United States Patent 7,468,248 (METHODS AND SYSTEMS FOR INFERRING BOVINE TRAITS) - sequence listing, part 10

SEQ ID NO: 38293 - DNA, 1589 bp, Bovine  19866880867706
tgagtttcttggtctgtgttttatcacttagaaaaagaattctgacttggaaaaatacatcattgtctttctcttacctgcaaatatcagaggagaaaaattgcaatacccttgtcttctcaacaaaaggtggaaatgaggctgcatctgtttaaaaaccaaaccagtggcaagggattagatggaaagagtgcatcttagacaaatctagaaatcttgattccagcatggttaagagagatataatgcaaactgtatatataaaattaaaattctccagtaactgcattttaaagatgaaaaaaaaaatgtatcaagtatatgttgtttaaccccatatatcaaaaataccatcattttaacatataaaaattaacaaatttctgaaaatccagtgtttatacttaccgtatttcagtttgtactagctgtgtttcaagtgctgctgaattgtgacctgtagctgctgctgctgctgctgctaagttgcttcagtcgtgtccaactctgtgcgagcccatagacggcagcccaccaggctcccccgtccctgggattctccaggcaagaatactggagtgggttgccatttccttctccaatgcatgaaagtgaaaagtgaaagtgaagtcgctcagttgtttccgactcttagcaaccccatggtactgcagccagcaggctcccccatccatgggattttccaggcaagagtactggagtggggtgccattgccttctccgatgtagctagcagctaccatatctaataagactgtatactatacgtagtcattggtattctgtttcatattaaattttcccattccataggtacagatgaaagtttttaaaaatgtcaaaattacgttgtcaaaattacgttgttaaaactgcaattttatgtttttaaatcttccatctatcagtagaatagcaattttttaatcttgagattcctttaaaactcatttttgtaaatgttgtttgtacttttaatagcgatccattcacctacccttatggctgatcaatattttttaaatcactaaacaatttcacacaaatggttggaaaatgtacacatcaaacaaaaaagggcattttttgagcttagtaaatctctactacggttgtgctccatagtacacactggatgtaagaaaaaatagctagataattcctccgtttgctccacaaatgaatatcaccaaacatgagccaccactgaatgtgtttgttccaaacagtaagaccctacccttcagttatgaataccatactctttttctggtaatggctctgaccttgtgattttattacatttcacttacatttttgtgataggtgaaatataacagaggatctcagtgaacctgatagagacattgagagaatgggatactgaaggttaaattccccaaataggtccctgaatgggccttgcctacaactgctgtcccaacaccttagccattaatggaaaagagtacattgaaaatctttaaaaaccatcggaaatatcatcaaagattatgttgtaatgacaccagtaactaccaagagccatgaccataacatagctgata

SEQ ID NO: 38294 - DNA, 1066 bp, Bovine  19866881186130
gaaacttatccaaaacaaattctatgacccatataacatgtagctctggtgtgttatctgattcctgagcagtgaccatactctggacaagtaggacgaacttttaacccaacaaatgacaatttagcaaacaacagctgcccggccctttcactagtagacctataaaaacacaaataaaataaattgtgtttacacttattaaataatggctattttttatttcttttcttctttagtctgcagaaaataagaaagcttgcagcaatcacaaggttcagctcttcttcaggagataaaccacgccttagaaaagcaaataagattaatgtcttttcttctttggctcaactggctatttgattctatcttgagctctgctttgaatcttttctaaggcaaagcagaatctgtcttggatggtttttttaacaatgtgggttatattatgttttatgactaattaaaatgagactgaaaactgcataatggtgtctcaaattaattcaccgcccatttggtccacccaagacttgcctcagcaggttttgcctaatcctgtagtcctaggcactgccaggtggttattgattgaatttgcagatttggttacagcaaatgacactatgtggcctgcttcttaattacttaatgcagtctctatcagtcatgacaacagcacattaaaacaggtggcataaattcagctgcaatgagcctggtggaggcaatttttataaaagctgttctacccaaatgggaggatctcaaattcagttaggcaaagtatttcagtgaaaataatgcattatcttaaaagccatgtggatgattttatctgttatatatgaaatgaccaaatgaaaaaattaaattgataacaaaagcataaatgtctatatattagggtctgggtgggcaggatagtattttgcctgacagcaagctcctttttaaactaggataaacaggggacatgatgtctaattatcaagcaggattcagggaagcacgtctacatactagataggatgctgagtaacccacaaggcaggaaataaattta

SEQ ID NO: 38295 - DNA, 951 bp, Bovine  19866881210859
tgatacagcactgcccttttcgccttcccacaaaaacatatgtgctctcgtgcaccatgtatgcacatgcacagacgtgcacacgcgcacacacacaggtgtgagattctgagggtgatcttaatgtctaaatcttttcccagagttaatttacactttcttttttagccaaagcatatatgcagatggttaaaaatcaagtaatttagaggaatttataatgaaaatcatgtttcctatttgaattcctcttttctgaaaaaaaaaaaaaaaaaaggagttactctttttagaagttgacttttaaaatttctgacttttggctgcttactgtgactgcttttcattctttaaattatttctattcattatcaatttattttgttgtaatctataaaaatttattttatataacttcttaccacactccttcctctccccaatatagtcctgtcacatctcttttacttctataagtgacatcatacattttaaaagtagaaggctcaaaatattgtacagctatgataatgatgatgatgatgatgtcatgaagagtcatgttctgaagattaggtaatggcataggaaaagagtcaccacttaaaattaaatgaaaaccaaaaaagacatatttattaatatggttgggttgggaagataccctggggaagcgaaaggctacacactccagtattctggcctggagaattccatggactgtatagaccatggagtcacaaagagttcaacgtgactgagtgactttcaattcaaatcctgtggatatagactgtatataataacattatagaaataaaacatacaatagaattaataatgtttatctcaaagaaacaggcttatagatcattcttatttccttttttctaaaatcgctataataaatacatagacttttatagtaaaagaatattcagagtaaaaaat

SEQ ID NO: 38296 - DNA, 1804 bp, Bovine  19866881234689
aacaatgagaaatgcattattcctttagtcatcacattccttgaatattacatggaatttcaactttcctttgctatcctagttcttaaacattttttattgagacatcaaaagctacacctcattaactaaatagttcttttgtattcaaaatgatgcagggccacagccaaggatgtatttcaagttgactgctgcacaaaatatacacaaagctggaccatagtttatcagaaacatatttaagccaagaaatgtgcaacatttcaaaataaagagatgggcaaataggtttcaggcaacaatatatacaataagaaaccactaacaagatagtataaaatgtaaaatttaaggtgacaaaagagaaagaatggtaaaaagaacaattaatgataaaggtgtaaaaatcttactgcaccagaaaaaaacagtcaaatatgcagtgtaattattgtacatgaatgaaaaatagcacaaaaagcaattattatgggtggttttaaatacacctctatcaacattagacagatctactagatcaaaacaagtacagaatagatagggcttttgtttctagtaacatggcagcctaacattacctaaaattgcagtaaaagtatttaaatgctggacaaattgtaaaacattcttgtaagtgatatgaacttgaaataaaggtaaatctgtaggggccaaaaacaaagaaaacactggttaaaaaattaaaaagtatcttttgctctggaggtactcactcacattgctaaagaagaggcttttgtttcagggaccatggacagccaggaaacaaagcattaggtttaggatagattcatgtttgtactgaaaaccctggataaagctggaacccacaaagacctacatgatgaaagcctggattaagaaaatgtgcccagggacttccctggtcatccagtagctaagacttcacactctgaatgaggaggcactgattcaatccctggtcagggcactggatctcgcatgccacaactaagtcacacttcaaaagatcccacatgccacaaccaggacctggcacaccagataaatacgtatttaaaaaagaaaatgtgctcaacagagaagtttgcctaaaagataacttatttgcctgacccaacccatacgtgtagataaatccctcctctgagagtttatattcgccatcctgtcatcacgaagattaagattaaaatttatactcattacacttggctgaggtaccatcagcctaacaattaacacaaggtgagtaacacattttgaatacagctggcaggaaaacatgctccaggagatggtgaaggacagggaagcctggtgggctgcagtccatggggttgcaaaaagtcagacatgactgaacaacaaagcctcaggtgtagccaaaaaaaggaaagaaacaggtgaagaggaaaaggtgtgctcaaacactgaataacagaaattactctgaatgcagcaggaagagaaacaggaaaaagtgtaaaagagtttagaagataaggaaggatgagagggtccaaaatatatgcatttgtaatcctagaagaggaaaacagaataagagaaaggaatatttgaagagagcatgtctgagagtttgccagaattaatgaaagaatccttagattcaaatcacataagtaaaatgctatgccaatatactagggaatctacgaacaagaaaagagagaaataataccttaaaactaactagagatatagatatcactttactcttgttattatgacagttagattcttaccgcctcct

SEQ ID NO: 38297 - DNA, 917 bp, Bovine  19866881423765
ctgacataatgtttcgcttaaatttaattgggtagttatatccttttgcagttcatgaagatcaagcaaagatcacactgtattgccaagcaaaagtgtttatgaacatcaaatcaatatgtggtttaaaaaaagccaatttcacatatttcattcgtaaattatccacaaagagtttttttacttttttataaaagcacttttgccttgaaaaaaatcaatattttgtcatctaaatgcttatcttctagttccctgtgacctcaatttatttctgagtgttcctgttaatacagatgttgaatgggaaaacaccaagaaataaaattctttctgctggagaaaattatagctccattttttggcaactgaccagcagggtcagtttctcccaaatactgtgaggacccctgtggcaaaaaacctgatataccatctttgtttggaaaactacaggagtttctttaggttacagtacggtacatttcaacctttttgtggaatagaggtatattcctctattcctctggtgtatttcagttcagttcaattcagtagctcaatcgtgtctgacttcttgcaaccgcatgaattgcagcaggccaggcctccctgtccatcaccaactcttagagttcactcagactcatgtctattgagtcagtgatgccaaccagccatctcatcctctgtcgtccccttctcctcctgcccccaatccctcccattattagggtcttttccaatgagtcaactcttcgcatgaggtggccacagtattggagtttcagcttcagcaccagtccttccatgaacacccaggactgatctcctttaggatggactgattggaactccttgcagtccaagggactctcaagagtcttctccaataccgcagttcaaaagcatcaatt

SEQ ID NO: 38298 - DNA, 1490 bp, Bovine  19866881623352
ctgactccactccctgcttcctacaccgcagccttattggccttcttgctggcacactctcactcccaatatcttccaatagttgctcctttgctcaaaaaggcttctgtcagacatgtctatggttctctccctcaattccttcagctctgttttaggtgacagtttatataatatataaaacgctttgtggcaattctatcaaaaatttcatcttctccccataagctatctgtctttcctgtttagttttttctccaaagaatatatcaggagagtaaaatgtcctacttaccttgtttactgtctgtgaccaactattaggattatgctccagagaagagagaccatttctgtgttttattcatcacaatatacccagctgctattatagaataccgctttacaagggagggttcaattaacccttgctgaatgaataggcatactgacaagatcgtgaagaacttttagaatcagacagaaaacggtaccttaatactgcttgcaccttgagtaagtccaaatttgctgtccaaattcaatgagttgagcttgtatgatctcggagttccaacatcacaaaaaaccctacaaaacatgaacaaattgaaacagcagtgagactggtttataaccctctaacctgctgtacttaaagactgtagctactaaaaattttctccagccttatggaaatacaagagaggaattgaaataaatttcatttttgtagatagctcacataaatgagcaacaatttagggtctttgtgctctttaattttatagtcactgcctgcatgtttttacacgtggtgtaagctgtattgtatcactgtaaatacattttgagttccatggcatactgtggtcagttttcatggtataaagtgtttctttacagctgaagtagtactttttgtttggtctagtccctacccttcctcctgaaacctactccaaattcaggctcatcaagcatgcaaaaaacattaagaacagtaagatacatccacttcccctgctattattcttatccaagtgtctaagaaaagctcagatatccagctggttcaggagctgtgttattcacagttttggctgattcaggcctgaacaaatatcgcttctgttactgtcctggaactctaacacccaacttgactccttaaaagaaaacacctgagttagagactatatagaccttccctgaaatgtatgcatggaagaaaaaaaaaaaaaaaagcaagcatttacattatccagatcttataaatattcaaccaaagagaacatcaataagaaaagatatgagagtggttatataccccatattcttaccaatggtttaagaatatgtttgcaaaggaattctttccagtgtccaaatggaactatcgaaaagtttaaaggggtaaaatcctaaagacatgcccatttaaaacaaaggaacaaaaagtcatcatcaacagaaacaggttcatagat

SEQ ID NO: 38299 - DNA, 1318 bp, Bovine  19866881630831
ctctggatggctttaaacagaagatgaaaaacttgtattgtcctctagcacccaatggaaaattcttaaaactctacatcaaactttccatttgcgaattgaaaatggttaccaacttgctaagagtcttttaagggaaaaggattaataaaagctataagccaaattgttaaaggatgtgaagtctgtcaaaagaataatccctgtaacaaccagtcagctctcccaggcttatagcatacaggaagatatcctggagaggactggcagatagaattcattcatgtgccaaagacttcaccaggcttccctggtggctcagacggtaaagaatctgcctgcaatgtggggaacctgggtttgatccctgggttgggaagatcccttggaggagggcctggcaacccactccagtattcttgcctggagaatccccatggacagaggggcctggcaggctgcagtccatggggtctcagagtcggacacgactgactgactaagcaccagagatcatttcacatgtatgggagggtgtgtgtaaattgtatgccagtacacaccgatttatataaaggacttgagcatccacaaacattgttatctgcagggcgtcttggtaccaatcccccatgaatatcaagggacaactgtatatactttagaaatttttctttccattgaattccatctactttatagttttcaacaattcatcagttagctctgtcacactagcaacatctcatattttccaacagtgctatagatacttctcatttttgtttcttttatcatttgtatgggatttggagaatgtgagctctgtccatcattgaatcaaatgtctaaacctttacatttgattaccatataagtataaggtaacactttacttgcagctagtatgctcatacattttttaaaagagcaactttttttcattgatgtaacttaatgacagcactgaaagtacagtgtatattaaagaataataatccttaataatttttcagacatcattgttgaatataatagtaatgaatacattctgctgtttttatatttaatgaataagtacaataaaataaagtgttagttgctcaatcatgtccaactttttaggatcccatggactgtatgtaacccatcaggttcctctgaccatgggattttccaggcaagaaaactggagtgggtagccacttccttctccaggggatcttcctgctccagggatcaaacctgggtctcttgtactgcaggactgattctttactgtctgagccaccagggaagcccaagttattaactgtag

SEQ ID NO: 38300 - DNA, 3048 bp, Bovine  19866880368566
ccaagtatacaaacagaatgagaaggcctcactgacattattcggagaaaaactttggctctaccagttcatgaccctaaagttctgaattctacaagcacttggaagtcatgatattaactgctcccactcccaacaccagaaaagaaaatcaattataatgtgaaaggaagcctctacaaaatacattattgagaaaagcagaagagagaagacagccatttactacgggctgcacgatttatattcagtatcttaacttactcctcacaatatccatgggagacagatcttccccctgcttacaaatcagaagcatgagacgtgatgcaacttcagggtctcactggaagagaccggcagggttaagatggaaacaaagacctgtctgactccatagctgagagcaagggtgtctgataaaaatcaaatgtgatccacagacataatttaaaactttttagaagtaacattaacaaaaaaagtaaaaaggaagagacaaaattaatgctactattatatttgattgtgggtttcccaggtggctcagtggtaaagaatccagtcaccaatggaggagatgtagatgatgagggtttgatctctggatcggtacgatgccctggaggagaaaatggcaacccactccagtatttttgcctgggaaatcccatggacagaggagcctggcaggctacagtccataaggtcacaaagagttaagacatgactgagtgtgcacatgtgcacacacacaaatttgattataacccaatagagtcagaatattatcatttcagtgtgtaatcaatataaaaactatggacatatttcacattctttcatattgtctttgaaatcagagtgtatttcaaacttatataccttaattgagaccagccagatttcaatcactcaatagccacgcgcagttagtggctacttcattaggtagcatacccctagagtaacaatcaaatttgctaccgatcattttattttgatgtacagcaatgagtcccagatgcttagagttcacagacataaaatttttaatacctgatgaggccctacagggttgaccatatttaatttcgccaagtgtattggttggcttagatgaagtatcataacaagcagccccagagctcagtggctcagacaacaaagttttatttcctcctcaagcaacatgcccaataagagttgcctgtcactctatttcacatcatcttcactctgagacctaggcagctggaagagatcacaccttacagaagaagggaaaaaaagaatggagaaatgacacaaacagctcacagaactcaaaaacaaaaaaatacaaacaacccaatcaaaaagtgggcagaagacctaaatagacatttatcgaaagaagacacacagatcaccaaaacgcatgtgagaaaacgatcaacttttattagagaagtgcaaatcaaaactacaatgaggtaacccctcacaccaatcagaatggccatcttcaaaaaatctacaagtgacaaatgctggtgagggtgggagaaaagggggaccctcctccactgctggtgggactgtaaattggtgcagcctatggaaaacggtatggaggtttcttaaaaaactacaatctgccacatgatccagcaaccacactcctgggaatacatctggacaaaactgtaacttgaaaagatacacgctccccatgttcacagcagtgcaatttacaacagccaagacatggaagaaacccaaatatccatcgacagatgaatggataaaaaagacatggtgtgtggctgtctgtgtgtgtatacacacaccatggaataccactcagccataagaattaaataatgccactggcagctccatggacgaaactagagattatcgtactaagtgaagtaagtcagaaagagaaaaacaaatactataatgacctcatttatatatatggaatctaaaatatgacacaagggaacttatctatgaaatagaaagagactcacagacatacaaaacaaacttgtggcggccagggttgcaggggagagggatggcttaggagtttgggattagcagatgccaactattatatggagaatggagaaacaacaaggtccgactgtgtaacacaaggaactatattcaacatcctgtgatgaaccataatggaaaagaaaacaagaaggaaaaccaaacatacattgtctcttaaaagactctcataagaaatgacacacacagttgaccaatgaaatagacaaagcaagtcacaaggctaagcccgaggtctcagcggcaggagtgggagaggatattatacacagctcccctctaaggaggggcagcgactgtgtgtgtactttgaattaacaacccaatctccaactttaagaaaggacttatgaacattatgttaactaatatccattattattgcccttgtgatacttcaacaccgcaaaaatagaaagaactcatatcattcttaatttctcttttcaccagaaatcagagagaactccccctcagatgggtagcagggtatgactggggaatcactgatttcgtaacaacatctcttctccttttccccaattcctaatcctgacggtccccatacaggcgaaattttccaggtcttctagaatctatgtaatttgatatgcaccaaataatagttattttctaaaggcggcttacccagagacttgcactgtctactttttacatttctgttctacttctatacatatatatatatatatttacaaacacacatacatatatatatatatttctataccacaagaaaaaatagacataaatatttagccaagtttgcaggagaccaactcagtgatggggaccagattgggggcagcttttctcccaaagtgtaggtgaaggagacagcctccacgtaccattgggatgctgagaaacctacgcttctctatctttaagttttgctttaaaatgtgggttaggacttagggggattggatcctttgagaaattcaaaccaatcaa

SEQ ID NO: 38301 - DNA, 1487 bp, Bovine  19866880393378
tacccctatcagggacccaagttaacgatgaggctgcagccaatagaaaaaaagtggtagccttgtttgctacatggggacagaagccacggagctggatagccagagtgggccagggaagttccacaagtgatcagggtgctgtttcaaaaaagagggggaaaatattgctgctgctgctgctgctaagtcgcttcagtcgtgtccgactctgtgcggccccatagacggcagcccaccaggctcccccgtccctgggattctccaggcaagaacactggagtgggttgccatttccttctccaatgcatcaaagtgaaatgtgaaagtgaagtcgctcagtcgtgtcagactcttagcgacaccatggactgcagcccaccaggctcctctgtccttgggattttccaggcaagagtactggagtggggtgccattgccttctccaaaatattgctagttaggccaaaacaatagtccttacaataactgtttccatatggagattgcccctagcatttcttggggaagtcattttttttctgaatctcacattctgagaaagatgaattttagaaatcaggaaaatggggacaagattataactcttcagtagaataaaagattaacattcaacacagatacattactcttcaaaggaatccagtgatatcaagatgtaagagcagataagcagacatgcggagttgaaggtcaaagtcaagatttctggtaactgggacaaggcaaggaggagagaagcacttacaatctaaccagttttgcttgtagctatggccatgttataaatacgacccactggctgctaatgatgtagtcttacaaataaatgttaaggttattcacatggtatcctttatactcaatcaatgagtaatattgcccaaaacaacagattttcaaagaaaaataaaacttcaaattggtaatttctacacattcctctgtgtagagcatatagtcttactagagtgctaaattatataaaacccacccagttatgtccccagacattttccagtatttgtgtattcagtctagactatagttctttgtgattattactaaactgatgtatgtttcttcttaaattttctttttgaaaattctaagaatgagttaaacataggaacaacattcgggatatactgggaatcctttaataacaatttatgatttgggatgtttcagagaattctgatcttttttacccagttccctaatattaatatctgtctggagttgagaaacaaatcatgcctgccactgggaagaggaattgtccaaagagaaagcgaaggcgggagcagagaggaggagaggtgccgaggctacgtgggaggcagagctgaggtggtcttatgatgccatagccccaagaggcagagaggctctggggagggaaaagcaagcgggagcagatcaggctcctcctttaggggggtttggggaagggatgggttcag

SEQ ID NO: 38302 - DNA, 1850 bp, Bovine  19866880460152
tgtatgtgtcttttcagattatggttttttctctttatgtatgcccaggagtgagattgctagatcatacggtagctctatttttagttttttaagacacctccatactgttctccatagtcgctgcaccaatttgcattcccaccaacagtataggaaggttcccttttctgtgcaccctctccagcattgtacatttttttttaatatttgtttgcttattttttggctgcgtggggtttcagttgtgtcacgcaggatcttcctagcagcatgtagacgtccctctacttgcggcaaacaggctcagtagtcgtggtacgtgggctccagagtatgcgggctccatagtttgcggcctatgggctttctagttgcagtgcaccagttcggttgctccagggcagatggaatcttagttttgcggcccgggatcgaacctgcatcccttacattggaaagtgtattcttaacccctggaccgccaggaaagtccctgttggtagactttttttttttttgatgatggccattctgactggtgtgaggtgatccttcattgtagttttggtgtgcatttctctattaattagtgatgttgagcatctttcatgtgctttttgtccatctgtaagtcatttctaaaaatgatacaacctgctggtacagtgtcccagggggattggttccaggacagcaccctccgatggttgtcatcgtttagtcgctaagttgtgtctgactctttgccaccccattgactgtagccaaccaggcttctctgtccatgggattttctgggcaagaatactggagtgggttgccgttcccttctccagggaagggggttgccatttccttctccactcaggatctcctgcagtgcaggtagaatctttaccaactgagtcaccagagaagccctcagatagcaaaatctacagaagctcaagtcccttatgtaagtggcctcgtacctgaatccagtcagcactttgtgtccacaggttgaaatttcatggcagaaaatccacgattggctgaatcggcatctgtgaaacccgtggatatggaggactagctgtttgtgtgtacagtatatggttctaaagctttggcatcgctgttgtagaggtgtggataagcttttgtttttcctgtttacattttctgctttgtttaaaagaaaaggttttccccaatgcagtctattcattgaaaaaatttgaaattggattgaaatccatttgaaaatgatcctagcagttatagataaccatatttagctttaagtcttgatctcatctatgcaatacagttgtccagagctgttctttggggagggaagaatacagagttacctcttgtgggggagagccaagagctgttttccgaagcagactatgatgtggatatagatccttggctcagcttttctgtggaagatcagatcagatcagtcgctcagtcgtgtccgactctttgcgaccccatgagtcgcagcacgccaggcctccctgtccatcaccaactcctgaagttcactgagactcgcgtccatcgagtcagtgatgccatccagccatctcatcctctgtcgtccccttctcctcttgcccccaatccctcccagcatcagagtcttggaaactcatcttttaaaagtcttgggtggagttacattggtaacagaatgtgcaggtgaggtcatttctttataggtacttttcctgggtgggaggaaagcactttaggttctaggctctatgcaggcctgattttggctggaaaaggaggctcactagattacctggtcagaagagaccacccaggctgttgtatctgtggag

SEQ ID NO: 38303 - DNA, 2676 bp, Bovine  19866880663308
tgagaaagtgtgcagtgatccttggcatgtctacccaggcgagagtggtgacatcagtgcctgatactttctatccttgtagagctggaactgtttctgtcactaaatggtctgtaattctttttgaggacctacctggctttggcaggaggcacttacctctctggttttcccacacactcctatttgtcctgttttcctcttcttgaaactcctgcccccattcccaaaaaagaaaaagtcacaaccaccctatgcaccaaatgtctccttttcagcctttccttgattctctttcataaatctgagtcatttctccacacctaccagcaatcccggctgaaattactgttttccacagcacttccacttttcatcttctgagacctgctttctgtctgattcagaagcctttggaagatggggaaaggcactccagccttctctctgacaaagatttcttgctgaaatgcattttttcctccacatcaaagtcctctggaaacacagaaacctcaacccatcaggggttatatacatacagaaatacatctacccactcctccaaccctggtctctatcaagagtaactcctttacaagggcatgagcagcatattgtataaggcagctgacagtcagtggcccagtcccttgctgccgctgctgctaagtcgctgcagtcgtgtccgagtctgtgcaaccccatagacggcagcccattaggctactctgtccctgggattctccaggcaagaacactggaatgggttgccatttccttctccaaagcatgaaagtgaaaagtgaaagtgaagtcgctcagtcgtgcccgactcttcgcgaccccatggactgcagcctaccaggctcctccgtccgagggggtggcaattggcattttcccctgtggggccaaactgtgtgtgatggtcataccacaaatcaagtgatcccagggcctgcaagccctattcccaaccatttgttggctgaggccacttcaaggaaatcttcctgaggagcaacaaaatctgtgcacagcatgacacaggccacaggttctgcagcaaaggaaattccattgcagaaggaatgtcagccagccctagaagagcctacttctctgggcctctgtacgcagccagaaagctgagctgacagatggatctgagtaagctttctacagcaggaaaaacgctggcagttttctttcacagctctcgcttcagtcaggaacaaagaccagaatcattctgtctaaagcaggattctcagagcctggatcacaagcagtcatggcaggaagagtggcaggtagggtagcaccttgtttgagatacaggttcccagggacccacagacctactgaaatagtcatccttcagaatctaagaatctgattattaaccaaaccagcacgtgtgggcatgcacacccacgctgagatgcttgtgcacactcaatgtttaactaccaggaaaaggctaagcgtcaactagagaacgacctcacttttcatagaccaggggaaaaatacattgtttgatcaccgagtagaagaaagtttcagaacatccatttcccaggggcaggaagtattttcagtccttatgagtcccatgacagagcttttgttgcagggtcttctgttgtccacatgcaagctccagaccattctcagcaggagagttccatttctctattgttgtcttcttaggtggagacattccatagcaacctctgctgctactaagaagcattcggaaaaccagatttaaatcatatcattggcagtccctatttatgcttctgagaatgccgttctctgttttcccacctgcctttgttatgcttttgacctttttgattgaaaataatggaatctactgaaatgaatttaagcaagaaaagaaaggtggtacaggtgatcaggggagaaggcaatggcaacccactccagtactcttgcctgggaaatcctatggatgaggagcctggtaggctgcagtccatggggtcgcgaagagtcggacaggactgagcgacttcactttcgcttttcactttcatgcattggagaaggaaatggaaacccactccagtcttcttgcctggagaatcccaggaacaggggagcctggtgtgctgctgtctatggggtcacacagagtcagatatgactgaagcaacttagcagcagcagcataggtgatcagggtattcagggatcattctaggtgggcagtacattcagttttcccatagatctaaaaccaggatcttggcaacactggaaactgcagtgtctatgactgagtatcttcctagaactcccttccttcttccttagagagtcgcagttcccctcagtattcagccctccccttcacggcccagtggttgcagagaaagcccaactcagcgctcaatgagacccaaaccactgacttccattttagcagatttctgtaatttgtggcatcccctatattatcatgaaatgaaattcagagatacatattttatcaaatcaatatgatttcctaactgccatacaaaggataaataaaagtttcatgtgataaaattatatacatttcaatcagaatatgtcccagcatggctccactaaagcacataataaataggggaagaccgagctgagggataagtg

SEQ ID NO: 38304 - DNA, 577 bp, Bovine  19866880723184
aaataacagggatttgacacttacgtaaatatgatcattttgtgtactttaaaggacagaacatctgtttttctctgtgcatttgcttccataatatccccaaacactcatgtattttcctcccatataatatccatggaaatagttacctttcaaaaggtgcagatgttaatctaatccaactgagacgatgagcagttgagactggccccctattcacagcaagcctaggttggtggtgggggtgggggtgggtacaacaggctgatgggactttagaactgtcaacaacctgtctctgctaagaaatctcgcaaggaagtggggatgatggtgcacaccattccctctgaaaactgggtctgctttcggaagcccagctcttggctgtgttgctggtcgttaaccttcttgaactgaccagggtgcctcccaaaggcacgcctccaaaaacagagccttcctggaggtacagacactgttccctcctgctgagccgccccagggaggttcaggaagaatctccctgagtcttgacctctgatctgaggacaggccactcatctgaaaccaccgg

SEQ ID NO: 38305 - DNA, 1327 bp, Bovine  19866880763985
gctcccatttttaccctcacaccccacatcactccattaatttccggcatcacccttcattagcgaccccgtggctgaaggactgttatgaggcttcagggtcatgaactgcaccatctaccccttggttcatttcacagcttgctcccctcttaatgcctcacagctcattttccccccttcacttggcgagagggacctttcccagggcatgaaatggatgggtctcccgctggtcctcttttgtttaatgcctctctattctctgagcttaaacatgtaccccgtcacagaagagaagcacttgctctgtgcccccaccacaagtcgagtttggattgcagagaaattatgaggctacagtgctttaacataggcagtttttcaatgaagatggaacatgagaagatggccttattttttcagtacatttactctcatgggtaaaccccatggtggaagatagtatttggtgagtttaatctgctctgccttttttcataaatgaggtttaattatgagatgtgtgtgtgcttgtgttttcccactgaacaccatgggtagcagtctgccttagaaaatgccgtgtgtgtaaaagaaacttccaaagctgataaaagcagggacaagagggcacacctgctaagcgctgggatttctcccatctgtctgggtgataagctgtgttacttttgcccttcttctttgctgatcagcaggctggggaagaccgtagcaacgtctaaaagtgcctactaaggtggcaggggagcagaagtaaagtatgttttcctataaaagaggtactaggtgcataaaggagtatttcagaaaccctgaggagacacagtaggattgtggtaaagaacatgaacttgagagccaggcaagcttgggtttgaatccagactctagtgcttggtagatgtgtgactgtgctgcactcagtcatgtcccactctttgcgactccatggactatagcctaccaggctcctctgtccatgggatttcccaggcaagaatactggggcaggttgctatccccttctccaggggatattcgtgacccagggattgaacctgcatctcttgcattgggaggcagattctctaccactaacgctactcgggaagatgtgcgaccgggctatgaaaaatcacaggaagtcccctacatacgaaccttcaagttgcaaactttcgaagatgttaacatatgtttgcatgtccagtcacataagttagttcacatgtctggtatttattgtcacatgtgaacatcctctacaagtgtgggttgtgcctgctgtttattgtatggagta

SEQ ID NO: 38306 - DNA, 929 bp, Bovine  19866880798476
gctacgttttagcagtgacgtccctgtccttacccagcatccactgggtggagctgcgtgttaattactcagtgtcttttgtccccagagtgctctttcttttgattcctactggaggtttcaagtctctcttctctcctcccttctccactaattcattggggttggggaaagagagcaaagacagagaaaactgtttaaaatgtctgactccacaggccttccttcactgtttcagctattatctctaatggcctttgaagctgaaagcagagttgagtgtatattactttttgcctttacggtctgactgatgacatttcatgttttaaaatagttttgttccaatgatttcttctcgtagcagtggatgggaaaatcctaatacatgaggatatcatatgataagtggataataatcggcaggcattcgggtggtgggcaaatcaactgtgtgttatttttagagtgttcacgtgatatgattcatcttaaaagcatttctgagtgttgggatctgaaactatccccatgatttactgaagtcatggagaacacatgtgactcttgttttgaaaatgacagcctacggatcccatggcttttttcctccccttttggtttcttagagaattggtgggcaaaaccaaaagaccaatataaattccccctggtaccctgctgtccatgttcaaagactgggagtatttggtgtacatgatctatgtaccaaggtgatattctaagagagacaaattatgttcaaacatctgaaagtcatcatttccatgcatatgcaggcattttgagaaaaatctacaagaggatcaaaaacaagattaaaccacatctgtttgggtttaaacgacgttgtctatgtagttcaaagttgtttccttttgtattaaaaaaaaaaaagaaaagaaacg

SEQ ID NO: 38307 - DNA, 1632 bp, Bovine  19866880810562
ttccaaacatttttaaacacagtgctcattgagccaaacacttcttttagccacatccacgcgtacagcctgccaattatggagctgactcccccaaaaggtcaggcaacccaagtaatcatttccatctctgcagtatttgcaaaggactgaccaataacgggccccaaccaagtgccaggcaccttgctcattgctttccaagagtcatctcattttgaacctcattacaaactgactgcaacatcgttacccaggttgaagagacaaagaaaggctcttaggaaagttcagatcttgtctaagttctgagagtcaggcgggagcaggattcgaacttgcatctttgtgactttaaaccgcacctactttccactaatgcacaggacccacctagaaacaagagtggaataaagcagaccttgcagggagggtttcttcagccctgaggaaatagctgaggtggcatacagatctctatgcatttgttgggaatacaccaccaagtttactgtttcagagtcagtgatttaatgcagtcatctaagtagtgataaataacagggtatttgaccatgtttcaaatttatgattcagcccttcactgtgataattgctggctggtgtgcagtgggccagaggaggccagaaatctggtcactaactagatctgcaagcgaaattattcttaataataacaaaagtaacaataatcactttttaaaaggcaaaccagaaactttttgttgcagaaggctttacacataatgactctttcttatatctagaagtttcacagctaacaagttgattttaatctccttatttcaacatcaaagagagaaaaaaggttcaacatcaaatggatcagaaatgaaggattttataaaaaaaaaaaaattctggtaacctcatgcagcactctttcctaattatgttaagttaatcaagtttccatattgcttaatgctcacttttggcaaaaattaaagcaaaagcaactgagtccaaaattagtgcacagaccagttgcgatttgtatttgccttaattcaacttgacaatagagcgattgtgaaggacacagcttcctcccaaatattccacctccaccacctctcactctagccatttttgagaacaaacgtccaattatttacatagagctacacaactacaggagtgtttaactgtgtatcaatccactatttccaactccaagtgaaaaaaataaattgagaaaacaactatctacattataaactcaaagggtaattttttttttttaattaaaaagacagcctggaattacatggggctgcatttcagagtgctttatgtaacagaagcagcttactggaactgtctaggtgacccacaccacagagcagacagaataccccctgactgtccataggaatcacattctctgtgaaaggcatggccacctcagcaggagagggaagttcttgtaaagaactttcttagtgaaaagcccaggtgagagatcaccaaagacatcaactatggatggtcctgctggacgttccactttgtatcttttactgccttacgctggaacatcctttgccaatacgaccttttcctccaggtactctgtgtccacatcac

SEQ ID NO: 38308 - DNA, 1721 bp, Bovine  19866880819832
aacgaagaggtgggggaggacttggcaagaggagtctgggctctggcgaaaatgttaaagggtggtgcggggggcgggggagcttcagacctttagcttcagacatttgctaaactgaaattaagatgaagatgaccaccccacccaccccgtcctctgtaggccttcgggctccaccgaccaagctcagatgctagtgagacggatactccagagtgatgagcactggggtctggggctttgtctaatgaggctgggccctttggaagtgctctggaaccagctgaaaatatgggctattttgggactgctgggaatcagaatggagaagagagaaaggctttatgtatgtaggattccacgaaagggaatggaggcagcattttccataagagctgtcttaccagggtaccatagcaaagaaggaatcttatgtttcagacctcaccaactggaggttctttgaagtaccacatcttggaggcttgactatctcactaggaacttggtccccttaaatccccaggatgtaggcaggagagggatgcaggcatccacgctatgtacagcggtgctttccacttggaactttcacacgtgcgttttattaagctaatgaattatgagggggtaataaagaagtgaggaataaatgaggtttctggagtgagggtcaatcactcaacacctgttttggctaaaaattaaatggactgctttaatttttgcctgtcagaaagctagtggcaagttcaagtggagaaaggcaattcttgccaaagaagaaagtaacaaataaaacaaaatgcagggacagacgcaggtgaaagatctacagagaaatggcagacagacagacggtaccagacaatctcaagaatggatgagaaagaacgttcaaacggccggaaaagagagaaaatggtatgaagggtgacacctgccccaaccccggggcccatcaggcacagagctggccgggtccggggggacatcaaacatccccagaaccattttcttttgatatgtcacatgcttggtggcttatctcttctcgcctctgaacacaagtacaatcactttctgttgataatcatgttcagcttaattacacagaggttgcacttgaacatttccttccttaaggctgaagtgatgccattatttttcatttaactgcagaataaggggtgctctgttcgcacagtccaggaattgctaagaccacaatggtgaatagccatggctgtgcacaacttcaattttcatgattactattaattaagggtctgtcaaagggatagaatgggctcttttcttctctatcagccagcatagacactctcacccagagaagttgcacggcaggaagggtgagtcaggctgccctgttgcttgggttcaaagcccaatcccacaagcccaacatggacacggtatagctgtttccacaagttcgctcttccataaaggctgtgtgcgtgctcagtcgcatcagttatgttcagctctttgcgacctcagactgtagcccgccaggctcctctgctcatgagattctctaagcaagaatactggagtgggttgccacgccctcctccgggggatctttctgactcagggatggaatccatgtctcttctgtctcctgcattgacaggcgggttctgtagcacgagtgccatctgggaagcctgagccataaaggttgggtgaagaca

SEQ ID NO: 38309 - DNA, 503 bp, Bovine  19866880832026
caggggaacagaagaatgggcaagtgcctatgaaactgggagggtagtgagaaggttccctggaggcgccctggtgctgtgccttcaaggctacagaaaatcacataggttggcggggaaaacctgtatttatttctaggatggcctcacttccctcgtgatctactcatgtttctctctgagacctggtttggagctcgttttagtccccttgttgaaagtagctctccttttctgatctcaaaatgacatcaggacacagcataggtgacggcggcctcagagccccgctgggatgccactgatgaatccactgggaaatgcaaacaatagactgacggaaagaagccttcttcagacacctattttctttcttaattgcttacaggaagatccagagcaggtgttcagtacctgaaaatttatgggtaattatttggcggctcaacccttgggcatacttgggtgtaattcttttaacgctaagcagtttcaaaataaca

SEQ ID NO: 38310 - DNA, 1565 bp, Bovine  19866880838133
aactgggtgacttagaaaagagacattcattgactccaagttctggaggctgttagtcggaaatccaggtgttaacagggccaccacgctccctctgagaaaactgtagacagatccgtcctttgctctccctggtttctgatggttgtctgtagtctttggcattgctcagcttatagaagcatcagtccagtcctctgtctttgcaaggcattctccctgtgtctcttcatattgtctttcctctttgtcaaaatttcccctttttataaggacaccagtcatactggatgagggtccactccagtgatcttattttaacttgataacctctagcacaatcctctttccaactaaagtcacatcctcagggacttgagattaggactttaccctaatcttttttaaggaacccatttcaacctattacagatattaagtttaaaaaagtacaaaagaaaatcttacttctttttatctaggtcaattgggaatttatttctcccagatagttccatcgaacctgaattttctggatacttaagggagaaaacaggaatagcaggtattaacaattgaccctccacatgtcagtttgtaatgagttggttagatgatttgttcagtgggtcctgggtcatgaagttgggcctaagtttaaccagttcagatggctttagctccaggttatagatttcactccaaccctgctagcttctctagatataggtgccgttgtttctcgaaaggcttgtcaaaaagcatatgaatgtctctctcccatttgagaatggcatccacaatgaatggcaggcagtgggtggaacaggagtgagtgagtttggagagttacagacctatatttagatcctgccaatgcctcttaccagctgactgaccttggtcttagtcctgctgaatgatcttgatcctgatccttcataaaaatcagaggatgaagctccaataagataatgtgagcaaagtacttagcacatagcacaggcttaataaaagtttgctcctcaagcagcccatccttcatatagtccctgagcatgctgaggaaatgttaataatcattaacaccatgttttatagtttacaaagccattttatgtattgttacatttaatttatatttattgggttgttggacagtgttgaaaatagggaaatggcttcttttaaatttcacaactagcaactagtaattattcatagctttctatattaaatattttaattatttgttcagcaaatagctgcagttagtaatctcagtgctaatatcacccgctcatgcagtagttctcagtgggaggcgatctttgtcagcggacatctattcatgtctggagacatttttggttgtcccaggtggggatggtggctctgttggcatctcagaggcagaagcaaaaggtgctgttaaaatcccataatgctcaggacagctgctgcagcatagacttacccagcccaagatgtcagttttgctgagcttgagaaaccctgcctaaagcatccaatgtatttccatgagtaagtgctcacccttcaat

SEQ ID NO: 38311 - DNA, 3570 bp, Bovine  19866880851380
ttccccccaaaggagtcagcttacaaaaatttactagctgcactgccacagggatttatggtttcctttttaatagttgcagtctgataaacctgagtttctcgggtcacgaggtagattcatttatctttcttttgaacattttaagcaaattccagccctgcaaattgactgcatttttatatcgtggaataaactatagaacagagttggaatacacatccaaaaataagaagatcttacaataaaaacagataccgaagtctgtattttcctgattgtcagtcaagctaattatgttttactctgaagctctgtctatcaggcaagaaaggaaaaggcagcaaggggctccctcctcacccaggctgatgtttgggaatataacaccagtttcttcacagcaggagtctgctgtaattggcagctctgttttctcctactagagggtaattctctagccaaggaaacacaatgttaacaagattttacaaatctgacatatggcatcctatctgaaatgaccaacaaaagttccttctctccccaagccaacagttattgctggttagggatacaagacagggtgataaaaaggaagtaaaggcccctggagttcttttaggggggctggtaaatttgtgatcttgaaaaaggccaattaataaggaaaggtaagctattcagtgtggtggtatctctcagagatggatgaaatgacaataaaaacttcaccgggaagactgggcctcgctcaggacatgtttcttccctaaggcattcaaggcgagctcaatgagtccattaaggaggggctgggagtggcagggctggtcccccatgtgagtgaaagcgggaatcctaaacaacgcactggacctagcagtggttctgggttgatctcatcctcgccccacacctacagaaacactagaacaaatttgcacggagggtgaaatagctttgatgtgactccaagaactgcatcacaacctaaatcttgtttaaaaccataacccctcaatgagaaccctatactctgttttaactaacaaaaaatggcagaaagaacagtctggggcataaaacccaggcagaaatacatgtagactttccaggaaaagaggaacaagagtattttccttccctcttgggcatattaagtgactgacattaagtgcttcattctttcttggcaggacgctgggtagattctaaagagggcaaagatgggttctcagaaagttatcccggatgcactgtgatacccgcactgtagttacagccgaatgcaggggccgactgtcaccagatcccatctaacgttccatgactccagctgcagatagtgatcagactgcaggctcattcaaaggtgggtgggatcaaggagtttacacatgaagggattaatgagcagcttcaaagcaccaggtacttgggagtaaagacacagagtcaggtcaagtcttaattttcacggggaattaaactgccttttgttacctcctggtaacatactgttgacagtcaactggaatctgcccacgagaaggaagaaggatgatggcgcccttctttggtttcggtgtacccagggccacagacactgcaaatattccaagagcaggatttgtttcttcagtgagatcatctgctcattcgctgtacctgcccatttcttctttcctttctgtatgtcctacagtggacagcagcatctgaactattttaagtagtaccaggacagaccttgaacgaacacggactcacaaaacagttctgcttcctcaaatatcctgctgtccttaagattatgagaaagtgagagtctcagtttggtgctgatacatcttgctaatatctgctaacctcaaagggagataagaacctcagaacgtccaagagacagcagaacccagccagcatctaacaatgggatgttttcattgtattcattcttatggctactacttctttgatgacaagcatggctgatttgccatttctagacgttagagaagattttcatttgaaatacagttcctcaaatgaagtgaaataaaccaatcacaaaaaaacacacatattttaggattccacttacatagagtatcgacagtagtcacatttatatagatagcagaatggttgtcaggggctgggggaaggagagaacagggaatggtctaatgggtacagagcttcaattctgcaagatgaaaaagttttggagactggtttcagatcaatgtgaatatacttaacactacagaactgcactcaagaacagttgagatggtaaattttaccttatgtgtattttattgcaactgaaaaaaataagtggaagatagaggtagaggaggatatggctctggaagatagacgtaatgctgctggctttaaacatggaaggaggggccgccagccaaggaaagcaggcagcctctagaagcaggaaaatgcaaggagacagattttcctctagagcctcaggaaggaggtagctcagccagcaccttgattatagcccagtgagacgtattttcgacttctgccttccaaaactgtaagatgataaatcttcaccctgaaaaacagttactcaatgttttttcttagagtcaatcagaatatatttagaaatgatgctgatgaagtacatgtttctgggaaaactgtgacaacatgtgaacacctggtgtctggtgaaagatacatacactatcttttgggctgtaaaagacaaaccaagttttccaagatttattttacataagaggcatcagaattatcaggatggattaaaaataggtgtctaacatggttcatatacagttcacaagcaatgatctttagttattaaaagcaagccctcccaaactctttcattgtatggactgatgcaaatatgaaccaaaagctaagctgaggatctggaggccgcaaccttaagttaaaccctatctctgccacttaagaatggcaaaaacttggactagtcacctaatctcagaaccttaatttgtgcaactgtaaaatgggatactcagcacctccctcaaaagagctgctgtgaaatcaaataagaggatgtatgtcaacttttggctcaggcctgattcctattatgattatcagacattatctgtgctcagactctcagtcgtgtccgactctcgggaaccccatggaccacagccaggctcctctgtccatgggattctctaggcaagaatactggagtgggttatcatttcctcctccaggggatcttcccaacccagggattgaacctgcatctcttgtgtctcctgatcctaccaaatagctgtttgtttctggaaacaaaaataattcagcacttcaatataaattcaatctgagcaactccagcttttccacatttggaagatctcattagctggagtcatggcaaccctgggtttctcttagatgttggagcaggcgtgctcggggagttggctctactgtttggtcagtggagtgagatcactgtctgcttgcttgctgtacacttgcagcggctgaagggctgcccgaaag

SEQ ID NO: 38312 - DNA, 2933 bp, Bovine  19866880900647
agtctctggatgtagaagtgctatataaataagcaccactatgcttgtgattaggtactgtttacccaattgcttaccactcaaaactatccccaccccccaccaccgcacctgagcaatatcttagtaactttaattggagactaatcacattaggggctttcctggtcagtcagtcagttcagtcactcagtcgtgcccgactctttgcgaccccatggactgcagcacaccaggcctccctgtccatcaccaactcccggaaaagaatctgcctgccaatgcaggagacacaggtttgacccctgggtcgggaagatcccatggagaaggaaatggcaactccagttgccagtattcttgcatagaaaaccccatggagagaggagcctggcaggctacaatccatgcggtcacaaagagtcagacacaactgagtgaccatacacacacgtaatcatatctagacagcaggtttactgaagaaatcacacaattatctcattttttcttcatgactctagaaaattagggtatttttcccctcaaagtatgaactattataaaaagcagatttttgtgagtgtgtatgggtctctgtgtgtccgtccatgatagctttcaaagggacaaatcattttttatcaactagattctgtagaaactaagacaaagattacatgaaaaattactgctgagacattacgatttgtgtgaattttaactggatcagtctagctgtctgcctgtggaatatttgcccagagaacacagctgccattgcttgggagaagtatgactgatcaactgtttggagtttgtagagactcagatatggtatttgaaaacagctcttcagaattaaggtaaacgtttctatccttggataaacagagcacagttgtccagagcagagctgcccagcacgatgactcatgcattctcagccctgcagcactcagtaacaagccaggtctactgactgctctctactgtgagctgactctctggtagacagagaaggatcagatgaccccagccccaataatctaaagcactaaaattaacaagtaaagtggataattaagggcacaggtagaggatacaaagagaggaaaacattttgagaatgtaaatggtagtaaaaagataattagcatcctttaaaacattatctcacttattcttcatgactgaagtaagaagtattatccccactttatatttgaagaagctaaaggtcatcagagtcagcatttgaatccaagccctctgattacacggtttgtatcctgaagctttccagcatatgctttcagaacataggataaagaccaacaatacaggctggagtggctggttggcaaaaatgacacagaagagtttgaaaaaaactattttttttcagttctggcaaaggattaggaggatgtgagatgggcatggacaggaatgaggagagatgctgaaatatacatggcatccacatgatcaggacactcatcctgaccagagtctatataaggggtgtaagggaaacaataagaaagaatgggggtgaggaaaaagaaacctacaactgtgtgcaaatgtctccccagctgctggagatgcaaggcagaggcaaatgaagcccagaaacccaggtgttaatcagcacagtgctgctcagtgaagagtttatgtagttatgagatggaaaagagaggatcaaagtctgggtctgagtaacagtgactatttaaggcaggagaaagaaccaggaaaaaggaatatgcagtttaatggacttatatacctataagattctatttgggcttccttggaggctcggcagcaaagaatctgcctgccaatccaggagatattgagttggatccctgggttggaaagatcccctgcaaaaagaaacagcaacccactccagtattcttgcctgggaaaccccatggacagaaaaggccagcaggctacaatccatgtccagcaaaagagtcggatatgacttagcccctaaataacaaggttctatttggatcaaatcccagttaggaaacttactagctttattactttggtcaagttcaatttttctcaaatataaaatggggaaaataagaatacttatctcacagggctgatgtgaggattaacacacacacatacacacaaacacacactccaatgataaaactaatgctgggcacacagttaagtacttgctaagtgtctgcttattatcgttgttattgttgtcatcatcaccatcattcatataagcttagtctatagcactgtgggtagcagagagcagttagaaacaactcaatgtacattcagagggaaaaggccacccatggaataccatgagacagtttaaaaaactggagtcgaattctgtatattctagcctggaaaggccttcaagatataaagtaacagaaataagctagattccagaattctcatccatacacattaattctgacaaggcagtgacaatgatgagtgtcacacaaacatcttagtaatttcttagcagaatgagtctttgcagaccccagtgtggtagggagaacagttttctatagagatgcatttagcagggccaagcacactgtgaggcctgggccaaagccctcagtggcagaggaagaaccagattccaacaagcctgactggctgtcgcctgccttaatcaccagacagagcagataagctgcacaggggatagaaaaattaaacatgtctgttttactttttagaggcaattagggatttatagccaaagtgttgtaattttttggatcacagccagcaatttttttttttttttctttcaaggaagatgattatgccactgacattctaaaggcccattttagagccatttctttattcccctagaacaaggactagttactaaaacctag

SEQ ID NO: 38313 - DNA, 2334 bp, Bovine  19866880903939
ggttttattcggatccgtccttattgcatggtccgggcacatctggtggcccttaacatacccttgtgacctgaatgaacacattcactgaacgagctcttgatttccttcccctgctgcccttctgaagggctgacttgtcactagggctcagctgccatctgggcatatttgggcaagctgatgtgttttatttggctcacacacgattaaaaaaattgaaccaacgtttgaaagttaggaggtttcacacaaaaatatgagttcctgcttctcttgaaaaatacgaatccctggcatgaaaacgtctactggagctaagaaatgagggtcccctttagagatgcaagtgcccttccattgaccaaggtaaccagctttttgtttctctttccctgacaccaaggctctagcagcttgtcattcattactgtgattacaatgttattttagagtacaggaaggtctctaaaacttacggctctatcaaaatggggaaatgaaaaataacccacagtgtccatgtgattaaaaaaaaaaaaatacctgcctggctgaagtagccaatagagtttataaactatattctctgctcccaaggtcaagagagtgatttcatcccatagtttttcagtagggctgtgaatcctcatctttggtatctttgctttcttatccgtccaggtttgcagtggcaagtgaagtccatgttcaactgcaagactaacttttctactggcatgtggtggataaaacagccatggaaagaaaccaccagcttcttctgttaatactacatctgcacacacacaaatcatttttggtttgttctagaaatccatatggccaaggcttcagttctactgttgggaactgttcttcaatttttactcatctccctttttagtacacttcagcatatctagatcagagtcagattctatgtgtagagcaatggaagaatgggaagatgaaggtggccttgttcaatgggtagagttgtaggtaagagttgaaggatgcttatctcccctgagacaaatcaaagtttaggctgaagagaagaaacaatttgtcatcacagagctaagggaaggaaaggagataaactagatacaattgtgtaactagtgtggattggcaggtcaacctgaaagtgaatggaaattcagaagatcttcaggtttacttatctgagttattagtttgttgttaataacagagacccaatgaaacaattagggatttactttctctcatttaaaagaatatttataacagtcatccaagattactatggaagttccctagaatccttgcgggtccagttttgtactgcgtttggctctggcagccatcaatgcgtgagctccatcctcaggtcacaagatggctgccggagttccagccatcaagccagcttgctgagtaagaggaaggagaacagaaaggaatctcccagataccccaagccccaaacttgtgcatccctatatataagggaggatagaaatgtattcattcagctgaacacattgcttagggttctggtactaaggaacaaatgatgaataactgtaacaaactatgccaaatctacttaagaaaagtaattatcattcaactgactaagacatgctggtgccgtgctatgactaatccttactagatagtaaaaaacccatactgaataagaaatagtacgttactttgcactatagacaaggaaactgaggctcagagaggttaaataacttgcctaatgccacacagtaatatgcgtgcatgttcaatcacattggactctttgcgaccccatggactgtagcctgcctcctctgtccttgggattctccaggcaagtatactggagtgggttgcaatttcctcctctagtgaatcttcctgacccagggatcaaacatgtgtctcctgcagtgcctgcatcggcaggtgatttatttactactgccaccagggaagcccaagcccatatagtaagtaggtcagcatttcagaaattgctgatttatccctggaaacttatgtgacgtgagatacgttggtaaacgcttagagtttctcatttttcttagtgtggtatgaatcctgcagaccaatatgaaccttctaccatgaactcttctgttctttattattgagatttaaaatcataataaaacagtggttaaaagcctttgagaactttaagaaagtgataaactgtctttcgattttctccattcctccacatttaactaagcagttttcagggccctccaatggacaaagtattttccttgaagctgtgttcccatatgtgtactttgctca

SEQ ID NO: 38314 - DNA, 1163 bp, Bovine  19866880956687
ttaagtgtcatgactgacttatgatcaattcacagattcttttcagaagaaagaggaaaggatatcactgacttttctttctgatgactctagagctattctccacagcaacatatccacctacaccctctcgcccactcatgcctcttacctgcttctcactgtcttcactatataaatgtgtatcactacagatggacctcttccattcaactccaaaaataaatacttactgatcttttatttgtgcaaggctttgaatgatagtctagggcaagataagacttggtccctgcccccaaagcactttcccaatagtgtagaagaccaacatctggaccaattgttccggtagaagacaagccatggtaacagaagacgtgatttgacataaaagaagaatagatggagtgctaggaaagcaccaggaagggagcaattagatggtacttaaaagaatcagagaagattgctcagtggagactgtatttgtgtcttaacctttaaaggcaagcaggatttcgacatgtgggcaaaagcgtggaggaggaagaggagggagaaaagacagattgcagacatgagtaagggctcagtacaagagatttactcatttgagctggtcaggctcctgtgctccaactgcccatcagacttgtacatctgtaatacagtccaggggaaactcaataccttgcctctaagatactggcggcggagtgcagtctcctgtccctccccctcggaatggaacccatccaggttcccacatcactttcttcctgagtccaatccacctcaggaaaagtatcacttttcaagaagggacttagaggctcagataacaaatctctcattggtgagtcatgttcttcttggcaacccaagaacccatggatatttcctttccagcctctttttttcccccagtcatccctaatggaaacattgcctcatgccttcctttgccaaggcctccagcttacctgaagcccagcttccgggatttcttgctcaaactccatttctatctctcataaacaagtcagccaggaagtcttccttgagccacatgggtgctaagcatagaagatgatgctaaaaattgcaagataattttttatttttaccctttccagccttcacagttagaaacggcaata

SEQ ID NO: 38315 - DNA, 1436 bp, Bovine  19866880981010
tcttacccactaatgaaataagtagcttcgacttcttgaagcctttgaatcttaaagagagtcaggtcaagaaagctaattttgaaaaatgcttacgggccctaatgccctgcactttatttgcttcttttaacaagattatgaaatctcctagctatctctaaacaacacaaaggtcaggtaacaaaccaatgagttccagaaagaaaatcaaagttaaagtggattcactataaatagaatttcttggctgtcagggatttgtgtaacctcaaatctggtttggaacctcaacaggggtttggaattttttggttttttttttttgtttgttgtcagttttccaaccaaagaagcaaaattttgatatatatcactttgatgaaaattaattttggctcctgtatcaccaactagttcatctagtgatctacagactgatagtaaaactgataaaatgactgtgataggctccttgaagaaaatactgtgaagactaaatggagttgttgtttagtcgctaactcatgtctgattcttttgtgaccccattaactgtagcctgccaggttccttggtttgtgagatgtcccaggcaagaatgctagaatgggttgccatttcctcctccagaggatcttcctgacccagggattgatcccacagttcctgcttggcaggtggattctctaccactgagccactagggaagccccgagtaaatgtaggcttggcggttaaaaaaatcagttgaaaaggacctggtgtcagcgtgaaaacagaactactcctgaattctgagagaacaggctatttattcttctgtctttatagagtcataatcattagttggcttgtccataatcacctttctaaataaattatgccgtgtcttctcaaataccttcaatttcctaaaaagcatttgtataaaggacagaaatggtatggacctaacagaagcagaagatattaaaaagaggtggcaagaatacatagaaaaactgtacaaaaaagatcttcatgacccagataatcatgctggtgtgatcactcacactcacctagagccagacatcctggaatgggaagtcaagtgggccttaggaagcatcactacaaacaaagctagtggagctgatggaattccagttgagctctttcaaatcctgaaagatgatgctatggaagtgctgcactcaatctgtcagcaaatttggaaaactcagcagtggccactgcaaaaggtccgttttcattccaatcccaaagaaaggcaatgccaaagaatgctcaaactaccgcacaattgcactcatctcacacgctagtaaagtcatgctcaaaattctccaagccaggcttcagcaatacatgaacagtgaacttctagatgttcaaacaggttttagagaaggcagaggaaccagagatca

SEQ ID NO: 38316 - DNA, 662 bp, Bovine  19866881238586
ctgttatttaatcggtaagtgcaggacttatatgagccatgtgtggatttattccatggatccaggtttgaaatgagacccaagaaagcagaaggcaccacctctagggctccctttacactcacaacttactctgctgtctccttaaaagaaccatcagcattccctgtagtgataactaccaaacctttcctctgccatttgcggtgattaaattttattctgaaacaacttttatgacatttgtaagtaattttgttcttcggctataatttgaataactccgctccagggttataataaagtaattaatatgtcggggcggttttgagcaggattcaatttatcgcctctataaacaataaagtgaaacacgggcaacttggaagaaaacggttaagatgtgttcatttttctcctcacacagaaaggaagacactgacttccctgtacttctgtgccacccctaacacactcaagatgcatggtcacgggcttccccgtggtccactgggtgatcatccactttgtgatggtggggacacccgttggatccctggtccgggaggatcccacatgccgtggggcaactacgctcgtgcgccacaactacagatcgcgcactctagagcctgtgctctgcaacgagagaggccactgca

SEQ ID NO: 38317 - DNA, 1671 bp, Bovine  19866881294340
ctcaactttctccttgagaatggtactggaatttctgggagaaaacgatgagctgaatgttctagaagcaactttttcttgcgtggctctttcttgagcttggtacagatgttagttgggaaagaggacttaccttagaaatgggatctccaagcactcttggaagtgtaagatgttatacttgagttggtcttgcacggctgactttttcagaaggttccaggcacctttgtagtctgtaaaaaacacacatattgtagttgtgagccacctcgagaattacaagtgtaattataaacccagttcttccttttaagtacagtatagtgccatttgtgttcattgtttttatcagcgatcctggtaaattacagaagtactagtttgtgcgataaaagatgaaattcttcagagcttggagattgtctgtgtattataacttattaactttttcccccctttctttaaaaaaccatcactttgcgctctcgtcccacacttcaaagaagtgacaacttatctttgctctttggggagctgagaggtagaaaactcagttgtatttggcagctgctccagtaggactggtgttataaatgaaccctttgttcagcgtaggaccgaactgccagagatagaaggagctagatgcgggtagaagaaacctgactttggtttaaaagtcaccgtcttttctcttctgttgagtcagtgttggttggtcccttttggctggttttcaatcatcagtgtgcttatttgtttgttttctgtgttggccactcggcatatgggattttagttcccagaccaagggtcgaacccatgctccctgcaatggaagcctggggtcttagccctgggactgccagggaagtcccgtcagtgtgctcgtttgacttaactcatttcgtttctttctgttttgggagaagtgtcagggaaggaggctgagccgagattcctcagctacacaggctcccgctgcctaattaagatggtcaagtacataccctgttgggttttagaagctttatccagctttagccaagaaggcacttctaccctggggcaggttttctccgtgctgaggagattagcagtcaagaggctccgagtgggggctgagaatgtacttagagcacagcctttagccctggagggtaattaatgttggacattttttttcttttcctttagaggccgagtgtcaaatatcagacaggggtagagtcagctcacttatgcagacaactgttacttctctgtgatgttagagtgaggggtatttgccctttaaatttcaggccttcttgcttcctgtgactgctcaggtccagaggatgcactgagtccagctgcacactctacctggccgctggaactgtgtgtccgtggcaaggcaggggtgaacagcttgtcttgagtggggtggaaagcctttaatatttgctgtgatttttttttttaaattgtcacatcatgggttactttgagggcctggtgcgataacaacccatggccgtcagaggggtaaatttgtatattttttggccttttaaaaagccttataaaaggtaattttggagggcttgtatagatttggaagactgaaagtggcccataacattgacatttcaccattgactgggggtttatactctgtaaagg

SEQ ID NO: 38318 - DNA, 1265 bp, Bovine  19866881386642
tctctcttttaggacaaggaaaaaatccttaaaaaagaaaatatgttagaatcatttattcagaccacaaatatttattgagcgtctacttcatttcatggattatctctgtggctcagcggtaaagaatacgcctgcaatgcaggagatgcaagagatgagggtttgatcccgggtcaggaagatcccctggaggagggcatggcaactcactccagtattcttgcctgaagaatcccatggacacaggagcctggctatagggccgccaggagtcggacatgagcacacacacacttcatttcatgtgctgggaaaaagctatagatatgacagtgagatcctcattgggacttaacttgtaacaggaggaggaacaagagaaaaaaaactaattataatggccataatttctttgaatagaataaacaaggaactgagtaagggacactcagaaggggtcctctttagagcaaagacagtctgccaggatggaggagggggacctttgatgtgagaactaagaatggggaagagaggcgaggagagaggggagccaagaggtgagaaaacatgctccagaaatgagaatctgaagcccacccttcactggaaaatgtagaattcagaaatttggttttcttgttggctgtaggctcaaacttctttgcaagcagagaagacgatgatatttgaggtagaatttcagggctgtgaacaggaagttaggcagagatatcaaccaccccgttggcctggatgcttgactgaaatatccagcatttgtcctattcttgaaggatcctctggagaaactcagtccgtttactttggctccgagtccactgttaactggagaggaaatgcatttattagcaggggccaatctgttggactaactccggacaaaccaccctcaacattgggagactctgggtggcccacagccaagtatgagggagatggctgtgagtgagtggggtgggagagtggccgacatgggcttgagtccctgttgtgccatctagttccctgtgtcctggggaaaggaactcatctctctgaacctctgtttcctcttcgattagtggtgagaaaaccaaatacactagcaggctgcttgtgaagatcagaaagaaagtgtgtaaggacgacctggctcagtatttggaactctcaaaatgagagtctaggttgtaacagaagtagtaatagtagcaagcactgtacagtgagagtagcagcagtcatagtaatagtaacaa

SEQ ID NO: 38319 - DNA, 1761 bp, Bovine  19866881391303
acaagctccacatcttgctgtagacttgggagataagccacagttctggaggcaactgcagagaagagcagaaagcttctcttttgctgattggcttgtgacatttacttggtttatccacagtctccatcatgaaagctctagtcttttcaaaactacagaagtttttccatgtgtctccttaaactcttgaaaaatgaagtccctcagtcatgtctgactctgcgaccccatggactgtagcctaccaggcttctccgtccatgggattttccaggcaagaatactggagtgggttgccatttccttctccaggggatcttcccgacccagggattgaacctgggtctcccgcattgtaggcagatgcttttactctctgagccaccagggaagtctcaaactcttgaaatccaagcaaaatatatgtgatgctttctcaagtgcaggaagaaactggcattttttaatgggaaagtgtgggaagaaggcttttgcaaaatcacgccattccctctttgccaggcccctcttcgattgattgttaaatgtctcctttttgtacttctgtggccctgctcacagttattctgtgtgcctgtaactggggcacaaccagcagtgcttactgctgtcatacgtactatgacagatggaatgtacattgtgatttatggggggttgttcacagagatgaggagatagcttgattctctgccatccacgtgaggtccagggatccctgaaagaagaacgcatctgagggatagaggaaagctcgtaatatttctaaactttgtgatgaattgatctgggacttcttttcttttctctaatcagccagagtcctctagaataaaacagcattggatttccacccagtgatttcggagttagcaaaactcccatgttgaccaagtggactttgatctttgggaagaactgattaaaatctttgaaagagggatcagacgtacagaagacaatccacctgaccacccatgaaattgatcaaaagttagaaaacacacagccatgagcaaacagattggatgtttgttttttattgtcttgattatcgggtttgaaaagagagactgccctcggagacctgactcctcgctaagcactccagctcacctctctgtaaaaggcagatgctcagtgaagcgattcttgagatcttttttggtatgagctaaaattctgttgacacaaacctgataaattttctgaaccccactgtcccttgctcacttaggtgccaaattacctggcacactttccccaaacctaagcccctattccagtctccatcctgccctgtgtcagtgcagaggccccacctgtgctcaagggaatggatcatccctgtcttttctggaagcacgtgtgtccctctcagctttcacagagctgcctctgctccctgggttctgagcagccgactaagggatgaactcggggccgagtctgttgattgagcacggaccacctgcttgtggagatcgagttctctgacccttcttgctggggcagctgtggctttgattgaaaaggtatgcagagctgacttcaaacccagtggcactggtctttgaaaaatgtcctttggcacagtccctgcggcacgtgtttgcttatggatttcgccttttcttagaagtgagcacgaggcttgggctggattgcccgtcgctgaaggcatctactatgatgagtcttctactaatatgtttaaggattataaagaaaacagag

SEQ ID NO: 38320 - DNA, 1983 bp, Bovine  19866881416533
tccagtcctgtggccactgctgagttttccaaatctggcatattgagtgcagcactttccccagcatcatcttttaggattcgaaagagctcaactggaaatgtcaggtacagggctgacctttttaataggaactttctgtattccaaaaaaatttctctgatgttggttttagcatctttctgtctggtgaattcctgtcatttgttttcttactcacaggatacatagcgctgactgtcaatatttgctcattagatgtatgctttcaggagtttctgaaagattatgagatgagccacagtggatggagacaggccctagagctgctattggtgctgccaccaggatcacattgtcatttgcatgattcctcatatttactgaacactctatatgccagatgctgtgcttcacacctgtaagacaggcattgggttggtcaagaagttcatttgaattttctgttagatgttacagaaaaacctgaatgaactttttggctaacccaatactatatgtttcctctcattttacagatgagaaacagcagagaaagggttcaacttgagtccagctgatattcttaacagaactgctattctactagaggggctggataggaagaaagaaggaatgaacatttgggttataattatgaggttcaggatggatgaaaatgaatgtggaaaacactagagaaatgaatgccattccagaatatgagatttgggattggaaaaaaagggatttgaaacattccatagatgtggaactcaaaagactatggaaactgacagagtataagaaaaagagaggaaatgaaaaggatcccaaatactggtacggcactttatggttggggaaatattgaaaggacaatattggctgtgggtacagaaggggaaatacattcattgctgaatttactgaattttctgtacaaagtggctatttgtgtagaaacagtgaatcattcattcatttattaactcagcacataaagaacacagatctatattaagcattagagatacacaataaaactagctttataaataaaaatacaatagataaaactagtgcttagaaatgcatgggtctgaaagatatagatttggtgtttatttgtttattcattaaaacgtgtattcggggtgttccaaagcatgtgatatacaaaacagaggggatagaggaatttgggaaaacaaacatgatcatcaagggaaatggtaagagaaggtgaaatgccagacttcagggagtgtctattttaagaggtataagcaggaggcagagaaatttgaaaagaagtgatagtaaatgaggaaagagagcagaacaacataaagtcccagaatgtgatgtatgagaaagggtttaggaagaaattcataagagctcaatatggccaaatcccacagctgctgctgctaagtcgcttcagttgtgtccgactctgtgcaaccccatagatggcagcccaccaggctcccccgtccctgggattctccaggcaagaacactggagtgggttgccatttccttctccaatgcatgaaagtgaaaagtgaaagtgaagtcactcagtcgtgtctgactcttagctactccgtggactgcagcctaccaggttcctccgtccatgggattccccaggcaagagtactggagtggggtgccatcaccttgagatgtcaattaatataagaagtatatacagacctgtttttgagggatgagaggtcactgaatgtagggaaagcatgtttgtttattcttttaagtctttcatgagggagacagcaatggccctattacctctattgccttagaagtaatagggccattgggaagatttttaagggtaagtttacaaaaaggagttagtgaaaagggagtggttctagatgtaagggaatcagttttggggaggcaggtattttagtggagtaagatggtatgttacgtgggaaaatg

SEQ ID NO: 38321 - DNA, 1766 bp, Bovine  19866881428896
ctgtgctttgctggttctcatttgatgtttttcccagcatctgagatctcttaaattatctcatcagtgaattggtttctttcaggtcccccagattgttgggtccttgagggcagatacctggtctaagtcattcatatcttattaagaatgcaaatgatgatacattcagatttaggtttatgtctcagcctcacagttttctaaacagaaggcctgcagcaagttacctaattgctgaacctgttttctcaccttcagaaagagatcatcagcttctctggtggtccagtggtaaggaatccccctgcagtacaggaaatatgggttcaagctcttatctgggaagatcccacatactgtggagcattgaagcccatgcaccacaactattgagcctgtgctctagagcccaggaaccacaactactgacccacaagatgcaacttctgaagccagggcaccctacagcccatgccccgcaacaagagtagccactgcaatgaaaagctcaagcaccacagctggagagtagcccctgctctccacaactagagaaaagcctgcaaagcgaagagcacctagcactgccaaaactaaatcaataaaaccttttttaaaatgagagatgatctctcttcaggaatggtgttgagcattaactgaaaacatgtaagagcccatcagaggacttgtcacttgctggtcttttaacagatcaatgttttgtagttctttctttgttttgtgtttgggatattagttgatatttacatctcaacaaagtcaaccatttgggaagattgggtaactaaaggtatttctcttcgctttaaaaatagacaaagttggaaagctgtccttggctttaccacttctgacttgaactattaatttcttttgctgatttcttctgcaaaatggaaaaccacaatacatgagttgggatgatcattaggatgagagagagaaaaactgtttggaaccccatataaaagcgaagccaaattttatagaaatacaaaacgcatttgagatattcagcagttctctcaaggcctgattataggcttgatggccttaatttttctctaatatataattctgtgttatagtactctacaaaaatgctgtagcatatcattaatgctcacaaaatgtcataaaaatacacagagcagaaaacctcccagctagagaaattttacaatctgaagatagaggcagttaactttaatctaggaaactaaagacaaccacaaaaagggtggatatcttggagagaatgttcttactttttcttttgaagtagaggactttatttgaaaactgatgatgtttgactatagaagaaaatctaaaataaactcccaaaagtaatcatagtaaagggaaggagaaatagcagtcaggggaagagatttttgacagaagagaaacctccatggaaatgtagaaacagaacaaagaaataatctgtccacagatagatttttttaagggaaacgtaagtttgttgcaaataaaagacgatcgcagcattatggtcatttgggaagctgtattatattgctcaccaaatccactagaatgcatataatatcagtgcatgattttggagttgaaatcaatctgaactgtgaaaagcctatgatagatattcctagaggtaaagaataaattatatcagtcaatgaattaataaagacttagtgagaagatgctgtatgccaggtctggggacaaacccagggaagtcagccagg

SEQ ID NO: 38322 - DNA, 1738 bp, Bovine  19866881507650
tcctgaggctctcccgtctgctgtggatagggctgtagacccaagcagtggggagacacctggctcaactcccctcccttgggtggcacgtgatgcactgggcaggtgactggcaggaaggggacccagcagctggtggccgtgtctctgccacattgcaggctgagccccccaagaagcctatgagggtcatcagtgcacgtgccctgtgcggagctctgtatctgagggtgcttggcattcaatagcaaataaaaacaccgtgacaggtagacagaccatggaagaaaagaaagagttttacgtgttagttattttaatgacacttttttccctgccttttctaacagggcctcacattttcattctgcactggtccctgtaaattctgatcttgtctaccacagcatccctagcacccagcccagagcagatattcaacctctgttgagtaaacctctctgcatcccattctgtttgggggagggggtgggtgagaggaggacttccatggagatgctctacggaaaactaaacacaatccttgaggttggtaagtactgcatctgaggtgatcctccctgggctcaggggcagtttctagtattcctatgggcacctgagggggccacgtttcagactgtttgccgggtacctaaacccacagatgtggtgacaaggtaatgacccgattttgtgagccgcttgtggactcagccatattcctcacaatcgcatctcttcacgtggaaacctctggactgacaaaaaatatctcacttgatgaactgattttaactggcactacctgccctgcaagacctcaaagacattttttcccaaacaactaattttatcttcatgccccagcacacctgcagccctggcggggctcagcacccctcccagaggatgcataagcagcaaagtctgttttcctcccttgtgtttaaaggggaagccccccgcctccaacaccgaaggttctgtgggctgaaataacactgcctggcccatctcaccactgcacgcagaatcccagggcccttcctacccacccaagagagagaaaacacggcgcctggttaggattcttgttcctcatatagtatcgtgcacatccataaggttttcagttccacgctcggctcagccgagactgtgagctcctcccatcactccctgcaagatcagttcttgtttcttttggcaggagcacctgtaccctccagagtggcagatgtgggcaaaatcctcatatctgcaccagtggctgcatagaggcgtttctcttcaccggcggttctctagctataaattccaacgtgagcagactcagcaaaaactagggctacagggtgtctcttctttattgctgaatccgcatgaaatcccacttgacgggggaaaggacgaggttatggtgcattcagactaaaatgacctttccagtgaaggtctggttcttcgtcaggcaagctgctgcagaacccaggcctgccttcccgagtaagggatgcaggcagtggctgttgttctccggatccttgaacttgaaaggagtccaagtgacctgacccagcccactgccaaaggaaacagtgtctgaggacccctggccagaggtaagtgcagcacggcagtccttaaatgcataggccccctcttctcctgcccctctcaggctgaaactgtaatatcaggagtcagtaaaaaacctgccaggcaaactttccaa

SEQ ID NO: 38323 - DNA, 836 bp, Bovine  19866881526800
tagagtgggttgcctttcgttctccgagatctttccgacccagggatcaaacccgtgtctccttttttagctgacgattctttaccagtgagccacctgggaagctccatgtacctggtacctggtgtgcactcagtaaatagaagctgtcgcacttctctgtgcttctgtctgagatatgcttgcgacttgtgcgttgttagtagtggctgtgagagagagaggagtctcaaagagattcaggcgggaaagggttagtgtgcgctaggcccgagggaagggctgccatgctgggcagtggtgtctttgtgggctggctgatccagctcagcgcccacagtcttactgatccagccccccggaagagtgttgagggaacccagatggcagtgggagatttatctttgtcttgtggggatagatgttgggaacaacccttaatgctcattttacattgtgattttagtttcttttgagtcctattataacattatatagtgttgtgtgtgtgtctttgtgagcagcggggcagggaggggagagcagagttggggagtgtgcgttttcccactgtgggttcctgttgttagacttcagggggtagacttcaaagtcatctctctccatctttagaatatagggtttgggggttgtttaattttttaacaaatggaattttgatgtatttgcatttgatgtatttgtattttacaaatttgatgtatttgtacagagaaatgattactgaagtagatgttcttacggcattatggcagggaaatcaccaagatggggatttgggagttttttgggaacatccgaatttacttcctaaa

SEQ ID NO: 38324 - DNA, 1121 bp, Bovine  19866881539176
agtttggtagtcatcttgaggaaataaagagaagcctcctatagagaagcatgtttaactcttcctgtctcatttcctcatgtgggaaccctgttgaccacccaccatggttgacaacccaccccagccttcttcatgtgaaattcatcatcacagtagagacctggtccttgttgctatcagcacaaaggcagcaagtggcccagagcttactggaatctcatgtaaagtaaataaaataaggtcagtgcctctagctacccgccttcaactttccatttcaaactccacagtggggacacatgttttatggagggtgaaaggggaggaactattacctcttagttctaatatctactgtgagcaaaccctctgcagccttgctactcaaagtgtggtctggggaccagcggcagcattggcttcttgggaatgtgtcagaaatgcacaatctcagactccatcccagccctactcatttagaatctacattttcacaaggtgtctggggaagacttcctacatattaaagtttgagaagtactgcatagcagtgctaagtatttcatttatgcacttcatacatttcaggcacatgtatttatgaccatgaaagtgaagtgttagtcactcaattgtgtctgaatctttgtgaccccatggactgcaacctaccaggctcctctgttcaaggaattctccaagcagaaatactggagtgggttgccatttccttctccaaggacttttccccacccagggatcaagcctgggtctcccacattgcaggcacactctttaccaactgagccatcgaggaagcttgtatttaaatccatgttacttaaatgagaaaacaacccagatcatggtggttaaggagcttggccaaagtcttggctagtttgtgttaggaccaatatttgaatcctgttatgtctgactttgaagcttgcctatcttctactgtctcatgttaccttcatttttttccctaaaggttaggttgcagtgagcagctctcacttcaatgagaagaaacatgagacttgaatttccacaaggagagacttagtgaagcaagaattagaagttccaataatgatggaccaagggaagca

SEQ ID NO: 38325 - DNA, 1031 bp, Bovine  19866881694870
atgaaagaaaccatagtgttggtagatttttattttagagtaacatgctcatagcatcattctgtgtaattccagtgaagctttatgaacaactaatgtgctttagttttgccttattatgatagtgctatctgataatactcatgtagcagtgtccagaattggggccctatttttactttgagacaactttatactctcagtcttaacagaatgacagcttgctaggggatgttaccaactattacttctcttcattgtctacattatagacaattaaatgctcctattttcttgactgcattttttttttttcatttgattcttttactatgactttgaacatcaagacttgcaaacctgaattcttggaagacatgtttaatgtgagtgaagtctagagttgtgttttagaaagactttttttttttttttttacattctaggcaggtcagtatcaaaggagtctcttaaagaatgatgacctagtgtttttttttccccccccacaaatagaacaaggatctttcttgtcaccatgaatttaatactgtttcttgtgttttcctttgcaatctctttgactggattatattcaaggacacaggggcctcttgtcttttaggtccatttaaaagttaattttcaagctttgacattaagctcaagagtttcaacagcaattaatccaaaatacccacatcagaaacatcattaatctttaccagacaggagtggttatgtttgtgactaaacctcagtggactctttggaggtgggatttgccatttgcaaatgttttgaaaggaaagacaaggctttgaagccaagtaggagaaacagttttaaagagttagaaccaaaatccaagagtcactctgtgagtcctggaggaaacagtcatttctgttgtaggtcgtgaaaagggtcacttctggattgaacaccatccaagtgcgaattagggcacctggtcatctttcctccaaatttcagtcctcagcccttctctgccctctccccttggatga

SEQ ID NO: 38326 - DNA, 925 bp, Bovine  19866881850431
tattttccccttcataaatgcaggaagtatctgcatttccaaggaaaatatttatgtatttttaaagtggattctaagaccaattgaatacacaaattaaaacaaatatatttgcctgctggccaatgcctctctgaagccctcaagttgtgctttacagataaaaacaggctaaatgttttaactctgatgaaagagtttcatttgattctgtcatcttgtttttgatggaatttatgctcctccctgcctcttccattcatttcatcaaatggtgattctgcattagcaaaaacccaacaaggtgcgaggcggaagtggttcagaaactgtaacttgtgtttcagttgtttttgaagaacagtggatggttgggcagcgagcatttgtagggttccatttgcatttgaacacaacactgtagcctggttagttcacagtgtctcacatgtttggagcatcatttttcatttaggaatggccaacctagctttcttttcccattgtaagggagcaagcacgagactgtcatgggaccactgcaaaagaaactcattatctcaaaaccatgtgacatcctcagttccatgattagaataatctaaagaaatcaaagaaaataatgttagtttaatgcttctcataaatatgattaaagtcactggttggtgggggaaaataagcctggatctctgaggtttctatatttgaatggactttcagctttagggctttgagaactagcaccccaagtatcttccctgtagtcgtgttgattaattggttaatgtaaattccaaggagtctcattaattagagtaaagaaatagcagtaggccatgttgagtttaaaattacttatgaaatttaatcattagtaacaacaatacaactcacctttgtaatattttccaaaagccaaata

SEQ ID NO: 38327 - DNA, 830 bp, Bovine  19866881866648
cgttaattcctttcccaacctacaacaaggactccacccggctgtgactttggggtgctgactggacaagtgacatgttcagtatcctccagaaagcacaagaattgccactgcccccagccccccagctgtcatgatgcaaattatcgccacacctatggtggtcttcaagtgacttctggctgcccccatcccaatggattagctccaaatctctcagagcataaaaaggacccacacctcatggctcgggaaatcaagaaagggctgtggacatgtctgaatttggttgtgggtggggagcatttgcagggcaccacttgctcctgcaaaggggacaagcaggaccctggaaaagcctggctgctgctggcggcaggaagcaaggactggcctcactctcagtgttctctgcctctctctacaaattcccttcttattttgggattactttgattggctaatgagatgtctacagtgagagatttatccattcgaatcataaccacagctgtgcttaccgcttaatagcctttactgccagcaccaaaaatataggctttctccacaataaacactttttataaaaccaataagaccactccagggagggttgttatcatgaaataatcatggccccatgggattctgccagcctggccatgtttcaggcctcataatgctggggtgggggaggggagcatggaagggcagaggtaaggggagattatatcaaaacaaggacaccccctatcgtgcctttctgcttaaagactttaaatacttcggtcgaaaatgtgtgcatgcgagtcatgcggcttaacagctgt

SEQ ID NO: 38328 - DNA, 909 bp, Bovine  19866881929273
aaactaaaatataaactcatttcatgtctcattgaaggtgaatgcaaaacaaaataaaataaaaccctgagcttgatttcttaagagaaaactctactgtcagagccacttcatagacagagctgggaaattcatttgaaattcctcttttgtcccttaggatgaagtatgatgcatgcccgggagcttaatggtttacaagttgggactcccactgtgtctttttttgctggtgattttatgattcttctacacacaacatgatggattcttgagtatcctgagttttgaatccatacttttttttgttgcttgagtgaaacccttcaggcagagctgtgaagatgtgggtcttaaataaaatatttttctactgtgctaataattcacacattctccacatttctcttctatactcagggtcagtgggatacatccatttttcttaattctatcaggcttgtttttctctggcttccagcagctttttatgaaagcacagcatggcttattccagatgctggtctttggggagggaggagggctttggagggggagggggcactttcttcttcttttccctccactctattaatggtggacttttaataatttgaaaactctttgtaagtgacctaatatgaaatactgcattacaaacccccataggagacacaattcaaacaataaaagcaataacacattttcatcctgcttctaagttttaatggagtgtatgttattgagagccaggatacttttttttcccatctgagaagtcatttatttacttgctggattgctaaatctctacagagttgacattcttcttttgaaaaactggatgtttagatttctggttcagaggaaagattgtactatcagacggaaaatgttacatatttcaag

SEQ ID NO: 38329 - DNA, 973 bp, Bovine  19866882158886
ctatcttttttcaagagtaataaaaaattagttaattgaaagtatacagacttaagctctgagaggttagcattccacgccatgggtcagaatgttttcttttagagggagaacccaatacttctttggtggattgtttcattcaaggttccagggatcccagaaaaattgtgcgtgcctcatccttagatgttcaggtcctggatgctgaatgtcctggtttgaggagggaaaggtgaaaacttgcttgctgttcagttctttgtagacggagggggaacacagtggctgttgttatggacacgcggatgctaacaggtttgcttctcaggggcgctggttaaacaacttcttaactggccagagtccagcacgttaatcattaacccgggcctgagcgtctgctgccccgtgtattcagaattagtttatcattacctctaactactgccttttatggttccgaagcgcttctatgaaatcccttatcaccaccaagcctaatcttcattaacttgcaggggggagcgctctgatatttctgagctggaccagagtaagcagtttatggccagttgaagaatttttcatcacaactgcttaaaaaacagagagaaagaaaacaggaaaaaagaaaacaaaactcagctcgctcattgcggtctttggtccatgcttagaagttcatattctcgtgacctacttttccacttaactcttgataactccgggcttctttgttttctttttgactttggagaactaggttagtggggaaagtcagggttccctggcagacaggctgggttgagagcccttggctggcatctcctcagagccccatctcagcgcccctctgcttcctgtgtcagctcagctcctggcagagtccctgcctggaaccagcccttgtagctttcacaaatggtctcagggctccagtcattcccgggggacacacagcatctctaca

SEQ ID NO: 38330 - DNA, 2139 bp, Bovine  19866880385731
ttccctctgattctattcaggaacacaggctctctcaatgacccccaagtgctctggcctgtccacctttgagtgtagatgtgggtataaacggagaaggcaatggcaccccactccagtactcttgcctggaaaatcccatggatggaggagcctggtgggctgcagtccatggggttgctaagagttggacacaactgagcgacttcactttcacttttcactttcatgcattggagaaggaaatggcaacccactccagtgttcttgtctggagaatcccagggacgggggagcctggtgggctgccgtctatggggtcgcacagggtcagacagtgaagtgtcttaagcgactgaagtgacttagcagtgggtataaaatggctaaaaccaattttgatggctgttttgtacacatagtaggtgttcagtgaatactcacgggccggatctaaaggcacgtgtaaatttctaacggaaatgttcccctaattctaggtgaccccaaccagtgtcaaaatatcttgagtttgaaaatgtattctgaaatttagctgaatctattatgtattcgcatgtgttttcaacttaaacattaacaaaaattttttttaataatggtagtgaaaatattatatggtttgtttgaagaagtttgttcttttccagaaacagcattgatcgatttttatattatgagtagtttattcgtgtgtgtgtgtgtgtgtgtgtgcgtgttagtcactcagtcatgtccgactctttgtgaccccatggactgtaacccgccaggcttctctgtccatggaattctccaggcaagaatactggagtgagttgtcatgcccttctccaggggatcttcttgactcagagatcgaacctgagtctcccacactgcagacagattctttaccatctgagccaccggggaagcccctagtttattcataaaaccaaatcaacaagagcatctttatgacataaataagaagaaatgtcaaatgtcccacttagtcacagtagaataatgaaactccagtccaattctcgacacttaccgcgacatctgtgtttactgtaatgaaattctcattcgcatacaggtaaggcatcgtgtgaatcataagccagaggatgtgcgcagtctgagctcaaggcacactcagggacggtgcagcgtcgacatcagagaatgtagcaagtggcatttccctgtggaaaatcttgggttcagtgccagttaagcactttcatccatttttctcaatgataggatagaaagcatgttcattaagtgaacaaggaaaccaagctgggagcagcagataacaccatagagaatggggactgatttgatcatgaccatgaaatttaactaaatggtcagaaggagactgagagtctgcagaggggagagaggccaggctacccgacttaggtggccagtggggcagggacatttacaagtgcaggccctcatctttctgcttttacctggaggctctgcaaacacacggagcccagccatcacctacactaacgcagtcaggagcatgggcaagccaggagacctccaggtacctcccacctgccagccgggtgccctccaggtgatccttactcatgtctctgttttgcaagcctccgttttaggaacttacatgatggatttggattttgacagaaaagggcttagactacatgctgaaaaggacaccacaaagtagttggggaattaaaaaaaaaaaaaagaaacggattacaagttcctagaaattgcaaaattcacacggaacaagctgtccagtgaaagtcactcaatcgtgtccaactctgtgtgacccatggaattctccaggccagaatactgcagtgagtagccattcccttctccaggtcatcttcccaacccagagatcaaacccaggtcttccacactgcaggcagattctttaccagttgagctacaaggaaagcccaagaatactggagtgggtagcctatcccttctccaggggatcttcccaacccaggaatcgaaccagggtctcctgcatagcaggcggattctttaccaactgagctatcagggaagcccactaatatgaggggaagtccaaccaaatgttaattg

SEQ ID NO: 38331 - DNA, 758 bp, Bovine  19866880704778
gatttttcctgtctaaagattgtcctttcgatagatgcaatatcgctttgtttgttcccaggagtattttcagtttagagaccgtatttggaaatgtaagtcttattacatcaaaatagcattcaatgtaaatgactttcactatcaaagatttcaatagtgggatgaataagaaaatatgcaattcaaatagagttcattctattctatgtgctgagaactctatcatattattttctcccgtgattatttctggtgacaataaaatatatcaatgactttcacgtgattataggagtaagactattatgggcaggaatgcttaaggaaaattaaaaactgcttaattgtagtatcaggtggcactggtagtaaagaatcctcctgccagtgcaggagactcaggagacttgggtttgatccctgggttgaagagattccctgaaggagggtatggcaacccactccagcattcttgcctggagaatcccatggacagaggagcctggcaggctacagtctatggggtcacaaagagtcggacatgactggattgacttagcatgtacgcactgtaattaatgcaaccaattgtctcgtaactagatttcttttctttcttaaataaaaacacaggtgaagtgctctaaaactaaaactttgaccaaaattttttactttatgataaatatagaagcaatagggcctatatttatgcatagtaaaatttatgctttttttctttttatatttgcctt

SEQ ID NO: 38332 - DNA, 1816 bp, Bovine  19866880799039
attttgcaaatccccagtgaaaaacagacttaggtagcaatgattaatggctgctaaccattcagtgaaagtcaatggaatgtatttgaatgaatcagggtgaaaaacgaaacctgcagagcaatgtgagttgatgtcaccaaaagtggagaaccttgtctcttggggtgatgcaataggaagcacacagtaccacctaagaagtaattttgattaaaaaaaaaaatcctgaatctgatcaagccctcaactctactcctagaaaaggaaacgatcaaggacagaggaacaggttaacaggtagttccagaaatcagtaaaccaaattcggaaatgtagaaaattctacaggacaaatgacccagtttcttcaataagtacatagttgtgaaaaagagaaggacaactgttagattaaaggagacttgggacaatgcaatcaaatgcagtatatggctcttaattgcatcctgatttgaaaaaaacaactacaaatatatgttttcaagataatcagggaaaagtgaatacaagtcaggtactggatactattaatagtaggaattacttgggctttcctggtggctcagacagtaaagaatctgccagcgacgcaggagacctgggtttaatccctgggcaggaagacctcctcaagaaggaaatggcaacccactccagtattcttgtctggacaattccatggtcagaggagcctggcaggctacagtccacggggtcacagagttggacatgactgagactaacacacacacacattggtggatttaactgcacaagtggaagcttgaaatgtgtctccacagttggctgccttgttgaacttctgcatttgcaatgagaaggaaatccttgagctgccacagccaacccctctaaacacagagtccagggtcagacttgtgaagagagccaccccaactaactgttggatgagtgaacaaggaataattcttggaagtacatgctgaaatttgcttgcttcctagcaaagctgtctaatcaaccgaaaactctttaagtaccttccttcatgtttattcttgcttgtgacatcctcaccctcctgtgtggtctgaatgtttgtgcccccgaactcacatgctgatttcccagtccctgcggaatggtactggagcttgtgcccctggcgggtgctcaggtcacaagggagaagcccctgtgaatggaatcagtgctcttataaaggagccttggagcaaaaaggggctcatccatgagccaggaagcaggctctcaccaataagagcaccttgatcttagagttcccagcctccacgaccgtgaggctgtcgaagagcaatccaggttacagcagtttgttttagcagccccaacggactgatgcctcttctgtgcacaggagacttttcagctagaaaaatcttaccatccttcatgtacagatcacaccccttatcaccctcctgaaagccattttatcaccagaagccagagaaaatacctttgactgcatatgttgtttctccaataaaattaatctttatgcattatctcatttgaccatgagaccgattctacgtggataagcggatagataacattagctccattttgtaaataatgagaaaattagcgctcacagaagttgagtcactaaatcttattggcgtaaccaacgaggggcacagagagagagttcagtccagaaccggagccttcgttctgcgctcttgcacacgttttggagtctgagccaaatctcgaattccgaaaggcttggtctaaacaagcgatttctcctcatgttcag

SEQ ID NO: 38333 - DNA, 772 bp, Bovine  19866880812012
gttaatccacatttgcttttaggcaactgtgaaccagatgttttttggggaaaaaaaaaaagctgaagccttttatttttgtgtgtgtttgtgtgtgttttgcttggggcataaaaatcatttttcccccttcagtgaggtcgtttccaattacaattatgtttgtgctacaaacacttaaaaaattaacggatgtatttggttattagtttatctttcagcatgctggtattaatgcagtcattatgttaagtatatttttttaaaaagctagtcaagtgacaagctcaatatcatcaaaagtccagggaatttggccccttctctgcctccccaaacacaaagctggggaaaccgcccagggacgcacatgtgcacggcatgtggggcctgccgggtccccagacactgacatacctgcccagccccctgggctgctgcagtgagaaccacaagcctcgatgtgggagggccacccatccccaggcacccagacatccccgcctgcacccgctgtgcatctgtgggagagccatggaaatgcaagagcaatcctgagcatcccctgctctctgtaaggagtatcttatacaaccaaaaccagcaaccacactgctctgtgtcctctgggtcctcagtgaccccaccccgggaaagcaattctacagaattacctgtgtgggggaaaggctttatcagcttgatggcctcgtgtttgctctactgccagggagaccgccatccccattggtctggggctgaaggagtctca

SEQ ID NO: 38334 - DNA, 1428 bp, Bovine  19866880815329
gcttggtgttcctgctggtgttcctggtggagtaggtgagcttctgatccggcctatcactgccactttctagctctgccacgtgaccatgcacttggttctcctgatggtacaaaagggatcaaaatagtagattgtaggtcagtcactatacaggtcgggtgaggtgatgcctggaggggtggccaaagcagagcgtcacccccgcccacagtgaccgtcacaggctgagaaacccgggggcagaggtgacccgggccagagtgggttctcatagatgcccgtcatgattcatctttccaggtgggtgatgtcaccacccgtgaaagaggtgctggggacacatcatccttgtgtaaatgtgagcccactggcgcctccagaccagagcatggccacttctgccaccatccgcggctgcgtcgggtttaacgagtctgcacactccttggccatgtatttcttgctctccaggaactttcagcctacaagactctctccctcagtttcctgtaactgcactggagtgtccagtctgctctaaccatcctgtgagagcaatgtgctggtggtcataagctacaaagtgcttcatcagcccgaattattactttggtaaattatttttacatttttaatccaaaggagtgaaataaaccagcataagcagaaaaacataaaacgcaagaattgctttatgggcccctggctgagatttctgaacttgaacattatatgcgggaaacattagatgcagtaattatgtaatgatgcttcactgtataactattatctttcttattgtcacttctcccttcagatgagggctggagggattaaccctctcccttctgtcctcagaagagctgtctacagtgcatagagacatccagagtttacagggcctgagagagaagatcttgcaggtcctagaagcacttctaaacttgatcctttgtttcttggtatctcaaaatatcaggaattaaaagaatggcaggaaggcatcaaattaaaatagattcaggttaatgcaattagtgaggatgcatttagcttacaggcaggtggcgctagtggtaaaagaaccagcctgtcaatgcaggagacataagatgcgcaggttcaatccctgggtcgggaagatcccctggaggagggcgtggcaacccactccagtgttcttccctggagaatctcatggacagaggggcctggtgggctacagtccaccgggccgcagagagtcagacacgactgagcgacttcacgcacatgcatttacaatggggtaggataactttgttgtgcacagttcttgggctggttctccttcctgtagcatctgaaatcagccgtggtgcacagcgcagctcagagcaggcatgcggtccaaggggctgagccaagaaatgcagaaaaggcttc

SEQ ID NO: 38335 - DNA, 3722 bp, Bovine  19866880984052
ttaatttaattaattgtgtttgattaaatgaggtcctttcattagcccacttagccacgaaccatatatacatcatcataatccttttacaagccccaccgcccagacagagacctgacatcagagcatattcaaatcaccagcctcagccatgcagacctccctgcataattaacaactcaacgagctgcagtcacttaagctgaaaagaaaactgttcacatcaacctctctgatactgtttaaattgaagatgtcacgggtaaaacaaaggtgaacagacaatggtaattaaaaattaaaaaggacaaggggagtttgcaagtgatggcagcgcatggaacgagggctgggcccgcttcagagaagcaccacggagcgtgtgggtgtgcggtcccttctgggagggtgtggtgtggacggcctgcaggacagagaagtcggacacactttacagggagggtggacgagggctgagctcggaagccagaagtgactctatcagggacaaatggaattgtcgcctgagctgcccaaagccgccctttgtgggatcccgcagtgatcgagaggcgcgaggcgtcctgacggggccctgacgtttgctcccctgcgtgtctccactgcggccaacatcaggtgtcacactgggccccacacaggagcctgccacgccgctgccacccggcccacctctgagggccagttccttaaatggattttcctccagacgacatgacagagccttgacataaaatatagggatgtctgctggaagttattcatcccttcctggttcgatgcacaaccttccagggatggttttaattcacactgatcctcgagtataacaaatagtgtgctgtgtttcagagacagaaccggggccgcattgcggagagaaggtccagacgcaaaatggaaggggcaggcggtgttgccaggctgtggccacaggagcacacgaagggcagtgtgagagcaattaggcagaggagccaaaagaccacgaataaaagtacccttgaggcacagcgggtgatgtccgcgtttgcagctacttgtcgggattgctccttgcgttctggacgtttggatacagatgtcacagcaagatacatagagcctggacttaggggcatttgtaccatctttagataactacctggcagtcaccaacataaataatagtacatcaaaggcaaatacaaacattccaaatggatcgatccacatccacagatatattccattaacgatgtctgagaaatataaccacaactggacaaagaagcaggatagatatggctcagaaagtaacatgtcttggcagcaagaaaggacttgctccttttcatgccagctgaggagggcagtctctttctagggagataaactgaagcagatataagctcacgcacccacggggcacggccacattggagatgctgagagtggtaacgctgtccatgctggtgacttagctccaccgccatgctgatacagcccgcccgggagtagggacaggccctctgcaggcacggggaccggcgcccgccggcagtgcaggcgcggctcgggctctgaatgtcccgctccggccccaccggccatgtggctccaggctgccacggcgcctgccttcggcctcagtgacaggaggcttcacttccgtgccggggctgattcaggctctaggtcagcttagaacagagcttgggacaccttcagcccctaagtcacgttcacttatattgttatcatttgttgcatctccttttatctcccggcacagatgacggcagcctcggtgaccctaggctgagcgacgtcaggcgtgtcgtgtgtgacccgtgacgcaggagacgaccacccctctcccttcttagcatctgcgcagcccgccctctgcctccggccgcctcccagctcctgggtctggaccctgggatgcacttctcttcctgggcccggtggatcccaggaccgtcctcctcccggcaggtggctggagtgtgagcctgaggctgcagacacaccacccagcacccctgcttcctgctggctcccatcccggtggctgggtagccacttggaggggccacgtggacacacccaccaaggccaccgcaggtggggtggcgtctgcagcttaaagggaggacaaggaggtgaaggtgaaggttcccggaccacccccccagaggcccactgttatcagattagaaaagtcagcgagcatttagcatctagaaccctcccaatcaccccggaattctgagaagtgtttgtttccacatcttttttttccccttatgccaggtccatagcaagttttaaaacacgaattcaaatacattcttttcaatgaaagaataaaatgatgaataaatgaatgaatcaaggagtaaaaacatccatctttagtggttctgttccaccggatacacaatgtcatagaaccttgagaattattctgaaatctcattcataacacatccctcccaataacaattttgttcagctgccgaaatcttaggagtgtaatacatctttcaagaagataattcaaatacagggtattgctttttatttattttttaaaataaactgtgattgaaatagaccttaaggatttagggaaactaatttgagagtttatgttcaatttattaaaacaataaaaatcatcaaaaatttaatttaaaattaaagagactagagttctttttacccagaaacaatccagtgcttttttaggagttccttcccaacacttcaccccatcaattgctttctggtggaaatgacttactgcgatctagcagccatggtgatttttcagaatctaaaatctgaggaattctcacatggccctaaaagcagttcctttcctgcttgcccagcatgacgaataatttaaaatgaggacgtgaaatcgatgactattagcttggagtctgcagatcacacgtggggaaagaaaactaataaaaaatatgtatgacgtctggaaagtttcacttctgttgacaaaagcacacgggcgcgtctgtgtgtgagagcctgaaacatcctccccagcaataataagcccaggtttcctccccagcagggggaacagagacagctgtagagaaacaaagggtatatgaattccaaataaaattgctgaattaagtcttaaaatgaagattctcaaatgcagaatacaggaggtgttctaggggagaaaaagctcgatctgatcttatgtcataaggcacagcttaaataaataggtaatgcgaatgaacccgcagttctgtgcgggaagcagcaataaagggggtgcctccaggggcagatgagcgcgtgcgcgagcaaaaatgtgagtgcagcacccgcgctcttctgtggagctgctgcgcatttcaggtggaaaacactcccaggtccttccaagctccagcggtcacgaatgcgggtgtggatccctgagctgactcggtgccccagaaaggcagaggcaaactggcggtggctcaggtgcccaagtagcttgggtttagctacttccataagatgcatggatcgccagttggcaccatcacaaggggccacctggaccctgtgggagcctcagagggttcccctggcatgagctaatagagggcaaagccaccttcaacactcgggcccatctcgggggccgcatcttctgtccaacaccagcaatactg

SEQ ID NO: 38336 - DNA, 735 bp, Bovine  19866881039624
ctgctaaaaaggttaacatctccgagtcgccggttaagttcgcgctgcagcctgatgatatacttaacagcagcaaagcgcccagcaaatttcctgcaacattagctgcatttaaaagtataatcttatgcagctttttcttgctcaacaacgtttcagaataatgggggaacgcgtctatttacaagggagaaaataacacacagtatttaacactccgtgcgatgcttacaattcctttaggtgcaaacccgtaaaaacagacaaggggcttgaaatactctccacaagcagaaaagcgttggaacctgggggaccataaccaagtcgcaggttatcaaaggctgaggtttgtctaataagtgggtgcagggcgcacgcgtgtttttagacgtaattactatatgcagaagggaaaggcttagcccttctaactagcacgtaatgagcccctcatcaatagggtcctttataaggcttctctctgtgcagcagggcagaactgactgctgggctgcgtgttttgtgtctggggctttcagtctttctccaatgaaaatacatcattccgagccactcttccaatacatcacagtcattttcggcacttgagttgtttttctctccatttttcttacaaaatcaagcatcattacagcaggtttcaagtgcacgttagtgtctgcaatctacccctgcttttctttaatatttcatcattaaatagcaaaataa

SEQ ID NO: 38337 - DNA, 788 bp, Bovine  19866881328194
gtgaaggcactgatgaggggctggcactggggaccccgatgtgtgtccccaggataggacagggaacccaggggaggtgtgatgggggttcaccccatggtggactaccagaggagaagaggggctcctgtgagcaggggtggagggggagcctggtcaggctgcgggcaggggaagcgtgtgtgaaacacactgtgctgagcgggctccctcctggcacaccttctcactgtgcatctgaggggcttggctgcaaagggagacatttctggaattccttaagcagcagcctggctggtggggctctgagaggctttgagtcactcgggttctgctgagctaacaaaactaatgagatgacaccaaccttccccacgccaccggggtcaggcttcgcacctggagctgtcacttctgatttgccgtgaaaaagttatagataagagagagacaaacaaacaaggtaaaagaagtgagaaaaaaattactcaataaaaagcaacgataaagcagtaaaaataagcagctacggcgagagcagaaatgcccaactggacaaaaccatcaccgaaggccaggctgagtcctccgcctagatgagaaacaaataaagcaataaagcatgtctgcagggtcaggcctgaggtccgactcggggcctgggaccagggcgggtcatgggtgaaggtcctggcggtggcggtccctcccgctgaccgcagccggggcgccggccccgacctccgcacgaggaccgcggcgggcagagcgcgggcgggccgtggggc

SEQ ID NO: 38338 - DNA, 1074 bp, Bovine  19866881388000
ggaaaaaatgtacaacatcttgagcaaaaaaaaacccattattttttcttgaattttcacagggtatcaatcttaagtatttaatagatagatggcatacatataaatgtagacatatgtatatatttgtaattagattctgtaatgtgtgtacttaagacaaacgtatttgctctccttatctgcgtcctattttatcttttagttggaggctgtttaataataagaaaagtaaacaaataaaaaagcgaataaataaagtgtttttcagggtcagctatttttctcatcttagtgcatgcagtactgtacatttggtagtacttatttaatgcttctaattaagtggaatgcttttgctaattctgaatcttcatttactgtaattgtgggcctaaacactcccagtaggattccttccgagatggttttaaattcactgtgattgtgcacatgggtggctgcaggaataacctgtttaattcctcagccgtgcaggctcggcacaaagttgagccatttccataagtgcgccttctctctctggaggcagttctttgacacatcaaatgaacgctctctttccccagtaaacacgaaacacttgcacttcagtcccctcgtcgctgcacgtctatgcggaaacttctgcggagacccactagcgttgctctggtcgcatccctcttaccgccagaggtgagaaggaagcgagctgtctgaccttcctggtgccctgcgccccctggcggggaagtgtgctggtcccccaagtgtttctccaggactcacagtcacttcctctttacacaactcctgaggctctgccaatccagagctaaagatacttcgtaattaaaaagttaattttcaataaagttttgtgacccattttgcaattctcctctagctttggagagttctcggtctacgagttgaccaaccactctctactgggcgggaaagaactccttagtaggagtgatccagcctgtgagccggccaagctcaacctggtgtgagaaagatttcctctatgcaggacacgaattagacagaagtagagacagtcaa

SEQ ID NO: 38339 - DNA, 1409 bp, Bovine  19866881585911
gtgaaattcacgtagctatgaatatggattaaaatttatagctggaagataattcactggtcacatgcctctaattagcaggcataattttgaagagctaaaagctgcctcttcaaacacagcttgtattttgttccactaaaacaggatggtggtttcccttgaatggaacgcgggcagctccccgccaagtttggaggaaggctatggaggtgtctgtccagtgtggtcatgtgggctctatcacttcattattttccacgggtcagagccagcagtgcacttacagctgcaatcctgagaggtacaggaaagtatccctcacgtaatgcgtgctgcgaactgagttacatggaggatgagcaccctctccttcacatgatgggcgctgtgaactgactcacatggaggatgagcatcctggaccatctccactgcagacatacataaggtttcctgatgtcctggaccatgtccaccactcctccaagcaaacagttccacggtcctgattcagacacaaagtagcccctctcttggctcatttggacatgaatctttgaggctgtagcatgctgattttatcgctgcctctattattattattatttgtttaaagtagtcagcatcccacggtgcatctttccttttgctcacggtaagcaaggctaattaaaaaatgcccaacattcaatgtaaaatatttgccaatgcaaaacaaataaagctaatcaacctcttcccctgtgagcccacattattagtgcaaagcagatgcattaaagcaaggatcagagtcagatagaggagaagatgagccaagtggctccagagccctgacacccagtgaggtggtccctggggagctgggccctacaggaggccgagcatcacaggcccagaatccaccaactggacagagatgggagcctcggggggtggtcacaggcacatttgtatcaaagttcctgaaaactcaccctaggaaaacgtatctgccaccgttcctaatatccaaaaagtgcactcaagctattaagagagagaaacccaagccatttaaaactcgtacctaaattgttatcgaaccacttcctccagcaattctcaaaatcctcccagaggagcacttattaatatttctatcatcttaggtattgtaggtcatcaagaaataaatatcatttatttttattctttatttgctatttctgtttctccgtttattcttttacttaaatctcttaaataaaatatctagtttttcctttcaaaatagttttattaatgcaatctcccctactaatgttagagagaaatttctgtgtctctaggctgccaggcatggttccatctttccatgaccatagaactaaagaacacactctcatttttttacatttttgtag

SEQ ID NO: 38340 - DNA, 2556 bp, Bovine  19866880407736
ctgttccattttatcagattctccccccggataagtagcaaactagtaagaaggcaaaatcaggtcaaaacttagacatcaagaatatcctttcccttgttcttaccacctcttaaatatggagacactaaactattcccctcaattctacccacctggaaatccattgactagatgaacagatctctttcttttccctcctccttgtccttatttcacagccagagtgttgggctgaatctctgaggtcttctccagtgcttagtctctgtgaattcccacttaacctctcccttcttcaggcaagaatgccacccactatcacagacagccagtagcctgtcttcatggagtgtgtacataggctaagccttgggctttttaatcctagatgaatggctaccagaaaaagatcaaagatgctactgaaaaaatgatggctcttgttgctgagctgtccatgaaacaagctatggccattgaactccaaaaggaagtcaaggagaaggaagagttcatcttcacttgcaattccaggatggaaaagggtcttcccctcaataaagagattgagagagaatggttgaaagtacttcgagatgaagaaatgtatgccatggccatcgctgaaaagtctcgggtaagctatggcttctttattttctacattgcatttgtaaagtgtgccaggaagggctgtttcagggattgtcaatctcccaaaatacatgaaatttttctactccacagcacacagagtcccaacaactcattagagagaagttttgctctttttaagctattacgtaggtagtcaaaagtacaacagtgcaaagcgtcagaatattccctggagaacatttggcaagcaccaagtcccacgccagggcctcccactagcatggcaatgtccatgctggcattggttttatcttagatctctggtctctgtctttgcagccctgctcagaccataccttactcttcgatgtccatctgctgtggccaccacagcatattgtaaggcctcaagcataagctcatcacaggtttctgaagactctacatttggtgcaaaagcgatgactccagcgccacccttcttctcccaccagtgacctaactctatcactgaccccacttaggagctgtgtgtccagttctttttcctactcccatgatttttcaataatcttagagtggaattaggcatctctttcaaaagagacctacaacttactcttgactatggggcagacatccccagaagatcactattcactctctaagccaagaaaaaagtgtattccaaacacatactaagaattcttgaaaatagggtctgacttatcattctcacactcactgcctaggattgtatttttgaagacattcagatttttacctgtggtgtcccagctgtcatttacctgtctccattttcccaacccaccccccccccccaagttctttttaatgctataagagattcctgttttccagaaacacaggcagaatcttgaggctcaaagcaagctgctgaccactttcctctaattctattttactcttcctttgtaccatttgctcaccaatgacctaccaaaggaaatagattatcctgcctttgtcacagacatggaaataactagtgcttaatgtaagatactaagtttggaacatggtgactttaggccctatcaaccagtttatggtagaccctataccccaggaacagagtgatgcttgagcaacatggctcattctagtgagaggaaatgtgtgtgggggtgtgtgtgtttggtgactctaccctcacacccttttgtcccttggaatattggccagcatagccaacgggtgctcagacccagctgtgtctgatgggccctggggatgaagtgacttaaccactgttttcaaaaactgaaaaggataaatcattctttgcaggagttcttggaagctgaaactcgccagctgcccaatggtgtttacacaactgcggagcagcgtccaaatgcctacatcccagaggcagaggccactcttcctctgccaaaaccgtatggcgctctggctcctttcaaacccagtgaacctggggctaacataagacacataaggaaacctgttataaagccaattgaaatctgaacatgtgaaccaacccaggcttctgaaggagatacttcaaccaggcttcttcacatccacagctggaaaatgtcagcaaacagccctaaattacaaacaaacacagtatccacaattacccaacagacgacaacatatacttccttccattcatactcatcgatttttctttttcactccatctcttgattacatttcagaaatatatagtagtctgagtgttatacaaatgcaataaaaataaataccttttcaacaaagtacagaaattggcagtggtctttattacagaaagaaaaggagatcctgctcaatatattcattttaaagagaaagaaaaaatggtttaaaagaaaaatatcccaagtatcacaggggcataactcactttgttaagta

SEQ ID NO: 38341 - DNA, 1644 bp, Bovine  19866880421216
tgttggcaaagttacagctcatgtgaaatttaagctggtttgccacatagtctcatccagctcagtgtattctgtgctaaacaccagtgatttcactttaaaagaagatgtttaccaagtatgcagatttggtctccaactgctatgaaataagataaatctcatataaaagtatttcttttctttctaatgactattggagcatggggagtctcacagccttatacaaaaatttgaactagtttctaaaacacagatcaaggagtgttaaaatatgattatacctatgacatttctattctgtaaataattcacataaatcctcctgctcaacatgactaggtgctataattcctaaacttatgaagtaaacatcattatgtgatttatatttcatattctggataaaatgaggaaaatcaagggtggggtgatgaagccagaaagagaagagactcagaaaaggagactaggaaagtagggggaggaacagtgaacaggaaggacagtggcaagagaagactgaaacaataaagaaaaataacgtggcaaagccaatcctctagcccccgaatctgtttgggggtatctaggaggcaacaacaaaagcactacccttgaggcagtcacctggtacaatatatcacttccctggaaaagatgaataattacaatattagaaagaataatcagtctggaatattactaaattctaacaaattcacaaatctagtgctaattgaagcagacaaggagacacagaaatggaaacccacattcttcctggtcttaagtatatgtgacattgaaacctcagaaaattcacataccacagactttttcttaagtttcctgaggatctgatgtattccaagagattaagcattagacacaaaaattaatatataaaatctattatattgctacataccagtaatagtacatataatgtttttaaatgtgccatttatgagagcaacaaaaaactaataatagcccaggagtaaatctagtaaattttcatggagaaaattctaaaacttgttaagagtcataaaaaggctctaaataaataacaggctatatactttgttcacaattgggaagatttaatatcgtaaagatgcaacttctcccctagctgatctatagattcaatgtaactcaaattaaaaaatccaacagactttttggtgaaatctgacagggtgattccaaaatctaaatgtaagaacaaggagcataaaatagccaagaggaccccaacagagactgaggtgaggagacgtaccaattaccaagacttaacagaaagatagttactaaggtgtcttcaccttatattgaccaatggaacaaaatttaaaacccagaaaagaagactcacatgcatacggaaacatgatgtttaaaggaagtggttttgctgtcagtgagaaaaggtagggctatctggttagtgaccgtagaactactagctattaacagagaaaaacaatgcagttgacaaaagaatattttaacacatgtaagctatagataataacaaaataaaaccatgtaacgaccacccagcttaaaagtaacagatatcaagactacttctaaaggctgccagtgttcccctattcctatatcacatta

SEQ ID NO: 38342 - DNA, 1647 bp, Bovine  19866880569179
agtgggcagagggagactactgtaccttctgctgtgcccaggctgttggaaaataaatctggtggtttccagtccccagccacagcacacagacccaacatctgtgcattcgttttcactaactgctgtttcccaatttaaaacccgatcgtcttcttccttgttggcaaaggtgccttggaatttgtgtcgctgagtcagcaagcctttcagatttgcccggtttttgttgtttgcgttttctatcaagatgggaatccacacaagtcattcctcctaaggatctggtatcttcatcaataaggcacggtttgtgccagctctccacagagaaaaggtgagagccacagggatttcacgtcgctgcctttccaatctggttttcagtagagaaagtgcagactgggaagggggaaatttgaggtccccaggatgaaagtgagccctggaagtggattgttgattgcctcctgtctcagataaattcaggtggcttcttgccaacagcttctcctgtttaaccagtcttagaagctactttctgttttcacacatgcgttatgagacgaaggacacgagtcaggatttctgcatcgaaaattttaatttccttggtcacttgaacctttactgggtgcttccttttggtcagccccttttgcttggtgctgagcgtgcagtgaccagccataaaaactctgtcttccaggagctcatcattcagtgggaaaggtaaagaaaccatagattgcaacaaagcattgtcggtgtgatacatatagaggagtgggtaatcacaggcagagcccaccccacccccacccttgcccagaagggaaggtccagaaggctttgagaacgtgagagccaaagtgaattgtgaagaaggagtaggacccaggaagtatgggacgaagccaggcagaggagtcagtaaatgcaaagttgtgaagagacccggtgtgtctgggtcactgtaagtgtgactccagtgtggctggggcatcgggatgggtacagggctgagtgtgggggcttttgcgtgtcatgtcaagacttgggggattttagcggagaattccaggaagggccttgctaaatgagcaccctggctagaaagcatggaatgggttggattggatcattctcctcgtgactgtttccttacatcacgccagcttctagtacagggaggtagacagggaagcttgtgctctggctgttcctgggcttgtcaaagagatagaatggccggagagaactgtagaggacagatgcaatgctgtagaagttgatgagaggggattttcttgcaagagggcacatcacggcatcctggaggtgtttaactggttggccaagtgggtggggttccaggtaaagttgaagcacagagttggggaaaccggatatatatggggtatcgggtcatcacttaaactctgtggaaggagctggggagggggaagagtacacgagagaggggtactgaagggagtgtgccaccaggtagtgttagggagggaccaggctggtggactttcaccgtgagccacggaatgtgaacattgtttctagacctcgaagggaggtgtggagagagaggggcaagactgtactccaggaagctccgcctcatccctgtct

SEQ ID NO: 38343 - DNA, 2192 bp, Bovine  19866880690108
taatttcatggctgcatttaccatctgcagtgattttggagcccaagaaagtaaaatcagtcactgctcccacttttttccccttctatttgccatgaagtgatgggaacagatgtcttgacttagtttctgaatgttgagttttaagccagcttttttcactctcctctttaagcttcatcaagaagctctttagttcctcttcagtttctgtattagagtggtattatctgcatatctcggagaaggcaatggcaccccactccagcactcttgcctgggaaatctcatggacagaggagcctggaaggctgcagtccatggggtcgctgagggttggatacgactgagcaacttcactttcacttttcactttcatgcgttggagaaagaaatggcaacccactccagtggtcttacctggagaatcccaggaacggagaagcctggtgggctgccgtctatggggttgcacagagtcggacatgactgaagtgacttagcggcagcagcacctgcatatctgaggttgttgatatttctcctggcaatcttgattccagtttgtaatcatctagctgagcatttcacacgaatactctgcatagaagttagataagcagggtgacaatatacagccttgtactcctttcacaattttgaaccagtgtgttgttccatgtccagttctaactgtcatttcttgacccacatacaggtttatcaggagacaggtaaagtggtctgttatccctacctctttaagaattttcctcagtttgttgtgatccacacagtcaaagactttagtatagtcaatgaagcagaagtagatgtttttctgaaattttcttgctttttctatgacaatttgatctctggttcctctgcccattctaaacccagcttgtatatctggaagttctagtttcatgtactgctaaagcctggcttggaggattttgaggattcccttgctagcatgagaagtgagtgcagttgtatggtagtttgaacattctttggcattgcccttcttcaagactggaatgaaaactgaccttttccagtcctgtggccattgctgagttttccaaatttgctgacatattgagtgcaatactttaacagcatcatcttttgggattttaaatagcatagcttcttttactctacttgtttcttaccattttctttttttactccttttttactcttcactatagttttagaattatgatagtgcagtaaatataggtggtataactctatgagtatcccttaaacacacgtgaagaaaaatactgctatttttgatgctggaggaaggcactgggaagaatggtttcagagtcctgtgtttatcctggaaaatagattttcattggaagaagggaatatttgaagtttttttttctttgttagtcatatttcaattatttattattcctgtcccaagccttttaaactcttggcagaaaaaccactgaaatctcacagataggtttgccaaactggcctgaaaaataacagtaattacttttttccatggattattttagtgttatttggttcaaaacttggctttgtgtggtctgataaatattgtgatgtttaggttgaaaatgcgtagtcagtacatttaagtcattttttttttttttttttacattttttaacttttagaagaatcattatttttcttccatgtttcccaggaagtacaggggtttgtttttttagttgtgctgtagtagattaagttagagtggaagaagagagtttgtatagatgcctaaagctatttattttgtagttgcgcataaatctctgactgggagtgtgatactgagaaaaattgtgcacgacaataataatattattaaataaccttgtggatatctaaccatgttttagaacattattaatacatttcctttctggattacccctaatgtgtaaagctttctttttctctcttttgcaggtaatataacattacgaagcaagatgggtaacatcacagtaggtatgtgctaagtggttgttagtaaattttgtattctttttaaaatagctatatttgcggtattttattagagtacataaaatctacaatttagccgatgaacctaatagtatcctgatataccagtcagatataggcagacccactatagaactgaggatga

SEQ ID NO: 38344 - DNA, 2187 bp, Bovine  19866880725163
ctttctgtattacataaagggtctacatacatggcagtcctcatgataagcattttgttctcttatgtctatagggatgtaaccccttcagttcagttcagttcagtcactcagtcgtgtacgactctttgcaaccccatgaatcgcagtatgccaggcctccctgtccatcaccaactcccggagttcactgagactcacgtccatcaagtcagtgatgccatccagccatctcatcctctgtcatccccttctcctcctacccccaatccctcctatcatcagagtcttttccaatgagtcaactctttgcatgaggtggccaaagtattgaagtttcagctttagcatcagtctttccaaaatacacccaggactgatctccttcagaatggactggttggatctccttgcagtccaagggactctcaagagtcttctccaacaccacagttcaaaagcatcaactcttcagtgctcagctttcttcacagtccaactctcacatccatacatgaccactggaaaaacaatagccttgactaaatggacctttgttgacaaagtaatatctctgctttttaatatgctgtctaggttggtcataactttccttccaaggagtaagaatcttttattttcatggctgcaatcaccatccgcagtgatttgaggaattaaaaggaaactcaagatcaatctctcatacaagatacaaaaatatattttgtttcctcattggttatatgaagatttttaagtctctggaaatttagaaaaatgacagcaaaattaggtgccacaccccatggatctcttggatcctccatgatccccttttggtgtgggatacatagtaaagagatttttgttgataaggtattgacagatggacatcccaagactcccatggaatattccagtttcataaaattctaatctgagaatccctggataccccattgaagacaggctattagtacatcaagtgattatatgttctgtagtcttataaagagtggacctttggatatttctgttgatccagaacccctgtaaggacccacatagtggatctttcatggtaggtccatgctggagggattcctagtctaaatcgcttcatctatgctagtgtgaagtacttgcaagatgtaacaaagaacctaccaactgtcattctagctttaaccaaaatcaggcaattcttgatctctctgtggattgctgaaatcaggcttttgtttaaagttctttccatgagatacacaatgaacctttaaggagtattaagataaacagtatttattgttgacatttcaagtagtttaaaaagtgaaagtttaatttttatcacgaaatcatacactccctaaagaaccatttaataagtcagaaactacaaatatgttaaattaataggtgtaatatcaacaaagggatctcaacattacaaataataattattaaatttacttaactccgtttgataaaaatagaaacataaagggtttctttatttaataataaactctattaagggaaaggaaaatgtgcttttggaatctgatccagatacagtaaatgcagatcccttttgaatatactttgcataaaaaaaagaaaagaagtttgaatatgttgtgagcattgactgatgaaagcacttttcacataggccttataaaaacatatcttactactttaaaattccaacatatattggtgttcatttgttcagatctgaaaaacaagtgggcataatgtgtcagttttatgttgaaagtggatatgggatagaaggttctgactgccatcatcagtagatgatcctaggagtcaggacaggcttagcatgagaaagtccacaatggtttcctagcaagagggagaatcaaggtcagagggtgggaattttgtgcaagttgaggacaggaagtcagctcttcaagtttttggtcatttgatggctgactccttgaaaccctctcccctggtctttgtgacactgtactcttctgattctgatattttacaatccttttggttcctgtggtttcaaattgacatccatttccattctgtgttgtttgtaatacttagatattcaactgtatattaggtatttctactttgcatcttgtcactctattcaaaacagaaatattactgctacactctccccaa

SEQ ID NO: 38345 - DNA, 1695 bp, Bovine  19866880799838
tggaagcagggttcttgcctggagatcccagggacgggggagcctggtgggctgccgtctatggggtcacacagagttggacacgactgaagtgacttagcagtagcagcagcagagtaacttagcagcagcagcagcagagtaaccaatggaggcagtttttatcctttcagacaagacagaatattttagggtggtgtattctgccttccttcaatgctgtatgcctcagcatagttgaaatatagtcttggcatttaaactcatcatgaggtcagagtctaatttaggaaatctagccttacattataaagtggcaaattatggcaatttctcaggtaatttaaagtaacaatcactttctcttccacacttcaggaaaatattaaatagcaaataaatccagttatgcattgggtcaatgcaattaaatgcaattaaatccagggctcagaataaattctagaaggaacactgtttctatattactcacagtgactatagaaaacaatttttagtgttgaaacacctttgtactgtaggcgtgcaaaactatgtttgctaacctgaactggcaatagtcttaaaatagaagcaaaagctattgctaaaaataatcgaataaaacaaggatataagtaatttatgtttccaaacatctcatttgtaaaacttacccatcatactctagatctcccttcttctgcttttcttgagattctaatctttctaactcatcattttatttcctacatcacattaacacttcactaactctggaatttaacccaaaatccaacttttgcttttccatcccaaactcatgaaggctatatgatggatgcttgataaaactaaatctctctccctctccctctctctctctcaaagtaaacatgtaaaactactgtttctgcaattatcatcaaacacttttctctctgctcccagagcagggactgacatgttaggacatcctatgaaaatatgttgtgaatgttttatgaaggtgcttttacttaaccaggaagtccggaaggaggagaatgacctaacctgccacattttctttatgagaacatcttcctggtgatctatagcttcatgaagtagtcatggagtttcaaatttgcccttgaatcctgggtcaagcaatgccatcaacacatattctttcttgtcacacatttcaatgaacttgtagtcaagtcaatatcattactttgagtttgatttgtgagtattccacaaaaatgtatttatgctcattaataataaagaacagagaaggcaatggcaccccactccagtactcttgcctggaaaatcccatggacggaggagcctggtgggctgcagtccatggggtcgctaagagccggatacgactgagtgacttcactttcacttttcactttcatacattggagaaggaaatggcaacccactccagtgttcttgcctggagaatcccagggacgggggaacctggtgggctgctgtctatggggtcgcacagagtccgacacgactgaagcgacttagcagcataataaagaaggagaaggggatggcagagaatgagatggttggatggcatcactgacttgatggtcatgagtttgagaagctccaggagttggtgatggacagagaaacctggtgtgctacagtccgtgtagtcacaaagagttg

SEQ ID NO: 38346 - DNA, 1621 bp, Bovine  19866880842798
agaaatgcatatttccccaatttcctcaaaataaattgcttaaacttgagtcatcttccccacacaagaatagtgtttttgatgttaaaatatcatgttgattatgacaaataccaatattcagaaaaaaatatgcaaaatacccgataaatcagagcaaacttcagcctgtattcctgattaaaaaggaaaaatcaagatacaaaatcaggataattggtgagctcaatccctgcactggagctggcagtgggaaacatttagaaaggcaaagagcaggttcactgagaacccaggaatcatcctgcaatctctcttccaaactctttacagaaagaaactacgtggattgtctgcagacaaggcaaagggaggggcaagtgttgcttatatatgtgtatatacaactttcaatgtctagtgaggtatcagaaacacttctcaaggattaaaaaaaaataatcccttggtctcttaggataatagtatgattcagttggcttactgctgaatagcaaagaaaaggtaaacagaatgaactgtttcctctatcatacttataataggaaaatgggtaattactgaaaaatcctttaaggtagattttgcagacatctaaagagaatttctgtgagttatttttcatcctgcatatgactcaaaactcctggaatgtaatgtgtcaatattttgcaaagtattttttttttctttccagattataaggatgctgggactttctcaaaagtacacttaaaaggttttaactaagataagaaactcctttataagaatcttgctaagaaaatccaatttccttgcaaaagcacacctattttcaaatcactataatattaagagaaaaaaaaagtcttcaacaagtgcagattacaaatgatatatgcttattccattaactcaggggttctcaaggctggttgtgtcagaatcatcagggggaaattttgaaagaacatggatgcccaaatcctgcccccaaatattctgatttttttgagctggtaaaggtcctgctctctcctgtgtgtgtttttaagttcgctttgttactccaatgggcagccagaactgagaaccactgaagtacatatttacaatatacattaaacaatatttattagacagcacaattataaccagcttacaatgtaatcattatatacagatttgaaggaaataataaaaattatgccttcatgggtctattagggagcaatgattgcagtcttaaataattctgcagttaagcacatggttctcatctctatgacatttgcattagataaatttggcaatactggaaatccagacactggcatctcaccacacactataaacccgctagcccttcctcttcagattagctgctcatggtttagacacacccttttaaaagacttattcaataacctctttgcttattcattctgactattctcccacagttcatcattggaaagtccaggaggaagtttagcaatttcaaatgaggaaatgtggtttagttttacagttagttaaatcagagttcatgaagaaaaatgtagcattttgatagttacttgcataaaagtaaatctattataaaaaaaaataagta

SEQ ID NO: 38347 - DNA, 1067 bp, Bovine  19866880924336
tgcttttcaaccttgtccgtatgactcaaatcaaaattgatgagaaggagcaaaaatccaaggatttcctgaaagctcaggtaactgcatttttgtaaccattcattaattaccacaacagtccagggtagcctcatgttaatacaatgggcattagaaaactatgactttaagccccctgcaagttcagtgactacacagcttccctaaacaaaactcaaccatgtaatgaaaaacagtcccaggattcagctggcaatagtcaacaatctagaggaaaaaagaattagattaatgacaatgagcagagatttgaacagatgacaatttcagtaagaataaggtgagtacctccaggggaaatggctgacaggctcaaaggcacaggtgtctgtgattcaccaccatcccacagtccatcatgatctacccagaacaactcaggagccgcagcatcagaccactctccttcccaagttcatcgagtcggcatcatttaaaccactgtgaggacagttacctttagtaactgtttctccctatgcctttcctgggctcctgaccaagggccagagctgacccagtgcaacatccccaaacaaaatcaacaatgaaacaatagcaaaacaatctttctatgataggtaaaatcctaacattacaatcatttattccacgtaaggattgtgtccagagaccctcttttaaaaattattatggcgtttccctggtggtctagtggtaaagaatccacctgccaatgcaggagacatgggttccattcctggtccaggaagatcccacatgcctcggagcaactaaccccgagtgctgcaaccactgaggactacacacttagagccggtgctccacaacaagagcagccaccacaataagaagcctgagcaccacagggaggagtggctcccactcgctgcagctagagaaagcccacacacagcaacgaagacccaccaccccaaaagctaaaataagtatacaactcttcttaaaaatgatatgacactactaaagtagaatacctaaatataccatggacccagatg

SEQ ID NO: 38348 - DNA, 2420 bp, Bovine  19866880985392
tcatactcttttagtgatttaaaggtcactaaacaggatccttctgaagttgacactgatcttttaaagaagctgaaatgtgtctttggatgctccacacgcatgaacctgtgcatcttcagtagcatttttttcgcccacagaggcccaatgatatcttgctttccatggcctctcctactgcagagagctagctgctgagaagcacgtactggacttaggaaaatgagacatggtattgtgaaatccatgtaacaatatatagacttgtgatttggatgagctgataattcctacagcaggtcagaagatggagagctccacatagacttgaataatcaaggaaggtttcaaggaagagttgagaagccagtgaggaagactttgatttttcttctggaaagtagagttaattcttcctggacagattggagtccagcaagtatcttggtccctgactatttctctgccactgatgcccaggagcaggctgctctaaatgttgctcccaagtgtaggcaaatctgtacatgtcactgacagggactagagaagcttatacagtttctacagagatatgatgagagcaaactcaactcctctgtaaactaaaggctcctgacaaattttcctggattcaggtctcaggcattttaagttttttccaatgttttaaattacaaacaatactacagtgaatgatactcatttttgaactctgcataactgttttttgacattttctcaattctccacaaacccagccctccagtttcaggagggaattacgtgtgctttgtgaaagaggtaataaggtgaggcattggtagcagagcttcctggctgcctgctgctgctgctaagtcgcttcagtcgtgtccgactctgtgcgatcccatagacggcagcccactaggctcctctgtccctgggattctccaggcaagaatactggagtgtgttgccatttccttctgccttttccttcctggctgcctagccaatatctgtcctccactttgacattactaacagaaccccagttttgttcagagctgcggtgtatccaaaaatcttcaaactccttcaaagttgggggtgatgataagagccagggtgggccaataaaatgtaactggaggggctcctggaaaggtgactgttttagaaagacagtgtcagccaggtcagctgccatatgcattttgctctctgcccttcctcacttctgtatgatcttatgcccagaggcttaatggccattttgtaacccttggagaaaaaacatgcatattatagatgacagacgagaaagctcagaggctctggactttccattatgtgaaactgcttggtgtgtgcctatctttgaatttttttattatttgaatgaagcaacccatatttacttaagccactgtaactgagtgtctattacttcttgaagccaaattaaaaacctgattgatacatctcttccaaaggaaatcttcctaaggtaatctggggaataggctagagttaagctgaagtttccactaatggagaagagaaaaactgatcaagtatcaaagttctaataccgaggtaaagtaatagaccattattttcgagccggcaagctgtatatatagtatgttttgtaagcttattcattttagttatttatttgatttttatagagtagcatttgatatatttttaaaaactgtatgtttattgtaacaaaaaaatgaaaaaagtaggtaaagtaagaaattaaacatcttcactccccacttccacattcagatgctactcatcaggaggcagcattaatagtttggtgtctgtttttcctaacatttttaatacatgaacaaacatttactttcatgaaattaagaaattaggcatattctgttgttgtaaacatcccagttactttgtatcagtgaacttcagtttctttaaggctctgttgtttttctaaaatatttcaaattttcatgaggtctgtggaattctgggagagtctctacagtcaaaggcctaagagaatcaaacagttgtccctagggggaaacaaattttgaagaatagcctgaccccttcttgcttatcttttatcttttctgtttttagaatgcttgcaagtctgaaatgttcaggctgggagtgactggcctgacccactcctattttcaagtactgccagtcagtgtaggaccacggctgggctaattataagtcataagttcaaagaggaagttagtctctccctgaaactgaactagaacaaaagcataggcttttcttgaaatcagggaaggaaaaggacttttattttcatttctaatgctatatgagtgttattttatggacttaataaatagctagaagtagtccaatataaatagcatttctttactaaaatacta

SEQ ID NO: 38349 - DNA, 1949 bp, Bovine  19866881018516
tcctgggggaaagtcctcaactcacctgatctacttccaggatgcatagctcagcccataattactcagacttctgtagactgttaggtcacatttaagtaccagaaatattaaaatccatgaataaagcatacaatccaatacctgaatgtttgaatcctaacaaaaactctttaaagggaaagataagagaatttttataattaaatgggtattataatgtgttatacttaaactgaaagttagatcctcagaatcttttgttatgtacttatatgaaccaattagtcactttatagatttcttgaaatactataacttcaatggtaaccaatggatagcaattgctcatggtaattataaaacagcctattctgggatttcctcagaaaagggtggaatattcagaaattaacacagtttgccaagaagtctgtttttttatgatatttgaagacatagtttttagttttgaaaaaagaagagaaaaccatataatgtcaccaagtataattttaaaactttttcacttgataccaactttgatacccaagcaaagtaaaataaaaatacatgaaaaaaagtttaaaaagtagattttaacaaacacttcaccaaacacagctgtttctagttcactaagtcagtgattacaaaatattttaatgtgcttgctggcaaacatgaagagcctcatttcatggaaatgccacatttccagttatccttgataggttgtaaaatttaaggactggtaactatttctacatatttcttaatcaggaaaagtaggtaagatactgcccatatctcttaaaatatgtgagatgcacctgaatccatgtcacagcagtgtattttactccaaatattgcaaactagcagtcccagatggtgctaggggtaaaaattccacctgctaattcaggaaacctaagagactcaggttccgtccctgggttgggaagatcccctggagaaggaaatggcaatccactccagtattcttgtcggagaatcccatggacagaggagccaggtgggctacagttcatagggttgcatagagtcagacatgcctgaagcaacttagcacacagcagtcaaaagtacaaatctgcagatatttttagtatgtacagtttttaaaattagaaaattagctggtaccatctaaaaacttgtagattttgccataaagactgaatttccagcttctcttgaaaaaactttagatttgatgaccctggattcatattctaacattataataatcaattggcatttagcagagactgactttcagaagtaataaaagaggtttcccccttttaaaaggagcccagtctaccctaccctttcaatgtatgtacaatgtactaacacctaggctgtttcacttgttacctttacagacctgtagtagtaggcatttaacattggaatgctgctttgtttcatgctttattaatacacatacacaaacacacataactatatcagaagtttaaaacttaatgctttaaaatttctgagattttcttactgtttttccattttagtttctgataattttatgaaaagattaaataaataaaaaaaagcccaggtccagatggcttcacagctgaattctaccaaaaatttagagaacagctaacacctatcctgctcaaactcttccaaaaaattgcagaggaaggtaaacttccaaactcattctatgaggccaccatcaccctaataccaaaacctgacaaagatcccacaaaaaaagaaaactacaggccaatatcactgatgaacatagatgcaaaaatccttaacaaaattctagcaatcagaatccaacaacacattaaaaagatcatacaccatgaccaagtgggctttatcccaaggatgcaaggattcttcaatatccgcaaatcaatcaatgtaatacacca

SEQ ID NO: 38350 - DNA, 1811 bp, Bovine  19866881024083
cccacccctctgtctgctgcccctgctgggcctaccgagtacttgcccctctggctgtgtgtgtgcttcttggcacagaccacatagaatgcttaaccattttctcctcttaggaaaccacagtaatatttacatctgtgagtctgaggggaggcagaagggaaacacatgcttttggcatttaaactgataaatttaaatacaggtgaggtcagaaggttctggaactgtatttcctcccactgttgttcctgccatggcaggaaaacattcccgggttgaaggaaagatgagaaacatgagcgaaagggttaaacaggcactgcttgtttttgtggaggatattagctctctgagtcagaaatgctgtgaaattaagaaatcccactgcaaggtcttcagagcctctaactctgtggacttcctggccccgagagccttggccagctctgtgctgtttacatacagtaaacactcatatctctagcatgatcctcccaccaaggggtgtctgatgcctttcgggacctcatcatcttgctttgtaacgtcttctcaccttcacaggcttaccgaagcaaaggcaagaatagaaaacaaagcatattttccatggctagatctctctggggaatatctctgaacatttagtttggtttctgaacatgtttttttttcccccttatactcctagggaattgaaatttttgggcaagacattttcagagtacatgcctataacctttagcttcatattaaaatatcacttagggttggcatgcacatactcagttttgaagagtaacagatgaactccatttaaaaaaaaaaagagttcggcaacatcagtgcacaaattgctttccacagagttgcgtttaagggagtatttattcaaaattcagaagcatacctcataggaaatggcctttctccaagatcattaactataaagatgacatcttttagactaactagctggaatacagcttgtaaaattatgaatagatataagataaatttatttattgctgagagctataggttcctctctctctttttccatatttttaattactgacttaaatttttttagtgtggaaggtacagagattcctatataccccctgtccccacacatgcacgacctctctcattatcaacagcccccaccagaatggtccatcttctacaatggatgaacccacactaacacatcataatcattgaagtccatagataacatcagggttcatgcttggtgttggtcattctgtgagtttggacaaatgtttaaggagatatctctcattgtagtatatacagagtattttcactgccctaaaaatcctcctctacatatttttttaatttgcaaaaatagcttacaggtcagaagatctgtcgactttgggatcatcctgttagttctaatataatttcccggaaccatgtaaagcgactgcttcagaactacaacaaacaggtgagtctgtgtggagcggagccctgctatatgtttttttggagcttctttgtccattttatgaatggcctttcttggtgctgaagtatggacagcaatttatagttcttaccactttaagttcatgcttttttggagaatcaactgactttacagctgtttcccttttagccctggagttctgtaatggacaagtcgtcattcagtgtagaatttctgcctctgaactacttcattcacatcctgacagacatcgagtcctccaatccaggtaagtcactcctgtttctcagaatttgcctgttttccctgaacatccatcagt

SEQ ID NO: 38351 - DNA, 1687 bp, Bovine  19866881162794
cttctctgtataaacttaggatactgaaattaacaatacaatttaaaaatagccatttcatataaaatgatacatatagaatacaacagagtatttattatgctcacttgattctcacaatcttcttcaggaaaaacaaaaaaatcaccatccctatgttgtgaataatgaaagagtctcagtcaagttaactgggaggtttgctgctgctactgtcgcttcagtcgtgtccaactctgtgtgaccccatagacggcagcccaccaggttcccccatccctgggattctccaggcaagaacactggagtgggttgccatttccttctctaatgcatgaagtttaggacttgtcaaattatctttcctgtgtttcatttacctctatcaacatcattgtcatcaacactacaacagagttagctatgccagacaccgtattaagtactttatctatattatgttttaactcatttaatcctcatgacaaccatatgagttaacaccgttattattattccattttccagaaaaccaaaatacatagaggttaaataactaatccgaaagtaaagagcttagttagtggctgtgccaggattcaaacccaagtacactgatgctcaattttgtgctcttaaccaattcagtatgctacctctcaaatatccaaaacatttccatgaaagctgtatattaaaagttaatatattttataagcattttttatataaagccccacaaacttagaaatatgtattaaaaattaacattatgcataatataaactaaaagaaatatcaaaataaatttgttagcacaacacaaaactcagttaggcaggaaacaaacaaacaaaaaaaaacagaaagtaggaataaacgaatattcaatagaccatgaaagttgacagaaaagataaatgatgagtggaaacagtggccaaaatattaaaaatagtaaataattatgatgatttaaatctttgatagttacatctgaacatcagtgtgtactattctacaactgcagttgtccaatttcccttttgtacctccaagaccacaatcagagaggtgaagctaaatgccatctcaaaacaactgccacataaagccaggcagtgtctttcaacactttttaaaaagatacatttaaatgtttcggtttaaacagtctcccacaggttctaaggaaaaggctatgaaaaataaaaaggtataataattagtgtgataacctgccttgtttaattatgccaacaataatctacatataggattccagttcctctctaccaatcatctgaggatatagttgagtatggaactgaacaaatttatgacgaaagagccatgcaaattatctaagtgtaaaataaaagatggcttgtgtgctcagtcatgactgactctttgcaaccccatggactgtaacttgcgatgctcctctgtccatggaattttccaggtgaaatactggagtgggttgccagtttgtattccaggggatcttcctgacccaggaattgaatctgcgtttctttcgtctcctgtattgccagtggattctttactgctcagccaccacagaagccccaaaagatggcttgtgcctgtgtgctaagtcacttcagtcgtgtctgactctctgcgaccccactgattgcagaccaccaggctctcctgg

SEQ ID NO: 38352 - DNA, 697 bp, Bovine  19866880477457
aaaattgatgcagtagctccagggcaaggtcaaagatacataactattatttgataatccctggaggattttcaccttgaaacaaaatggaaaattggttcagtttttggatagagcatcactcagggtaatcagaactggaactaaaaaaccaaagtggcagaaaacacaggaaagttactgcttggcatggatcaacaatttgggcctgggaaggcagggagtggatttgcctttctaattaggtttgacttgggctaatattgaagtgagcttttgttgccggaggagacaccagctgggaggaactccaggaacgtgctgggtggcagagtgaagtcagcctgatattacacattttctctgggtgatccataaatagaaggttcacacatggacacatgagaccagtctataaacttagctctgacgcagaatgtccagagaagttagactcttgagtcactctggataacagtttaaacccagactcggctactggcttgccgtgtggcctaacacaaaatttcagcttttctgaggctcatttttctctcaatctagaaagtgcagatggataagatacacctcaagaggttgttgtgaaggataaaaagcaagtcagctaaaagattatattaacttttattacagaaaccttggaataacaccaaatttcattacaccatgtactgat

SEQ ID NO: 38353 - DNA, 1429 bp, Bovine  19866880541695
ttgctgctagcattcagacattgttctgtaggagttgttcctatttagatgaatttttgatgaatctgtaggaaggaaggtgatctccctgtcttagtcacccatcatcttcttcatttccatcagatttttagaatttttaacaactagaatggtttggtctttgttatttttgcttaattctattacttaaaatttttacagaaattatttttgcttcttcattctgtttggacatctttgaaggacttatacaggctgtctagaagtccacacagtagaaaggtgttattgatgtagctacttaaagggagagaggaggtaatgcaggataagaagaaaggagcttttcttttgcagaccaagatcctggaagttaagaaaacatgagtcccctatggacagatatggaggttgatgacggtggaggcagtgattaagcccattttctcctatccactttacttgattcctttctagtggttcataaactgggagaaagccaatggaaaccaaggaggacaaaaatgatacttagagctcagcgaaggacacagagcaacttttgttctatgtcaaaagcttaggagggtctatttctaagtggtcatgaattctgcttactaatgaatgtggagtttcattttcccagggacaatgaatagcactccgcattgggaacctgatttcaggccagtgttgaataattgctgggttgctgaaagcatccaagtagaatctctccctccacttcactgcttggctcctctctcctcccagctacttcaagctcttataaacagcattcattttcaattacaagctaagaaatgtgattgtgaagccaaggtgcaaggttcctggagagggactgctagggaggctgtttcctcacatctcattttagtttgtaacttgctggtggggttgagtaatcactgaagaacagatcagaatgcacctgctgtaagaagagaaacagtgatgggatgtcactcagagaataggttgtgaaagatgtgatgtccttgctcactctggcactcctcacttgctctgatgaagaaagttaccatttgtgatctactgtctggaggggatgatatgacaaagacctgagagtgaccttttgacaagcagccagtcaggagctgaggctctctgcctaacaggctggggtgaactgagtcctaccaacaatattctcaatgagattgaagagaatctttctctgtcctgcaggtttgcaaggactgcagtcccagaagacactgactatagcttcacacggagaaggcaatggcaacccactccagtactcttgcctggaaaaatcccatggaccgaggagcctggtaggctggagtccatggggttgctaaaagtctggcatgactgagcgagttcactttcacttttcacattcata

SEQ ID NO: 38354 - DNA, 1787 bp, Bovine  19866880639157
cctggaaagctccatattttctttaaatcagtaaaaataaaactgacagctgactcggtggaacagaaaacagaagcctgaagtctgtggagtgataagtgccatgttaaaagaaaataactgcctgacattgaccatcaacagatcctactgcagaaaattattaataaaattcctcagagagcaagaaagtgattccagataggggcatagagatacaagagtaggaagaacaatagcaaagcaaacacatgagtgaaaactcattgtgtaaaacaattgcaatacataagacagaattgtaaacaaacagaatcaaaacacatggcagcaaaagcacacacgttggaacaggcaaggggaaatgggattaatttgtttaaagttcctgtattgcctggaaagcagtcctaattcatattagatattaacaaatcaaggccatatgctatgattttgaaggtaaacactaaaagaatagtaaaaaaaataaaaagcttgctagctaaagtggagagcagatgaaattaaaaaaaaatccatgagtgagcaagaaaagagagaaaaataaagagatgagtgaagcacatagaaagatgataaatttaagctcaaatatatatgcaattacactcattttgaaataagtttctaaaagacaattatgaacagactgaatgaaaataatagagccacatttatgaggtttacaagagaaataccttaaatagaaggatagaaaggtttgaaaggaaaaggaaaaactcccgtccatggtatttatttaagagaaatgaaaacacatgttcacataaagacttgcacaaggattcatagataccttgtttgtaatagccccagactgaaatggtgcagatgcccaccaatatctcaatatacaaaagagctatgtatgcataaggcatgtgaaagtgttagtcctcagtcctgtctgactcttcactaccccatggactataatcatacttctcagcaaaaaccagggataaccaataaatgaatgaatctccaaaaaattatgttaaagaaaccagacataaaaaatgaagaaaaaaatcaaaatatgataatttcaaaacactcaataaaattcaacatccattcatgatacttttattatactaagactaatgggaaacatctctaatctgataaagaatatctataataacctacttaaatgagatataatgaaagcttgccctctgtaatgctgagcaagacaaaggaatttacttttctctttaacattgtattaaaaatcctagacatgatgtttggaaaaaaacagcacaattctgtaaagcaattatccttcaattaaaaaataaaagtcatagacagtttaaaaaaagtgagaaaataaatgtaatagaatcagaaaataataaatgaagtacttattaattacagatgtcttgattacctatgtacatacaaaagaataactattataataaattaatgagctttagattcaatgtcaatatgcaaaaatgagttgtactttcatataatagcaaccaatcagaaaatgaagtacaaaatgttatattattcatgatatttgtaacaagatcaagtactaggtgtataactaagacgagtaaaaatcctatacagaatatcatgtgttttttgctatgttttgttttcagttggtagaaaatgaaggagacactaataaagaagggatataccactggattggaatatttaatatcataatggcacaaactgatgtatagactcagtgcaatctcaat

SEQ ID NO: 38355 - DNA, 1897 bp, Bovine  19866880726019
ctttataatgcccataaggcttcacttggagacattctggaagctgtaagttcataaataatgtctcttccacttggtcagacttgcagtgccagtggaagacagatgatcctcggctgtacatggtatccctgcaagctaacacgttacttcgtagtcttgggttgcccatcccctggagtgttttgatgcgatcagttgtcagtttcaggtctgttgtttctctcagcagaagcccagccagtggaagatgacagcccccaaagccctgcctgtgttaggggagctatcgaagtcggataatgacataagcgagtcggtgttcatctggggaacctcagacaaagcagcccagagaaaaaccatctctgtcgatgaaggtttgtttcacttgcaacaggaaaagcagcagcagcagcatccggagccggtactcaggctggggagaggcaaagggaagctgaagctgccacatgtgagtagcattttgcgctttctctgcagctgggaaaggaacgatggggagggggcttggctgtgaggtgggcgtgcatgtgtgcgttggggctctctgtatggctgagggtgggagatggtttacacaattaacaagtcccttggggatctgctctcctctgccaaaggaggtgcaagagtgggctcacacgcacttgcattttctccgctgatcataacacacgtaagcagcaggtggggattgttttcttttggttttcattttttctttcctcttctccattcttgagagtgggttacacagcagaaagcgcagcctgaaagaggattcctgactggaaggactcttttctttcccaagaggttttctttcccaagtttctttagcaggtgtgcagatctccattcctttgcccctgagctgctctttggtaggggtgtttactccctgctaaccacaaagcagccagggtgacttttgcatctttctcagccagagttgtctgcaataaacagcaccagatctgacacaatttaacctctcaggggtactgttcaaagagtttagtgagcaaagccctgggatgggaaacatgggatgtacttcatgcttctgctcagcaggtctctcaaggctgacagcatggatcttgaactttgggaaagttttttgtttgcttgtttagccaagctctgacatttactgtgaacatgggatcgagtgatgctgaaaaggggcaggagagaatgctgttgctttaaagccctcgtacagcaggttgttgcagcatcaggaactggttaatgtctttgggttactgttactgatgctaaataatgtgtggagccaaagcacacctgggcatgatgtattctggttatgggaggacacaggtgcttgtgtgcagtttgttttctcatccctgcttccttctttctctctttagaaggtttgatgtggctgcgcctgtcatgctgagtgtttgtatgtttgagtatctgcagtaaatacatacaagttcatcctccctaggatgggggagggggaaggagggacacagcatcgcctatcctaaacacaggctttgagcagctgtgcatgatgaagggagaagagtcagagacgcttcacactggggcttggtcgggaggagagcagtcagtgatgcttgagtgaagaactgagtgccctagcactggagggccagggcccagctcctgagttgccgtggggtgttggtggtgaacgaaccatgggatgagtttcttggggagtcctctcacccaggccacgctttctgacctttcccacactttggctccccgaggaaaaagacaaggtgactcaaagctggggattaacggcttagaggggctcgagtggccatcccagtggagagggtccactagggggacatca

SEQ ID NO: 38356 - DNA, 1463 bp, Bovine  19866880730909
cattttatctactactgcgggcaggaatccctcaaaagaaatggagtagccatcatggtcaacaaaagagtccataatgcagtatttggatgcaatctcaaaatgacagaatgatctctgttcgtttccaaggcaaaccattcaatatcacagtagtccaagtctatgccccaaccagtaacgctgaagaagctggagttgaacggttctatgaagacctaaaagaccttttagaactaacacccaaaaaagatgtccttttcattataggggactagaatgcaaaagtaagaagtcaagaaacatctgaagtaacaggcaaatttggccttggaatacggagtgaagcagagcaaagactaatagagttttgccaagaaaatgcactggtcatagcaaacaccctcttccaacaacacaagagaagactctacacatgaacatcaccagatggtcagcccccattagctgctggcaaatgcaaccgtgtgagccacttcccactggtcattgccattcacaggaattctgtgctgatttctttctttctttctttctttctttctttttttagttactctgtcttctgagatttcaaagctccgcactgaccagaccacttagagggtttcctattgtggaaacttctttcactactgcatccccagaatgggtctctgtccctaaatcctttgtttccctttttgtctttatattttgttctacctcatttccaagagattggtttgcttttctgggtatctgggatcctcccccagtgtttagaagttgttttgtggaaattgctccacatacagatgatcttttgatgtatttgtggggaaggaagtggtctccctgtcctcttcctccaccgtcttggaatgcctccccccaccactgttgttccataaattgtttaaccaatctcctgttgtgtgcctatgtgtacatatatatacaaaagcattattgcagaaatatatatatatatatatatatatatttatatatatatacacacacacacacatatatatatgagccctcattaaatattttctgcccatcagttcctaaaaataggatttcttgtgcattttaaactgttgaaaaatctgacaaaaatacgcagaatgtcaaatgttggaatgggaggacaaaaaccattgaaggtgggaaaagtcacataaataaatatatggaggagcataagtcacattcctttgtttctccaaagatgtttcagaattttgaccctttgtgtgagctcaaatgacaaattccagctcatgccaagtgagcacaagctatttgttagtctctttatcctcctcctgtccttccagtgagaagtctccagaggttaaacactctcattagtaatctcaccagtagaacccctggaaatcaatgtttgctgcccttggtttttatcttaaggctcttcatcacacacagac

SEQ ID NO: 38357 - DNA, 1995 bp, Bovine  19866880772433
caagtgttagaacactataattcagtgctttaaaaaagagtgtaaaatgtttgtactatctcaagaaactcttaagtaacataggtaattttaaaatttcctttattctgaatcagttttaacagtcactttcttcagttgtaaatcactgtttaatcaactgcagaattctagactttaatcagttctactaatttttatttatttattctagatttagctcttaattggaggaaaattgctttacaatgttgtgttggtttctgctgtacaacaacacaaatagttctacccgatctttaaagtcaatatcctttctattatactcctctgttcctcaacagtttttaactcattttaaaagtttaagacaatgtgtatttcatacatgcttcagtgattgtaaatactcagtcaagttttccctgattctagtctatcccatctttcactctgatggcagcacagggtgtctacaaatatgctggttcctacacgagggccagtgtccacacacacacactcctatctcttccctttggctgctcaagactcccagtgccatcttggagagctctgtgcttcaagaatcaatcaaaggttcagcagatgtgctgacagccacacaagctcatttcctgtacctcttagccctcagtcccagaaaggaaacacagcccctaatggactttatttgtaattaaacgacaaggatattgtggtgggaagagttttctcctccttactagggccacttgctggccttttttattcatttttttatgtgagtttaattcccattgatgtgggtgatgattgttggtcaaataccgttcctgcatctgagtcggcatggcattctccgctgttgtccctgtggtaaacacgggggaactgaaaggcaggatgagttcacctctgaagtcctatttggtgcacattttgagcccgaggcccagcaacgcaggaggcctggagtgttttcacttgggcatagccatcaaagtgttgtgtgtatttttcccctttggtggaaaaatgatggctttgctttcttgaagcattcctgctgacttattcatggaacccaaagagggtgacatccaaggagggcagcatgcagcccttctgtttcccagccagagtcagggtttggcaaagtgtgagagttgaagggaggcgggactgcccggtgcagtaggtgagagaagagttggccaaaaggtaggaaagacttgaaaccaaaatccacactctgatgtgcggggcctcccagtgagaaaaaacactcaccaaacacccacatacttatttgggttggaagagggtatgcagtgcccaggaggctgttgaaacagagaactgaccccctttgatgggctggaagagctgtggaaagctgaggcaggggctgggaggagggatgaagtggagggtacccaaggcaaggctgtggatacttggccccaaaagcccattttgcaggtttgcttgggatgaaactgtacgttgtgccttgtgtgggtggtggatggagagacttatgagaagaagggatctatgactttcctagggagccagacagacttggggttgaattcaagccccaccacttatgaccattggaactttgggagaaaaatcacttagcttgtctgggcctcggtttcttagccagtaaaatgggaataaaattgtgtgtgtgtgtgtgtgtgtgtgtgttttaatgaggattaaatttggccttggtgtactggccctaaccagttttccatacacagctgccatctttccatatgtttgatgatgagtcaaatataaagaggaaggcctaagataacggtttcagaacatctcagtgtgactgtaaatcctagttctaccttgcactagctttgtgacagagtaattttcttaacctcacaaaactgcaatttcttttatcacagaaaaatttatcacaataatatgtatctcacactgttatcaagagtt

SEQ ID NO: 38358 - DNA, 1186 bp, Bovine  19866880800087
agaaaaagaaagcactattagtaagtactattggtccaataagacttttgctgttgttcagttgctcagtcgtgtctgactctttgtgaccctatggactatagcccagcccaccagactccactgtccgtgggattctccatacaagagtactggaatgggttgccatgccctcgtttaggggatcttcctgacccaggaattgaacccgtgactcctgcattgcaggcagattctttactgctgagccaccagggaagccccaatctcactaatagggctgcccataaaatggaaatggacatagggtttgcagccaaattgcttttgaatatgcgagtaccaatgacaaaaagcattcaaaccagaattttagtctgatttcattaaatattccatttttctagctctatagtttgatttcaagctcatcaagtggatttctggttggaatctgattttccgtgtaggtctgcctccagggaagaaacattctcccctagattttctggtatttttagcctttctaccaaagatctctctatggagtgatatattgcttgtcatgtagttttctacagaaagaacaacgcccaaaaatgtgcttcaactttttctgatcactattatagggtgaaattactatttcaccctataaataaattacttgccatcataattaaatacatcaatctcatgagctcagctaatataaatctgagacatgaatttgttcttaccaacaaaatcaactcagaacctgtaggactccaagccagacgctagattacataaattcaccaaggtattcattgcactctgtcccatttctggacacagcttgccagccttgtctcctggtgaagaagtgaagtgttacttgatcagctgtgcctggctcttagtgaccccatggactgcagcccaccaggctcctctgtccatgggattttccaggcaaggatactggagtgggttgccatttccttctccaggggatcttccctacccaggaattgaacccaggtcttctgcactgcaggcagattctttaccgactgagctacgagggaagccctggtggatgcacattaacatgaccatttgtgttaggtacaagtatgcataatttctagagatactcttatgtaatcagagggggttcaaactttaaaacttaagctca

SEQ ID NO: 38359 - DNA, 927 bp, Bovine  19866880880707
ccagttctacctgttgcttcctgacctgcaaaggcattattcagttcagttcagttcagttcagtcgctcagtcgtgtccgactctttgcgaccccatgaatcgcagcaaacactgtgcaattgatgctgagccataggaaaagcaagacactgtgaacatacaatatatcagagtgtaccaggccagcacaacaggtgcaaatgaaagaatgctcgtggcatgcacggccatggagattaaagagggtggagaaataagaagggacagttcacaaaaagctgtataagtcatgctgtttacatcttcccttgtttttagggtgtgaggagccactgatgtgttttagaaaacttactctatagccaggtggagaaggaactgggttataaaaccagaggcagtgacgaggaaagaggatggtgtggtaagggatgatgataccaggatgataataatggcatagataaaaacagattccaaacatgctcaagaagcagaacctacagaaccaattatagattggactgaggggtatggaagtagtattttagggtcattcaagttgtttcccaatgatcagtcagagcgaagcctccacataaatgactggttaatgttgacctacatttaaaaatgcagacagtgtgttcaacaggcttattttaacaaatcaacgatttttgttagctcagtttctttgtaattataatcatagtttcagaatttgggaggaattacattaggatttttattagggctttgggttttctattaattccagatgaaacttcttataacatcttcagatgcaataatgagctttaaccacttgatggccacatttcaaagtcctttatcttcctcacctctgacaactttctctctattctaatcagccgtctctgggactacatacatctgtttt

SEQ ID NO: 38360 - DNA, 1623 bp, Bovine  19866880948695
ctggagcagcaaaactgttttttggtgccctgtacttcttccaatatgactgctcctttgaaaaaaggaagcgcatcatgtgtgggtggggggtggggaagggaggtttggacatgatcctggatgccgtgagggcagagattcacagtggatgcttaaagcgtagctgaatggacctaccgggcaactgctagcaagggttttcccttcctaagacatatccagggtcccattcaagaaagaatcaaacctggcattttcctggttatttactttaaagaaaaaaaaaaagtgaagcttagcattttgaaatatgtatttcttggagacaaatatattttggcccaacccacatcccattagaactcaccacatgaagtttccagttccatccccaggccacagccccactgtagcatgaaggatgatattttatttatttaattccttctttttttttttaaactctcccgttctagctcctttagcaatcacttggtctgtatgcttttttcttgattagtcccctttccttgcatccatcaggtcagagttgtgtttgctcactttcatgaaaatttttgtcagtaatgaaataagatttacctgatttggagctataagtgcccccgggggccattgggaacctccttgacctcttcctggcccagatgtcgtcgccattcagctgaccacaggccgccctgggaacgggaagacgtgcactgtcgttcaggtggtaggcaagcaagcgccgagaggccgcccgcctcaacgcgccaggggtgggctgtggcttctctctcctcttccccagcccctcatccccaggaaagatctagcggcccactgtagaattattaggagtaacaagaaaagaatcccaataaaatctcacaccatgactcaaattccagtcttcagcaactggtagtaaggatcgtctgttttgaaggagactctgaacagggcctctgtggtaatcctccaaggcaacagagggcactgtggacacacattggaacaaggccttcctgtgcctcaggaagctgaccacagttagtagctcatgctctggaaggcttcctgtgcctcaggaagctgaccacagttggtggctcatgctctggacggcttcctgtgcctcaggaagctgaccacagttggtagctcatgctctggaaggctgcctgtgcctcagaaagctgaccacagttagtagcacatgctcaggggctggtatcccacatctttcatgtcaagtggtcccctccagagtcttattgccatgattccatggaagcaaccatcttgacaaaaataaaagattctcgttctttcaatttcttctttcaaaatcaagtctaccttgatgctgagggtcatgaactttgaaagaggctggctttttctcagatcctaagttggctacttcctggttgtgtgacctctgagacccaacttctctgagtctagatttcctcatttggaaagtggaaataacaatacttattgaccatgggattgttgtgaggatcagttaggataatgcagatgggtgccttcagcgtataaatgtcaatccacggtagctggttgttgtaattaataattttgcaaatg

SEQ ID NO: 38361 - DNA, 1644 bp, Bovine  19866880983406
catttgagaagttttagtagggacttccctggtggtcctgtggctaggactccaagatcccaatgcagggggcctgggttcgatccctggtcggggaactagatcctaattgctgcaactaaaaagaacccgtatgtggcaatcaaagtcaaagatccccgcatgctgcagctgggacctggcatagtcaaagaagtaagaagtttcagcagcaatgagtatttattattttgaatgaactgtacatgaaacttaaatttttacatgaaatataaaaatcatcaaaagtgctgtttaggattattttaatattaatttatccccccatgtgatctagtagctacacattttaccttttttaatgatctgacacatcattacaatcatgtaagaactgtccaatgttaaaacataaaaaaaatattagtttattcctcaagaaaagtaccaccagtgatgctttactgaacatgaaaaataaacagatgccagagaatcaacttttcgggaaaaagaaatatcatagagtttcacgggtgaatgcaaagtccaaagcagatcagactctcagcagaacattcttgggatataacatcctaatagtgtgggttatctcctttggaggcaggtcactggtgtgccagaactcatcttttctggcctactttccaacaaaatgtctaatgccacgaacctctcatgactcctaaaatatttaatacagagggttttcagtcttagaatagcccttggagttaagtttgtcgttgaagaagaaagcagtcattgctcacagacgagagccccgcgcaccttccgccgtcaggccgacccgtgcgtctggtccgcgccaagtgcgtgctccccacagccgtcctgggtgccctggctgatgaagagacagcaggtccttcaagtcacgcgtcccaactggtctcattcggccctaagcaaaccagcctctctgattcaccaccagagttgtctggctctcccgcctcttggctttcttgctcctctgcctcaccttccagcacagagcgctggacgctaacagaaaaagtcccagggacagaaggaccaggcccaagatggagatgatggagccatgggagttgaagctgtacgccacggcagtgaccacggtcccggtgatgaggaccaccacagcgaaggggatgacgcagcggtagcaggagagctcagcgcccccggtggcggccgccagctgaatctcactgaccaggggcaccaaggtaaccaccacttcgccattggcattcttttccatcgccaccggtttgggagactttggggttcccaggatctcctttatgggctcgtctgtcattgttacagcggtgtctcctagctgagttcacagactagatctgggtggtctcctcagggcaaaaactgtgaagacaggagatgtcagctgaatgcattagagtgagccccacaagtagcagcaaagacctggggaaacaccactatgttcttttcttttctaggagacatggatgcctgtgaaaatcaactttaatgtattttttccccaacttttgcattctctttgcattgggcagaaagcaagataaagcagagaaccataaagaaagggaaggatataagcaggaagca

SEQ ID NO: 38362 - DNA, 1323 bp, Bovine  19866881017297
tataaaagggtttcccttactttctccaacttaagtctgaattttgcaatatggagttcatgctctgagccacagttagctctcagtcttgtttttgctgactgtatagagcttttccatctttggctgcaaagaatatagttgatctgatttcggtattgaccatctggtgatatccatgtgtagagtcctctcttgtgttgttggagaagggtgcttgctatagggtgcagtgcattctcttggcaaaactctcttagccttttccctggttcattttgtactctaagggggtatctcttgacttcctacttttgcattccagacccttatgatgaaaaaaactttttttttttttttttggtgttagttctagaaggtcttatgggtcttcatagagccattcaacttccgcttcttcagcattagtgattggggcatgagctagcacatacactggtgctttgatctccagtgggaaccatttttgtacagtgcaacagccctggtctgacaaaggtacaaccaggagtttagtcatctcagggtgaagatctggttaccctaccaatcaaacaacctagactagcttagcagaagttctggttcaagataagagtaatctagagcaggtggtatttagataaacatgacgaatatcatcattaaacaggtttgcatgaaatgctgccagtgtctaatccataattctttgcctttatcactttggtgtatggtagtagttacctgtattccctttcttaaagtttctttctttctttttttaatttaaattaccaaagcttggtttgctgtctctagtgtaactcataagtgctagggaattactgtcccttggaagaagtcttcaaccaatgactgatcctagtcagagtataaacaacacaactgtctcaaacagtaagtgggaaagtcactttatacaattcttttacattggctccaagcgtttttttggctcaattaagcttcagtcaccttcagaagtagctggcttgattctgtccctttatttgctgctttcccattcttgtttcatgtccccttctcctgtgcttgtgtttttcttcacctccaaaggagctacttgcatgtgaatcattttctcaggatcttctttggggaaacataaataaattgggaaaagaaagatgggttattatgggtttcttttcaaacataatgatgaattaaactgagaactatgtttggtgcccatgtatctcacacattaataaatgagaacctaacagaagctagaagtataaaacatagttcttgaaatctatcccaagttatttt

SEQ ID NO: 38363 - DNA, 913 bp, Bovine  19866881089553
ccttgccctgggaggtcaaaatatcactccttatccaatgagctaaaagttagagctgtctatttgcatgagactttcagtcaccaaaattaatcactgctattcaagataccttaatgactggctagatcaataaaagcgtatttgagattctgtctgaaaggaaaaaaaaaaaaaaaaacttcaaacccaaagctgaaacttcagctaacttaaaaatgaggctgtgtcccccaaaggtttatacttacatgtacctcagagagaagcaatccattaccagggagacccctggacctgagagggaaggaacagcagtctgagcttcttcttggacttctgagaaggcagcctgtcacagcacctctgtcaggaaagtgacgggacagagatctctgggaaggagaaaagatataaaatgctgtgggttttagatcctgagctctttctctcactctaccccttcctaaatgacgcttgtctttccctctctctttttatttcctcccccgccggtttgctcctccctgccattttttttttttttccttctttcttttccttgccagcagattctgagttttggcttcccccagctctgctcagtgacatgataagtcagaatcattttagagtccccagagacacaggaggcagcttttacttttatttctcttgcagcctttactgagcgcactgctttgcattactcattttttccccagccagactccaaatcttcccccgcccagcaggcattttcacaagaaaatccccgagtcagcgttgcagacccagctgaggggacggggccgaagggacagacacttttagggctgcgggaacagctgtgaagtcatcgggcagctgaatccagcctgtaagccaacaaaaatctatgttcctaggtttc

SEQ ID NO: 38364 - DNA, 1462 bp, Bovine  19866881165533
actgccgtttgcatactcatgacatactctttgaaaaaactctgttacaagacaattacctgctttagccattctggcccagataatgccagtgttattgttattctctgcaaagctgctttaacttcccaaagcttttccaagtcttctatttccttagatccaccttgcaaacctataatgttggcaggacaactgttatcctgttttcacagagagatgaggaaactgagatcctgacttaagttctcagagttagctgttggcaggaatgggattccaaagtatgtcttcttatgttccctgccttcctgttccttcctttccaccacattaactttcaattcaggatgtttgtgcacgcagctttcaatgttcttattgacagtgctcctaacaacattttaagtgtttcttttcttgctactacaataggaaattccaaaccaattgtgtattcaacaggtttgtattcttttaagttaaaaatgtacttataaagcattttaccattggaagtataaaataattgtggttagaactttcaaaatgccccagcaaatcacaatattgtagaaaaagtggtatcagtagtaccaaaccctaaattctgctgcactctactttccttgactcgagcatggacctctgctcagccccgataagcctggagcttcccagaggggctaaggattaagtgcatctgtgcaggaaagtggtctaacagcagcctttccaaggactgtttacctgtgaatcaagtaccctcagcagataactagcctccctaagccaagcccaggattcttcctttgaaaaatcttctgcccacaaaattgtgcacaccatgtgtcctggtactaaatgaccacagaagaaagaagccccactgccattgactgtccttcccctcttaggagagtcaaaggtgtcacacattgacagagctggcacctcctctagaaatactcatcaagtgtaaacatctatgcacaagctgtgagaggaagtaagttgttcccatttagcacatttattttttcatttcaccatgctcaccagcagaggtgaaattcgaacaggttcccagtcccaactcccagaaacaacttgaaaccccaaccgttcccctctgcacatcagcaccaaaatgagagcacagcaatttccatgtcctctgaccatcagtagtgcgtccagaactgtcctgctgctgctactgctgctaagtcgcttcagtcatgtccgactctttgcgaccccatggactgcagcccaccaggctcctccatccatgggactttccaggcaagagtactggagtgggatgccattgccttctccgccagcactgtcctaggctctgcaacagagagaaatgggtttcactctccattcttcagtgtcttttcaagatagacctggaataggtagcaaaatagaataaagaggagaaagaagg

SEQ ID NO: 38365 - DNA, 1654 bp, Bovine  19866881249916
ctctttcacgagaaagaaaagcagaaatagggttatctgttatgggagaggaagctcttctacacgggaagaccaaggaaagctcccccgaggggcaacactgaagactaaatacagagaaagagaagaagtgagtcctgaactttagcagagtgccatgctccacatcccccagaggagaaaacaagtgtcaagactgagtggggagcctggctcatgtgtttaaggatgaggaggaggcagcaatggccggaggaagctgggaaggggtgaaggatgagcggcatgctcacggggaccagggtcctgaggcttctattctgagtgattcaagaactggaacttaaactataaaagatcactctgactgtgttaagcatcagaatcacctttcagaagcctccctcttgctgtgtagggtctcaggcagaagccaagcagccaattaggaggcttgttcgcagcctcagcaggagacagccacggggctcagactcagtgcagaggtgagggcagtaaagcagatcacgcttgaaatgagggttagagcaggatatgaaagaaagaagaccaggagagctgcacactgcagaatctgacaaagctaagatgattttctctcaagacagagtcaacttggctgtgggagtgcggctggatcagacattcggtgctcactggagatgcgtgtagtaaccatctacatagggacaaagagtggacagctcagcacatcagcctggagttcaggggagacggacatgccaatgtcaagagtgtgtcccacagggttccgagggcatttgattgtctgtggttggatgagcatcctaagggggagggtgtggatggaaaggggaatattggagaactccagtgtaaaaaaatggggtagaaacacagaattcacagaggaaatgggaagagggacttgtgaggtaatgagacaatcaaaacagagtgatatgtacaacagactcactttttctgtacagctgaaactaacataacattgtgttatgttaactaacataaatcaactatggcccaataaaaattaaaaattaaattcaacaaaaaataattttgtttgcaaaaaaaataaataaatagtgaagtcctaaaagtaaaaggaacggctcaataaggaagagataattcaacagcatcaagcattagctgtacttccaataaggactgagacctgcccatggatgtcagcggtgtgctatgttcagctctgtggatatgcaatgttccctgggagaattaggaattatttgtccccaggagttacagggacatttagattgagacaaagagttgttccaaagcgaagctaacctgatggattcctatctgctgagcagggtgcctgcccttttctcaggtccagagaagtgatttttcatcagaggagaaacctgtcacccctttgagatgccaagccataaatctcctttccaccaacttgctaatagtttttgttgccacctttcctgataatccagagtaattgttatgaaatatgggcttgttctagccctgccagctacggcgcctccatcctctgcaggtcccgggagagcagaggctctgtgtctgtcactgggtgtgcgtgtgttagaagcacagcagatgctgttaccaagag

SEQ ID NO: 38366 - DNA, 1059 bp, Bovine  19866881288807
tatttaaatattttatattatacataaaatctttaatagtaatttaatgtatttagtatatataatataaaatatttaaatatatgtatatatactcatgaatttagagaacttcataaataatatgagttttaaaataaaggaataaaggatgactgggaaagactgagggcaggaggaaaaggggacgacagaggatgagatggttagatggcatcattgactcaatggacatgggtttgggtggactccgggagttggcgatggacagggaggcctggtgtgctgcggggcatggggttgcaaagagtcggacatgactgagcaactgaactgaactgaataaagtttaagataggaacctggggaaagcaatggccattaattaacacatttttgactggatatttttttttcagaaacgaacatctgtggcattaataagtcttttgtcaataatgtgttaagaaatggtatacaatcagttgagactggtaaggaggtgaaatggaagatgatatcagtattgggcagaagttctagaagcaaagagggtattcagagagggttgccatttccttctccagaggatcttcctgacccagagaccaaactcaagtctcctgtatctcctgcattgcagtcggattctttaccagctgaattatcagcagtaaataaaacacgaaattccttgccctcctggagttcacattccaatggataaagaaaacagaaaaacatagtcatttgggaaatataatattaaattgtttgtaaaagtctgttgctgggttggtctcctatatgcagcttaattccccatcagacttttaactctagtactacaaatatttattctattttgctgataaattttaacatcgacctccactgttatcttggatagaatacattgtctttcagttcagttcagtcgctcagtcgtgtctgactctttgagaccccatgaatcacagcacaccaggcctccatgtccatcaccaactcccggagttcattcagactcacgtccattgagtcagtgatgccatccag

SEQ ID NO: 38367 - DNA, 1701 bp, Bovine  19866881341101
ttccagtcaagagtactggagtggggtgccattgccttcaacagaaattgttaatcttcaagctatcaagagtgttgaatgagagacttccccggtggttcaatggtataaagaagctgcctgtcaatgcaggagacatgagtttgatccctggtctgggaagataccatatgccatggagcaactaatcccaaacaccacagctatttgttttagagcctgggagccacaactgctgaagcctgtgcatcctagagaccgtgctctgcagtaagaaatgccactacaataagaaacccgtgcagggcgactagacagtagcccccactctctgcagctagagaaaagcctgtgttgttaagggagacccagcacagccaaaaataaaataaatacaaaattttttttggaaaaaaaaaaaagagagatcttgagttgcttaggtgggggaagccacaaataaaagaggaattttctaagggttgagtcttttcatatatttctctatagtcttgaaaacctagaactctggaaagccagagctgggaacttatctcatgcctcatttgacagagaagaaatctggagcctacctagaggaagaagctatgaatatgcaagaattcatggatagactgggagcattttaagagttacttttagaaatactttggaaaataaatatacataaacaaaaacaactctccagctatccaacctaagtttgaaattcatgctcagctgttgatccaaaattggctgaagatgggagaatgtctttgtgcagagggggtgctgggagccagtgacctccgctagaagcccagcccacgacgggaaccgcgttcccccacgtgcactgcgtcctcccggcgtcctccccgacgtgcacagggtccctggagacccgggcgctgaaggagactgcagagcctcccggtgcagagctgaaatgctgacagccttccgattgcaacggtcaccacagtaacttttcgaaacctcccacggcgtggttggggggagggggaaaccaaaaatcccaaatataatttaatttccagggtaaacacttttcatgcaaaaatggccaaggcgatccttgaggcgaggctgccttcttcagcatgaccacctgcccccttgagcattctgctgaaatcccgcgcagagctccaacttcacaagcgatcttccagagcctggatccctgtggaagaggaggaggcgaggatctagaggcaggattgacaggaaggaggaggctgaaacagctttgccttctcaagagggcccgatgtggataatcaagatgtgagttgttagggaacattcgtttgatcttgaaagactcgtgagccaagtgcatagtcgctggtcaaaatcagggatgcccactggcccatctgaaaaccaaaagggtcgccccactccaggcatcctactctcgtaaaactttttagcatttatgatgtaggacatatcagaagctatgctaagtccattacacttctttccttatttcatcgtcatcttctgggtttgagggagaacaaggaggaggccctggaggctgatgtccttttcagtaaccatgtgagcagcaaatggcttagtagaggcttgaaccccactgtgtgggactgtgctgtgaggtccaggagagcccagttgctagttcagctgccatcagctccatga

SEQ ID NO: 38368 - DNA, 2006 bp, Bovine  19866881381555
ctcctcctccatccgtgggattttccagccaagagtactggtctgctaagaactgagaatgatgagcttttagataaggaagttgaaaaaagtcactaagcctgctataattagcagagtcaagaccaattcacattcgtgcttgctaatacgaagaagacagaaccatacagcattgatatatgagattatgcggggaaactgagaacctctgaaccaagagtaaagctggcattaggcactcaaatggtacttaatgagtgactttactgatctggagaagactgaccacatgacacatacccctctggatgttttgcctctgcaaaacccacccagacagagaggtttgatgtgattacgttaaatactactttgaagtttaataaggcaggaagagaaggggacgacagaggatgagatggttggatggcatcactgattcaatggacatgagtttcagcaccctccaggaggtggtgaaggacagggaagcctgacgtgctgcattccatggcgtcgcaaagagtcagacatgactcagcaactgaactgaactgaatttaattcaagccaaaattttcccccaagctatcattttacgggttacagattcctcagtttctgattggtcttttcttgagaccaccagatcctttatttgtgaaggggtgtctttgctggtgtggttactggttatactttaatattatggaaatggctcagtctggactgaattcagctaagattagtcaggatttcagaattttgatgactaaagtagcactttggtcagtgctaatttcttttcccacaggcgaattattcatactgtgtaacagtttaaagttaatgaacaccttggtaacgagaaattccagcagagagtcacttcctgaagatgttcgtatttcacagtgagagtcttgacctggctctctggctgtaatttctcacccagaatcttcacatctagggcctgcccttcaaaacccctgcttccctactgggctgaaagagagaaagcaggaagagcccattcaattctcttgtttccggaagcaccacccagccggctcagggaattgtctttagatgttttgagatgtgtgttcacttcacagatatttctcaatggtctggcatccatctggccaggggacagcatggtagctcctgggatgagggagacacatggggtgcaccttcaaggagctatgatccagtgaagacacagcaggcaagctgttaacaggtgatgagttgtgagagggggcaagtaaagggggctaaccaagtttggggggttgggcagaacatgttggagttggctggatgagggttgaagaagaaagctattccacatggaaggaataatttccataaaatccctcaagcaggagagccagtcatgttgcaggaacaactggaggcccataggtctgagcaatgagagtggaggaaggcatctcacatgtggctgaagaagaaggtggtgaggctgtgggagatcctgagagacatggtaaggacttttactttatacccagaatgccagtaagttttgaaagattttgggctgagcagtgacctgatgagacatactcaatcctaacagctgctcattccccaacggttcatcatctccagcattcctagcatggtgtgggggtgctggccaagacgctctaagcccgttctatgaatccttccttcccactgtgaggcagcacgctgagaagcccccactcaaatctagtttccaaagtagagcatgagactcagaagtttaaccagagaaaagagatcagagaatctccatgtgcatgacccctgatgctcctggcccatgctgttctcagtacaccttccagtgtgactatatcatgcatccagtaagaacagagccactgcaagagccagaagtggtagagaaaaaggaaagtcatataaaatgtaagcaggtctgcatttcccaaagtttaattttctaaactcctccccaa

SEQ ID NO: 38369 - DNA, 918 bp, Bovine  19866881973980
cacaatttgccacttaccagtccccaccctattttgcccttcaagtacgaacatgatgctgttgactcactacaattaggaaagatgttttgaggttttcagcataacttagtgagtgttgagtgaacatctattatgtcccaggctctgcttctaagtttagcaatagttttcagttcaggaaagagtagttaggccaacaagatgaagaaagtacgttttcaagaatattttttgaggcatgtttaaataactgatgtgtacataattggaaagtagcatgcaaacatgtaagaagaaggcatgtgagtcatatggaagcgttggcagatcctagaggatggagcggttaattcctcctggggtatcagagaggacttgtctggtatgtaaaaactcagagagtttgaactgagctttacatattatttcaaacatgaattccactgccatttactgaatggctgttgagtgacagatagtgcagatttaagcaatgttcttgtcaccagggaactcatgacctatctggtgagtcagataaataatgatcatcataaaataaagaaaaatggctttggactggtaatgatagtaacagcacccccagctctttcaaaagcattactatgtgctaggtaccattcactgactacttttcaactcattatttaattataatttaaaatcataccatacactggtgtctaaaataggtttacacaaagggaaacttgttcagaattgcctttctagtcactgggataaccaaaatctgaagtcttgaatccatgtatgttagaatccaaagttaatagacccttaactattaaagaagagttgggtggagggaacaatgtaaagcgagagaacaaaattggggaagacacaggagaaggaaattacacgcacggtcaa

SEQ ID NO: 38370 - DNA, 753 bp, Bovine  19866880393662
tttcatgaatactaaatttaacaattaatgaggttgatataatgttacagttggacatttgattaaggatttattgatttcaattttgcagtgttcttattttagagcaggtaatttttttccagctgtcaaatattcaaatgatgcccttgtggaggctcttgtgggcaatatgtgagcaacctgggccaatacgtcttggccatcctccacctgaagcatacatccctttatacacacagacacagacacacagacacacacacacacacagagcctatgtatatggacacgtaattgttaggaattgtgttaagctactataacaaataaacttccaaatttcagtggcttaacacaatagattatttttcatttccaaaaacagtctgatttggttccaggacaatgatatcaaggatgagggtgtgttaaagagggggtagacctgtgttccacgcagatttggggtgtcaagcttgtggaagctctctttctgtagcatgtgactttcaagtttgcctttcttctcttttggtcattttattattttttaacactatacattcatatatactcaacaccaatttatatcctatcttcttttttctttcagtttgattgatgcaggtgacatacaacattgtattagcttaaggtgtataacataagggtttggtatatgtgtgtattgcaaaataatcaccacaataagtctagttaatattatttacctcacaatgttacaaaata

SEQ ID NO: 38371 - DNA, 878 bp, Bovine  19866880395907
tagttttggtatttcatacggatgcagtcagaagtagctatacatgaaagaagcctaacataaaaatagagctttttccgtcctcccgtccggaaagcaaacatccttcaataaacatgcaacgcagctgcctagagagacccaggtctggcgaggaggtcacagagggcagccctgggcctgcaggaacactagcctccccgagtccttgcaggagggagaacgagggggcgatctgggtctagcaagtccagaaggactcgggcctcagccctaaggtccagagatggggacccccattcatctttttaaaccccactctctggcccacaggttcttaggccaagagcatcactgcatttcatcagtttgaggaggagtttttgaaaaataatctccaaaagatagtcttgggtcatcaaggccccagctttagagtcacagcctgcattctgtggccctcaacaccctcgccccacgggggcccaacagccgcctgcggctggccatctgcaggcccggtgtcccccgtcaggtttacgcagtccccctgggaagaagtggtggacaaggagctcctgggcccagccagttctgggtgtgagacttttctagtgcctcagggctgcagaagcctgcagcacacccgggccccgtgaggctctaatggaccagcaggccaagaatgagcgtgggcaggacacccagccagaggctggtggccagggtgcaggcgtggcccagcagttgtgaggtcatggcgctgtcctcgcgcagcagctcccagtgctgagcttcgcggaggtaggagtcctcctgggcctcgcagtagtagtggccataatggaggtccgtgaggttctcgataacaggatgca

SEQ ID NO: 38372 - DNA, 1879 bp, Bovine  19866880518401
acctctctgttggagtcaaccctcacagcccacccgtctgctcatctgatcctcacacctttcctatgaagagacgcaagatgagggtcagagctgctcaaagtcacccagatctcttgcctgcctggaacataatggaggccgggggtgagggctgagggagtgagttcccttcccttcgctaccctgctttctagatgaccatgatgtcctgtccttcctgaccttcagtctgtgggaaccgggtccagaggtaacgccgaacctgggccttccctggggggagggctgggggagaagcagcccagtgatccctccccttcccggatgctctgctcacgtccagctgtcagacctgtcattccaacgcttatctctacctgcttgcagagctctactcaggccaagccttgtgcagggaagtgctaggggccagaggtgacccagagccaggccctgtcctcaaagagctgtgggagcactgaggggtcctaaccagccaggggagcatggcaaagatgagcttgaaggaacagagggagtagcatagacacaggcctgagggagctgctggggtctgggccacagtgggagagacgggtgtaaagattggcagtgcagcagggctgggaggactgggccaggtggctgagctgagggagaactaggtgtgtgtgtgagtgtgtgtgcatgtgtgtgtgtgtgtgtgtgtgagtgtggcggaggtacggcagggctgggaggactgggtctatgccagggtggctgtttggtcagggagggggacagggcttgagggaggccctgtgggaagactcctctgggtttggggcctgagtttgtgtcttctttctccagcctccctcacagcccttcctggagacggagcagctccgcctggcaaagcagctggaagggctgcaggcaaggctgggcctgggcaccaaggaagacatgactccagagctgaactatggagtctgggaagagggtagggacccagagaacaggcaggtgggccagggactcgactgagggtcacagtatcctcttccgttcaaaccaagagccctttaaccagcgggaagggggcgcctgaggaggctgtatctaagcaggctctgccccatcacccagacacatctttccaggggagtcctggaggcagaagccacacgtttctgcccctccaaggtggcttcaaaagacaggctctgttgcccaccccagcggcctgcctgcccccactctgccttgatccccaggggaacaaagcttcggcctggaggagacactgcacagacacagccagatccttcaggccctccagggcctctccaagcacttgatgcaggctgagcggcaatggaagcagcagctggggtccccaggccacatcaggcctgaaggaggctgggtgagtggtccttcgagcacccaagggtctgcctacaggccctgagaagccgagctccataggcaccagatctgatggcaccagtgagctctctctgtccagaaagaggggcaagcactacccgggaactcatctcccccagggtctggagagataggagtgcgtgcatgcgtgcctagtcacttcagtcgtgtctgactctttgtggccccatggactgtatcccaccaggctcctctgtccatggggcaagaatactggagtgggatgccatgcccttctctagatcttcccaacccagggatcgaactcgcgtctcttgtgtcttttgcattggcaggtgtgttcttcaccactagtgccacctgggaagccctggagggaaaggagggcaggggtgaaatgctgcaactggcagggtggcatggatctgcgaggcaagggagtgaggtgggggctggg

SEQ ID NO: 38373 - DNA, 793 bp, Bovine  19866880580855
cgctgtgatttgtggcctctgtcggtcattctgtgggctataaggcccagtgggctcagggttgggggtcctcggcccttctctcctgcccagtgtccgcagcctgccaagagtggaaagggcagcccttgccccagaccccagctccagaagccactggcatctgttcacattgctgtggggagggagcaggatctcagtgacagaggcgccgtctcttctcacagcttcccctcagcccccacttctccccacagctctcatggtaccaagtgacaggtcggccttcctgtgacacggggacgccagatcttctaggaagatgtcagcaattcaggtactgcggcgatgggggtctggtgtggcgggggtccccatggcaccatggggtgccgagaggggagagagtgagaatgcaggtcgatgctctccccttctccccagccctggctcttagcaaagtagaattcagatgcaggcactcaagatgggagcccagggggtgagactcagctagcaggcgcccagcgctctgtggaggaagggcgcctcacccaggcttgtggaggctaggagagaggctgtggccttgcaggcgtgcaggcaggtgggtgggggttgccccgggctgcacctgcccacctgctgcctgccctgcaggctgcctggccatccggtacagaatgtattgccaagtacaactttcacggcactgctgagcaagaccttcccttctgcaaaggagatgtgctcaccattgggctgtcaccaaggtaaccagggacctcacacc

SEQ ID NO: 38374 - DNA, 1138 bp, Bovine  19866880599576
agatatgctcactgtccattcactcattcatccttttatctgactcacccccatgtcctctgtgccccgcccagagacacagggctgagtcaatttcgaggatcctgcagtctgcagtgaggtcccctgaacaatccaccggaggcccagtgcagaagtggggcagacatgggcaacctctgcctcctgcatgctacttcagaggcggtggtggctcccaagggctccagccctcctggccttgaagcctctgagcctccctacccccagctctggccgctgctgagcaaacaggctggattagcagtctccaggacatgctggcagggtctgggccctgggccaggttccaggctggcaggccgcaggggagtggaggcagctggggcagggcctctggtctcccttctccatttcctgccaaacctgcctcagtttctcactccttccttccctctccccccatcccactcacatcagtggtaattctcacactcactccatccctcacggccagttcccacctctgctttcgtgctttccccaccttgggatgccccctaggtgcccccaccaggaaggcccacctctgtctggacatatctgtgtatccacagcctggagtcctggccctccgcctggttattctctcagggtgctgctcccctatgttcgtggtctccggcctgtccttcccctcataggcctctctttcctcctctgagaaacacaatgctcccatgctcacttgctcagtcatgtctgactctttgcaaccccgtggactgtagcccgccaggctcttctctccaggggactctccaggcaggaatactggagtgggttgccattccctttggacacaaatctctctcatggtggaaatgacttgtattttggagtcagagggagctgggttcccattcatttagttccttaatttttttgagcctcagcttcctcatctataaaatggggccttgggacttccctgatggtcccatggttaagactctaagcttccactgctggggtcatgggttcgatccctggttggggaactaagatcccccgtgccgtatggccaaaaatagtataataaataattaaaagataaaatggggccctataaaagcaa

SEQ ID NO: 38375 - DNA, 1534 bp, Bovine  19866880603644
aggaacctctggttgaagctcttgaacctttgcagagccgggttgggcaggtatttaaggatagggaagaagtccacaggattcccggagctggcggattccacgaaatcatggctgctctccaccagactgagcatctccttactgctctgggggaagtgctgcccgaagcacatggcaccgatgacgttggccactgatgccaccacatggccataggggtcgaagcgcccaggccctgacatcagctcctggaacttgcccaggagggcctcagcctccttgctcacatgatcctccaggtagcaggaggaggaggaagatgggtctgaggccacagagaaggtgttgagagcattctgggccaggcgtcgccgggcagcccacactggtccagagtctgggttgaaggtcatgctctggccatcagtgaccaaggtgaagctgtagaggtcgggccggcccttgaaatcatcgccctgccgcacgagggcctgccggacggtgtccaggccgctgagcaccagcacgggtgtgcagccaatgcggatctgcagcacgtccccatagcgctggctcagctgcgacaggaccacgtgcgggttcttccccaatgtcagcatgtgcccaagcagaggccagccccagggctccggtggactcttcaggccttgagggacccgaggccgccaggtcctgaccacccagaataccaggcagaagatggcagaggccaggagaagctccatggctgagaagggactgagttgggacaatgccatctgtacctactgcaggggaagaggaaggaggggcgagatggagccattcattcacttgtttattcagtcaataagcacttgctcacattctttccttggttcccagccagacagattgagaaagactgagttacatccagtaaattacgtaggttctgcatcccaggacctcatccatggtgcatcacagaatctgaagcctggaaaggagccctgagcttcccaacgtgagtgtctgaactcccagccctggccctcccctctgcccatcacctgtttccaattctgaggccggtgtgatcacttcaaaacgggggagcactcttgcgaaccccagtgcagggtgtatgctgggcattgtgccaaagggaacctgcctggggacccttcctgctgatacctcctcataccttgggaacagggagctgctcccctcttcgcaacactgatgagaccaaggtcccagggctcatgcaaatggcttttgatgctgtcttccctaggccattccttattaagacccaaaagagaggacaaatcctcattctcccagtcttttttcttttggctgtgcagctcactatgtgggaatctcagttcccagactagggattgaactgtgccccctggagcggaaatgcagagtcctaacccctggacaaccagggaagtctctcacatctctcatcgcttttaaatgtttatttatttggctgccttgggtcttgattgcagtgtgtggacttattgct

SEQ ID NO: 38376 - DNA, 1260 bp, Bovine  19866880611937
gttatgaggtagttccaattattattctcattttaaagatggaggaactcggatttggaaaggtgaggcaacttgcccaaggtacaggggctcagagggcaaacacacgcccccggggccccgtcccctgctcggtgctgccccctcttggccgaaggctgtggtgacgggctcgctgccatcagagcctctgtgtgtccatgagcccagacacactcaggatgtctcagcactcctaactctctggaccagctgcttcacccccgcggggaggctggctggtcatcttgtccttggctgctagggtgggtctcgtgctgtctgtcctgctatgggccaagagtggcagaaaggagaagaaagagaagccgtacccagagggaagccagtgggagaccgtggaggcggtggtgggcctggggaattgtgggtagaaatcccactgttggcccaggctgagccctagggaagcgtctcagggcgggcctcggcctcttctgtggattccaagtcccagcgttctgccaggcaaggctcgctttcccgctcctctctcttctgctgcgagagcagaatacagcaatggaggctggagctagaccagtaccattgggggcagggtggcactgcaggcctgggcagcacggcctctgggaccacccctactggttaggccttgggtcctgtgtggcctggctggattccaagtgcccacagggatggaggcagcctgctgctgggctcctgccgccaggacttccggaaccggccgtaccccttcagagcacggatcacctactgggggcagaggctgcgtgtgagtcgtccctcctgcctttgtgggtctactgggcaggaagtgcgggttacagggctcagagttctgtggattcccacgatcccacagacacacctgtaacagcacacgtggtccctggcacatgcaggcaacacccatagggatccctgctctctacacagactcctaacttgcccccagcacattcctgggagagctggcacaagcccaggtgtgcgagcccctccacatcactctgattccaagcttcccgcccgccttccgggtcagggagccagtgagtcaggtggggacactgcctctgctggggctgggggagagacgtgggctccccctgtgagggactcatgccctttgtgtccctcaggtgtccttgaacagcggcctcactcccagtggcccagatgaggtctggttcgatgtggggcccttgcttttgg

SEQ ID NO: 38377 - DNA, 3773 bp, Bovine  19866880634176
ttaaaaataaataaaaattttaaaaaagaagaaaataaattaaaaacttagagaaggaaaacaaaagagacctattgttaagggagtgggagacggatggactggcatttcaggttagtagacacaaactattacatatggatggatggacaacaaggtcctactgtacagcacagggaactacagtcaaaatcctgggataaaccatcatagaaaagaacacagaaaagaatgtgtgtgtgtaactgagtcactttgctgtacagcagaaattaacacaacactgcaaatcaactatacttcaataaagaatagagagacctattgttaatcataaaaccatcattaatatcttagatttctataatgcttaatggcttttttcattcatttacttacctgctcactcaaaaggtatacacagagtacttactatgtatgtggtaacccctgtagcaggagttgggtatataaagatgaaaagcaatatatgctcacacagaacctgaagtctagtcagcagaaaattcaagtaggtaatcaaaagtgttgaacactatgacagaggtgtgtactggggactagagcccccaaagcaaaatacatgttagtctggtagagatggatgaagcacttaagctgagtctggttgggaagggaaaataagagttggccaagcagagtatgggaggagaggggcaccttaagccaaggctcagagactgaggccatgtgaggaactgccaatgttactgttgttactgtaaatgttatagtgttactaaagagacaaatgcttgtagagggccatcaggaggtaaggctgtagagaaagttagggatcagatcatagtcacactggatttttctggtggctgtaggaacagcaaggaaactagagacaggggcacctgttaggagatgaggcagaagtaagaggggatgtatacagcagtgacaatgcaaagagagaaaggacgatggaaccaaaaaaacatttggaatccaaagaatttggtgactaactgaacatgaagatcaagagaatgaagaattctttacgactcctaagtttctaacctgggtgaaaggtgtcacttagggcaataccgagtggcaaatgcaaggcgtgtgcagaaaggggaggagtgtttttactatgggggaagcctcagaaagttagaaagtgatgagaagagagacagtataaaggctcaaagtgaagacacaaaagaaaggggcagggtctcaaaggatatagaaaacgataacacataaagcatgtgtgataaggttagccctgaacacaaagggtatatcttctgtgaagacttcagaggaggtaagcaataaggatggatacacacctacagaaaaggttaggtctgggtgttgtttaggaagtcgaggaagctctttccagaaagtctttttttaaaaaaacgttaagaaaggaaggtttctgtgaaacttgtgaaaagagggatgtgaagacaacatctaagcttgagatctgctggcaaacactaaagaaaaatacattcctagagctaaggactttagctactagctagagtgtgtctctggagataaattataatacaaatctacaaagagagataagttatgttgggggacagggtgtgggggggtggggaatcaataaaggcctcacatataagaaagaacaaataatacaaaactgagaaaggaaatctgaaaccgtagaagaaaacagaaagatgattctaaatttgacacatttaaatataatattgcatgtctgacagagataagaaaaatgtttcacaaaccctgaatcatcagctgaaagctagttactacacaaagtctctgctgaaacagcagtagaactagaagatctaaggttgtaaaatctctcccctgacaaaagtagtcctatgcaagagaatactggcaatgagacctaggtcaagctccatagaccaccagactggatttgaagagtcagttaggacactcacctgaaagtgacttctggcacaaggcacttcactccattgtggaaaggccgggtgagagaaatggtctggctgacctgatccactgctgacactcttccctgatagacacccaagctatctccacagttgatggacacaatactgcccagccaatctgtagccatgtttcagatgtgagattgccgtggagagaaggaatcatgcagtgtaccttgagaaacagacaaatcttcagtaaaatttagaaaacattatatcaggttatgtaataggtgctgcttaataacacatattctatcacaaccttaactgaggtaataaagcagtaaaaatcaagctttttttttcccactaggagtaagcatactgatgaataagcaatattgttatgtatatagttcttttaagtactttcaaccatatgtactagccatttacccagacatcacttaaatgataatgaaaaatcctggacaaaatttgtttttgaaaagttgactgaagacattacagaacactaaacctaacaactacgggacatacattcatttccagttcaccaacatatgctgggccttaaactagtaccaattcatttcaaaggactgaaatctgacagagtatactttttgtccaaaaccagaattaaatttgaattcgataataagatttttcaaatctctccaaataactgtaaattaagcaaaacacctctatacaaccaatgagtcaaagaagaaatcaaaaggacagttagaaaatagtccaaagtcaaggaaaatgaaaatagaacataccaacatgtgtgggatgtgcttaaaaaagtgtttgaaaagaaatttattgggagagggagaaggtgggatgatttgggagcatggcattgtaacatgtataataacatataagaaacaaatcgccagtccaggttcgatgcaggatacaggatgcctggggctggtgcactgggatgacccagagggatggtacggggagggaggtgggaggggggttcaggatggggaacacatgacacccgtggcagattcatgttgatgtatggcaaaatcaatacaatactgtaaagtaattagccaccaattaaaataaataaatttaaatttaaaaaaaaccaaaaattaaaatatgcagaaaaaaatttatatatttatattttctaatataaatgcttatatcagaaaggaagaaaggtttaaaaccaatgattgaagcttccatcttaagaagctaggcaaaaaggagcaaattaaccaaaggtattagaaaggaaccaaagagtagaaatcaatgaaataagaaacaagaaagatacacaaaaccaaaaatctgttctcttgaaaatatcaatgaggctgataaatccctactagactaaccaagaaaaagacagagaacatatattgtcaatatcaggaatgaacaacagacatcacaggcattaaaaagataaatttgacaactcagatgaaacaaagaaattccttgaaaaacaaattacaaaagtgatacaagtgtaaaatagacacaatcactaacacaaaaaagctagaaatagacccacacaaatatgcctaactgatttttgacaaagtggaaaagtaattcaaaggaggtaatgtagcttttaacaacaaatggtaacggacaaaaactaccagaactgataaaacaaattcagcaaggtgacaagacacaattaacatacagaaactggctgcattcgctacactaacagagaaatgtcag

SEQ ID NO: 38378 - DNA, 1166 bp, Bovine  19866880742862
acccgctgacctctaagtgtgaatgtcgatgttgggtggcagccacaaggggctgggggttcagctctgagctccggggtctgcaggagatgaacaactaccggcgggccatgcagaagatggcagaggacatcctgtcactgcggaaacagaccagcatcctggaggcagagaaccgcatgctgagaagccagctggcccagaaggaggtagaagaggagtcagccagccccaacaaggcccagaacctgggtgagggcgtgcaggccaccgagggaacagggaggtgggggcctctcccaggtgtgcgtgctgcgggacacaggctaatcagtaggagcctggggtctctccggggaaggaaattgagagtccagtcctgtctcaagccccgggactgagagacatctgcccttcccacctgctcccgtctcaagtattccaatttgaattgggaggtgcctcctccctgagccagctcctccaccaccactagcatccatgaagcagaaactgctgctgagtgagctggacatgaagaagctgagggacaaggtgcagcgtttgcagagtgaactgactctagtaagccagggctcagagggcagaggggaagggcgctcgggagggagtacctgaaagtagaagggagagggacataggggccagggggccagggaagtggtgaactgagcagggggagctggggtggaccctcagggccaagggcatccctgttcccccttctcccctctctctgcaacccccaccaccatcagaagaatgatcgagaaaaggagctgctcctcctacaccaggctcagcagccacaggctgcgctgctgaagcgctaccaggacaagctgcagaagatgaaggcgctggaagagaccgtgaggcaccaggagaaggcaggtagcagaagggccaggctgccccggatccggccactgaagggaaggtgtgatgcccccgggccagcccagcctctgtgctccgccctccaggtgatcgagaagatggagcaagtgctggaggacaagctgcgcaagaggagcaagcccctgcagaacaagccgcagggaaagcccagcatgcgtgagtctgctcccgcccctgcaggccctgccttcttgaggcctctcagtttcagcagcaccttcaaa

SEQ ID NO: 38379 - DNA, 1538 bp, Bovine  19866880776656
tgggtttgcctgtacagaggttgtgaataagaaaacccaataaaaaagggaaagaagggcctgcctacaagaaagagactattgcttatgttcccaggcccatcagagaaagatattgccaccaaagcaagacagagttatcaggcagacacaaagatttttctcatagaaaagcagaacctagcaaactccccttgggtttaaacttttaaaatttcccagaataaatggccagcctactttttgagtgggctgagccaatgctaactggacattatagcctcaaaaagaatccaatttcaacaacatgagagaatgaaacacgaaaggaggcaagagttctcaaattgcaatcgtcaactcaaaaacaaacgggggagggggggattcctctggagatttttaagctttaattaattggaaacaggtatcaatatcgtctaaacaagtcaaagctccttttgtaaatttttaaattttttttaaagcttttttaaaaacagtctagaaaatctcgtcacatcccctttctttctgattcacttctatgacattctatgacaaatacaaaaaggaaaggctttcaggccaaaagtattctggaggcaggtttatcagcattcttaccaatcagtctccaaacacacacccctttcacaccctctcctcctttaaccagcccccctctttaccttcctccttttcaggcccccacccccagcaaacctcacttgagttatgtttcctcagcaagtcttcgcaactgaatggattactatgcacgggcaaattttaggtgaacaggacttgcaacatggcgtgcagtgctatcatcacataaaagcagcagcagcagtgcacaggttgggacttgataaatttgataaatgcactgttcaactgtttaaggattgggcagaaagacttaaaaaaagaaagaaagaaagaaacctaaatgtcttcacgtcttcaaaaactcacggggaagtaatcacacccctagcaaaatcaactgcttggatttatgttgttttttttttttttaacagattgaaaaggtacaacttttcaagctaggcaaaaaaataaatttttaaattttcattttctgtttaatcttagaagtacttcgtttgtcttttgcattctgtgaaaaattcaaattccaatttgcctcttactgcctctacttcctctcttcgcactttagaaagtgtgagttatgcctgcagcaatactttcattctgctatagccctttttatagcgtaccaaagcatgaaaaggtttacacccacgttaaatccagttgccaaaagtgttcatttaaaataaaaacaatctgcatcaaagaaaagtaaacaaaagaataaggaaaagcaaagaattcggtggtcattttcattctccttatagcattataacatcaatcgatcacaagcgggataatttttcaaacaagtcctgccagtcatcgaacaactgtttctcctcttgtggcaccatcttctctgtatgctgtcctcagcggggaggggt

SEQ ID NO: 38380 - DNA, 1811 bp, Bovine  19866880782450
catggctttggaactacacttgcgaatagctttcagagtttatactgttttcattagattctctccaaggtcgtagatcttcaaatatagggtgtgttttacttttagaaacagtcattcaaggaaaacaagccaggaaaataggatgaagtgagcaggcggtttatactgattttgtgtgaagatgaggtgtggccatacagcatgacagatttcctcgtgtggcttgaactgcctctgaaggcagctccccagggaggaattatagattccctcagagcagtcactggactaaatgtctagtcatttgagatgacttctttcaaagacaacaacatcatagatgtgaaaagtcattaaaaattcgcctctttatagtcacacagcaactgactgcgttaggctgggagttgctcaggggcatgggaaacgggcagatacgggacctgagaagatgagttaggagcaaggtggcattctgagtccccagggtgacctctcccctacaccagggctgctctgccacccagccccactctgggcacgtgggggtcgtgatttctctcagcagggcccctactgcctggccaggcaccccagttccaggaattggcaggtaagaggaacaggcgttttcctcctcatggatggccctccacaaaacccctaaaagtagcatccagagcaggtgggccccctcagtcccaccagaaacaaagctgaccatatcctgcaagccaactttagatgacatcctggctttctcacattaagcagccagtccggacataaaacctgccctggttttgattttttcgacaactaagacagaagcagggtcctcaggctagtctggctctgtggtctgccctgtgcttagtgggcctaggagccatctcctgtgtcccaaggagactcaactacgaaagagggggagaagaccttttagctgagtttccctccctgaacaaggcgaaaaaaacccaagaacatcatactggggcgtggggatggggggctgacatattcaggcctcagtttccctgtctggctgaagcagggaatttggactagatgacttccagctctaaagtcctatgagtctaggaataaaaactcgaagttcaagtctataagcagtgcctattcccctagccttggggggaaatgggggagctggtggcccaccctgtgggctggattacatcttactctaaagagcctcttcacctgagagacagctggcctcagtccacaataaaagccaaagcaacctgcagagagccaggaaggaggccagcagctagtgcagagcactctccgtgggtcaccagcattggccctgcagggggccgaatccccgcccctgttacacctcccagagtgggcgggagcacgttgcgggaaaccctgtgggctgtcagtcactgctatcaaagcaggagcttggattgagggtaattaatcatggtccctctgacagcaatccagggccttatctgtaccccaagaaatgccgctggtctccagttccctcctcaataaaggagactgacagttccaacaaagaggccccttatcagatttcagccagggagcctgaagcagcccgagggagatgcggaaagggcttttatgaggctgggaccaggcacgctgctgggggctccgggggctttaccccggggggtaggaacgctgctgggctgggcgctggccctagtgctgctgtccggggccttcagtgcaaatggagccaaacaaagcctgctcctggtcctcggactcctccctgggactcctccctggca

SEQ ID NO: 38381 - DNA, 1163 bp, Bovine  19866880798132
caggttcagctgctccaccaccaccttcttctcgctcttcatcaggtgggagaaacagctcccagagcagaagtcacagcctcggagtcctggctcaggctctgcttcagctgcgctgctgcgttgtctccaattagaaactggaattccggcacctctgcaggaaggtcaggccaggacccgcatcaggaatggttaagatggaacccgcaaacggtggaaagctggaggaggcctccccgtctcattcctaaccaaggagccaggcaaagctatgtaagtttcgcagtgaaaatttactgctcatgaccagccttcagcaaccacacctgagcctggtctcatgagcctcccccaggaacatcaggaattcatgaggccatgggacttccctggtggtccagtggttaagaatctgccttgcaatgcaggggatgcaggttcaatacctggttggggaaccaagatcctacatacggcagagcaactaagcctgagcactgcaactactgagcctgagcaacctggagcctgtatgccacaaactagagcatccgtgcaacataatgaaaggttccgcttgatgcagtgacgatcccgcctgccacaataaagacctgatgtaaccaaatacatatataaatcattttttaaaaattcatgaggccaaccagcccttcagttcctgggatactcagcctctgttctcagcctccagctctgccctgggttgcccttgcatcctaggtccagtatgcaggctcttagcattttgcccaatcttacttgttagaaaggtcacaatttcttcaactggccggaagccacataagccctggaagggggtgagggcaattgccatctctggcttatggttggcatcggggtagtgctgtggagcctggaggtgcagcttctctgccagctcctgtgggatgggcaagggagaggaggatgtttaggtgcagccgtcacccagcaagacaccagttcctaccagcccttgttcttgaccctccccagtcagcttcctgcctctggcactgagctcagtcaaggcataattcagaaactcagggttcagccaacccaaggcaggcacatggatcaactctggggtagagctggggcagactttaagaggactataaccagaagaccca

SEQ ID NO: 38382 - DNA, 2235 bp, Bovine  19866880800132
acaagaaggatgaatctgaatcttaacgtgagaaaagtcagttccaatgaaaaaggagcgatgttgggcaggggatcaagcaggacgccttggagcactaatgaaaacagcccactgtctctgggggtgtgttacaggtgacgagaacaatcccacagccctggatgaagccaggctatagcagctggcagcagcaggagccaaaggcttattgccaaacttccagtgagaagagacatttaaccagcgtctcctgacccaagaaaggtaccttgggctttttcactggggatctggaagaagaagaaaaaaaaaaaaaaaaaaaaaccaaccagaccacgcctctaagaccttaggagccagcactgcattccttagagctgtgcctccccagagacagaagcgcctgactttaaaagcaattaagtatctaggctattttaggattactccttgaccacctggaatatcttattaaagcacagctcagatgtccaaagcaattttagtccccattcctcactcttccccaaggcaagagttaaccctttccttcaggtttaaagcacagaggctaagttactagctcttcacttgagctccccatattctgaaacctctaagaagctgtcctgtccttagaacgccatcacacacactacagctttacagagattcttgagtgttctctgaaagcaacacaacagtaatgtgtttcctttctgtctactctataatctgatagataatgaatcccacccacctttcagatctgggcaaattcctgggccttgaacctcatagtcagctccatgggtagacttcaaaggggctgatcccaagctcaaggatatcaagctggtaactttgaaatataaagtgtaacaaaagtattccagctgaatactgctgttgttagtactgttctttttttaaaataagcaacacatgaactaccttttctttgctatgcctgtgtctctgtaggtattacccctaacacttgtgactgtctactactggacaagtggataatgctgtaatgttaaatgtccagttcccagatctcaagaagaaaagaaaaaacacctctggtctcccaccagttttaactgatcccaagaggtaatgagacatgcacaaaggggtaatgggctggattacaggagaatcctgaaaggagaggggagccccaggaagtaaaacagatactgttagaagcgacactgttggactccagaaccctactgataagatcaggatcactgctcttagctcaacggctcaggccttggaagcactggagttatcattatcagatgcacaccttccgctgtcaggtaactttagcaggaaccagaaagtgcttccccacgttcttactggcaacaaaggtcaattcaaactcggtggcttggaaaaagagccaagggacccttttctgattaagcagcagaaagggggaagggtggaggaagggagagagggttggcagtcctgcctttccatctaggcatataatcacactttcatgccataatcaagaagactgcccagaaatggggtgttcctacaaaaaggaggaagaaaactccaacacactgttggggatgaaaacacatctataccgaagagtgaagtggccccgacaaggctaagtctaagcaccccacaggaaagttccagctccttttctctgcagtatttgagtcagcagcacagattattcacgccgttagctaccaaccacctgactgtccataatggttgctgacatcccttcacacggcagagctcaggaagccagagcgggagagccgagcgggagaacacctgccctgagacctgaagaggtcaagaaacctgccctaagtcagtgcttcagaaaggtttcacaatttttttttcaaactacatattttaaatgtatagaaagaacaatttttttttaaactgctatgatgaattatttcataaagtaaaaaaaaaaaaaaaaaaaaaaaacttttccttcaagtttgggattctacagagcaagtttcctcaggcagaaaagttgcattatgtttagaaatcaatcccactgacaatctgagagcttctcctggggcttttgcccaccccactcccacccccgctccacaggtggatggcactgtggcacacacattgcgactctgatgccagccacccctgtgctgcctgccacctttcccaggctgaatctctctcata

SEQ ID NO: 38383 - DNA, 1493 bp, Bovine  19866880896139
agcctggcaggctacagtccatggggtcacagagagtcgaacacaactaagcaaatatcactcactcttttacttatgatcagtgagcaaataaaatgaaggctatttcctgaaatgattgatgaaagattaacagaagaggaccagaaatatccctttaaaatgggcaatcatataggtcagggttatgggcttcccaggcggtgctaatggtaaaggactggtctgccaatgcaagagacataagagacttaggttcaatcactgggtcaggaagatcctctggaggagggcatagcaacccactccagtattcttgcctggagaatcctatggacagaggagcctggtgggctacagaccatagggttacaaagagtcaggtatgactgaagtgacttagtacagcacagcaaactatagctcatggactaaatcctgcccactgcctgtttttataaataaagttttattagaacaccaccactgtcatcagtttacctattgtcactggcaacactcagccatctaatccacccaacctatatttcctgctgggcttttggggagaaagttcactctagataagtggaggaggaggacatgctactgagcgaatggtgagaaggacagttagactgaagcgaagacagcagctgacacgggccaggagaagaggcaggacaggcccagggtaaaggagtcttgaggtctagaatggtgaggtcacctgtgaggcaatggggagccactgtgggttgtggagcagaggagagatggcatttgttttcaattcattgccattattaaagaggtgtaacatggatcatccctttctcaatctgatgggggaggggggttcatttagacataaacagacagaacagatgggaaacttacagagcagttgcttgcttggaacgagtgttggcttaaagaggagcagctggggtttgtttccctacttactggtgtgggagtcgtctcccgtgaaagtgtaagcaattaaactggtggtggcaaaactcacagttggcagcacttctgaatgtgcctgcccaaggggtgaataggtgctcccccaaaagtgagccttctctgatcttgcctcttggaaatggtgaattaaatcagcaaagtaaacaggtttctgttcccaccaattactcggaatctggacagtaccattatgtatttagattttactagagggggtactgaaattaaaacatgcttgctccttataagaaaagctatgacaaatatagatggcatattaaaaagcagagacatcattttgccaacaaaggtccatatagttgctctggtttttccagtagtcatgaatggatgtgagaattgaatcataaataaggctgaatgacaatgaattgatgctttcaaactgtggtgctggagaagactctcaagaatcccttggacagtaaggagatcaaaccagtcaatcttaaaggaaatcaaccctgaatatt

SEQ ID NO: 38384 - DNA, 1784 bp, Bovine  19866880951522
ttttgtatgtggatatctagccgtcctgcaccatttgttgaagaggccattcttcaaccattcagtggttttggcacacttgtctaaaatcagttgatgataaatatatagatttgtttctggactctcaattctattccattgatctataatatatgtctatcctgatgccagtaccatactgtttcgatagctatagctttgtattaatttttaaaatcaaaatgtgaggctgtccccttggtagatgagaacactggctcaggaaggagaggtgactggctggaggcagcggggctgttcctgggctgcagggtggggagctgaggtgagaggatgaatgaagtgggttggctaatgatcctccttcccagagggagggccctctgcagtgagcagccctaggctttccatgtcccctaaagggctctacccaccgtcactcttaacagtgaaagcagcagccacatcctcccttccaggcctcacatggcccatagattccctatgggcattatggggcctggtggcctttacagaggcctggcctcacaggccaggcttttggcccatagggctctgtgctgcccagagatgcccgggtggtgttcagcacacagtggccacttggagaagagcccctcacagggagctctggggcccaatcccactgtgctctccccggcctcctccgcctttgcagtggttggattgcagccctgtctacgatgaagcacaacttggctgtgtcggtcatcatgatggtggtggctggcttcttcaccctctgtgccgtgctctcactcttcctcctgaagcgggtgagtgagtggtgggtgctgggccaactgcaaaccccaggaagccccagcccctggggtaggcacctctctcctgctttctccatgggggatgttcatcactacagcagttgcgtctcctgggtcctcagagctccagcagcttcctccaaggctctgggtgggaggtcagacaggctggggtccgtggtggctgccttgggcccatgagctggtggcccccaggcgggtggacttttctcaccacagcctctttctgcaggtgcactccctgtaccgcaggacaggggccagcttccagcaggcccaggaggagttttcccagggcatcttcagtagcaggaccttccgcagtgccgcctcatctgctgcccaaggagcgttccaggggaattagtcctcctgactcctccctctgccctggccttctctctctcacctgccttttgagctgcactttccacgggtgccttaagcattgggtatgcccagcacagacctggggagggtcttgcccatggctcttcttcctccctcagcaaccatctctcccttccacctgaggaaaggggagggagggacagggacttttttctacacaagaggaaaaaaaaaaaagctgtcttttcttctctggtggtggtttgataggatttttttgtatctttggaagcaatgggactgaagttctcttcttcacagatacacacatatactcacacacatacaaacacaaacacacgcacttgggatcactggctgtactgggcccaaccaccttgagtcctgagattccactcctccccagcaggcctgacgggaatctggcttcatggacccagcctgtcacttccacagtcctgcccttccctcctgctcagactctgggagcctcctaagggctcccctttagatgaactgcagtactgggctcttcctcagaatcactactagggtaactct

SEQ ID NO: 38385 - DNA, 2455 bp, Bovine  19866881021058
ctgcctgcctcagagcccagagctctctccattcattcctgtcggggactaacgggcatcctgacccctgagtcctcccaatcctacctccccggctgtcccagtttctataatagcctacctccctttccctccctcccaatttcccagggcatcacttgccccaaaaaagcagtcagatgatcagatgactgcctgccggggacattacctctaagtgtccacgatcccccctctgcgggttctgggatgtggtccctggctcccttggcctgaaagacttccagcccacgcactaccttcacacccacactgcccttcacctcctccacagcccggtgacaacctcccatagcttcttccagctgtaagagcctcccattctctgcagaaggctcagaaagtcctatctcccatccagccccaagccttcatgctgcaaactccaaaacggtatctctctgatggccctaagggagaaccgagacaaatgccctcatcactcaagtgcatcggcttccaggtctgcagaaagggagcctacagctgcctcagcccaggaccagcctgccttgtcctggctcctgctcccagtcttacaatgtcaccccgcctacaccccagtgctctatcctgctggcgggtcacaatagtcaggccatccgctgctagagcagagcaaggacagggctcagtgggtggagccaggatgaatggaggagtcaaggggtggtggatctcacaactcagaagccaagcctgtgaacaggaaattactctccccaagactcctaagagtcaaaacaccaatgagaacaccatgaccctgagaaaaccccaaggtgaagcaacagctggaagtcacatggggcggtatgtgcaattgagggggctgcctgaggcctagactacatgaccccagaggtgttaggcactgcgggagacactgcttttctgatggcaccactacccagtcccaaggaaggcctattgctcccagggcatcttcgcccacagtctgggaccaggaagttgctctaaagccacctcagggctgttttctttacggccaatgatcttctgggatgcaggctcatctttcagaacgttctattctgcttctggggccagccagaccccactcccagagggagcccctctagggaagaggaggtggcccagcagtcctccgcaagaccctgcaaaggcgctgccgtcagcaggcccttcctcacatctcacaaaacgctttgcatcccacagcagatggttcctcttacttgcataatctcaaagacagcaagaggagccaatttcctcactctgcctagcagaggcccataggacacctgggaccaggccctcccacctgactttccacatctcttcctaccatcctcaggagtcagggtgctggaccaagctacacccagctttgctcacactcaccacatttctgcctctgaatccgagtaccttccagccttcgatgccctcctccctctgccccacctcctccaggaagccctcactgattgactctttcacagctacacatattaactcctgacagctcttagccactcagttctcccttccaggtataactatccaaccagatgttaatgacattactctttatactcattttaaccaagcagactggagagggggtcccgggtagccccttacctgtggttaggtaaagcacgtggaaggtctccccattgctggcgtgcatgcggtggacaaccactttctggtagtggtacttagagtggaacagtggtgccttcagaggccccatgggctccaccctctgcaccacctcagggtgactgtcggccacctggaaggtctctgtgggtatcggctgccggtctgggaggcactgggcgaggagaacaggtccagatcagtggggtggctgggagatggggtcgcggcctgggccatggcgggtgtcactgctcaccttgccaggccgtgggttggggaggctcgagtggtagcccttgagtgaggaagtgcagaagaccttgtcaatgtcaccgagggagtacacgcagacagccgagtagttcctggggggacatagagaccacctcagtgggaggcccaggaccgcccacctccactcactcaggccagccccgcaccagatggagtataactatagccttgcgaccaagccacctggccttcgagctctgtgacagcagggactttcctggaggccaatgccagtgcctgagtgttagcaaataccactgaaggaaggagagaggcaggacagaaagagggagggacggaagttcagcctaatttctctcttttgcaatataaaaccacaacctgtattctgtcacggaatcactgagttcagaggtcaagcccagggcaggagaaatcccaacacgcgcatccttgggatgctaatggccacagaggccag

SEQ ID NO: 38386 - DNA, 1105 bp, Bovine  19866881034763
agtttttctgcagatggtatttcagctgtgaagagcaggctgccatgagtcttcttttattttttaagttttatttatttatttgttttggctattctgggtctttgttgctgcacaggcttttctctagttggggagagagagaggactaatctctagttgcaatgcatgggcttctcacggtggtggctcctcttgtggagcatgggctctagggctcccaggcttcagtagttgaggcacacgggctcagtagttgtggttccctggctcgagcacacaggctccgccacatgtgggagctccctgaatcagggatcacacctgtgtctcctgcactgggaggtggattatttacccctgagccagcagagtagctctgggatgattctctagagctacagaattgctggggactctgagagccaaaggagagactgggctacagagcaaggtgatggacttggaagtggacttgccacagcttccacataaattctttccactctctgtggctctagctcctacttggtgtaaaggatagacctttctcgggtactgcaaaaattctcagacagagcctgagatgcaaaggtgaaatgaatagaaggatgctggacagaattgaagtctagcaatacctcccctgtctcctgcctattctgttatctaaattccaccattatatcattagcactttgggctcaacaccctggtcatgcaccttaatacagatggatttaactcctttacctgttattaatatcttgcaagatcttggcttatcagatcaatttcccaaggctgattttctgtgttagagcatggaggatggagtgacagtttgggtccgtgtcctgtcaagaatcaaatgttctgagaattaccatgaagcaatgctggaaataaaccaggagaaatctaacttgctgtggaaaggatccaggaagtgttctcagaggaagtgatgtcttagctgaggctttaagtaggaaagattcaaagtagaagtgggcattcctgttaggctctgcaaaagattctggtttctattcagatgggagctactggaggggcaaggtggtgatggaatgagatttttcat

SEQ ID NO: 38387 - DNA, 1373 bp, Bovine  19866881058193
ctgaaagcactgagtcctaagcactggaccaccagggaggctctcacaattctctttttagccaaggcaagcttcagtgattcctacacaaggcagagcttgagagtcatctagggagagctccagaatagtttttaaaaatgtagactccagggtcctaatgaattaattcaggaggtggaacctaaggaatctgtgctttcttcgccttctgctgctgcttgtctttctgacttgccatgctccttttcttcacccaaagaatgggagtgatgatcaggtcttccaggccaggtgacttggtgctaaggcagggagttcataataaagctggtaatatttgggtactccctgtaagcacataatacttcttttttttccctgaaaaatacttacttatttatttatttggctttgccggctcttagttgaggcatgtggggtctgtagttgcagcatgtgaactcttagttgccgtatgcaggatctaattgcctgaccagggatggaacctgggccctctgcgttgggagctcagagtcttggcccctggacctccagggaagtgcgcagcatacatacttcttgtggtccgatgatgctgtttagaaatcagttgtgaagagctatggatttacacagagcaccaagaagccatatgagaaaggtcctttgtaggctgaagaatcagcatctttgtacccaggagccctacctatgcagttggtctgagctttacagtagcagtgttggcagtagattccagagccagcgaagtgggttcaaataccacctcttccatctattacccttgtgatctttcagtagggctcttaattcctttgagccctctgtgaaataaaaataccaagcgtacctccaaggatgttgtgaggattaacagagctggctcacggtggtagcagtgccccaggtgctttttcatgcacgcagtgccatcctccgctgcagctccgcagacatgctcagaagcaggggagacaccgagaggcgcagaggtttcccctctgatcaccaggaaggtggtggcagagctcggactaggatcagagagtcctagcttccccgacagcagcagcctggctgccagcccagacccgcctcccggctgattgctttggtttagcaaaacatctgtgacttgccggcagcccccgaactgctgtgtggttggcagagttccatgctggccgctgagtcagctcctagcaggagcccgccctgacagcactggggaaagttcaggcccgaggcggctgggctgcccctgccttggcagctggccagcctctgcgtgtgtgccggtcgttcctagaaagtgcagcctcgtgcgaggaacaagtggagctcca

SEQ ID NO: 38388 - DNA, 938 bp, Bovine  19866881074188
cacaaggattgcatcttctctctgccttctctgctctctggagagtcccacagactgtcagtaccagcagggccctggagatcacttggtccaactcccacaatgaccagaagataaatgggaataggctgtgcccaagatcattcaaagcttagtggtgaaatccgctctttcctgtgccctactccatcttgctcttttccttgccctctccatcaccttgtcttttgctctgtatttctctctctcacttatctctagagccttcggtcccctgaagatcccaggtccccaggccctcctggctgttcccacaaatagggacataagacctggggtggggaagcagctttgtaccctgccccctctgcgagttccctggatgagagccagggtaccccaacactgagagagggaaacaaaaccccacagtggtccagattccaggtcccctccctccttctgagtaagaagctgatctaagatcttagaacatctcttttcagagagcagcagccaaggaccctcgctcatctggcaggtccccaagggtttcctcgtgcctgcagcctggcatcttcctgttcttcctcttcatccagactgtaggcttcttctgctatgtacacttcaggtgggcattcccatgcgcaggacttcccacacctacctggcatctcttgggtctggaccacagagattcagtttgagagaggggatactaagattccagtggggagatccacatgacttaccagctggcaaggagcactgcccaagttagggcccattttttccatagagatgtggactacctgctcagctgctggtcccatctgagtcctctcttcacagaattcactctctaatgtgagaaactgacaagtaactaacagtcacatcctttgtgatcagggccatgatagcaggaagctcag

SEQ ID NO: 38389 - DNA, 922 bp, Bovine  19866881088158
cccagagccttactgccctctcacctcgattcagggacaggcagacaggtcagggcccctcagggttctcaggctgtgagcaaggagccagaatgggggctcggccccctcccactccctaaccccaggccccagccagcccattttgtgagggttcagtgagtgttcactccccggcctccccacggctcgcatccctgctctttcgctttggtcctgcaaaccactgaggggaaagggtctgtccagtcccattaggcagaaggcccctggagggcggagtgctgacgtgggccttgctgctgatgctgccgaggtggcccatgccccaccccccacaacctggggccagaacttggtctcctctagctccaggaaggtcaggaggggtttttgtcccatgaccctccttgggggcagcccaggcccctttccctggggtgttcaagagagaagacccagcgtgacagctgagcatcactgcccagatccggggcctgcgtccctccctgcccccacaaccgaaactgccagctcatggagattgttgttattccttggtggtttgatttgttctctttgggctggttagttaaagctctatagggtcttctcccatcctaactcatcgtcctctctttctctcccacctctccctccccacattacctactgcacaggttttatgtttcttgttcttattttacaaaggaacctaatggaagctttgcccttgaaaccaaaccccaagatggctcttctgcctataaatcttggctggcttctctacagtcctgtgtgaaacaggggcaccaggatctgcctgtagcaccttgctcctcgcaggcctctgagatggcctgcttgcagagcctcctggttggtctcctggataacccccaccctcgggacacacacatag

SEQ ID NO: 38390 - DNA, 1276 bp, Bovine  19866881555043
tcccctgcaggggtgggtgagcctgagaaagtgtctgggctcccctctccctaggaccccaattggtacaaagccaagaacaaggtgggccgtgagggcatcatcccagccaactatgtccagaagcgggagggtgtgaaggcaggcaccaagctcagcctcatgccgtgagtacctccaaggagcgatcagaagctccagtctgggagggaggaggatgggagccctgagtccccaggaagagagtcaggaaagcatgaaggcaagggtaagagctgggatgtccatgagggcctctcaagaggaagggcgtgggtgcagacctcagaggggatgaagggtgggaagcagaggacgagggcctcagtgcctgtctgagccacaaactctgaggaggcaccagccagagggagggccttcaggacgtggaacccagcactgcccttgggctgccacgaccccaggcttggcctccctgcagctggttccatggcaagatcacgcgggaacaggcagagcggctcctgtgcccaccagagacaggcctgttcctggtgcgggagagcaccaactaccccggggactacacgctgtgcgtgagctgtgatggcaaggtggagcattaccgcatcatgtaccacgccagcaagctcagcatcgatgaagaggtgtactttgagaacctcatgcagctggtggaggtgagcgggaccccagggccagctgggttccggctgcagccccaccgccactggcagggtgaccttgggcaggtcctgcggcctcggcgagcctgcctttccctgcgcctctgtagagcccctgtcgtgtgccggggtttatctctgagcccacagtgcctccacgtggagatggcaccccagtatgtaggccaggaaacaaaggttcagagcagttaaggggcctgctgctggtcacactgctgtgatttggaggtgccaggactagatctaagtcttctgatcccagagctagcttccctccagccactcagaactgtctgcccaaccatgtgtgtataagcatgtctcctcgagctccaccttggtggcccccttgtccggcagttcccaaggccgactctgccccaggcagccttcagatgcctcctgcacccaccctcagcactgtccccgccgctggcctgacttggggcaggggtcctctgcacacctagctagaggctgagtcagggctgttggtgaggccaagtgatagcaacagctggtgtccgtccagcacctggggtgtgggg

SEQ ID NO: 38391 - DNA, 3003 bp, Bovine  19866881719442
gtagcctgccggctcctctgtcctggaattttccggcaagaatactggagcgggttgctatttcctactccagttttattaactacaccacagtaaaaaaaaaaaaaaaaagaatagtgatgtgtttttttttacaatttgccaagaaacccagccttttggagtctcagggagtactgagggtgagggtaagattgctttgcactaaaggcatggggaggagtgggcagggcaggagaagatgacaaacggggtctcttacgtggctctgctagcttttttctacgccactgtctttcctgggcctggtttgcagggtccacctgccaaggcggcaggtgtgctgtgactatttggaccaaaggtagattctgttctgaggggacccaacgctgactgacaaatgggtggttcaatcaaactcctctctcaagaacctgaactgaggggttgttttttaattaaaaaaaaaaaaaagttttatttggcggcaccaggtctaagttgcagcacttgagatccttgatcttcactgtggcacgaggactctttagttgaggcatgtgaatggttagttgcagcatatgggatctagttctctgaccaggcatggaacctggcccctctgcattgacagcgaggagacttagccactggaccaccagggaagtcccatgaactgagttatgtaaaggaaagtgctacttaggggtggatgcctctgataaaaggagttgagagtctgaactggacaagataggagactttgaaaaatcacttaatttcccctgttaggctgacatgaaattcccagcccagggcttttcccagtatagggtctcccccccatttcatctttgccaaattacccttccccagtgccctgcaccccgcagtttgccagattctcgtgggatgttgcccatagcagaccagggatcattgccagtggcctgatcttggtttatggtaagacctcagagctggctgaggatgggggatcagaggcccagtgaaagggagggacttgcccaaatttaccacacctaaaacctgagttcagggctcctaatcctccagcccagttttctctccaactcttcacacggttcaatgatcgtattgcatttctgagctgccctgttctagccagacagtcctggctaaggaggtgaggcaggggaatagacccagccttgagtccctcccccaccaattctgagccttgtgttccttatctctaaaggggtggtcacagtatctgccttctgaggtttttgtgagaacaacctgggatgatgtatgtccagggcctgcccagaaagggacaggacagaactgtttcagtctgcctccagcctgctgtgggaggcagaaggtgcatggggggcaaagtctccacgtcccatttctgctcctttggccctggcacgaagggaaccctaagtcagcccaagtgagttaaagattggccaggtgtgcgtgagaagctcaggccaacttctgaccacagggagccagccagggcagtgacctagggtgaccgccgctgggccttgactgagtcttggatgggcaaagtatggtagtgtctgtttgttgcttgttgggggtctttacaaggggacaacagaggatgagatggttggatggtatcatcgactcaatggacgtgagtttcggtaaactctgggagctggggatggacagggaggcctggtgtgctgcagtccatggggtcacaaagagtcggacacaactgagagactgaactgaacgtgtgccgatagggtgccttagtggagttttccagtagttagaggctccagaaggataggaccatgtccctgacagactggagctcccagagcaagggcccatctccttgctcagacagggaggtgtttcttgagattcccaggcctgggctgcagcccaattattagactgggccttgcagagcaggctcatttccccctcagactggagccccccggtagggctgctgtctccttcctcagcttgcgacatgcaggaacgggtctcaggttcccaggataggactgtcctctccctcggaccacaattccctggggcagagctatgcctccttcgtctgacaggtgagctggctttcctcagaggtttccttgaggagtttgctttgggtgtgaggacaggcctggaaacagacaagtggagctcaagtgaggtgctttcttcctccaggactttaacagagaatctggctgggtttgttctttttctttttttaaattaattaatttatttatctgtggctgtgctgggacttcatttccgtgtgcaggctttctctagttgcggcgagtgggggttagtctgtagttgcagcgcatgggctcctgactgtggtggcttctcttgcggcggagcatgggctcaaggcacgcgggctttgtagttgtggtgcacaggcttattgcccagcagcatgtgagatcttcccacaccagggatcaaacccgtgtcccctgcattggcaggcagattctttaccacaggaccaccagcgaagtcctgattttactcttatattattttcttcaaaaccgcagacagccatgattatttccagaaggttggggcaattcagccactgcatgaacactttggaaatgaggtctggcttgttttcatctcatctctgctgctgctgctgctgctaagtcgcttcagtcatgtccaactccgcgctaccccatagacagcagcccaccaggctcgcccgtccctgggattcttcaagcaagaacactggagtgggtcatctcatctcagagaactgcaatttgtaggacatataaggctgaatcttgattagaaacaaagaaggcaaaaattaactgaaggaacgtgtcagcaagagtgcagatggcgcgtattaggtagtagcggtcctgttggccaaaggtggcattgcagcttagctcgttagtccttgggttatcgctcagaagcgga

SEQ ID NO: 38392 - DNA, 1260 bp, Bovine  19866881920887
tgccgagacactggagcagcacctgtgccttcctgttcctcctcctgaaatctgtcctgcctcctccaggtggcttcctgtttgaagggctctctgatgatgaggacgactttcacccagtaagtgacgggccgcccgccatttgggggagatggtgctggggaggcgccctcctcaggacctggcacgcccagcagggggtggtcagaggccctgtgggggcccaggtccgccacactattgctgtgaccctggcagcctggggagtctccccaagaactgttcttggagcaggggtggggttctgaaaaccactcagggcttcccccctgatctgggcacctcccttgtccagagtgccaggtccacgccctcaagcagcacccccagctcccgcccagcttccctggggtacagtggagctgctgggccccggcccatcacccagagcgagctggccactgccctggccctggtcagcactccggagagaggtatggagagagggtggggaagtccaggccgagcccccaggtatggagagaggggtggggaaggtccaggccgagcccccagggagaagggcccagtggtagagtgggtttacctttgctgatccttgtgctccatctgctttgatctgagctctacctggagccccagtgggtttcccactgcagctcaggcgacctcccctcacctgcctttaggctcagaagtctggggctcatcctaggcctgactgactcttctcagcagttggaagaacctcatgtcgcataatggttccttacttattcctgaaagtggccaggcgtatatcacaggcttaagcattcctggtgatagtcactccagccagcaaagccatctttcctctgccagtatgggtcctaggctcggtcaggggtcccattccatctccgtggagcaagagagtacagaacccttcctgcgcacatagagagctttaaggtggctctgtggctgtctcctgctggcccctgctgggaggcagtggtgaggcacgcagggcaccgtggggcgatgtgacggcagcgggtgtgtgctgggagactggggtggctctgagggtggcactgaccatggtctgtctctagggccactcctcagggacctccccaatgtcctccagcgtccagtcagggacgcccatcaccaacgatctcttcagccaagccctgcagcatgccctgcaggcctcagggcagcccagccttcaggtcagtcttccccgtt

SEQ ID NO: 38393 - DNA, 642 bp, Bovine  19866882182869
cctccccgaccctggcctgggagccctgcaggagtaaagccaggctgactcacgtcctagcaggggccaggcccagagcggctgggccgtgattgagtactgaatgaatgaaggaaccaacaaacaacagggggaagctaggctggctgcaccacactgtggtcccacaaccgacaggactatatttaaccccaaaaggacagcagctgccaccccacccccacagagctgggggacagggggctttcactcctacttcctgccccaaaccctgctcccagcagtccttgtgctggggtcccgggaacaggctgggcattgtgcccaagcactgaggtcagtggccgcagcctcaggcaggctttcttgggagcccaggctgccagggaggggcgaagcccagaaactgccctcttcctgctttggggcagctgtagaccccagagccaagcacgtgctgagggccagagtaggtcaaggggctcctgccctgcccccctcaccaaaactccactgcctagtggggcgtgggagccttcagtaactgtttacacccagctaaaaatacccactgaaaagggaagtgcacaggagacctgggggggactcgggggccacagtccccagagactcaggtccagc

SEQ ID NO: 38394 - DNA, 1833 bp, Bovine  19866880347367
ttagtaagaggaaaggacattgacacaggaaccacaagggatcaccccagggacatcacatgacacaaaagaagggggctgggaagactgttcagctgtgcaagtcccccgcgcagagctgtaggtggccaggccagtctctggggacaggatcagagtacagggcccaggagccagcagactgatgccaggactcgtgggaacccatggctctgtactgagtgcatggatctgcagaagctcatggaatcatccacttacgatcttacatccactgcacgtaaatgtgccctcaatcagatagaagtagcaagcctcaaagatcaacatttggataaatttggacttggagtcaaggggaagaagcggcccggggaagtaggcctgacagcctggggtgccccccttgggcagaccgccccctcttccaccctaagagtcatgatgcaattcggcttgtcgcccttcggcccttctggtcctgtgggcagaggcaggggccgtgggcgcaggtggaatgggcaggtagctgctgcagaggccatgcactgacaatgtctgtccccctggctcccacctcgagaggccagcagcagcctcagaccccagaccccagaccaccaagccaatggaagtcagcgtttccaccttatacctgtgtctgtgaagatgcccctgcacctgaccctctaggggcaaggttcccacctgggccttcaaatggagggaaagggagtgggaggtggggtgaccgactctccactccatagcttccaagcaaaggtcaggacccagacttggggcctccccagaccccacccggccttcgaggtcatggccaaactcatatctccaacctcagtcccttggttcccttatttttttattggaccacagttgatttacaatgttgtattaatttctgttgtacagcaaggtgaatcagttatacatatacatatatccactcttggattcttttcccataaaggccattacggagtattgagtcaagttgcctgtgctatacagcaggtccttattagtggtctattttatagacctatataaagtggtctatataatagtgtgtatatatcaatccaaccccagttatcatctctgatggacatgcactgcccttgagctgtaacccataaagcaacacaatccactcctgtccacccggagcatcggccttcatgagagcggctgggaacacccgagtaaattagtcatgagggagcctgtgggctgcggaaggtaataaaatatattgacactggcaagagttaattaaagctttacaagaattcactcacggagggcctttgagttcaagccaaactccaaaagcctggagaaattaatgaaattcacacacgtccccagcctggccatccacataggtactaataagccatcaacaattaacacgagtttactcttttgttaatgacttaatttgcaatagcagagtgtgaaagacagcattgtgcagtctgcagaaggaggcaaaggcattctcaaagacacacacttgctttcttacagttttactttgggtgatgaggaaataaatcaagcaaagaaaggttattagtgccatggtgcatgcaggtctaaagatgacacctctgtctctgggacatggctggaccccctcccctgtgggtcagtggagccatggacactaagagagccacagaggggctgcaggtgtggcccgaggcagacctgtagagacacacagcctgcagaggaaacacacccagaacaggatcaagtcaccaccctgaaggtgctgtcccagagccagcatccaggggcatt

SEQ ID NO: 38395 - DNA, 2326 bp, Bovine  19866880373769
ctgatgcacccttttctgtaataattaaagcagaggcacgaagtagggttttttttttttaaattatttatttggctgtgccagggtctttagttgtgtcatgtagactcttagtggcggcatgtgcgatctggttccctgaccaggaatcaaacctgggccacctgcatggacacattgtaggattggtcggccagaaacagactgttttagtcagcatccagttcactcacatagaagccagagcaacttcatcatatctccatctgtgagaatttctttcatcagtaggttgtgccctggagaaggctggtgggggtgctcactggtcattccccgtccctcccactaaggttaaagatgggcttctcctgttatatcaggggtcaacaaaccactgtccacagacaaagtgcagcctgtctcctgtttatgcatggcccagggcacaaggtgagcaatgtgagcccaagctagggtgtcccctccaaccttgcttcccactctgctcccaacacctgctggaccctgagctctggactcccagtctggggattggagaggcattggaggaaactgacttagcttccagttagttttcaagggggaaccaactggtcctccaggaggaacaggtctgggtgtcattggcaaagagaaattgatggcaggggctgaatccccatcaactacccccatccatctaatctggtccaccaggcccccacccccaacaggctgttcttcttgaggtggtctccagccaatgcagttgaacccatagggtgcccactaccaagggcaaatttatatttgcttcttgacccagagggtccagccgggctttcctgatagctcagttggtaaagaatctacctgcaatgcaggagaccttggttcgattcctgggtcagaaagatccactggagaagggataggctacccactccagtattcttgggcttcccttgtggctcagctggtaaagaatctgcccacaatgcgggatacctgggtttgatccctgggttgggaagatcccctggagaagagaaaggctacccactccactattccggcctggagaattctatggactgtatagtccatggggttgtaaagagtcggacatgactaagcaatgttcactttcacttttggactattaaaaaaattcatataaaatgcagaaaaacagatcaaaataaaaagacattaagaatgctttgaattcagcagtaaaagggagaagtcctgaggcgcactgatgaacctcgagatgtcacttcggagtccacacaccactccatctacatgacgtgaccggacaatcagggcacgaaagaaagacggctctggctacaccacacgtccaggacaaccaagtcacagagacagaaaggaggcaagtcccaagaaggagcatttgggctgtggtttggggacagtgtgtggctgaggttactgcttcctgagtccctctctcaggactctacagaagacgagccccttctgcctggggcaggcagacactcatcacagaactggtcctgcctttgacttcctggtggcaggaaggtgttccttccctgtatgtcagtgagattccaacgtcagagcctggtcccctctgcggagcaggaccacgagctgtctgcagaagcagcatcttcccaaatacaagaggcccagctgggctctggcctgagcccgccagacgtcctgtcgccacacagaagccatgtgcaatgagaacacatgggcgacaggccctgctggctgaggggatggcacgcagatcacggagcacccggggccctcagcaccgcccacccccgtcccctccgctctgccaagggctggaacacagcctccctggaggagcagaaagtccagaagcagacctgacaacgcctggtgactttcttgtgtgcctgagggccgcaagtgggcaaaggaagaaaaccacacccacctgccagccattgacaatcttctggttgaaaatcccaaactcatagcggatcccgtagccgtacgccgccaggcccagggtggccatcgagtcaaggaagcaggctggaagtacaaacacagggacagtcagcagatccgaggcctctgagcccaggcctggacaccgaggcaagcagacaccccgtgttggggggaagcccccagggtggcaggcagtagctccgtggggacctgttggcctcaggtctcgtgaaaaggaaaggctgaggctgctgggccaccgctgaggctctttcgcctaagagcctatggccaagacagcatcaacatggggactacttgggggcgt

SEQ ID NO: 38396 - DNA, 1416 bp, Bovine  19866880417539
cgcagagcctgtgcttctgtgggaatggccggcaactcagtggctacgaggcggggctcttgtgtcggctcagggaatcgatgtaatgaaaagtggcgcccagagcccagctggtctgccacgttgtcgatcttccgggtcagcttgaagagacaagcagggagaggagcacgtgtgtggggaagacgggcacgtgctcttgaggggcagggagggggcaccccagggttccctaccttcagcactttgtcccccgggaagccgagctcctggagcagcaagctgatgtaggtgaggtccaggcacaggaaggggctgggtggcggccgggtctctgccgtccggcacactgagggggacacggctcctgggtgtgggcacgggcccaggctgcctagttacacccatgcagggcaccaccccctaggccctgtgccgcccagggcctccctgctggtcagagcccaggaccagcagggacttgaggtcaacccagggtctactacccaccctggctctgtctccacccggtgaccccagccacctctcctgggtgtggacccaagcctcctgaggactggaaacaccctcaaagctgatgagagagagcaacccacccctcttagcgaggacagacaaaccacccatagcctctgctcagagccttctcccgctggtgtccaggagacaaacccagaagtgaggagaacgatggaaaagaagcctttctgggggcagggagaggggaaggaggtcgttcgatggagaaatacagagttaactccttggacctgcaactgggaaagggactcagggtggaactgctacaagcggcctgcacacctgccagtggggagtgaggagggaagggtgggcaacccgcccccggccacaccctagggggacggatcttggtccccctctctgggctctgctgtgcaggggtccctggcaactgtgaatctgctgggacactttgggggcttgaggttaccctagccagagtcagaaaaagtgaaatcaggggagtccacgcctcacaccccaggactaaaacccttgcccctaccgctcaggccacacaaggcgtggtgggcttggggtccagctggctcggtggcccctcacatgctcacacccctgaaggcttgtctgggcgacaggcaggagctgaagagaaattccggggccagggcctgcctcgagcccgggaatggtgtcctgcctccaggccactcaccatacttggccgctatctcaaagtcttcaacgacaaggctgcctcccttctccgcatctgtggatgagaccaagtgccccgttggcaccagggctgcagagcagagacagcactgaggccctggggcccacgcacccgaggggagaggtccaaaggtggacggctgcatgtctggg

SEQ ID NO: 38397 - DNA, 1344 bp, Bovine  19866880477545
ctctcccaacgcagcgtgggcgcccggtgggtctctgcgcgcaccccccagcgtagcccgagccgagcccgagctcgagccgagccgagccggagccgggaaggatcccgagctggagctgaacccggcaaattctgcgtccccgggtgggtcttctgcaaaccccaggattaagcgaggggcttccgataaagataattacaaaaggctgcgcattaacttttcattattaaaagaagacccaaatctccccctcgcaagctgttcctgagattagcaaaaccataactttcctttaggataattgtcttttgagtcgctcggggctgggggcgtctttagggaccagcgtcgttttgggctctgccaggaatttctccccaaatttatctctgagtttaggggaaagtgttaggggtacaagatccaaccacgatgctctggctctcggcccggcagagcaggagttcgtaaatcaggatttggggccgcagttaaggaagactgctaaagatgcacacaactgcagacatcccgagcaggaaggcgggacaaccggccttgaggtcgccggtcctggggccttcgcaggggctggtctcagagacggacgtgtgtgcaccctgtctgcagcttggagggccgacggcgcccgctggcctgtgccggggtctcgaagtttctgtcccccagtccctaccagagcaggcctcgaatagatggccagggacccccggggtaccaaaagcccggccgaaaggagcccaatttcgaccgccactgagtgccaacagcacactagtttccaaccccttaggaaggatattacaaaacccattttgcagatgagagaaattgaggtgtattaacccgctcacaccggacacgcagagagaaatcgagaaagcaaagcgaagcaaaggaaagactcggggtgggagttataaggagatcttggaattcctggacggaagagtcactgccgccggctctggccccacctacaagaaggggctcgcgggagggaccaggatgcagggagagctgagccctgggcgcttccctttccgccgcacggtggctgcgggggcgggcaatcccgccacgctaatctgcgcccctattccacccgcagacattgcgtgggatcgtgggtctgctagggccgcagcccctggggatcgcgtctagcgctccgcccaaagttggcgcagtgagggaagcgcgcccagagtttcaggagacggggagggagcgagctggccctaagcccacccacattgcactgtcccccggcgtcctggcgggtgccttgaatccagataatgttcggcggcgacagca

SEQ ID NO: 38398 - DNA, 1081 bp, Bovine  19866880787452
tacagatctgagagcaaaggcagatgcggcaaaagcagatgcagaggccccacagtgagaggatgtgctcagacgtcagcccagaggcaagagaacgcgtgagagctgtgaaccgccaacctccactgccttctccctcacaaggggcccggcccgcagcgggaccctcttccacacctgcctggcctgaacacgagtctgcccgacgcccacctttctgccgagctggaagggcacgaccgggtcgtcctcggcgtgcaggatgagcagggagcaggagatgtgcttcacactgcaggaggcggagggagaaaggcactggatggccaggacaggctgggcctcccgggctcccgggctgccagcagcaggggccagtgagggagccctgcactgcagcgtggagcgcctcaaactgccaggcgcttttaatacaaagccagcagctgatttcttagatgtttccatcagtatctgttttaggtgacaagtttcaatcaaatctagagctcacttcattcaccaaatcgggtccctgaatattacctggaaatttaaaaacaaaacaaaacaactttgccagtacactattcttaaaaagttacaaaacaatatttacaaactgagtaataggtgggccaggaaacttactgcaaatgaacattactggacatcagctggcaaaagagccaccctctaatttctcttctgtgtatatgacatttaattcctgaatgtttcaaataaatgaacattctcaagatggtcactgaatccaaacccctcagcaaaccgccaacggaaggacaggctgcaggactgatgggccctggacgctcctagctgcccctcactgaggccgcacggggagctggtggatgcagcacacgcctgcttctggcgacctcatgctgaactgaggctttgcgtaggcagccccagggcaagcctggcacctggcaggactaggcctgggtgtgcgcccagccatctggcaggctgcactgctgctagtggcacacagatcacccactcaccacattctactcccagggtgaagtgcttgctggtgtacaggaca

SEQ ID NO: 38399 - DNA, 2010 bp, Bovine  19866880800489
ggcccagggacggagggagggggctgggctggggaagagggtgggagccacaggagggacgcccagggctgaggcccagtcccttacgactctggggaagtctttgcccacacagcccatcttgaggtctcacacacatttgttctgagctctcctcaccctcctggggtccctcccccaaaggcaggtatcacctgtttaacagcaaagacaccaaggctggtgagacacagccagtagcagggacgagaccccagctgccacccacaaatccatccccacccaagtacaccaagtccccaggtcccagagacaatcaccacgcttggggaggtttttaagagaaaatggctttacaaggactcatcttcccctcagcaaattcaagacctagcccaggtgaaggtgtcctggggccacacacctcccggaccagcaggcatggaggaagggcggcacatggggtgacaatgggatccaggtaacagcgggctccgggtgacaacgggcacagggtgacagcaagcctaagcagactacaggcggagtctgcacaggtagggggccctgaaggagcccaggtaaagatgcccactgtgttcatgcgcctcgctcacataggtgaccacctgcccttcggggtcatgcagactcctcaggaaggtcccgctatcactgagctccaggacaaggctgtaccgtggcacgaatttcatcactgtctcttggctgaatagctgcaaaggaagcacagagtagagagagtatggcagggcaggtgcagaccctggagcccagacaacaagcccacctggagacccgcagccaggcacctagtcctgtcacctgctgggtgcatcccacctgcactgccccccactgaaccacctccccacctgctcccctccacacaagagtgctactgccttttaaaattattggtcccaaaacatttagtcaaaaaatggcttgtggggctaagcaggctaggtgcgtgcaggggtcgcccaaaccagggagtcagtctgagtagggagctttcaccctggaggagaggccatggctccaagcaggggagatggtgtcctgcagcggagtggctggcacaggccgtgggcccccaaggagacagcaggcccctacacgtggctgggaggagggagaaactgggaggagggagaagggctggcctaggtaccagagccctaaccagggccgtgtgatgctggggacaaaggctacaaatgtggacactggggaattgatcaaacaggcatgagggagcacgggacccaggtttctcacccttagagaaaggaagtaccaacatggatggtaagaagacaggcacagatcctgtggtgttggactagaaacatcagtcttacttagagttttcagtttaaaggaacagataaagatatatgaatgtaggtacaaaggtctgtccatgagcacatgtgcacagactcactcaggaaccgccgcctggcaccttctaggaccttagattacaaacagttcagtaccagtaccatgggcaggatcccatggagggcatgacgaggctccggggaggcagaaggaaggggcacctaaaccacgtgaggaagagccaaaggctgggcgtccaggggagagcaagaggaacaagcaggacagaggcccaacaggtcatgatggtgagggtgacaattccagatgaggaaacaaggagggcaagagtcagagggctcaaagatgtaaattcacattttaaggcaaaggataagtttaaagaagtcactgaaagtatcagataccataagcagaactagaatctttagagctttcacaagggtcaaaaaaacccacaatgagatgcaatttcattttgtttcttgaaatcatagttttcatgtttaccttaaaaatcacttttttaagaaaaggcctctcggataagaaatccaacatggagaagccgggattggcgcggatggccgccatgctgacccagtaccccccgga

SEQ ID NO: 38400 - DNA, 697 bp, Bovine  19866880843197
cttgcactcgtctattgagtatgtcttagcattatatacatattttattgcttaaaaaatcctgctctctgacaatgcagggttgacacaaatcatcagtttgtaaaaaaacaaatcagtattagagaagcacaataaagcaaagcacaaacgagagaagaaacataaacccaagccaaaacttttgcttgtagacggtggtgggaataggattgaacaattaaaaatttctggctgtacctgtttttaaagttttaactttagaaccatgtaagtgttttacacattgttaaaagaaaatgaaatcaaagtgaaaaaccaacccaaaactctctttggcatctccttcagtttccttgctgtctgtgctgacctacacatatattcagagatttggcatttttcttcctccccatcagagctgtaggtacatatacagtgcccagctacttgatggttactccgtaataaaaaataatttagatatgataaaacatcagtttttcttttcaggtgcggtgtctaaaagactacagagaatttgaagttgaggatgttgcttcagtgctattcaaaaaacatagccaggtatttaccgtcttaggatactttaaattttgtaagcgtgtcgaatgatagaaatgttggaatcagtagcaaactaaataccaccttcgagatcatttgtgtcataggt

SEQ ID NO: 38401 - DNA, 1568 bp, Bovine  19866880949466
acactaatcttttgttaagataaaacagtccaacaactgaggttagaagggaccattgcttggtgaacattcccatcagagtaaaaactggcttctttgcacagtgtgggatactctgattttgtcttgtcatccttcactccatggaaactttggtagaaattgatccggatcacctagtactaccagtcctgtgagctgtgagacaggccaggtgctcccagagagggtagctggcccttgcacccctctgtgctggggagggggtctcctcctataagcctctctgcttcccctcccacctcaatctaggtctggtttcaaaaccggcgggccaagtggcggaagcgagagaagcgctggggcggcagcagcgtgatggccgaatatgggctctacggggcgatggtgcgccactgcatcccgctgcctgactccgtcctgggctctggggagggcggcctgctgggctcctgcgcaccctggctcctgggtaaggaagaaggccttgtggccgcgccgcacaggcaatgtccggggtccctatgattggagggccactgccaagccaagcagtgtaaatttactccgatttttaaataattacaaggcttggactctaatcggttgccttttcattggaactgtgtaggcagtgtgtggaggtccagtcaggccctggttctctgagtggaatgatacacattcattacgtgaaatatgtatttccagtgttgagtactgtcaaccacacagttcagagctcatggcaataggaagcaagatggtgcaggcagtgaacctacaggccgttaaccacacgcaccctggactccagaggtctggttctctgtcccggttcagctgataacaacctgcgacgtagctgttctgtgccctagttttgtgctagaactgtctgctctgttggagttcaagctttgaggctggaagttctgagaagctggcatccttactggtctgttggctattaccggagaaccatgggcttggagaaatgagttatagacagcatccaggcaaattaggtggaggaaaacacaaggcagaaagttaggattagggggatgctcgcagggggccaattttaggctggggaggaggagggtttttgttcagcgaaacttttttgaactcctgcccacctgaaactatgctgggactgaagatatcaagttatctttgccctcaaggactggagagcctgagagggagcgctgggcaggtcacccgacccacccctcctagcttacatgggcaggtggggtgagcttactgagtctgcaggtctgcggccttacaggaaagtgggcctcgggctgccagacacctgactttttgagagaagctggacatctggcttttgatgtaaatcttttgattttaaaatcttgccaacaaactttaaaataaaaatttaaaaaccaccacgtcatccaaataaggcatttgccctggctgtgcccagtgtacaaactctaatgttgagagttacctacaagactctctggtaggccccagacaggcaccagcaatggaaattctaa

SEQ ID NO: 38402 - DNA, 1621 bp, Bovine  19866881017547
ctggggctctgacccctcaaggaaggttctagcccccatcaggcgggaccccagcagggcttggaggaaggcagtcctgtgagcggtgtggaagacgtggtcattgatctctccagctccacacgccaggagactgatagagcacagcagggggtcggggaccaaggacgtccagactctgaggggctagaggggctccaacctgggaaggagggggccttatgagaccctaggcctctacctgcaacacacaaaggctggaaatgtgcacattcctcaccagcatttttcagaagacaaacgttgtccaagacaaatgctctcagctggattttcttcttcctgtgtcaggataaaatgcaatgtcacttgctttaagaagacaaatggtgactcttggaacattccactgcattctagaatggaaatcattccttgaaggcacgtgaatcaattaattagatctaatacttgcattctcttctgtaggtagaacttgaggagggaggatttcaagccccaaacgcattctcactgccagacattctgaagtttggtttagtagactgtgtggattcataggctaagtatgctgtccttacactgaatcaaaaaatacagaagtatttaatctacagagaatcatatatcttcataaacagtgaagaccttgtgcagcccccatatgattgaaatatgatattcttaccttgaacttggctttagacatttccattttcttgttagacaatgcttctgtgtccctctgagtgtcatttgattgggtctgtgcatcttggaacagttcctccaaggaagctctctcccccttcccttctgatacagcagggaaccatttctgaacagctgttgaatatctataaacagtgttttaaggtcagatcaggcttctcggttttttaaaatttatgtttgagagcactttagagacttgatttcgtgaatgtttccttgcctctatttccttcctttatttattatttaaaaataaatgttttatggtttgctcggttctcatgcacccactctgtccacatgttcatctactgccaccctgaccaagggcatccccatttcctgccccaaactttatgcctgaagccttcatgcttggctgcagctcttacccagtgttgctctgtaaactcctataaggcaatggctgtatctaactcctttttaaaaaaaaaaaaatgttgtaatagttccaggtacacagcagagcaactcaaccatatattatacatgtatccattctcccccaaagtcccctcccatccaggctgccatgtaacattgagcagagtttcctgtgccatagagtaggaccttgttggttatccatttttaaatatagcagtgtgtacatgttgatctcaatccacctgcaatgcaggagaccacctgcaatgcagagacacaggtttgatccctgggtggggaagatcccttggagaaggaactggcaccccactccagtattcttgcctgggaaatccggtggagagagggggtcgcaagagttggacacaacttaatgactaaactaccttcaccacatgtcaatctcaaattcctaactatccccttccctccagtc

SEQ ID NO: 38403 - DNA, 1338 bp, Bovine  19866881284229
ggtgaatcttgaggacgttacactaagtgagatgagtcagccacaaaaagacaggtagtgtgacgtcactacactaagtgcccatagccggaatcactttcactttctatttctagagcgtgaaatggtggttgccatggcctggagatcaggggccggggagacagtttaatgtgtgcaaagtttccggtttacaagatggaaaaaattctggaaatggatgctggtgatggtggcacaacgtgtgtcactgtgccctgagctgcacactgaacaagggttaagacggcaaactttatgttacatttgtttcaccatgatacacaaataatgcatgttttaggtataatgtataatattttgaaagtatatctaaaaacaatgcaaaaactaatacaattaattcatattatgatagattgtgaaaataagtctaaaggctgtttctcataactggatttgtcatatgcaatgtcataatgtcagatgtaggaaaaattactatttatgaaataaaatatattataaaatccttgagaataatttagcacaatctattaaaatcataaatagccttatctaccttatgcgacatagtaacccaagtttatttttatatttaagaaaaagagaaggtgaaaatgataaaaatctaagggtctgttggttgcttacaattttattttttttatgaaaataggaatttataaatttagtaaatatttattttgataaagatgaggattgactataattcaaataaacatttcattctatgatttgaaaaaatggattttagcttcctttaaaataatgcacacaaaattttaatcagcaaatttcagcctgtgtttatattgaaaaccatgggttattgctccctaaactcaaaatacatttaaaaccataatcttattaagctataagcatccctgctccactgctcaaagatacttgtctttcagccaaatgacatatccagatgacaagcactgacaaagtcagggagaaagctgatatttttaaactcatgaaagaagttgatttcagtgcttcttacctgtaatctctctgcctcactcccacgtgactgttccctgaaagcaatgctgactttggctatacgtgcagagcccctgctccactgcctgcatctctgggtgcagacccttccagcacttctcccgacagagcaagtttcatgcgggaagggtccccacactcacgtgccatcttccagcagccctgatttccagaacaggagagataggtatcagtgggcaccatgagtgggggatgggacaggggccctgcgtgccccccagtcaacttaagagg

SEQ ID NO: 38404 - DNA, 1220 bp, Bovine  19866881579888
ttcgaggccccgggggcctgccgtcttttctattccacttaccttgctatggaaggtccccaggggcaactcatctctcaggatgggtatctatagtttcttatgcttttggcctcactgcctgtctgttttacttgaattttagaaatcagagagggtaaaacagctcttgctttcttcaccagctccccctttgcagactgtaggtaacgtggcaacactgtttcagggggaagccagtctcgtctgtctttgaaagacagtcccccagctggacgcccgtcagcagctgagcgctcgtctgtgtgcctgggatgccacgggggctccttgctgctgcaggatgtgaggctggtggctaccgggtcaggggcttcagagctgatgacaccagcaggaggggatacatctggccaggcagaggaagggtgcttgcttctcatggagggtgaggtggctaagcagggatctggacagaggctgggggaccctgagtagcacagcagctcagcctacagtctgatggcgaggcccttctggtgaaatgtgtgtggctgaaatccaagacggtaaaccaaacaggaatttggttcacttcacgagtccagataattgtactttgaaaaatgtttccaacataacgttaattttgacctatatgtgaaatgtgacataagtgtgtttttaaaatggatattcatgcatgacacatttccattagcaccttatcagattttctgagttgctgctgcaatagataggttaggtgtttaaaataagcaatcagttacttttatgcttctgcaaggacaggttatggtgattgaacagaatttgctttttcttttttcccttcatggagcctcaaaacaaaggccaggggagggtggtgggtcctgccacctggaccactcgaggcagggtgggggatggaagggtggaaagtgagggaggggcctgcaggtactcactcctcatgtctgatgggactggcagctctttcctataccctctgaccttgagatctccctgggaaatacctaagacccaggctaagatttatctgtggattcccatggaagccaccggcttcctgattcagaacatcttcccttctgccagcaccatcccggccgaggggcggaggggcagggaaatcgggctatctcccccatcccccgtttcttgttggctaaggtctgcttctgggaatccaccct

SEQ ID NO: 38405 - DNA, 1190 bp, Bovine  19866882094134
tgggagcctcctgggggccggcattcaggatacagtagtgagaacccagcaagtcagtgagaacccagcaagttgggggcacaggcagctgacagaggagtgaggagttgacgatgcaaacacagtggtgtgggatctgggcttctggggacagtgctgcgtgttgcattacgtggtcagagcaggcttcactgaggaggtgatgggaggaggcagcaggtttaaaatgggagatgcccagggcccttggtgaccggctgggagagcagtgcgaggggaggctgtggctggactgttgggcgaggagttcgtgggagactttggctctggggagagggcccgtttgcaggtattgaggggtggacacccttgatctgtgtctcacagagtgcaggtgggctgctgggtcacaagcagacttgggggatgagggaggaagtgggaagggaagatggtggcgtggccctgggttgcaacagttgctgacggtttgggagaagcagcgtgtttgcctgtggatggaggagacgggagagctcctgggcacttctgcgtgagcctggggcgggggtgagggtccaggccacagcggggttgcgcctgtgtgggcgcaggggggtggccccaggcccagctgtcttctgtcctctccatggagcaggaagcaaggccgtccctgtgaaatgtcctctgcgctctctgtctcggttgggcctggatggccgggcagccagtggcagaataaatgccaggctttgtgagctggagggtaaagtttgttggatgggttggggaggcccggcaccctgggcctcaggtgacaggagagtgtttttgcgtcagccacattgacgccttcagttttcttctgtgttgtgacctttcctgataccctgggaagttttttcttttaactagtgcttctggcaactaaggatattattgtaatgtgtgccctttgtcaaagaatggggaattatgcatgtaggtccttgcaggtcttcagtaaatactttcttcatatatttttatagacaaatccctataattgcattattttacagcttcaaagaaccccctctcttccttggtgtgctgcaaccaaatacggagttacaacaggcggaaaggctatttgaaaatcagcttgttgggccagagtccatagcaaatattgggggtaagtagac

SEQ ID NO: 38406 - DNA, 1821 bp, Bovine  19866880346432
ttatacagtccagaccacatgccaagtaattctgggcaaaagatccagaagacggtcttaaatggaaagttaccaaccaaatggcctgattctgaggatgcacaaaagtaggagcaagggttggtggcaagtgagccctagtgaccagagcagctgcccaccagccccttctatgctcaccctgcttctcacttttcctcaacacactggcaagtctagggaggacgatgctcttcctggctccagagctgaaacttatgaagcatcacacaggagggatgaggtttataacctttcacttaggggctccttcagaaagaaaatcctcagcagatagaccccaaacactgccacagtcttaggcccacaaagtcctgagcgtgaggcaaacgcacttttaaaggacagtccaattgttagcgtcaatatataaacgtggcttccttgcggcttaacaatataacagagtgagacaaactttagatcacacttagctggttttttatccaagtgttaaggtgtgcttggcccaggaaacatcattatcttttgttagaattgctgttgtttaggcacttagtcctgtcccactctttgtgacccgatggactgtaccccgccaggctcctctgtccatgggatttcccaggcaagaacactggagtgggttgccatttccttctccaggggatcttcctgacccagggatagaacccaagtctcctgcattgacaagcagattctttaccactgagtcagcaggggagcctccctttctgagagtaaatgacattgaaaagaacagaacaaccagagttaactttccaaaactggaaaaacataggtggaggtttttataatctatattttccagattttttttcaagaaaaaaaatcaccaacacaagataacaattgactatttttttactatggtaaaactatacataagatttacgatattaaccattttagagtggacagttcagtggcattaactatattcacaccattgtgctatcactgccccaaggtatgttattgtgagagataatcaattcacccattagaggatgcttaagttgctttcattttctgactattgtgtataaagatgctatgactgtggatgtacaaacacatgcttgagtccctgctttccattctttggggcacatacccagaaatggaactgctgggttacatggtaattctatgtttcactcttgaggagccaccataccattttccatagaggctgtaccatatgatgttcccaccaacaatgcacaatagttcacaattttaaagtttacacatttttgtaagtagaatttacttggcagctagtttcttaaaacccatcacattgctagtttacaagttgtaatggcatgctgtgattcatggggtcgcaaacagtcagacatgactgagcgactgaactgaactgaatgacaaagttaaaatatctctcctagattgagccattaaatcgaactcaaacatgacagtatgaaaatatgatcctggaacaaacagaggtcctcagagagggaagtgggttttgcttgttcctgcagtggcctcacctcctgcccacttgtccagctcactagccacatctatgctccacagtgtcttcagtctgccccttggttcctactgcaatgcttgccatccttattcaaaggctcatcattcaaacttgaatttctggaagatcagaaaagtaatcctcaaccacaatcttcattatctcagtcataagctcaagaatataaattaattccatgcccttgcttataaggaaagagccca

SEQ ID NO: 38407 - DNA, 1744 bp, Bovine  19866880645212
cctgtgagacattttattcccttctgtttcacgtgacctttaaaaacttgagtagagacaataaagtaatgggaccataagggcagcagaatgaactgggaaccagtcaccttcatcctgtagaggacaggcttcccttttcagaatcgtggttgagagggaaagggcagtgatgggccagggtagagacatagcaagtcaggagtgccccaccctcccctcctctcatcccactgccgtctgtctccagcaagaactttcctccctcaccccaccaggccctccacccagagttattgctggctgccaagtgcttcttgaggcagaagcttttctggagaccacagtgatggacagacttgggtaacttcagtgtacctggagctgaagcacagtacatacacacacaggaaatatctcagaatccccagcacctagagtaatacttggcacacagcaaatgtttattgagcatcttctatggctcagatggtaaagaatctgcctgcagtgtggaagaccagagttcgattcctgggtcaggaagatcccctggagaaggaaatggctacctgctctagtattcttgcgcggagaattccatggacagaggagcctggtggactacagtccatggggtcgcagagtccgacatgactgagctggtaacattttcacttttctatgtgtcaggccctgtgctgagcactaggcttgccacgatggacatacaggcagaatccctgccctgacagcacttacagtctcatcattttaatagtcagtcttagacatctcactgacttggaccaagatgaaggatgtttgacttaaggaaaacttggaatcacagacttcaagtaattctgtctaactttcaagttatataaagaagctatagtactaagtggttgtgtagagacattcttaatgaacagataaagatgattagtggatcaaagcagcttagtccctgtttatatttcatgggtttgactttatgtaaatgatatttctaatctgtttgaaaatggttccttctcctaagtcagtaaaatctcttcatgaaatttgtttgcacaattaattaacatccatgtttaaggttcatttgttagtgtgtcacagattaatgtcagagctcttagtgttggattacaagcttcgagagcaaagcgtatattatctgtttaactcactcagtatttggccctgcagccccaccacgggggcatatatgctttcaagggtgagagtggtgatagtgactgttacattgctgctgctgctactgctgctgctaagtcgcttcagtcgtgttcgactctgtgcgaccccagagacggcagcccaccagcctcccccatccctgggattctccaggcaagaacactggagtgggttgccatttccttctccaatgcaggaaagtgaaaagtgaaagtgaagtcgctcagtcgtgtctgactctcagcaaccccatggactgcaggccaccaggctcctccgtccatgggattttccaggcaagagtactggagtggggtgccattgccttctccggacagttacattagggatggttaattctcctcttcctagaagaattcctgaaaggaaatgcatgaagcatgaagggaaaagagaccttctcttcctccatgatttccaagaatgccttgaaagaatggaatcaccaactctctgcctttgttccctcaaatatgctttgtgaatacaagaa

SEQ ID NO: 38408 - DNA, 2047 bp, Bovine  19866880655364
ccttagccagtgtgcaggggagagtggcagagagcaggactgtctggccctgtcccagctgttgggggagtgacaggtgaggagggacagggaaccccgaagtgtgcagctctgcggacagggctatcattacctaggagggcatgcaggggagccacttggacgaggggcaggagacacgggcttactcaccccctgtgccacttggagcatatcaaaatgggggagccgtttattccttttttgggtctcagtcctaacatttacagaaatcaagggatcccgcctgaattaagggtccctggcaaccctctgctttttatccttcaatttatttattcttattcaaaaatatccctattaagtaggccaagatagtgagttagtagctgtaattttactctgttagactgtcttctgggtacattagattcatttttatctgttagttacctggatgtgctaagcataccccaacactgaatgcctttgtgtaagctgtaagcatctggccttaattcatgctgtgtttgtgatatagctcctacagttctaagagtggctggctgcgctgtgaccaccacctgacactaagctccttctagccaagattaggatgtggtgatatgcttagttggtttagaaaggctcagcttccatgagactggaaggacatgacgcttgtgcttctgtgatcaacctccccctgatgcccactctggaagggcctttctcatcacaggtatgatgggcgccagataccagaccacttgagctgtctcccatgggggagattgtgaagacaggtgggcgagcagtggctgggaattagccaggatatttcattcactctgcagtgagaatggcctccctgtcacagtcctttctgtccacgcatcttctgtgatgcattgtgtgttattattaatatattataatctattagagggcaattttctctaattttctgtcattttgccgttctatgcaaaaggcattaaattgtgaattaaaatgtgggcatctggttatcactggaaaaaacccagctgaattcacaggctctcaaagcggcagtatgtttgaaaagttttaaccatttctgtgattttcctttttgtgaagataggggcaggagaggaggtggccactggtccctagagaatatttcagcagtgtgtgactcagcgaagactgaattgttttcactgacttagtctcagggttgggcttccttctcactccagcatcgccaggccttggagaagcatctgattttcagggctgtcagcccgccacctgtcattaacacaagtctgagagagaaacagtcattgccagtgcaacgaattacaagtgcagagacaatatatacaagtactcggttattcttgtccgtggttgtagagctccattcgttcacctgtactggttctcttgggattcgaaccacaaacacatgaggtacccagaaagctgggagcagcacctgggagagtctggaagtccagaatgccagcctagggtgttcaccatcccctccctgccatgtttccaggggccagatggttagaggccatgatgatgcccctcatatatggtcattcaccatgcacttcagctctccattaaccccctcccccgcaactctctcgggtgtgtactcagtcactaggtcgtgtctgactctttgtgaccccatggactccaccaggctcctatgtctatgagatttcacaggcaagaatactggagtgggttgccatttccttctctagggatctttccaatccaaggatccaacccacattttaccactgagccacatgggaagccctgtgtatgacctagcggttcatcaaatgctatcacagtagatactaattaaatagttgtccgataaacaatggagtgatatgtgtacaaaatagaataaataaaataaaattttaaagggaatttaattttattagcctgccttgtctagtccactctggctgccaggctttgtgtggtgagctgtccactcttagcacacagagccccg

SEQ ID NO: 38409 - DNA, 768 bp, Bovine  19866880694673
ttcatgactcctcttggacaagcactttgaaatagtcctcaggttgctcattcttgctttccttagtttacacatcgaataaaatgtaatattctagctttcttatgatctgcttatatttgtcaaatatatctttcttttgaaattattacataatttggaatcttcaataacttggagatttcaggtctgctccttgcctaccccaccccaggcacacacctaattaattttaaattgagattttactatgctaacagtctttagtgtgacaaattagcatgcctctatcttatagaggtattggtgaagattaattaatgagtcatatatttcagatgcctaagtcactcccagggagtaattacgtgtttgggaagcatattagtcaccatttttaggactctgaagatcacttggtgcattgctgctgcaccagtggccacaaagagttaacatactctttcagtagcttatctgagtgccagaaggactgagaaaaaaggtaccatgtgaaaagcaagcatagcagcagacctgtcatatactcaaggctgtgaccaggagttttctaattccatgacacatctgagcgagtctaacagtttccatcactttaacaagcctggtttctcttggtccctgtggctcagactgtgaggatctgtatcagtgggaagactgaacccattagcctgttcttgacaggctgcctttttgttaaagcaaacagtccctagagaccccagtggaagcaagatgggaagg

SEQ ID NO: 38410 - DNA, 2593 bp, Bovine  19866880737546
agaagattcatccttcttaagcagatctttttccagttattatcaataccccaaatggtttcttaacattatgaaaggttagttttcaggtttctaggaagtgacatttgcatttggtggtcaggtacactggaaagaatctgcctgtaatttgggagaccccgggttcaatccctgggtcaagaagatcccctggagaaaggagtggtaacccactccaggattcttgcctggagaattccatggacagagaagcctggtgggctacagtccatggggtcacaaagagttggacacaactgagtgacccacactttcacaatcaaagcccagggcattcttgccccatcctgcagtctccatgtgttcgcttcctggaccttattctccagaatccagacacctaatctgatgagggtgtttaagtttatgggaactgaccctaacatccctgcccagcaacacctgtacatcccagtggccaagccccagtctttttccagctaggagagatgcagcagagcccagcggggctggggagggaaggcgggggcaggtatgtgtggtcttttctaagcctccagtcccaacactgggtggcagcaatcagggctgtgctccaaactggacacaaaaacagacctaagctgggaaagattttaagaaatcatccagtccaacagtgcctcttcttttcagtgataagcagagtgagactcaggacagagcttaaagtttaaatatctcctgatccattactgtttctatcacctaacacactctctagcctacctgctgcccccacagaggaggtggcttgttgttgtttagtcgctaagtcatgtctgactttttgcaaccccaaggactatagcctgccaggcccctgtgtttaggggatttcccaggcaagaatactgcttcccaggcaagaatactggagtgggtcactccagtattcctcatacaggggatcttcccgacccaaggattgaacctgtgtctcctgcactggcaggcggattctttaccactgagccaccagggaagccccaagggggcagcttgggtttggcaattgaaggactcttgcaaaagtctgattcacacaaatctgtggcataaaatgaggggtgcctgtggtttcaacacaacctcacttttaccttctatgccagcgggcacatcaacatgccaagcactaaagtgggttcactcattgcaggagaatgtagcagagagggttggggaacctcccagaagtatagtgagtcagcaagcaccatggtggcctctgcctcagcccctgtccccccagctccccccaccggggccactggctctgatgtcatgctgccctccccctgccccaccccgccttgctgctggagccgctttacactgttatccttggcaaacaccagggtattgttacccacggccccgggtcagacgctgtgagaagacacttggaatgagacaccacagcgccacatagagcaggtggaatctggaaaggagccagctgctaatcacagtgagaccaactttcatttcagtctccctctgctttacggctcccgtttgtttacctgctcacgtctgcaggttagccaggaatgagctttgatcctgctccaagcccagcatcactgtttgcccgtggcagtgagcaaaggaaatgtggcgagcaaggtgggtcgggagtgcgcccccgcttcagtcccaggggatcccgagactcctcctcgtgcactttggcacctgaagtttgagtttcgcttggcccacgtggcctagtatgtttttatcttcatgtgttggtcctgccttctaggactccagcctcctagaagaggggacgctagcacctactgcatagcacagggaactcagtgcttggtgtgacctaaatggaaaggaaacccaaaaaagaggggatacatgtatacatataactgagtcacttcgctgtacagtagaaactaacacaacattgtaaagcaaccacactccaataaaaaatttttaaaagatggggtgatgacagtgctgaggaaatgacaatgaaaacagcacagaacagcagccacaccaagggagggccccagggctccaagtctgggcggctcccaactcacctccagagaatcaagcacgacaaccctctgaccaacagccttgatcacaaacctggagtcagtcctgtgccacctgagaccctgccacgtgatgcttccagccctgggccaggcctttcagacgatgggcccctgacaagccactcaaccaggacaagaatttgggggcaaagaaaagaaagttcacaaatctcttcacattagttgagaggtgagcagaaaatagtgtttcagagactcacccatgtactggccggatgtgggggatataacctgtgaggccacacatgacctaaaaaccagcagcatcaccaaacactcctcgggtgcaagaggctgggaagtgctggtgaggaacgactactacagctgcccagaggtggcctgggcctgcacagtgagactgctgggccgggtgaagctgacagtgtcttctgaatttaaggctgaca

SEQ ID NO: 38411 - DNA, 1656 bp, Bovine  19866880780933
tatacttttatggcacaggcgtatgtctgtaagcaatatggaatattgctttacattttaacccttttatacatggatcatactgtaagtttcatactgcaacccttatttcctcattcagtattatgttttggggattcaaacattttagtactgttctattacatggaaatttcacagcatatttatccgctctcccactgatggtcattccagaattttgctcctgcagatgttgctgcaatgaatgttgctgattgtgccatttgcgagtttctctagggtagtattggaagtgctgagtcatgaataggtccatctccttcttttctagaaactgccaaattatttttcatgttttaaaggtatcacataaataccagagtctgccccccatggacacttattataaataacagtggtaaatattgttggagtgcttaccatgggctaggaaatgttctggcgggttttacatgattcagtacattcagtccttacctcattttcacacgtgaggaaactgagatacaaagatcttgactaaggtcatacagggagtgacagagccccttcaaaccacaaaagtgtagtttacaagacctgtctcttaacactaggctatgctccaagttatagaaagacactgcccgggccacatttatagtggtacaaagacaccagccatttagctgatgggagacctctgaagaagggagcagccttactagagtattactgtctactgattaggaggaagcagcagaaagttgcttaatttgtgcaaggtccaaggatcagtgactaaacctttaggctctggtgcagcatgtcatcttgcctgtttagtgtctctctccccacctgtgtgtccctaaaggcatcaagctacatctccatgtgctttcaatttctttcagtctagggtagattgcttgtaatagaaaggtcaaataatttttttaggagtagtaatggatataatctcatacatggaaattttaattgcagtgctttaatcccattctgagtgccaaacttttaggattaatttgttgaatctgttggtaacatggtgctcagtcttctgaccagattctttgcctgagggctctcatttactaatgagtaatcgctgcaattttcagagaaaaagctaccggtaggatcacgtttgaacattcatcaaatatgacgcaagcccagttagaagagatgttagcgtccttagcctgcaaataagggcatggaattaaatctccctacactgtaattttcctagggttattactcccatcagtgtttggaatggctgatgatgaaactattcgtggccttagagctcagttgataggaacatgtcatgagtcaggcttacaaagtggctggctgaagcctgccttccatttgcctgttattactgaagcccattttggagagagaaggcagaggtggaagaggaggtgctccaggaggagtgcatttctctttgtacacacatcatagactcacagcgctgacaaactaattatagctttaggttgaatgcttccttgctctgcattctgtttgcaaacagcccattatttccatcctgtgtgcaggaaaaacacaagacaaagtgggttcatcggttatgtttcggtaagtccagct

SEQ ID NO: 38412 - DNA, 1035 bp, Bovine  19866880800589
ttgtaatacaagggaccccagtttgatccctggtccaggaagattccacgtgctgcacagcatgctgtaagcgccggtgccacaaccactgagcccacacaccgcaactccttagagcccatgctctgcaacgcgagaagccaccccagtgagaagcctgtgcaccgcaactagagacgcagaccctactcacccactgggactacagaaagcctgcacacagcagcgaagacccaccacagccaaaaaagaaatatgaacaaatctttttttttaaaaaaggaatttttatagactccagttgaaatcttcaatctagtaacaagagtgattgatagctcatgttttcctggtgccatacctgttattccggaaatactctaagtgaatgaaatgacttcagtttatagaagtgtcattatactttacaaaatcctataaggcaataatctatcccctcttaacttaccctttgtcctcttatccaccacaaaactccaaaaccaaagagataagaatactaagtaaattcttttaactggaatgattaaagtatcctctagaacttttgcataattgttttaaaattattaatcacttaaataagtcattgttaacaagtaataagacttcccctagtggctcacacagtaagaatctgcctgcagtgtaggagacctgggtttgatccttgggtggggaagatcccctggagaagggaatgccaacccactccagtattcttgcctggggaattccacggacagagaagcctggtgagctacagtccatggggtcacaaacactgagacacaactgagcaactttcatttataagtaacgaatcactctcaccttcttcagtcatatactttatcagttcatccttagaaagaaatcctcgtttagctggatctaatacctagggggaaggaaaagatagatactctattttttgatgaaaattccacatgatgatttttttcacataaatataaatatatgtaaaatttgggcttacatacctcaaaagct

SEQ ID NO: 38413 - DNA, 1706 bp, Bovine  19866880804504
tcacatgttgtcaaaaagccggacaggatgtcatttcgtggcacgagagccaggaacgactgactctgaaacttcaggacttgatgaagggacagaagggcctggcctggctatactgcctttatgtttattccaccagcacttgctctaaaagagaagttgcttccagttttagttttggggaggaatttcacatttccttcaccacttaatatcagaaaccaccagcatgccagatattcttcaggtgtgtgagcagtaattacccagatgcaaacaattaacacatccaagttaattttgctaagattgagtaaataaatgaagggagttgatgtattgagttcaatgtcagaattgaaaaggatcctcggggacatttagtctgaaaatatcttttcacagataaggaaatttaggtccaacacaataaagagattttctcagggtccctgaacatgttagaagcagaactgagaacagaactcaaatctcttggtttattctattttttcttaatcactatgtagatgacccttccattctctacaatgacacagttcttcataacctggaagaaataaccatgattctctgacatactgggtaaatcctcaatgtttcttgctgtgtccatgacacataaagagggtggggtggattacagtgataagctatttccttccttgttgctgaatttatggaaaaccacgttccttcaatcctatatccagagaatacaacatctaatttatggctgaataaaactggatgctttcacatgactctattcatttggacatgtttgtatactaacaaccctcatgttttagaaataattccaaaacaagtccttcaaatcctttaccacatcactggctttctttcccaacaagagattatttaggcccacaagactggcaccctttatggcattacagtaaatttatattcgatttttctgactgctactgataataacatgctgacagatataatcctgttgatatgattacacatcaaccaacagggccttgactgtgaatcagcaaatggactaacgtagcctactaagcataaatccaagaaatatgacagaaaatgacggcttaaagagggtctaagtcacaataaaagctcaaacaaaattcttcatctttggtaagcgtaatacaatggtactctattggcaccgctattccagctgatgaacacatcctagaacactcgcagagaccactggggtatgacagagcaagaaaaacaggaacggatactgaggacatagaaaggggaacaactgagttgattccactcagcatcttaggatgctacggatttcgttttcacacatcttggcaacctggagattgtcatcttaacactgattaggaaataatcaggcagtggaaggcagaagcatgggtcagagatttctttgagaaatgattcagccttatggttcaccaacagtctgtttaagcttcaaaccagattcatttaagcagtaaacatttgaaatgataagagcaatacaacatttcctgtcttctgaagagctctctgatacaggtgtcagagagtattagcctacaatgttaagatacagggcaaggggcaggatgacctgggactccagcccaagtcctaaagctctttgagtccaacccccagagtccaaccaggcaagtacagccagaatttgg

SEQ ID NO: 38414 - DNA, 1732 bp, Bovine  19866880897188
aggtaaatctgaagactaggggaaataaaatatggctcagttttggccttaccagccccttccaaatgcattcatgtttctctctgcatgtcttgttatgtgaatggaaaaagaaaaaaaaaaagcatgctttggtccatcaggtttttttttttccctttgtctccttctgaggtgctcaaaggcatcagtaacagagcaggaaagccctggctgaacaaaacttggtattttcctttgataccttccattgggaggcttcatacaatgcactttgtcagcaagcccctgcttcaggcaaacattgagaaaactattgaggaggcttcaatggaaaggatctgatctgccctagaaactgccctagttctctatcaggggagccaccagccctggaagagaagattgccccaccccccaacagtcttttttcctttctcctttttaatctcctttccattgtaagaattgtgggaactctctttaaatgaaaataactctcaagctgggctttgttttccaacatggataaatgcctagatatctcctatctactctgtaaatctggagtctcaacttcagattataacaaatttatctgggacaaatgtttgagttaaggtgaaataagcactagatgttgtgagtgtggttttctaaagcacctgaatattaaaaacttgttcatcaacctcctgctagggaacctctattccctcctcctggtctgtctgtgcgtctgcttgaagctggctccattactgtattaatggcaacctgctccagtattcttgtctggaatatcccatggacagaggatcctggcaggctatagtccatggggtcccaaagagtcgagcgcaagtgagcacacacacatccagtctctggccaccctacctgctgtttgattttagttgattttaggtgtttctaaccccccaaaacatcaattactttaaaaaaactatgctatgtcactttctattttcaattgcagcttaaagtataaagcaaatacttgaggtagtgatgtcaagcgaaataaaatatctttttaacgcctttccccagttattgtgatgaacccgattgcatacaaatggaagaatattccagaagtgagagagcatgaacacagcccagagcacttattcatggtgtctgcagttctattctggctggacccctggggctcattagaggtcttgcagcccttccttatggcccttggaaaacatggctgcccaggccaggaaggagtatggtcactcaaggagtgtgaccatcacttaatctcttcccgactataaaaatgaagatcctttctgggtctcagtttttataattatctgataatttgtgttttcttctaattataagacagggctattgaaacatacatcaggttatgaagaaataagacacccacgatcacaggagcagagacaatcactagagactttttagagtatttctttcaatctttctccactgcgtaagttattttgctgaattggattcatgcatgtatgcagtctcctgcttgctccactaacattatctcttgaacatttgtccatttaacataatttgaaaaaatatgaaaatgtatatgaagactgaagattattatattatgttgataatatttatttaatgaatatgctattgttacatgctcaggggttttgttagatagatgatgccataggaatatcttgcacacaaa

SEQ ID NO: 38415 - DNA, 1063 bp, Bovine  19866880931735
cctctgagggctcttggaaacccctgtctagttgctgctcccttgctttattattaaatggagagaaaagcaggggagatgctgaaaatgaaatcaaagtgcatggtaaactggatttgatgcagagatgggcaggaacacagactccttctcacccaccaccaccccaaagagtgtgtctccataaagatgagaaatacctaacaagacctgagtgtgtataaattctcccaaagtaagatgggctctttgtaggatgcaaattttgaatagtcaccgtcaacctaacagatatatttcaaatgtaaataaaagtcatcaagcagtaacagttcatctcctgacttcattttttgttgtcacagaggtgttctgtttagagagaaaataagctgttataatattccaactgaaatttcaagaacatgatttagtaggtgagttatttagggctacttagtaaatagaatttctggactgtggtaaatgtgttactctccttcacatgttcaatgaaacagccttttcttcttctcaccaaggtagttatcctgtcctcagcccagagactcaatttctaacggctgttggatttattccagggcagccaagcacaggttctgaaccattttctttttcaattcctgtggcctcagaatgctcagaaatgttgacttttgcaaagaggccaaggaggtctgcacgtgtgccaaggcttctgctgtgggcttggcataggagaggcagctgggaggaaggagtgtgtgggccttccgtggtgcacgtttctccagaaactaattcaggacaatcttgtgggttacatacatctagcaagcatttctctgtccctaagaattatatccattgttagaaaaatccatctatattaatatcaataagtccatctatttattatattgatactaatattaatatcaacaccccctttacaggtacatgatcaggccccaaaaggccaagtgatcagtaggaatccttctcccattcacatccgtctctcaacttctttctctcttactgctgctgctgctgctaagtt

SEQ ID NO: 38416 - DNA, 2247 bp, Bovine  19866880982863
tggagcaggggttaagctggaccaggaaggtggctggacgctcagagaggctgggatcctggtttagccaaaggctggaatcacaggaatgtttcaccggggtctgctctgagaattcccagacccccatggattttagaatttcccagcctttcctccttcaccttcgcactctcttacttcctcctgagatggcccccgatctgcgagagacatttgagagaagctatttattaacagatatgaagaaatggattctgcacttgattatttagccatgatttatcaatgatgatggattggaaagcggtgtaagtaacagttatattcctgtagttagatggtctgtcttagttgctcttttcttttttgctttagcttttccggtgaatttccttttgagaaaagtgaagaataaaatgtatcaagtatagagaagttagaagttaggagggtccagcttatatgagctttcttcttgttcagtcgacttgcagaatacgtcagctatatcaagtgagacacgcaaactgcccacagagaatctacaaacatcccccagagggtgaggctaaaatgggaaataaatgaaccagggatttgaactgacaatcattgctataatcagacttgttcagaggtgctaaaaaaattgacattggctcattttagaatcaaagacgaaattgacatgtgctgtcttcacaggatcataaaaatgaagttagcctgtggctctcagaatagcttctttctggctacataaatgtgagatggatttttttcccccctaatgttaattgttgactgtatttaccttccatttcagcttttcttgagacagaacccctcccagtctggaacgtaatgtctggtcaccctgtggctgtatgacattggcaatttgaaaggcactcactgccagtcaatgccagtcagaagatattccatttttctgtgccagggcttgatttaagcacttaactcccagtatttggggtgggaaggtgggaacaacaagtaagtttaagaccaaaacccatccatttcacaggacagagtaacagctctctagaagattagaaatggaaattaaagaagatgatttgctttttcttcaggatttgtaacgaggctagttttgtatagaaagagtaacttaaactttcttgatttaagaaaacagcattttaaaggaaacttttaagatcataaaccacttaggtaagaacatcaaaacagattgctaacatttttatgaccagttgaaactttttctcttggagtctatacagtagtgttattacaaatatgtctggcttaaaacttgcttagttatttggaagaggggtttctaccagggacactgtaaagagcttttctgagtgatcttttgcctttctcatccatcacatccacactgtagcccctgcccctgcctgtctcccagcgcccgtcctgcctctgagtcttggaacctcatgaaagacctttctaaagattccctttagcatgccctgcccagctctggacagaggaagtactgtaatgcaacacacaaggctgccaaatttggaattgaatgagctcagttgattcctgaatattaaatcagttctatgagccattgaatgagatcatatcttgtaaacctgacccagagtgttgctaactttattgacgggcattttgcagcctcaagggctgcagtactgggcacctgaggggatcagcctaaaaccaaaggaaatcctcccactcttctcggattcctgctggccacatatacctagggccacgccttttaaaatgtgtcctttgttatcaagggaaatctgagacagaaaacacatgttggcagcgtcacgtgagtgcctctgcacatgaaggggtagtatcacaggggaaatgctttcgatctggtgctgttttgtttgggtttcttgtttataaggattctggcaggcttgtgcatctggaagaggtttggggtagggggagactgaaaaaacctaaagcaaaacctgaagggaaaaggaaaatcattgaaaagcaaggtcagactcgaaatggaatagctctcttaccccaattccagttctcatccttagttttagtttcctgttaaagcagacactgatcactgccttcctgggcttgtagagatcgattctttcccactgcttttagattttgagcaaaggaggggcaatttctccagaaacagaaaagccaataagaaaccat

SEQ ID NO: 38417 - DNA, 1579 bp, Bovine  19866881064687
accacaggaaaaaccatatccttgactagacgaaactttgtggcaaagaatgtctctgcttttcaatatgctgtctaggtggtcataactttccttccaaggagtaagcatcttttggtaccaaatccttccttgtcctcagggaggtctccctgaaaacctatctgtattaattggaaaagaacttcatgctaagctcttttcaaactacacatgcattattctaatttgtcttttaaacattacatctagattttcatgtatcattttccctcatgcgtatatctaattaacacacagctttcatgactatttggctgtgtacggtatgaattagattttaatttttgtaaggtgccaaaatttgcatgctctctttgggtggtgctgaccaccccatatataccacatgtcgagtgaatttttaagatactggcttttcccaaattcagcacctacattcttgaaagcacttcctttccccccacacagatctaactaaatatcagaggtatttgacctttcattttaaaaaatgtttgatgttcctattttcaacaaaagatctctgttctcaaatccattctatggagagaattcctcagttcttttgagggatgaaaatcctctcttaagtccaccaaactgaagatcaaagcctcagagccccacttatctgcagagcaatcattgtccaggagagaaggctccctggtgatagggctgcttcaacccctggatggatgggtggatttggagtgaggactggggagctttactcttgggtttgctgcaaggtggctgtcttgccttgtgaaggtttgaacatcgatctcttctcctatggctttccagatggctcagtagtaaaagaatctgcctgccaatgaaggagccacaagagatgagagttcgatccctgggtcaggaagatcccctagaggaggaaatggcaacctgcaatattcttgcccagaaaatcccatggacagaggagcctggcaggctacagaccatggggttgcaaaagagttggatgtgactgagcacagcacagctcttctgtacagctcttgtagttttcctaggccgattcagctgttatgctgtgggatttgacatcatgtgactctacctgggcccaccccacgcattcgccagagatgtgtccaaaggttttctacagaggattgccagtggtcctctcctgagtggccaaatgcagccggtataagagcttcccagggaaaggaacctggccctgctctggtcattttcttctatccctgctgctgctgctgctgctaagtcacttcagtcatattcgactctgggcgaccccatagacggcagcccaccaggcttccctgtccctgggattctccaggcaagaacactggaatggattgccatttccttctccaatgcataaaagtgaaaagtgaaaagtgaaagtgaagtcgctcagtcgtgtctgaccctcagcaaccccatggactgcagccctccaggcttctccgtccacgggactctccaggcaagagtctgggagtgggttgctattgccttctcccttcta

SEQ ID NO: 38418 - DNA, 883 bp, Bovine  19866881068972
cccctctctgccctcgcgcaactgtcaggcaaagcgggacggcggatattggctcccccacacgccgaggctcctccccgatctggatctttatattttgggagaatttctttgaactcagttaccaagctccgcgaaaggagacaagttcccacagccggttcgctggcagtaggcgaggcgggggtctcgcccacctcctcggcagctgccgtgtgtcccgattgtactcgtcttttccctcgtggaggaaaatggactcactagactaaggaaaatgccaattatctggatgtgaccgtgaaaagagaacgtgtgactggaggaggcagaagaggaggaaaagccttatttgaagagaagaataaaccaagcactccaacccttctgcaaattagtgctgttacttctggggtccatctgcttttatccccccaacccctccattaagaaaccttgacttgagggccaagagagagccccctaccactgggcatccttctgggttggaagaccttttggatgtagcgttggtggaacatttagacactctcctctggaaaagccaccatgaattcgatagctgggaataaagagaggcttgcagtctccaccaggggcaagaaatacggggtaagttgtgacgggtctaatgcggagatgtgttaccagactctttcccgaccggggtctccctttctgggtaacgtgcggccagggcagggcggctccgagctctcctccggctgcagcggcgcctcggccaggccagccaggcgtgcgcgcgcggaggcgggtctgcccgtgaggacgcccgcacactcgccttgccctcggaatttttgcggccctactcgtccctcctcttccccgcatccctaac

SEQ ID NO: 38419 - DNA, 1896 bp, Bovine  19866881088024
acagcagccaccagcaaaagcgagggtgggagaaagtgcagccgtgggcagtcttctcacagagcccgtgtgtgggcagggggcagcttctttgaagctatatctgacagcgttcagttttgtccactgcactttcttttggaagagatattaatagtttaaatctgtgtggattgtcaagttttcttcctctcagtaatatactcattaatatttgacttcctttcagcctggaattttcaataatttaatagctgccctcgccagctgcctgtgaggaagacccgtcttgcccgttgcctagaggttctgtgcgtccacggggcagctctgagagcagcgggcagaaaaagcagagcaagtctggtctctcctcattcctctcttgcctaccaacgtttccttttccggctcacattcttctttgcctccatatttctgggtccctggggatgtaatatcactaagtcctaggcttagctccagaaagaaaggagacagagctggttgaaggaaatgagtttcacctttatcttccccctgactcttgtgtaagttacaaatcagtgaattcatcctcttcttatgcagcatcttgccaccctgaggccccttcccaactcttcagaattccttctgtaattaagtgcggtggtggaaaagtcaaagttttgtgtgtttgtgtgtgtgagggaagagggaagaggaggctaagcaggtgcttgaagggaagcagactcagtcacattcacaagatggcaggttgccaaacttgtatgactactgcaaaaagaactcgcactgcatttttgtaccaggttttatcggtatcaagtatcttgtatcagtgctagcagtggctcttgttacctgtgctcagagagaaagatgtatggaagctctaaactgcagacaattctcagtcagtgtcctcagtagtgacgcatattacaaaagtaagaaagcactaaataatagtaacgtgtgtgtgtaaaggtggggagtgtatcctttctgggagaaggttctaacactttacaaaaataatctagattaatccaacatcatcagagtatcatgaggttaaataaatcagcctagatagactaagtgatatagccaaggctgcacagtgaatttagaagtaaagtcagatgaagatacaatcccttcttcatactgactttttcttgccatattccatgggaactaagaataatagagattgttttccgattttattttctttggacaagttaagctggctaaattagctgggggtacgtgcctgactcatagataaataggttactgtcagtggtataatttttgtaatccaaaaagtttccactcacagattttctataatttactgacaaataaatccatgaccccaggaggcagagacgatagcattgcttcagaaagcacatgtttcttggaaatagcttgttagtacatatggctttcagattaaccagttgatgtcctgggcctgcgggaatggaagactgggcagaagccttgttttgttggggttttgctcttggtgttcaggctggttggtctgatgcccggtaaagcatggagtccataatgcacaccaggtaagcagtgtggaatgtgtgaccaggccattttccttgaaggaattctccctccctcaagattctgccgaggcttagccacggcaggaacatcactatttcccctgtttgatttttcaatgctgtttccgcctgggtggctgcacgccattaagtagactgtagatagatggctccccctcttgctaagaatatggcagtttgggggactacatgtcttagacatccattctctaagccccagagcagaacattcagaaacattccttccagttctgaaattccttag

SEQ ID NO: 38420 - DNA, 797 bp, Bovine  19866881114675
gccccatagacttgaaactttgctctgcttcaattcatgccctgacttggaaagccttggcattattcagttgtaactctgccaacacacactttcttattctcattcattaaacgtatggtaaggaaactcagcctacatcagcaaaagcagagagcaggcaggaaagacagccaacggcctggaggacatcccctgcagacacagagactgctgccctggggcttcctctgctgcccatggggtgtgggctcccctcagccaattgccactctaccagaggaatgaggcaggctggagcgggggcagctgaaacaatcagggacctggccaccgccgtgcactctgttgtcagcacaaaatgggtgttgatgaagcactggtggtacatgatgccatcctggacaatgtccccccataaaactgcaaaatttgtagcaccattttcttttcatcaagcagctacaatccaagggacacatacactgcttttaatacacaaagacaactgaaaaaaaatcagtaaaccagttgcgtgagttgtgtaatttgttaccacttataaaatgcattcactggctgtagctaccgtctgatcttctgcttgtgttgtttccttttcattagtgtcactataatctgaagtttggagggaagggaatggcattcttctgcctctctatgtatgaacagtccttgcacatgccctgtgaacccacatagaagacagtaggatgtgtggcaaataacatgacggcctaactcagaggcacaggcttccgggcagttccaggttc

SEQ ID NO: 38421 - DNA, 752 bp, Bovine  19866881200011
agtggagctctgtgcagggccagagaaccccagcacggtggctgggtctgagccactcacatacagtctgtgctccgtaaagctgctgctgatgcctgggctgctcatcctttagtcatttcctgaacagactgaaaaccatttcaggggagttagccttacctgctccatctgcatcacccctggtaggatcagccaggctgggttgggctaaggttataagtgtggcagattgagggtctcctggaatggtgggttgggctggttaggtgggtgagtaggaaaacaacttgttcaagctgtgaagagcccagcctgtgtctgtacgaccaggtcagcctccagtgtggagatggccgtctgcagatataacgggtgctgggatggaaggacccggctgattaaccacttcctggcttatcccttctgcatccttccttcctaccaggtaaatattgcttagacaccaggttctgattaaaactacaggatgaaacttgtaccaaggatacaactgatggtctgtgtcagcttgttggagttaaaaaatatattttaatttgtttagctctctggggaaattatctgaggctgcatgtgataatcaactttcacatgagctttcaaaaccctgaaattattcaagccacaaaatgagatttttttaatctacatgaatacaggaatcttttgcccccaccccacttttttttgagtgggggagattaaaaaatttctaattcattcctctc

SEQ ID NO: 38422 - DNA, 2566 bp, Bovine  19866881300132
catcaaggagcttacattacagcagtgggaaatagataaatcatctttgtcctaaagtagatctgaatctactaaaaacacatgggtcttaacatacacacacacttcctaagtacttgtaggtcactaggtgaaatgactaacaatctttagttacagaacgtctaaatgcctccctccccacaacacacacagttaaagttacttctgtttgataaaccagaatgtccactcactccaattttctctcttcatctcatttcctgcctccttcctcccatggtcgacccccttggaagcaaaggtaggtcacaaaccagcaaaaagacctaaccgactacctgggattgcacgtggtcagtctgtttttggatcctttaaaactgcttattggtaatgaggcaatacattcctgtgatctgggaggtgaaccaaaaatcctagctcgggtttcagtttcatgtaaaactgactgcttagcaaagggccagtctttccagtttaatgaagctggctttgtgggcggtgagcactctgggaagagaaaggataaggactcacagagaattagcaacattcaggtgagcaaggccaaaaagcatgctgttgatccagtaggtgaacaggaaaaactaggaagtggctaaaccccgagggcccttcgggagctgtccccaaccctggtgccacagatccatcacagcccacacctacagagaagcctagagagacagaagatttcctgccatggaggatttctacacagagaaggggaaaactgcattcctccctggaacagatcaccgagggccagatcaaccgttcagcagccaggacgaagcacacacctgaatggctgtgacccgcagtcttgcaaactgcccctaagtcctgcacatcgatccacaggcccctgtgcagtccttcttctttgtatggccaacagcctcctttccttgtctttttcctggcaacagaggatggagcttcttttagagagcacccttgggacttccctggtggttaagaatctgccttgcaatgcagaggacacctggtccaggaagatcccactttccacgagacagctaagcctgtgagttgcaactactgagacctcgtgccacaactagagagtccgagtgaatgctgcaacgaaagatctcgcctgtcccaatgaagattctgcatattgcaactaagtctgaggcacccaaataaataaaaataaaattaattagtttattaatttaaaaagtctttagaaacgacccttggggcctaagggcttccttggtggcttacacggtaaagaatctgcctgcaatgcaggagtctcagatctgatccctgggtctggaagatcccctggagaagaaaatggcaatccacttccagtatttttgctgggaaaatccccatgtacagagaagcctggaaggctacagtctgtgaagttgcatagagttggacacgactgagcaactgagcacacacacattgtatttttaatttcaaactccactgttcattgctagtatgttaggaaagaaattatttttttaaaaacgagctttgtttatttttgtgtaaggtgttagacagtgttctagtttcattcttttacaagtggttgaccagttttcccagcaccatggattaaagatctaaacgtaagaccagaaactataaaactcctagaggagaacataggcaaaacactctccgacatacatcacagcaggatcctctatgacccacctcccagaatattggaaataaaagaaaaaataaacaaatgggacctaattaaacttaaaagcttctgcacaacaaagaaaactattagcaaggtgaaaacacagccttcagaatgggagaaaataatagcaaatgaagcaacggacaaacaactaatctcaaaactatacaagcaactcctacagctcaattccagaaaaataaatgcttgtttgtttatttggggagtagtccagagagctgggtaaaatgttttaaaaattcagtcttcataggctgttagactagctcctagatataccatttatgtgtttgtctttagaatgttccatacccttcttttgtttcaggtcaatcaagtcttatttatttatataaagaacatttctttataataataacctggctgtaggaagcccttaggacagttctataattattaaaataatcaagttcttttgagaaaaatcattttctcaatgatgatattctccaaagtttggattaaattacctcagttggtagagatctcaaattacagaaagacctgtaaatgtagaagaatacaaagacaggaaatgtgtttgcatagtatatttgaacccttctgggtttcttcttcactgcacacttaaaataagcatttgagagttagacagaaataataccactctaagcatactgaatattttgagtcacatgctacattctgttattgtgattctaacttaacacttaatcattatatataaatatagaacagagttgtttgaccaaaatttaaataacataggggcaccaatta

SEQ ID NO: 38423 - DNA, 2704 bp, Bovine  19866881629211
tattatcgagcctcatttctgcataggaagacagaacaaaaaaattatttattttatagacgtttatgaaattaaataagagtacaggtaaagggtttagtatacaggaagtacttaatagatggtactttgaaggaatataataataaacagtggaactgagactgaatctaggtctctgttccccatattgcatcagatcatctctgaacaggtagaaaaacaggcagctgaaatgtaagggcatttgtgggatataagtaaagggggcatctttctaaaaatcggagtaacccattagtgatgggtctgcttcttgaaatagcttttatcatcccaagtgtccaagtagtggctagaaagccatttacagggaataccagggagatgaaagcaggcactgggaacgtagtatgatttccaaaatttcttccgatgcaaagacactgaaatgatccctgaaatctctattccattcagggaagcctctgttggcttcaatgcagaaaaactgtaatgcagaaaattatttgagaatacataaaaactacttccttcttaaaacatatatgaaatttcaagggggaaactttgctcacatcacagttacaaaaaaataatacaaaacctaaagcatatatgtgaaataagaagtattctagagcttagaaatcacagtttagagccatatattgcataagaacattttattttcatttcgacatcatcctaaccagctatttgatctctattttatatgtttcaatttcttggaagccagcagcttctgctgtttttacagagcacttcaatgacacacagatgggccaagtttaagagacagaaatcgttcatatacacttgtattattcagtggcataaaggagcagcagtcatgaaagaattgaaaaggtaaagacattttggctagcaattattttgtgtaattaatgcctcacaggttctttttttttttttttttaagggacaggaacagacgagtatgtcgtttgataagattttaaacaacaaaaagttaacctaaaaactgtgagaagtaatatttacttgactcattcttggcatggactgtatcacatatttcctacagctattcagccctgcacacatctttaactatccctgggcttcacttaattctctgaaccttatttcaattaaaaaaaaaagtggcctctccagcaggatgaaattaatattcactgaacagctataaagaaagtgacgccacaccaagcattatcagtctgaggagaggagcaataatgtgaacttggcaagaatttaaacctagcgagctcagtgcttccctctgggctctaccctttctctccatccttactcgtctcacacaggggacaattatcctaacacatcagtgtgatgccatccgaattcaggaatcagtttagaattgagatgaccttcaaaggggatggttccttgttccccctggccagatctacccagatcaaaaagaaagaggtaaataattatctagttaatttaattggtttaggtgggggagagctttagattatacagatcagaggtgggaacttatagggtacctttttctttttttgcatttatgtgatagactatttgaccttggattttcagaattacggagtgtttaaatggcaagcccttcattctaaacgcatcccatgagaattaagttggggtctaccccgcttagtgtctagagtttactaaaatattgccctaacaatattgtaagaatcgttagcttcgtgaagaatagaattctccttagagaatatcaagcaggaatatcaggtagtacagttgtttttctaaggattcttcatcctttaaaaaattctaagtaccgtgtttgctaacaatactcagagcatttcatcctgtctgaagggggtgttcaactgtgagatgatcatataggtgggtgacagcttcatgaaaattaagaggtcattcaaactgggttcaaataaattgaacccaagcaattgactggtgagacatcattctgaaaaactgctcaagaggagggcagggtgaggcccttagaactgcccccatctgttgcccagagagggtcctgacccaggagggagatgagagtggtaaaatcgccagcgtcagcaggtaaaaagacaatccacatggcaatttaaagtgaaatggccagggctgtcataggctccgatggcttatgcgccattataaaatatttcaatgctctgaggattaagactgtctggtaaatgagcaatgacatgacagatcacagcagctcccaggaaatccatggggtcagagacacaggggtagaagaaaatagaacagattataaataggaagggtgtgtgacaagaaccagtggtctgaggcaaagccctctggaaatagttaagatatccatctacgtgttaaaaaaaaaaatcagttagccttcattttgaaataatgcctatttaaaagtattccggcactgccatttctcattctggaaattctccaaacagggaataaaaagcgtcctccttcacctttccattttctaattggctgtcactgaggtcatttccatgcctccggagaccaaaaagcatatgggtcttggggtttttcagatttttatgtaaatgatccatttcattagtgtaggaagatattcagacagacttcaaat

SEQ ID NO: 38424 - DNA, 1487 bp, Bovine  19866881751601
catctatccacatttcacatattattttgtatgcaagatacacttaacgataacatttttaaatgagtcgtaacagctgggatttggtccaaaagttaggtcttaatgaataataaagagaaaaaattgcaaagagctaacctaaaacaaaagttaataggagggggaaaaaaaaaaaaaaacccaaagaaagcaccagagtgagtgaacccagtagaataagcaatagagtggaggtgggttttgataaactgatggctttggggctcagaaaggtgtcacacttgtaagcagtggtggcaaaggggtgttcttacagagatgggttacacgaagtgggaacagagcttgcactaagtctcctcgagaaggaccacttaaattaacagagaacaaaatctctcatttacttgacttaaaaggtttggaggaattataaattgaaagttaggaattataataataattaatgaatgaatggatatatgaatgaatacatggttggatgaatggatggatggatgaatggatggatggatggatggatggggtgctaaggcaaaagggcccacaacaactctgggtaacatcactatctaaggggcattttaaatgctgtttaatagtttttaaagtgtttcatttggtaacaagatcccatgtatagctgaggaatcatagatcagaaaagttaaatgacttgctcttagtacacaactaataacttctagagggagatctagaacccaaacctttccacaggtaatctgctgcatttcccattatactgaattaagccccaacaggtgaatgtgatcattaaacttggtaaacagaaatggaaatgaaaattactcccaagactccatcttgaagcacagtggagaagctatcttgaggactggtctatctgtcaaaacatctgttcagcaagcatcatattcagtattacagagttgggactctctaaccagaagtttgagacggcctggcagatggttgggaaagctgccgtcaccacttgcctcttcactatctcttagttcaccagaaggctagtgaccatggctactggacatggagatgtgttctctagatctttcttcaagggaggtcttgttgccctagctgtgggcagttagcctctagctgtcagctcttttaggatttgcctagctgcagaacgctgctttacccaaatgcatggccttctctgggtcacccacattccatggttgatgggggttcaaggacccagccatcaagtccagtacaggtcatcatgatggccatttatgctccagagctcccctgtggtgttgactgaggttttgtttggcagcttgacattttcctccatatagtcctgcatcctcctcctcatttccacagcctttaatctctaataagcatcctgcatgggcacacccatctccatgttggcctcccagagaccccaacctgcaaggccagagggggaagcagcg

SEQ ID NO: 38425 - DNA, 790 bp, Bovine  19866881894211
ctctgccttccgctgtcaaactgctttctctacaagggaatgaagcaaattagtcaagttaggtaaggttaccactcacttttggggcggtaacatctcaacaacacaaccatgcttaccccctcacaccgatcaaaagctgaggtacatgtgcgagaataggaaaacaaccaaaacccggacagcatgattagaacaagagagattgcacacaatcttgatgtatgggcccctgaggtcattaatgaatgacttgttacgtataccctgggtgcctgtagtgtcaccacattaaatccatgtttctagagaagtttctgtataatatgtgtctttagttataacatgagctcattgttgaaactcagtaagcaaaaaatattaccacaatctatccacattcatgttattttgtccttaaaataaatgggaaccatggtgatcttgctcaatttcatgattctaaatgccatctatatgccaataactcccaaatttatatcttcagaccagactatttcctgaactccagactcatttatccaactgcctgcttgacagctcctcttaaatgtctaatggacatctcgacctcagcgtacatccaaactaaactccttgtcttccttcacaaacctttttatctcacttaatggcaattccatccttacaggttgatcaaactaaaaatctttggattaatctttatatcctcactttgtctcaatcttaagagaaattctactggctaccttcaaaatacatccagaatctgatcacttctctacca

SEQ ID NO: 38426 - DNA, 948 bp, Bovine  19866881973505
aaaaactgagtaaggtaattagtataaagttcttagcaaagtgccaggcacattgtaagcatccagtgaatgttagctattattaatagtaatagaataatataaatagcattagcagtatctaaaaaaaaccagagagtcctggtctatattaaaccaagtcacactatgttatatcatatgctaccttctgggcatcaagtttgcttcttcccttaataacctttgacattacatactcacatcccaaagaagaatcagaaatggaaaataaatcactgctttaaaaaacttcaaacttagcaaacattaaaatgaactctttcaagagggaggagtgctatgtttaaaatgtactggatctgactgtcttggaaaatggctaacactccggggctatccccaaatcacttctgtccatactggggcctgacatctcttagatttctacctcaggacttgatcatagattggataattttaaaatgaaatgagccatcaagtttacttccatgagatattaatatcttttctatatttgcatcgcgaatccagtccatgtttattcataagtgacacacaattgcaatttaacaaacgatactgcattctcatatctgctctggagggttgaaaaggatgcattagtcctcctgaggctgttatttcaaggagtttgttcaagaaaatgcctacaatgccaacggactgctttatggtgaatgtgtttataacaatcagtaaggggtttttacctagatgatcagcaaagaggtttagctgccagagtgtggaagctagactagctgtaccatgtctgacagtgaattgtaggaggtaagaatctgctttcctgcccatacaaatccacaggacccactgcaagggattcctggggtgctgaagtccaggggagtcctctgagatgggagggtccaggtcattttg

SEQ ID NO: 38427 - DNA, 3275 bp, Bovine  19866880084237
ggcatccggtcccatcacttcatggcaaatagatggggaaacagtggaaacagtgtcagactttattttgggggggggggctccaaaatcactgcagatggtgactgcagccatgaaattaaaagacgcttactccttggaaggaaagttatgaccaacctagatagcatattgaaaagcagagacattactttgccaacaaagtttcgtctagtcaaggctatggtttttcctgtagtcatgtatggatgtgagagttggactgtgaagaaggctgagcgctgaagaattgatgcttttgaactgtggtgttggagaagactcttgagagtcccatggactgcaaggagatccaaccagtctattctgaaggagatcagccctgggatttctttggaaggaatgatgctaaagctgaaactccagtactttgggcacctcatgcgaagagttgactcattggaaaagactctgatgctggaagggattgggggcaggaggagaaggggatgacagaggatgaaatggctggatggcatcactgacttgatggacgtgagtctgagtgaactccggcagttggtgatggacagggaggcctggcgtgctgcgattcatggggtcgcagagtcagacacgactgagcaactgctctgatctgattcctctgaagctgctgctgctgctaagtcacttcagtcatgtctgactctgtgcaaccccatagatggcagccctccaggctccgacttccctgggattctccagtcaagaacactggagtgggttgccatttccttctccaatgcatgaaagtgaaaagtgaaagtgaagttgctcagtcgtgtccaactgttagagaccccatggactgcagcctaccaggctcctccgtccatgagattttccaggcaagagtgctggagtggggtgccattgccttctccatctgaagttgctaagatgttttaatagcaaatggcatttaggaaccatagtctaggtgttaactgtgttcagttctatttggttctattggttctaggccccttcagtgaacagagctaggaaatttgttttccaaagtaaggaaaaatcaggagcttataatgatttttcaaattcagatcaaacattaaaaataatttaattttttgattttatacttgtactttttctcttacaagaagtattttactatgtaatgctatcaaatttaattacatatttacctgtatatctataatttcaaggtaaaactaccagtaagtatactactattaagatttcttttaaactctttttattcacaaaatatgttatactcaactaaatatgaaaagttaaaaaaactgtggaaaacaatttctttggcgttttcttatgtctctaacttgatgtacaattcaattcatgctttcacattgtttttcatatttaagggctcttacttcaattctaatttcatccatcctctaccttctctctcttttttaaattgctgctcattacaagtttactataacaaattcttacttcaaatgcaatttgccaaataaatatgaattcttttcttatataaaagatagcataccatctatgttattctgcattttaagtttccacttaataatatattagtgtatgtatcagtgtatgttatgtatcagtgtatcagtatatgatatgatcttcaatcctgtttaagactatgtaatatttaatttatcataatttatgtaatcattccctactgatgaccatttgagttgtctgataaccattgaggttttggtattaaaaataattctgcaatgagtaattttatatataaaaaattctgaatttttccatttcttgacagatacctataagtaaaattgctgagtcaaaaagaaagcatgaataattctagttattgccaacttctcttctatcagtgttatctctttctgtattctcactgtcaaggagttgctgtgtcccaataaaagaatacaggatcaaaattttggatttttgccaatcttataggtgagaagtgatatcgtaataaaatttggtttgtgattatgttgctaaactcatctgtttcattcttcttgtatgtactgtttgttcacatcttttgcccatgtttctatctggttgtggttgttttgcttcaatttttagaatatctttgtactgggaactgtcatctttttgtaaattatatatcttttcttagtatatcctttgccattgtttatattttttcaatacaaatctcatattttagcgcagtcccacattatttattttattgtttctgaattttgaatatttttccaacttccaagttgtaaagaagttcattcttatttctccatgatataatttaaaaattaatttttatattttagatctttgatttatttggtatgagtgtgaaatgaaaattcaattttatcatttttcaaatgtttgccttttgctccaactctacataaaaatgtctgtctttttctcacaaatttgcagtgccacctttatcatatatacttttaagggtcaaaagtttatacaaacttttctggtatcaaagataggtgttcggtttaataatctgccttctattcaaataacttcaactcaaactcatccttaaatttggcttatttaaatgcaaatagattaaaaacagaagtaaaatttccaagatgttatcctacaccctactacaaagatgtataaggcatggactttgtaattaggagcttatagtttaataagagagatggatatgcaaaaagactattttaatatatttttccatataaagtatttgtgtcatgtgtgctaagttgcttcagttgtgtctgactctttgtgactccatggactgtagtagcctgccaggctcctctgtctgtgggattctccaggcaagaatactggaatgggtagccatgccctccttcagagtgttgggtgggggtgggggtgaggtgtaatttccttggttatgtctcatcacaacaaaaatttgaagtgatggaccagcgttacagccctcagacagaccagtgttacagctttcagatggaccagcgttacagctccctgttacagctcagttttatttagaaaataaaggaaatacatccttggggtgtgagggcatgctgactcaaaagacttgaagagaagagagagagagagagagagagagagacccctcctcccccagccctttggctcctctttttagtccctgggactgccttatgtaa

SEQ ID NO: 38428 - DNA, 1022 bp, Bovine  19866880348266
agttggtgatggacaggaaagcctggcgtgctgcagtccatggggtcgcaaagtatcagacatgactgagtgactgaattgaactgaactgggttttatagaacaatttccatttattatggaggaggtattgtggttctgaaggtgatacttaagttctagatactcaaattcaagtcaactgatctaattgcaagagaaaatataggccaatataggcttttatttcttttaccaataaagattgtattccttttctacctaattagatgagtcattctgatttgttattctgactacagtttgcagtcttctctttatagagagtggaacttgaagcatcccaacagtctcatcagcagtttttgtttcaagcctggaattttaatttgttgaaagatgagccaaggtgaagaatcctgcgtcaagctttatacagcacagcgtctcttttttaaaaaaaactagaaccttcatggcttgcttttcactgtgtatggaagtaaatacatcagagcttgctaagctatccatccaaggttaagcaaaatttctctaacgtgcaggaaagcctgtttttcctcttgacgctgatgtagtacaattggtgttcacagctgctacataaattgtttgcaaaatcaatgaaagcattccagggccagagttagcatgcacttctcctggtgactctggaagcatgttactttccaaataaagtcatattcccaacatatgcactgccactctggttcctgacctcccagaggacaatgaccatgactagctagtgacacacaaaaataatgtaccaccctggttatgaaagctaccaacctgtagccttgaataagagctcctattagttaagcaatcaggggttgcatttctgctcagcaagtaccaaatatttaaagtaacatccttgacttttaataatagaagattgattatagacctagtttcaatttgaaaaatactcaagatgactaaagaaaagaaggagatatataactaatagg

SEQ ID NO: 38429 - DNA, 811 bp, Bovine  19866880454546
ttcattattagtgaaagttgtgctttttgagtgtctttctaaggagcatcccttgagtgtgcagtgctatgggtttgaggacaaataagtcacatagttatggagctcagagctggctcctttatgagaacccaccaaatcagaaaccacaaagcagagtcaccccaaaccgtcagacccaaattctaagtgccagttttcctctggtccccacgcttccctcttttctctggatgcctgtctcagacgccacactgccttgtggcatgtcatgccacacaaaaatgcacttccactctcaactctcctaattgaggtcagatgtaagaccctctgtgttcgccctgaaggaatgtttaattggaatcccatcagaccgcagtgtggtacagtgggagagacagaggattccaagtgtgggtttgaatcctccttccctggctctgtgacctggagcccatgaccacacctctctcacctctctcctctgagcctcactttcctcatctgtaaattaagaattctcattcagtgttggtttttgcctttctgaaaggtaaaatgaaacaaagtattttgtaaagatactatataaatggtacgccttctgcatatgaattataatggtaataacatgggctattccatccagtttgactgggaccccttaagaggaagcttctgtaggttttcttgctcctgtcaatgcactccttcaagatgggccactccatctttgaaaaagaaaaggatctttaaaatgccaaagtgcatttcacagaacattaacctttcaagattctctgtaaat

SEQ ID NO: 38430 - DNA, 1384 bp, Bovine  19866880483663
tgctctcctccattttcaacacccatccttcagctacatcttttctttcaggaataacttcagatatttattacctggaccattttagccttcctactctccacccattagtaaataagcacaacagaaataactaaagccaagcagtaaaaacagaatgctccttagataactctggtggggaaatggatacagaaatgtacagtttagtattgttctccaagtcatccgtaaaaataataccttttcaatcagtagtgttccaagtactgatcagtaaaacactgtaaaatattaattgaatgttactatttaaataattaagataagtaagattagcattcatctgacatctgatgttaccgagacttaagggagcataattgactactgacttaaaggggcattatcactattttgatttgcctccaatccattaattcatataaatatatggtacataaacctgaaattatatttatgacataattgcaggcatattaatagaaacatgtttatatttacaagtgtagtgtagtccttttacaaattagattctgttgatgaccagcatctacatataaaaatgctccatattgttcacatttataggccataaaatgcagatgataaaatatactttctcatactttctactttctcataaacaagaaataatgacaaaggaggagctttatatgaaagcatcagtacaatttaaacactcacgaggtcataatatattacactgagtagaaaagttcagctgtaaagaaaatgtaaagaacattctctccccttaaaaagtcaaacaaggttccaaatgcctaaccaaaacacaaaagtacagagaaaagacctacatctttccattaacaaaacacttggttttaaaaagagcttagtagtagaacatacaaaagaaaatgcaattcagtatctaggatgaacattttttataagttcagcattaacattgaagaaatattgaattaagctgctttgaaagaattgaattccatctgctgaaatttttcttaaaatgaattttttaagcatacacagtagcagtctgtattggttttgagtttcaggaagctatattccaacatatgcaagagaagagtcacagaaaaatgtaacttgggagagaagaatgaattttatgacctgcttgcagagctgaaaagaataaacgcatacccacttttgctgctgtgtgtgttggggtttccctggtggctcaggtggtaaagaatctgcctgcaattcaagaggcgtggattcaatccctggttcatgtagatcccctgaagaaggaaacggcagcacattccagtattcttacctggagagttcatggacagatgagcctggcaggcta

SEQ ID NO: 38431 - DNA, 1358 bp, Bovine  19866880508125
agacattaatgtgctgttattagcatcacactcatattgttttcagcaaatagcaatcaataagacccattagctagatccggcaagtcaatagtaagatctacaaaatattgatttcattatatgaggagctgtgaaagagaaacaaccacatccaagctttttaagctggtctagccagcaggggcattttgtaggcaactcaccatcgtaagtgtagatgttgatgttgcgaggttccgggtagaagcaagagcagatcagggacagcatggacagttccttcattttttccttgtaggctgaaacaaacagctcaagattagtatctctcatttcctgaatttcctctgaatgcttcatttcacctgaatgattgttatagcctcctgtagaatgaatgttggtagggactctctctcacaaattcgatggaaacagaactctggggtgcatatttcttattacagaggacataaaaggcaaattactgcaggttagataagaagtgaggggaagggagctaaagaaaaacaggaaggtagaaggaattgagatccagcaaggtaggagggagagacagaaaagatatggaggaaacagaaacagacaaaatggacagagataggttcattctatacatgtgtgcgcaggtctgttgtatataagtcagtttcaggaggtgtgctttgttaaatctgaatggccacatattcatttgggaagaggcagagaactcatcaggacaattattaagcaaatacatcctccagggagcagtgctgctgccttctcttcatgcccaagtgcactttcatttatctccctctttccacaaacaaacctggaccagagatctgataaggacctcccttcctctctgcacgctcagtttggatgccaagcagctgcagggattcggacctccttcctccttcaccccccacaactcccatttcatttttcccttttcccctcaagaagcctcctgcctaggtgaccatgggggcctcttatcactattggccatcactgagacaacagatggggataaggaggtgggattctctaacctttgttgattcttaattctcaagaataataaattaaggaaaatgaaagaagaatcatagagagactttgttcactaacttatgagaacatataaacagatggtgaggtcctaacatattgaacctcacagggagctagtgcctcttggcagggtcttctgatggttatgcaacccatgggagaggagtaccttgggaaggtgagaactcacagaagattgtttggggattattgccaggtgcatctgcagttagccagtagaaaatagattcaatatctggatg

SEQ ID NO: 38432 - DNA, 834 bp, Bovine  19866880526486
attcagctggtatttattcctgcacatctccccataagaattatgatctcctaagctatgatagccacggagattttgaaaggttaatattttgatcagccaaagcagcatattttttctgtaggaatagatatcaaatcaaatcaagggacatttaagaaggtcaaagctgtacaacccatcattggattttgcagaagcatatgagactcttaaatttcaattccattgataattggtcaagcagttgtaacaaggaaaagaaactgggtgacccgaatcagtccctgtggtcaaaactgtaataaaagcagtaaattgtatcaacttggaacttcaccttactcttacttccaagtcaaacatccgttgagtttaatgagaatttaatcatgcagagtgctgttcttttatctttccccgcgatgaaagaaattcttgtagtcttacatggagaccaaactacactatggtttacacaggagtaatggaagcactttattttgtctgcaagtcaagattttattaccaagcctaattctaggtatcaaagggtatatttttctttttgtttttgtttttttatacagtaacatttttttttaaattttattttaaactttacataattgtattagttttgccaaatatcaaaatgaatcaaagggtatatttttcttaagtctccagcagtagtcacaagcctaggatgatagctaaattggttgggactaaaatgagagaaaaccagagtggaagaacagagtttgttcatttggctgagtgaagttctcatagagcaatggctttttttctccctttttttctcttctt

SEQ ID NO: 38433 - DNA, 1172 bp, Bovine  19866880546589
ttttgaattttgaatccctgtcttttttccatttaaagaaaagagaacagtggctggctgtgtgcctgttccatgccgtgttaagtgtcaaacccatcaccaagggtaaacagctcccagtaggtgaagtgggattaagatagtccaggcaaatcccccacaccctggcacttttaatggttgaacagaaaaagtagaacggaaaacatgttgcctaatgctgcatgagttgcctaatgctttatctatagactgaatgcttatcgtttcatctaagcatggaagataagtgtctctgggtgcagggtacagcttgtgcccatactctcaaaggctggttattgttgaagattatgtaaaaaggctgttgggagctcaaaaaaaaaaaagaaaaaagaaaatcacagagttccgtttgttcctgttgtcagactgagatagcagccaagaaaagaaggaaggaaagaaagcctaacaccctgtcagatagcacacgagtgcactgtgtgagccaacctgctccatcttttaattagcacagaccatgctactgtcggcatcacaacccaagagccggtgttctcaccagcctgtgggtggctgggttggggaacggctatgaagtttccagattcacacttttccactgcgtggctggaatggaaggccttcttcccatgcttctaactgatggcatcttgtccaccgactctctcataggtgaccctgctgctccctcctctcccagaccccatccgtcatctggtcctgtcagtctctctgctaaacttctcccaaatctacctgctgttcttcgcctccaacaccatatcttagtctgagccacactcaccactcatgctgaacttctacaataccttcctaaatgttcttccagtgtccaattttgaagtttcctttaatcatcttccactctgcaggcagttatcttttaaattaggaggatgggattaacacataaacacccctccctgtacataaactagaccagcaacaaagacctaatgtgcagcacagggaactatattcaccatttggtagtagtctataagggaaaagaatctgagaagtaatatacacatatatatttagacatatacatatagcattctttatgtgcatatacatggttaatacggacgggggagcat

SEQ ID NO: 38434 - DNA, 2043 bp, Bovine  19866880569937
atggaattctccaggcaagaatactagagtgggtagccattcccttctccaagagatcttcccaacatagggatcaaaccccagtcttctgcattgcaggcagattcattaccatctaagccaccagggaagccctgaagcttcatagtagtaataataaaagcagaatgccttgctccattttgtctttctattaagtcatctttcccaagggtatcattttgctagaagaatgaaacccaactctaaagaaataactgtggtgtgaggacatgttattgaaaggaaaacatttagaggtgatgactaaccttccttgctttctccacaactttccaaagatcctatcagaagtaggttttaggaattgtttttctctgcatcctgccttgtttccccttccctggtttcttctcatgttgtttaattaattcatgacacaaacatgacaggcaccttgttaagtcattggggtgtcaacaattcaacaatcagtattgtggactgaattgtgacccccaccaaaattcctatgtttgaagttctaaccctccgtacttcaggatgtgactgcatttgagacagagtctttaaagaggtcaagttaaaatgaggtcattaggctggattctaatacaatatgactgatgtccttatgggaagaagagattaggacacaacaccttcagaaggaagaccacatgaagacacatggagaagatggccatctgcaagccagtgagagaactcagaagaacccaatccttctgacaccttgagctcagacttccagcctctagaattgtaagaaaataattttctatgggttgagtcacactgcctatggcacttagttatagcagccctagcaaactaatacaataagcattataaaacacagcattgtagaggagatgcgcaagttcatagctaaccacctgacaaggtaaggcaatgctgagccacagaagttctaaggttaaatccctgggcaccaagcatacagatgctatttccaaaggcagtgcagacaggcagggaatgatctaaggaagaaatagattgtgaaccaggactagaatgactcacaaggactttacaggattagagacaagggcattctagggggctggctcaggatgagtcatctttctcgtatggtctctctttgtccttcttgtgcattatcctgaccaagctctataaccaaactattatcctatcattattgcattcataaacataaattgggacttccctggtggtccaggggctaaaactccatgctcccaatgcaggggggcccaggtttgatccctagtcagggaactagatccacatgctataactatgagctggtacacccaaatataataaattaattaaatgtaagtttattaaaggggtttcccaggtggctcagtagtaaagaatccacctgccaagcaggagacatgggtttcatcagtgagtctggaagatcccctggagatggaaatggccagccactccagtattcttgcctgggaaatcccacagacagaggagcctggtgggctagagtccatggggtcaccaagagtcagacatgactgagcaactaaaccaccgccaccaagtttcttaaggagcaaaagtatcactgtccccattttccagatgaggaaactggggcacagacaggtgcagtaacttgtccaaggccacccagctcgtaagtgtcagagctggatgcacacccagcagtcctcctcctccaggggtctaatgactgagaccaggtttaatcaaggagcagggtgggtatagactgaggctctgtgaacacagcctagagggaagtagggactttctttccagacctgtgggtggaatcagaaggacagagcttgacagtagcttgagaaggaaggaaagctgaaggaagtcgtttttatttttgagaagaggaaagatgagaaactgtaggtttctaaaaggagataggagatagctggcaacagaagttccagcaggagaacagacgtctttgataaagcctaa

SEQ ID NO: 38435 - DNA, 798 bp, Bovine  19866880642521
ttttaaactagacaaattgcatcgggaggcttatttaaagatcccccattttcttaactgtgatgatggtcttaaatattaataataactacagctttggcttatatggtgcctcttccaacaaagagagatgcccttctttcataatcagtatctggcactaactgatatgcaaatccccctcccacccccgagtgcacagcgttgcatgctgcacagctgtgagtcatcagacattaatgtggacttaatttgaactggtgctggaggtatcgtttaaccacagtattaccaattcccattctgacatctgacagcccttaataattaactgcatgtaaatggtcaaaccttccgtctctgttggaccggtctctaactctaccagtctctgcatcgtgattgcaagtcagggctgtcaactgctctagtggcaaatcatagggaaaagatcagacatcttcaggagtcctgtgttcttcactctagctgccttttaattggactggaaggccttcctagcagctcccatatgctgctttcttagaaagacagaatattttctctggataagagggaaattgactgtgctttgaggcttaactggaggctctggggaaacacacttttgtggtagacttgccagggttatgctacagtgcgccaaggcaggtatattgtcccaaagccacaagttactcctttcctgaaacctcatccttgtgtgatttttcttccttctccctataaaatgtcttatttgaatttaagccacggattgacaggctggttccttgg

SEQ ID NO: 38436 - DNA, 3203 bp, Bovine  19866880750938
catgcacgcacgcattcttgttatgagaaaccagtgaaacagtacacataacgcacagtgtggtgatagcccagtaccagacacatgccaagatctcaactcatacacctttctttcttctgtcttttcatctattacttcacattgttgttgctgttgtttagtcactaagtcacgtccaactcttttgcgaccccacggactgaagcctggcagtctcctctgtccatgggatttaccaggtaaggatactggagtgggttgccatgcctttctccaggggatcttcccaatccagggatcgaactcacgtctcctgcattggcaggtgcattctttaccactgagccaccagagaagcctttgacttcatattgggatatcttaatgacagtctctttcattttagttattatgtacagctttcaaaacagtctcatacagatggtgattttagatactgtactttaaaatatatatatatgcatttggctgcaccaggttttagctgtggcatgtaggatctttcgtttcagcatgcacatttttagttgtggcaggtgggatctagttccccaagcagggattgaacctgggcctcctgctttgggggcattgggagtgagtagaatcttagccaatggaccaccagggaagtcccaataatgtatttcttaattttttagtgcacagaccacacaggacatttttgatgattatttaactgtttcatatctatctactccttagaatatatactagcttttcaaagacagaggccatgcctgcctggttcacttcagtatccttggtgcctcccatcactggcatagagatgcagttatcatttgttagataaataaattaatccttatgaaaacctagactcacatgtgatgagggagagggaggcccactggtaagataggtagctgatgaacaaaaaattgcagttatctattatcccaggtcccctgatgcttgctttctcatgcttaggcttgctcagtcatgtccagctctttgtgaccctgtggactatagtttgccatgttcctctgtccatgggatttaccaggcaagaatactggagtgggttgccatttcctcctccaggggatcttcccaacccaggaattgaacccagatctcctgtattgtaggcagattctttaccactagcaccacctgggaagctccctcttgctctaatacttacccagtaacctgaagggactggatttccctggcgtggcctggtccaggagttggatatataaagtcagatcgagttggatgagagaggagagaaaggatggatcatgaaatgtccactaaaccagaagccttataatttctacttggaaaaccttcagacaaattcaccacgagcctcaaatatcagcctcatctgggtcatgtcttctctaggctccaacgctgctgaattctctctcatgtcaggttttgtgtatgtgatatttcctttgtcttttctattctccactgctatgcactccctcctttgcctgcctgactcctgtttattcatagttcagcttagagaccattttatgtaccatataaatttagtttagatcctggttttgtcggttgtttagtctctaagtcgtgtctgactcttttgcgaccctatggactgtagcccgctaggctcctttgtccatgagatttttcaggcaacaatacctgagtaggttgctatttcctcttccagggggtcttcttgaaccagggaacaaatctgcaactccggcattgcaggtaggttctttactgctgagcaaccagaacacccagattctggtttaagtctttccaaattttgtatttcaccatcgtcaaactgtataatgctacactgtattataatttccttacttgtctgtgtcactctcgaacccatcctaagagggagaaaagtatctatctcatgtgcccgggacagagcacaatgactagcatattaaatatatgctcagaaaatatttgttgactgaaaggtcacagtagaaagggaacgtcttatataaactcctcttccccactgataaccactttcattattctcaaggcaggtcaaatcaccaacttaaagatagtatatctgagtgggtcacctagacacttactctacagatatatgaagattagagaaaatatttttaaataacttaagacagcatgcttttgattccatttgtagagtaaggccttgatgcatcttctctgtggggactggctgtttgttccattttttttcttttattaattaatttttattgaagtatatagttgctttaaaatgttgtgttagcttctactgcatagcaaaatgagtcaaccatacatgtacctatgcccccacctctttggatttccctccgattcagatcaccgcagtacattaagtagagttcctatgctgttcactatgctcccatcagttgtctactttatattaatacatagtatcaatagggcttatgtgtctatcccaatctcccaattactctcacctccacccctttcccccttggtatccatacatcagatccgctttttgaaaatgagatgtacaaagttggtttgcccgtcttgaatttcttattgcatctatgttgatgatttagatttcccacgtctccatcactttggctccatttataaaaggagatgaggcccaccctctgggatatctccgtctttctctggtctccagtccaggtgggcagcacaacacacatgggccaggtcttagaaaggatatttaggaacctgtcagttaaatgaagtataagaacttccagggtttccaggatctaagcaaccaggaacaattccccactgtttgcaactaagacaaacagaaaaaaacgtgggggaggaggaacaccggcccgtctctgataaataacctttccgtgtgaagtgcacatcagcctgacataagtaattagctgtcaggtgctgggctttgctgtcagaggccaattttcagattagtgttaattgcagggggggatctgatggcctttgctcccgccccctcaccccttcagtggactgccttccccagcttgctgccagtttgactggagcctcgggtaatggagctggcagggtggaatcaattactagccaatgaagattttcccacaggtctgggcttggagaggagg

SEQ ID NO: 38437 - DNA, 899 bp, Bovine  19866880801210
tgatgtactctgcatagaagttaaataagcagggtgacaacatacagccttgacgtactccttttcctatttgggaccagtctgttgttccatgtccagttctaactgttgcttcctgacctgcatacagatttctcaagaggtaggtcaggtggtctgatactcccatctctttcagaattttccacagtttattgtgattcacacagtcaaaggctttgacatagtcaataaagcagaaatagatgtttttctggaactctcttgctttttcgatgatccagcggatgttggcaatttgatctctggttcctctgccttttctaaaaccagcttgaacgtcaggaagtttactactatactgtaaatgaagactttgtattctttcattttttatttctgttgttgaatgctctcattgaggtaagaaacacggaaaggaagaaatcagagaaaaaccagaaattggtaagtgaaagaaaacctattatctttcatatttttgcatgtgtaatcagcattgggggggggtggtaattacctcacatagtttagatttaattttccccaagaatctagaagtcttctactctagaatgaaaaaaaaaaaaaattgagagggtgtatctttttcacaaaataccttaatatggatattattccaggaggaaattagattgaagccaagggagcaaggtgtcttctggcaaacaccaaatttagagcccattattattactaaactctaattatgttttcaatgtcttgcttttggtattgtgggaagaactgatttaattttaagagactccctgaagctcactaccaactgactcatccttcttaattccacctgcgtgtttctctctttttacttcccatactctatatttagaaaa

SEQ ID NO: 38438 - DNA, 1755 bp, Bovine  19866880874311
aaaaaaaaaaaattaattcaagaagatccatgcacctcaaagtttatagcagcattatttacaatagtcaagatatggaagccacctaattgtccaacaacagatgaatggataaaaatgtggttatatatatctacaatggaatactactcagccattacaagaatggaattttgctatttgcagcaacatgatggacatggaggacattaagttaagtgaaagaagtcagaaaagacaaaggttatatgatatctcttatatgcagaatctaaaaaatacagcaaactagtggatataagaagaaaggagcagactcaaagatacagagaactagtggttaccagtgaggagcagggaggggcaatacaaaggtgggggagtgggaggcagactctactgggtataaatagactcaaggatgtattagataatgtgggggatatggccaatgttttgtaataactgtaaatggagagtaacctttaaaagtatattaaatttttaaaaaaaaaataaaacattttctccagtggaaaaacatccaaacttaatatttctgtctctggcaaagacaacacctcctctttgaatttaaacctattacccttgttatagagatacagaaagtacaaaagtatacaattctctatcttagatttattatctccatatttctgatattttctggtcaattctttatgatatgtcacctctgtggtagataacttaccagtaaccttcgataagttcttggctaaaaggcattgaaaagtattatcagttaaaaattgttattttgtcactgtatttttagtgtatcgaggttacactaaaaacctcaataatagtatatattccctcttcaagtagttatctctcaaatacaaaaggattcgtaagttgatttgtgtccctcctcatacagcctacttttatgttcacttttagtcatttaaatgttaattttttaggatttatatcctaaaattccaggagaaaatgagcaatttataaaaattactaccttgaattcggtcactgctaagatttaatttattcaatagaaattcttctccttggctcctttgggacctgagttatctggatatttgtttttgttgttcagttgctcagtcgtatcctactctttgtgacctcaagactgcagcacaccaggcttccctgtccttcactctctcctggagtttgctcaaactcatgtccattgagttgatgataccatacatccatctcatcctctgttttccccttctccttctgccctcaatctttcccagcatcaggttcttttccaatgaggtggctctttgcatcagatggccaaagtattgaagcttcagcttcagcatcagtccttccagtgagtattcagggttgatttcctttgggattgactagtttgatctccttgatctgaatatacaagcacccaaatatctcagaacacttgtctccaagctgacccactgtaactaagacctctcagactcacattgtataatctctgcctggagatgcagcatccaaccaacctcttcctcctcacgtctcttatatcacttcctgcctcctcatcattcaagcttcagatggtctggcttaattagccttctgggtaggcaagactcacctagggcatttctgtgatagtaggtgcttaaaagaaacagaagcagcagaaaacgataacatattttccaagtaggtaatatattttcaaattttctcatg

SEQ ID NO: 38439 - DNA, 1619 bp, Bovine  19866880896662
aatggtctaagtttttgtctctgtaaatgctcatattttgaatgctgagcttttatccaccataattcttcatgccccctaatttacttcttcccagattcatgcaatactcaatttaaaaggttccttctgtttcaatgtattatctttaagttaacttttactcagaaatcactttactttccctgcaatgtgctccctgaattgaagtcaagaagtacaaattgtaacaaaaataatcacagcttttagagttagagacagctaccggattgtgtgttacctggaacagtgttcctttctgtgtagaagttacctttatcaaacaatccaccccatctggggtagagaaatatgttttgtatgtactttgtgtggatcataaatggttgagataattagtaagcaactgatattaaaaggtcaattagaatggattaattttagcaaaagtcctcttattcaaagaaattagatcatatatttggccaattaacacagtcaaatgtgaaattacaacacaattttgtgcagtgaagaattaagttaactcaaagacaggtcaggcctttgcctttggctactgggaggtgatctttagtatcctgggatgttctgcctaataaaagagtctgtctggggaaagggaatgaagactaaaggtattagtttgagcctctaggagggattggagactaaaggacagctacctgggtagtatgtaatagagtcccaataaaagctctggacactaaaggcttggatgagctttcctgattggcaatactctgtacctataatgcagcagatgtgagttcaatccccgggccgggaagatcccctggagaaaggcgtggcaacctactccagtattcttgcctggagaatcccatggacagaggaacctggcgggctacagtccataggatagcaaagagttggacacgatttaagtgactgagcacatacatggtgatatacgtaaatataccacattcttgattccttggggagaggacagaaaaactccacacttgctacctttcttggactctttcctatgctgcatccttggctcattttaatttgtaccctttccctgatataaaccataaccgtgattataacagcatttaataagttacttgagtccttctagtaagttatttaaccagaaagtggttggggactctctttcctactgaatttcaattatttttagaagtgagtgtaatcttgtaatgtgctgtaaatttgcagttggataaactcaacacagatgttcatcagagatatccataaatatttagagtctacttcttctaggcatattgtatatatagagtgtgtgaagaactgttgtttaaaataactgaaatttgtagattgcaactccagtgtaacctagacatctagttgaggaatacacaaataaaagctttgacttacagcatagaagtgtaaatttgtttgactgtgttttgaaaggcattttctgtgagtatggactcagagcaggatcctcctagatttcttccctgatttttgaactcatatttcatgtgtatgtgcaataattccttgagtaatataatcataatactagtacaacagacaaa

SEQ ID NO: 38440 - DNA, 1834 bp, Bovine  19866880976054
tatatatatacatataccatatatttgccctgagcagctcacaaattaaagtgtcatttactgaagtgtgaaggatgaggagaggaaggagaatcagaaatttggggattaaaagatatcagttttggataagttagagattcctatttagacatccatatggagaagccgagtaggcaggaagataacatagcatcctggagttcaagggaaagactagaagcctgctgctgatgctgttgctgctaagtcgcttcagccgtgtccgactctgtatgaccccatagacagcagcccaccaggctcccctgtccctgggattctccaggcaagaacactggggtgggttgccatttgttctccaatgcatgaaagtgaaaagtgaaagggaagtcattcagtcatgcccaactcttagcgaccccatggactgcagcctaccaggctcctccatccatgagattttccaggcaagagtactggagtgggttgccattgccttctccagactagaagactagagatacttaattgcctgtcatcatcaaaacagtgatatgtagagctatactagtaactacatgagatgatctaatgactaaatataaatatttgaatgtatttctgctagtatattattaaatttgagtatcatcagtcttcatacagtaaatgttgctgaattgtaagaatagcacaccatttatctatagttatgtctacatctgtatctgtctatctctctatctatctccctacctctccatctatctccctacctctccacagagaggactatatataacagaaagggaaaaaagaaatgtatctggcagtttcctcaataaacatactaaaacttctctgctttttgacaagccagtacatttttataactcataaataattgaaaatagcaaacagcttactgtcataaagcacttttatgtgatagtaaaagattctcttgcacatgttagtattggtcataaacagcacactgaagtcaaaagtaaatggcatgagcaagaaatttcattaaatttttaatgaggacaaataaaattctatcatgctatggttgctaccaaattcaattcaattaaatacatacttgtcacatgtttattacatgcatatcatataatgtgctagtgtaaaggatgcaaagataagccacaattgtcacagactcacagactttggagttcacactctggtagaagagggctttattccaataatcacatggcttattggttaatcacacattgagataaaattgtgaaggacaccaacatgaatctataaaagcataaggtaactataactgacttagtctgaaaaatcagagatgactttgtgagaaagtatcacatgaacctggtgaagagaagttcataaaacaaatgggatctaggggattgacatcgtgtgttccgtaaaatggagaaatccagtgtagatgaagaattaagaaaaatgataagcgataggatagtcagcattgttcaccctgctcgtgtgagatttgtaaaatatcttaagatttttttagatgattttcttttctcatttggaaaaacatgagaaatttctcattttttaatcccaaagatccctttcactcaaaagctagagaattctgaaattccagctcatgactttcaagtcacaggtgctgtccgtggtgctagaaagtaagtaactgagaagagagaagtgattaacaccaaggttcccaaacttgaccatactttggaatcaccacactcaagatctactgaattataatcctgaggattagaacccttgggtctgtatttttgtagat

SEQ ID NO: 38441 - DNA, 1271 bp, Bovine  19866881294529
tccattttaaaggagatcagtcctgggtgttctttggaaggaatgatgctaaagctgaaactcccaatactttggccacctcatgagaagagttgactcattggaaaagactttgatgctgggagggattgggggcaggaggatattgggatgacagaggatgaaatggctggatggcatcaccgactcgatggatgtgagtttaagtgaactccaggagttggtgatggacagggaggcctggcgtgatgcaattcatggagttgcaaagagtcggacacgactgagtgactgaacttaactgaactgaactgaagtatgcttccctggtggctcagatggtaaaatgtctgcctacaaaatgggagacctggtttcaatccctgggtcaggaagacctcctggagaaggaaatggcaatccacttcagtattcttgcctggaaaatcccatgaatggaggaacctggtaggctatagtccatggggtcgcaaagagttggacacgactgagcgacttcactttcacttcaaactatggtggaggtaatgaagataatggcaaccttcttcaaatggtccaatgcatgtactgctacacttattgcccccaacctgaagttggccatcgcggacccatgcctcaatacttaaccactactgttttcttttaccactaaacctatgtgctccttgatttatcaccttatctagcaagtgttgatttttcttttgcaaactctccaacaattttttcataggcttttctgaaatcttttttgctcagtgaaatttttgatcattttctccatcaataaatatagggctaaatcacaatttttagataatatatatcaatttgatatatatgtctttaccataaagtattttaaaaaatcaagcagatacttttcagtagagtggaatgaagataattgcctgactttgctctgccctctggcctctggcttagttgattgctccaagggtggaaatattgatgtcctgatatttcacagatatataaatttaagatctgctttcagttaacttgcttggcaattaccgaactctttcaatttaacaattattgttttctttgaaaactgggggaattctattgtattaatgtctttattttaaaaataattacatttccagttatctcttatctctctatgaaattcctattactaggtccaaggatactctctttttaagttgctgtaattatgtaacaaattactccagaacttatttcttcaaaacaac

SEQ ID NO: 38442 - DNA, 1784 bp, Bovine  19866881392352
attggttgatgagactacgtccagtttttgtgccagttgtagtcagcttcatttcctggttctcacacagccgcctgacactgttgtgtttggattcccaacacggctgggggatgtttatgtccccacccagacagctgtgctcattgaaacagaaggatcgttgatgctgtttacttccagaatggtaaaacgccgaaactcctcgtctctaaaaaatggttactattttatttaaaggtgaattaaagctgtttatctcaactcagcactatcttataatggttttcccaagttagcgtcaattgaaaatgctcttatgttatttttaaagtgtcaaaaaatggtaggtcttggaaattctgcagatttttatttctggcataattggaagatttggaatatggttaagagagtgtttccatctatttattctaaattggccaagtctggaaaattacagagatggctggtccttttgtcatgagttcccaaaatcagaattgcttggctgatggccggactctgactttcttgaaaagtttccaaggcagtcttcatcctaaaacacactggccatttaggaaaggccagaggaatctgctttaccaataagaggccacttccggtggtcctagggaaataagataatcccttttggggtgggctttaaaaatattacacaatttttacaccctacaattctcaagatacaacttagttctgtggataagctgagctatcagaaaagaacctcatgttgtgtaaaagggccatcttttcactgtttaatcctttacagacccagcatcaaccttcccaatcccgatagctgtatttctcatcctttatattctaaaagcttatattaggaatataataagagaacaccttgacaagtttcaggaaatgaagcttacttgacagaagcaaatttctttctttaaaatacccaaaggtactcaaattatgttttcaaatatttgcattctttggcctgattctcaaatatgttttcaaatctttgcactctttgacctgcagaaaagttctataagagcctcagatttccatgattcacatgcagatggaatcctagaatactgtctgaatttcaattaatttttggcttccttgctgattcaggtgatctgagtgatataggctgttacttgcctactcagtatctattcttgccttcttcctgagtgacagatttttttagctgagcacattactgcctagaacaagacacatttccagcccccattctgcttggaatggccaattagttgcaagtggaatttgttaggaagggcttctagaaagtataccttttgacagtgacacatggaggaatggcatttttttccttgcccttccccacttcctcagtgccaaccaggatcgtggccctgatggctagaccttcacatcataatggattttgagctgaccttgaagatggaagctcctgggttaagaatgttggagcagggagataggagtgtggagccttgatggccctatggtgccactgttactgctgttgttatgttcctaagttgtgtccgagtctttgtgaccccatggactgtagtccaccaggctcctctgaccatgggagaggagcaaaaatactggcgtgggttgtcatgccatcctccaagggatcttcctgatccagggatcgaacctgagtctcctgtgtctcctgcactggcaggtagattcttttaccactgagtcaccagggtagaactgcttattcttggacttcatta

SEQ ID NO: 38443 - DNA, 1408 bp, Bovine  19866881522310
cttctttttgctgctcttctgtgggaaagaggaagcaggagatcttagcctcaggaagtgatgtcgaacagtttagctgattataagtgcttgaaaggcaaattaaggccttccctttaataggatgtaattggttaaatacggtaatagaccacctgtggctgagacgaagccaagtcctgagaagcccctgagaccacagcctggtgttgacctgcctgaaggtcagacgggtctctgtgttacagagaaagattctaatcaaaacctgggtgtacaatttggtttagaatatgttgaccaatggaaaaaagttatacaatttttaaaagaatttctttttagaaattaatcaaccaccaagcaagtaaaacagctttcctggtgcctcagatggtaaagaatctgtctgcaatgcaggagagccaggttcaatccctgggttgggaagatcccctggagaagggaatggcaacccactccagtattcttacctggagaatcccgtggacagaggagtctggtggactacagtcgacggggtggcaaagagtcagacacgactgagtgacgaacacacatgcgagtaaacagtgcatcctgtgtgccaggtgctttagtaagcattcgtgtataatgaacttgctaaccagtctgtgagacagattcgattactatcatcagaatcaaacccactttgcagatgaaaacactgaggcacagagtaagcttggcttgaggtcacacaacttgtagtggtagagctgagacttgaagccagacaatctgagtttaccatctacattcctaatccctacagtatactgcttcccaagatctccttacttgttacttgtgaattccatacacaacacaggctagaccttgcatttggagcaatatgtcttcgtacactcccatctcctcatggcatcagaatgatcacaaaagtagctttagggaagtgaaaaagcccattcaagattgcatccactgggacttcctggtggtccagtggttaagaatctgccttccaatgcatgagactcagtttcgattcctggtcagggaactaagatcctacatactgcaactaagcccacatccccaaactagagaaaagctggcataccacaatgaagacatgatgcagccataaataaatattaatattttttaaaaacggttacatcagcaaacctaaaattaccaagtgacaacaaatgtcatacaccttactcatacacagtctcatctgagcttgaagcatgatgctgaggtgatttaataaggagaaattaactgaggactcctttggaagtagaaaaatgttcacacgtggttttgccatagtgggcagagtcatccttaacacagcatctgtttggcaaggaagaaactcctagaa

SEQ ID NO: 38444 - DNA, 1051 bp, Bovine  19866881657475
ccttacatcacccagtcgttcagctgtgcacaaagtcttccatcagaatcttctcataaggatggaaatgtcaaaatcaatttcctggaaaagaaacaaaaatggattttttttcccttaaatggtcttgatagcaaaatttatgagagtagaaatacatcctgagggattggatgaaaggctcattgaaagagtcattttcatctggaccagggaaagccctagagaggaaactgccctgagacccagagggcagactatatgttggaatttttctttgtttctaacagctacagttggtttttttgtttatttgcaaagtgctggttgtgtctcaggggtagtgagttggcaaagcattttacatgggaaaaccaaaaaagtcagtgtcacagatagaggttggcatgtcccactgcagatagctcagtgaaaagtgaggtgtgtccaggggccaaggacatttggagagaccctgtaccctgataagctgtctagagcttccatctacaaggactgctaaaatcttatgggaatatgtctgaaagcatggcccactgtacctcagatcatcacccagactcactgcaggaatggtcaaaaagtaagctggtttctctgccccagaagagacaaggctctgaagtaaacgttagaaacagttctctcccatcctggccctgtgcccacaaatgagctttgaggagaatttaaagatggtcagcctgaagggtgccaagtctctatcctgccccagttggtccagaagcacagacaactctcccccgagtatcctgatgaagagactgagcgtaccatggggacagttcaggtgatccctcaggtctttaaactgcagggatagccacagtggtggggccccagggcccactgaccaccggagccctgcacctcagcgggccgtgtgtgggaggctggtcagggctgcagctgagtgacagctccaaggatgcagcaaggcaggccccagtcaaaagcaggtgatgactccggctccggacttttgaggaagggctccagggcagccatt

SEQ ID NO: 38445 - DNA, 801 bp, Bovine  19866881799978
attttgtaaattgagatttggtaaaatcccattgtaaaatataccatatagatcaaatgggaagacccaagatacaacttactaagattattttttaataaagaagctaggcttgaataagaatagctgtaatatgacagccggtatatggacactaactgatttataaaatcttttggcttattaatagatacttagggaaagaagtgttgctttaaattttaaaaaatgacatgctgttagaataaaagctgaggtttcactgcacccttcggagaaggcaatggcaccccactccagtactcttgcctggaaaatcccatagatggaggagcctggtaggctgcagtccatggggttgctaagagtcggacatgactgagggacttcactttcacttttcactttcatgcattggagaaggaaatggcaacccactccagtgttcttgtctggaggatcccagggacgggggagcctagtgggctgccgtctatggggtctcgaagagttggacacgactgaagtgacttagcagtagcattaacattagaaggatttggagatgaccaatcaaaattgatactgtgctgttaatgtacatgctaaagaaatactggaatggggactgggaataagtggggagaagagaggaaagtgcttattttgggttagtggaataaggctaatcacaacaagtaaaaatttcagaaactgatttgttaaatattcacttgacagaaaaagaactatgtagattttgatttcctcagaaaaggaatagggaaaaagaaagtaaaa

SEQ ID NO: 38446 - DNA, 1129 bp, Bovine  19866881940761
aaaactaatttaaatagataaatgcactccagtgttcatgtgtgtgcatgctcagtcacatctgactctgcaaccctgtggactatagcccgccaggctcctctgtccatgggattctccaggcaagaatactgaagtgggttgtcatatccttctccagggactcttctggatccagggatcaaacaagggtctcctgcaactcctgccttggcaggtggattcttttaccattgagccatacgggacagcattattcacaatagccaggacaaagaggcaagctaaatgttcattgacagatgagtggataaagaaaatgtggcatttttccataccaatacaatattgtaaagtaaaaaataaataaataaataaaaagaaaatgtggcatttatatacaatggaatattacttagccataaaaaatgaaataatgttcttttcagcaacttagacctagagattatcattactaagtgaagtaagtcagacaaagacaaatgtcatataatatcacttacatgtgacatgtaagacaaatgatataaatgaacctatttgcaaaacagaaacagactcaaagacaaaacaagcttatggctaccacaggagacagggtagagggagggataaattaggagtttgagattaacaaatgcaaaatattttatataaaataggtaaaaaacaaggtgatgctgtacagcaacagggagctatattcaatatcttgtagtacactataatggaaaaatagacaaagcacacacacatatatatataaaactgaatcactttgctgtatatcagaaactaacacagcattgtaaattaactatacttcagtaaaagtaaaaattattttaaaaagttgtcagaaaaaatctacatgtgtgtcccttcatctgcatatttgcaaatggtatatttgtgtatatgtccatgtttgtcattcaaaaacattttgaaaatctctttttgtgtttatcactgtgctaaaaataagtcatatagatttcattgaaaaaaatcttagttactctgaagcctccttggtctctaagatgcaattgagaaatcttgttaatgattggagaaggggatctacatgtaaacaaattgacaa

SEQ ID NO: 38447 - DNA, 2760 bp, Bovine  19866880122763
ataattagggatgctgagcatcttgtcttatggtggttagggtattttttctttctttttcttttagttaggcatatgtggaaattttacgtttctattgtcatcttgcaagttgggcgtgtttgcaatttatttctctaatatttacctcaggatctttcttgaggcaagctgtcactgacaagcacccccgcccccttgtgaattggaggaccctttggttaagttgtagttacagaaaagttccacaaggtggcagcacttttgatgcttactctggttcctggggcaaacagcgcattagggaaagtcggcttccagggttgtgaaatagagtggaatgtacctcagcgaacatttaagggcttgtgtcgcactacttatttcccctaaagcatcacacacacacacacacccacagacggcttccagactaatcccaaccagagccacagcaccttgctgactacgcttcagtgcctagggagtctgcactctcagaaaggaggcttgagctgggaacttcagcatcagcagacgtggaggttaggtgactactgcccccaaggtctccaaggacttgatcccactcgggtctctggtcccagccagagcacagcggactatataggcttaaaaagggttcaacgaacaccctgccaggctgtctcaaaaacatagcagtctagcctggagacccaagcctgcgcaggctccaggatggatcacaccccaagtcagggagatgggagggaataaagcaggcactgcttttctttttctttaacatcatgccgatgctatgttggaggatagtacattcgcagtgttgtgcttgtcctcagcgtgcagccgccggattcaggtataatatattcatggtgtatctctattgcatttttgaactttttaccataggaggtcgagaagagtgccaagcaccaggtccttgtgaattatatatctcagatacacttttctgtgtacataaagaaaggaatttaggagataatttttgtggattatctcttagagatacagatttctgtctttagagatacagattgctgcctatatatggaagatagaaaggatggaaggggacagtcactgttgattatatattacaatacagatttcttgtgtatgtaggcatgctgctgctgctaagtcgcttcagtcgtgtcagactctgtgcgaccccagagatgacagcccaccaggctcttctgtccctgggattctccaggcaagaattggagtgggttgccatttccttctccagtgcaggaaagtgaaaagtgaaagtgaagtcgctcagtcgtgtctgactcttcatgaccccatggactgcagcctaccaggctcctccgtccatgggattttccaggcaagagtactgtagtggggtgccattgccttctctggaggaagatactgagcaaccagcaaaactgagaatgaactataaataacatgagcttccctggtgactcagtggtaaagccaatgaggagatgccaatgccccacatgccaattggcatgccccacatgccaatacaggagatgatacaggtttgatccctaggtcaggaagatctcctggagaaggaaatgtcaaacccactgcagtattcttgcctttgaaatcccatggacagaggagcctggtgggctacagtccacagggtcacaagagtcatgcctgacttagcagctaaacaacaacagcaagaacaatgtaaggttttaaattctaaaaactgttaccaacctttaccgtatacaaaaatgtagaatatggccatcatccaaacacaccttcaaaagctggtctaaaatcttgaacttaactggtctgagtcaaaggtaattgctgaaatattcattaaagatgttaatggcctctcctgtggactctggttcaataaaaccagtcaaggctagatatgtccaaaacaaatcagccccataccaccaaatactccttaaaattccctttttgaaagtcttatctccacctcccacagacctcctcagcccaaccagtttcagagaaatatgttccattccatacatctttatttgcaggtccttgagagaaattatgcatatgccggacacttttaagttgggagcgcaactagaaatagtttgaaactgcttattctggaatctccaaattgtaggcatgtgcaggggttagaatggtgctaagattgaggagagaaaggagacaaagcattagaaagacagagtttatttttaaagaattaagaacaactattctaagtatcctcctctgttgcttttgtttgaataaatgctgcaattaaggaagatgctatataacccagccttgaaaatccccaggtgctgcattaagcagacctgagtcccaagtctggcttcaacacttcctgtgtatattcttattcaagtgactcagtcccctaagtagcagctttcttagaggcaaaaatgtgggtattattaatacccacctcccagggttgtcacgaggattaaatcaagcagttcctcccctgcagttcttagaggtttgcatagaaatttgagaatgttgcattgctatgtggtcaggtcccagaacttcccaatttatgctttttaaaattataattaaaccccgtacttcctggtcatgcactggatatcagtgtttatattaatatatgggaattacatatcactttattagataagtagcatgccatctccttcttctgccccatca

SEQ ID NO: 38448 - DNA, 810 bp, Bovine  19866880275652
catgggattttccaggcaagagtactggagtggggttccattgccttctccgacatcactgtataaaggaccttgaaattctctgaaatcttaaggaaacctgatagttttctcaatatgacatcaatgctaaatatttacactaattttcaataatgagtaatgaagatgaatggacttttcaaaatgccaattaaaaaaaatagcactggagaaataaaactgaattaactttctactctatagaaaacaatataaaaataatatcatacaaaaatatcaaaagtatacagataaaatatagacaatattagagaggtctgttatgcaggttattaaaaaatatcatgtttttcttgcttttgtgaaatacacgtcagcatcagcattgtcagcagattaacattataattgttatggcttcaattttaaacaaagatttacttccgtgtctacatttgttcttgttatttctgtatccttttcttaagggtggggaggggggttccaaactttataagctacagacccaccaaacatggtctgccctggctagaaacttgtgtttttccctaaagcctctgttctcagctcttaaaatcaggacagaatcaacaaatatttagaagaatcacaagatgttctctaagaatcccttttcaacttgatttgctgtttctcttgagaaccatctgatagaaactctgacctttatttcttagaggcgacagaattactccagggagatctgctcctggtgaggattatggaatccacttttaacaagcaccccaggcattcacaggccaa

SEQ ID NO: 38449 - DNA, 1240 bp, Bovine  19866880279738
gtttttccgtggtctgtatggatgtgagagttggactataaagaaagctgagcactgaaaaattgatacttttgaactgtggtgttggagaagacttttgagagtcccttggactgcaaggagatccaaccagtccatcctaaaggagatcagtcctcggtgtgcattggaaggactgatgctaaagctgaaactccagtactttggccacctcatgcgaagagttgactcattggaaaagaccctgatgctgggagggattgggggcaggaggagaaggggacgacagaggatgagatggctggatggcatcaccgactcaatggacatgagtttgagtgaactccgggagttggcgttagatggggaggcctggcgtgctgtgattcatggggtggcaatgagttggacaggactgagcgactgaactgaactgaagtactctaatgtgtttttaaaattttataggtagtcattccaaaaataagcacacctttaaggtgatcatctcaacccacaggccaggatatgccgatggacagacacaagataggcattgtagagcatcagaagctctattatgaccattcaatctgggggtgacccagacatttcagcccaagtctccatgaggtgcatatcacgtccaaggctccggactacagtcagcctggtacgaactcaatgttgcaccaggtatatgaccttgagccaagtatttcctactttgggcttcagtttccccttctggacgtggctgtgcctgttgacatctagtaggaagcactgaatagggttgacaagttactaggattagcccaggaaccaaactcacttccctctgctccatgaccactcttcctggctctctgacctatgaatctttatggctcctgcatccctcctatttctttcactgagtcttgcaaagtcttattcattctgcctgtttctggtcagccctcattcacgcaataaacacataccaagcattgagctaggttggcaaactttttccgaaaaatgccagatggttcatgttttagggttggggagtcacacagtatctgttatgaactattcagctctgcttttatagtgaaaaagcagccatagacgatacataaaccatcagagaaggctatgttccagcaagactttatttgcaaaacaggtagagggacagatttggcttatgagctgtagttgaaggcaaatgagctagatgctgggcattaca

SEQ ID NO: 38450 - DNA, 2708 bp, Bovine  19866880493568
gatgttgaagctgaaactccgtactttggcccctcatgcaaagtagctgacttattggaaaagaccctgatgctgggaaagattgagggcaggagaagcggatgacagaggatgagatggttagatggcatcaccgactcaatggacaggagtttgggtaaactccaggagttggtgatggacagggaggcctggcttgctgtgattcatggggtcgcaaagagttggacacgactgagcaactaaactgaactgaactgaactgaagtttaacttatattccacctgccagaaacacaattgggatccaactattcttttataaacaactgagttttgcattatttattgtatctaatagctgaatgtttaaagcaaacctataatatctctgttgacatctgtttatatgtttatgtatatttgagaatctgcctgcaatgtaggaggcctgggttcagtccttgggttgggaagatctcctggagaagggaatggctacccactccagaattcttcatggaaaattccttgaacagaggagcctggcaggctgcagtccatggagactgacaggtggattatttaccatgagaactaccaggatagcccataagtaagacaaaagtttattagtaaacttttcaacaataattatgctttatgttatgtctacttaaaaatggtttacaaaatcttttaaaagcttgaaatcttaaatttacactgaaataagtgaccagtggagaaggcaatggcaacccactccagtactcttgcctggaatatcccatggatggaggagcctggtaggctgcagtccatggggtcactaagagtcggacacggctgagtgacttcactttcacttttcactttcacgcattggagaagacaatggcaacctactccagtgttcttgcctggaaaatcccagggacagaggagcctggtgggctgccgtctatggggttgcacagagtcagacacgactgaagtgacttagcagcaagtgaccagtgggtcagaagctcacataacaacctggtttttgacattgacatctgatatagaaggtagtcttgtggggctaagctcttaccatatggaatctaatgctatctccaagtagatagtgtcagaatagagttgaattgcaggacacttaactggtgttagataattacttggtggcatagagggaaaaacccacatattggtattggagtcagaatattatgacttattcgaaattgatgagaattgtagggtaactatacttgtccttttgagtctgcagtagagaaaaactacctcatattgacttaaaccacacctagagtcctttaatgggcccaaaagaaaggttaagcactgtcaagaaagagaaagccaagtcaagcagtgtatcttattcctgatgaatgcagggatgcagagccgactcaagtcactggggtatttcttatattctttctgtccaactactctcttaagaccccttcatggatcatagccttgtcatggtgaaaggacttgcataactatatgaagctatgagtcatgctgtgcagggccgtccaagacggacgactcatagtgaagagttctgatggaacatggtccactgcaggaggcaccgagacccactccagtattcttgcctagagaatcccatgaacagtatgaaaaggcaaaaagataggacatcagaagatgaaccccccctgcccccgccaaaggtcagaaggtgtccaatatgctactgggttatgatggttagatagcatcaccaactcaatggacatgagtttgagcaaagtccagtagaaagtggaggacagaggtgcctggtgtgctagagtccatggggtccgaaaaagtcagataagactcggctacttactgaacaacaaaaacagctctcttgagacagcttcaggtacaaatcagatgcaccaatgataagcacactggactgggattcaggaatctcatacttgctctacagctttgggcttctctttgagtgcctcttgggtcttgattttaatccaagtcagatgagtttaacaagacactatctacagtcctttctatctctgacatgctattgccttaggttttcaatggcccatctgcctggggaagggcatccatgtccttctatagctgacggtcccctccttctctgcccacatccctcaggaccatacctcatcttggcctcccaaagtggtatcaggcagccagacaatctcatttactcacaattatttccgtcaccaggacccagtatatccaatggcaatttaccacacatcgttaatatgtttgttatattttgttggcagaatatgaaagttcatcagtaagcccgcacacagggaaagcatattgaaatgagcattatggatctgtcaggctggagtttatggccttttctcagtactacactgtaagtaaaacaagccgtgattgagtcagcagcctcctgggtactcatttgccaaagtgtagggaattttaatgctaagtttatcttcctgcattaggcaggcagggtgagggtggggtgttgggcagattgcttcggcttaggggtattacagaccagcctgcaagttcaacagacaccaggagggaagctttcaggagatgtagtacccggagttttaaagctcagttgcaaatactccttttaaaac

SEQ ID NO: 38451 - DNA, 1434 bp, Bovine  19866880526881
atgtgcctccaaatctcaggctccattaatctggatcatgaaggctgaaaaggaaatttgccagattgggggaagagcatttgagggccgagaaaacagcctctgcaaattcatggagccacaaaaggcacgtccccagaaagaaaggggaaggccttcagaggaaggagactgaactgggaagggcagtggggctggtttataatgagccgtgaacgccaaggggagagttggtctttgcggtttctttagcctgggctggttggtgtgggcaagctacgtagccatggtggagcagtggggacgtgggtttctcccactgatcagatgtcttcactgtgttacgacattctccagtgtgttaatggtgactagttccgacacaggcagcccagctcattcttctgctcctttgttggactgaacactatctcatcattttgtgggtattgcctttatgcaaatgctcacctctgatatttactcacaaaaattagacagtcaaaatgttaccctgtaggcttactatggaactggaggactggctcatttctgaggtgccaggacatgttaagttttttaaaaataagcacagaaacaagcggcctactcacttcaagggcagagctgggtggtgcttcaaaaggtcttagctctaagcttctgttcacgacccagagcagtcactgtcagacatgaccagtctgcatctttgggtccagaaaaggagactgcagccctgagaagggaatggtctgccctggggcagagaactggtttgtgccaggaaggctgtgtgatctgggttctggatggatctagctgggcagatgatccgaatatgcttgataaacaattcagtggcacagataaactcctagactctggcagaataatgaaaggatgtggccttttctgaaaatcatgcttaatgaaaggaatggccagctccatagaggaagttcagtccttagcgccacaaggaaagacagattccaattcaaaatatggaaatactttctgtgaattagaaatgagagttgaatgatcttagtcagagagtccctgagagcttgctcatcattttattccccccacccccaaggaaaatcttctgactaaagagaacagtgtgtactcataggaatctagggacgtgtagcttaaaatgcattttaaaagcacaaaattcttttgaagtctcctgtcttatggcaaaatgccatacacacctttaaattaaatccaacaacatgtcccttttttgttttaatatagcctttgaaatacttattatccgtaaaattgatcgtgggtttacccctggaggtatagatactctaatcagagaagcagtatctgatatcatgtaataattatgatatcataacatctcagagttgaaagagattcacgaaatcaccgatctgaatt

SEQ ID NO: 38452 - DNA, 1920 bp, Bovine  19866880548699
gattgctgggtcatatggcagttctatttccagttttttaaggaatctccaaactgttctccatagtggctgtactagtttgcattcccaccaacagtgtaagagggttcccttttctccacaccctctccagcatttattgtttgtagactttttgacagcagccattctgactggtgtgaaatggtacctcatagtggttttgatttgcatttctctgttaatgagtgatgatcatcttttcatgtgcttgttagccatctgtatgtcttctttggagaaatgtctgtttagttccttggcccatttttttgattgggtcatttatttttctggaattgagctgcatgagctgcttgtatatttttgagattaattcattgtcatttgcttcatttgctattattttctcccattctgaaggcttgaggaaaggacattttagaatgaggggcacaattagaactggctcagatatatggtctttccaggtcatttagggcatagagtaaatgggggagagaggaaaatacagatgcaagagagactgaggccagtttaggaagaactggtttgataaacaggggtatggactctgtcctgcaggaaatgaggccaccggggaatgggctggttcccctcagctttcacaagataatcataggagccttgtaaacgatggtttagaagaggcaaaaggcaagaggtgagcaaacataaactaaaatcgtaggaatttataaggataagaaaagacatgttcatataattaagtatctaagatattttaacattctgtacagtggatatggtgattatctctactgcatcagtttcttgtaccgttaaattaattagtgcataaaagttgctgagagtagtatctgacacatatattagctaatatttatatgctgtaataacagtatttctgtgtatttttctatgcaccagtaccatttctatgtacttggccttgcagaagtgacacagaagactatgtaaacattcgtcctttggctggtggcagaaattattacagtaactagggtcccagctaacttagaacacacctaaatgccataacggtggcacacaaatacacacagtgctttgggggctgatctggaggagagagaatgatttagaatcgatcaggtagaatgcattttggtggggaagaggagcatttgcaaaggaactggatgaataggaatggcacaggcactttgagagagcaagatatggtatggcagggtatcaagttgagaacatggtctttgaaatctactggctgtgatcgaatcttggctgtgccctgtccaattttatgatttaggtcaactccctccctctaaatctcagtatcctcatcttgaaaattgtactgaaaattttatgtgtcttatgagaaatcatatgtatttcatctgtgataaaaaataaggtaagtgcgggtgaaatgcttagcatgggacctggtgccccttaagagaacaacacatattggtattatattttgcttattgttatgatcagacatctcagtgcagagcattacgagcatctgcccactgatttttcttcatttgaatgctaagtcttttaccctgtgtgcagggcaaatcctggcctgacatttgcattctgttgccctggtttcccctgcctttgcctcaatgtcaaagaaatctccctttcaaattaaagggagatttaatgttcttaagcatagctgccccctctcgtcttaagagtgtgtggcatttcaagtgcgatttgcagactttcagaatggaagatgctctaaagcattagctcctgtggcaatgagttggttgtctgttttccaaaccactgatgaatcagaacatctgcattatatgagggggatgttccaaaattgtactgttcacacaa

SEQ ID NO: 38453 - DNA, 2257 bp, Bovine  19866880554987
tgcccggagaatcccatggatggaggagcctgataggctgcagtccatggggtcgctaagagtcggacacgactgagcgacttcactttcacttttcactttcatgcattggagaaggaaatggcaacccactccagtgttcttgcctggagagtccctgggacggggaagcctggtgggctgccatatatggggtcgcacagagttggacacgactgaagcgacttagcagcagcagcagcacacttgagtgtagagattcttttgtttcttgctgacggaggatggtagagagaagacacatagctgtacctattatgctgttctatttcagtctactctgtaattcacttcctttttttggatcttattcttttgctaagtaccacccacctacttctgggagacaaggccaggtgaaagacatcttcagatgtctcaacttcctcatctgcttgtcactcactgggtactaatttggaaggctgtctctcaaagaaaactagagaaagtggtccctgaccctggaaaaatacctgttatgtatgggaagcttgtaaacttatgcatagagaggctaccctggtgatcaaaagtcagttagcgctggagacagaattagtagtggttactagaggacagtcttccagttgaaaagattttaatggtcagggttgcttgaagatgggaaggaggaccttggtagaattgaggaggcaatcactctccatcaccaaagggaatctacttatcatagtctgactgaaagggaatgtgagcaggtgagacagtggcttccatgacctttgatacccttggcagcccaaggttgaataatcacacctacgaggtctgctttcctgacgtttgtctgtctgaagagagcacctttctctgattttcttgcggagtctgtcgtacgagtggaggggctgagaatctgctcagcatccatgggacactcctgctgtgtccagggtgtttcctctaagtctcctctgtgggcccctcctcttccagatgtcaattaaatgctgcttttcctcccactcctgttgggttatcacactgacccccctgtcttcccttatccttcattccagcaagtcccaaatatctggtttcagatttcgtctctcctccaaactcaacaattcttttacgcaactgccaaacggacatttccgttggatttttctgtctcagaatcctcacttcccctcttctttacctatctgtttctcttcctgtgttctctgtctcaagtaatggcaccagcatcagtcagaggcccaagtgaggaggaaggttgggcagtattcttgagtctttcttcttcctaactcagtataataatagtaaaaataaggaaacagtagtaatttcatagtaactgctattatttgaacacttgccatatttcagactccacattacatggataataccacataatccttctgttaccctatgacttttgcctcatatcacgagtggaggaaattagtagcttgcccaagatagttactaagtggaggggctaggattcaggactccagaatctgtgttcttcatcttcttgatatcctgctttcatatctaatcactcaccattctccttctctctcaacttgtgtaagtcttccagttcatgtactttcccctattttagcttccttttttcctatcttatttcctgtgttcgtttacatattataaacacacagcatacctatgctttctacatattatcaagaagaactaatacgcaaggtttcctatcacacaagcacaaacacagacattttaaaagatgtgtccacttcaaactgtcaccgcgttgttaaccaacaatatgaaataaaaagttcaatttaaaaaaaaatttttaaagatatggaggaataaataagaatggttaattttttataaattattttggtttattacttaccagtacataattagcagttgtggaaagatgaacacgctaatgtcaaacattcttttcaattattctaaatttggggaaggaaattggcagatatggttgcttcatgatgattttttactttgtcctatgattgctggtgtactttctccaggaataggagaaatatcaactctgccattttcttctggtttgtgttatttgtcttatcttcaactggtaatttctttgcaggaatctgtcaaagcaaattggtcattttaggagggttgggcttaattgctgctgctgctgctgctgctaagt

SEQ ID NO: 38454 - DNA, 1154 bp, Bovine  19866880598468
taaagaatctgcctgcaatgcaggagacccaggttcaatccctggatcgggaagatcccctggagaaggaaatggtgacccactccagttttcttgcctggagaattccatggacaagaggggcctggtaggctacagtccatggggtcacaaagagttggacaggactgagcaactaacactttcagctcttcatatctgtaaaagctccatttctctattcaactttaagactcaatcttaagactcatcaaatttctggtatttttctaattaaaaaaatatatacatactttctctctctctctagttatctgtgatacttatcgctataaagttactatgaacaaggaattagggaatcctgaaccactgcctcctggggaaacacagggttaggttcctacaagactccagttacctttctatcaacttatcaatacataacctgcttcgatgatggtttctgtttaaagataccatatttaatacatactgatgattcattaacattgaactcacagccaagagcgctgtcactcaagcctgaataaagcttatctaacacatgggttttctccttaaggcacatcgcagctgtcctgtactcaggaaactagacagcacttcagcgctatgcgtggaggccatttttaactacaacataaagtgcagaaaccctgaaaacctcggtgctaagcagaccatgagtaggacgtttgtctgtaggatgagagctgcagcctcagctgggaatgtactccctgggagactcgctgctctgtgcacgttcacaaatgatccaaaaagtcgcaggggtactgacaggtaacaaatttcagcgagtgagtgaactcacaaatatgggctcacttataattaggatttaccatatacagatgttgtagcttgttcagttgctaaatcgtgtccaactctttgcaacatgccaggcttccctgtccttcactatctcctgaagtttgctcaagttcatgtccattgagttggtgatgccatccaagcatctcatccttctcctcccgccttcaatccttcccagcatcagggtctcttccaatgagtcggctctttgcatcaggcagccaaagcactggagattcagcttcagcatcagtccttccagtgaatat

SEQ ID NO: 38455 - DNA, 2237 bp, Bovine  19866880605390
aaaactctctctttctctgtctctctctctctatatatatactatatataaaacttatatataaaacatatatatatggtggcttctctctctctctctctctctctatatatatatatatatagtgacttctctctctatatatatatataaatatatatggtggcttccctgttagctcagatggtaaagcatctgcacatgctcagtcgctcagtcatgtccaactctttgcgaccccatagacagcagcccacctggctcctctgtccatgggattctccaggcaagaatactggagtgggttgccatttccttctccagtatacacacacacacacacacacacatatatgtgtgggcatataactatttgcatctagtttatttcttttgtccaatattatatacacacacacacacatatatatgagattaattgaaatgtctgtgtggaacattgggtctttcatcattatttctgtataatattcctttctgttaacatactataaccgtttattctgatgggtgctgtcaggggtgaacgaattttcttctacccttctaggtactaagatctagactgctctaggaattaaattgacatgagacagattaacaggataaaatcaagcaaaagcttaatagcatgcacacttgagagaggcccagaaaaactgagccagtcaccaaaatggaaaattattcttaattcttaggtttaaaaaaatactctcctgtaaattcctcaaaaattgccattgattccttttcacttttagatcagctgtctctgtggactttaattttgtgtaacatatgaggtaggagctcaagaattattttttctatgatgatatccaactggccctctatcctttattggcaagatcatatttcatccccaacactgtgataccaccaatacagtgaattagataaccatattcttgagtacatattatgttctgttgatcagcttatcttgaaaacaaaaaaacaccattattttgcatgtttgaagaaactgagtgggaaggggcgctggtagtgtttgatgatttctacaggaagccaagttgcaccatgccctaaagactggctttgaacactcctacagacagttgcagcttctgttattttaacattcttggaatgagatctgtttgaaagctccatgcaaatagctgcaatttcatttgccaaatgtgttaaaaatatgtattttcacatttttctgagaacacataggttaggttcatttttttcccgggcattattaggcataatcattttgttcagctatttcttggaaaccaaagctcaacttagtcacagagagtaacggtcagggctgtggcccttccagagagccgggttctaatctcagagctcctctggttcagtgggagataagtggtaaagtcctctaagagcttagtgccttatttccctcagagtaaaatgaaactaataaaaatttaattatatgtatatccccaagctaattaaagaaccaatcaataataccctcaaataattattgtaattgtaaaactgaaaaaatatgtgtgacagcgtattagaatgttagaaactcctttgcataaagatattattctggtgtgctgcttctctcctgggttatattttgttacgggtccataaagtctttaactaaaggtgatgtgctattaaagagtaataaagattgtgatgcagtgaaactgacaattgtcttcacttcatccataagtttcaaatgaattcattttagattttccaaacacagcctccttggcatctacagattccttctggcttcaggctgctcccctgtggggtgtaccaaacctgaagacatgattaaaatgattgttttcacatttgaatcttctttcctacctgtgattcgcttgtctctggccagagtcaaatttttgaattaggaaaatggaatttttctaatctatggatagaaggggaaaatggcatgagatttcatgtggacatttagcctccactctttccccatcacacatgcttttgcaggatgtctcaacttcttgaagcatttgcatttaactaaggagggggcttccctggtggttcacatggtaaagaatctgcctgcaatgcaggacgcctgggttcgatccctgcgttggaagatctcggagaaaggaatagcaactcactccagtattcggccggagaattccaggactagagga

SEQ ID NO: 38456 - DNA, 1198 bp, Bovine  19866880608558
atctctgactagtgatctcgcctgtcagagcctcagtatctcccccttaaagaggaacttagaatccttacctccctgacagatggcaagtatgatgctcacaagaggaagagggagtagatgtgcttggtaaaccctgcgtgcatgctgcatgcgtgccaagtcactttactcatgtctgactttgtgaccctgtggacggtcctctgtcaataggattctccaggcagaaatactggagtgggttaccatgccctcctccaagggatcttcctgacccagggattgaacccttgtctcttgtagctccttcaccgcaggcagattcttttactgctgagccgccggggaagcccaaagcctgcacctttgtgtaaatatgggccctattgttcctgttactggcacccaggaactggcttggattccttccactgctctgatggaagataagtgctttggtacctaatcactgcatatgaatagcctgatttcaaaatatcattttaggataacaaagtgaacggactgttagatgtcctatcttttagatgtccagaataaatgcacgagaacagttgacccagacaaattgaccgatgaaaggataacttgcgcttcaatataatgagttcaatattcttttgatttacaaaaaaaagcactggggcattcaggcctgggatgcttgtcagcaaaagggaaatgtaaactgtattgcatttcccttttgctgttccctgttctaacagcttcagctcaacctgcttctatttgtttttattttttttaattttgaccacactgcatggctcgcaggatcttagttccccaaccagggatcagacctgtaccccctgcagtggaagtgaggaatcttaaccactgggctgccagggaagtcctccaacctgcttttaaatgtagtggttgcagcagcagcagtagtaggtagcagtagcaggaggagtaagggcaagggaaagaggctcctagggagcaggggcttccaaagacagagtgttttaagggggagcctccttgccacgcaactctcccacccttgatgcttcaagctgaggcaaaatgaataagatgataggaattccaaaacagaactctccggctggagttcattccagaaaatagaataacgttgaacagcagcaaagcacacacagaaggaactaataaacta

SEQ ID NO: 38457 - DNA, 4000 bp, Bovine  19866880617820
tgtgttgaatgaaaattaaaatttgggtagaggagcgacagcagatgagattgctggatggcatcaccaactcaatggacatgagtttgggcaagctctgggaggtagtgaagcacagggaagcctggtgtgctgcaatccacggggtcgcaaagagtcagatatgactcagcaactgagcaacaacgaaagggtaactgaggatgaggaaagcgaggcagggcagggagaaaaggaggggggagtaagggatttagaaagcatattatttatctaatcctatataacaaatcacccctaaacttagtatcaatagcttacaatgacaaacatttattatctctggagggtcgctgatgtgacagatgactttcaataaatatttatctttgaactagttacagatattatgccaatacttggagaagtggttgtctttattcattataataatgacatgcctgacagtttaggaatatttatgtatgttatctaaatttgtcatcgtgacaatcttatgacataactgtcactctgtcgtgttaattaactcattaattatttatttaagcaaactatttattacccctgtacaacataccagaccctgtgcattcagaagcaaacaaatagataaaaatccctgccttcatggagcttatgtcaaatagggaaaagacagataataaatatagacacatatacggtaagattcacagtatgtcagagggtgatatgtgctgtcaggacaataggccaggaaggataaaggaggcacccaaacacagagtaattaactaacttcccagcactgtacagccagcaagagggtggaaatattccattctgaatctgaacttagagggtgtgttagtgaccacggcctgtatgtaatgagaacttcagagattctttagggcattttttcatggtagagtccaagcagtagttaggaaaaatcccaactcaaatgggaaattgctttacctaccaggaagcctggagttttcagtcctcaaaggctaaatactgtcttccctctaggaacaagatagctaccattttagcttcccatccagatgctccagcactcaacagaataaagagaacaacttggccaacaacctttcccagaaagcttgagaagacctccccttatcatccaaagcaggatcacatgatccccactgagcaccttcctagcaaggcaaggagtaccctctgtattctggatttactcctggagtgtaatagagttatcctctcctgtattatacaagggagcaagggtgatttggagaaaattcatcaataggaaaaacagagagtagggaatcgcaagcatttgctattgatatggaccaagcctccttcatggtccagagatcatagtgaacacacaaaagaaactttagaaatagctgttgattttaattacagtaagaaatagaaagggtttccctggtggctcaactggtaaagaatccgactgaaatacaggaaactgccagcaatgcaagagacctgagttcaatccccgggtcaggaagatctcctagagaaggaaacggcaagccattccaatattcttgtctgggaaaccccatggacagaggagcctggtggactgtagtccatgtggttgcaaagagtcagacacaactgagcacgaatgtacacacacaagaaatgtaaaacagacacaaagaaaagagaagagggaggaaaaagggtgggagaagcagaataatcctgatcctaatataaaggagagaagacgcccagcactctgagttgagagtgaaaagactctgttccccatcattgcccagccattcaacagctgtgtgacttgagctaatcacatagcttctctgtgacttagtttcaggaacagtgactctagtctaataatgctcattagtcacgtttcatgaacagcagaagatttagtaaaatgtctgtgttcagtgagaagaaagtgatatgtggcattccagttcaaagtgggtttggtctccatttacagatatagagtgggttgataatataatagagttagtcaagcagatgattcaaagaggacaacacacacacacagacacttgtattcatgtgtgcacacacacagtcacacgcacacacacctacaatcctttctcattaaggaaatactgttgtctattgttctttgagcaattattgtttgctaggctctagccaaattatatatgaccattttctcacttaatttcccaacaacccatgagttagttttctgtttgaattatctggaatagatttttcaaatttccacttcattttgcatatatgcactttctcttccccatgaaatggatgccatttcaatatatgactgtggtcttcgggttgtttctactaaatttaaacacaatcctgcaatcattttccttgcaccagtgagccatttcatcgtgctttgagctgatcagatcaaaactgttcaggaaaatttagtgccagcctattcctaaatgctgagctggctctggttctctcttgaccattctcctttttgctcatccagtcccaagaccgaactccgtgctcatccatcacttgtaacatgtccctctcagcaattgctcaacaaaaaccttgactgagaaatctcattgatgatcacaagctagcatttcacatcgcattcctcttcaaagcagtttgctcagatgatgtgaatatttgatatgagacagagaaacaaggtcagaaagagattctgagagaaggagtgatttggcaggcttcccatgaggactccaggagaaggaccaaggcaaggctgagagcatcaggcacagagtcaggagaggtgagaacttaccatggctctgccaatatcatgctgtgtgcctgtgggcaactcttaaatcttgcagcatcaattttccaatctgtacaaattggggaagagaactaagctgcgatgggaaagcaccagacctggcggccttcaggaggcacggggaatcaatcatggtactttccccactgagcctgtgatgcttcctctgttctcagcacacactccgggtaggctaaaacaactagagttggcatatcatttagaatatatctgtcacttttggttgaaataatctctaacatccattttggatctcatatttcaggaatatattgctgctgtggaaagaatcatgaactcaggatcagaagaccaggtttaaatcctggttctgacatttattacttctgtgaccttaagcaaatcaattcatatctttgatctgtgtgtgttttttttttttaatctgcaaaatgggaagaaaatatcaatgtcctatggtcgaagtgaagatcaaacaagatatatgagaaggcacccaaagcacacagcatatcctgggatattgtagacattcaatcagccattaaaattaatattttaaaggtggcatctggtgagacaaatgcatatgtgataaaattgctaagcatgctggaagccaagaggaaagtgaaggaggaagggagggtcgttcctatttggttatctcagcttttccctttttccatcactgctggtgatggatcctatagtcgtagccaaaatgctggcagcccacccaaatgtcatgtcctcgatcctgtctacaggctacttcttccccttcagctctagatagctggctcacaaatttaatttctcagtgacacatctaggaaccaccagtatctatctgatccctctctactttgtcccccaccccacaagcacccctccccacactcaaaggggtgatatctcattagtatcttaactcagtggggtacttggctttggcttatctatgttcagtcttaattgtgtgtgttggagggaacagtggcttgaggtcagggggatggtgctaggagcttcttgcttctgcatcaccagtacaaccctaggtgttcaggggcctcagtctccatttctaaagtttgtaattat

SEQ ID NO: 38458 - DNA, 2648 bp, Bovine  19866880728419
tttaaatccctggctccatctgggtgccagctacctgttacaggctgaattgtgttcacaattcagatcccagatcacagagctggaccttaatccaatatgactagtgtccttataggaagaggcgattaggacacagacagaaggaagatgttgtgaaggcccaggggaagacggacatctgcaagaccaggagagagggcccagaagaagccagccttggtcttgtggcctccagaattgtgggaaaataccttcatgtggtttaaaccacgcagcctgtgttactttgttgttgcagcccttgcagacttaacacactatttaacttctttgagggaattatacttaatatcttgtaatgacctgcagcagactgcaatctgaaaatatatacataactgaattactttattgtacagctgaaactaacacatgttgtaaatcaactatccttcaattttacaaaagggaggcaatggtacttaacctcagggtactgttattaagtttagatataatttatgtaaagcagatacaggtattttatgaatgatatctggaaggtgcagtgatggcagtaatagtaagcccacaggcctactgaagaggtaaactggaatgatgattttgatgtgaaatgtaaacttcaacctctggaatcaaactgcgtaactgtgaactcggctccaccactgactgtgtacacagtattgattattctcatcctaccaggtctcactttccagccctttcaatgtgactacctgaccaacttgtcaagaagaaggatgcttaatatcatggaacacttcttagtgtgtgttaggaagtgtcctaagcctattcgaatttgaatatccacacaaatctaatatttttctccccatttttataaagtaaggattctgcagcagagtgggaacttcctccaagtcacagagttcacaaaaggtggagtcaggaatcaaacttgcacagaaaagcagaaatgaaaaaaaaagtagaatattagctcattaaacatgatcttgtctgactttattgttcctttgcatgctttgttatcagtttcttattctaccctccagaagaatggtcactttcgtttcaggagtaggatcttaatcggcaagagttcggagacctgtccagttctgaacaccacacactggcagaagcacctcttaggaaccgccttctagacccaggccccttggggtagacgtcagcactgaaccctgagaccagagttctggctcctcccacaggcgtggggccatgtgactcggttatccagtacagtgcaggctacaattgcgtgtgttactattgggtccagagcatttaattgctagtgtgagatccttctgaactcaatttccctttgacatggtgaccagcaacagttatgaggctgcctgctccagtacctgaattccggagtgactgcaatgatcacaacaatctttcttactcaaaacagacatgcaggttaatgagatactcttgctgatggatgtcactgaagtttcagagttatgtgttactacagcataacttagcccaccctgactgatgcatccattaatcagttttaatcttctgctttttccctctggaaattttatcagtttgatcataccctcagtcccctttgcctcctttctactcttacactcactctcttcttacctttgactctctccatcccatacaattgctttctgcagtgctccttggggtggggtatatggccggggtgtctccctggggaagcctaaatataatctaagttaggtacaaactcacttggtctgcctccttccatttcaaattaggatgagagtgtggaaccagtcctaaatcctgctcatgaaaggcagacacttgagcctgatttttgaagacttaggtgcagtctgggtcactgcagctgaatcctgcacttcagacctcatcttcccagtgataaggttgtgtccatccatgactatatggagtatgtccatttaaaaaggacaagaggagctgatttgtccctaaagggccttgaaaatccattgcgctagcatgaaatgggtcaataaatgaaattaaggtcagagactttctctagagagacagtaaatggcatctgaagcatcctttatcctccgtccccacgatgctgctgcagatccaccagtaaagtactgatcagtagccagaggaaatgtcactgctgtctgggccccaggaaccatggccccttttcccaggaggaaatgggaggccacgaagaaatcttgcaagccagtctgtgtccagaacaggcaaggctatctgcttcagttcctaattctaaatttgaggtccaaatcctggggctatgatgatgatcataatgatcataactggggatttcgctagggtggaagtattttaagggcagggattagatcttgttcaggttatgtttcagtacccaaggcagtccatggcatataatatatgcttgcgatttttgatgatcggtggatatacaaatgtataacccagttgattctcaaggaaatcaaccctgaatattcactggaaggactgatgctgaggctgaagctcccatacttgggtcacctgatgcaaagagatgactcattagaaaa

SEQ ID NO: 38459 - DNA, 1833 bp, Bovine  19866880774774
cttttcttaatttgtaatgcgcccccctccacctttctcttctcgacacccattctgactagcacatggattccaagctcacagttacattctcaagtcccctttctgcctctcaagtgtgaagttcatcaactgaaagaataaatcaagtgtgactttccacccttttagtttcctaatcattttaaagcactgatttattttccaaaataatgaggacagtgcaatgttctaaaaggggaacaaaaagaaaaaaaatgacttacctggctttgagcactgaattcactttcacctaaaaaaaaattatatatatataatatatatatatatacacacatacatgtatcttacataaagaataatgtttgtaatagaaaaaatagttactagagataaaacaaggaaaataaaatatataagggtatatctggatacagatgcaattttatttcacagtctactggcagaaatagcctcctgaggtcagctgctctgaagcattctgttcccattctaataaagatccagtggcatttatgcagcaatgtgctgccaggtaattctgcggctgttgcttcatttctatagttccctgaagctggaataatgtcagcttctctacaaaccagaatctgggaaaggcagggcagccatgcatcgctcctctccaaatcatggcagagatcgccactgagaccccagggcagagcaggtcctgtgaaatgcacgggtttcccttcctccatccatctccaggagtcactctgtccagcttggagggtggcatatgttctgatccatgatttacttccctcacccaataaaggtctttgccaaatcacgggattaaatgtctgcatctatgttgaattatatcgtcattcattctttacctgtaaatttctctgttgaaatatgcaaatgttaaataacagtgagatggattataatagtgtttatcttccaagacccccggtgtgtctcacagcagaatatatttaaaagttgtctaaaaggccacccccttggctaaggcactgtccactctgtggacagtgttttactttttagactttttttttaaatgtagaccatgcttaaagtctttattcaacttgttacactactgcttctctttcgtgttttggttgttcgggccatgaagcacatagaatcttagctcattgactagggatccaagccacacgtcctccacaggaaggcgacgtcttaacactggaccacctgggaagtccctcactctgatagcattttaatgaacaaatatttgggacttttccatatatcttagaagttattgatttctaatgcaattccatttgatgagaggttgtattctgtaaggtatctatttttaagtattactgagatatacttaatagtctcaaatgctgtctatcttagaaaagttcgtatgctctagaatttctgggtgtcatgtggtataactgtcacttatgttagtgcagttgatagtgttggtcataaatatatccttacagattttcttttaattcatcaactattgaagaagagtgtttaaactttcattatgattatggatacatctatttttatttaattatgtgcttaatgtattttaaaatcttcaatgatgactctggatttatatcttttcccctttaaattctagaagttttgtttaatgtatttttaagctctgtttttagacatatatacacttaatgattcctttctcttcccaacaaattcaccccctttttttttttttttttttacagtttccagtgttattctttatactcctggccatcaattagaaacccc

SEQ ID NO: 38460 - DNA, 1581 bp, Bovine  19866880801283
aattagactttcaatcatcgggcagataattaaacattagaatccttggcctttctcctcgtgtttattagatgttcttcattaatcagacagggcactgatgggctctatcactgtcagctggtgcgaccccctggccagttttggaagcccttgttcctagtgtgaacaatttcactggggaggtatatcaacaccttcaaagttccttgtataggtctccctgacttagaaaccagtatctattctccaaataatcactgcagttcagttcagttcagtcgctcagtcatgtctgactctttgcagtagcctaagataaaaacatatgatttcgttcagagttgagttttagtcccagttttgccatttcaaacaatgtgaacatgagtgattcttctcccttgcatgcatctgttttcccttctctttaagacaaggggtttaaatcttagctcttcccaactttgagcttctaaggggtctgaatgattggggtcactgtctcgataggtgccacagtttggcttttatctaggagtaagagaggcaggacagccatgtgtcagcatagagaagtcagttcatgcatgatggcttttctcatctctctccttggtggatgagcaacatgaaacagtaagataagaagggccagtctcaggtatatgagctggggacctccatgcccaggttgttggaggggctcgccttgacacaaaatatctatgatgagcctgggaaggaaagccaactgcataatatgtctgccatattttagcaacaaaatatctaataatattcagacgcaaatcctgtggcacaggcattctcatctttgttttacagaaaataaataccagggctcagagatactaaacagcctaaaccttgtaaaatcactagcacgtggcactgccaagggtagaaggatgtaagtaaactctgcagtcacttggtccatcacctttcgccataatgggcttgagttttgaccctgcatctatccttggagggatttagaaggaagggctataattccctcttgtcctcaattcttccccaaatccaagatgaataagagtattattttctcccatatcatcaattgtttttataaagattaaattagatacaaggttgacaaaacctttgagggtttaaatgcttaacaatcaagcttagctcttgggagatatatcctaatatcacagtactatgatgtgaagatcaaggacccaccctctggagctggagcacctaggttagaaccctggcttgcccacttatgttcccatctgaaaaatgaggataataagagcaagtgcatgacagggttgcattgatatttataggaatatttatatttatatgcttggtataagaagagttgactcgttggggaagaccctgatgctgggagggattggggacaggaggagaagtggacaacagaggatgagatggctggatggcatcactgacttgatggacatgagtttgagtaaactccagcagttggtgatggacagggaggcctggcgtgctgcgattcatggggttgcaaaaagtcggacacga

SEQ ID NO: 38461 - DNA, 1819 bp, Bovine  19866880817438
ttggctaatttttatattaatactggaaagttgactatagtattaaatctttcctccatccaagccatgctattctcttcaggaatttttattttgtgttttccaataatactgtttaggattatatatatcttatttctttaatgttgaatttatttctaaaatttaaagttttgggctatttagattatttctcaatttcttttttcaactgaattttgctagaatagagataatatatttattttgtacatttattttatattcagtcaccaagcaaattctcttattattttcatgtgtcttctaccagaatgatggattatctctgtatataacattcaagaggagatggttaagtatcttcttttcaaattctttacaaaagtaatttaattctcctgtttttgaatatttgctagaacatctaaggcatttggaatattaatgtagatagcagttatttcttccagtgtcctgatattttttgtattaaatagtttttattcaatttgtacttaactatagtttttaagaatgggttttaaatttattaaatgcattttcacaatcttttgatggagtcagctaatttcccctttaatatggtgatgtagaaaattaggtatattttcaaatgaacctcatagtcaaagaataaaccctacgtggtaatgctttttgaaattttaaaaattattttctaattaatttcttctctatgcatttatttttctccttttgaaatttctatcctccgtgtactagatctcctatatgtcttacctgttacttataactgcattcttgatgttcattacttcatatattatcttcgtgctttgaaatacttgttttctatttgatctctgtccctgtcttcttccctccctcccttccactctctcttatctccttctctccttcttttttttttttattaattactagaaatatgaccctttgtagtattaaatcttcccatccactaaaaaccaacaggttttattttatatatttcaataggcttgtaaatggtttacaatcttaaaagactattgattacaatcttaaaagaatgcatatactctttaatgatgttttagttgtttagcgtgacctctttctcctttaactctgtattttgttcctgatcttcctctctatctagctgcaagccctgctgggtgtcttgttatggtcctttgactgctcccctggagcagtgccaaaacttttctgtcgagcttccaaaaaataacaccttgactgtagaagtctcatgagagattgaaggttcaggaggtagtccatgaaggccctgatgaagtagtagggtgtagtccctctattccctggtctcctgtctttgcacttcaaggtcctcctgcccatgaatcaggaggtggagcctgcctactgcaagccatgtgaacttccttctctgaagggtcacggttctttgttctgtttttttaaaatatttatttattcatttgactgtttcacatcttagctgcagcctgcaggatcttcaatcttggttgcagcatgtgggatctttagttgtggtatgtgaacacttagttggagcatgtaggatctagttccttgaccagggtttgaacccagaccacctgcatcgggattgtgggatctcagccactgggccactaaggaagttccaggtcatgaattttgataggtcaaccatttaccaggattctccactaatcactaggctttcttttgattgaaagggaaagctgttcttcatattcaatttcattaggatttcagcagaagctaagattttcaa

SEQ ID NO: 38462 - DNA, 1578 bp, Bovine  19866880829705
tttgggaagtgtttgcagagaattctgcatgatatctctggccaagttagcttgtttagtaacttaaaaaaaaaaaaaaaaaaaactgctgtccaagctgttagctagaattgaaagatacagtgatggttagagggcctatttagtaagagcagaaaaatgtactggaagtgaatcatttgtctggacacagaaggctgagtcagggagatggactgtcacgtaggcaggttgggctaaagccaagaacacggggcagtgattgctctgagggacaaattcaatccaggcagtaagactctctccatgcccccaacccactccctggttcagggtctttcaatgggtctctcagttaaaatccagggaggagagcactgactggcaagaatgaaaaaaggggaaatgccatcttgtcctccactgaattactaacagcattcttagtttcctatccagcaagcctcatatgacaggaagaaaaaaatattgattcaacatgagaaacaatacgttaaaactcatgactctcaaatgacagaatctttccctaggaagtaatgagttctccaaagctataagggttcaagaatgcaaaagataaaccatagtgagaagtttttcattaaacagacccctacagggataacttcaacccaacctcactccataattttatattttggattgaattgggagctattaatcaaacattgggttttccaggtggctcaatggtaaagaatgcccctgccaatgcaggagacatgggtttggtccttggatcgggaagatccctggaggaggaaatgacaacctactccagtattcttgcttggagaatcctatggacagaggagtctggcgggctacagtttgtggggtcacagagtcacacacccgaggaactgagtacatgtgcacgacacaatcaaacatgagctttcctagttgaaaaatgtgaagattgcagccaaaggcaaggtaaaaataacagtaaaaattaataaatagtttggaagaatctactatgtagtggacatgtcctaggtatgatgaaggatagagagttgcagtggttataggcgctgtcctccgagctcacagtgaaggtagggagagagactgtttttacatcattggattattcattatttttttccccacctgaaggcaaacacatttactggcaactcgatcccaagttctcttctagtctgtggtggtaaaacagtgaataaacttagccactggtctcaaagtggaggaaggttttggaggtcaagaactatttactggaggatatatactcaattaaggagaataggagtagaaaagaaccttctcacattcaacccacattatggcccagaagggagggacaggtaccctggtgcctttaagaatctgaaggacctccaatatctggggaagtgagggaagataagggataaagatagagaggtactcagggggtgaaccggagtgcttttataaacccatattaaagggtctgagattaatggagagttactgatagttttcaacagaggagtgacatcaccagagtaaagatca

SEQ ID NO: 38463 - DNA, 1368 bp, Bovine  19866880858668
gtggtacgtcctcagtgtttgtttagtcttcatattatgattcctgtccaagagctatttggataaaaatgaaaaggtcccaaacaaggtccttgaactcagatcactcccagggagcatatgatgcattgaaggtatgattatatcagtacttaaaggcatatgccaaaggaatggcctgacaagaacccaaaacatggcaattcagccacatctgttcttgaaagcgcctgcagaatgaactttttaagaggtatcatctgtcaagattcctcgactgtccctctggaagctgtctctctggaaacttattccaaaggcaagcccaaggacctcagcattccagtctttgataaataagcccctctctctgatagcctcagcaacagataaatctgtccacccaaggacattttccaagcgggacgggctgtttaaactccttaccagattgcagctggcacccgccacgttgatttttccctctccttataatcataatgggatctcagcaataaagatggatttgttaatttccatccccttctcactttctcttttaatcactgtcgagcataaattaatttcagcttaaagagctttcaacaagattccatcattgtctagggcagtaaaggtcaaaaaacaggagcctctgaaaatactcatcagctgtttgccaggaataaactttagttattgacacttaattatttctattttgtccaaggcaagctgaagtcagcaagagagacagaaagggaaggagagagggaggtgggaaggagagaaagagagagaagcacgctacccaatttgatcacccacctgctcaaatgttgagtgttatattttctcctgaatctttgatgaagcagactaaacttccaatatcaggcttgatattgtcagtctcctcagagtgaaatatagagtcaagtgttaggtcactagatttgtttaaatcccaattccgctacatatcagctgggctgggatgtctgggaaaaaaacatttaagttctggaattttaccagttaaaatgcactaattgtacccatcttgcagaatcatcctgtggaacatatgagagaaaggatgtaaaatactaactgcagagcctggaatggcataaatatccctcaaagtacagctacaattagaggtatttcctttgtaggtctggcacttgagagtctgctatgagtcacagactgtgatacagacagaaacatatgcaaacgcataggatcatgaagtaatgcttcttttattccccagcaaaactgaaggagggttaggaatgtagtatagaaaccttctcatgtgacctgcaaatgtacacaatattctatgctctttcgtgg

SEQ ID NO: 38464 - DNA, 1261 bp, Bovine  19866880885258
atgttaggggatgtcaggaagggagccagatctaaaagggacaaggggtgaagcggtggctgtgagatcacagaggccagagtgttggaaagatacagagaaagatgactcagattatttcatcaaataaaaaggagtaacagcatcccctctgtgaaccatcacagctggcttccacttaaaagtgatatgaatttaacaaacaattttgaggccgcactgagattgttaaatagagtattgtctatatgggcatgtattttccctgtgcatgtacacatttcaatcaagagataaatattagggagaaaaaagcttcaattaaaatattacaatgcatattgggtgatttcattaacatagtcgttgttctaaagtcttggaatacacctctctctcttctctttctctctcctccttctttcaagctttcacagctgtggttgtctctgactaaaactctatttcctgtcttctccaccagatgaattcctattcatgaccaaattcttctttgaacacgcttcactggggaagtattcctgactcctaaactaagaactggtttctttgtatgcactcccatctaaccagcacaggactgcttaatatccaggttgcaaactctaaagccagagtttacaattgattttacaaaagttcacatagtttacatttcactccactactttctggtattgggactttgtccacattaattcagttgtcccatctataaaacagaaatagtactaatacccacccttgcaaatgaggtattatttatttgagaattgaatgaggcaatttatttaacaagctgaaactaggcttcagcttttcattctcttcaaccagctttgttctcaaactgaaatagaatgaaaagaaactatgaacatctaagacaccaaactaagagactggactttagctagtaagttggagaactactgaaactttcaggaaggagagacagggtcagatacaagttttagaaaatagaaggaaaaaaaaaaaaaaaaagaatccaggatgagaggcaagtgttaaaacatgttcaatatagtcaaatgattcaattttaagcaatcacatttaatcaccattccccaaaactaagagctcatttaattttacaaatatttagggaatgttcactaatggtggggtgctgaactgtgggctgcaaattcaaagaggcagtttgctactacaaaataatctagtggttaagagctttggatttacaaccacgtag

SEQ ID NO: 38465 - DNA, 1093 bp, Bovine  19866880924136
ttatttctgttagaagcagcatccccataaaaactgaaatgtgccactgactctttgctgagatgggaatcactgtctctgagtctggaacaaactctaattgtgcaatggaagggtttgtctgctgtgacgagagatgtaagactctgcaagttccaaacgtgaggggaagacctcggctggctgctggtgggggtcattacagactgcactgaagcataaaagcagacccctattgcagcatcaccaggcagatcaaggacagagcagctcattaagcagtagctgaggcagctaaggcccacagtgacatgggctcatctgacctgatacttctcaggggggagcagagaaaggggagatctatcttgaccctaatgaagagatgctgaatagaaggggacaggcagcctccccaaacctccagctcccagcatctttaaggagtcagacttctacatactggcagatagctgcattccgatgactcaacagtgacacccagtgactctctctgtcaatcccagctgcctgttcccggaggatcttgaagagaatgcatttcagccttccttacctaacagggaagcagcaacagcaatcacatcagattcactcccgagtaagacaaacataataataaatcccagtctgcattaacataatcatctaactgttgaagcatatttctctcccctgctgggccatgtctgatgtcaaacataatagcagtgtgcagcacggtatcagcttgactttggagtcacatggaagagagtctttcatttacatctttgtccaaattcaaagggcccttgttttctgtcattttgaagcacacgcacctacatacacacactcatgcacaaacacacacacacacttgtctgggttcatggaaactttaataatggaaggaagaacccagagacaagaggtaacatatccatatcattctatactgagccacatgaatctggagatgagagagagagatgaacaatttggggtgtaaccggtaggaggtgaccagaatagccctggaattccaaactgtggcatatgaatactaaatgcaactggggacatttag

SEQ ID NO: 38466 - DNA, 3689 bp, Bovine  19866880929536
aaacctgacatggtcaatgtggaattggtcaaatgtggtcaaattaggaattgctagtttaaacaaagttgaagagatttatttaaggtagacctttataagatctttctatgtcaataagcattatattaataaaccttcagaaaagttgtgtaaggtttgatgtctctaaaagtatcaggcatagaatctgtgatagccagagctcttgacatcttgacaagtgatggagaccaactcaaaatgaagagagaaagagagaaagatgttcttttaactaaaaagtctctaggaaagcctatattaagaggatcaaaattagtcatcaaaagagggtccatgtttattcttgggttctgatgatagtttcatgtttttgttctttgagtagagaactgggtctttacccatctctgaattaaacagtgatggcagtaagatgggtacgatgctctgattagatgtgctccatccctgaagcttcagatgaaagcatttccacatcactcacgtggacttaagagtattaaaggagtgacttagggcgccattatcagaatggatacaagtaagttaaatgacatgatacatgccacagaatcatgccctctttggggcattgtggaaaatcaagtgggacaaagacacagcgttcttcgggaaatatgaatgagatggttatgaaaggggcctggccgtggtaggccctcatgaaatgtcagtcttctttccttttttgctctccttatgctcttttcatgtctgatgacactcaaggagcctctcaaatgagccagtcaaaccatgaggaagaatctgtgaatccctaaacatcgatccaagtatcgagtctgagaacctagctcaaatttccaagcacttgagaaattctttaacctcagtcatgagaccactcctatagaatgcctgactatattctactgggcattctttaattgaaggaaccaaaaatagctgtgtttccatataccacataccatacagcccatgagtcatacatatttattagtttaaatgccacaggaaagactttcacaactttttgctcaggccattattaagatgattttctccccattctctctgaagacattaatacttcaaggtggccttggcctgcttcctcttcctctcctccctccctgcgtgctttgggctccccctgtacctgcctcacttcctcggatgcctcttgtttcggtccctgcactccccttggccagtctctctctctggcttcagggaagcctctatttcctgacttcgtgatctttatttttgccactatgtgcctgcccttggacctttcggatgcctcacccttgaacctctttcctcactttaggccctgccatggtgttgcattcttaaatattgtcttctccaattgggaaccgtatgaccttttgtttgcagaaatcatatccatattcataagttgctaagcgtattttgtaagtcagaacacattgtgaaatacactaacccctcctgctgtttcagcttgcctaacagaggaagctacagtctcttgcaattttgttccaaggaataaaggcaatgtttggcaaatggaatgtactccagcccctgctggagggaaaatactgagaaatcacaccctggttaacctgctggggcttttgtctccccagcaatacctctgagtgtaggtaaatagtaataatgaaattgtacatacaagtacatttttcatctgtaggtttccctctctgtcccaaagcaccttagcttccggaatgaccatcaagcatccaaatctgttttttaagaaccaggcatgtcattcagccaacaaagaactgaaactaaattactgacttgtaataaaacaaaagaggagaggaagacaagtttttattgaacttctccttcaggtcagcacaggattaggtttgtagtcctactggagctttgaaatgatattattgaatatctaaatgtagatatagagacatgtaaatatagatatcttcttagctcagactgcgttaacaaaaataccatgtgctagctggcttaaacaacagaaattaattttgcacagttttggaggctggaaatccaagatacggtgccaggacagtcaggttgtggtgagagcccgcctcctggtgtacagatggctgttttctcgatgtgtcctccgtggggctcagtagtctctttcttcttatgaggagactaattccatcatgaaggtcccacccaaagatccccccaaagacactgcttcctaaggacatcacattgagagctagggctacaacatgtgaatttgggtgtacgtaaatatgcgtttagtctataagaatatgtttcagttctcatagaggtggaaaccaaggttccaacatagtccaggatcacacagtaggtgagtaaggtaaattttggagtccagtctgtctatctggttccaaatcctggtacatttaaatccatgggtcttttaaaaataaaagagagaggagaaagtaattcagactcttatgaagtcttacagtgatgaggagtttactttctctcaaggcaccctgctgttttcataatgtaggtagtaaagcagattgaggggcttccctggtggtccagtggttaagactccatgcttccactacacggggcacaggtttgatccctggttggggatataagaacccaaatgctgtgtggtgcagccaaaaaagaaaaaaaagcacagattgagaattatgcttgtctcatttttagactcgtctctggtcgcaaagagttgaacataactaagcgactaagcatgctgcactactgcgctactcccattaaacaagtttcccctctggagctcctcatccctaaataatggcatacggaggtgtggtctgttctgaacgatcaaagctctcacttgtgaagtggccccaatgtgccatgtgccagatacccagtaagctctcatctaaatcttccattggcatcaaaccattttttaaatgagggctcaaaaggtaaaatgaacccacctagcaattggaacccagaactggcctcaagcttgtagactcaacaaaaattccaagtaacagtttaaatatcctttccaggggagtgtagattcctcttacaatacggaaaagaactccagggatggtcttacacatgaaggtgaacagggaactctcagcccattgattttttgctataaacacagtccctcaaagtgaaagacacatgcaatctgcctccaaggtcaaatcctagttgcccctaaggtcgatcatggttgtggtccatttatctgattacgactcaaggctaaagagactgaggtttatgtgctgcgatttaaacctgcggttcccagggatctcaggtgtgttgcaggtgctgcactaattaagccctcccaccaactctctctgccttgctggctgtatgtcatttttgctagtgccccgcatgccaggcttatactgccactgagactgtgcactctggtaaaacctttcatcttcgtatctcaggctgcttttcaaacaataattaattaggcctcataaccccctgatgagattattatgtataaacacagtctcgtgcactgcccagggaattttgtcatcaggagttggaagtccaattcacacctccacacagacctcagg

SEQ ID NO: 38467 - DNA, 1811 bp, Bovine  19866881002090
cacatgccacctgggccaggccctactgatatctctggccagctgccagccctcagcccggtgtctgtagttcaatgcccccaacactacatgagctaatttgttgcaagtatataaaggtctctgagaaatccaagttcttcctggtaaggagggtgcactgaaggcagatgtctgatgagaggagcaggaagtttagagccaggaaatcacctgactaggttcagtcccagatcctgagccttcttccaggatgattttgggcaagctatgtgttcacttctagccattttgtctctttgtattaaaaaagaaaaagaaaaaaaaaaaaaaagagcttcccaatacacccttcagatctcacgaaattttattttttaatgtgaattgaccaagtcaaacttcgcaatcaatgaggtgactgatgtcacatcagatagcccttgtggccattatttgaatcagggcacttgaaaccctctcaacctccctctcctgccagcaaagatgaaagtgtcatttctgacctccgcactggcctttgccttgaactttgccgtgcctttcatattaccatttccagctggttctttgccccctggtgagaccagacttttctgaaagagtgtaaacttctctgaatgatatttgaaaataaaatataattgatttcacagctccttgaacctgtcctatcaagaattgattttttttttttctctcttctgttttacacacttgaaagcgatttgagtgatgacaggtaaaaaatccaatacataaatgttcttcatcctttctccttttctttttaaattcttccttgcaataacagtgcatttgggtatgtgtgcaagtccatgtgtttgtacaagtgtcctttcacatacattcgtatctgtatttgcctgtgtttatgaattcagcctgcatgcactgcacacgtgcatttgtacgtcaatgtctgtgtgcacctacatgtgtagaaaatgcatttatgcatttgtgtttttcatgtgttcatcctaatgcaagtttgcataactgcgtttataagcgtgcatattagcatgaatgttttgaatgcacatatatctgtgtgcttgtggtctgtgcaaagttaacccatatatgaataggcaggtttgtgtctagttgcttgcatgagtgtgcttatccctctgaatgagtgtacatgtgcctatgtagttagattggcatttcaaagcacacctggccttgctgttcatccacctctccctcgaaaagaatacacgaaactcaacttttcttggatgctccagacagcttctgctgatttggatagtcattatgaaccatggaatgctctcctctgccagccccgtatgagttgtcacttcctcaggcaggataaagtcacccaactggactgtgtcctaattatctggcaagagaaggaggtgtggcagatgctgcaatggacctgggaacccctctgcctacagcagcccctggtctccgttggctcccgggaagccacccctggagcctgggctgccctactgtctgagtgccacaagggctggtggaacgtgctgcggattgaaatgttggtgtggcagcagatgtcagtgccagacaggcccagcacacctgttttccacccctagcctgcatagacgggtgtgagcggcagatctgcgcttcctgtcagtcagcctgtatactctgagctggcagcgccgccgggctggtcagtttgtgacagtgatgcttgggagcggagaaactgggctcttgtccaaggaggcctttggcttccttcagca

SEQ ID NO: 38468 - DNA, 718 bp, Bovine  19866881002170
atgactgtggaagaaacacagcaggaaaagatgggaaatggacctgagaatgagcagaacaactgtgagcaaagcctgcaagatgccttttctctttgcaggaggcgcatccattccgtgatcaaacaggaagtacacagtcaggtgcggagaggaaacctggtgtttgtctttgtactggagacaggccccgaggccgctgcctgatcctggggccagggctggcagctgaaggctccggtatcctttctgtgagcacaactgctttgtgcagcgatcaaaggccctcccatcccacatcccacgcttcagtcacatgcccctggagagagagcttccccctcttctttcagtcacttgtgtttcctagcaaaccaggagcagttgagcctggcggttgagatccatcctgccacaatttgttgttgacattgttctcagttttacgttccctgatttaacaactactggctttcatttttttttaaaggagggatgaacaggggctctgtgttgataaggaggaagatttgagcccccgtattttctaactgcactgtcataggccagttacttaacttcttggtgcatcagttcttatagccccagagtttgaattgtaatacccatctcttaagattttcctgatggatatacaagattgtgtatgcttttgcaaacacagtttaaagcccatcctctgctcaacacacgggat

SEQ ID NO: 38469 - DNA, 1868 bp, Bovine  19866881037705
gtggtcctgatgactaatgacatggagtttttgtgcttattgccttttgaatatcctctttttgacctgcccagtcatatcatcattatcagttgcctacttccccttttggtcattttttgggggtaggggagacatatcacatttattaaacagtttagtgagaactttgtgaagaaaaatgtaaatcgtgataattgcatctcctctggtttaaagagactcagaaaggagtggcagactcaggcagtatgaactgccttctagcccagcatccagccagcgtaggagttatttatggactataaatacagtctgtgattgggtagaggtaatgcaaatatattttctaactcaggcttgtctttccactctttgaatggtatcttttgatggatatgttttaatcttaatatagccctattaatcaggtgtgttttttccccctttatggtgagctgtgttaagaaatctttacctactccaatctcgtaatgatgcccctctctgttttcttctaaaaggtgctttagagatgctaatattgtattacttttcacatttagacctataatccctctgttaatgaaactggggtatagaagagattgtgtcaagaagagattttgaggttgctgttttaatatcaatattcaatggatccagcaacaattcttgaattctttccctggaattttaaagctgtacttatttcaaaaggaccattttctttgtgagctcaagaggaacacaacagtttgttttcgtgagagacagtgtgcgcctactctatgtcaggagctttgcatccattatcttatctgatctttaagacaatcccacaagtaatgtattattcttccattctgtagttgagaaaactgaaacttaggaaggacaagcgattagctgaaggttaagtaacgagcagcagagctgggattccataccccatcttttctgactccagagccacatctagctctttcttcaagcttcatggtgacagcattcattagaaccgtggaaggtgagtgaccagtgagattaggacattaagctataatcaactgggctgttctagtaaccaaaaggagtatttttacctggaacatttatgaaacacagttattctttgccctcagtaataataacggttaatggtcaatcatagcgccctttcactgcaaacctcccaggagttttgtgtgtctgattcttgttctgaagattaaatgtaaggtaggtattacctctcccgtttgacagataaagaaactgaggatcaaagaggtgaagtgagttatccaaggtcaaatgtccacagcaaaatagtggtagagcaggcccagcatttcctcggccgagtccccctccctgcctggatcgctgacctcgagggccacctctgtacttcaggatgcagccccttagccctgaccagctgcttctaccatccctgcctttcggtctgtgtctgcctttctgcctgcccactgcccaggaagagtaagtcgctcttgcagctctccacctgggagcttcctgctactctagcctctctgtcagccctaaggaggcttctggatccttccttcacttgccttcagcacagccatgccccaaagcagaaagccaaatttgaaaatgttacctgtcacctctttccagacacaaaactgtaactgccaaagctgtttcgtaatccttcccagttaaacttctgacaatctgattttaaagactgtcagatttttgcattgctgatcttcctctcctgccttctgccctcagcttctgccctccccccaaaagacctattgccttcacggcacaacaccaaaccagaaaacatctgcatcgtgggg

SEQ ID NO: 38470 - DNA, 1120 bp, Bovine  19866881047297
tggttctatctgaatgatgagacattgacctagttttcattctcttttattttcttacataggtatgcttttttaaattttctctaataaacatgtattaccgtttcattaaagagaagtaaacaatttttcaaatagaaaatgtagcagaagaatagacaatttcaggacccagctaaggattcatctatcacggggtgccttcccacatctctatgttgtaattattatttctttccctaaattcttctgctacaagtgtttagaccttcttgctatacgtaagactccttccctaggctgaaggctctgtgatggctggatctatgttttatctaactgagaaagcctatagctccacaagcagtggaaggaacatgtatgcacaaagactgctgctggttaacctgaattaaatgacctgtttgaggttaagtttaaatgaagattaccagagtactgatgacataacagtagatataggccttgttaactttggaaattgcccattgatggtgaaacaaacaaacaaaaaaaaaccaaaataaacagaaaccctctacactgacacatttttttagtttctgctgaaagtggctccatttgaatgcatgctcagagggacaggtgagactgtgaaacacatgtgctggaaggcacttgaaaaggctctctctaccttgaacagggacaaagacacggcacagcaaaaatcagatttccgtaaggagtttcactatggagaaaatcctgagtcctccatcattccaagccttggacaagccctgagtttttaataaagagcctagtaatcttgtacctgctcgctttcttgcttttttgagggagtaaaagctgcgaggtgaggcctggcagttttgtgcttctctaggacttgttaaatttctctctccttcttcttctacctcttgaagtcttaagcgctgatgctttatgttccagcttgtaaatgaagcctgttattatcattgagatagtgtttttatggcataaataatgagctcaaacaggggaagcagcgttgggtggaattactgcttgagctgagatgaaaataatcaatatgtcctcacttacaaatctcatctgcatgtcaact

SEQ ID NO: 38471 - DNA, 1190 bp, Bovine  19866881085781
cgttcggaattgaaactgcttctgcaatattttttagaaaacagattgtgggtggtggtaattctagcaggtttcttggcttagtggcacttttttctctgggagtggagtacattgttataaaagaaatggggaccaatgagcaccccgacctccctaattatactgttgaaagagttaaccttgacagagcacttcccaggaccctccactaggctgtatccttgaccttccagatattgttatattcttacaaaccccctccaggggcatattttccagcctctctttcacagaggaggaaactgagatttgcaggatttaaattaaaaagtagtttaaaatcacaaagctagcaaatggcggagtcaatattcccacccagcccatcagacttaagaatctactgtctcatacagtgtttattggatccaaattttataatttaataactttttaaagaaataaatttgatagtattatgcgttgattttagaaaatcaggaaaaattctgaaaactgtaaatcactcacttgtcctcttaacaagaatttggttcccgctgataaaagtagcacagtatattagcacagaaatttacagctttctccttattatttcaggtgctaaacatttgatccttataaaaagtgtggctttcttgcactaggtcagacgtggctcaggaaatttgctcatgcctcagttttgcgtgcttctcttctgggctgtcacatgacagattcctttacttttttcatttctctgtttcaacatccatcttgtcagaggcctttccaggttgtaacataagctctgtgagaccaggggctttggtttctactatattgctatgatggaacctggtatagtttctggcacatagtaggcactcaataatatttgctgaataggagcaatattgggtaaaaaaaaattatgtttcccattcagaaggaagggactgtaaaatgattcaggtgagaaggcttacttacggctagtaaatagcagaatagggcttggtgccaattctcctaattcttaaccacacgctttctcccacttagctcagctctgactctaacgtaattggctctgagcacagggccagcacggctgtgcataaagccacatcagtgtagcacacccagtaaatggatctgagtccggtacttaagggggaaaa

SEQ ID NO: 38472 - DNA, 1287 bp, Bovine  19866881204088
gatgtaagagcctttcatcacttcgttgtcattgcctagcactatctgggcatatattatgtgcttaacaaacggtcagcattttatgtgcggatgaagggataaatacgaaagtggtccggctctacagtgtttgttgaatgacacatctgccttaactactagactgaaatcttcctgtgagaagattcaggatcattaaaattaatctctgggttccacatgcctagatttaagctgagttcaggataagaaactcatatctgctccttcccatgaagcctttgccagttatacaggagagcatgaccgtccatcctttggatctgcagcaacctgaacagacttggcttaaagatgactttatactcaacaattggagaaggaaatggcaacccactccagtattcttgcctagagaatcccagggacaggggagcctggtgggctgccgtctatggggtcgcacagagtcggacacgactgaagcgacttagcagtagcaatactcaacaattagatgttgagttccagagggtgagtggtggcctgaggcaagaaggactctatctgatttttctttgtaatgttcccagtgcttctcccaggtcaaatgaagagccaaagttcagttaccatttgatgggtagatggatggatggatggggagacagatgattaaatggatagatgaacagatagatgagtggagaggtaaatgattaaataagtgaatataagctagaagttagagccaggaggcagaggaaataaatattacacgtgtcagctcaggctctctaaggggcctgtgaaagagaaggcgaaatagcccaggtccctcaggactgagaactggaagaagcaaaccttagatcaagaggggttaatgggcttcttgctgcattattaagacttaatttcttgtttattaagagaacattctgtttagagttgctttcccatttgggcattcctgcaaattgcctcttcacccctcatagccctttcctcagtctttctgtcctctggggggttttgtctcactctctgcagcacttctttcgggggggaacaaagtgggacatgcagaggatgggcgatgaggggaaaaatccatcatcttaccttctgagtcactaggggacactgtttccagaaaagggaagggcatgtctggacttcaggtctctggggtatccctcagcctttccttctgaaaagcctttcctcagcctttccccagcaacttagttcacagtcttcctcttagccaaggggagctct

SEQ ID NO: 38473 - DNA, 980 bp, Bovine  19866881214038
tctttactgctgagtcgccaggggagcccccaaccaataccaataatgatcccaagaccaccaagggccatgatttgttaggggccaaacacccgaaaacaagcactgtcaatgcatcattttctataaccttcaaagtatgcgtgaatagcagtgttatttctatttacacaagaggaaaccaaggctgagagtatagagtaaactgtcaaggtgacacaaaacttgtgagaaccaggagatcaaacaccagagtccgcccttctagaccctacgatctacagcccccttctctgccatcgcatgaggacactcttaagaaagacttttctatgaatgaatgaatgaagtgatgatgtgagaaggacctcacatggctgctgatgctgtgtccatcaacagtaaatcctcccgcctccccgctccccactccgcccgctgaggatggaggaagcatttagggcttgctgtccaatcctggaactcagtccaatgctctgcatattttaaaatgttgtgctgtaaaaacaggagaggaacaaggctctgtgaataattcaccacctcgcctcagagaaattaaaaatatatttcactgcaaaagaaaagtcgttgttatttgggacttccggggacttggacagaacacagttcctaatggaagaactgcattgatcctagtaactatttttttttttttttcccaagtgaaatgggaggtgggggaagtttaaagaaaagagtacatgttaatgccacactcaatgtagaagtgatttcattttcattttatgatagagcagaatttatatgacatgatttaacattcatcagttaaccaatacacgctggctgattgattgttggattgggcgggttggcaggtcagtgagctggttaaagagatgacagatgttgggtcaaaaaataatgcaaggtttgtggatggaaaaccctaagttaaaatgttaattttgtca

SEQ ID NO: 38474 - DNA, 714 bp, Bovine  19866881230021
cagaggtatatgaaaaaagactttttagaagggaaagcattcagctaggtcttgaagactgcttaggagcttaactgatggcagaaacgtaagtaaaccataaaatgtgtttcgaggaaatgagggccttcctggtggctcattgataaagaacctgcctgccagtgctggagatatgggtttgattcctgggttaggaaggttccttggagaaggaaatggcaacccattcctgtattcttgcctgggaaatcccatggacagaggagcctgatgggctacagtccatggggtcacaaagagttggacacaacagagcaacagcagcaactagggaatggggacacactcagaaccaccaacacgaaggtacaggagaaggaggtggtggcgacagttgtagtttggggatggatgatggagggaccttgagtgccaagccaaggagcccagccaactccgcttacactgattccctgagtgtagaaatgagacaggctaccaataggtcaggaattacacacagttctcattgctcactgcctttcatgcctggcctggcggagatacttctccttataggggatgttttattctgtttttaagagctcttcatttgtcacttgggacaggaagttggagctggttgcagtcggcaatccatcagcctgcctttgcggaagaactaccaggaaaggagtcttcctccaccgt

SEQ ID NO: 38475 - DNA, 3427 bp, Bovine  19866881232490
acaagcagaggcgatgacaatcctgttaatgtgtgccccttgctgggcctgtattgtctaagcaaacacaccgtcagccatctcacctgaagctcactaagaacctggaattttgcaactatcagacttgtttcatgagacctgttatccctttgtgcacgtatgctaagtcgcttcagttgtgcccaactctttgtaaccccatggactgcagcccaccagactcctctgcccattggattctccaggcaagaatactggagtgggctaccatgccctcctccaggagatcttcctgacccagggattgaacccacgtctcttaggtctcctgcaacagtgggctggttcttcaccactatcactgcctggaaagtgccattatccctttggacagatatttttattcaagaactggtttaagattcagttctcgggttggtggagcagtttgcctgacttccactttgtttttcatcatctatgtaaatgcattacgtgggctaataagactttagatgtggtatttacataactggctaggatgagttgcagatattttcttccacctgtgtaaaatgtaaatgcatacacatgtcctaagatgatctcttcccagcactttcattcattttcaagtggggagtgggctaggaatgggaaatatgagagaacagattctgtgtatattttctcacagagcttaagtcgtctctgcttgcagcagttttctatgatcatcatacatttcctgccctatggaaataaacatcatttctcctaggtcgatagcacttcttaaggttcatctgtgaagatgcattgtatcattggtaatgacatgcatgccaattctttactagatttaaagtcctttgagggcaaagagctgactgccaccttctcctacctccttttccttatctcaagccttgcacagcagatgggctcaatgatgataactatattcaccttattcacaccttgcaatgttctattaatttgacttgtatcctccccttgctttgctcaacatgcagcagccatatttgcttcctagaccagggagggagggatgtaagagggtgaaagaaattaatattaccaatcttctaggcctagtgaaccatgcaaaatgcttgcagtcaaactatttcttggcacaagtgtaacaggatgatgcaaacaagctctggaacctcactgcctgggtttgaatgggaatccgagctgtgtggccctgtaacattacttaacctgtctgtaccttactcctctcacctgtaaaatgaggacaataatattgtctctttcgtaaatagctaaaagtgttaaagaaaatgaaccacttaaactgcttgaaattggtgctggacatattagaacagacacacacacacacacatacacacaaaataagtatcagctagtgttactttgtcccgatgcaatgttgggagttaattgtttacatatgaataccatttacaaataatggaagcaaaactcagatacctcaaggaatacagttaataagtggtaggaaccagtgtttgcactcagttctagaggctgataagaagtatgatgcaaaaagaataaccgcatgatttgccgaatgctgtgtgtgcccagccgcgtgctaaaagctctgcagacaccatctcagttaagctgcaacaacaaaatgaggaaatttctaatcactggccagattttacagatgatgacctcctgcctcagagagacacacgccatgaagttagcggcggagtgaggaactaaagccagtgtgcctgatcccaaagcacacgtacactactaaggggtcggaagtgcatctcctctgaaaggccaggggctcacatacgtagctcggcagcagtggggtggaggaggagctggtgaaggaatgaatgtaaacagcattttgaaggagagtcatttataagcgagattatggagtctgtttgaagattccccccgaggacacgttaaaaagatggctcacatgcaacctaacgggaggttagatgaaacgcaccgggctgtgtggaggcgggatgcacacggaaaattaaatccacgttggaaatgttaataaatgcatacacatgttcttgtctgtaatgtgctccttgtttctctcattttctccgtgttggaaccgtgagggcatctttgctggatctccagggactggctttttccctttggttgttgtgctcgctctctctccttccccgctccaccatcatgccctctaagtgtgatttcatagcttgagatattcaggacccagaagtgtgactatgcacaaagaatgaagaaggaggagagatgactctctcggggcttccagaccatgcatcacacggtagccatagtgatgtgaaaaccaaaagcatctcatcactccctcacttagagacttctcagggcttcctttggggcttcatgcaatgaagtcagacacttatgcaggatctttaagtctccaggtgtactggccactctccagacccctggccattgtgacttttcatgctctcatgctcttttccactggagacctccttcattcattcttcatatctaattcgagcataatctttttttagtgaagccttccctctaataccccagggaacaggggccctgggctcttagttgctctttcacgtcacccctttctgtccattaatactcccaataacaaacaggtcaccattttattgaatgcttaacatataaagaactaggctaaatatcttacatgagctttctaacttaattaacttttcaagttaatttctaactttctaactcagactcattttatcccaatctaaagatgagaactctgagactctgagacatttacaaaatgtcttagtatgtgccaaaaggtggcagagctagaattaatgccctgatccttttggcttcaacacctgtacaattaacaactatccttgaccatcattttacgttcatggataatggatgctcacataagtagagtcactttactattctctctctctgtgtgcatgctcagtcatgtctgattctttgcaaccccatggactgtagccagccaggctactctgtccatggaatttcccaggcaagaatactggagcaggttgccgtttccttctccaagtgatcttcctgacccagggatcgaactcacatctcttgcagctcctgaattgcaggcagattctttacccattgagctatttggaaacactaggcttgggtatatttaaaggcggacatatttgcttagtcttctgaagaaggtaggatagtgtagtggagaaagcacttattctagagttcagttcagttgctcagttatgtctgactctttgtgaccccgtggactgcagcacgccaggctgccctgtccatcacc

SEQ ID NO: 38476 - DNA, 1761 bp, Bovine  19866881352907
gaaccttgcaccatcctaggactatcttggctccttgtcacatgtccttcccctttacccttctacctgcaggctccccactctcccatcctctgcagatcttccctcctcggcttcttccttctctttgttctctgtttaccccacaccctctctcaccttctcatcccattctttcctgccctcctctcctctcttccacaccttcaggtagtgaaagaccacagtcttgagggaattgcctcaacttcaaacgcgaattcggatgcagaaacgtctgcgctgatgtgggatggcgtctgggaagaacctacatctggagaggtaacagtagacacaagcgccttggaaataaacactggctgttaccacaatcgccattgttttcctcaccaacaccaacataaacagcaacaacaggacttccctggtggtctggtggttaagagtcagccttgcaatgctgggaatgtgcattcagtctctgctcagggaactaagagcccacacgctgtggaggaactaagctcgtgcaccgcaactagagagcccgtgggtcacagtaaaagattcctcatgcggcaactaagatcgggcatggccaaataagtattttaaagacccaggaatgacaaaatgttagtctttctccaactttcctatcttttcatttctgcagttcgtcttctgaccctcggtttctcctgggtgagtgaagtcgctgtcctattctatgttgtcataacgcgtgagaatccctctcggagttctcatctcaccggctcatagtggtctgcttgagcacccttctgtcgtctcccctcggagcagggcactggcttgttcagtgctctgtctttagggccagggacggtgccagagtgcagtaggcacgagggccaggactgagcagggcccagatggaaacatttcaggagacactctctctgagattcctgccccggtaacaggtactcagtaaaaacacactgaatggctttatgggttagttcgttccatcttcccttcccttacgttctctcaatcacaaagtcattcccttgctctgtctttctcctctctcctgctcctccattaactcccgtttttcacccatggttttcgctgccaggtcctgtccctttaacagccccgagatctccctcctctatccctccttcattccccaccccaggcaccttcccttggaccctccccagcccttgctctgtctgcttgcttgaagctggcaaactttcttatctctgcctcttcttttattgatttctatgtggttagtttgtccatagagggaaaggatttctttgatactccaaaggatcagactgggcacaaaagccatggacaagttttgtttgatgtggacaattttattcccattcaattccctgggttttcaaacagttgtagatctctgaactcaaaacatctgaaccagctcatccccccctctcctgtaagtgcacaggcattttctaagtctttaacaaccagtcctgtatctcagtgaacagaggtcacctcattagtagggccctgaattcatcctggaagataaaactgttaaattacgaacagatctaggcacaagtttttaaataaaagtgaaaggtacaagctaaaatctaaactacttccttcttcctgtcacatgttggttgcgccctgaactttctaaggtcaggctctttttgaacacttacatctaccatatgagccacttttaccattagctgcaca

SEQ ID NO: 38477 - DNA, 906 bp, Bovine  19866881358305
aaaaaaaataataaagaaaataaccaaaatctaaaaacaaaagaattttacaattttggcacaagagagctgagtgagacttcgggataatctagtggattccagcattttatggatgtctgtgcagaaactgagtcagtaatgtcttcaaagtcacacacctaggcaggttagtgcaaatgagaaatcaaaatctgaaaagagaaccatgggggatgggaagaagggaagaggaaagacaaagtcaccagggtgatgagagagaagaaagagcaagccattaaaacatctaagcgcagtgggaatgacatgtattgaatctaccctgtcagcagagcgagcagagcgcagtatccaccctgataaatgccaggttcccttgctgacacttgataaaggttccacccagcagcacagcggcagccagaacagggtgatggtgccgcccgctggtttaacccctgctgctctccagcatgtggcacagagttggtgctaaatgaatgtggagtaatgaccaaattagtgaggtcaactccttaagcatttccgtcatcaatgcacacacacctagcattgctgtgtgctttgtgtttggttgtctagctaactatgagtgaacacctttgttccccttctttttacatcattttgtgtctgtgctactaaaaaaggtgcagtctcaggtgttcatgtcataccgtgtgtggccgtccttgtctgccctcagtcgtgtctgactctctgcaaacccaaggaccatagcccaccaggctcctctgtccataggattttccaggcaagaatactggagtgggttgccacttcctcctccaaggaatcttcctgacccacgtccccctgcttctcctgtattgcatgagggttcattatttgctgagccat

SEQ ID NO: 38478 - DNA, 902 bp, Bovine  19866881466847
gtacacaataaatgctcgtgctttctgtgctctaatagaggcatttttattctttttgagagacgaagtaccttccgaactggtgtttcccctcctaggtttctccctgcaactaattcccttaaggtcaagcagtaaaaacggatcctggagaaataaagtccaaagctattgcaaaggaaagagcttcagtcaaccttagcattaaactcctaataaaggagtctgcctcataaaggagtcgccttgccaccctttctcgtaagaactcaggttattaactattaccccctggagagacattccccctgacagacacatgtgcaccctttctgagcagtccttgcttttccgtgatgaagccctggagagtcattgcatcccgcttggtaaaatagtgatttaataagatgcttaattatttttgaaccaacaacaatattttgctgaatactgtaattgcattttccattttgctagaaaattgaatgctgagaagcatgtgaagttgtcaagtcagtgcacagcctggaaaatcaacagactcaacactaaaagctccttttgcaatcagccgtaataccctgaattctgagcaacaggttttgcggcctcgctgaatgcgactcaagaggaaaaattcatgcatatataatttgatcggcaatgtagaaagggatggggagtaaagttaggcaggcgtgaattctgtacaaggattctctggttaccgatatgtgtctttgtaacaaaactgcactatgtctgttaagtcttaatttactgctccctgaattaagaataatagtgatgcctacactgttggttatggagaggtttaaaagataccaccgccggtaatgactgacacctagcaagtattcagtaaaacagagctttcc

SEQ ID NO: 38479 - DNA, 874 bp, Bovine  19866881645333
caactgtatctcaatgaagccagaagaatacaaataaactaaaaagagagccaaccacttctagtcaaaaaaattattcttgtgttaaaacggcagtagttgaggctgcagtttgatgaaacttttgtgactgcattttgacaataatacaagacaggtaattacatttccaccaacaagtgataccacaaggatgaaaagcgacatgccgcaaacagtcaaagaataaaaagggagatgatctgattatcctggtgcaaatatatttctatgaaaactgtgaagagaaatatagaacatcagacccacagacataaactcactaacacttatgtcagcttcaagacttaacgttcatgtgttgaatggatgttcatatacaatgagatgttcccatatgtttcctatgttaatatgagggaatattccatataaaataaaaaacacccaagagatgtgctttcttttttgaaacagctttgtcaagttaaaaaaagaaacccaaactataatgccagataattagtttatatgttgttattggtgggcttccctttggtgggctcagtggtaaagaatgcccctgccaaatgcaggagccacaggggatgcagggtcaatcccctgggttgggaagaccccctggaggaggaaatggcaacccactccagtattgtcaccaggataattccatggacagagagcttggcaggctacagtccagggggtcacaaagagtcagacacgactgaagcagctaagcagacatgagcacactgttttggtgagtcacttgaagcatgatactcaaattatggaaaataatttcacaacataaactgctttgctcattcattccttcattttgtgtgga

SEQ ID NO: 38480 - DNA, 678 bp, Bovine  19866881705674
atagtacagattgtttgctattacaccaacttgaactccctgaaggaaaagctgaaggttttgcatcaccattctgcttttttgggtaacttgcccacatattgaattaatcactgagtctccacatacttttctctaaagtgacactactcacatagtgaagtgtttctgagggaacaaacggaggagcactttgaaggttataagggcttccctggtggctcagatggtgaagaatccacctgcagtgtgggataccttggtttgatccctgggttgggacaatcccctaaagaacagcatggcagcccactcatgtatttgcctggagaatcccatggacagacgaacctggcagcctactattgtggagttgcaaagagtcagacacgattgagcaactttcatattgaagcctataaacaaccttcccaatatgaatgaggcatcctcacaatcattgttactgcctgttgctgacaaattgtgagggttacctctgctactgcagttgcatctgtcagaagagacagagagagagaaaaatgtatttgatatgccccccaccttcattacccactaataatgaaaaaataatgacctctttccccgcgttggtgaatatttttcctgtcaactctgatatgctcataatgtgggcagacagattatttatga

SEQ ID NO: 38481 - DNA, 933 bp, Bovine  19866882206856
ataatgaagaaattacttgaccccaggacacacagttagcagtaatgatggtccgtgtcattgggcctctctgccatctgtgcccaagcaagcggggagggcaggggaaagatggagaggctgagatggtggaggagaactccaaggagagagaaggttgatggttcagaagccggaagggaacagacttttgtaaacctgcttctatggtcccggcatttcacatgcaggatcccatttagttctcaaaataatgtgctaagatcactataggctgatccttttgaattgttcttaaaaggaaaaaagaataactgagagtcaaagaaagcaggtaaaggaagagaggcagaaaataaaggaaacggcaatgtgccagtttaagtctctgaaatttggaattgtccaagaatagatctgaatctagtcttctgcaatagaatggttgtgtgaccttgaacaagggatgtgtgtgtgagtgcatgcgtgcacacacaaagcgcttgccagcttctcaacattcactttctatgtgcagaaagtgaataataacaggatcaacttggatgtgttactctaaaagttaactgagataatggacataaaatttgtagcctggtttcaggcacaaaacaactactgcatacatgagaagttttctatttttgttcttcttgttagtactcagataaaatgatcacatgatgtgtccagcactcaaatacaagcctgtttccttaattctttgctctttctactccaggacacggctcaacaagtcattagtaaaagcaaatagaaagggcaagaataaagcattgaaagttctctgtgtcatcataatatatctctataggttgactggggtagagccctctggcctagatttgtaatttctaatttttagagcctgaagagttagtcatctttctg

SEQ ID NO: 38482 - DNA, 1624 bp, Bovine  19866880362502
ttgcctggaaaatcccatggacggaggagcctggtaggctgcagtccatggggtcgtgaagagtcggacacgactgagcgacttcactttgacttttcactttcctgcattggagaaggaaatggcaacccactccagtgttcttgcctggagaatcccagggatgggggagcctggtggctgccgtctatggggtcacacagagtcagacacgactgaagtgacttatcagcagcagcagcaaggggtattggggaaaatggggagcaaccactgagaggtgcttccttttggggtgaagatgttctaaaattgactgtggtacgggctgcacaattctgcaaacatactaaagccaatgcattctaacattaaatggatgaactgtgtggaagtggagtatatctcaataaagctgttattttaaaacatgaattgtcaaatgtgataaaatattaacaaccaataactgttgggtataggtgattcgtacctgtgggtacccatctttactttttacttttgagatgtaatttacttccgagatgagatttacccatctttaattctctttacttctgagatgtttgaaattcttcacatctttaagactgtttcattttggggggtacagtacacttaataaatgagaaaggtactcttacctgtatgagttcgaacatgctgaacataattgttttttctgtctgaaaaatagttgcattttccacatgtgtaaactttccttggaaaatggtttctcaggtgtttcctccagtgatattcactcactgtggtgtacgtgcatatgatacacttgtagactcgctcattgtccccggctcgggtgtgatgtttcaggtgagcagtatagtgatcatagcgattggtattgtagccacagcggtcacagcggatggggcccttggagaaatcgccctcttccccagtagaagagccggattccctggcttttgcttgcttctcggcactttcctccacaaaaaatttcttggcgctgtgaactcggatgtgatgcacaaactgctcttcagattctgcttcatactggcatggtttacagcggaagggtttggtcttcaagttcttgcacttgtcctctgctacgggtgtttcctgagggacgtctttatttgagctgtacgtttctgaggcagctgctacctcaaacacaggccgtggctgcacaacactgagttccaaactttccagttccatgttctccagcccactgggttcgcctttcacctcaggagactcctcaagtccttctccatcactatctgagaagttgctatccccaacaggcatcaattctgccatctgcctttcttcgccaaccaggtaatcacagcagccgccatttacttccccagttaaggccacgtttgccaacatgatgagctgaggcgcagccagttcagctcgagagagatcaggcaagtcatacatgtcgtttggcaaggccatgcccatgctgccactgccggtgaacagccctcctcctccggaagactgccccattacctgggtggccatatctgtgctctgcattcaaaacaaaacaaaacaaaacacacaaaagcaccagttaagcacaacg

SEQ ID NO: 38483 - DNA, 980 bp, Bovine  19866880401051
acgtccgggagacgctcctcgagaggagatgcgcggccgactcctcctcccggcacccagcgcctgggacgtggctttccccgtggcgcggtggcgactgggggtaacccaagaggggctgacctggaggagagttttctgttccccgaatgcgtccaggattcggagccggaactgaccctccaagactagctgtgggagctgcagcagcggcgggaggggaaggagcgacagcggcagcggcgacggcaggagaggcggcagcagaagttacgggccagccaacaggtgctcccggcccgtacgccaatactgcttagtgttggtgcatcaccagcgcgccctgcgctttcaggtgagccaggaacagttcctggaggtggtgagcgccgctctgcggtggccggaacccgccctggtgttgtacaaggtggagctgctggatctgcccgacgtcctgctgctgcacctgcccggcccggtgggccccaagcagctgatcgtgctgagaagcaaggtggaccttatgccccaggacactcccgactaccagcagcgactccaggagcgactgtgggatggctattggcgccgggctcttgccgccccgtggctaccgaaggccacaacatctcagcgggcacaggccaccggatggggaggagaatgagaatgttccgtccaagatccgcacggtactcagagccgtgcggcttatcagcgccaagactggctatggagttgaggcgttgatctccgcgctccagcgctcctggcgctaccgcggcgacgtctacctggttggtgaaacctacgctggcaagtcaactcttttcagtacgcttctggagtccgattactggatcgccaagggcgctgaagctatcgacagggccaccatctccccttgggctggttagccttggggcacccacctccttcgttttcataaaagttataagtcgatcatgtttcaggca

SEQ ID NO: 38484 - DNA, 1883 bp, Bovine  19866880412500
tgctttttagcgtctaaaaggagatgagtaataaaccatctatcctttgctcacataggaaggagtccccttatgtaagcaaactagcaattttgtctagtttaattgcaacattttattcttaggatgcacttttaaagtttataatatatataattttctactgggaccaaatagtttttaaacttttatttcttaacacaatggaaaagaacagaaacaaaaaaatcagtgtaattcagaaacacttcaatatgtactcagcaagttacacatccacaatatcctcctgttactcagattttctgagtcataaaagtcctttgcgtgtacttcacaggcattctgacactcaaggagcttctgttaaaacaggcaaaaagagtcagccatttactcttgggggtaaagaagatcatttctaaattgctcacaaaagcatatatgctcagaaataaaaagggaggaaatactgatacattcaacaatatggatgaatctcaagagcattacgctgagtgaaaggaactgaactcaaaagctgagtgttgtattgagatgagcaaaatctcatttccagtttttctataagatggtacagaaaaccccgaacagagtttttggccaacccaatatgataccccttacaatgcacgggaaagggcaagacaatacagacatatttcagatcagtggttgccaggtttggaacaagacggggggactaatgaaaagggacaagaggggcctttttggagtaatgggagtgttctctacggattctgatatggtcacactgttcaaagtgcccctgaaaaaggttgaagttcactgtatgtaaactagacctcaataaacctgtacaaaactgctacggagagttcctcgggcaaagataaaaggggaccaggtctaaaagtttccaataaattgttcttcaagttaaattctgaatgggagctaatactgtgatctaatactgtgattttggtcagaggcgcttcatttgtttcctctcaaagactgttcagggggcagctcagggccaggccagtctctgaaagcaaatgggaggaaggagaaacagcctgggcatctggaaggtcctgacccagatggcagtttctggccttcttcacagactcctgagacaggttcttgatccactgtgttaaggaagctgaagtcaatcatatcacttcctgctgtgttcggccgacccttatgttcatctcaaactgcccaggaaaaagagaagtgccaactgcagacacttgggcagtcatatcactgctctcggtgatgtttctaggactagttactgaaggagcacccatgagggtatctcccaagcacgtgacataacagcaaacaagaccgaaggccctgctgtcctggagcttaggttctgaaggatggcaaacagcacaacttttttttttccccaaacagcacacatgtattaagtgcttgctgtgtgccaggtgccacaggggctgaccttgaattcatacaactatggagtgcagaggcaattattagcatgttcatttaaaatttaggaacctgaagccctgcaagccaagtaacttgtccaaagatgagcagccagaagtggcagaatctggggtgaaacccaggcagactcactccttaagtccatgcccttagtaggaacactgcctctctgagtggtggacagtcagcagaaatgttgtccttagagggttccagaatgtcagtgttagatgccttatgaaatatcgataaacatcaaaactttcccacgtatatagaaacagtgttacctcatgagataaaaggtcaaatatcactaacagacaatttaccaaaaaataaaggtaattacatatatagagaaa

SEQ ID NO: 38485 - DNA, 3679 bp, Bovine  19866880427418
tttaatacaatgaaagtatttttcaaaatatggtgccctgatttatatggagcaaaaaccaaaggacacatgtattcatggatattaaatatctgcttcaaagagaacttgctgctgctaagtcacttcagtcgtgtccgactctgtgcaaccccacagacggcagcccaccaggctcccctgtccctgggattctccaggcaagaacactggagtgggttgccatttccttctccagtgcatgaaagtgaaaagtgaaagtgaagtcgctcagtcgtgtctgaccctcagcgaccccatggactgcagcccaccaggctcctccatccatgggattttccaggcaggagtactggagtgggttgccattgccttctccgcaaagagaacttagaacacaataatcagtcctgcctttgcagagattctccaaggaaagactactttaaaaagtcaaagagtcgacagaacaatgaccctgaccctccaagtccaatgcaaatgctgggatgaatcccttcagttgaattctgtcccaaagcattagtcttgggaaagtgatagaaaattgaaagcaaagggaacagaactgctgtgttatgaacataatctctggattcaggcagatctaggtgatgttgggtaagttatctaacattttgagcctcagttttgtcacctacaaaatggggtaataataagtacccaggtctcatgggatttctgtgttacaagcacagggcttccttgctttctggcacacaataagcactcaataaatggccactgttatttatgatttcaaaatagttatcttaaagtgggataggatttgttttcctggttaaggaggaagctggaccaaatgactttcatagtgtctaaccaccatattctattattaacccatttcatgttaactgtttcccctctcaactcagtcgtgcccctcacatcccccatccgtggcattaacaacaatatgtaggcccattcattgactgcaccatgggcattcagatgtgtgactaacttaaccttctcaaccactccttgagcttggggctgtctcctgtcttacagagcagacaaccgaggcacaggaaagttgagtgatttgcctaaagtcacgaggcttaaaatggaagagccgggattcaaaaccaggcaatttggttctagaacgtaggttcctagccagcatcccatattatcttataagtaacctaaaactctgccccaacatatggaccaaccaaatacagtcaactggtcaactgtgtgctgcagctgatgaaacagtggtacaagatccagtgcgtgctttcagtctccatcgtagatcttccagctttacaccccagagcttcattcctaattatcaatttctctccctcccttcccacagaacactcttacccttgatggaccagtgatataaatatgcattcccattcacttctgggtttagggttaaaaaaaacttgactctaccaagttcctctgctagtgatacataccaggtccctggagggctggctaaccctgagcttaacagagccctgagcacagtcaggcatctcagaaatgcacttagatgatgacgagggggttgctctaacaatgaaaagttcccaataaagctgtcaggacttgagaggaccagttccaccaccccacccctgccggcctgggagctggcactggggcattgctggctccccacccacagggaacccaatcctcctggatcaactgactccatgcctctggctgcagctgttcgtttcctcttgttccacgtgtttcctccagcactgatggctaatgccctctcttttagaaaaatgaccttgctctccatacaagtaggggccacccattccatctacaacagaagtacacagctacttgattcagcacaagagtatcctctctgcggacttccagtcactttttcaatcaaggtattacattgtcttgtgatttcctttttttctcttaaaatgaaaacaaattgcaggtgatcccttgcattttgtgttgctaaaattcacattctgctgtacttcattagtaaaagctctttcccccccacctttccacaaggctctatgagatgcaaatagaaccatttcagttttccagttgaacagccagggaaaaaagtagaaaaaaaggagcagcaccctgcttatctccatgttacacattaacatggttctcctttgcagaggttcttcaaggtaagcacactttaaaagtcaaataactgacagaataattaccacagcactctaacatcaatgcgaatgctgggatgcagtcttcagttgaattctgcaccaaagcgtcagtcttcaggaatgtaatagaaaatggaatgcaaagggaaaggaatttcccaatttctccactaagatgtgattgaaaattataatagggctcaagggaaagaaagcccacaagtcaagttttctatgaaattttccgaaggtctccggtccgacaatctctcccctgctgaaacctatcacttctgctttgctctcgcactcctgtgctagaggtctcactaataatgatgataatcagtaataataaaaactattattcttaccatcgctactaatactgcctctaccaccatttactgagcttaatatacgccaggcattgtgcaagctttcccatattatttcaggaaactcttacaagaatcgaacgttcattagccccattttcaggtgagaaatcagaggctctgagaggtaaataactcgcatagagcctaccagtcagtaccagggccaggagtctacagtaggtttaactccagaacttgcgtcctgatcatgattcccagttttctgagtaatggccctttgacatgaacctcccaccacagggcttgcagggcacttgaatgaatgaatgactacgtgaaggaacaagccaataaacaagtgaatgtgctttctgaagactttttcaagtaaagttctctctctgccagaacaccaagaaatgtctaaaattgagtatgggaattctcaaaatgagatctttccttcacatctttaaaattcagcagagaggaactgacacgattgcactctacttccgttggttcttggtgctcctggccacaggcataatggctgaaataaccgaagctgacatattcaaaagaaccttgatttcagagacatgaaggttttcaccaaagttaacatcaatgtcttttcttccaatactgaactcccttcctcccactttagagggagcttgctgagtaatgtttactcttcttactttttatctagtattagggagagagaatatcaatctttacccacactcctcctgccaacacacacccaaatgacccatgggcatgaaagtgttcaagccgttagatcagcactaccaatgaaagtgttctgggtcacagaaaccgtgctgctttctttcccccatgaaggagacatctatgctggctccatgctctttcaatgtctcctccctgtcctgggccagcattcccagaattccttgggtgggctgaggacgctgagaggtgccatctggtccatctcacctttcctcctatgagaggcaaggccaatttcctctacagagcttcccccttttgtcagcataggaagtgagcatccca

SEQ ID NO: 38486 - DNA, 1073 bp, Bovine  19866880429853
gataaattaaattgcatcctattaacccatatgagtgtatttctgtaagcatcatcacattgaaacaaagttttaaaaagcaaaaaaaaaaaaaaaggaggtgaaagttttcagggacaagtcaattttgaaaaacgttaagcacatttctcatctaaagaggggagtgttttaaaggacagtgagagggtttctcaaagagcaacccacagctccttgtcccctttagctaaggactgtttctacctgacaaggaagagttcagggacctccacataaagcacactcatgtgcaggcaggtccccgccatcaaagaaggcaaggtcaggcacagggaagagaaagatgctaaacgagctgtcccaacccaaaccatacacaggagaggctcacgttaatgcctgcttcatttgcttccagtctcggtgacgggaattagacaattgctttaaaaactcagaaggcaccgtaaaaatagaaaattattgcttcctttcatgaccaaatattaaacacagtgcacacctaatgactctatgcctccccaggggaggaactttatgaacaataaaatcccagcagacttgcactgtttgggtttggaggtctcattacaggctcactgatccaatacaatttacaagctcaatggactccacttgaagtgaaaaccgccaagctgcagttgtaaacggaacacctacagtgaaaccaccatctcactcctcatcagggaaggaaaaggtgaaaggaaggactggggggtaaggctttaggggcaagcggctcatggcaatggctctgaccacctgcattgttcaaggtcagattcatcactagaaacacaaggcagggacttccctggtggtctggagattaggactctgagctttcattgccaaggacttgggttcaatccttggttggggaactaagatcctacaagcttcaaggctcagcaaaaaaaaaagagggtgcaaggcagtgggaaggaaagtagggagaccctaaaggtgaaggcagaaaggaaaacaatgatgaacaaagatgaaagaaagagatggggacaaca

SEQ ID NO: 38487 - DNA, 1195 bp, Bovine  19866880570356
atggcagggtgtggccatggaaacattcaccactggacactgtgatgtgggcaacttccaagctcttcccttcatttcagtacggtagctgcatgctcttcacactcttctcttcttcccattgctgtgaaaggatgacaacttgagcaaccaccttagacccagagatggaagccatggtgtgttccccagttgggtacttggctgactacgtgaagtgcagccgcttactcacctctctgatttaagatagcatattttggagaaattaactttctgccattttctcttaagccaactgctaagctgcttttttctaaatgagaagtgccatctggtctcaaatactagtgggagaaaacaatgtagcagaactctcttttaggtatgtttgaatcacacatacatacatgtatgtaccctactaaaaaaaataacgtgtttacaaactcagttcattaaaaagaggcacggtccttggtagtttaaaaagggttagggggctttattacagcagtatttaataaaatgtggtgcgatgcacacagaatgttctatatagttcatcttcaatgtgaacaggtcagcttcacgtatctatcttttcttctgcagattgtacataagagcaggaggccttttggttttatacgccacacttcccttgatgcgctttcctttgatgttaactatatgtggcaagagagggcgccggactgtcaggactgtcccttgaggtgtatagcctcggagggtcagtgtgtccttaaactgcggtgtcactgctacccaacctatgcaggcacatgaaaaaacacagacggtgttagcaaccatcctattaaaaacaccaaacacagctccagatggagaccccagggaggctactgctgcctcactattttttttaaaaagcatcaatacatttgtgaaaatgtacagattcattttcagagcaggttgcatcttatggataatctagcatgtatttcttaaaatatttggcttatgtcagttaaggcaaatctgtataaaaatatgataaactcttgtgcttggtgtaaaattacctgcagaggagaacttgatgtcagccactgcttcagattccccaagtccttcatctaacgtgatgtcttcagcaacaagaggaggaaatcctgccattctttcttctccacccactggtaccttc

SEQ ID NO: 38488 - DNA, 2303 bp, Bovine  19866880585368
ttggacacaactgacccaggcgcgcgtgccaaatatacaagtcctcctcactgatgggcctttcccttctcactagctcctcagtgacattggttgtctgccagcaccatcagcaggaggggagaaacaaagggacatttctcttctggctggtttgatcacagacacttctactccctcctttaattacgtgaaaatataggatttgcttgtcacacttgtctatccctcgagctcccttctttttcaccttccagcatttctacccttctcttttaactctgtctataacgtggaacattaccaaagctaattttctataggaaacatttcaggaaacttcaataagattgtatgaattccccctctaattcagtaattagacaaggtgattaaggtgaagcatactctcactgtgaaaataaaatctttttgaactttcaaatttatggcacagatgaggttttaagacttagcctattattatctctaggtgaaagaattacaggtagtttttattatcttttaaaaatttttttcaaagtgtcttctaatgacattttacttttatgattagaaaaataaaaattacttcaaaagatttaacctaagtgaaaactatttccacccactttagaaacatctttttccatataaactgctaatatcctaattagaaaccagttagctattcattaaagctggttccttaaggagttctactcggcaatattttgacagcttggttcaaattattgcattctttgcaagagccttataagaatgtcacttaattttccaaattctggattcgagaaacatggggtggtaaaggggaagaaaataaacatgggcaagaaagtaaaaatcactcgcaatccaatcaattgaaaaaaaagcatataaaacaaaaaggtaaaatattcccccacccctgttttcctacacataaacagacgtacctacaatcgcactttttaaaaaataaaagagggattatcatatttctactttttcacgtacacatctgcactgggcaatacatatatatgtaccttgtcctttttattggctatctgaaccataatttatttagccaattttcctattgccaagtaacaggttctttccaatttcttgttattgaattatggcttcaatgaacatctatatacatgtatttttatatacagtgatattacttctgcaaaattcttaagagtgctattctccaattaaagatgagttattctaaatcttaataaatgctatcaaattagcctcttaaaaggttaaacgattatactctcatagtacaagtacttcctttccatttatagttatccattttttttcaatcgttcttaatctgattccagaaaaaagattttcattcataacctcagaacacgttttcatatattttgtgccacttctgtaacttctgtaaacgtgtttaaatccactatgaatgttttactgtctttttcctattgttcactcttacatacttactgtccagtcctctctttgatgcttgctgaaatcactcctttacaatgctcaataccaaatctgccctgagtttaaggagacaccatcatctaaggacattccagcttctaatgttttcataccgtaagaataaaagacacccattcactattagtgatcaaaagtctaaagcttaacagtgcactggaaatgctgaaataccaagagaaacagcatcacaccacaggatacacagccatgaagttatttcttcacttgaataatttcatgtccacacaccacagtaagaatcacagcacacttcatcacactgggaggagcttaaagagacaaagccatctactctcaaatttttaaattatgacataggacactctcatcattagtcataaaaatatctcaatgcttaaaaaatctaaaataaaatgcacgaagaatgacaagaatttggttagaatggggagtttgaaggatatttttctccttttctttaaaatttttaaatggcattttactttcatcatttaaaagtaaatcttaattctgaacttagagtggtgatgggtacataactccatgaacatactgaaaaacacagaattgtgtaagttaaaaaggtgaattttatgtgtgtataatatctcaatgaagttatttttgtataagtagaattttaaagttaaaatatcacattgattttgctgtgactctaaaactgctctataaaatatatttaaaacaaaaaaccttgaatactctgtgttctcattaattttacattgaaaatt

SEQ ID NO: 38489 - DNA, 1951 bp, Bovine  19866880643627
tggatacctgaggtcctaacccctgggccaccagtgaattccctgaaggcactatttttaatagctgggtcatttgaaacattatggtttgagagtctttttgtgaagtttagaataatttttttttattttttgttatttttatttatttatgttttggctgcagtgggtctttgttgctgtacttgggctttctctagttgcagcgagcaggggctactctttgttgtggtgcatggacttcaggtaattgtggcacatgagctgagtagctctgcggcatgtgggatcatcccagactggggatcaaactggtgtcctttgtgtgttgcaagacagattcttaaccactggaccaccagggaagcccctagaataactttttaaacatattttattaaggtttaatttacccacacaaaaatgcacacgtgttaggcatataggtcagtgattttatgtatgctttctcttgtttgaccgccattttggtgtagacatgaaatgtttctactacccttagaaaagttccctccttaccctttctagtcagtactcccatattcttccatcaagtgatactctgatttctattaaagatttaacatccttctgtaaaatgtttttgagagtcattccatgctgcgttatcagaatgttgtgtttattgctgagtagtacacccctattactcttgagttaaaaggtcccttgttattctatctgggctctacttgataagaatgtgtataagcttgtaaaactctcttgaatttgccttacatttataaattaatttgggaagaataaaacagacacctggcacatttataaagatgaaaaacaggtagaaatttttactagaactggaaaaggaaattaagttaaaactgttggtacagggcaaaataattttcattcagctaggtattagtaaactagtcaacttgatgaattgatcttccagtgcaacagatttaatggcaataaagcaaaaataggggtggggtgaatgaagcaaataaatgatgccattggaacagagtactaggaactccatttcttcatcatttcacaggtggatgcttgcatcttgcttgatgctggctatgaaaatgctctcattcattagggcttaaaagtggtgacattttctttataattcttttaagagcacaaatattttcctaacgagatcagcttcattcatcagctctttgtttactcaaaggtaaggtttatatagtaaggcaggataagcacctgaaatcttcctttgtgttctataatataccagttcattccaaaagtcataaattacaggtaatatgtattgactgtttggccatatgttctacactaagtgctttatatggattagattatttatagcttaaaacataagaatagtttagttaagatgaggaaatagagccttagagagttttcagtaccttgcttaagacctcacagtaagttgcagagcccgtacttgatccctgtaggtattcttactgtagaacaagttcttaaccgttatgtcacatatcttgtttctgccattctgtttctttatatattaagtagatgtttgtctccattgaagtcattcaatggaaaggacaagaaagggccaagtggagagtaatgtagcctgttgttagaaacctccctttatgaatctgttactggactaatgtggaaaagagcttatagtttgacatacttggataagtttttgtttttgtggtcaagtattctgtaatcagatatcttctaatctgtaaagcttactatctatggttttacttaatgtctgagtagttttgctttacgaaaaaatttaataagattttacgtgaatttgagaatgttgagagatgaattttcataaatgtcaatttccatttttctgctatgcattccatggaccagtggggtaggataccgt

SEQ ID NO: 38490 - DNA, 1030 bp, Bovine  19866880726211
atagcttaatatcataaatttctcagtagaagtactggggcagatcctggggtgaccatctctgagggctattatgggagggattcttattttggtcgagggttggacttagtattcctgttctcatagttcaagctgtgttaagtatcaaatgttacatgggtgacctgtgtaatagctcttaggacttaagtttgacccttcatacagttaactcctgtcctagattcatagtttaattgccgtggttaaaattaccagatatcaactaagtaaaaattattggtatgttctaagttgtattattaaaggaaaataaagttcactttagaaccctgtatttttaggtctgttttctatcgatcatacaaggaacaggaatctaaaaaagggtttgatcaagaagaagtttttgagaagcctacacgtgaaacttgccagggtaagtgatactgacagtgaaattatggaattcaaagttaactcctgattagtttttctgggttttgtcttcccaccctcctttatgcagtgtgggagtatgtttgctagtcattcttagagcttatatttaaggaaatagatatatttgcctgaagtctttacagctggagtgggcttactatagtccttctattctgctaggtctgttcttctatccttttattctgttaggtctattcttctatccttttattctgttaggtctgttcttctattctgcattgaggaaaggatttaggaaagaagagaggccatataattgcatgggacacacccagcctcattctcacttgtactgtgtcctgtcccttagtttacgtattttcatgggaacttcctcccctcttcacattctgatgtgaccatagtgtttgtctggccacagtatatgtatatatttagcagataaatagtgagagaatgtctacaactttgtttcttctgaaaaactcagatttattttctagttactgtttttacagacatttaaaagctatatacagcttttgggatggatggggatgtc

SEQ ID NO: 38491 - DNA, 1317 bp, Bovine  19866880738623
atacagcagatcaaatctgagtccttgtctctctgtgctcctgacttggcatgctggggtgcccggggtgcggggaggggacctgggggctcatctctttcatgtctctgcaatttcaccgtccgccatgtaaagccgagggggagttgggtgaaggtggatttgatactcttgagttcagagagagaaggggcattttcctcaagggaggccaccttcagtaaggtggtaaaaacgccgggatcctctctttctgtcccagtaagaagagggaagttcagtgtaaatttatgagaaccagtggagcacaatgaaaacagcactgaatatgttttagaagacgtggattcaggtccctttggtaccactcattcattccataagcttgggccagtcactggatcttgactttttttgtaaaacgaggagttccgataatgtgattgctaaggctttttgcagctttgtgggattaaatattagccacattaaagataaagatcagatgatgtattctggttttttgttttttgttttttttcttttgaatcataaaagacctaggtctagagcagtagttctcagccagaggcgatcttccccgccaggggacattggacaacacccggaggcatttttttggttgtccagacagaagtgaacaggggttgctgctatcgtctggtgtccagagggcaggagtgatgctaagcatcccatgatgtgcaggagaactccccacaacaaagaattatctggcctcaaatgtcaatcatgccgagcttgagaatccccgatgtagataaaggcagtaatttctacaatatattcgattcattacagtcttctttcagatgaccacagcttacctctttttcttcctcaatgtcattcattttctgtacatattaaatattttatatctaatttatcaagcccattaaatattttgcctcatattaaaaactattttgtttatatattttaaaataattccctttttaatccagcttttaattctaaatactctttttcttcctaatttctgtcctttaccctcctgccactgtccattcagctccctcccaccagtgatcagtctctttctggcccttactccagcagcctcctctgatccactgtgttccttctggcctgtggtcacagtgggcagctgcagcaaggcaaagaggacatcctagtggcagaacaagattgctttcatcttttccgtgtgtttagcatcaatcatggaaagacttcttggcctggggccttcttccccttggccgtggtacccactgtaacccaaacagg

SEQ ID NO: 38492 - DNA, 2720 bp, Bovine  19866880754371
caggatctctcacagtagaatgatttcttgtctcacctcttcaagtgaccaagaggagaaggaaaaacatttagggagcccaggatgcaggtcacaatagaaaagtttatcacagcctcggggacattatgcaggcaggtcagtggattgtggctcatccccaggtacaaactacatcaaaatccactcgggattgtgctggctgattttgcaattgtttgttaaaacaacaaaccaaggtgtttcccacatatgtgcttgtcttttactgtcagagatggcaagtcctgacctgtctgtcccaagtcctcagccaagaacttgaacactctaacttcctacatctcaatacatcttaaactgggggaaggggaagggtgcacatctgccattttttagccccatttcagaggctacttaggtatgagatatgcagcaggaagtcatgttgcctcaaatctgctagaacaatccatacatgcatgctaagttgctgcagtcgtgtccgactttgtgaccgcatggactgcagcctaccaggctcctctgtccatgggattctccaggcaagaatacttgagtgggttgccatgccctcctccaggggatcttccctgacccagggattgaaccggcatctcttatgtctcctgcattggcaggtggttcttcaccattaacgtcacctgagaagcccctgctagagcactatttggctctaaagtaaggaaatataaaagaccttgaagctggtcaaacacccgttctcttgactttgcagttatttttaatacaatcacaggggatgtctgattaaaaagatagttgctgtagatcctcctcagctggatttgggctctgtcttggaaatccttatctagagaggctcatagtgaagtggactctactgcaccctgcgggaatcatgtccaggccacgctgggccatgaagagccggttgacaggaagcttcctactcacagctttagttcgaaaaacctggggtagagggatgaagaaggttgcagatttcagggtgactcacacaagccctcaggtggaaatttctcctgctgctcagtccctggccctggaaagtgcaggggtgaagcgctgcagacctatctccacctctgtaaaaggcagagattaaaagcgccgcccccatttccccaactgtgaaaagtaacttctgccctctgggtcatttctctgaaggaggtgtggggtgtaccgccctccctggagaggctgcaaagtgctaaaccgctttagaggcagcagggcttgcaagggtgaggcgtcccgccgtggaacccggctgccagcccagcgatccgtcaggactgtcaccagagcagctccctctgcccggaggaagcgtttgaaggcggtttttcaaaaatcaccgccgctcttcctccactccttccttaaagcctcaaggcggggagggtgcggccgcctcctccttgcattgccctagagcaggggccccggggaaacctgttgtaaaaactggggtcaggagggaggcccaaggacgtgcagggatcccctaggcgcgcccccggaagggccccgcgcaggctcccggcacagcctgcagcgctggacacccgcgcgccgtgccaccgcaggcggggacagccccgcgggctgagggcaccccggatcgccgttcctccctgcgctctgcccacggcctcgctcatcaccgccgcttctccctctctagcagccgtgccggaaccatgtcgaccgagaccgcgagcggccccactgaggaccaggtggagatcctggagtacaacttcaacaaggtcaacaagcacccggaccccaccacgctgtgcctgatcgcggcagaggcaggcctttcagaggaggagacccaggtaagccccggcgagcgccccgcgcgcccacgctcccgccgctccggacagcctagatctcgagaaggtgagggcctccctcgccctcggctcccgcctggccttcttcccccggatctatcagcgtttctgcccgcaccctgggagcccagacctgcatcgcttccaccgcagcatccctgcttctcggctccacccgcgccgggtctgccctgcaccccagccgagtggctcccgcagaagctgcttagaaaccccacgcacgccctcccgtctgattttcctctctcccctgcagccagagaaagcactctctcctcccgccgggctgggagccgcgtcaatgaacccacttttgtcttgctttcccaggtttagttcccctctgggctctgagcgaaacctgccggagaggcgccgtgttcgcccactgagcccagcgtccacaaatctattcccagcgggaatgtcagagctggacgggatcgtagtgataagctataaattcagtcctcggggttggtaaacgaggaaacaggttcagagggagggaattgtcatgacggcacaggtcgctatgcatgctctttacaccacatctcgctgcagcttccgctcagctgcagagctaaaattgaagggagtcagggagatttggttccgatttttaaaaattccacggttctaaggagatctaggatcttctttttctggagttttctgacaaggtagacatctaacattacaactgaagggagcggagaaagatgtcactgtaagtgcactgatttatttatctattttaaaaacttctgtattatc

SEQ ID NO: 38493 - DNA, 1165 bp, Bovine  19866880777387
tatccatgactatgactttaagaactcttcatttgactagtaccaaagataagattacaagcttccctataaacaaaaatgatttcatggcttgaataagacatctgacaagtcaaaaagaaaatcactgaaatcatactgcacaaatgaaaaagctgggcaaaggatatgaataggccgttcaggcaggacaaaacaggaatgcccattaaatgtattaaaagtggctcatcctcagaaatactcaaggaaatgtactttaaaaactaagtaccaagacttccctggcagtccagtggtttaaaagttggtgcttccaatacaaggagtacgagttcggttactgatcagggaactaagatcccacgtcctacctggagtgactaaaaaagaggaaaaaactaagtgccacttttttcttttttacctagcttttttattcaataagttcctaatacctaaagatttcagggtgtgccaacagtaggacaatgacttggaaaagcattatgaaattattgtatttcttttgacgttcattacctttatcatttatatcagaaataggaataagacgaccaatgcataaaggacgatttccatagggatctcggactgcataaatcacatctttgtgcattataagcagagaatatgctgtgggtgcttccttcattaaatttttaatcctgcaatcagttaaataattcaatgaataattttcattataaacgcatgcaagacaaaggtctcattatcacagctgcaagctcagtctacttttataattacctagctacccagtctggggtgtcatcttgttcctgaggaggggtataagccagtagctgggtgatcatttcactatcagaacttgttgacagaccaataccatgacgcagaagctatttagaaagaagaaaagtcataatcaatagaggggaaacttcaactcacccttcacccaagagcctgccatcacagaaagagatcagatattgtgtggatgctgttatgaaatcctgcattctaccaatggtaggtatatatatctaataatatactaataatatactgtatatctactgctggaggcaatggggaagtctctgaagcttttcaaacagggggataaaaaagtgctttaggaggtatacaggaaagc

SEQ ID NO: 38494 - DNA, 1057 bp, Bovine  19866880791597
tctgagtaaagtcgagttcctttagttattataatatgtacaaattgcatagtaagagaattttctactaaataaacagaactgattttttttcattctcaaacaaaaagtgacatcatcaggtgacagcccttgataatctaactagattaccatgaatccactgtaaagagctatagaaatacaaaatatattctaacacacttacaatatttaacaatgatagacaaaacattttatttgctcataaaatgtacctgtaaaatagtcactctgtgatgggaaaacagaacagcagctaattttgatgggaccattttgacagaagttggcacaataagcaaagaggcaccacttgacaaagcaacaaatatttccaccacagaaggatcaaaggtcagaggtgaagccagaaacaaaacatcctcatgagtgatttcaaaaagcaccctaaggcaagagagaatgtaattatgagaaatgcctaacatttagtaaacatatatcctaaaaaagtatttatgatcattaagtttccagatattagcccgatttatttttctctcttaaacaaaatggtgctattaattctagaactcttcttcatatatataagggttaaaagccattttaagcaatatctactctttactatgacatattttatgcacttaggcactacttggagggattttgtagatataattaaggttcctaatcatctgactttaatcaagagagaggttatcctggattggcgggcttttctcagttggaaggcctttaagagagtgtttaggggactcccccagaagtccagtagttaagactttgtgttcccaatgcagagggcatgagttcaatccctgatcagggaactaagatcctgcatgccacatggcacggccaaaaaaaagagagagcgtgtttaggctttctctgaaaagagactccatagagcagctgggtcagcaattattctccctttcccctggattctctttcctgacttgcctgtagacaagcacatgcccactggggttcagtctattcacaa

SEQ ID NO: 38495 - DNA, 447 bp, Bovine  19866880801331
cttgttccttgagtgaaatatggacaaaaactaagacatcatttagttcatgagtaaagaatcaaactgtgattcaatggcaagtgtttatgtagaagagctagaaattgaacaaacatctaaaaactgtagggcagttaatcctgcgaaatcatggcaactatgaagtagttcatctttaaaattatgacaagattagagatgataagtatgtgaactctggttgtacatggaaatagatctctgaaataatgttgactgaaaacaattagaattcaaaatagtacagttatttcaactatggaaaaatacaagcttgcctactggcaaagatggggacttaatttaaacctatgtaaatagtgcttatatttacaagggccttattttctcctgagttgtgttaatgataaaagtcaattgcagaggtagacagtttggggaggg

SEQ ID NO: 38496 - DNA, 1922 bp, Bovine  19866880933912
tgattttaggccttgaacatcaatgtatttctcccttctccaatctgtagtctgttctgagtctctcagaagatgctttgaagattcctgatgagtcactcttcttaaatagtggtggagattccttgaaatccatacggcttctcaatgagattgaaaaccttgttggcacatcagtacctgggcttctggaaattattctcagcagttctattttacggatttacaatcacatccttcaaacagtgttttcagataaagatatgacacttagcaagaatcatgccatgaaaagaaaattcaacgttactcaagaggaaaccagtggaaaatctttacgtcaggaaactgtcatgcctttaaattgtgacaaggagatcaatgcttttattgcactgagcagagggaatcagattttgtctttgaatactgataagtatttaactaagttgggacattgcccttcaacctattcttctgatttaaattcacagactgacattcaaaatagagaaagcctaaatactccacctcttattgggaagtcagaagatccatcctgtgttgtggaagtttctgaagaggaaacacctgtgattagggctgagaaaatggagtttcgtgtgaggtggaggtcagacacaggcaaatgtgtggatgcttcacctctggttgtaataccagctattgataagtcatctgcaactgtgtacattggctctcattctcatagaatgatagcagttgatctttactctggaaaggtgaaatgggaacagattttaggagatcgcattgaatcctcagcatgtgtatctaagtgtggaaactttattgtagtgggtaagtttctgaatttgaggtttatagagttaaatggaattaccatatgaaaatatcagtagagccaagttaaatttaaaaaacctgtgtttagtgggtttggtttctgtcaaagaataataattacatgctgattcacagtgtgggccttgggtcagagtttctgggtctgaacctagctctaaggctattacccgctctgtgaccttcaacaagttgtggaactccctagaacttcagttttctcatgagtatatgggcataataaataaaacatggtgctgcatcacaaattattcccaaacttgatggtttagagcaataaacatttattatttcacagtttgtgtggatcaggaatttaggaggagcttagtggaaagttctggctcagggtttctcctgtggctgcaaccatgtgaaagcttgacttgagctggcgaaatctgcttccaagatggcttacagtgcggctaacacaagaccagttctttgctgagttttgacaggaagcttcagtttcttgccccatgggcttctctctgagtgatccaagagagtgagtgaggaaaaatgcagtacttttagtgtctaaagttgtaaatcataattcatgctttattctgttattagaagcacatcatttaagtctggcccacactcaaagggaggggaattggctccacgtcttgaaaggaagagtatcaaagaatatgtgggtatattttaaaactaccacaatgatcatagagcttctgagaggattaaatgtgataattgcttgtgaatcctttagtacatacctggtggctcagacagtaaagaatctgcctgtaatgcaagggacctgggttcaatccctgggttggaaagaactcctggagaagggaatgctgacccactgcagtattgcctggagaaatccatggacagaggagcctggcgggctacagtccatgtgattgcaaaaagactgagcgactaacacttttactttctttttcagggacagactaagtgctcattgagtattagctattacctgctactctgtttccctaaggtgcaggtgactttta

SEQ ID NO: 38497 - DNA, 1821 bp, Bovine  19866880952159
ccctgaatgttgtggtgttatgtattttatatataaaaacaaatggaatatcaattactagacagtcatgcactggatgcttaatccagatgggttcatccagaaatccttcttttttagtagtctggctgcttgcagatttataccatagctctgctttctgtcagggggaattttcagtgttaagctaattggttgtcctcttcagctataaagctgtgtgtgtgtgcttgttcatgccagataaatataatcaattacttttttgggcttaaacatcaatgagttctgaggtttgcagagttgggacaaaccatacaccccattgtagattagagatctttatctttaaaccacagtcccagttaatggagactagaatgacatggacatatttgaagattccgtaaaaggaattactaaaatttcagacgtttatcacatgtatcagctagttagcctttccttagttagttaggggacaaaaatgcccttcaagtgaattatcattttcctgtgttaggaactgaaccctacaactggtaaacattttcataccttttctaaaaatttatgacatttacctgatgaagttgggtcacatagggagtctcctgactgcaaaaatattctgaagaatcttttggttctgttgttctttgagtaagctgatttgcagcggtctcagaagcagttttcttaagagatacagatgctggttctgcaaaaagtatataacgtatcactagaaaggcacttgggaggtagaggggagggatgcactcagacaaacctatggaatttgttcccagttgtcttcatttagtttgttgggaaacccaggagtagattatcagagaacttgctttgaattgccatattaaggctggggttaacttttttgatttttatctcttagaaataatagccaaacatgttacattcctctagtgttttacattcccttagttggaaaagtgacttatcccccaaaggatcttaaggtactactgatttgtcgttctggtaagtgttgggaacagcctctttaacataagacttgaagtctaccaggtttcctagtaatagtttgatcttgggaaagtctcctaatttctgactctgtttctcacctgttaggctaggcttgtatattttaaagatccggtgcacaaagtcagtgcattgggaatgatactttcgtgtggttaatccttagcagtttcccttttcagtcacacatccattaaagggcattgagagaaggaaaacatgaggcaactcatctgatttgtaatttatgtcaaaaaatggagaataaaattttcagctttcgtgagatataagtgttgttgggcagggttggggaacagtggagtcctgctattctctaatattttattcgaaaaatatttgttgagctcgtcctgtgtgtatgcagggccctgtggttgacactaggaatactgtgctatacgaggctgatggtccctgcccccacagagaggcagtagagcaacagagcagacttgttcatgcctccatttcctcctctgtaaatgggaatcatggtatcactcacctcagagagttgtagtagggattaaatgtattaatatataacgtgcttagaacactacctggatatatgcataccctgtgaccctgcatcccactcctgggtgtgtactcaacagagatgcatacatatgtttattgggagacatgcacaggaatttgtatagcagcattattcttagtagccccaatctgggaacattggatagagaaagtagagggatgtatgttcctattatggaa

SEQ ID NO: 38498 - DNA, 879 bp, Bovine  19866881007261
ttgggagaatttctcttcaaattcaatgtctctcttcttatcgctagaacaattttaaagtgctaactttatataaagcaggcaaattcttcaagtcatttgctatttaagtaagccaatttttatagggctataaacgaagaataaactaaagtgaaacaggaacacagacatgaggaaaaaactgattaagttatatagctgaacaaattgacagattgctctaataccaccttggccaccttagttcaattaaaagcaaaaacagattaaaaaaaaaaaaaagctcacagatttagaagtctgctacaataactcccttggatttgctaaaatgtgtacatcagtaggtacacggagtccaagaaaaagagtgggacttaaaaatcaagattggacagtaattaattttaaaaacaaaaggctgtctactactccaaatgaatataaaatgtcagagaccttatacactaagaactgaagccttgaccagagtttcattactcctgcccttgagctgccttttcaaggaagtatacattaaccaaatggcgattgaggtgtttgctgtaatccttttcctttcgaaaagaacgatcacagaagatacaaacgaaatctcccgcggccactttgacagccaaggcatcctttccatctttcccactggtctcttgtggaactggccgagcaccgttcaatccagaatcgtcactgtcctctgacgtgttgtcacttaggtcacttccatcatgactgtggatgccttcgtcttcatccatttcctgagactcatttactgccacggtgacaggaggtgaggccacagcagttgtggacacggcttcatgtttttctagcggtagagcaggaagtggt

SEQ ID NO: 38499 - DNA, 1110 bp, Bovine  19866881008508
attgtaaggctctagtcggctggactagcccagtcggggttcttccttctttgcttgcgcgttttgatctcccagagtctgaagctgttcttgtggtagaactgtgtgggatgtttgctagtcctagacctacaatacactttgaggtttcgcggggagcctgcaaccaccacaagcttttgtttgcaagagcagagctattgggcagatggtgtatttgaacgaaatcatagctatgggaatgtaaggattcaaacccggggaggctgaaccggttgatgttcaaaaggaactaccggttctagatcttatgaattccaacagataataatccaatcacggagaagtagtgaatgtgcaaaaaattctttggtaaacattttagataatgaatgaaaagattagtagtaaggaaatgccaaaataattcccttctttaaaagagggagagaacctgtatgacaaaatacacactgactttggaaaactgataaatcttttgagttaaaaaataactttgcttctgtgatctttccatttcctactaactgaactaagttttaatataaacagttttcttcagggtaagaaatataaacctaagcctgacatcactgaaagtattacagtttccataagaggatacctcagcaacaacttctagaacagttaaggaacttggtgataacacttatcagcaatatgggcgaaatatgtataaatgcattccaaatgattagctttacctccaccaaacttaaagtagaagtaggctttttgcttttttcagaatccagaatagttgggtttgagtttcacatcttgtatattccttgtttactaaaagctgagagtaatttagaattctaggatgaatcaaaaagaatatttttaatttgaattaattttggataactgtgggttgaccataatagagatcttattttaaagtacatttatgttattgagaggattatatatataatacaaggaaaaactaaaagctattcatatggtactccataacaccatgagtttataacattcttcagagaagttattttggatatcctgtcagggaagaggtgtacaaacacaagggatctttag

SEQ ID NO: 38500 - DNA, 1543 bp, Bovine  19866881025522
attaagggagtaattccaagaataactttggcactagacttaagactggaaaacaattctccttctcctttgggcagtgaaaatgcctcaaggacagtaaaatgtgcaggagaatcaggctgagggccatttttcctcttctcctctgccagggtccacgtgtgtaaaacacatgaactgttggctaccttcctgagtttttactcagctgtttatagcaggcctgtaaatatgcacatcgtaaagttaaaaataaagccaaatagcaagacttcagagtgggagagacaagaaaatacttatactttacaagaattaaactaaaattccaacctcaactatataaggtaagttttttgaatcctaagaattatattttgcaatattgagtgtatcatttttgaaaaagccacatctttttaatctacttgggttaacactattttcaaatttatctttcttacagccattacatagaatgcaaagaagataaagaaacaacagtgctaaaatgtattcccagtaaattgatacattctctgtggaatctttttgcaaaaacggaatatggattaaagattaaagtaatgtaccaatggttataattcaaagtaaaagtgaagtgaaagtgttaatcgctcagtcatgtctgactctttatgatcccaccaggctcttctgtccatggaattctccaagaaagaatactggagtgggaaactatcccttttttcgactcagggatcaaactcatgtctcctgcattgcaggcatattctttactgtctgagtcaccagggaagctcaaccaatagttatattcaaatatattctaaaatacatataattgtactaagaggtaaaggagtattatgtatgtaatctacaaatagttcaagaacaatattatgcataatgaagcatccacatatatgtatttatagagatagtgaattataaaacaaatgtgggaaaatgataaaagttgatagattcattgtaatgtactgattgctactgatttgttcactttaaaatagttaattttatattatgtgagtttcacctcaatggaaaaaaatatataatggatttgagtgaaggtataaagggtgtctagaatttttctgtattactctgcatttctgtattattctgtattttctgtaagtataaaattatttttaataaaaagttaaagaaacctctatagaaactatagtaagtagctcagcagagagaatttaacttggaaattaaattagttatacagatgttaaaggtctgaaaaaagcaaagggaccctgaggtaactgaggtaaagcctgcgggtaccatgagccatgttctaggaggggctccacagagctgagactcagacctctgaggactacagtagttcagagagctggaaaaaagtctgaaatcagctgctactaccgtcagggtaaacggccgtgcatgcgtgcttcgactcttcagtcgtgtccagtcgtgtgaccctatgtacggtagtccgccaggctcctctgtccaagggatt

SEQ ID NO: 38501 - DNA, 1723 bp, Bovine  19866881064463
ataagactcaagctatttacaaggtaaaagttttaataacaattgattcaatatgggaaatatggacagttaaggatggtgcctaggttagaagtctgtacccaatgctattccctctcaatttagttgaatcggcatttatttatttatggccatcccactgtggcttgtggaatcttagtttgccaaactgcccccctgcaatggaagcatggagttctaaccactgggcaattagggaatcccctgaatcatgatttattacctaatttgcttttctatccattaatagaaataacataacattatagaagacaattgctaccagtgccaaaatgcttgctataaattcatagatgaattcagaagaggctgatgaggactgagaataattcatggaattgaaatttaagagtatggaaaactacacatctaggatggtgctgtccaataaagaacagccactagccacaggtgcctatgaaacatttgaaatgtggctactccaaattgagatgatgtaagtgtaaaatacacagtggatttcaatatttttttaaaaactcgcaaaaatcacagtttttatattgattatgcgttgaaatggtactactttggatataatttagaagtaaaaatagcacaaactatctttcctgaggatcctcatcacgcatggacaaaacgattataaatatgtaacatgataaatgcaaagtgaagcaagaaactttttgcctggtggttttgaaaagagtcggacacgactgagcggcactttcacttcactttgaaactctcattggcataaaatggctaaaaacaaaatctcgacaggaaatataaaaattttcagaaggttcaattattaattttctgaaacaggctattattaacctaaagggaaaagcaagactttggtttcgggaatcaacattagatgttcctgcgtttgttttgcaatacctattgattgcaaacgcgatttgcaggtatctctctaatttctggccatcactcgttccaatgaccctttgcgccttttcctcattccatgagaagttctggatgttacaaaaagttcggaggccccggagcgctttgtttccaacgcacggctccgcagcgtcagggccacgtgcccgcgcgcccagtggcctagagaggaggatgcagggagacggggcatagtccggggaagcatgccgtggggagccaagaacagcgcacaggccagcgtgagagaggcgggaagaccgtggagtcccaactcctgcggagcccaattaactcaccttcgactgccgccattgtccggagaggtctgaggccttcggccgcgctgcgaagagacgcaggactctggaaaagaaacgcgatcagagaggctcacggggccggggagcgaggcaccgcccacaggcacgcccctggcatggccacgtgacccctagcgccccctccgggtctcttcgaacatctccgcggccacggaatgtcgcgggtccctaaccttcccagaactcggaccccggagcaaggcttcccgccgcgcaggcgcagcgacgcgggcttccgccgccccgcccagcgcgggcgcagttcttgtaaagaaaaatggcgcgcactggcagcccctccccactttactgccgctcgctgaccgggcccctcctcgccagagagagcggctcagaagttggagcataccaagtagtgacgg

SEQ ID NO: 38502 - DNA, 1734 bp, Bovine  19866881072829
ttctccaggccagaatactggagtggatagactttccccttctccaggggatctttcccaacccagggattgaacccatgtctctcacattgcaggcagattctttaccagctgagccacaagggaagcatctatgggtagaactactgtgatatcatttctggaaacagaaaaaaatactgttttaaaagattttcaaatggaattatatagtctgtgtcagtactccagattgtgtcaggcagtcctgtcaggctattcttctttgatctgaatcccttcctttgcaccaataccacatttatttcttttgattctactctgttctccctggagagcattttgtggggatgaggcggtcctttgagaatcactgccctcccagcaggtttctcatacctagactaaaccttggacaatagctcagacaggtaatagattcaccctagcaatgtcctattctggggagacaaaaaagacacaaccactgtgttttatagaaactttccattagttcgtgcaccagatactggtagaataagcgacagcccaatcctgagagtccaagggaaggtgatttaaatttcctccagtgtctgggatgtattatctctttgactaataatccctgggttcacgtgatgcggaagttggagagaaacctcaaaggtgtcctttgtccttttatggttgggcatcattttgtaaggtaatctaggttcaggggttacaaacaccttagaaatccaaatgtttcccacataactcactgtccacagccttccaggagagtcacaggagctctactgcgaacacaaaggtcactcctgaaccaaaaacattatggctcagattttatttcctaaacacagccctctgggcaaatactgctgctttttggtttgtttgttttagcaccaccaagtctgctgctgctgctaagtcgcttcattcgtgtctgactctgtgcgaccccagagacggcagcccaccaggctcccctgtccctgggaatctccaggcaagaacactggagtgggttgccatttccttctccaatgcatgaaagtgaaaagtgaaagtgaagtcactcagtcgtgtccgactcctagcgaccccatggactgcagcccaccaggctcctctgtccataggatattccaggcaagagtactggagtgggttgccattgccttcaccaagtctaacagtggctaaacctgtgatttttttgtgtgtgtactatttctcaataataaggagagatgctcttcatctcaagaggttatgtaaatgcagggaaacaacccctccaatcttgaagatctgggtttatttggtcactgctgccattttctagtttcttgggacctcagtttccacatctgcaaaatgaagcacctaagctctatatgagggtccctccctgttttaaaactctaagaatcatttctttaaaatgtcagtgaacttcaggggcttccctggtggtccagtggttaagactctgcctttcaatgcaagggacaccagttcgatccctggtctggaaagacattacatgctgcagagcaacaaagcccatgtgccataactgctgagcccacgctctagagcctgcactctgcaacaaaagctaccacaatgagaagcccatgcaccacaaccaagagcagcccccacacgtaactagagaaagcccacatgtagcaatgaagacctagcacagctgaa

SEQ ID NO: 38503 - DNA, 1880 bp, Bovine  19866881114465
ccagggcagagctccaggtaggggatttctcatacagctttttcacactggtcttaagtatgtggcgtcaaaggaaacaggctcctgaatctgcttttcagctcaggcttgatgtcaactacttggctttgagactatcaaaaaacactggctccatttacattctacctaaaattcaccctttcctcacatcctaatataatcttgtctcgtcttttgtttagacggctcttatggtatgcagtcttcttgctacaggaagtcaaaaaacctcatcttgttggaccacaggcaatggaggtggagcaggctcatatcaccttgttaaaggctcaggaatttaacaagccacttgatatcacattggtaatttgaaattagccatggttgggagtatttacaccacagaaaaggacaaatactacaaatcacaggtatctctaatccctgaagacctgactgttaaatgtgtatcatcaccccactgatagtgggtatgtttctgatgatatttatccatgtcagagtttatgaatggggtggcaagacagcttgtgctctgaaatgcctaaaatgctgtgctagtttttacactggaggaaataaaacatgctttaagggaaaaaacctttaagtacacttaagtagaaatggacctgttctctctacctgtcactgatgtaggaagagtgttggcctttttgagttgttctctgcgctcaagcctggacactggtgtctctggcttcttctcttctggctgagtggtgggcttgtgcagggaactagctctgctgacgctgctgcttccaggctgtggggtgacactgacctgcatggacagaaaatcagggaaagcatgtattcatcctaaagacagagaaggactgaccatgcaaggcaaagctgcttagaggtttccatcagctggcccccatcttctgctcccagaggaggagccagactgcacagggagcagtgtgtgctcaaccctggcccccagccaaggagcagctcagtcaaatgtcccaaagaagggatgctacaggctttcccggaagagtcccatcaaactatacaatcagagccacagagcaagactcctaatttcctctcgacccactgcttaaaagaaagttattttcgttacttttcatataactgttgtgtgcgaggattctgccaaatcaggttaacctaagagcataaggaaaccaaatcaaatttctaactgaaaatacctctttggcttaacagtggtcaactgatttactgctctaccatctaagtattttccaccattcctggccagccttttctcattactgttgttttaaatcctgaactaaaagaaagccaagcttggaagttccctggctgtccagtagttaggacttggcactttcactgccagggcctcagttcaatccctggtcagggaactaagaccccacgagccttgtggtgctcaaaaaataaaagagagagtgagccaagctcagagttaaagccgaagaccaggctacttacttgttctctggcgagcttctctgcctgtttggcctccctggcctgcttcctctcttcccgagttgcctgctgctcccgaaaccccttctgtttctgcagcgccagcgttatccacagtggctggcgcggtctcaaccttctccacaagtttggagccatctaaggagtgtctgctctgaagcattggcttttctatgggggaaaaaagacagactgatattgtgatatactataagaaatacatatttgatctttgtccctgtttctggcactgaattcctaaaacccttgcaatgtcctaactgatgagagcataaaggtctcttttgttctgctaaatgaggtgattc

SEQ ID NO: 38504 - DNA, 1581 bp, Bovine  19866881191339
aaaaataatttttatcactgtacaatatgtgaagtggctatcgggtactatgtacaaaatgtcttaaaaacatgttttccagttgctcagtcatgtccaactctttgcaaccccatggactgcagcatgccaggcatttcctgtcgttcaccatctcccaagaggttgagcaaactcatgtccatcgagttggtgatgccatccaaccatctcgtcctctgtcatccccttctcctcctgccttcaatctttaccagcatcagggtggcagattatattttccaaagatggccacaacaacatagccccttatcccattatgctcttcccacaatgtggtcctgatgctgctccgttgagaggtgggagtctacgtgtcctccccaacctgcatgggcctctatagtggaagtgatgccgcacggattccaaggccaagttaaaaaagaccacattgcttctaccagtgctctagtggcacacaagcctttggagcccaagctgccatgtgaggagcctagctaccctgacgtgacaggctaaagagataacacacagatagagaaaaatgctgggcagtcccagctgttcccacaccaggtatgaaactcttccccacccagcaccacagagctgagtaaaagccttcagaagagtccagcctcccggctaatgtcaaatgaaacagaaataagccaccctaactgaaccctgtccagactgcagattcatgagaaaaattaatgacgtttgaagtactaagttttgggtagtttgttatatagcactaaataattaaaacatcatatatattactaggttaaaaggtatatgtattcatacatatataatatatagatagagttctggagtagttatatagtactagataactagaacactattatatatatgctaatacattataatatatattactgcatttaaagatagctatataatttatacatatgtatttacatgtcagtctatctatctatgtataggtgtatacatatagatatcttttaacctagcaatttcaattctaagaatttatgttaagaaaatacttagaaactatgcaaaaatgactctagcattattcataaaatgaaatattttgaaacaatctaaaatgttcggcaatacgcaaatgattaaatatatttctctatattcatatgatcagttactaagcagcaacaaaaaggtgatgatatgaagctgcagttggtgacaagatagtgagtcatgaatcaaaaattataattaaccaaattctttgtgcctaaggtccatttttcttactagttttttataggaccttatgtgcaaataaatggaccttgggtgtaaaaaactagattaatcatattcatcagtagctcatgcctggctcttttaaaaattttttattcatacaaagatattaaaggatatttacatgcaccctcaccaggcaactaaccctccctccctccctccctctccttctctctctctcatgggtagaaaacagtcccattttttacatatctaggttataaacttcttgtcgtatgttgcaaatattttttt

SEQ ID NO: 38505 - DNA, 2928 bp, Bovine  19866881205619
ttctctctagttcttttttgatcccagtgcctggagctaagtagattaacaaacctgagtagctgaatgaactgatgccaatacctaaatatacaccagattttgtacttccaattcaaagttttaggaagattttaggaagcactccaagagattggcttcctttgttgtggattttgtgaggctataactacttttatcacagaatttgtacaaaggcgtgtcagtgggcagcgattttgattactatggctattcaaacattggtcctcagctgttcaaaggaacaaacaggccaatgtttaggagccctgcttattatgttcctgacccagctactcaactagagcaataagatggccagacttgctgatgccgtatttttacacttacattacatggatcatatgttaaaaatatctactaaagtagtaatctcatttaaaatttagataaaacccaggagaccaaagataaaggctgaccctctaggaaaatgctgccttattagtcagtttacaagattttaaaattgagggtcattggtcagacttttagtaggagaaaccagagtgaagttgggggcaactatttaaaactacaaaagtgcaagtctgtgttgacaagcaataatattatattggaaaagatggatttaaaagaaacaaccagcaaagcataaaccccagtcccctaaagatgttaaaaacatttatatgaggttttaagtacaaaaggtcaacttaatagtctgtttccaaacgtgaaagaagaattgttgattccacatgcagaggaaaagctccagctgacagacaggccccttccaggagaatagtctcaggagacagtactgagattcttctcttgtgataaataactcctgcctgatgaatacttccttattcttaaattatcatatagccagtgaccttagatgtagaaggaccccaagatccatgttgtccaaattctcactttatagatgaggcttggggatggggaggggatggttaaacatttgcctactcactcatcattgccaggatgctggcagaaatggaactagaactgtttgaattcatctccttgtactttattaataatcagaaaaaacagtatctgctctcaatcagctggccgccatttaaacagtgtgaagctgagcgattagaaaggcgctgagcaaaagcattaagcatgaacagctgcatttcccaagcagaagggcagcacacagtttagttgtgggaggatgtccaatttgcatgaatggaacatggacaagataaaaccggctccagaaaagtaattcccccaattcccatgagccttggatttggcaaagtgcagtctgctcagggattctgggacgtggcaaatggtcctgggtagaccctccccagatgacctcagcccacgcatgcatggaggctggtcaaggtcccaggtgctggctcacccgcagcttgtggttgagacagaaaaacaaagaaaaaaagtgttccccacacatgcacataagcaaaaactatcttcccatgttctctgccaagagagctggagccaaagagaggagttcaagactctgattcatccatcaagacaaatcaactcagtctaaggaggttaggaaggcaatttaggaagtaaacaaaagttgggtttcagaaagaagctttggagaaaacaaagactatccctggaatccaactccataatgaaaacagaaaagggctgctacggcagcgaattctgaaaatgccaacagatggtcgcattcaaaggggcagctccagaggcaaatggcatcaagatgtcagccctcctcccacgtggagtctggtttctgagccagtgccttgctgagcagaagaagcatctctagtgaagaaggcctaatagcactgctcgagttcagcaacagcaaagtgagattggtgagaagtgctccccttcccggagtgccaggctcctgggctagcctggagcatccatccttgtgcttttacctctatcgcttttctggttgcctggccagttgttcccctgtctcccctccctccctcttggcccccatgccagtcacagatgagagttatgtccacatgctctttctctttgcctcccaggcatcactagagtatctggtctgggtctgttcatcccttctgcaacatgactttcccatttccttatcaaatactccctttttaggtgcagccaaatcctgctgcccttgaatgtgagctagacttagtgactcccttctaacaaacagaatgtgatggaagagacaatgtgtgaattctgagactaggtcattaagggcactgcagcttccttcttgcttctttttagatcatttgctctgggggaagtcagcctccatgttgttaggatgctcaagaagtgcaatagagatgtccatgtgatgaggaactaagtcctcatgacaacagtcaagtgagtgaggcaagctggaaatagaccctccaacctcaaaccttcagatgagtagtacccactgacatcttgaccgcaactgcatgagagacccccaagccaaagaccacctagataagccagtcccaaatttctgacccacacaaactgtatgagataacagatattcatagttgctttatttaggctgcaagttttggactaatttattgagtagcagtaaataactagaatgcaacatctttgaactttttagttgaaccatcaactagaattgtcccttgttcatcatctctttttagagaaagagattttttttgttagttttgcttttgtcataaagtcctttcctcaaaggttagggcaaaaccactcatatttataccgaccagacctcatggacggaggagcctggtgggctgcagtccatggggtcgctagagtcggacacaacgagcgact

SEQ ID NO: 38506 - DNA, 826 bp, Bovine  19866881226685
ggcatcagagagacagacaacaggacaaagattaagagcaggcagaggtgctatctgttggattcacatgagtctgaagtcttgtttttattgtttaagcattactctgacatttgagagaaaacaatccctcggggaggagaggagccaagagaaaatggagcagtctgagaaagaatggaaatgattctgttgctccacaagacacagccaggtgggagggaagccagggtaaatgatcagaggctgtctacaaaacagctcgtcttagctggagcacaggggtgcctattctgtgaagcaataagcagtctgccatgtctggcaccactggagctccaagttagtcatctgtaggaaaccagccttgatttccattttgcagagagtgagtgagcaagaagcacaagcacacaggattgtgtctgttctctacttctcggttgtcatggcaagtattgcaggtaacagacaaattagacactggggaactacacagtaaagccccaatgattggtagaacttgctgtttatggtgattagaaatacaaaatacatcaaacttcactgaaactttgaagaaaatgctattttaaaaggggagaaaaagaagatggaacgtcaacccctattctgtggacatgaggggctgtcctgacaccttgccgttaacttctctttccacctgcatgcatgctgccatggtataaatgattaatgctggaagggtactcttcatactgagaccagtggattaagaagtattagtaagttgacttatactcagaaaccaacacagtaagagaactttcttatagcaaatcca

SEQ ID NO: 38507 - DNA, 736 bp, Bovine  19866881235381
ttgtttgttttcttttgtttggtggatctctgaggcaggtttcagggtttggcaatgcaacatgaaaaattaggaaaaagtattaaactgtgtgtggaaaactagttattctgagagtgggtgtttaaggcaaaggacatttgaacttggaattgactgggaggccaaagatttaaagaagcagaaaattttctcaagatatgagtaagttgtgtattactgttgtgtgttttctgtacataatagggatttgtaaatgatgttgaattctaggtgaattctcagctccgacaatcattgtcaaacagatcaagctgcagatatttatgttttaaaacttaaattataaagctagttaaacctttctaacaactagatttaatgttcactagtgcattttatattaaaacgttaccttttccagtacatacagaaatactcatattaagtacaaattggagattgggaatcagtttggattctttgatacctcaaaagaaaaaaaattgactcctggggaattgaacgtattttcttatctagattttaagactagaatgccaaaaccaaaaatacaaaagaaattaaaacccctcattaaagtgatttgtgaaaacattgttactggaaattgaatggacttgaggcctttcctccagaaaacaaggacttgtttgtcaggcctatattaggttctgaaccttagtgccatgtatttgttcttattggaaaatca

SEQ ID NO: 38508 - DNA, 1697 bp, Bovine  19866881367525
cttgcctagagaatcccagggacggggggagcctggtgggctgccgtctatggggtcacacagagtcggacacgactgaagcgacttagcagcaagcttatacggaaatggctgacctcctaggctatcttgccctgtttcctgtttactctttgaagctctataaacttgctgttgctcagactccctctgcaagagtgctctattgtctgtctgtaaggcaatgtactcctcgatccatggatggttttggcatggaccagtttccatggctaaactgatttcaaatgccttgaattcatacctatgccccaaaggttttaaagtattgtttcataaaaccacttattatcaatatcttcaaacatctcaaagtagagaaaatagggtaatgaagttcatatatccatcatttagtaaggcattgtttttttaaaattaaaaaaacttgatgagtcatgaagtccatgaataaaggtagcaagagaaaaatgcacaattggcttgtagtcctagctctgctatgaataagctagtactgaataattcatggtgccttgttcactgagacataaaacctggaacctgaaaggtatgtgtggggactctccaggccttgtgtcctatacttagattctaaagttccgctatctacattcattaagccaccattatctcttgccttagctaaaatccctttgcccattcctgctcttctacattccattcttcatctggaggcctcagaaattcagcttttaaaaatgcaaatcagatatctgatcacgtcattcctgtgctaaaatcccctcccagttttctcatttctttaaggcaatgtttgagctgcttaacaagttcaataagaagctgcctgacctgggctgctatctctcctgccaccaactcctccacactggccatttccagtatcagactatttccacgtgctgtttcaactacctggatggttcttccgggcctcagtacctaccccgactccaacacagacccactgtgcttgggcaacttgttctcattttaggaaccccctaaaatgtcacatcttccaggaagccttcagtgaactgcatcaagtcctactaagcctctgtgtgctctcttaccacctgttacttggatgttgtagctctaaacactattttaattgattagttacttgtatattaatttaaaaaactgatttccctcaccagactctaaattccatgtcagttttactattttggtcaccttcataaatccagcacctagcacagcacctggtacagtataggccctcaaataaatatctgtggccaaataattagtccctgctaagctttaggtcctggtttcatggctcagatgataaagaatctacctgtaatgccggagacccaggttcaatccctgggtcgctaagctttagggataaaagaagctcataacagtggcgagggagaatttcatggaaaaatgacaatgcatttctagaagtgttaagatggatgaagaggtgcatggcagcaaaccaggcctgtttaaggagcatctaatccagtctgggtcaagataggcttactgaaggggacagtgactttgtaggggaaatccattccacaagcctcctatagagtcctataagtagggagggatgagtagggggagggaactttctcagtaccttttagaat

SEQ ID NO: 38509 - DNA, 1315 bp, Bovine  19866881609259
tggagaggcggggacaacagccatcctttactctttggataatggaagaaaaaaaaagtctcagaagatttctgcaaatgagctccactgttaattcacagggcacagcccccggcgcctgagagagtccacgttagagggaaggagcctggaatcccggggtgacagtacagtacttccagaaccaaacctggcccaaagtcaaagctcgaggccatttcttcaaagaatgagttaattattccctctgaatttcagctgtccactgctttgggtcttggagctgaataaagaatctaactgcagggacatcttgcatcagagtcctgggaaagggacaaccttcccttggggcctggaaagttttctggcataatccgcattcaaagggcacgaagtctcccctcttgcaacaggctatttccagcccacaattaatttcttgaaacagaaaggaaatgacaacagcatgtaagagttttcccactcatctcaagtactgaaagctgatttttaaaaaatccctcagggtagttttattttttccctttgtaagaataggcaaaacatagttttgaaagctctaaatatatttcttgcttccttccctctaaagcctaggtctgaaaggaagcatgtctcttggccaggggtcttagtctcttctgtggctaacgtggacacagtgagtaaagtggggctgcgtttgtgtgtactgctggctctgtttccgatgcttccttgtctgtcctcaccaacacaaggcccctcaccgcatcttgggctccctctagggccctgggacccaaagaacttggacaccatacagtggatctggctcaagcctgagggccccgtgaggctctgtccttcccacacagacttggcgggacaacctcaaagctcaggggatctcaagggagtgttctgagaagaatgccccagtgttcagagattggaggggacctggaacaaagctgcctctcacgtagcaaaaccacatgaggaatgcaagattcctgtgagattcgagtgcctcagccttgcaacaagccacttatttcaactcgcagccacttctctatagatggagcaaggagcagggtcattggtcttagccaaggcagtttctggagcccacatggaagaactctagcctgattttctgtcacatgtcttgaagacatgctatggattctctaacagcctaattttaaaactaagatgtccttagttttaatatagtccagtgtatcaaatatttcttttagattgatgctttttgtgtgttagatttttgttttggcccagacca

SEQ ID NO: 38510 - DNA, 805 bp, Bovine  19866881798643
aaactcatattagtaatatgttggtcttactggaatattctctggttttcttttttttttttcctcaccctgctcatcgttttttatctttctggaaatttctgcagcttcatcttccaaaccttttactgaacgatctacttcataaatgattaatttccaagagttctttcttttctctgaatgaataggtttctactcttttttttcacataggctgtgtctttctcttatatctttgaggatttaactgttttctttgaagttttcttctgctccctgcattgctctgatgtctttgagttctcttttcctgtttgctcactctggtctctgtctttcatgctggatactttaatcaaaggttgagtgattcttagctatctactcatattttaataatgaagcatgaaaaagctattttgaagctagcatatgaactggtagacttcacaatgaagtatctgagcaaaaagtcaggttaattttttttttaactacatagtgtattaggttataggctaagttgctacaacaaagaggtccccaaatacagaggctcacacaagttaagagtttacttctgtctcttttaacatttcatagttgatggttgttcccggctgctgctgctgctctttctgttctattccgctgctccactgtctcccagggtcttgtccttcccttatcagcaccacaaccacatcccaccctagaagggaatgagggaaaggggagaaagaagtagaggctcctcacagggctcagaaaagtttaatcagcagtcacacctcaccgcaag

SEQ ID NO: 38511 - DNA, 705 bp, Bovine  19866881869302
aagtaaagatgtgtttggtcgattcttttagccagatgtgtaaagccaagtgacggaacgaacagcagtagctcagaggcatgtgtttgagcctcagctctgccactgattattccactttcaattctgaataagaactggaagacaaaggaaagttccttagtctctctctagcttatcttgctcatctaagaaatgtgcttctcccagttctataataaggtccctctcttacagatggaccagtacaaaaaaatcaccttccacatctaaaaatcatatacaggtagttcaaattcaaagagcactcccaccgcccaccatatcaagttatcctcacattctttatcccacattttaacatcttcatttattgggaaacactacactacctcaaaattagaaaataaaaccatatccatatgtgtaactagttttttatcttttttttttttaaacaggtgaaggtgctgagctgtaaacctgcagaatgtattagtctgcatagctaaaagtagtcatgggtaactacagcctcctgttcttgcctagtaaccagtttcttttcatccagtccactaacacttgagctatattcactgattttacacagtgaaatacgaaattaagataacacaccaagactatctacaaaaatttattgtctatttacagaagaaaagcatgcgtatcattaaaacaaat

SEQ ID NO: 38512 - DNA, 1065 bp, Bovine  19866881871689
acttttcactttcttgcattggagaaggaaatggcaacccactccagtgttcttgcctggagaatcccagggacgggggagcctggggggctgccgtctatggggtcgcagagagtcggacacaactgaagcgacttagcagtaaagaatgagaactagactccaatttttctactcttgtcttctgtcaacatggttaggaggctaagaagtctaccaactatttgatgtgcactagaaggtccccaaacagagtaaacacattaattcttaagtatagcatatactttttcaaataaaatacaatgacgtagtacagaataaaatcttgtaacattatcatttaacttattcgaattcatctgtatgctaaaaatgtaataataaaagttaatctaaataaagtagcttctccacgagtgagactcccaagcaatcaaacctgaaacaataaatgcacattggcacaagtaatggaaagaacaggtgaatcagtcacaggtttccccagcttagtaagtgaaatgaaatgcattgttctgataggcaggcaagtagatggtaatggcttccttaatattcctctatataaaagataaagaatggtttcatgggaatatacacacacacacacacacaacatatatatatattaataaaatacatatgattaaagagcttctaatgatgttaccaaaaacaaaacacttggtcagctttagaggattctaagtaactgacccattattttgaaaactggtaaataaaagcaaagaatcaagcatttatcatgtcttttactatatgaactatgtcaccaggtaaccagatgatgaaacaaaatttctctctatgaaagtattccagctaataaatgaaggaatgataaaattagaatctcatcagtctgcaatccctatttaattaaaggttttaggtaatgaacattaatgatcattaatagctactgaagtcacaaaagaaaaacaaccagatatgggaaagtatacaactttgaatactgccttttaagtattactattgaagaacacaaaccctttacct

SEQ ID NO: 38513 - DNA, 913 bp, Bovine  19866881874201
aactgcttatgagttcagagtttctttgttttttgggtcaaaggaaatattctggaattagatagtggcaatggttgtactatcttgtgactatactaaaaaccactcaatgacatactttaaaatgttttatgtcatgttaattatatctcattttaattatatctcatttttttcctaactgcatgttctcacctgtaattgttatattctctctctttcaattgatcaatgtgtctcttcttcaaaagcagcttttgtttttccacaattagaagtggtctacaaatacggcctgcatctgtatagatccgaatctcccgctctcgaatatctctgatcatagaaacctacacataagaagacaaaatagtctcataaatttatatcttctctgtatcattaaggctgagataaaataacattaataaattatcagataaaactaacagatcttagttgatcattgttcaatatgctaaaaacctaggtataatttaaaattttatagaagataaatatttaaccttgataattatagagctgaacaacatctggtagtaatgtcatgcaaaataaaatatgaataaaatgtattttggatatcaaaacactagtatgtgacaatttcttatttttgtctctgataattacatatacttcactgtgtaacagtttcaatatccagccctgtgtcactgcttcaatcaagctttcccaatcgtaagcctgacttctcatgatagtctatcagcaaatggtttaaaatctatatgtctaatacagcagtcactagccacaggtcactactaagcacttggaaatgtgaccattctaaaaggagatatgctttaagtataaactacttactgaatttcaatgataaaatttatcactaataattttccatgga

SEQ ID NO: 38514 - DNA, 1675 bp, Bovine  19866880116261
tacatcatgagaaacgctgggctggaagaagcacaagctggaatcaagattgccgggagaaatatcaataacctcagatatgcagatgacaccacccttatggcagaaagtgaagacgaactaaagagtctcttgatgaaagtgaaaaatgagagtgaaaaagttggcttaaagctcaacattcagaaaacgaagatcatggcatctggtcccatcacttcatggcaaatagatggggaaacagtggaaacagtgtcagactttaatttttttggctccaaaatcactccagatggtgattgcagccacgaaattaaaagatgcttactccttggaaggaaacttatgaccaacgtagatagcatattgaaaagcagagacattactttgccaacaaaggtccatctagtcaaggctatggttttttccagtagtcgtgtatggatgtgcgagttggactgtcaagaaagctgagcgctgaagaattgatgcttttgaactatggtgttggagaagactcttgagagtcccttggattgcaaggagatccaaccagtccaccctaaaggaaatcagtcctgggtgtccactggaaagactgatgctaaagctgaaactccaatactttggccacctcatgagaagagttgactcattggaaaagactctgatgctgggagggattgggcgcaggaggagaaggagacaacagatgatgagatggctggatgacatcaccaactcgatggacatgagtttgcttaaactccagaagttggtgatggacagggaggactggcaccgctgagattcatggggtcgcaaagagtcagatacgactgagtgactgaactgaactgaactgatgcttaggttaaaaaaaaaaaaaaaaaagctataagttgttggaggtctctggttctctgcactgaaagggtttcccctctctgctttgtcttaccttgaccccaaagaatctcatgctatataaaatttgagcatttatagattcccaaaaggagaagacaatggcgacccactccagtactcttgcctggagcatcccatggatggaggagcctggtgggctgcagtctgtgggtcaaagagtcagacacgactgagtgatttcactttcacttttcactttcatgcactggagaaggaaatggcaacccactccagtgttcttgcctggagaataccagggatggggcagcctggtgggctgccgtctaaggggtcgtgcagagtcggacacgactgaagcgacttagcagcagcagcagcagcagattcccaaaggccagtttctaggtatacaagaaaaggaaaaattaaatctgcctttgtatggctatttgcttaatgtgagccagccagggctgaaatccatttgaattatgacagatgtctcctcatcatatttaagcttattagtgaactgcagatatgagaaatgcatttttcatcaatgcctcagttattctgaaccaaacatttgtgagacttgacctataaattacactctcaagaacacaaggattcaacaaaggaatgtattatgattaatggtctgctgccaatggaattaatgattttctattaaaaaatactatactcatgagtcttggtcatgaatgtatgagagatttcattaaaccatttactccta

SEQ ID NO: 38515 - DNA, 3202 bp, Bovine  19866880557669
ctcttgcctggagaatcccatggatggaggagcctggtaggctgcagtccatggggtcactaagagtcggacacgactgagcgactttactttcacttttcactttcatgcattggaggaggaaatggcaacccactccagtgttcttgcctggagaatcccagggacaggggagcctggtgggctgccgtctatggggtcgcacagagtcggacatgactaaagcgacttagcagcagcagcagcagttattaatttgtctaccagaattataccaaattttataatatgattaataaaaatgtaattgagtccctttacatctgtttatagataaaacaaacaaacttacactagcctgagagactacagtgacatgaaatcaatatattttacaccaaagttctgattaatgaataactatgagaaagaaaaatcatatctgaaacataactcaaaccacgggatcaatttgcacagaaactgaattacaatgaatttatggagagaaaacagtgagatatacttttattacagtcattaatgtaaaataattacacagaataaaaatgtactcttttataccattggccttacagaaatttaactttttgatgcatctgtaatgagaacacagaaataaccatttacttccatgtttgctttgggccagatgaaggaattcagattctatccattaatgactgtgactttgtaagtatctaaacctttttccaaatctcatgtttttctgtaaaatgtgaactaatacataatttctaaggctactagggatatgcaggaaaacagtatttgtgaggatgtttctacaaatatagaaaaagtatttaattctagttcttaaattctatgttgtctttaaaagagtagctcatagatgtaatttacaaatatgaagacaaaaaagttaaaacaaaactagaaattgcatatttgaagaaaatagttacaaagatcaggatttattttcccctaagactttttgcttttgttttccctgtccccagatttttactgttctcatacaactgctttcggctctaaactaacaccttgcaaatgatgtaaaccaatgtgatgtggaaattactagaaagcaaaaggaatcaagcacagaggaacaatctctactcctttgagagaagcaattgcataactacagatggaaattacagaagtcttatttaccaaggcgtttcccctgttctttcaatattggaaatgaaatcactgtcaagagagctctcagatcctacatatttcaaatgacacagtcactctcattctttatcttcttgcccagacataatgcattttccactgtttctaattccattaatgaggaaaaagacatgcaaataaattcctgttataaaataataatgctattcagcaaacatatgggttgaagacaaaatatgattaaaaacaaaccattttcagaagattcgaaggatctcatgtgtagagtgggttaccaataacaataacagtttcattctctgatgagaattaactaaagttaaatgcagacatatatcatatggaactaattcaagttatattgtgtaaattgcttctcattttaagttatatgattttatatagtccagggttagatgactccaagcaatcatgaaatttagttcttcctgagataataagatactgatctccatattaattgctcagaaaggttttgggaacagcttaaattataatatctccacagctagtgagtgacagggatagtaagagctgttgggtgagaacttagattctacatccaaattgcctttgtttaatctgtgtgactgtgagtaaatcatttacatttccatgcctcagcttcctcatctgtataatggagaataaaaatgataaaataccatataataggattttcataaggattggataagttacgtgtataaataacatagaataatgtctggcacaaataagcacttaacattagctggtggttgttcctaggccttgacgggctcataccttaagatctacagtttatactttgcacctggctattccagattagcaggttattccataggtatactggctatatgtctcccagaacaggtaagaatggtcatgggtgcataagactactcaccctcacccctgaatagtgcccagactgcgcttctgggcccttgggaaggaagcttccttcactcaacagctggttgccatccatattcctcttttcacactattaagttgtaactttcatagacaaagaggaattgtatcatctatatcattttaaaatcagtgcaatctttccattaaccacagtcatctcatatttatttctttcagttaggcagaacccaactcaaacaacaagtgtaaaatgtaaaagacacaactgagtcagtgttcaaatggtatcacctagactcttgttctctcaactcagctttgctctgggttggcttcactctcagataggctcaggcaaaggagaccacgcacaactccagactaatgtcatcacagctggtaatagcaaagatgtcctttctctcctgctctccaggtgagtctgaggcctgagcagctctgcatgggacagatactatcccagcaacaatctaaaggaagtgactggggaaatggattctctggtcagtgaaagtcgcagtgccacccctgtgacaaaggatgggtgcctcagctctatctaaactatatggaaacaaaggctgtgttgccactgtaagggaaaaagatgttaacaggaaaaaatagcatattcatcacattctacatttctcttgctaacttctttcaatggtagtagtctgtcaaacatagcttctcacaagtttggagtaatataattttaaactattttttaaaaaataatttctgtatgcatttggcaaaattgaacagataaaagtgttaaataaaaagtcagatttgtgtattcattaatcttaactttctgtaaaagatttaggacaatgtttcctagcagtcatagtatcttatttttatttgcctctcacatgactttaaatactacagtccttcacacttattttcaaagtttttaagtttcctaatttttaaaagattttattggctctactaataatttattctttttttgatgaatatttattgagcattttctttatgcttatca

SEQ ID NO: 38516 - DNA, 4368 bp, Bovine  19866880573530
gaaaaagaataggaagaggagagtcctcaaagtcaggctagttttacaggacaccaggctaagcaattgttgacctcaaaattaaaataagcgcatagcaaaaacattggtacatttagctaagaaaaataattgcaacagattgtgctttgcttctattagctgcctagctagagaggagatcagtgtactaacctccaataaaaaaaaaaaaaaaaagtaaacctaaaagtcaataaggtatttagcatagcttactggcttcttttgtggcacactcttttctagatatcaagtgagcatcttatgagttttgaaagatttggttttctgaaagatgcaaaattttccatagtgaatgttaagacttctttgcaaaacactatatttttgaagaaatcatagctcacagtgtttcaggtgaaatataaatatgatctgcaaaagtgacatcttctggggtcaagaagaaaataaagactgtgtcaagaaccagagagattagtttaatgcgatcttagcactgttaactaactcctggcacttatgaaatattaagaggaggatttatctactgacctggaaaggaaatgagaaagctatgtactgagtggagctaaaatatttgccccagcttagagactccataaattagcatgcctcaaatcagtcctcaagtcaatttttaaaaatttgagaaagtagcattcagaaatattaaacaggtaaagaaagaggagttgtctgagtttcccagtacaatgtctatcatattgggttagggaaggaaacagcagttgcataggttttgctcctaattcaatttggtatcatcagttcaagggaaaatacacacacagacacagaattataattcattttataaatcataatgtagatgggaaattaaagcatacctgggtactattttttaactaattggagtatttttgtatcgtcagtggatattagtatccaggaaagatgatcaaatatctattgtttaaggattagtaagcatatctgaggagaaggcaatggcatcccactccagtactcttgcctggaaaatcccatggacagaggggcccggtgggctgcagtccatggggtcgctaggagtcggacacgactgagtgacttcacttttactttccaatttcatgcattagagaaggaaatggcaacccactccagtgttcttgcctggagaatcccagggactggggagcctggtgggctgccgtctatggggttgcacagagtcggacacgactgaagtgacttagcagcagcaagcatatctgaacctaatctgatcatcattccattaaataaaagaaaaaaatctttaaaaaagtgtttttttaggtactaatttaaatgattatagaatattttgtgttttcttcttttggcttatctcttattttttccctacaataaacatttattgatttgatacaaaattaaattattttaaaccaaataagcaaagaaaaggaaataagaaatctaaagctttaggaggtaattctttgaaggattggttattccctgtgagtcagaagtcagacttgtggattctatatcacatactatgtgagtcaattaattaccaagcagctgtgatattaccttatacccatgtaatgaacctcagaaagcatgtctatttgggaatagccaagaactaagcaatctacaaaaacaaggaaaggagtaggaaatggatggaaagataaagaaaaaagataggaatgaggaaagatggggaaggagaaaaaatacagaaaaataaggaatgagaaaaaaacatgtatagagtaataaatcatacaggttatttattaaatctcataccctgtacttcacccttcctatataatatttagtctcacttaaaacattttaaaaataagtatattaatctttcttcatatacaaatcaatttttttaaaaatagagaagaaactaacagagtgtctggcatacagtcgatatacattgcataaattgggtattttaatgagcttagtggttaactccatggtatattgaaatttcaaatgatgacttcaataattatgaaaatgttctattacgtctgacatcctttgcttaagaaataggcattcagcctattcatttaaggaaattcaataaacaaatacaagtgttaattaaattgtcaggacagaggaacagtaaaacgttcacatattgttggtggtcaagtacattgcacctgacttgagagaagtaatttgtcattatttactagtcataaaaatttaaaatcatgcagtacagtaagcccaataaaattcaaatatgaaaaatgtatatgaatatatgcatatgaataaaggcgtatgcttatcatagacttatttatcataatgttcgacattatgataatgttaactaaatgctccacaatgtggcaatggttaagtaaattatagtatatctactttatggaatataatgaatacattaaaatattgctttatactgtgtcagaaaaatagctatgatataaagttaaagaagtcagaatgcagaaagtgtaaattttgattgaaaaactacataaaatacatatcaaatatggattggagggtaaaaaccaatattggttgaaccagaatggtgatatatgtacattttattttttgttatttttttcctaaattatcctgtaccattatcttattttttaaaaaagcatatacaatagaataaaagtttgttagctaaaatacctgagtataaatgtgtgtatacatgtgagcacactaatacacaaataaattcatttgggtttattggagtttatgcaaatacaatagtttaaagaacttttcataaatatttaaaatatttaaagcagtaaggtcctttaagcaaacactttctgacaataggatttacaatgcataatctcatggaaggtttttattctgtttcctgttacttgtgtatttactttttgatttgagtgtgtaacgcgttgtacgctgatgtccagaggacagcagctctgtgtgtatgcctgatgctgagtgaatgaactggggcaacaggaaatgaagcctgtgtgccgagtttgctcttagtcttgcgtatgatgcggaacaatgctttttttttttttttttttttactcagaagcataatgtgattgtacttgcattttgaaaaggtttttctcacttgaagtcctgattctgtcttaatttaccctacagggagtatttgcatgactggctgttttctacttcttgggagcttggcttcagtaggggctggcttggaacactccaggctgcagctgccgcgggcttgtccccttgtgctagggttctggaatgtgtccacagcaacatgaaaggaacttgaggggacagagacaggaaagtgtattaggaaagctgttgtgataaagcaggtggaaaacaaggagtgtgaggagagagtggggcttgagatggcaagacagcttcgagaaatatgcaagaggcaaataggcagccttacagtttcaacttacactgtttctttaatgaaaatggaagcatcatttgtatgtacatttaatctaagaaaactttaaacttcttgtgtataaatgctactttttgatctgttgccccctcccttttctggaaagacatgaatgtttaatggttttgttttgttgtactcatatatagaactgtgttgctaaacaactgaaataataagaatgagcccttgacttcttgctaaatgcttgtctcaagaaaataaaaaatccaaaattaaaaatgcattttaaaaatacctggaatgattgtttaattatgactcaataattgacttgatacaggtaatttaaacaagtagcctactttagagtttgatctgtccagtaattatgctaaacaatagaaaattaccttcacagtaaaagaaaccatcaacagaatgaaaaggctacctattaaacagaagaaatgtttaaatcatatgtctgataaggagttagtttgtaaaatatattgcaaatatatgtagtgatagcaaaatttaataaacaatccaactaaaaatgggcagaggttccaaatagacactattttttccaaagaagacatacagatggccaactggtataggaaggtgctcacgcatcactaattatcagcaaaatgcaaatcaaaaacacaatgaaacatcacctcacacctgtcagaatggctattttcaaaaagataagaaataaaggttggcaacaatgtagagaaaagggaactactatgtactgtttttgtggaagtaaatttttgcagccaccgtgaaaaacattatggaagctcctc

SEQ ID NO: 38517 - DNA, 956 bp, Bovine  19866880598774
aaaatgtttctgggtttgagatcccagatgtaaaagtggggagtatagtttgagcaagatatttcacaactccggggctctgactactttacctctaaaactggaattacaatacctacatggaagagtttgtgcatggcagatattaaatgtcacagttattagcttttcagtcagttaaaaatgatttgcttgaaatgtcattatgtttccaagatccaatgttctaggaacttatcctaggttagcagacttacttaaatatttgcatggagaatttcaggtgctcagagtcacaaaatttcatattggtcataagaactgtcagcagctccacaaaaatcaacttcaaaagccctttgcattaatagcatagagtgtggttatggtttgagtctgatgtgtctctcatccataacaaatgacctttagggcagagtagaaaaattgtccttacagtcgctggctttgttaggtgactcacctttctgcttcagagatttctttaccaatgcatatttagaggaatgaggactgtaaagaacatgaaagcacatcaaatatttatctccagagtttcattttctaaggaacaggaagtgtgtcacacgatttctcagaggggtaaacacccctaggcctctcctaatattcaggagatagaaggcatagagtatgtagtgtgggatggactgttgctgtttttcagtcactaagttgtgtccaactctttgcagccccatggacttcagcatgtcaggcttccctgttctccccgtctcttggaatttgctcaaattcatgtccattgagtcggtcctatgccaccctcttctccttttgccttcaatcatatccagcatcaggatctttttcaaggagtcagttattcacatcaggtggccaaagtattagagtttcagtttcaaccttagtccttccaagaatattcagtg

SEQ ID NO: 38518 - DNA, 3002 bp, Bovine  19866880788759
catcctttgcttgtagaaaccctggataatttacacatcaatataatatccttgcaaaacaaaacaaagcaccccccccacacacacacaaaagaacaaaactctgctccttgccctaattacacatatttctctgagtatctgagaaatgtttatgaagagtcaaaagccttttactttttcagaagaacatattgtcacttctggggggaaatgctcaaaatatatgctattatggggaattaataacttctgattccaatttgactgtttccacatcaaagtatacttttatgatcaaaatagcatactcaaattgcacagttatagagtaatctttctaaaacaatgattcctgcttttagccatttaaaataattggcacttttatttatctagaacatccttatttactgtctttcatctatgtaattcctacttaaaatttatgttaactcaaatttcatctccacaagacctttcctgattcattactctgatatagctgcctctatactatgtccccaaagcaactgttgtataaatgtatcacagtatttggttatcattattttactggagtagaagcctcttatgcagctttttggttttgttttcttattcatattcccagagcttagcagaatcataatattatgtattcagcaaattcttactgaatgaaatacatagctgaacattttaaaacttatactagtttattggtaactgggattttaaaaatatttttctgtaattcgatatggaagaatgattttcaaccaagaggatttcatgtttttttttttttttttttccacaaaagattttgataagggcaaaaaaattgatctttgtagataaaaacttagactaattaaggaatgaaggaaagaacttaataattacccataaaaagtgattattcactattgttgatatggatccagatgacaatttggaatataaatgatatgtctgtgagtgttatgactgtcagcctggaattgtacttggtgattcagggaagggtaagctacaaagttaatcaaacaactctagttcccttctgacctcatgttattgtaacaatgcacaatgacaggttttcagttaatattggtatataagaccttgagaaacgtatatgatagtctcagaaatgtgaacagaatgtcagttatgctttagcataatagatgctgccatacttatacagacagaatgctctgggggcacaggtgataggtccaagttttgtggcacttatattggcatagttcattctccatatttttggagttactactgcacaaggtctggtgaactgcaggcattcagtaccgcttagttctcaatctcctctctttttctattttttgtatgtttttgtatgtgtgtcatcaataaatatatcagtctccttattttcttccctttgaccatcactgatttgctcattctcagatgcacattagggataaaagagatggctctatgaaaatatcagagtgatatccctttagagtatacctgtgtttgcttcttttaataagtgaatactttttttgcagttgatttggtcaacctttggcatagatatattttgtcaaaaatatatctataagtcaaatcccagtgcgttctcaggtgtctggtaatcagagagatgctgtgccaaatagactgaggccacagagcttctgttagggcaacaggcttgaacactctggggaaaagccaaaggtgagaaagggcagcccgtgaactcacacttggaacttgtgtaaagatgtccatgctgtcttctttgttcaggatacaaagggcatccagagatctccctttctccagcctgcaaagaaacctctgaagatcagagaggagccgtgggatacagctggctcaaatggagctcttctccacacagaatagctctgtctgtacccacttgcaaaagtatgtatcattttgtaaatcaaattatccagaaaagttaattagatgtccccatgattcaacaggcctgtgagggaagtgggcaaacatttaaaaaaaaaatttaaagggtatctccaatatttagctatagttcttagagtaaaagagaacagctactaaagaaagggagaacagctcattagttgactgtattataccctggatgaaaaggaactacccataagcctctgtgcctatgatagcccaagtctgaggatatttctatatacatcaagcaagctgtcttaattatttgtgctatttcttccccctttaaaaactgttttagaatgtaaaatcctattgcaaatgcgctatctgattatctcctgccatatggctattcaaacaaagaattcaaggatttgtggtctatttgagcatacgtatggtgtgatgccctggttttcaaactgtggtccagagaactcttcgaatatccacagatatgcagcaggaatcctgaagggggaagggaagggggtttcagtgtgtagccttggaccctcacacctgtgccaaacagagaagcacagctttaatatggttaaacataagtttctgtgaaaaattttatttggaacaaaaaagtgttcttaagctaaaagtatatttgaagaacattagtataatgtaaagaatgcaagctatagaaataaatgggctaatgctttatactgaaactctactactcgctaaggatatgattctgtgaagaccttataatttctttcatcttaatttcagttacctaaaaatggggccactctcacagattttacaagcgattctgtgtattaggtggaagggaactaacgtttctagaggcattaataattacaaggctctgaagagaaaactattcaatatattctgtattcctttctgctctccataccactctgccagtgtacagtaactacactaaaaacacacgtagaacataggtttgatccatgctggcatattttagtattatcatgtgttctgcattgcaagaa

SEQ ID NO: 38519 - DNA, 2469 bp, Bovine  19866880801507
agagagagagaaggagagagagagagagaaggagagagagataaggagagagagataaggagagagagagaaaaagagagagaaagagaaggagagagagagaaaaggagagagagagaaagctgtcttttgcattttgcatcttctacacaagaaaggttattgacatcttgacttcatgaactgtgctccatatttcacccccccaccctttttttttccagatttcaacatctgcttctctcattcattccaggcaatttcaacgtagcagtaggtcagacaatagtttatattctccctgaatctgagttcattgtaagtgatttaatgtgacaggagatagaaaattgtattggcagactgttactaaacttaattactcaccagatccaaccccaatcaattaactgcagcattaaacaacataaattctgcattagccacaatgagaaaagttgcaactcctgtttcttctcagttaataacttcactcctttcatttactatgcagagtcagagccactaaagctgtgtcaatttataataactgtgcctgatatttatatgacaattgccattttcaaagcactttcatatctactaactcattcagctccgtcattcaataactcattaatggaagcaggtaacattattgccacttttcaggtcaggaaaatgagagttggagaggtcaatggctcacctaatatgacaagcttaagacatttcagatgtcagacaagtcacataacccttggaggttagcaactctaggtatactttttcagaaaactcctaaacagaacacacgaggaagccaatgctccctaagtgctctatttcttctcattatctccttgccctcacctaccattgccaggagcttggacttgtgtttatcagtcactctgccacccttctcagccaggcagcctcacatactttcagtccaacagtatatacttttatccccaatgatttttttttttctgtgcctctaagcttctcattcaacactcattcttactctgtgaactttacccatcatatttgtcccatttctaactttgaaaaacattcttatctcacttattccaatatgtctgctcaaactgaccagtttattttgatatttcttatttaaaaacgcctaaatcacacccctgttgtagaaaatgaaaagtgtgactaaaaaataagatagcacctacagtttgtcaggcacccatcagagacctctgcaaatgctattctcattgatcatcacagaggccgtttttgatagaaccagaaatgttaaatgaattggcaagttccactaattcagccacctgatgtgaagaactgactcatttgaaaagaccctcatgctgggaaagattgaaggcagagaaggggatgacagaggccgagatgcttggatggcatcaccaactcaatggacatgagtttgagtaaactatgggagcgggtgacggacagggaggcctggcgtgctgcagtccgtggggttgcagagagtcggacacgactgagtgactgaactgaactgactaatttagtgttagttttagaaaccagattaaaacactactacatctaaaagtaataataaccttgacaaaattactgttaatgtttttctcatatatcagagaatgataactgacttatactcgttacagaattttaaaatcacaatgcgtgttcagttgctcagtcatgtctaactctcatggttgtatggactatagcccaccaggctcctctgtccatggaattctccaggcaagaatactggagcagattgccatttccaactccaggggatcttcccaaccaagggactgaacccacaaatcacaataataatcataaataacactaaccccactttatacataaataagtcacaaaggagttaatcacactactcaaagctttataactcgtgtgtagtcaagcttgaacttgaaccaaaccaggtgattttatagctcttgaacttttaatcatgttcttatacttcagagaacatatatgtggcagtacaccatgatttattatcaaatttattatcttctagctaatacattctgtcacacattcctgaaaatggaatagccttgaaacttaatactttaaaacggtgtttggaagtctcctaaaataacactaatttatggaataacttggtaagtgccaagtcttatatatgcatattatatcaaatcataaattctgtgatataattttgagtattgaaattttataaacagaaaaaccaaggtctctaattacacagtaataaatggtcaaaccacaatctaaatcttgttctattgctttcaaagtccctattgttcattcactatttctcacaatctctcttgcattcagttcaattcagttcagtccgctcaatcgtgtccgactcttggcgaccccatgaatcgcagcact

SEQ ID NO: 38520 - DNA, 2217 bp, Bovine  19866880825056
caatgagtcgactcttcgcatgaggtggccaaatctcttgcattaacacatggttataacattgttggcaactgatatatacttgatagtggaacttcagtctgattttgctgaaactgaagaatccttcttgtatgataacatttttcctaaagatgaattagagaaagttgtggggaaagccttttctctacccatgatttgtaattcatgttaatgaaaaatcctactgggtataaaatgaaaattacaattaattatctatttggagacttacttattttgaaaatagattatgcaacattaagattctctaataaatgtgaggactatggccattatatgctcagcagcccaagcttgatattatagaaatgattaatgaacacattttacaaagtttaaggaagataggaagaaagttcctactaaacatttgttaaataaggagttaaaatattctatacactcagtttaacagtccatgctaaactgattaacattcctgcctttagcatttcaccatatttaaaaaataaaattcaacaagcatctcacattttttcaaggcaattttctctttttcatttagtaaattattagcagaaaaatgactaggtgagtccaattctttgtgtctctctcattatcagaaagtaactacattatggagaagaaaaacagatggaaataatacaggatgcactttgtatccttgtatttaatatttataaaaatcctgcaaagtaattattattataataaattaacatttcatgaaattgagccttagaagtgcagtaacttgtcagacaatgaagtagtggtagagtggaatgggactccagggacatctggtttggtgacagtgatacgccctctctttcaaaaggagtttgaaatgcaggagaccttggagaagggaatggttggttacccaccctagtatgcttccctggagaattccatggataataatgtagtgtaagtgcatcagttaaccatgttcagaaaatgctgagtaacagatcactccaaaactcaggcttaagacaagaatcatttatcttcaaacatctgcagagtggctggtctcagcagctcgggcctgaacttttctgtagcaaatgccttccgaaagtctcttatcccccttctggaaggagcaggctagtataggcatgtctggtgatggtagaagcatatgcattagcaacttagttttaccagtgctttgcaccatatttctaatatcccattggtcgaagcaaatgcctctggtgagatattacatggcacacatagttgtaggcactgtaaaatcacttaccaaatggcagatatagagaaagatggagaatcagagtccaggaatgcaatttaccacaggaggggataaacacttttacatcaatagtccactgcaagaatgagtcaagaactcctggaaagcttgctaaaactacaaagtttgggctacctccagagtttaaattcctttaaatatttattttaacaagtatgccagtgattcccaagccaggtgtccatactctgagaaatgtttctatattcagccccataatagttctcacagaaatgttttattcaatgtaccaacccaagacctgttcacctaaaaatgtcacatttgtgactcaataatcagaaactcagtttcctactctaggtcgagaaatgccattctttaaatactttaatttatttgtttatttgttgtttatactttaacgatattttgataccattccaaatacaacagttggttgtcgaagatctggtaatagccaatctgaaaagaattatcaatatgcaacttgactttggattgcaaggtaagacaatgagaagagacacatatatgaagtaatcaattgacagatttctctttctacttatgctgatgctttcatgtgtaaaacaccctaacttctctgttatattgataatgaaaaagaaaagaaaaaagactggccaaaatagaatttgataataatatgaaatagcaggtgcttaaatttcttcaaaattatttctgaagctctctctttcaaccaccccttttaattctgtgattttatgaggaggtatgaactatgaggtgctggtctctaatgctttgtatctgttagactttcctccagaaaattgcaggtttgttgttgttgtttccttttcaggacaagagtcaacagg

SEQ ID NO: 38521 - DNA, 971 bp, Bovine  19866880834075
atggcttcgtgatgtgagctctagtgatttctcatgtctggttctggcaccatcttcctgtcctttctatgctagattcatgacaatcccctggtttgtgcaactttttctgtctcacacgacgagctacaggaagggaaatcctgtaaatattcctttcataccagtgtccctaaaggggagatcctgcatatagatgcttttcaacaagcattttgcaatttcagtacaaaataagaaaaatcaattctatgtatttgatggaggttcccagaatcaatctttaacttgtcaggaaacactttattgtggttgcttaatataaaactctctaacctccgtgaagaatgcaaaaagaaagatgacaaagtattaaacaaacacatttagagatgcctggggctggaatctggactaaatagatttagccaaccttgatggaacatgagaaaatcaaatgtaggaaaaaaaaaaaaaaacgtccaggcatctgttatctttcctagggaccttaggcttgaattaatactgactgttatgaattaaagttggcaatagactggagacacagggagtcttattcattttattttatttttagtgttattattaggagaactagaagaaatatgaatgttcttctgtggtaaaggatcctgagagagcaaagatctgacactttaaaaatgatcaagccatttgtatgtaactgctctcatcttttataggagcaagtatgaaatgaagtttctgagtcttggaaacccctagtttttatcacttattgtgtaatgaaagaagacaccatcatatagacaggagggaatggttgaaaggagtcatttgtgacattttgtagtatagaatattaagctttgcctggagttggttcccaaatattgggggctgtggatacaataatttacaaatacaaattctggggggccttgtcctcacttaataatcagagc

SEQ ID NO: 38522 - DNA, 1496 bp, Bovine  19866880843227
caagaggactggagtggggtgccagtgccttactgtttgctattaggaagtgcggggcattgtgtgagagtttgtcatttttcattctcatctggtatcattttggtttcacgcttgacatgggcaccatgtcctgtgttagcaaggcagccaagatacggtgagtctgccattgtgtagctgtttctcttgattgctggcagactggattaaacaggaagtgagagataattttgttagccttaattagggcctgcagtacatatgttctttttccagatgcgacaacctgatgaaaaaagcagcagaaagtcattagaacaccggtaaataaggcactgctaaagatgggggaaagaggcaaaacatttggaaaacagattacctttgtttgcaagttgaaaagaaagaggcagtctttctgaagaatctgtgaaacttatatgcatagttttgagcagttacttgtcattttctagttttgttcataggttaaaaaaatgttggtatataattagtgtgttttctgttccagatgtaacaaatcatgacagcatttaatttgtaaatctggatgtctgataaaataattatagctactgctaccatattactgagtacttcagtgtgcagcaagcaagaatttcagagtccagattttgcaacattttcaaatgcagtccccttgatgtcctgccacagatcagtattatcatgccattatattatggaccagaaaactgagacttggggcagttgagtgcctcgcctgaagtcacccagctaacaggtggcagactccaagtgtaagtcttgtgtgtgttttgggactgcatttttttctctgtgttttaggactgcagagatgtcacagggagtaaattgcaggccttagtgggtacctctctctttcatagaaaaatcctcctttaagtctctcacttttaattattactttcctgtaagaatttatgataggcattgacagggcacatttagcaaataaatcacgtatagcatacactgactgcagtccaaggggtcacaaagagtcggacacgacttggccactgaacaagaacatagcatgtatcgaatataagtagttgaacaagtgcaacaaagtccatgccagccagtttccccaccgagcagcatataacagaatacctagcaggacagttttgttttattttttgagtaaggaatatgttcatcctatatttatggtcatctagattccccaggtcagggtaatcttatctctgacccgggaatctgaagctggtctcttggaaacatgaaataatgtgtatatccctgcagtatctagaatcataagctttaatgatctatccattaactttctccctaggtcaggaattcttggtctttgatttagctcataagccacatactgaaagacattgtcccatgcctgtaagatgttgccactcaggtctgtagttgagtttttcaaagtcaattccacaatt

SEQ ID NO: 38523 - DNA, 1065 bp, Bovine  19866880869236
ttaattagtaagatttatagttccttgtgattagagtctatggagatatccttatttctgctgtcccatgaccctgaatattatggtcacataatgggcttttgacaaaaattcattcatcagactagaaatgatcattcttacttacatgttgtttacaaagcaacagtgtaaaattttattaagctaaatagttcatgtatattttttcagacaaatgaactatttagcttaacataggaatagaagtctttcataggttttgactgttggtggtttcatgttttattgaaagcatttaactatatttcagcaaggaaaacataaaagaaggttaaaaggaacagtcttttagatagctaggtagctagtgtttgacagcataaattgaatctgtcccttatcttataaaggcagaatacactgagaatgaatgaagaaaattggacttctaaaatgataaaatattcaataactctactggaacaaaatcttgtttttcataacttgatttctaatcaaatttatgttatgtgaaaaaaataatactgcctagaaaacacttcagtctcctgcttcattttaaaacatgacaaaaacaatagcactgtaacaattggaaccactaattgggtttctgcactgtgcccacttttgttctaagtgctttgcctgtttccttgcatatcgtgacagtgccttggtttcacaggcaatgaaagtgagtttgacaaagatcaacaaatgcccaaggttctcagcaagtacagaacagctctgcttgaactccaaggtctctctgatctgaaagctcgtgtgtattccctatgttagtatttcccaaactgtcattatttatcaggcttccctagtggcttagacaacagtgagtccgcctgcaatgcaggagacttgagttcagtccctcagttggggagatctcctggaggagggcatggcaatctactccaggattcttgcctggagaattccatggagaggtaagcctagtgggctacagtccatggggtcacaaaaaagtcagataagactgactgactaaca

SEQ ID NO: 38524 - DNA, 2060 bp, Bovine  19866880946590
tgaaattcttaacaagctgaggaggaaagttgaaccttcccttcttaaatttataaattctcaatctttgtttttgtttactgtcccccatcagtctaactaatctacttttctgctttgttcaagcaaggaattagtcacaatttaatctaagttttaaaatgttcatgagcccttgaacttgttttaactattaacgaaagaccatttagttcgggatgttcaaatgttatggtttacccaagtcttttcattaagacaatgcacagaatttctatgatttcagaaagagaactccctcttgtggcaagagcagtttttgcagctaattctagagaatctgagtttctgatgctaaagaactgggtaagatcttagaaatccccttgttttacagaggaggtaactgaaacccgaagaggacaagaagtaagttttcagtgtttatatctggttggtgactgagccagattcagtacccagggttgctgtctactagtcaggtgctatttctctgtatttcagaaatctcactgatgtgatttttcccccccaaggtcctgctttatgctgccactgaaagcagagctgatagagatgtcctcatgctgaataggcaatgttctttcccacatgaaagctgattctcggtgagctttccctatgacacaattaaccatttctcaacactgggctgtaagctacatgccttacacctgagagcagtttggcccagaagacaaggattctgttcatctctttggggatagctgccatctagcatcacttagatgctgcttcctgtctaattctctttcataggttttggcttattggggcaatgctatgctgtgcttagtctctcagttgtgtctgactctttgcaaccccatggacagtagccctccaggctcctctgtccatgggaattctccaggcaataaaactggagtgggttgccatgccctcctccagaggattttcccaccccagggactctcttgtgtcttctgcattggcaggcaggttctttaccactagcgcaacctgagaagcaaatgctcactagtatatggttaaaacataagaaatatcaacatggacatgcaggagagcaccaacagtggactgaatatcaaagaacttggcaaatgtaccatatgttacagagaagttgcttttccttggaacattctctatgcaaaaggtcactaaagataattccgtatatatttctggtatttagggcttccctggtggctcagatggtaaagaatacacctgcaatgtgggagacccaggttcaatcctgggttgggaagatccctggagaagggaacgactgcccactccagcattctggcttggagaattccatggacagaggagcctgtcaggctactgtccatggggtcgaaaagagtcggatatgactgagcaactttgactttacttcaggtatttatgggcacagagaagttccctctgttggaaaatatgtctatatttttaacaattagagttcaaataacttataattcctctacaaaagttaagaggttgaggataggacgttttggaagaataaatagcagtcaaatattgaaatcccgttttacccttatgtaattgtccttcagtttttccctttatattgggtactcaaagtagaatctgtaaaactcaattcctaaatatatagaacaatggttattcctacaaaaatgagttcagaaaactttattaaatccctaagtatggtgagctaacttgatggaatttgtaagtatgagggagagagattaatataaggatgatctaattaaataattgttgtgttgtaagttatgagctttcaattaaataaagtcttaaattattctttttgcctctgctaattagtggattttgtatttgcttcagttaagcatgaagactgatactagtacagtcttttcacttcagggactgaatttgcaattttcctagtcttctgggatttaatgcaattaaaatgaaattgaatccttagcttcatccttctgagggagttcactaga

SEQ ID NO: 38525 - DNA, 1066 bp, Bovine  19866880953695
gagagtgccttcagtaattaccaaaggaactggagacctccagctccttccaattaacttctgttcctgagtgctgttaactgcctgcctgacagccacacacagatgggggagaggagtgcacacaagatttcgtagttcacagattaaaggcagtgtcaagagcaagtcagagttgagggattgatttattcggcactgagtgtccagggaagggccactttggagtcattacaaacaaggctgagctgctttcatattatgttctacctcttggtacacaaaccaaacaattttttttttttttcccatctagatgcatttactctgagtttcactgccagaaaatgtgactagattcagctttcttaagtctcagcactcataaccgtaatggtagctgttgtaaccactctggctcaagctcaaggcttgccggggggagctgctgatagtgggaacaagttgctgctagacaggtcagagaagattctggaagacttgatctaggcaaagttccagactgccagacacaaaaagatatcatagcagcacattagctataataatagttatgctataatggcaaccactgaaatatcatctgcaagtgttaggcctttccagagctgtgtgtgtgtgtgtgataggcggactatgcaaatgtctcacgcctcatcaaaatttctccctggattagcattcatcgatgattcttttctaatccagtctttaaggatacaaactgttaactttctaacacaaacacttctttcacattaaacaacaagcccttgacattttactgtaagcaagaggtctcccttccccactgattgactgatttggtctatttattatcagatatggtgaaattaatacaaaatttctatttttcaatcagttctttattgcacttaattattttcaaattgctgtgttccagttgttctagatttgttgaatagaagtcctgtcatgctattttctgtgctgttgtgacacgttttcatcttttctgaagcattccctagcttcctattaatagcgcaataagatatttttt

SEQ ID NO: 38526 - DNA, 1151 bp, Bovine  19866880954162
gggatcttcccgatgcagggatcaaacccaaggtctcctgcattgcaggcagatccttcaccttctgaactaccaagaccctttgaaaagccattaacagctattgtttgcatttcccagatatgtgatttgataaacagttctctctcaacctacaagttaaattgactagctataggatatcatagtaacatgattgtatatagataaagataatccctaaataagactcaacatgaacaaatggcacataacaagagtttaggaatgctgtataatgcaactggcatcccgtgtgtgcgaacaagagagacgtgtgaaggggctcagcagagtgagcgaggggcagatgccagtctgagaaatgaaggtttatgccacactgcagctccacaactaatctgcaaggctgctgagaaaccagcctgtgattctcctgtcacttcattaggagacatatgccatatatcatcaaatattacaccccaaatggcaagacgctatgagacaatagctctcgtttgttttttttcctaaactcacataccagtccatgtgaaagatccttagtgactggaaatgaaaaagaattcaatgaagagggatacaaaatctggggaaacaagaaagcatcctttgctcctttgagatgactgtataacattggtggcactagtggtaaagaactcacctggcaatacctgagatgcaagagatgctagtttgatccctggatggggaagaccccctggaggaggaaatggcaatccactccagtgttcttgcctggagaatccccatggacaggggagccttgcaggctagtccatggggtcagagttggatacgactgaaggaacttagcacataaaacacggaataccagaagtgataccttaattgcattatttttaaaagaaatattaaaatcatgcttcctgccaaaccttgtagataaaaggataaataatgtagagccttgaactcacaattctctagtaaagggtacagtataaagatccatataaagaaaattcagttcagttcagttcagttcagtcgctcagtcatgtccaactctttgcgacgccaggcctccctgtccatcaccaactcccggagttcactcagactcacgtccatcgagtcag

SEQ ID NO: 38527 - DNA, 1107 bp, Bovine  19866881011337
catttcgaagaaggtacttataatgataagagaacaaagattctgcagagttatgaaattgtagttcacttaatacattataaaactgggatgagaatctgcttttggcaactgcataagccattctttttctacaagataatgttgagcattaagtttttaccactattagtcttacataattatggttaacttaggtccaactctgctgatgagtcagcagataacttctcacccaggactgggtgactggagactgctcattgagaaagaaaacagaggaagagaaacaatgttcgggtatattaggttttagcgtgttgagtttgaggcaactgtgtggtaggcaaaaggagattttccacggagctgaaaatatgagttcaacattcaggaggtaagtgtatgccagagatggagatttggggaatggtctataaagctggcagctaaagccatgctagtcaaagaggtccctaaaggagaatatgtagactgagaagagtgctaaaaggtcgttttatggaattgagtggagggaaaaaaacctaaaaagaggattttgataaaggtcatctaaagcagacaggaactaagctaaaactatagtagaggataagaaaagaaggagtttcaaaaaggagaaagtggaatatattaaattgaggtaaggaatgtccattggatatatcagctaggagttttgatttatcaaccacttggtaattttgaagttttagggttatttcagaatagctaaaggatgtttgagttgagagaatgttaaaagtacatcaataaagcaaaccccaggatgcacttttaagcaacttgaatggagtataattgacatcatggaaaagagtcattctctagcctcaaactctgacttgttttgctatcatgtatttattattatttaatatatggatatgtgtgtttatcatctgcctgcttatggtagaataaaagctcataaaagaagtcactttatttcattactactacatcctcagtgtttagaataagtgaaagttgctcagtcatgtccaactctttgtgacctcatgaagtgtagccctccaggctcctcgtccaggaattctc

SEQ ID NO: 38528 - DNA, 1284 bp, Bovine  19866881016139
gggcaacagaggatgagatggctggatggcatcactgactcgatggacgtgaatctgggtgaactccgggagttggtgatggacagcgaggcctggcgtgctgtgattcatggggtcgcaaagagtcagacaggaccaagcgactgatctgatctgatcttaatttacttattactgcttaatattgattagacagaagagataaggaatcaggttttgtaattaagcatcttgggtttgaatgccacttttccattcactagcttcaagtccttggacaagttatttacatcactttgagcttcactttcctcatcagtagaaaagcatgaaatggcaacaacaaatacactatctcattggtttaatgtgaaaattattattgtgcataatgttacaaagtatgttcaataaacgttgtatatttactacactttcttttttgttgttacacaaaagatacctctaactctcgaccttggttcccaggagtggtctgtcctagtttgagaaaatgaatgtaggtgatgagagctgcttctggaagacgtgttctctcttccaggccctagctcctcacatatagaaacaatgatatactctatatttgcttcagagaatgatgcagaaacgtcccattcccattcccaagggacatggtgagacctagggagatggattcacagtttgcttttagtctaattccttctttctctggactgctcatgtttgtttctcttttaaaaagtcttccaaatttgtccatgcctttcggctatttctgctgtccaagacacaaagacggattcaaacacagcagtgacagctggagagcttcatattttcctttgggagatcccattggtcagcgaaatggaaaatgaaggcatttttagtcatttccctaaagtgcttctccaccatcttcatggctagtttgtttgcccacactgttctagcagaggtctgttaacatgatagcagaacatctgggggagatatttagatagaaaggagttgcaggagtagcttttattgttattaatgaaagtagctcaccatttggcacaatgtcctatgccttctgagggctgtataaagtaatgcctgattgcctgcgacacacttcatccccggagttcactgccaattaaaataataaataagcaacactaaccacagatattagagggaaagataattgttcttccttgtcaaataaatgaagagatgatcatgaaccagagaggaggactagagaggtatatgttttattctcccatg

SEQ ID NO: 38529 - DNA, 884 bp, Bovine  19866881057278
aaatactggagtgggttgccatttctttctccaatgcatgaaagtgaaaagtgaaagtgaagctgctcagtcgtgtccgactcctaaggacccccatggactgcagcctaccaggctcctctgtccatgggattttccaggcaagagtactggagtgggttagtactttttaaaaatcctgaaataatgataaattgataatttgttgactgaatgcttaccatatgccagatatcatttgcatatattagctaatcaacttgagggtcaaaatcattctaggattatgtctattttacattaaagattagggacattgagaaactttttcaagaacacagagatggtaagtgaaaaaactttcatatccatgcatgctcacatctgactgagcacagagcctgttttggagtctgtatatctaggttttctgacttttaagatcaattggaaattaagatttttaatctctggttgttgaaatattggctccgttttctcccaagcactgaatgtgggagcaaacaaacattttctgggcagcattcagcctccaagctgactgtttgcaatttctgctgagtctaacgcttacagtttacactaagagcataagcatataagttcagcaagcaggttaagaatatagaaatagagcctggtttcatgttttatgtaatcccatatggtattctcttgtagttcattataaatattcattgtatacattttatgtgatgggcactatgctggatactaaggattcaggataacagatataatcttttttcccttaaaagaaaaagaaaataagcaagtaagttttatgcagtatgaattctacaatataataatgaaagggaggttctaagggcaaaggagca

SEQ ID NO: 38530 - DNA, 1867 bp, Bovine  19866881067447
ccttttatttttcccctaggacagaactgtcatccaagtactttatgaaaattttgggagcctctcactatgtttaatcaagacaacactgtggtttaacaaactatagaaagtacttcttactgcatgaaattcaacttctacgttctccaaacttacgtctctcagactctgagttccagcttctaatttctagttctcagaggcagagtgttgacctcttgatatttgacccctcatttttcgtccatgtgtttcctttcacagcaaaaggaagtgtgtccgtagttacatgtactaaccagccaattttaaaatgaaaagattattctagattttggggagaaataaattatattctagtgcaatataatcatataaatccttaagagacaaaggaggaagacagaggaaaaagtcagagagtttcaaaatatgagaaacacgaccatgttgctgacttaagatcaaaaattcatgtgacaagaacaggacaaaaattgatttctattaaccagcaatgagcatggaagaaggtcacaagccccaggtgagaactacagttcagctgataccctgaattcagatttatgagctttaggttaagaatctagccagactatgttggacttagcctacagtatgagataataattaggagccttattaaactactaaattctgggtaataacaattaaaaaaaaaaaaacacacacattttgttgtgtgaaatggtgagtatgcctataccctagcatatccataatagtagtatagactttgaatacacataggctctgtcctgaaatctggctggaaaatcttatgatgcctggaatctcttgcttgtcctcctttgtgtgactctctcctgggctgttttgatcctttactgattatttaaccagaatttcatgttagtttgttcatacacatgtaccactaatgtatatagtcatcttgaggtcaatttttaccatgcgatcacactggacctatttctgtctttaggaaacagcctatacaatagccagcacctatcttaaaaaaggtaatacttgcaaaggcgaataatttttcaagccataaaggaacaatagtatggaacataaataactgagaatgtggatcatggtaactgatgtcaggccaactagtttatattcagcatcatttatctcttggacatgacaaaccttggtagcagaagggaataagttccagataatacacttttgaagtaatgaataacccttcctatgaagtactttaatgactcttctcatcaaatttatgattttattattaacattaaaaatggaagctcaaaaagatacagttgcaaatcaatttcactgtgccttcataatgagtccctaattgaactcaatttctgttacagttgtgaatttccttccatacttaattttaatgacatgtatagaaggatttagtgactgggaataaaaaaaaattatttaaactctattttttatgagtttaataggtgaaatgtaaatcataatcacattaatatgataattgagagtgtatttatgcctctttacaggttagagaatgatcacttggttaaattagtgtttcaattaactcattaaaaatagatgataagtaagaagaatactttcgccacctgatgcgaagaactgactcattggaaaacaccttgatgctgggaatgattgaaagcaggagaagaaggggacaacagaggatgagatggttggatggcatcaccaactcgatggacatgagcctaagctcggagagttggtgatagacagggaagcctggtgtgttgctgtccatgaggtcagagagagttggacacaactgagtgactga

SEQ ID NO: 38531 - DNA, 809 bp, Bovine  19866881327525
tcaaatgtattttttcaaaatcagtagcagttggtttttaaggtgtatattcatattctattagttaaatgagttatgccaatggtaaatataaaactccttaaagttaaaaaacaaaacaaataagccacccaacaatctgacaaaacacttataaagcattttgtgtaatagaataactcaattgaaggattatcttgccaatactcattaactcactatcaatacacataatgattcaaagcttttcaaagcacataatgctctagtggtctataaaacattaatatatatggacagaattattgtatcatgacacaatcattttcatttaaaattccagagttgatgaattttgatctctgctacttctaccaaaatcatcacaataggccaattcttccccccctggaattctcataaaatagttgtttttatcctattaatttcaatactaaaattatcttaattttgtattttaatttttcatgtgctaatgaattttaggttaaatatctttcaaagtagatagattagtcttgtttctaaacatgggggatattaactcattgtatccatattttgttaagctcttgtgtgtcaagagaccttcctgtgatactcatatcatctagccttttacctcagctctttgtgaaattaaattactgttacagtttcatcactgacattaaaactgctataagctaaatatgtgtagttatttcactgagaattctgaagcacacatcctacattagaggacatatgaatatctatattgaagaatatagaatgaaagaagaaag

SEQ ID NO: 38532 - DNA, 1840 bp, Bovine  19866881352831
tgaatccccagagactgctaatttctactcttcagcaatggaatctttacatttaggtgggcttgtgaccatcaaacatagatgtcatctttttatgcctccctagcagccaggtaagctcctttaattagttccagttaaataaatataagaaggaaaagagatatgtgcatcttttggagctaatgtgtaaatggtggggtcaaatttctttttctctgttcagctctttggactgcatcccaagggtaagcacagcagcaaaattggaagcagcctgcttatagaccactatggccctgcagtattagattagcattaacctctttatacttggatttaatctttaaaaaataataatacttctgcttttgttaagccactatggagtctctttatggagccaaaccaaaactctaaccaatatgatatgcaaaaattaccttcgtacattttaatgcaaaatataaacatttgggatcctaggcatgtgactatcctttctgtactcatctgctccgtggcattaaatagttgaactttaccttacagtgtcctagccgaactactggattgaaggacagacagagggtataaaagatacaggattttaattatacaaagtctcttggagagagagagtgaaaggttgaggttgagaaagggcatggagagaagcagagagacagggtcagagggagagggagagagagagagggagggagaggaactgcaactgtgaggtttggtgaaaaaacaaaaactgccacagaagatttaagtctcaataaacagttttatatgcaatttccgcaaacatattttcatttgctataaaacagcaaacggcttgggagggaaaagccagaaatatgcatagaggaaaaaatagtcttaaataaatactggcttgcaaaaaagaaatggcagtctatattgaaatatgtttatcttctggtactttaaaatgcaataaatttctcccgacaaacaataatttggtctgaggttaaaacaaattcccatttagtcccaggaatatgtaatttcagacttttgaggatgaatggttgtttttgcttagatattgatcattagccatgtaattctggctggactaggtcacttggactttgtagttgtaatgaaagaaattgcattaatctgattctttgaaagttaagcaaagatatctgaaaaaaaaaagaggtattaaaagttataagtcaaaagcaaatacaattttcattataaggaaagaataaaaatattttaagaaaagaacttcctttgggacagggacttaaagtgaaacatggcatgatatatttgaataattatgacttgtaatagagtttggctttatactcccaaagcattttaggttaatgagtaaaatctcagtaagatcgaataaaacagtaaatcacattgtactgattctaaacaagaacagagtaatagttttatatacatatatatatatatgtatgtatgtatatatatatatttctgtgtgtgtgtgtgtatatgtgtatgttactagggcatagggcacacgtgaatgttgaatttcacaacctcttttcttgatgagcttatggactaatgaaatatatagaagcaaataattataacatgttttctgtaaggaaggctgtaatcttaaattttatttataactcatatagttctagagagaagttaagaaaacaaaatccccatgatttgaaaatgaaacaaaaaatgtaattttgtttattacaacacttcagtaattaaaaaaaacaactttgtatttaaatgtccaaaaaaataagtcacttcaaatcaatgcatc

SEQ ID NO: 38533 - DNA, 4214 bp, Bovine  19866881363837
aagtctattgaagctaaaaggcattggcctaaaggttgaaactataccattgtacataaaatggcttatatttgaagatgactctgcagacataagtcttctctgatggcttagtggtaaaggaccagcctataatgcaagagatgcaagagacatgggttccatccctgggtcaggaagaccctctggaggaggaaatggcaacctgctgcagtattcttgcctggagaatctcatggatagaggagcctagcaggctaaagtccaccgggttgcaaaagctcggacacagctgaacgactgagcgagtacagtacagacacaaaacgccgcctctgtcggtgttaggctagagccaacgctgaggttagtgcctagtctgtcctcagcgctctcagtctccttgcaggtggcacaaaccgcctcttcctctgcttgacttcagcgaagagctgtgttccctggtcactgctgggccactggtgatgctccctgataatcttcatctcctctggttgttttcacttaccattcctagtctctgtggcctttttcactttcaaaacccttaatcttgacctatccttgctcatatgtcagatcactctaatttttctctcagaagaaaacaattttttcaacatttattaaggcaaaatatgtactaagcactgagctcgacactggagaagccaagattaataaaacattgctctgccctcaagaggtgctaggtggaaaagaggggaaatatcatatacatagaatgcacaatgtactaggcataatgctccaggcttcacgtaagtaattttttaatctgaaaattggtttatctgactcctctgatctccctttccccattcagctatttgtaaaattaaacctttttggttacccatatgcctgtttatttctttgaaagtgttgagtgagaaagagaaggaggaagggaggaaagaagaaataaaaaagagaagaagaaagaaggaagggagagagggcaagagaaaaagaaagaaaggagggaaagagagagagaaaggagaaaggcaactctgttggaagcatataataaggttaagagtgtggaccagtcagtcaaagtgcctcacataatttttagcatggtcttgaggaattaaggatgagatggctggatggcatcaccgactcgatggacatgagtctgagtgaactccgggagttggtgatggacagggaggcctggtgtgctgcaattcatggagtcgcaaagagtcggacatgactgagcaactgatctgatctgatctgaggaattaaatatttttaaatgaatatatgccaataagtatttttatgagtgtcagacatgactgaattgacttagcacataaaaggttagttattcaaatagtgttctctgagacatttcttaataaaattcttcatctatctctccttctctccttccaagagttctctagatttgaaatttgggatatcattcccaactctatcctagggctttaaattcatcagtaattattaataaacccataggaacagcaataatcatcctgtcctctctttatagagctcaatagcccacaaagtgctactacatacatcatctccagttggagaccatggtgtatatataatttaacttcatcactcagaatctttcagtaagggagacttgaaaaatggatagtaagtcatacaatggtgcctattttaaaaaattttttcaaaacttcagtattcattttctctaatatctggtacttccaggctgtttgaattttctgatatactttataacctaagcctaccattttctccttggtttcatcaattcagagcttttgccagactgtgaaacaaagacacagtaaagctactaaggggatggggggaggaattgcatattttttaaaggcactaaaagtccaaaccataaatatctgagactaagaaaccttttaggccagtgatgctgcagtcttctgaaggtggagcagtaactgaaccaacagagccagctgcttaagaatataatgcctattaatatccatttaatatctttgccctgaaaacacaatttgcttttgcgtggatgctgtggttgttcccactgaaaagtaaataatctctcctctttggaaacatgcacttaatagagaagaatccctcctatggctgaagtaatgtgtctccccacacatctgtagttctacggctaataaaaaggattatcaggcaaatagaaatatagtttatagttgcaatagctcacatcattaccttttacctcaatacgtaaaattaagcatttatgcctgaaaactacttaaaagccagcttttcagattccgtattcctctgacattgtataatgaatattttgtcatagcaagtaacagattttattacagctctaatgcttaaaattccatctgtttccacaaacagaacatgaacacaggaaagcaaccattaatcttaaaaggcactaaaaaattatcctaataaagggattctaaaaaaccttttaaagtattcaaagtctgctaattatgggatgctgtgtgtctgacaccttggtttccattcactggtccctcagagcccatccatgttaattctatagatttttaaggcaatttcaaagcaggaaactgcctaatttggcagtaggataaacaagtttcatttgctatttcatctacagttttgcaaatgcaagacagcatacaagggacttgggccacagagccatgcaatttatttttatcaagatgctcattccttcatatatccttcaaatatttattgaacaccttctatgtgttgaacactctgccctgaaaatttttaaatgaaattcatagcctctgttctaaactaattcatagttaagtggatggttggcagtaaatatgatactctctaatgagaaggaaatcaaggactatttctccaaataggtagcatatggggaaagttttaaataatgaagaggttttaactagacaaaaacgatggcttcccaggtggctctgtggtaaaagaatccgcctgccagtgcaggagacacaggagactcaggtttgatccctgggttgggaagatccagtggagaagggaatggcaacccactccagtattcttgcctggaaaatccgaaggacagaggagcctggcaggctacagttcatgaggtcacaaagagtccgacacgactgagcgactgagcgcacacacaaacaaaaaagaagataagaactatattcacaattatctaactcaactcatatatcctctgccatttaaaaatgagaatacaaaaaccgaaaaaagttaagtgattgtcataggggtattctgtaaatcaatctgcaataggcaatatttagcccactgttagcacattctgtttttcatacacacaaacacacacacacatgtatacgtatatatgaatatagattactaattaataatattactggcaattgcacttttgaaatatttgtttacaagtttctcaatcaaataattaaattattggagttatgattctacattttgggggatgtttttaattctcaattataattgagagtcccacttagctgagacataaaatttgtaaatgatgttatttatgcttttatttcagaattaaagaaataaataattagccaatgaaatgggagatcatgaactttttaaggacattgtcatttgtgacatttgtcatttaaccatatcttggttaaataacaatggcatgaagtgataaatgcaaataaaatgtatgcaagacataatcatctcacttctgtagcagatgaattcctggactactttcatgcatctattttctacttagaattctctgagatgttagcagctaagatataaaatatataaaatatgcatccagagtatacaagtatatgtttaacaacttgctttcagggcaaaatgctctgatttgtagcatttctcaattttgtaatataaatactcatggtgactgattttaagccaccaatataacatgaagcacaagttggaatcaagattgcgaggagaaatatcaatagcctcagatacgtagatgacaccactcttatggcagaaagcaaagaagaactgaagagcctcttgatgaaaggaaagaggagaggaaaaagtggtttaactcaacattcagaaaa

SEQ ID NO: 38534 - DNA, 1019 bp, Bovine  19866881424828
tataagcagagtatgtcatgtgaaataccaggctggatgaagctcaagctgaagtcaaggtttccagaagaaatatcaataacgtcagatgagccgatgacaccacttttatggcagaaagtgaagcagaactagaggctcttgatgaaaatgaaagaggagtgaaaaaagatgacaggatgagatggttggaatgcatcactgacttgatggacatgaggttgcgtaaactccagggcttggtgatggacagggaagcctggcatgcttcagtccatggggtcgcaaagagtcggacatgactgggcaactgaactgaactttcactctctgccagtatagtgaatactgttccattatcaaaaccaaggtgctatttcgtgcgtgctataattaaacagtaataatactaatactttctatttacccagagtcttgccctccaaaatataaccaatttatttactaaattaaaaaatatttattaaggttcattggtaaaccagagtctctatcctcatagaccttacagccgtgagatattatagagctacaacatgtgacaaataaacctttactcatttaagataggtcttaacaaccaaattatgtctttagtcataattttaagaaaaaatgttaacctgaaacagtgctgattattttagtgaatttatgtatccttttggactttttattgatatgtggtattatcaagaaaacacattttagtaagagtgtgtgcttgggaaatgttaacaaattacttaagacaaatgatttccttgttcatcagggtttaaatatcagaaagaatatccaagccagttagcaattcttacattacaagagggagtcattttagacccgagagtaagactttgatacaatagttcttgacatgtgaattcatcatgttataactgtttgggaaataactgttttcctataaaagttagacatacactttcatctatatgaagtatttgaatcatatgtatcagtttcttatgttacca

SEQ ID NO: 38535 - DNA, 1731 bp, Bovine  19866881439047
tttttagacttgctgttacctaattaattacctctttatagatgtagatgttgctgtttgcttgcctgatttgggttattatgaagatcaagttataagaatgaatgtatttcaatgtgagtctatctttctctctttttaggtgagcttcatatcacctttaaacgttggaggtaagttacatcctttgtataatgtattactctagaccaaccagagagcagagatcacctttctatatttatgtcccttgtcatgcactgttttgcaatgtatatacattgatattcaattaaaaaatttttttctatcttctaccctttttgaaacagaagaaatatggcacaggattactaaaattgacaggtccaacattagagatttatagtgatagggtcaaaattagaatctgtatcttcttattactaaagcaattacaaaaacaagattttttaaatgaaaaaaataaatgtatatagagacccctaaattgtagtgcgcatacagagaaggtctacttgctcacactgagagtgactttgcagtttataattatgcttctttagtttgctaggtgaataatcttagtgactgggaatgattttaagactgtcaatatattaagagaagacaggaaagatattgttctgataatatagatttgtcccttcacagtttcctctaaataaaatgcctggaacttttgcaaaaaaaaaaatactccctactcctttatctaaatttcccatattctttatatgtaacattttgacttggtcttcttgctgtattttttctttctttagatggaatctcttgtgtgaactaatagtctcttgacgtgtaagctgcttttaaaaccacattcatcttggggccattgtacatttatcttgccttctctgacatagtttctgggccataatttaaccttccttctgtataactgatgcttacaaagcttccaaaatagctatattttattacttgaaaatgtcagcaagactgagtatattaaatgtacactctagagaagagtacttgctcatattcttctctattaatgttaatttggaaaatgttcttggatttttccctattcacacagccccatacacaaactctgaatgtagacaatgcgatgatgaagacatgattagaaataagagttttatatctccacagagaagcattccaattttaatttccatgcttctaaactcttatttcaaaaatgaatttattttgaccatttttgaactctgagtgctccttgggtcctcgtacacctcacggtccagtcctcttgaccaattagcttgatgattaccaaacctaactctttcttgatggatggtaggtacagggaaacatattgaaaacattagcaaatttgtatgaacagaataagtcataaagagacagtatagaaaatatccttctataatagatccttgtactgtcttcacaatggtctatttttttcaatgatcatgttgtgactatgtcaaatacctgttcttcaatttttctttcctgagtaaaaagtgaaaaaggcttgaatccatattaactatctctctcctaactacttctagacaatctttatagcccacaggtccaaatttactccctgtacatagaagcaattaattttacaaagaaaaaaatgaaaggagcgatggaataaaagggatttgctatgggtgaagttcagtatgccctaggcta

SEQ ID NO: 38536 - DNA, 1316 bp, Bovine  19866881460932
cattccgtcaaaatctgttgtctacattagctgagcataaagggacacatgcgtcccctgggaagcctttggtctgttcccgcctggcagccctccttcaacccccactccacatatagggaagatgggtttctctctgtgtcccccaaggaagttcttttgcttttttatatctttacctgccctcatttctgaggtatttacttttaaactctgacatccagagagggaaagaaagataagagccacatgttgtaatggtaaaaatgaaagagagttgaaaaatatatcatacagttatagatcagaagagagtccagcagagtggtaaagactatgcaagcattcctactgccttttgctttctttgattcagatacaatttgctgaccttcatttgcaggttgaccaggacacagggggacatgctgtacacaggagatctcaacaggcatcaatgtttgaccagggaccaacagctgagaacagagttgcataacttcagatgacagatgaaaacaaagcacagccgcagcactggaggagctggagtgcggccgagttactgcagcacacgcttaacttgccaggtagcttgaccccatatagtgtggtgcacgccccttagcacacaattccaaaatccggagttcgtggatattttcctggacctcgccagtttatttcagatatgcttcagtattttaatttctctgttctccttatattcctttaatttctcaacttaagtcctcaccaaggactctggatctaatttatcattggctatttctacttaaggaatctcagttcatgtacttcccatagcagagtcgctctgaatcaaacttctcatatctccagctggtcggtgcccttgtttgccctcctagtattctattcaaggagaaataggaggattcacatattgggatgtaggcacacacacaaaaagaaatacaccttgtttttttgaattggctccaggaagggtacttctcaaagagcatgtcatgcgtctaatcgttagagttgaagcacaggatccgaaaatgactcttcttcaggctaatctagttttcctgagttgtctgttttatgaccagaccagagaactgatcataaaacttaaaatgaggctaaatctgtttcaggaatcacctggcagcagatgtggagagttgggcaatttagaactttttttggtggaccattttttttttttctttttttggctttattgaattagttacaacatttccttctgttttgtttgaccttttggctgcaaggtatggaggatcttgactccctga

SEQ ID NO: 38537 - DNA, 809 bp, Bovine  19866881495743
cttcagtactattatcttaattatcttttggcatcttgatgctttatataacctacttaaaattatagcaatcatccactcatctgtcatccatagaaaaatattttcctatgtaagttattattctattttagcttaacatttttcaatgtagatagtataatcctttaaaatattcaaatttatcatcttttcctttggcctgataattttttattcaaatctggataagttattaattcttcaccgatcctatttttttttttttttattttagttctttaaatcatctcttactagtgtaggtatactattttgatctacctttcaaggattgatttgcatacttggcatttttcaacagagggcagcactttgcatttgttctgccttgtgggtgcgtatttcaaccacagaacaccaaatgttctgaaatcttgctcctgcacatacagtgaacagcatgtacaagagcatttctatggaaacaaaggatgtattttcttatcatagaacttctgggagattcttaaatctactttgaaatgcaataaatgctctttaaatcaataattttggtgaaaataataaagaaagagtgcatgttacaaaaaaaaactgaatcagctttgaaagaagatagcgatgactgattttacccaaaccttttagacaatcaattctgactgaatgactaaaccaataaggcttgaatctcctgcagataatgtaaccaaattttgcaagaattgcaactaaagctttattctatatatgatttaattttaaaaatctacattatgttttaa

SEQ ID NO: 38538 - DNA, 1483 bp, Bovine  19866881605297
tatgtggtgaattgatccataccccttatttcttgtcagtttagcactgtgatcaatgatacagtctccataactaggttactgggttcaaattctggctcctgggcaaacatagccttgggctatttactcagtatctttggattcagtttccatatctgtaaattgggaacaaaaagaatagcacctgcagcaataggttgtttggagggttaaaaaatcatggtcattacataataactatttccaatatcaacatcattatttttactcaaagcttcctctgactcagagcttcctcatctcaccttatatgattgttggcaagatttgatataatatatgcatataatttataacatgcaatggttcctataacataaacatctttcaaaaaaggtaattattattccttaaataggggagaaagatggttgagttgggtggtccagtacgaatctcagatttccacccttagagccaagctctcagtatcttcagaaagccatctttctccttgtgtgctctaaatttcactgcaaaggcaattttcaaaacagttaatcaggtcaggcttatgcatatagcttgagattcacatgtggccaatggattccctaatttagatccaactctctaacatttccatctggtttaaaagcatttattttctttaatgctctttctggggtcaatggttccccgtaaatgactttgctatttggccatattagtcaggcagtactctatctgtataaagtaacacccatttcccaccactttgtctttttgtagagtgtcttttaaactgaaagcaaaagagttgcaataattgtccctggacactatcatgttccttcctgattctttgattgtctaaaagtgaactgggaaaaatataataaagttctcttcaataattagttcattggccaagaaaaaattggctaaggaaaaagaattagcaattctgtctgtcattaaagcctcattattcaggggtccagttaacacagttttataaattagaactaagaacagctggtggataagatgaaagaagccaagtgcatttgattttctttgtactctacctcttccattattaaagaaaaacattaaattttattgttgcaaatgcagggatcaaattaaaatttggatgtatatgttgatgtcatataataaaataatactaaattaggggattgtacatgagctctgttatcacttctgtgattaactctgacctcagacaaattacttaaccttttggctttcagctttctcatcactcaaattggaataacagaacatcacttaactatatcatcaatcaataataataattaaatgtataaattcctgtgaagatactttaaaaagcataaaaattatatacatttttactttttgtggtcattatccctactatttgtaaaaatttctgaatgtagcatttacattagttatctagaaagtt

SEQ ID NO: 38539 - DNA, 627 bp, Bovine  19866881668362
acgaacgctataatctgtaaaaagcaataaaacaaagcatggttacacaaggtaagcttgtacctgcttttttctttgaacttaattaaagttaaattcaattaatttaaaacttcattttctcacctttgccactctttaagggctcaatagccacatgtgactacctgctaccataccggcctgcaagactgggaaacgagtgtgagtgtgctttgtttgttcttgtttttgttgttttctgagtttatagaaggtaggacattctgataaaaagatgtttatcttttatgcatttccaataaagaggctaattttcttctttggtaaaatgcccggtgaaaataattgtgatgatgagtcagcattttaaaagttatagtcattacaaactaagagcgctctccttgaaaagacagttgtgtcttgattcagtcaagcaagatgcccaagctcctcacacaccagatgagccttctttgaggttctgttccctgaactgctgctgttgtctgctcgactaccactgagtgtcactgtgggctgagaagcttgtacgaaatcaacagctgtgagaactgcctgaaaggagaggagaacggaatgaaaatgcacgatgatacattg

SEQ ID NO: 38540 - DNA, 720 bp, Bovine  19866881707297
cttgggggaaaaatagtgtccctggaccatgtgttttaatattcccaatttgagaaatgagaaacataaacatatttaaaatattgagatagtctttggtaaactcacttaaagcttataaatatcccacataacacagaataaacgttggaagaccccgtccttagagaagccatccattgtcttccatttgctcttctgcatatagaatccatgctgcaggcacaagtattctattaatttatagtggcactagaagtaaccataaaataagcaccatgggtcatactaataagatatgtcggttcaaagtcaagaatgccaactaatgatgatatgcctaaagcaaacacatattgataaaaactatttcaattttagaacatgacaagtttcttaaatatcaaactaggtattgctggaaggtataaagtcaaattttattaacatttatctttccaccgggaaatttactcacgctgacagtactgaacaaatttaaaggattatacaattctgtttagtttcagattcaaagacaaaactactaaattttctattatcactgttagtaagaagaatagaaaaaaattcctatatgaaaattagaccatgctcctcttctgcttcaaaacatctaatggtctttcagtttaacacaatatcacatcctataatttgttccttatttgcctcttcagccagaagttcaatatggct

SEQ ID NO: 38541 - DNA, 906 bp, Bovine  19866881931735
tttattgtatagtagggatgaagggggattttgtgtcagatgagattcctgtgggatttttagatcctgggtcgtcaaggaatagtaagtggacagctgtgagtgctgcagtaatgggagaataaaacggaatgtgaggaattgtctaagagtcgcttaatctactgaaaagccagttcagatgctttcactgagacttatgctgatatatggaattgctgcgaggaggttagtaataactattgcccctcagaacgactttgttctcaggttaagacatagcctataaatgctgtggctatgactgtaaataggtgattctaacgaagtgcagtttctaaaaaagtctaggatccataatagaaccctgatcctacaggaagaaacaggcacataaaaatatggaggctccatttccatgtagatataagataactcacctgtaatcgatgttcttggctgggtaacattaactactgctgctgctgctaagtcgcttcagtcgtgtccaactctgtgcgaccccatagagggcagcccaccaggctccccagtccctgggattctccaggcaagaacactggagtgggttgccattgcattctccaacattaactagctaagtattaatgatgagaaagtggttattgtgtttgatgtgtaatgtattgctagaaataagcctgttaacatgtgtaatgctgaacaaatgcccagtaggaactgaaatctcctcatgatgggtttgatgggctggaagagcaataaatgcattgttaataatttgtattaatgggtgtggttttcagatgatggtgattggtgttcgtatagttgaataacaatgatgatttttcatgtcattggccatggtttgagtccatgtgagaataatgataacatata

SEQ ID NO: 38542 - DNA, 1087 bp, Bovine  19866882113513
tgtacctccaaagcacacgcccagaagagaagggacggatgtaggtaaattactactttatgtaatctccttgcaggggccttcccaatcaaagtatggatattgtgctcatagtctcttctcttatacagtgtcatctctgcctcctgaatggctctcattaattctctcatcactggggaatattgccgaaagagaaaggcagtatacctctttctcatatcctggagatattggaaaaatacagtggagcaagttaggaagctctgtcagttctgtttcccccagatcttccctcttccatctcttgcaagagtgaacacatagaactgtgttgctgttctgtatttcaaggtactttgacgttgaagtgtctgagttgtttcacataaagctctttgaccttttaatgccagttcagtgatatatcttcatcagccctgaagctaaaagaagatggaataagaagcatttcagagcaaggattaggaagattaagtgaaaagtcagctcattattgagtttctacaatagccccaacacagcactagatcatgataatgaagaaggacaaaggagacatatccattgagtagtagagctacacaaagtacattcgcgtttgttatgtgctcagtacttacgagagtccaagatagacattgctatgtctattttaaagacaaggagactaaaatattgggggtgatattttactcacttcgcctcagtcagatagctagtggaattaatacctaaaccttcacaatttcataatctagggggcagggaagagggacaacaaagtgtaatttgattttttaaattaaaatatatttggggaggtgaaatcgacactaatgatgtaacatcaaacacaggtgtttcatggcaagttgataaattatataatttagaccacaaatgctcttgaaattaaggggtcatgggtggggaccttgaccattcatggactcgtgaaatgttggagtcagcaaagaagtttttgctgaggtcttgaaaatcaagatagtcctaggatgaaaatgtactatagggattggacatcaagagagaataaagagca

SEQ ID NO: 38543 - DNA, 3769 bp, Bovine  19866880339911
cttcattccatattccaagaccaaatttgcctgttacccccagttgtttcttgacttcctactttttcattccagtcccctataatgaaaaggacagctttttggggtgttagttccaaaaggtcttctgggtgttcatagaactgttcaatcagcttcttcagcattactggtcagggcatagacttggattgctgtgatattgaatggttaccttggaaacgaacagagatcattctgtcgtttttgagattgcagccaagtactgcattttagactcttttgctgaccattagcatttcccaaatgactcatgatgctgagtatcttttaatgtgcttattggaaatttgcatatcttctttggaagaatatatagaaccttgccccttttctcatatagtatttgtattttgttgtcaaactgtaagtgttctttctgaacgccggtttcttagcagatatatgattcacaaatattctgtatattgtctcttcatttttttaatagtattctttgacgcacacattttttttaatttacttagttttaattgaaagataattgctttacaatattgtattgatttctgctatacatcaaacatgaatcagcctcaggcatacatatatctactctctctgggctctccctcccaccccatctcacgcctctaggttgtcacagagcactggtttgagctctctgagtcatacaggaaattcacacaggttatctgttttacagatgatagtgtatatgtttccaagctactctctccattcatcccaccttcttctttcccctccgtgtccgtaatctgttctgtatatctgtgtctccattatggtggtggtggttcagtcgctaagtcatgtccgactcttgcaaccccatgggctgtagcctgccaggtcctctgtccataggatttcccagataagaataccaaagtgggttgctgtttccttctccaggggatcttcccgacccaggaattgaatccaagtctcctgcatcgcaggtagattctttaccaactgagctatgagggaatcccgattcagttcagttcagttgctcagtcatatctgactctttgcaaccccatggactgcagcacgccaggcttccctgtccatcaccaactccctgagcttactcaaactcacatccattgagtcggtgatgccatccaaccatctcatcctctgtcgtccccttctcttcctgccttcaatcattcccagcatcagggtcttttccaatgagtcagttcttcacaacaggtggccaaagtattgcagcttcagctttagcattagtctttccaacgaatatttagggttgatttccttttggattgactggtttgattttgcaatccaagggactctttctttgatagaatatccttaacattatcgtcaatcctgaataatcctgaaactagaacaagaaatgcacatgatagccttctcttgaaagcacagtggattaaatatgaaatgacttaagacaagtctcatcactggcacagagctgagcaagatctgcccagcaaccacttctcaaaagtcaaaatcctgaaaagaattaagttcttaccccactttgtagggtatttgtgtatttttccatctggaccgatcccccttgctgaggctctgtgaacctctgcaagtctcaggtcacaagtctttgcatcaagtcttaatctgtcctgatttcttaaaaaaaaaaaaaaagagtgaaatgcaaaggaaacagacaggaaaaaaatcactatgatctctctttttcaatttgtttgttttcctttttcctgggcgctctggtcttcaggattaatgctcactctggggactaggcttatgtagtcatggcaaagtggttaaggaaatgaactagaaatccactggggtctccctgagcaggttcaaatcctgttgactatgcattccttttagggtttcccggtggctcagacagtaaagaatctggctggggactagactaaaaattggtatctctggctaggatcttggggaaggcccacctagataatacagagatattaaatattgacccctagaggtttcttccaccccaaatattctgaggtccagaaaggaatgatgatcccacatagatctttccaaactgggatttttactcctgggctgggaaaaatgtactcagagccccactaggtggcgctggcagacaggcaagaaatggctctgattttaaaatgtgagcacaaacttcctataagccagagaattcctttgtttctggatgaccaagatcagcttttgtcaagcacatgtcagaatagctttctggagtaacaataatctaactgtacagtttaccctaaatcaaccaaatagtcaagactgaacgaaagcagaaggaaatacgcgtaggggtaaaagtatgctataaatactttaaatttaagaactataaatctctcaaactatgtagtgtccaaaacaaagatgagtggtgaggagacttaaagatgatcaaaggtgataaattttagattcttattctgatgtggacatgtctttaccaatgagatgatgctgatacgaatttagtcgctcagtcgtgtccgactctttgtgaacccatggcctgtagcctaccaggctcctctgtccatgggatttttcaggcaagaatactggagtgggttgccatttctttctccagggaatcttcccgacccagggatcaaacccaggtctcttgcattgcaggcgtattcattaccatctgagccacagggaattcaggaatccccagattaaattaggaattagagtaggacctctccttcttcccaagaaaccatattgttttaacaaatctagatctgtgcaaggatttgtctggtgggtcgtctgatgaatgtttcactagagctggacaggacttagcaactcaacaaaaacaagtagggtcggattttggatttggaggggcacaggcacggcctctgtctctctcttggctcccacataacctcttccactttaacaagggcttgtccagtctttaaactgtcatgggaacagcaaactgacctctgtcttctatttccagacagttccaatagttagaaaattcgttctcagattaagccaaaccctggccctttttaactcccacacatgcatccccgttctgccttttagagcaatgcagaatgaactaacctttttttttttttttaatggcttctccttaaatatgggatggtttaggccttctcagcctccaacggtatcagttgttttcaaccatatttcctataacagagcttctgcatctcttagttacctttctctgcagtgggacccttcgctgtcttgatttaaatactgtgtatcaataaatgcagccaaatttggttaactctcttcactgtttttcctttggagcctgggggcaactaaaaccccccagatcatttccgtgggtgtggtaggtcccatcaacccaatccttgcatatgccactgatctttagaattaaaatgcggatgttgggctctataataccgcgtggatttaagctcaaagctgcggtctgtcgaaatgacacacgatcctttcatcccaactctggtaccagacatccctggattcaaagttttgttcctgccctcctgagactgtgtcatcttaagcacatgactcatctcagatcatcaatttcctcatgtcagaggcagatcacattcccatctgc

SEQ ID NO: 38544 - DNA, 2523 bp, Bovine  19866880366249
ctcagttgccaaggcccccaggggtggctccagaagggttggaggaccacactgggctgtctgaaagtggatgctcctgtcctctgcagagccatcttggagcagagagcagtggccccttctacgctcccacctcattaatcactactttaaaagactaagtttgggggtgaattgctacacagcaaaagatgacctgaatactcatctcctgagttgtgaaaagtcataatgtatttaaagtgcccagcacacagtaggcattttgtggtaccatttttctcaccatccccactgttcacaaggatttccgtctttctccatatcttttgcgcaagtatgttggcatactcctttgcaggattaatgtagtcattccaccaagaacttactgggcagcgcttttatacctagcccatgagcaggcactgggctttagcaataggcaaagacactggaatgaccattgaggaggtccaatcaccttggatgcgcgtgcatgtgttcagtcgctaagttgtatctgactctttgcaagtctgactgtagcccgaaaggatcctctgtccttgggatttcccaggcaagaatactgaatgggttgccatttcctcttccaggggaacttctcaacccagggatcaaacccacatctcctgcgggttctttaccactgagccaactgagaagcccttaatcaccttggatgttttgaaatatacggaacttttatagaagagctttctttggaaaggactctggtgggaggcaagagggcctatgaccgggggtacaggggagctctccagggtgtgagttaaatgtgtggtctgtacagtaagtcctacctggtaaagaaatcccaaagactaattttgctgttgtcatttttcttacaccaggtctgcaatgcaacaaaatggattgaatagtacaagtgaaatgcttagaacatgcctggttcatggtaagaacacggacactgcactcacatttcaaggccctgagctgggggctctgagttcaactcaatcaagcccttctcacgtgctggagattctcccagacgtaatgtgtcctcgtgaagttctttcgacaactctgtgaagttgatatactgtcgctgtctccacatcataacagatgacacaaaaacacaagagaacagcccacgtggtggagtgggcttgcgagtccaggatgccagcatgatcttccagaggtcacccagggttccagggacagggggtgggtcccaaccttgctgagaatcatccagagagttttagaaacaccatgctctggttctacccccagaaactaagacttagtgaagaagaaactagtacctggatctttttttttaagtccccggatgagtcaaacaggtagtcatggttgaggacagttggctatttagagatgaaaagacccatttgaggaaaaatccctaagtcacagagaagacccatccaaaactgtaagaagcctcacattatcaaaaggtccatccctaacagaggtccttgagagagtaaagctgtgctgtgggttggctgagtatgcagaggtttttgaaggatgcttggggaggactatgctgtaattggaccagttatcctgcctaaccccttcatggatcactgtcttgtcgtggcaaagggacttgcataactcaatgaagctatgagccaggccaagcagggccaccccagataggcaggttggggtggttatatctccaggagatagtgggggacagggaggcctggtgtgctgcagtccatggggtcatagacagacatgacaaccgaacaaccacaatccttctttatgagatgccacagaaaaaccaagtcgcctgtcactagaagggtccagttggactcattatttggcatagatgtagtagcagagctgcaaactctggaaggctgagcaatgcctctaatgttccatccaccccatcattgtctcctccaagccccacccccggaagatgaagaccgtgtgtagtagatgttcttcagaagccagccaacccttcctctgctgcctccccaaatccagcacctgggctcagggtgcagtttctctggcctgcacacatactgtttagggaaacccagatgccagcttgttcaaatgtggttgctgcaataagaggggatgtataagacgtgtcacgtggcttcccacccccgactcctcctcctcgggggagctcacacgtggccagggctcacatatggctgagacacgctgcagtgaatccatggcgcctcaagaatcaggccacagtcgttacccatcatcacctcccagcagcaaacccagcagtgttcttagtgtcttctgggaggtgggagccaagccaaggctgcagcagccagccacctggctgagccttcagacaacccctcacctgggggagttctcctgcatgaagcctccacagtcctatttctccccaattcaagccaaattgtttcttaaactatgtttcccccaaacaacttaaag

SEQ ID NO: 38545 - DNA, 2126 bp, Bovine  19866880367533
acagctcacacctgccccacaagtgttcacagcactcacaccagaccctgactggtaggccaggcggaagccagcgtgcagatgaagccagccccagagtctcaacaaggagaacgccgagcctggggggtgggcttcccagacgagaggcacagcctctacccactgaagaggaggacaagccccggagtggcaggtggagggaacaggagagggggtcctgataggggatccggggaacaaagccacaagcaccctggggacggtgaatctgctgctcggcatggtaggaccagacgagcatggcggggttgagagggtggcacacaggccagggaagacaggaggaatttttatgtttgttcacctctgcctggaaaggtatctggcaggcaagaggtgcctgtactattctgcctgtgaaatgggcatttaactataggctggataaattgatcagagaatgagtgcacactactggagatgagagcagtgccaaagacaggaggagccctggcgcttctccccagaggccaccttccagagcccagaggccccatcactgagaaaaacacacacagcctaccttcatcgacttctcaggctagagtaatcagctaaataaaacagtctgttggcctgacccacagctattcattcagcccaaaagatgcatgaaacatctgtgtatgtgtgtgcgtgtatgcgtgtgcgcgtatgtgtgtgctctgtcgctcagtcatgtctggctcttgtgaccccacggactgtagtccaccagggtcctctgtccatgggatttcccaggcaagaatgctggagtaggtagctattccttctccagggaatcttcccaaaccagggatcaaattaagcacctactatgtgccaaggatggcactgggcagtggaggcccagtggtgaacaaaatgatcagttctctgccctcctggacattatcatccaatgaacatcatcagagcaaatgagcagcagaattatccatcataagaagtgctagagctcctgcccaagtcacattcttctgagacgaggcagtgtagcccagtggacagcagtgtgagctcagaaagcacaccacctgattcggtcctggtcacactattagctgtgtgacctcgggaaatttacttaccctctctgagcttcagttcatgcatgcacgcaccctaagttgcttcagtcatgtttgactctttatgaccctatggaccatagcctgccaggcttctttatccatcggattctccaggcaagaatactgaagtgggttgccacactctccctggggggatcttcctgacccagggatcgaacctacatctcttatttctcctgcattggcaggcaggttctttatcgctagcgccacctgggaagcccaagcttcagtcccctcctatgcaaaataggaatcttagtaatatcttcatcttatctgggttactgcaaggatgaaataggtcatccatataaataccacaaaacagtctggcatcataaaatgtcacgaatctgtcatggttgttgccaactgttgtcaagggcaaggatccatggccaagctgcatgaagtcatttcatcagctccctaagagctgatgtttcctaactggcctgacggtgccactggtcagcggcaggaacagaacagtgcagcccgaacttttcactgcctgtctacgccttggtctaaccagcaccaaattcctcccttccagcttgtgatgtgatggttcccctgtgcagaatcagattcaggcttagagtggagcgataaccgagtgtccgtcatgccctgagccgggggatcacagggcccccggcagctggtgcggcaattagtgacccgcgggccgtcgtgtccctggtgtcctcccctcttcgcccccggctcccgccctgatgcccacaagcacaaacagctctggagctggacggccacaggggacgccgagcttttgtttaaacctttgaaccgagtcgataaccagctccaggctgttaatggccacaccagccacaccaattactcccaaggccctgataggctgtttctgagtcccttctgaactcctctcatcacacatctaccagatctact

SEQ ID NO: 38546 - DNA, 1590 bp, Bovine  19866880578548
tgcggccccgcatatgttccaagttaacagacaggtgagactttaggcagagtggggaggtgggggcgtgaaccctgaaaggtacagcccacggccacacgctgccagcagccagaaccccaggcagctcccaccctccttgagccctagcgcccacctttccaacagaaggttgaacctcacaatatccccacctcccaccccagccccgagaacctaagttttctactcagctccccgcccaccctggccgagaggcaaggaaaatagctgtgtccactttggggtgtggaggtgaggtctctgaggctgaatggtttgtccccgagctgggagcccacctctctgcctccccagagtgagctggggcatcaccagccatgtcagcgctgcggctgggagaagggtctgcggccgatgcccgacgactggtctgatagtcagaccccacttcccttggggaaggcagtaggaggtgacagtagcagagctgggccccccaccaccacggctcaaatcccccagttaaggagacaggtgccccgagatgagacagggtcccacggtcaagggggcgggcagagaccaaggcaggaaccgaccactgaaacacacatacagagcgggagggaacggcagggcttcaggccatgacgacatgaaatcaagactgctaattataccccaacgaggatataaagtcagaatcgatcacgtctgagttcagggacttccccaaagaggaaggagcagaggggtgtgagttctttgatcaagtccagggctgggggaggccgacctccaagcagatctgaaatggctctccccctctcctctgggccccctcttctgcagggtgcacacgaacatgcacacacacacacacaccacacacacggacaagtgctccccacaccaagacctggcggggaaaggaggccacttcatgaagggcaaacggaaaaataacctcgatgtgacgcgtgggttggcaggagctgggcagagctcaatgaacagaacagaaacatattgacaatagcaaaaagaaacaattaccacgcattttcatatgagatcccatccccaggaataaatttgctctggcttttgcttattcgacagaaaaacacgaagcaggagacggagagggatgaggaccggcagaatgcagacgctggcattttgtgcctccacgtttccccgaagctctctaaagagtgttttttggagatacaggctgacacggcagtcaggaggaaatagaaagaagaacattgtaagtggagaggtttcagggtgctgcctccagggcagccacaacatagaacaccgtcaaattaacagggagaggggccgctcccaaccactcggcacagttttgcaccttgggaagtagaagttatgggaaaaaaaaaaagattttaggtccatggtaccagcatggtgggcttcccttgtggctcagctggtaaagaatgtgcctgaaatgcgggagacctgggttcaatccctgggttgggaagatcccctggagaagggaaaggctaccccctgcaggattctggcctgtccatggggtcgcaaaga

SEQ ID NO: 38547 - DNA, 1067 bp, Bovine  19866880599840
ctagcatttaggggcttgagacagggttgagcgccaaatccagaaaactctgctcatgtgtctaattgactactcattactgagtgcccgccgttcatttatggaacagacgcacatgcaacacccactatgtgcgaggaacggggtgccttcctacccaccctacatcccaggagcgggaccctgcctgtccctgctgccacccttcaggagccagctgcctgccactccactctaacagctcccaggattgttgtgagatgcaaactggaaacctacatgaaaggatgttcattgctgttgttcagtcgctaagttgtgtccaactctttgcgaccccatggactgtaatccgccagggttccctgtccttcaccatctcctggagtttgctcaggttcatatccattgaatcagtgatgccatccaaccatctcaacctctttggaaacagaaggctgtattagcactggtggtcagactgtccctcccctcccttttctttcctagggacaagatgccagcccagctcaggtgtccgcaaagccctctgcagctcagcaccccaagaggctctctctccctcccggcatcctctcgccccagtcaccccaccttccaagtcaggactgtggggggtaggcggaggtcccagagagatgaaagaactgagaaggtcatcccatcaatgggagggaggtgcccagcagcagcaagtgagtccctagcatccggggagtggcagctcactcgggagattgtctgtatcctccagggcagagcaaggattacactgctgtgtcatctgctccaactcttcctgccaggagtcgggtatgatacctcagtaatacggccggctgacgctccccacagagatatgcaacttacacacgctggatcaggcaccgcatgctgacatctgtctcatgtgaggccagggacatcctcctcagggcagcatgaagctgcaggcaagacgcgagcctggggtcagggggcgcagggggccagccccagtgacccaaggcccaggcaccatgaccgatcagatcgttgagctgcag

SEQ ID NO: 38548 - DNA, 2756 bp, Bovine  19866880670919
aacccactccagtatttttgcctgaagaatcccatggaccgaggagcctggtgggttacagtccgtggggtcgtggagttggacacaactgagcacgcatgcattacatatgttatttaatttactctcacagaaaccatgtgagcttcagagacctctggagtgagttgtccaaggtcacccagttggggctcccctggtggctcagtggttaagaacctgcctgccaatgcagaagacatgggttcaattcctgatccgggaagatccctcagaccaactaagtccatgagtcatagctacggaagcctgtgcacctagagtctgtggtccacagcaaaagaaaacacagcaatgggaagcctgcacaccccaactagagtaacctccggttgccacgactagaggaaagctggagtggcaatgaagacccagtacagccaaaaataaataaatagaatttttttttaaaagatcgcccagttagcaaacggcagagtgagggttaccatctggtcttgcccaactccacactcactgtctttaacactgaactcggaggtgtaattatgggcttcacagagagtcacatatcattttgacaccaaaacactggcatttcccagaccttttctggtttgcttttttaatatatatactaaaagtctttagttgtacagtaaactcccatcccccgggttcaacaatgatcaacatttcctcacacttacatctccccattccttcctcttctctcttttttttctacagtacattaaagaaaattcctgacatttcatcattttgcccctaaatacttcccatatgtagctctaaacaggggggaaggcgagggaaggagggatttctgacagaatcacgaaaccaaaccacctaacacaggtcacagtttctgaatatcgccaaacagccagttgaactctaatgtctcctcgtgtctcagaaaacactgtttcacatttgatttgtctcaagaaggatccagacaagattcatctactgtgtttggttaaatgtcccctttgtctctccattctgacttgaatcctctttttttttccggcatcatcggttatgaaagaaatggtgcccactgccacggatgtttcactccctgggtatgtgggggttacttccttgtggtgcatttgacttcttcttttatcccctgtacttcctgtggagtctaaattcaaagacttggggaggtgcatgtttcagcaggaacaccacacggatggtgccgtgtacttatgaaatcacttcaggacagagggtacacggtgctcccagttttagtgctgagaactatttacatgtttagatggttaccagatatctcaatggcttatagagataagagataggctattttaaaaaatttcgttgacgcgtagttgatgtagaatgctgtattaatttccactgtgcagcaaagtgactcagttatatacacatgtattcctttgcacattcttttctattagtgatttattaacatcataggatattgaatatatttccctgcgctatacagctgtgttgctcagtcctaagttgtgtcccactctttgccaccccacagactgcagcacgccaggcttccctgtccttcactatctcccggagtttgctcaaacacatgtccattgagtcggtgatgccatccaaccatctcatcctcgtacaccctcttctcgtgtcctcaatctttcccagcatcacggtcttttccaatgagttgactctttgcatcaggtgaccaaagtgttggagcttcaacttcagcatcagtccttccaataaatattcaggattgatttcctttaggattgactagtttgatctcctccttgtccaagggactctcaagaatcttctccaacatcacagttctaaagcatcaattcagagacagaatatttatttattaaaatgtttcagccataccacgtggtgtgtgggaacttagttctctgatcagggatcaaaaccatgccccctgcattggaagtgcagtcttaaccactggaccgccaggaaagtcctgaggtagagtatttaaatccttcattgtcatagactatctggactacctgctggcttctcttgtgtgccaggtttgaagataaagcctagtaacatgggaaagctaaacttttctggcttcaagagggctgcacctttggggatctgaaagcctgtttgatggaagagagaggagtcactcttaggtgtggaggatttgccctttaatagatgtaggcatcttctccctcaagtgttatcctgtgggtgtgcttcacagttataagctaaacaatccaggaattagaaggtggccggctgatgctggcaggggagacaggaaggatgagccaagtcaagagaggcaggtgtggaccccatgtgctgagggagattatggaggagagagcttgaggggtatattgatgctcttggggagagtgagcaggatacaaaagacaacagaacctggaccaaggagttgaaaagactccatgcaaggaacttcatgcagagtgaggaataccagcaaatcatgaggagagggaagttatttgtgaaatccagctcaaagagtcttagagtcagggagtcctcagactgaagggactgtgggatagcccactatatcagaaaacaaaggatgtcggggccatgaaccagcagccactgcagctgcctgaccgtgcacactgaggggattctgg

SEQ ID NO: 38549 - DNA, 1004 bp, Bovine  19866880701439
acggtcatttctcattagtgggtcataaaatagtttagtgggtcaggaagaggattttttaaaaattaaaacaaaacacaaattcccagaatgtatctcacacagcagtttcgtggaacactttttcaggggtagcacacacgcacacagcttccctggtggctcagtggtaaagaatccgactgttaatgcaggagacgcaggagatgtgggttcaatctctgggtcgggaagatgccctagagaagagcatggcaacccactcgagtattcctgcctggagaatcccatggatagaggagcctgacggactacagtccacggggtcacaaagactcggacatgactgatgaaatgagcacgcctgagcaaacacacacacacaagcacatgctgagtcacgaagtttgagaaacacagccctgggcctctcacggtgacatgtgtggcccacaacagtctcagaatatgggctggccgctcatgagaatgtgtgctttccagacacaagctcataacgagttgttttctacaggcaggccacacctggacgcgatggttcagccaactgcaggaaatacacttggattcaccctccacgatggaaatgtggctacaagatgccaacgagttacatgtcccatgaagaaacagggcaggaaaatgtgtctgagtccccagattcagcaacagcatctgccaggcagaactctggctgggaaagtggacacagggtgctgagctatgagacgggagatcagtgcccacctcacagtgaagcaaaacctcaaatggaccatgaataacacaggctctttattcatgtattcccctcttgattgctgaaacaaatcaaagttggtttaaaaaatgcatgaagttccctcagcacagaactctaccttcctaacccattaaaccagagaaaaccaattctgaattgagccaatattttatccgttacaaattccacttcagctgtccacctcatgcagctgaaggag

SEQ ID NO: 38550 - DNA, 1106 bp, Bovine  19866880728309
gtcagcaggtgtgggctggggccccagattctgcatttctagcaagttctaacgagccagtgctgctgggccagggaccccactttgagaagcaagattctaaatccttctcaaagacgtttgtgctccttcagcaagaatttgaggggcgtgacccgtgtgctcagcgtgtcccaggcactctggagggcccaatttggtggccctggatttcatgggcaggtgccagaggctgtgtcaggtggcgggggtgtgttgaggacgtggaacggtggcattggaaatgcaattgatctcaaggttcttgaaaagctacgttgttctgccttggcaaccagccaccagagacgtcaggtgatggatggaaacttgacacctactcggattggagagggactgaacacaagcagcattggcgctggtggcgcagctccaacttccatggcgctccgccagcccgcacccccgcccggaggagggagggtggagcgggagctttaagaacagcctttgggttcggaagccttattgttaagtgaatggtggccagctgttcccagcaccccatcccccctcaacctgaaagctgtaccagaggaaagggctgagattatacacggcaaagcctggctcctggacgaggttgcctggggcgggaacagctgctggggaggagtgcagttccctgacctccacttggaccttgtcaccgtctcaactcagccaccgcctggctctacaatgtgggccagtcactcagtgaaggagtggatgggatgctctggccctcatgttctactggggctggccctgactgtctgggggcgccaggatggagcatatggactagaggaccccagtgatccttccagcccagaggaaggagctgggctggaaggatcttcacccacccaaacgccttgggtgaagaaaaggggcctctgccccaccttaagaggtgttctggccaccacccaggccccttccacctttactggcccgcaggcctcctgcagaagaggccaaagctggacccagacacactctgaggatcctcccaccatcttacctttcttgtgtacctacgggaaatcgcagccgttaga

SEQ ID NO: 38551 - DNA, 1902 bp, Bovine  19866880749337
ttaatgtagcctaagcaaatggggtttcaggtaccaaaacaccaaaataggctatgtgatgaaagatgttaaggaggaaaacgatacattaactatttcttctctaacaaccaatctgagagtctattgcttctgtggctgctttctatagaaagaaagtgaggacaggagttgtgtcgactcttttgagtccaacccgacatgaacaaactcatgtgatggctaacagaggtaagtagtacaagaacaacatccatgaaaaaagatagtggctcgttttgagaagagaggatgaattatagtgtcacagggtcaaaagatttaaaaggaaatgtttggggttctgggggcttaaacatagctttttccttttcatactaattcagatttctcttcaaatccttaatcaaatgttttacgaggcctacaggtagtagtggaattcagtgaaactatacagagaatcaaaaaattttgtatacatatacataccagtatgtatatatatatacacacatatattttgagatatattataattatatatggatatatgggcttctcaggaggtatggtggtaaagaatccatctgccaatgcaggagatgcaagagatatgggttccatccctgtgttgggaacattccctggagtaataccccactccagtattcttgcctggaaaatcccatggacagaggataccactgagcacacacacacatacacacatggatgtatatctattcatatacctatatggagatgcacacacacacaccatacatacttatacatatatggaacacacacatatatatatatatgtacagacatacatatggtatatatacacacatacataatgattttccttaatttatgattggatgtacatcctgataaacctatcataaattgaaaatgccataaaagtcaaagatgcatttaatacacttaatctaccaaacatcacagtttagcctaaccaaccttaaacgtgctcagaacacttgcgttagccttcagttggcaaaatcatctaacacaaagcctgttttgtaataaggtgctggatatctcatgtgatttattgaatactgtactgaaagtgaaaaacagaacggttgtgtgggtccagaatggctgtaagtgtatcgattgttcacagctgtgttcgcagagctgactgggagctgctgtcgctgcccagcatcttgagaaaatatcagaccacatagcactaacccaggaaaagatcaaaattcaaagtacagattctattgaatgcatatcacttttgcaccatcataaaatcaaactcttgtaagtcaggaccatttgtatatgaatacatatatgtgcacatacattcatatatgcatttaactggttatggcacagctattcaactgcatttaaaaacaattgaactcagtcttatatcagctccaaaaataaatgacaaaattaaagacaattgtacaaaaaaatactttcaagaaaatccagcacattatatgtgcttatatgtacaaaccaccagtgaaagccaactttcttgactgatgcatttcttgatctaatacagaagctataaagaaaagatcagggaggtcccttggggaaggaaatagcaacccacttcagtattcttgcctggaaaatcccattgacaccccatggggtcataaaagagtcagacacagtttagctacataacaaccaacaaatttgctcatataaggatttaaaatctttttttgacaaaagaaagtttcccttaccagataaatcgacaaaggataggttcaggaatatttgtaccacagatgacaacagtttttgttttgtttttacaaattgacaaaagtagacaaactcataggaaaatgaataaag

SEQ ID NO: 38552 - DNA, 2787 bp, Bovine  19866880783723
gagtggagcggttgctcctcagtagaagaggccccagtacaaccccctcccccacccccaaccttggcatttgcagggccagtgcccgtacccgcacccggggagtgagggggcgggcccagagagaaccacaccatccagcccaccaggccaactggaggaatgcgaacttgtcttccaggccactagacacgtggtttcctggctcagctcatcccaaacgaggtgaaacccatggccacagtctctgctcagggaacccctctcatcaagggctggaagctgccctcatggtggggagggtcccagggggccctgcaggagggctccaatgctccagttttaaggggtccaggttgggtgtttctagggtgccatcatggccacacctgcctttcttccacttcgcctataactttcctgattgtgcacaaggtgcccaggtccctgccagccagtgggggaaaccccctccatgtccctcctcctctctgcgccacctccccctccaaacccccagctcccccagcactcaccacgtttttggcatttggcttcatggatatagtcccgtagatctcctcccctctccggacagtgaggtaatcttccaggtagaagacggtctgcttccagtgggtgtagggggcatcaggggctgagggagagaagggagagtcacaggagacgcctccaggggctttcctggtggtccactggctaagacctctgcgctcccagtgcaggggaaagtgaaagtcgctcagctgggtccgactcctggcgatcccatggactatacagtccatggaattctccaggctagaatactggagtgggtagcctatcccttctccaatggatcttcccgacccagaaatcgaaacggggtctcctgtattgcaggtggactctttactagctgggctaccaggaaagccccagtgcagggggccagggttcaattcctagtaggggaactagatcctccgtgctgccgctgaagatcccacgtgctgaactaagacctggtgcagtcaaataaatattttttaaaaagagagagagagatgtctccagaagggctgggaccccacccggaagctgctgggtttcttctgggacatgctgaacactctgcccagccctctcactgggtcaggtgcccaagttctggcaggcctccccactcagcccaggggctcaacttgtcatcaactccccacgccctccaaactgaggatcttagtggacaaccagaggagaaaccaactgacattacaaggtcataccaagggtagtattaacacaaatgaatctcaaaatgctgctgtttcattggttcaacagagtgaagacttgcagacaaatgtaggggagagatacagagggcagtccatccactctcctgttaaatgacagcactcacaccaactccacagctaaaccagtttccccagtttcatggatatcccagccctacagatagttttctctgcctgcctctctgtcctagttcacaaaccatgggtgggtggtggcttcaggatgattccagtgtgctacattcttaggcactttatttctattattattacatcggctcacctcaggtcatcaggcattacatcccggaggttggggacccctgctataacccatcctgctgctcttggcttaggcctgtagtggggtttcgaacaagccttcctacctagatagggtaaaaattcagaatgattctccttctacagacccaatgctggtccacagctcacacctcatgcatgaaccaaagtcacactgatgctcacacctctcatgaaatcccatccatcctctgggctcatgacaaattctactactagatgaggggtcctgtcccagaagctgccgtccctcggacactcttccctccttaaccaccagcctctcccttcctcatcctccaaggtcaattctcgggagagcctcacctgaccacctagctggattaagggcatcctgagcctgtgtgattactgtagcagtcacactgctgcataaccatctctgtctctttttactttctgtagtctccacaagactgcaacctccatcaggacaggggtctgatggaatactattacacccttggagcccatcaccatacttgctaggtctgtgagcgccgaatacatgaccgatagtaaaaagccagagcgggtctggtgtgaggcttcaaggtacccagggatgttcagcaacattgaggctttggaaccaaagggttgtagaaaaatacatcttacagccagttcctcttgtcctgcaggctcttaccttcctccactaggaggcgtgactcacgaacactgattcattctctttccattacaaccagagttgaaggtgggaagccttggggaggactttaaaatatttcaaagtctgtcacatgaaaagtctgtggccttatggatggctttgggggcagaacaaaggctaggccctggacatcatcagaaggcaaagttttaattcgcaggaagagttggggctgtccctcagtcatactggccactggtgatccagcctgaaggaattcacacacagcctgcctggagatttatcgcaggtcccgcagtgggaccaagatcattcaaccctcaggatctattttaactgtctgtgtccttcgtaagagactagcttgatcatatgtcagtgctttgaatacagatctgagtagccttcaatatgtgtctttgggaaatcgatgcaaagtcaaggtcgtggggagaggaa

SEQ ID NO: 38553 - DNA, 942 bp, Bovine  19866880802090
tcactttccactcacagaaaggactctcgaagcgtctttcagcggctccgtgggtcgtaatggctttctgacattatgacgattgctttctggccacggttggttagctcagctggatggagcttgaagccaaagacacaggcttctcaggctcccgctcagcttcatggtcatggatgaactccagccagccttggagtaaacagagctggggctgcagcctggattctccggccaacaattgagcgctgcagtgagttaccagaactgctgtctcctgggtggacccttcctctgtgaaatgccatgatgatcacacctctgtcccagactgttgtgagctgacccaggaacacatcccgcatggtgagatggtagcccccttttttcagaaatgagggatccggacaagagcgtgtaggagcccctgggagggagaagcccctccaagctgagcctctgtgcacagtgggtcagagtgctgcttccaggggccaagtggccaaggcccccatcctctgtttcttggaagtgactctgacagctggcctggggatgcacagattagagacagggtaggaggtcagagcagggccagggcttggaggaccccaggctgttcaataggactcaggactgggaccacctgcaaacctggagcccgtggtggcggggaggctcccccgggttcatcacagaggacccaaggtcccctaagaggggggagcctggagcacagtggaatgtgggctctgggctggagcaccaggttcaacccccagtttccccacaacctcctggctgtgtgacctgcagcttccctgcctcaatttcctctactcgcaaactggctataacctttcccctctgcaggggcgttgatggaggtaagtgggagccgtgacggggatgcggtgagtgggcatgggtttactgtcatga

SEQ ID NO: 38554 - DNA, 2277 bp, Bovine  19866880805485
agactagcgacttcattgtattcgtgtgtctgattgtgcaacggaataagctggaaagagaagttggcaccgtgttaccggggttcttccccacctctcccgcgggcgggtggtcgctgggtgctgccctcacctggtagggcagctcggtgttcacgttctcccagtgtggtggcatggggatggcctcgttctcacagatgtaacttggagcagaaaagacaaaacaacattttagaagccgattataatcacggtcaacgactcagacattttctcccaagctgaattatcatgtgacaaaagcagtaaagtgtcgtccttggtttctttattttaaaacacttactgaatattggcttgtgtgcaacttttttaggggctgcgttgagaaatctgatgggaaacttcaaaaacgatattatttcgatcttgttttcctgtatttgccagagtttcttttaaaggtaggaagactttaggtgaagaaaagtaatttccgagaagaaaatcaacttcttgattaaaataaaactcctttaacagatttagtgtctattaaataccactcagaaccctcagctacatgttcaatgtccttcaagatctattattaactcaaatctaaacctttctctctttattgtccactaggcccctgcacggtcctaattaattcacccaaagcagaagctggcaaagtcatctaccacgtttaagccactggatgtgaacacagaaaaagacaatgaccttggggagcttgatggcagaaggctgtaactgatacatgaatcccatctggtgactggaagttgtggaagaaatgtatcaacttctagcctgtctttaacttatttttttaactcgttttccctttggggacatcacacaatcatgatttaaagatggggacaagagtttgagcaaactcagggagacagtgaaggacaggaaagcctggcgtgctgcagtccatggtatcgcaaagagtcggacatgactcagcgactggacaataaaggtgtaagagagtgagtggtggatggcttccctccctctccagtccccggtctggttctcacctctggcctccatgccaagtaatcactgctttcagtctcttgggtattctagaactttaggttaacacaaacctatggggttttttgtctgtctgttttgcacacaggaatggcagcatattcctttgtcttttgtagctgctctatgtttttcactatgttctcagagagccttctgtatcatggagagaactctccagcacacagcctggcacacacagacactctggacactggaggatgaaggcgtgcattctactgatgcaggtaccccagtgcacggacacacccccctcctgttgaccacaagttccctgtggatgacatttggctgtttccaactcttgctgccattaaggatgctagagaacaagtctgtccacttgtcattgtccatggccgcttgtcaacttttaagataacattttcggaatggcatttctgggtcaaagaatatatttattcctgactttaacagaaactttccagaggccctcctcgaaggctacagtcattgacattcccagcagaaacgtagagaatgcctacttgtccacaacctctccgaagaggtgtgttaccagactctggaatttctgtccatctgatagtaagaaataacctggtataatttgtatttctcttttttataagtgaggctgcatgaactgcacaaattcttttcttattcttctaaggggctattggttttctacttagagattcttcaaagtacttcatatactccagagactgtgataccacgtgacaatacctttcccaggttttctttgttttttgtttgtttttttcactttgcctgaagtatcttttttgcttcccaggtggctcagtggtaaagaatctgcctgcaatgcaggagacctgggttcaattcctgggttgggaagatcccctggagaaggaaatggcagcccactgcaatactcttgactagagaatcccatggacagaggagcctggcaggctccaatccatgggactgcaaacagtcaggcacaacttggtgactaagcaacgacagaagtatctttcagctgtgtgaaacgttttttgtttgcttatttgttgaatatttacagcccttggttaattgcaaatttcttgccaacaggcaatgtgctattcactttgcatgtcatgagagctcggtatattcccgcaatacaca

SEQ ID NO: 38555 - DNA, 1071 bp, Bovine  19866880829058
atatttctcatgcacacagggaaggaaggagaacagcagatggagaacaattccgagccgccccacccactgacacctcccctggaacatcattctctcaccaaggatggggcacgccctttgtcccttccagtctccgggttgcatggtcagagcacatgtttggcccgctcgctgcccagtccactgcaatccctcaaaagcagctgccgccacccgatggcagcacccctcccacatcctccttctccccgcaagccccaactccctggggggtggggcatgttgggcagagctgcaggccactcagaggcccccttgacctgggacaggggccccacagcttttcctgggattcactggaaggaggggggaggggcatgacctcctccaccagcggacctcatgcccataaaatgctgcagactgtgttctacgacatgcaggaggaatataagaagaaactcggaaaaccatctgcacttctgcctgaattcaactcaaggtcacagctgttaaaaattctgacccccacacctatttctgcacaggacccagttggaggcacgggtttcttggggacgggggtggggtgcaggaggtggcggcaaacttcagcagcctcctaggagtagaacaagtctctcctggaagagttgcagtgtccattcagccaccaaggagagagaaagatgtatgagagagggaggggaactgtgttttaagacccacttaccactgtgcagagagcagggccatgctgctcggagtgggtagagggtatgtgcttaagcaaagaggagaggccaaggcaggcgagacactcggaaggacttacccagaatatcaaattgaagaggaacatcatgtacttgaggcagcacaggcagcccctggccatgttgcacttcttaaattctaggaggaaaacaaaggacaggtccaggtaaaacaccacgtacttgctgcctttgggcgcattgtacttgtcggtcttcacgccggcctcggcgtggctctggccgcgggagcccgcggtgccgtaaaaggcgccggccgtgaagccgcggc

SEQ ID NO: 38556 - DNA, 1018 bp, Bovine  19866880864398
gtaagctcaaattagcttggaaagactctcctggaaccatccaattatttgggttgtaaatcctgagtaattacccactttgtcttcacctccactgagccccactgggcagctcctggaggtaatttcagatctgcagtgactaaagggggcctggggagacaggagtgcgtgggacggtggcccagctgcctgctgtcctatcctgaaaagctatgaatgccttgttgtggtttagtcaccaagtcatgtcccactctgcgaccccgtgggttgtagccccaccagactcttctgtccatggggattctccacgcaagaatactgcacttggtttccatttcctccttcaggggatcttcctgacccagggatcgaacccacatctcctgcatcggcaggcagattctttaccactgagccaccagggaagccctgctataaatgccacaagagaaacgagaataaataggtgttattcacatgagtaaagttgaagggaaaaactttagggcgtgtctcctattattgggaatgattcctcaatcaagtcttgagattcctgttgttcaaagaatttaaaatgaaacaaacaaaaaatgctgtttaatagcatgtgatttgtaggagatgcccatttgcttcttccaaggagatgttttgaaaggattaaagaaaatagtttttgaagtttctcttcttgggactttggtcatatattttaggatcatgatttataagttatgcaagtacttgtgtaatgaatgctctaggaagggagagaactttacttccttactagctacattatatcctcattcttaagtacaaggaatttaagaaaggaattgcttatctttagagggtatgtaatctgagagaaaaatgagacacaataatgaaaaatgtctatagtaattgtatgtcactatatctggtgtctttttgtgggggagaggcatgtaatgcaaggcactttgttcgctcacagaccatagaagcaatagcacaaagacag

SEQ ID NO: 38557 - DNA, 3684 bp, Bovine  19866880886359
aggagcctggcaggctacagtccacaggatggcaaagagtcagacacaactgagcagttaagttttattaatatttgtgtttatgaaatccttaacattttgaaaatcatggatcacaaccttgttatggcgaaggtgctcacagaactcaacgaagcgataagccaaggcttgcagggccacccaagacagacgggtcatagtggagagttctgacaagacgtggcccactggaggaagggatggcaaatcactcgaggggttttcatagggctcttgctgcaagaaccatatgaacagtatgaaaaggtaaaaagatatgatacttgaagatgagccgtttttttgcagaaatgaggactggggaaggggtatgacacagaggcctgggggtgatcattgccattcattcattcatttcattaatgctcattcagaaaacgctcactgagtccctacccggtactaagcatggcgaggcctctctggacaccaggccctgtctctcctcttgcctcctgtgctctggcccctgcccagtcccgtgatgctggtcttcaggcagacttggtggggactccggtacctgtgcagacagtcacggcggatggagcctttgccccgcattccgcggcaaagaggaaggaatgtgctttcattcttcccaggctctacctgggtgtggtgggcactgctgtcaccaggaggctcctatgaataaagcctgcttaatctccttagccggacggtggtgtcagccggctgggagccggcaggaaagcagcagtcatgcctcagattctccaagttgttgggagcggtgagtgatcccacaatccgaggggcctgcactggcttgcccaagggaggggagcggggctcagggtttcctctcggtctgctgctccgggcgtgctctctgaggccctttagccaccccagaagggctgagcagattcccaggatgccaaggagttggacagtctccaggagcaccaacgctgcctcgttcccactggagtgccctggagcttacatgagacatccaccagctccccagcttggcccttgaggctcaccgtgaaacatatccagagctctgcctctgtgggtccctcgggcttaagcaatttgtgaggccctctttaaggaaaaggacaccagccaaagagctggagcctctctgggtcttgggaagggtccaggcagtgaggagccctgcggatcagcttcatccacatagtgaaaagacccccattgcccatgcttcacttttcagtctctcttgactcctccgtggatgcgtccaacccaggcatcatccctgctcagggggcatctgcctgaccctgcctggcttcctcactcatgcctctgcaagctaagactacatggaaacgagctttcattccttgacatgccagattagcgacaatgactactagagtcattagacaacaactcttatcctgggtgcctcctatctcttggcttcgtgctagacgctgaccccctgcaaggcagggaaatagattagagactatgctgttcacagcaggcactgaatctcagatgtgtccacctagctgctggccaggatgcagggcaggtctgtgttgccctctcctgggtttcatgggtcctcctcatcccatctcccattgtctccatcctgcacaccctgtcctctgccctcccaaagcctcagcatcataaccaaactggtagagtggacacgtgagaaccctgagatgctgctgtccggctctctgatagccacctttggctgtcctttcacagaatccataatcactcatccgttcaatccattactcattggaaaacccgggcttcacatgagggagatgctgctccaggcacttagggatacagtggtgagaaaaacaaacaccctctctgcctttctggagctgaaattatactcaagaggattaatagacaattagctcagctggtaaagaatgcatctgcagtgcagaagacccctggttcaattcctgggtcaggaagatcccctggagaaggaaatggaaacccacttcagtatttttgcctggagaatcccatggacagaggagcctggtgggctatagtccatggggtcacaaagtcatacatgactgagtgactaacgagaaaggattcagtcaaggcttccctcatggttcagatggtaaagaatccacctgcagtgcagtagcccctgggtttgatccctgggttgggcagatcccctggagaagggaatggctacccactccagtattcttgcctgggaaatcccatggacagaggagtctggcaggctacagtccatgggggtagcacagagtcagacaaaactgagttactaacatacgtacacacacatacacaagcacacacaaagaatctatcaggttggtcctaatcgttgggcttctgtttgttttgatttttaagggttacggtaaagggtcgatgctttacccaaataagtgagtcactaacagcagaatttcaggcagttctgggggaaaaccttggggattccttccagtctccagactaaggtcacagacagggacgagcttagagatgaaaaacacgcagttaggagtgggagggaaagcaaaaagagtgcagattatttcagtaaaaaagcgaagactctggcagtgcccctccccaaagagaagtacgtggggacacctccggggacgtcccctctgtcaccagctgagcacctggagaaacaaacccgaagggcagagtaaggggactttagggcccattgttcagagcagcgctgttagggaagatgcgtgtggggaagattctcacaaccaggctggagaacatcccacttgaactcgaaatgccattcttctcactgtgccctcaactgcaggcccagcagacatacaggagaggggtgcccactgagaagtaccagcccctccttcctccgagcagccagagagcatctttgcatcctgctaacctgattggccatgaagccttcagactctcccgtcccttcctgtagatgagggtgaggttttgtttctagtaacggagtctccccagagggagacgcatcagaggtcacagtctgtctccaccacgggacagtggggagttcctccgatcttaaacaaacaaacacagcatcacgagaggaggtctcttgttcctacatcctcagagacctccactggggtgccatgtatgcttctctgagctgcatgccttctaggtttccactctttccaaatagttcctgtgccattggaggcagaggtttccagtgggagttggagccctctgcctttgatctgggtgccatgctctcaggagcagaaatcagaaagaagcctttgactttgctgtgcagccaaaggaagaagcactgactgccctggatggtccccttggctggctgtgccaggagtgccacctggcagggagcccagtgaaggagccccaacttcttcccttcttaatctctatctacagattgcagcctgaaacctgccctgcagagagtgagacagagagcttcagggaagacaaacctggataacccaggaaccagagcaatcgaagggcttccctagtggctcagatagttaagagtctgcctgcaatgtaggagacccaggttcaatcctcggatggaaa

SEQ ID NO: 38558 - DNA, 972 bp, Bovine  19866880993039
aatttttgagccaataaactggcaaagtcactgacccaacaaacctagctcagattcagaaattcataacctaattccagcagggctttctgtagattctccagagcagttttttcaaataaccctttatctttcccacttctcagctactgctttatagccggaccctctacatgaaggacggcggaagtgatggagaagctggcctgtttagcacttgagctccagtttgggggaaggatatggaagccaaagactaacaagaggttttggcattatttgtgaatatctccttattctgctattccatttccttgggcacttaagctaggctcatgatgtataagggccaactaactgtttacttaaaactctaccccagcatcctcagcgcaacctctcaactaactgccagctgccactcacttgccccaacggaattaacggaagctgccaacagctctgccctaacctcattggatagaattgtgtcctcagcagacacgagtttctctttcttctgagattgcctccctcctgtcttggagcgggaaatgttctcatgtccagtccaagtttcagagaggggaaggaacggggtgttttatttattcttaccttttacttattcttatttatttatttattcaatgtgctcctgtatgggtgtcaggactagtcctacaagcaactgctggcagggccagagataagccaaggagaggggtgccgaggaattaaagtgtttggggagggtcagcggtcccctgattaccaccgacaatccaaaaacatggtccttttggacttaactggtcaaacccagtgaagtcacagaaatgcatctgttaggaagagtgggctggtccttttccctgagatcttgtagcacagatgcaggtggatggaaaagacatggaaagccttcataactgcacaagtgtgggtggggatcagtacttactggggaat

SEQ ID NO: 38559 - DNA, 1239 bp, Bovine  19866881017406
ccaagtccctccctgggcccccttctcatagccacccctttccagaggtgggctggggtccagcctcaggtggaaaactcacccacagtggccgccgagcctggggagaacctgccatcacagaaccggcccaggaaagacgtcttccccacggaggagttgcccacaaacacgatcttgaagagccggtctggggtggatgggaagccttcctcctgcagaaggcagatagttgggtcaaccattggcatggtcaccagtccccacacttgccactccccaaccctcacccatccctgcagcatccagagagacaccagcaaccagcaagggaggctgctcggcctcggatgcaggaagcttcaggttcagggcactggggctccttccagcatcagatgtgggaagagagacatgccttccagcaccagtgatgcccatgtgctgggccgcagaccctgtgctgggctgggtttgtggtggagggaaggaggccatgtttacagagtcacagcatgatgctccaagtgtccagggagcacggtcaggaagtcaagggtcttggggtgcagggggctttgggctgggccttaaggaggagctggaggttttctgtggggggtgattaggaaggacaaggtggggtgttggcagggagatggggagatagaaaaagaaggcttagctatatcttggggtcagaatgatcccagatgggggtcaggcctcttatttctgccccatcactggaaacctagactggatggaggatgagcctcccttcctgcacactaccctgccatcccacctcaccagcttcatctaggggccccatctgccctcgaaataaaagaagaaaaaagaaatccacactcatttaaaaaaaaagctttaaaaattaaaagtgatactcattttaaaaattaggaaacttagtagagaggaaaataattattcatcattcatcccaccaccctgaaatgaccactgtttctattttgatggatttctttcagtttttttttttctatatagatgaagcaataggtgattcttgagagcgatttgagatattatatgtaatttgtttatattattatacatacatttaaatttatatgtaattttttatttttaatatattattaaattatgaatagttttctgaattgccaaagttttttgaaagtgtgatttttaaaaattattttaaaattaatgaatttttgtttcggctgg

SEQ ID NO: 38560 - DNA, 1500 bp, Bovine  19866881232566
tacccggagcatccaacctgcacagcagcctgctcagcatatccaagagtgggtgagaactgctcccccatcttcccacccgattttacttccttgagtgccaatcagatggagtggatgccagtggcttgtttacctacaacacatgtggagtgggaagtcaggaggtgggtaggagggaccttggctccatccgaaagccaactgtgcagggagtcctggtggacaaggcacaggggagccagaataaatattgaactttcactttgaaaccctgcgccactggggagtcgctgttgtgatgggcaagccgagagggctaaatatttacactttctgattgttcccaccaacctgctgcatgctctcactctgctgaaagttatctatttgttcattcattcattcatttaccttcttatttttaaaatgtgttggttcgtttgggaaaagaggttaggaggggttaggaggccaactgaaggtgagtcaagattctcttccatctcagagaaaggaaataaaaccacagatggaaagtcaaggtagagaaagtgctgactgacttccaaatcatttactcacagttctttttttttaaatttttttattttgggataattttaaacttatcaaaatattgcaaagacaatagagttcctgtacatctttcagccagtttcccctcaagttagcatcttatttaatcaagctacacgtgtcagaagtgagacagtgacacaggggccacactgttacctaagctcggtgtcagcagttcccccattcctgccctgttgctgtttccggagccaatctaggaccccgtgttacttttaatcatcatagctccttaagcatcctttggtctgggtcaatttcccaggcttctcttgtttcttatggggcttcccagatcgtaaaaaattcgcttgcaatgcaggcgacctgggttcgatccctagattgggaagatcccctgaagaaggaaatggcaactccagtattcttccctgggaaatcccattgacaggaccctggcaggctacagtccagggggtcgcaaaagagtcagccacaactgagagactaaacaacagtggacatatatttgaggggacacaagtcaactcagtacaatccatatggactcaaaggtttattctctggattagaatctgtttacttcttcaaattgttccagctttgtccttggggagctcttccagcttagtgttggcatctttttcataagtctccatcttgctttctcttttcttctattttgctttctcttttcttctattttccttcctcttttctgtctttttcagtctctgtctgtctctgtgtattttccttacttcctgagactaaaagatactccaggctcattttatatcatccctgccccacccctggaagcagccatttctttatacagccccgattccttttatggggaatgttacttagaaagatccaagtgcagggggtgtt

SEQ ID NO: 38561 - DNA, 1416 bp, Bovine  19866881236427
gaggagaaggggatgacagaggatgggatggttggatggcatcaccgactcgatggacatgagtttgaataaattccaggagttggcgatggacagggagggctggcctgctgcagtccatggggtcacaaagagttggacacgactgagtgactgaactaactgaactgaggtgaatttatggccttattgtttttattcaattgtggcaagacaatctccatcagtagtgtggcaaatcctgagatgccaggctatgggcagaactttccaaaacacggtcacactgccccttctctgcccagcagggggggggacctggagctggccagcgcattactttgcaatgctccagccagtaggaaatggacttgctccaggacaagggggatggggtgggaagccaagggtcgtgaagtccagagagccacccgcatgcccaaaccctgctctcaggctctgcccggtactgctggctgagtgagcaggctctttagaatccatttagaagtggatctggggggagttagctcttctcatggacaaatactgtaatggagccgcagctggtcttagcagtttcagagaaaagccattaatagccttttggggagaaatcaattccatgccatacttaggagggaattcaaggtcaattataggaatttgaactcatctttaaaaaaagagaaaagaaacccatgctcagaaacactgtcccagccccatgttctttattcctacacaagcaccactctctgccagcctggggtctccacgcgtcatttgtttgagattaaagctccgtgcggccacagtgtcccaggcccgtgacaacaaggaacatgaaaccgaggctggaaggagatgctccaggccacggaggtgggggctgaccttgctctgcgctctccccagccccgcccccaccctagcagagcacttattttccagacaggataccaccaacatggtgatggctcagctgaggccacctcacagggtggctcagcaggatccatctcacatgagtggcgaaccctcccagggtccactatcagcccttaacctggggaacaatccacccgcccacgacaatgagacaaccaaattgtggggcgggggcttgagaaacgatctcccactagcaagttaggggctctgttctcattctcgtcaaggccactctttttttaaagctctaaaaaaaaaatgtgttacaaactaagttttaaaaccaggaaacttagttgagagaaaaataataattattcgtcatttatcccaccaccctgaaacggccactattcttaaattgatgcatttcttccaggcgtttttctacattcccttttcacatttgatgaatcaatatgtgtttcttgagagaggttggacctattatatatatttaca

SEQ ID NO: 38562 - DNA, 1468 bp, Bovine  19866881237868
ttgcctgaggtcacacagctggtcggtggcagtgcctgggcgggagctcggggtgctcttgtcctgtttcagtgctctgcttgctacaggcctctgggaaatcgactgccagacagttcagtgaccccctccccagccgaggggggactccatcagctgacccagggcgggggtagctggccaggatgtggacacagagggctagaactcctggctgaactaatttctcccacacagccgacagtgaccttgactttcagctcacgaactttataaccatcattaaactgggacaaaagcatgaatggaggccacttacagatggatgtgaggactgaaaggctctgaagtaagtctctccctgcgggggtgcaggccacagaggggccccctgcagggaagattctaagccctgagctgggtcactgcggccactcaggacccccgcctccctagggaacaagggaaccgttggcccttctgggggtgtcatctgactttcctgtggctccttgggggtgatcaaggctggggtcagagacggagtgatgagggggagaaaataatccaacccctcattttacaggtgagaaaaaccaaagctcagagaggccaagagagcagagcaaggtcacagatctagctggctggagagccacacggctcagacccagagctcctgatttcctggttctgcttctaacatccacagaggaggtgctgggacctacttttattcagtgaggctgggactcctcccagcctgaggtcccaaaatgctggggccttactgcccagaggcgggtagggtggtttctaacgggtcttgggtaccagcctatctggcttaaaggaatacacactgcctcttacgtgctgtgaattctggggacgcgttacttacccttccactgcctcaatttccctatctgtaaaatgtggatgatgataaatatccgaatgaatagacaagatagcacagtgccgagcatggctgagggcctagtgcatgtgagccagggcttagaaacatacacacggtgtcagcttgagcccaggcccagctcgggtggatgactgacaggcggcagtgccggatataagacagaaggggtgttcctggtttgcacgtgtctgtgcagagggcgggctgacacaggtacccactttttcagggcgcactccagctcattcttctcctcatgggcttctaggagctgcgagaagattctggtcaggaaatcctcaaagttggacagtaagtgaggctcgtccttcttgagctgcagccagagctgcttgacatcagcttcactgcaagagaaaaaggagcattgaggcaggagtgtggacacgaggctttctgggacaccccgaggccccaggggcgacaggggcagccagagcatcatcactgtggtcgggacagtgacgtcaggggctggcatttattgagtgctggctgcat

SEQ ID NO: 38563 - DNA, 1870 bp, Bovine  19866881266442
attctttgtgtattcagtatggaatgcccatcctaggttgatatctttgtgaaagcagctggttcatgagatttctcctacagacagaatttgttagatcctcccaaggaggcagtgtttgtaaggtaggctttcaggaataagaaatcacctggatgatggaatagccttcacaaaaatatatgacttttgggcttccctggtggctcggtgataaagaatctgcctgctgatgcgggaaacacaagttcgatccctgatccaggaagaacccacaggtctcggagcaactaagtccttgccccacaactgctgatcctgtctagggcacgtgctctgcagcaagagaagccactgcaatgagaagcccgagaaccccaactggagagtagccactgctcgctgaaactagagaaaagctcatgcagcagtgaagacccagcacagccaaaaataaataaaattattaaaaaacaatgatttctctattctctcctactttccccctccctctctctgcccttccttgcttcatccctcccttcatcctctccatcccttctccctccctcccttcccccatccttccatcctcccttcctgaatcacatgatgaccaagtgtgagattcctgcacaaggcattctggacattggttcctgcccttaagaagtttccaacaaaagatacacaaccactcctcctcttactgtataagccgaattttattgcaggttaaactcaggtacaaaccacatggtgtggcctgtggaaggagaaacaggatcgtgtactggagctagaagggaccaccaggcagccagcatggctgaaggactgtgtgcgcacagaagagctggaggtgcagcccgtggggtggggctggagaagccagaccctcagagataacgcggcagaacagctgcagggagatgcagaaaggcagccatggacctaaatgagtccggtggctcagatggtaaagaatctgcctccaatgcaggagacctgggtttgatccctgggtcgggaaaatcccccggagtaggaaatggctgccctctccaatattctttcctggagaattccacgagcagaggagcctggtgggctacagtccttggggtagtaaagagctggacacaactaagtgactaatacaccactgaataaactaaaagagctgcagtgaggacttcctggtcctactcaaaggcaaggagagtgagcaaagctttaggaacagtgacatgacccagatccgatggtggtggcccaggccgtcagccggccttggcccaatgtcctgaggctacgatgctttctgcacttttccctgcagttgaaggacgcgctgggcacttctcttggaggacgaggcccggggattcatctggcctggggctggatctgtctgtccttggagtgtttttctagagaaccctcccctcccttcccactcctcacccaggggacggtcttgaccttcagctgagacggagctccaaggtctctgaagctctgtggtccctctagcggacggcccaccacgaggggcagagggcctcagggcacctgcctccttctccggctgcccagtcctcaccgcatcacggattttcctggagggaaatggaggagtccacacactcttggcttgaagagattccacgctgtctgcacaaacagagcctggagcctccgggagcgccttgctctcacctcacccccagaaagcctcccttcccggcccctgcagacaggctgtgaattgtgactctgaccgccacacactagtgtactgtggggctgaggcttggggtttctgccttaaaaaaataaatccctgcctctcctctctcggcggtca

SEQ ID NO: 38564 - DNA, 1357 bp, Bovine  19866881296044
gtggggggcctgtggctgcccctcgggagtggagggaacgccgcgcgtggagtggctgccgtgtccggaggtggtgctgggggctctcctgaccctggcaggcgatgtctgcatctctgtgtccagtgcctgccatctgacttctgagcagagctgtcttgatggaggaggcaggtctcagggagtatctgatggccagcaaggatggggctccagaacctggagaatggggctccagagcccggagggtgggacatggacagccggggagaaggcagggcagtgggatagtcgtggaaggttctgcgtgagagggggcagggcagcatggaggacatgggggcaggaaaaataagatgatactggaagcctggaaaaggtctgatgcgtccagtgtggtgggcagggactttctccctcacggtcggtggagcctgcaggtggtgggtttggagagcaggtgaaggttgcctggcccgcaaacccccacggccctttgccatgggctctaaggaaagatagaggattaggtggttggatggcatcactgattcaacggacatgagtctgagcaaactccgggagatagtgaaggacagggaagcctggcgtgctgcagtccatggggttgcaaagagtgggacacgactgagactgaacaactagggaaggtgcggctgctggcaggaccttcctgagccttccatgctcctgtggtgagcagcagcagccctagggttctctgtggcaaggcgggggcgggaggtggtcaggtgtgttccaagtcactgtgccccccacctgctgaagggaggcctcccacctgcaggcgagaagtcgctggacccaaatcagagtgacagcctgtcaggccgatgagcctgggccctgggcacgagccctgggatgtctgagccatttaggacacggtcctgactgggccctgaggcctgcgggggagggtgcgctggggaggggatgggcaccctggtggaggtgggggaaagaaacgtgtatgcaggcagaaggtgcttgattccttaccatttatggcagccaaagcgagcgatcccctcccgtctcccctctgcctggagccccctccgcctgccccgagctctaccgcctgccggggatggggcgcctgtgtgggtgtgagtcaggagcggtggggggaggagtgacaggattctcagcattgctgttttgtttcctctcctccctcctggatggaggcgtggatggaggtgcctcgtcatcagggtggggtgggcggggtgggctgggcagccccccaccccccagcgagcccagctatgtagactgcctccctcccggttctagaagtgcaggagtc

SEQ ID NO: 38565 - DNA, 1486 bp, Bovine  19866881303119
ctttggctctgattcagaagtggtctttgcaggttcttgtcacagcaccaggaaagtccactgctcaaagtataaggactcctaaggaccagtgaggcctgtgctgttataatgaattatgactggatccatctgacctataacaataaataatacacataaaaactctgcactgctaatcaaaaatgcccaaagaacatggacagagagaatggaatcttttttgactcgaaaaagaattaaagtgtggtactcaaggggactcataatgagtttggatcatgtgaccatggaactggagtttgatgagcacatgtagcatgaggtcaagggcagaagatgggggtgctggtgcgacatttggccaagggttgccaggctgctctgtaaaattactgtgtggtgtttatttatacagagtaagggcacaaacatccatctctgtggcctcatgttgggtacactggccagcagcgtttgcctaaagacccagctgagagcagagcatcacgagcacctggtgggtcactcggctggtcacctggacccttgtggcctggtagacccatgggtgtgcctgctagttccagtgaggagctgcttccagctttaaaacaaagtgtccaggagcgttccagctgccgaggtctgattgcctttcagtctctgtgcggcccatcagagcgtccatctcattgccctgagctgccccggctcccgctggcagtcatccatgacccacaggcagctcgacagctcaatttgacttgggctttgtgcctctgagcattaaaagatgcttccctgctggccctcttctttccttgtgtggaaccagccaccttcacccagacagtcccctcccaaacactttctctaaagacctgtgcagagtgcggacctgcagatgtgtgtgtggccgtgggcagaatctggacccacttgctgctctgagccccagcttcccaggctgtaaaagagttctctctgcccagctacactcaccgggcatggacgggtcaaaagagaactcttggggacagtgcttagtcaaccaaaaagttccagacaaatgttagttattacctctgtctctcgtgaagagatcagaacaaaacacaataggaaagagagaaatctcacatgcctgggtaactgggagaagctggggtctcgggtaagagcattgcttgtgtctctgggcaaatagaataaggaaaccctacatatctccaagctagagatgccgtcccagaacagaactctctgtgtcttcccgccctccgtggacggtggactgggagcggaatccagactccaggctcccccctccacactacctgcagggctcaggtctcagtcccttttgtatttattagaaactggcatgcaacagacactggttgggtggatgggtggatttaagattttagatattaataccacactccagatagaaccatcttcaccggcaggtttataaaca

SEQ ID NO: 38566 - DNA, 866 bp, Bovine  19866881342724
ccttgcactgtgaactcatgcaggaagggcctgtcttagatacaggctcagagaccccagggaagcagcagaggccgagctggggaagaagccaggcgtcccgggtctccagacctccccctgcttcagctcgctctctgccacagcacagtgactgtggatccgtacatgtgtgtatgcaaggcggtgagagaggacactcatgcatccgattctaaactccaattttcattttgggactcggatgtaaatctgctaggtattaagttcaggagatgatgtaatttattgaagagcgtttggaagctgctaagctccctgataaataaatcatgtttcttcatccccaggtctgtgaaaatgcatcttctagggactttcatcatcccccatcttgcccccccgaccaaagtattagaatctcccctgcaggagagccaagcatacagaaacctgtctctttggagatgctcgatctttccgggccaagaaatagcacactcgtgtggcaactagccagcaacccctgtactgtcaccctaattctttccaaaagagctttagtttcatgagttacagagggaggatgttatagaaatggacttggtatcagaataccctagctattgcccacattggctcccgatgtaatcggtgccaattacatcatcaccaggagcatcattatccattgttcccaaggtttggaaagctgtctgcagatcccaggtccagaagatgggagaaatcacttagaaatcacttcatccccatattggccagggaaaccatttctctattctcaccaggtaagactgggaagggctgggacacaaacctgtatttctggtcttcagtcctggttt

SEQ ID NO: 38567 - DNA, 1883 bp, Bovine  19866881364745
gagtggtctgcccatctgaatggagagaaaactggtacccaggggaggaggaggaggagacacaggcaggatgagacatcgggccaggtatgtcagttctaagtgccacactaaggtgtttggattctagaccacattgtatcctcaaaaccacaatgacaagaaaaaaaaggacctaacttatagacttggtgatggacagagaagcctggtgtgctacagtccatggggtcacaaagagtcggacatgactgagcgactgaactgaactgaacttatagcacagggaactatattcaatactttgcaataacctaaaagggaaaataatctgaaaaagtcatctatctatggagtggagtgttagttgcttagttgtgtctaactctttgctaccccacggacagaggggctcaacaggctcctctgtccatgggattctccaggcaagagtactggagtaggttgccacgccctcctccaggggatcttcctgacccagggatctaaccagtattgcaggcagattctttactgtctgagtcaccagggaaccctgcctctccatctatctatctacatcttacacctgaaactaacacaacattgtgaattagactcacagacttagagaatgaatgtatggttactggggggaagggtggtggggagggatagattgggactttgggatggacttgtacatgctgctagatttaacatggataaccaacaaatacctactgtacagcacagggaaaacggctcaatatcatgtaacagccgaaatgggaaaagtatttgaaaaagaacagatacatgtatgtgtataactgaaccactttgctgtaaatctgaagctaacataacattgttaatcagctatgctccaatataagataaaacgttaagaaaataaatcaactattcttcaattttaaaaagagtagagcaaattttattgagaggacactgaaagacgaggcaaatgagagcaactcgttagaaaatgtttgattgcttgaaacataaaacagagaccatcagaccttgaaggggccttcaacttcatctgatccaaatgcctgatttcccagatggggaaatttcagctgaaataaaaccaaaacctgcccacgcgcactcagtggataaagggaaaagccaaagctagaaaccagtgtggtgttttttcaccacccccccacccttaataaattcaaatctccagacgtagacaaatcacatcccacgttgctcaaagaactcgcagaacccttgtcaataatctttgaaaaagcatggagaatagcagaactgttaagagacaagagaagaacaaagttgtcccgattctcaaaaaaaaaaaaaccaggggggagggaaggggcacattataaaaacgataagctagtcagcttgacaattatccctggcagaattctagaacagaattttaaaaagctatttactccacaaacattattataatgatagaaacgaagggggaaataacccacaatttgaccactttaacccatcaactgaacagagtattaagtagactctttgtaagtctttagaaaaggagagatcactcagagccaacccgaaatctcaggaaacaaaacacgtcttcatttatttcttttttgatagggatgttagactggtagaaagcagtggcgtcaaaaccatgcttgctttcagcatggcgcttgacaagatccatcataatctttgtgggtgagacgtgaactggctcacagccagtgggaacagccatggctggggtaaggattgtacctaaagactgctgattagtgtgtacatcagcttgaagggacgctatggtgctgagccacagaggtctctctttattc

SEQ ID NO: 38568 - DNA, 1439 bp, Bovine  19866881423072
tctgactctttgcgaccccacagactaaagcccaccaggcttctctgtcccaggatttttctgagaaggatactgacgtgggttgccatgccttcctccagggggatcttcccaacccagcgattgaaccgcatgtcctgtgtcccctatatcgcaggcaaattccttaccactaagccaccagggaagctcccagtgcccacagttgtgagacagttttcatgagaccctttgccaacaaaacggaacagaacgtaaccagtagcttcggaccagcagatgccatggaaattgagaagcagcaggagagaacaggtgtcggggctggagaaaatgactgactttccgtgatgggcatgttcctgaagacagcaactgcatagttctcagaaagctctggggaggaggggcagaacggagcccagggagcagacagcgtggagggtgaggaccggagtccagtaggcagaggaacagagctctacgagcagccaaagccaccatgtccagtgccagagaagagcccagggagcatccaaaaatagcaccagggcagagagtcagatggccggagatggacgcctggtcctcctgtaccacacttcagaatttcctctgaatgtttatacacgagatgtctttagtcatcactgaaaccctgtaaaagtctggacacataattattgccatgtgacagggaaggaagctggaggtcagaaaggttaaatggggtttgcatcataacctgaatagggaaagagagaatgaagaccagagcccacaggtgccccgtgtgcatgtgacttctgcctgataccctctgtctccatggcgaccccggctgagtgtagagtcacctgcccggctcacatcccacgtggatgctgtgatccaaatccgggatgagggcttaatccaactctgggcaagatgagggtcaggggaggagatggtctttctgcacatctgtccataaaggaaacagagagcagcttggtggtgtccttccagtcaaaggagagacaggcccctgttggcttggggaggggaagtggggaggggaaaggggggaggggttggggcacatgggcaggtctgctgtttaaggccattcaggaggaagaaccaggagccaagcatccaattaacctgacatctcttgcagccaaaatatttgaggatataagaagaaaatttaatatgtggaggcttgggagaaaagtgactaatagctggaaaacagccccagtttatttaaaaaaaaaaaaataggtcagacccaacagctccaaaagattccttcccagcagttccagatctgggagatggagggggtaccgcatggcggcaatgcccccccgacatgaagcaggtgtggctattgtgccacaaaaagatggcctggtgctgccaggaagtgacgggacaccatgcacgtc

SEQ ID NO: 38569 - DNA, 1163 bp, Bovine  19866881514533
agatgccggttcgatccctgggtctggaagatcccttggaggaggaaatggcaacccactccagtgttcttgcctggagaatcccgtggaccggggagcctggcaggctacagtctatggggtctgagtgtacatgcacacagcacagttggtgagtttggatatttagtaataggaatgccctgggggaggaccctggtgagcagttctccatctgcactgaagacggaaagccgtggaggacaagatgtggagccgtgtacaaaccagggagcccaggatgcggtgagtcccacccggccacgtcacaggtgcgcttggaagcgggggagtgtgacgctgactacatagccgattgaggtttgggatttcttccctaaagccgctgtcctgctccgaatgggggggcttcccccgacctgagcctccaggacttctctctctgatgctcccattcccccgacacacacccccgctcacatcaccaggagacacgcactgaccaccccccagctgtgccaccatggagtccactggccctctttcgacagctctgctcagggccagtgcctgctctcattggtcaccctgggctgccagaggctccggccagccaaggtggccttgcctcacagcctagggccctgcaggagcctgcgtagctttgaccccaggcctgagcatccatgtggcacagtaggcttccctcacccccaggcccatgcaggacgcatctgcagacctttattaaacaggcgttggtcaccacttgctttggatccacgatgtccaccaggggctccttcatggcaacgtcccgaatacaagtcatgtcaaagccatagacgttctcccaccctgtggggacagagcgaaatgtgagggccagcagcgggacccccagaagtccctggggccccctgagtcctagagggtgggcggcagcttgtgttccctggtctgacgacaggagaggtgcttgcctgggggagagtttcacaaggtgccaaacggtccttcacaccatctaatgtgcacaggtcccgattcagggttaggaaaagtgaagctcagagagggtaagaaacttcaccgaagtcacacagctagactcctgtcgggccaggactagaacccagattcctactgttctgtatctgctc

SEQ ID NO: 38570 - DNA, 827 bp, Bovine  19866881516761
ccctttttttggtttttgagaaatcggagccttccaggtctggatgggagtttctccttcgatggtacaaggtgaccttcccggggcagacttttagggaactgtgtgtcctctgtggggggccctggcctagccatgctcttccgtggctcgtcctcatgacagagctgaggtcccagaagaatttggcgggacagccctgggtgcgtgggtgtgtggccaggtgccctaaacacattgactctgcctctccttccacacaggagatgctgaaggacgaggtgcggacgctcacttaccggaactccatgtaccacaacaaacatgtgttcaaggacaaagtggttctggacgtggggagcggcaccgggatcctctccatgtttgctgccaaggccggggccaagaaggtgttcggggtgagcatggcctctgcggggacactggcccttcccggtccttctggtccttcccagttcccgtccttgctggggtcacacacaccctccaggaggcagtcaggcatggctctcgggaggcaggcaagctccttagctccctgtcacctgggcattgctcctggccttgccttggagctgctgacatgtatagaggacttgacttttctgaaaccattttgggctcatcattgccttggagtccttagtcctatgtgggcttgagaggcagggtggccacacctgtgagctctggttggaatctccgctcttccactcccaataggtatgacctggactattcacatctcttctgtacctcggtttccccacctgtaaagtgggcataactacagtacctgcccacag

SEQ ID NO: 38571 - DNA, 812 bp, Bovine  19866881676759
gcgattggtggtcttctccctgaaggtggttaattggtacagaatgtagacttcagttgtcttgccagccccgatgaaaacgcagctggcaggtagccgagacggaggaatttgtcataggttagatcagccccagctctaagaaccgaatgtacggcttatgcaaatagttttgcttagcatggatcctgtgttcctctccccccctcagtcccccccacaactattttttcccctgaagggtggggagggaagcaggggtggggggccgagggtgagggggttgcggacagaggaaggaggcagagagagcacttgcttgccagatctcattctccatcagaaaggagcaaattgctttccctaaaaaaaagaaaagggcaggagaaaaagaagacaaaacacccatcctttgggctaatgtaccgagcatttgaaagctgaatggctcggtaagaaaggccagccatgagtgtatttgaagagactgttatccccatcaaaacccattcgtactctctgggaggcctgtggagcacctgggtggggacttggaacaggggcatctcttcctccctttgccatgatggcatcacctccccaaccctgcctcggtgtccgaccatggcagatgctgaccccagcctctgggtcacccacaggtcccagcagagagacggctgcagcggctactatcagcatgtgtatccggcagacaagccagttccaagctgtgcgattcaggatatatcgcttaacctctctgagcgacggtcgcctcatctgcacaaaccggggtagaatggtttcct

SEQ ID NO: 38572 - DNA, 1742 bp, Bovine  19866880457903
cccagttagcctctactgtatagattgaacatgaaaaaatcttcacttttgcagttcactctaactgcagccctcgctctttatcatattgtttagggcagcttcagatctaaagaaccatgtgtgctctgctctgatagtagtcaagaagtttttgtagtttatataggaatccatcaagaaataagatgcatcctttctgaaagcacctcctgtgactcataggggtctttactggcccttttacatgatttgaagagaaaagtacaatctctctttccccacacagaggagtaaggaaataatagatctgttatctgaacaaaagataggtaattcctttttactcatttgaaaagaccctgatgctgggaaagattgaaggcaggaggagaaagggacgacagaggatgagatggttggatggcatcaccaactcaatgcacatgagtttgggtacactctaggagttggtgatggacagggaggcctggtgtattgcagtccatagggccgcaaagagttggacacgactgagtgaactgaactgaactgaatttctttttaagactaaatcttttaaagcaaagctctttctatcatccaacagcctactttcaatttatcttttcttatatagatatgttgcaacttggtaatgggtttaggattccaaaacttgctcaggccacatcttaccacaccctaggaaaaggatctagcactactatattttgatacttaactatcactcattgtcctcaatgacttcagacaaaacactgaacactcaaaaggattccatttatctatctttatttatgatttatgatatttataaatatcctctatttatgagcaatgatgacctaaatatttaaaagtaataatttctacattagtgaataaagtataattcttactaactcagaataaactattactttgaatatatagctccattctgaatgttgaatgcttaaaaatcctccagtggtccctattttccagaaaataagtttaaagggcttagtatgaatatgcaattcatggtcttatcccattatctctcactaacttgttttcttcatttttcaacataactggtatcttcaaggtacaagactaacaggataattttacagatccacttaggctgaactcttatgaccttactctatgaagattttgccaacacacacatgtactgaagcaaaactaatacatgatgaaataatatattaaaaattcttaattttatatcaatatagcagattaacttttctatttttaacctagactatgactttctgttgtgtatatacatatgttcatacacacacacacacacacacaagttcacacagcgaaaaaaatgtgagtgtagtacagtatgtgttaaagtactatttgttgaaagaataaatgagtttagactggcagagtttccagactttccatattagaagggttcagtgagcaattaaattttgagaatgcttcaaataacatagctagtgataattatactctgaatctatcaaactctcttcctttgatcatagatatatgatatattatattgttcttttggggttttgaaataaaaaaataagcatttaaaaaagtacttacaaagataaatatgtttatagactaaagaaatagtttggaaatacattaatccatattggtgatgagcatatagtaaattgcacagtgggatataaaccaactttttt

SEQ ID NO: 38573 - DNA, 1373 bp, Bovine  19866880561151
ttaggaatagagtattttggtcataaatatattattgatacatttcttttgtaaggttattaactttgaaagcataataataacctatgtttcagttatataattgtttttatataagatatatatggctttataatagtgtcaagttccacatgttctataagttaaaattatactaaaaagttccctcttcacctaagtagtgtatttttaaaataaaagaagcaatgtcaacattatcaaaaaatattttaaaattttaataataatttgaatgttttgatcaaagtaaaaataaaaggcaatcggtaatgcactagaccctcattgtcactaattagacatagcaaagctgtttaacacaagaaatattatacaacagtctcagaatatgtggaatattaacaagattgattttcttgagcactttattccttgaaattatgtcaagattaaaagaaaataacttgacattttaaaagtgtcaatatgctttaatataaagcacaaatgcagaggaatagttagtctttacaagcatcagcttgtcattttcttagtatatcaagcaatgcacattctgtagaataaataacttggcaagtacatagaggttaaacatgtgcattaccacacaatcaaagaaatctgaccacccctgtcaataaactcaacataaagtggcaataagattatatataataatctccaaaagaaaatgaaatgtcaaaagcaataggtcaagagaaaatcagagtgtggatggggcagtgcatctgagtgtcaataaattctcacaaaatacatctaaaatctacaaatggctcaaagaagacatttgaaatcacggacatggaacagaaataatttccctagcaattcaaataccaaggaatattctcaaggtttaatttctctgcttttcctttgcctaaatgtctttccttggagaaggcaatggcaccccactccagcactcttgcctggaaaatcccatggacggaagagcctgatgcgccgctgtccatggggttgctaagagtcggacatgactgagcaacttcactttcacttttcactttcatgcattggagaaggaaatggcaacccactccagtgttcttgcctggagaatcccagggacgggggagcctggtgggcttccgtctatggggtcacacagagtcagacacgactgaagcgacttagcagcagcagaagcaaatgtctttcctatccctgtttccttgcagaagaatcaatgattgatagtcagtatatatgtcaacagaagccatgaatgttaattttagatttcaataatgactaaatcacagtcaaataggcactctgataaggaaataaggcctaaa

SEQ ID NO: 38574 - DNA, 1402 bp, Bovine  19866880802153
aatatgcctatttttcctagttattttgtatgaataaaaacatttatttcactttcttctaattaagtttcctaatttagcttttcaagcatgcagttctgatgagcatgacagcaaatgaaataaggctattatatgttaaactgttttctgaacataatttttgttgctaaggaaacagcatttcttttcctcataggatacattttcaaattcccatttatgttaagaaattctaactgtatttaggaattaaaaagacttcctatgaatgaaatacatacagctgcaaaacaacttaatcttatatttcagctgaattaatatattcaccagtcataattttcagaagtgcatctgagtctagttggtttttgtttagcataacaattggatgcaatttacccctccattatttttattttcatcaccttcaattatttaattttaatatatctcactaatttttaagcacttttagtgttttaccagaatgcagtcctacatgctttaaatttaaaaccaagtatagaatcaaatttgggcttccctggtgggttcagttgtaaagaacccacctgtcaatgcaggagacataggttcagtctcttggtcaggaaaatctcattctcctctgggtcaggaagtaaatggcaacccactctaaaatattcttgcctgagaaatcccatgaacagagaagcctggcatgtcacaaagtgtcagatatgacttagcaactaaacaaaagaatcaagttcaggccttgattaagaatattttttaaatctctgtaagagggacagaaatttcctacagaggtcaggattctgtttgatatttatattcatggactaccagattttcaaaacaggcatgtagctgcatgaacatacataaggctatttcttcccaaacttgtcagaacattattctaaatattagaatctctgattatcacagttttctttaaacactgttatttatgcatttcatcatatttttcctcctgtttaaagtcatacatttatgacttagtctatcacaatcatgttaccacaaataacgcttaaatttatgaaggaccattaaaactagatctataattcgtctctcacacctatgttactatagacaacttaaagaatagtacaactggtattatactactgttccaaataacaatattccttgtagacaatacaaacatgaaaaaacctatatctttgctctgaaaaaggataacacagatattttaaaggtataatatacatcaacattttattgtgacagtatatagggaaaatactccactgatccactaaaattagtgacatttttatcatttcctggatttttagagtgggtgtatatttatcatgtatgataaatagttccttca

SEQ ID NO: 38575 - DNA, 2556 bp, Bovine  19866881016562
tataactgtatcttgaactctttatcagacagattgcttatctccacttaacttaattctccttgggttgtatcttctttcttctattgcaatatattcctctgtctcctaattttgcctaattccctttgctagttttatcttttaggtaggaagattaaaattcccattcttggagaagtggcctcagtaggagacatgctatggggcccaagcacactgccctttggtcaccagccattatgctctaagtatacattctgagactgaatgggcccttttactgtggtgggacaacttctgtaggcatgcctctatacaggactggcccacagcctagttggttggtgcactggctgcctattcactggtacatgaggccaggttccagtgtggctaactaggggatcctaggggtactagatctgttactggtgagtaggatgggatcccagtgcagctggcttctcagcccaaggggactcataactgacactagcttctgatgggggggtaagtccctagtacaaagaggctagaaggatgattccacaatggcacttgccagaaccagtactctcatcatacaatcaacttcccaaatagtttctgccagcatctgtgtctccagagtgagtcccagttgcctcctccttctccaggaagctctccaagatcagcaagtgggctgactcaagctcttttgaaatcaccgtctctgcactgggactcagagcatgtgtgatcttgcacaccttttaagtgaactggagtctctgtttcctacagccctcatgaccctcccatacacaagtcctgctgcccttcaaagtcagacctttaaggagatcattttcctggtgctggactccaagtctggggagcccaatgggaggctcagatccctcgctacttggggagcacttatattgttgttattcagtcgtcaagttgtgtccagctcttctgtgaccccatgaactgcagcaccccaggcttccctgtccttcactatctcccggagtttactcagactcatgtccattgagtcagtgatgccatccaaccatctcatcctctgtcatccccttctcctcttgccttcaatctgtcccagcttcagggtcttttccaatgaatcagctctttgcatcacatgaccaaaatattggagcttcagcttcagcatcagtccttacaattaatattcagagttgatttcttttcggattaactggtttgatatctttgctgcccaaaggactctcaagagtcttctccagcactttggcagctgtaattatgttcctgtttttgtgtcacccacccagggtgtgggtcttaactatttcacatccctgctccttctacccatctcattgtgattccttctttgtatctttagctgtagaaaaccttttctgctagtcttcagagaattcttataccaatatttatttcagtgttgagatttttataaaaaattatctctccactcattctcttatcacttatactggatatatattgttttaacttttcaatgtcttaaattagaaaaacaaaaaacatttgtgccgcttctttgacccagcaacccagcagagctatgtttcataggtgctagaagaggagattctatagtagaatttcgagctagcattccttagcaattggaatactgtacgttttaattagctaggtttttcaacttccaaaacattcctctttaagaagagaactagtttaaaatgttttccaagtattctcacatatataaaatactaaactagaaaaaatgaggcagactttagaatgattctttctgtgtttgagtatcctgaattttataacatgatttctgaagttggttttctttaaagcatcattgttcgtttaccttttagtcaacattttctcatttgctcggaaaatgagaaactccatttctgtgatgttcaatgaaacttttgacatttaataaagaaacctcaggagtgcagagggtaagcaaagagatttttttcccctcatatcaggaagtagcactgaagtggtgaatatgtggctttatttctgttcttagtattatatcctggcctgcctgcccctagttttaaattgggaagcatctcagagaatcctctgaacaataactagcttttccattttctcgtgatttgctagctctattagatgagagtggcaggcactcacagctagttcaggttgaaggaggatccgtgcttcctcccaaccaatttcttagtgttctacagccccctctccccacctctggccagccagaggaacatattagaacctatattctcatgaaggaatttctggctgtattctgttgtgctgtgaaaacatatacacaagacacgaccccggataggcaggggtagcagtgtatcttggggtctgtgcttttctatgcttctgtttaaaatcatctcaggtatatttttccctgagggaggaaaaaaaggtgatctgtatcactaggtgatatatccaatccaggcccaattacctaagaaaatcttgtat

SEQ ID NO: 38576 - DNA, 5614 bp, Bovine  19866881054489
caatctgtggaaaattattaaagagattggaataccagaccaccttacctggctcctgagaaatgtgtatgcaggtcaagaagcaagagttagaaccagacatggaacaacagactggttccaaatcgggaaaggagtatatcaagtctatatactgtcaccctgcttatctaacttatatgcagagtatattatgtgaaatgccaggctggaagaaggacaagctggaatcaagattgctgggagaaatatcaataacctcagatatgcagatgacaccattcttatggcagaaagcaaagaagaactaaagaaaaataatttttttctgctgaatatgttgtgggtagccattcccttctccaaggggtcttcccaaccgagggactgaacccaggtctcctgcattgaaggagaattctttatctgagctacctgggaagcccaagaatactgcagtgtgtagcctatcccttcttccagcagatcttcccgacccaggaatcaaaccagggtctcctgcattgtaggcggattctttaccagctgagctatgagggaagccctttaatgtaggtagctggactctagagtccattcataaataatcataatatactttatggataagtatattaaggattgcataccagtgcctaggttcaatacttgaaaacagagtatatataaaattaaatatcaatccacttataactacatataaaaataatgcaaatgaagtaaaaatacagtataatgtaatattagtattttatcataatactactgtaacaatttaaccattattaatatttagaaatttataaatataatttaaacagtcagtatacatatagtattgttcttgcctggagaatcccagtgacgggggcagcctggtgggctgccgtctatggggttatacagagtcggacacgactgaagtgacttagcagcaacagtggaaggtgacttactgatgcaaaacttcagcttctattcaactatccaatttcctctaattatatttataatttctttcaatcatttcaaaagactccttcacaatcttatatattccttcatagaatcatctatcagttattcaaaatgacaccctgatctgctaccagtacttgctatgataaacaacaaagagccccgtgtttgctccatatttcattagatcgttcatgaaaaatggcctatgacacttgtgccttcagcctttctcttgacagaagctgaaatctgttcctgctgtccatttggagaagaaaaacattatatgttctctcttcctcttctaaggtttttagatttattatgctcccttttcttcctcagacaagtacgtcatcccctagagtcataagcagtcaccatcttttagaagaccacaaagaagtatccttcatatcacagatactgatgtgtgaaagcaatctgggatataaaatgtcttgcctggtaaacatgacatatttcctaaataagtaactttaccaatcaacatgaagctaacgtatctcatcaactgctgatgaatattggaatcactgctccgtcagttcagtcactcagtcgtgtctgactctgtgaccccatggactgcagcatgccaggcttccctgttctttggaatcactgctatgtagttgctatttggcttagggtggtgcattcttctgtcatgacacgaggaggcaaccagttctttgagtatgtcacattaaggcaaggagaatacaaggacaaaaagttgagaaccatcagataatctacaaatatatctacaacctcatatctataaccaaatgtatgtataaacaaacatatgtataacctataattctataacttctgctgttgttattggagtcactaagttgtatccaactcttgcaaccccatggactgtagcccaccaagctccttgatccatggaatttcccaggcaagaatactgaagtgagttgccatttccttctccacgggatcttcccaacctaggaactgaatttgcatttcctacactgcaagtggattctttagcactgagcccctggggaagcccataaactctatactattatacaaaatatattatctaatgaattaatatatatacaagggtgcattttagattttacctaatagttctagagttgtaaaaataaatatatttttaaagatacagtaggcagtattctggagtagagatttaaatttagacaaccagtttattggtatttctacttcatcacaatgacttttaaaatttatgcttaatatcttccttatgttatagattctttgagaatctggaattgatcaactaagcaattactttccatttcaaagactcagtagtgatgtgactaagttaccatatgccatttgccatattttaaagagaatctatttaccaagaggtccaagaagtcctacagttgatgttcttggacactgttttcacacgggactgatttttcttgctcccacagttataaaaccccaagtgtaacttccttaacataatataaaaataactgctatgaaccttagcacatggttggtggcatattttaagtaacactatcagattcatatattaatagtcaatcgcaacgtggtaagatctacatattttataattgctactttccacattttatatatttatttcaacttggtaataatagcaaaaaatccagcttaaaatgcatgtattctctttgctacctttatgtattattaatgcatctctctgtctatcttgttgctgctactgttgttcagttgccaagtcatgtgtgactctttgtgactccatgaactgcagcactccaggcctccctgtccctgaccatcttccagagtttgcccaagttcatgtcaattgaatcggtgataccgtccaaccatcttatcctatccacttgctttttatttattgaagattccaattctaggatgtcagagatgaaaatgagactggatacagtataaagtttacttctcaagcaaagtctcagaagctgtagtgataagaccaagatcataggtagtcaaagtttttggagtgaatatgtgagttctttagaggtaaatggactaatggatatacaaattaggtttcccctctcagtgcaggaaaactgacgatcttgcttatattagtgaagagaacttgctgatatcagggctggaggaatgagtagagaggcagtggtttgaaaccacaaaacatgagatactgacatagtagtgccatatataagcgagtggttaatattagtgcaatcaataaaaataagtatttttgaaaatgttttccatagtatacatttgggaacttaagatgtcatgctccccatacctcttacacagtttttaacctgaatgaaaggcaatgaaactgaatggaccaaggcctcatttcttaggtagcttaagtattaaccatatcttggaaacatttagggcaaagaacaacaacaacaacaaaaatctcttgaataataagaagtaaatataaaaattaacagtcatggagatgctatattgggtaataaccatcttcttagaccacttgtcatgtataattcctcttaagtaacaataacattggacataaacttatatggttaagaaaatattgatattatgtaagtcaaaaatacagccatgctgaaagatgtgaaaatagtacaaaagacatacagtcattttacttctaataaaaagtgatatttgaactgagtaaaggacagttaagaggtcaggagagccctcactatgctacaagctccatgagtaaaagatgtccttaccttatcaataagtatattctcagtccataaagtctggggcatagtaggtttcaaagaatattgacctactgagtgagaaatgttgtcattccctaggcatgcttatagctactattttgcaagtttaaatactattcattcattaaacttcattatgttactgaggtaatgctcactgattgatattgtaagctttcagaaaagggacctgtgggaaacatcaaaagcattttgattcaatgatttctgttttttgttagcaagtatagccatctgggacatccacatttttggccatgatgctcctgaacagatacatgtattgaatataatcctgagaagcagcacagactagatactgaattgggattttattgcaggggagctgtcgccatggcagtatttcaaggaatgacaaagtaaacatggcagttctcattaatctgctgtatctgttgccagaccacgtggctggaggatggatacctactgatggaatatttcttagctccaaaacaactgaaggtttttactagtttaattgaaaagctcagaaaagtttgagatgtggagtgaagggagtgttcacattattaccttaaagcatgactgcatggcttaatgaggggctttcctgattgaactatgtggtaaagtatctgcctgcagtgcaggagataggggttcaatacttgggtcgggaagatcccttggaaaaggaagtggcaacccactccagtattcttgcttgagaaatctcatggacagaggaacttccatgggttgaaagagttggacatgacttggtgactaaaccaaccaataaccagagtttaaatatgattcatcaattatcaatcctttgctaacacaaaaaattatatcttatcgaaacattgttattaggatttaaggggatatgcacaaaattgctataaaacaaaaaacagtctgcaattattttctcccattctgagggttgtcttttaaccttgtttattgtttcctttgctatgcaaaatgctcagatggtaaagaactgtggcaatacaggagatccaggtttgatccctgggttgggaaatgacaacccactccagttttctttcctggagcattccacagacagaggagtgtggtaggctacagtccatggggtcacaaagagtcagacacaattgagtgactaacacttgctgtgcaaaagcttttaattgtcacatttgtcatatttgtttacttttgttttttttttccattactctagaaggtggatcaaagaggatcttgctgtcacatttgtatacctgtgacatatatatatataccttaatttatggcagaaaccagcacaatattgtaaagttattatcctccaattaaaaaaaaatagtctggacactatatagcagtatttgtgtcctgtttttgcaaactgattttttttagcatcatgtcattgttaactcatttatattcactgtaatagcactagtcataatgaattcattcagattaatatggctgtcacacatactttcataaaaattctatagcaattcaatcttaatttaatatactattcaataaagtgtagatggtttaagtcacttaataatgccattatacgaagctgtaaagattataacagtatagattttctccagagagatgtgataatctagaagtggcatctctcaacttccatcagcagcctaatggctatgatcacaggcaactaatagctctctgaatggggtatgggatcctccactggg

SEQ ID NO: 38577 - DNA, 1078 bp, Bovine  19866881395098
ataccatctcaaactgctcaaacgggatatattttcttatcaagcagtacatttcttatcgtaatgaaaaggaaaatggattcatgggtaactctgataagttaacagagataatgtgttgtagtaaacattaatgtatcattccattgctaagaaacaaaaggaaataaaataataaagaaggaaggaatgttttggagcagaactgtataaccaatcaatgaaaaactaagcaaaactggatagctgacaatcaattaggtaaaatatttaaaattaaattctctacttttgaaacaaaaagctctagttcctctttgaaataaagtgatcataattaggtaaaagttataaacaatatccatccaaaaaagaataaatgaaattgtcaggtacaatttagtagcatgttgaaaatctcatttgtgagtggaaattctcattacccaagaagtttttccaaataaacatattagccttctgttagctgatcattgcagacatcttcagctatccaatgaagtaatcagtcttccttttgaaatgcaaaaaagtttaagaatattttcaataatgttgtaaagttataggctactctatgaaaccgaaaataaaggacaaaaattagatttacagtaattctaaactagatccctctgttatcaagtaccacaggaacaatacagacactggcatacaaagcaattagattagtccttactgctgctgatgctaagtcgcttcagtcgtatccgactctgtgcgaccccatagacagcagccaccaggctccctgcccctgggattctccaggcaagaacactggagtggttgccattgcccttgcagccatgctgttgttgagaagaatacatatttcaacattattttaccaattttagcaacataatcaatacacataattcctgccaacataccaattatctgtattttgttgtatcttgttaccactaaaattgtcacatatttgtcaagtatgcccctctttgtggcttgctgctgctgctgctgctaagtcacttcgcttaaatatgcattcacatgtttcattcaaatt

SEQ ID NO: 38578 - DNA, 1238 bp, Bovine  19866881745293
attatttaagatgttctgagattgtatatcctaaggctacttgggttctggaaggttaattttatttttatagatactttcctaattcattgtgactcaaagtgactccccagttgcattcctgagacctttcctttgtctttatttccatggataagtctgctttgtatcaatggtatcacatggtatacaaaataaattatattttgcttgaaatttattatacagaaacaacttatcttaaatataataatacagacaggggtatagatctatatattcttcctaccattgctctggcaatttaattccttttcaggtataacaatagagttacttaaaatgcttgcatgatttttttttataaaataaagattttatatatatatatatatatatatatatatataataaagaactgactcattggaaaagaacctggtgctgggaacgattgaaggtgggagaagaaggggacaacaaaggatgagatgattggatggcatcaccgactcaatggacttgagtttgggtgaactctgagagtttgtgatggacagggaggtctggtgtgctgcgtttcacggggtcacaaagagtcagacacaactgagcgactgaactgactgatgcctggtccacagtacctgccttccaaacgtcaccttcacgtcaccttgagcaagtgacactgagaaagaaaagtcaaagaggaattcatgaaccaagttactatctacaaggcaagctgaaaaagcatttatggtaaagttacgtggagacttctgtatatgtttgtacatgaatgcacatatgtatgtacctttaagttttatgtagctagaaaacaaggtcatttcaaaactctgccattattctatctatccaacacatgttaccccagttctctgccaggaaaaaaatgtaaatttcctattcgtgtcaccagtacaatgggtggtgcacacttgtacatttccagcccaactcccaggaagaatgagtataaatgcagcaattagcacactgttatactaaacttcaaaacctcgtctgctatacttaggatcacaaacttgacactcgagcacagtttggcaaggaaagagtttctctctggctaaataaactctgctttccattttaaaatgataactccaattatacaaaaaaatacaatatactcctcccctaaaaaactctcttagtgctcccaagagatattgcctcttcctgta

SEQ ID NO: 38579 - DNA, 917 bp, Bovine  19866880200547
cactgctactgctgctgctgctaagtccttcagtcgtgtccgactctgtgcgaccccacagatggcagcccaccaggctcccccgtccctgggattctccaggcaagaacactggagtgggttgccatttccttctccaatgcatgaaagtgaaaagtgaaagggaagtcgctcagtcgtgtccgaccctcagtgaccccatggactgcagccttccaggctcctccatccatgggattttccaggcaggagtactggagtgggcattcagcacaatgaatagcaaatattaagcattcaataaatatttcttgaatgaatgtgttaatgaattaagttttcttctcaaagagaatgagtgagaaactggaaaaaggactttaaatcatttatttttaaggctgaaaagaaaaattccactgataaggacaaccagcttgaatttgctaattttagaatttcagtgactccatgattaagagctcttgagcttatacagtctctaaagaaagaaacaaatgagtaaaactctaagatatttacctaaacacaaccaagggactggctgctctcatagccattactccaaggtagcaagagaaccttttaaggcaactgaggacagtgtttcctaagtaacaactctatgaagtgttggctcccacatcctgaatagacagatactcatctgaatagctcattaacatgtgatggctctgcggctcgaccacaggccacttatcatcattatcacttatttactcatttatgtaatggtggtggcattatacttctcaacagttaatggccttccccttatgatatcagtcacaccaaatctgcagctttgatatatagcatgcactctggaagcactgggccttcagtacacagacagttaccacggaagacaaacg

SEQ ID NO: 38580 - DNA, 1941 bp, Bovine  19866880353255
ctagataacatattcaaaagcagagacattactttgccaacaaaggtccatctggtcaaggctatggtttttcctgtggtcttgtatggatgtgagagttggactgtgaagaaggctgagcgctgaagaattgatgcttttgatctgtggtgttggagaagactcttgagagtcccttggactgcaaggagatccaaccagtctattctgaagatcagcccctctgggatttctttggaaggaatgatgctaaagctgaaactccagtactttggccacctcatgcaaagagttgactcattagaaaagactctgatgctgggagggattgggggcaggaggagaaggggacaacagaggatgagatggctggatggcatcactgactggatggacgtgagtctgagtgaactccgggagttggtgatggacagggaggcctggcgtgctgcgattcatggggttgcaaagagtcggacacgactgagcgactgaactgaactgaactgaactgaactagctatgggaccctggtgggtgagtctctaagctcccttggcttcagattctgcaatgtaaagtgggcgtcatcacatgttatggtgcttgggggtcctatgaaattaccagagaatatccactttactaacatcaaatataagacccagtggaattggccagaggttaaaagactgagattgaaagccaagcattcttgagctcacagcatgaagtcaccaaattctttctcttccctcgatcccatgtgtgactggccaatggagctgcaggcctgtctctgagcttatgggctgagggacagtaaagcaccaggtcattctggttctgggctttcgaggccggggagccgtacctatcctgccgccgctggcctccaggctctctgctgcctcttgttgtctctgcagccgccaggcctgctgcaggaggtggtgcaggctcagggccagcgcctgtctcatgtccttgatagcagcctccaggagcccctgtcccctcggccctggcctctcctgggagctccggagcactgtaatcactcgcctctgggctgccagcacattggcatccagcaggtcctggggccctcctgtatggggcacagtccggccctcctgtagggaagccccctggagccgggctggcttcctgctcagtggctccacaaagctgtcaccaggcagcaggaggttccccgaggcatcttgcagtcctcccagtgcaagcacctgacctggaggcaggaaccagagagagggggatgcgggaagggatgggggtgaatgaggcaaaagagagaaccggggggccaggacagagtgagtgacaggatgcgggtggaggtcagggatggggcagagtctagggtgagggagggcagaggggagaagggagggcagaggggagaaggaatgtctttcttgatggaaaaacatccatatgcttttactgcagaagcagctcagttctcgtctctgcctcccaccctgggcggggcgggggcactgtgctgaagatgagggtgagggaaaccgggaaggagaggaaaggtggccagagcatgaagggtggaaatacaggtgggcttggggtggaggctgaagactggaccagaatgtggagggtctgggctactgaggggaggggcttgggaagccaaaccagagggaggaagggcagaaggaaggcacgagggctgccagcagacctgtgttttcatccaacccgactcccaggattggcgagatgcctcctgtgacaggatcctccatggggccccccagctccaaaggggccagggtctgggtgagcggattgcagtatgtccccccaagagtgagccactgccttgtttgtgggtgcagagtcacagccagcacaggcacctcgatgcccgttatggggtctgtcatgagagcc

SEQ ID NO: 38581 - DNA, 1417 bp, Bovine  19866880411388
attcattgactcttatgacaggtcagtatcttcattctattaccttatagggtacattcattagtgttacataaaatttcaagtaaaattaaacaattaaaagtacagttaagaacatagttgatctgcatgagaggattcaccatcatgtaccctagtccctaatgcagttattttttctgtttcctgggcctctccagcttagactcattttcatttcagagaatataaaagtggctccactgagctctcgcccatgagggcccagctgctgcatatcagtgtgtgttgacccagtggtacctgtccacccggtgtccagcagtaggcctgtggcctttaggggtcttatgcaacgcatgataagcatttcctaggaggcccatctggccatccctcatattcttttttcggggaatagcaaacaccctcttccaacaacacaagagaagactctacacaccagatagtcaacactaaaatcagactgattatattctttgcagccaaagatggagaagctctatacggtcagcaaaaacaagaccgggagctgactgtggctcagatcatgaactccttattgccaaattcagacttaaattgaagaaagtggggaaaaccactagaccatgaatggtatgacctaaatcaaatcccttatgattatacagtggaagtgagaaataggtataagggactagatctgatagacagagtgcctgaagaagtatggaccgagattcgtgacactgactgaactgaactgaagtcacatcaggctaacattcccaccatagttactattaacgcaaaaaaccccccaaaaccctgatacattgtaagcgtgatagcattaaagatatcagagaatcacggaagcaaagatgaaaaataaactaaatttccagacattcgggaaatgctattttttatggtaacttggacatgagaaaacttttggcgtcattatgttgattgtggaaataaactccctggtaaatacatatgtcaaaagtttacaaattttgtattttaaatatttatagtttcattatatgtcattcatacctcaataaagctgtttaaaaaattaatcaaaaatttgttaaagggtgccagatgctcaaaacacctgccaacatcttatttattccaaattaagtacccagggaactgcagaattactgctcatattcctttaacattaaaatgagaataaagtaactgtgataggcattttctctacaccttcttagctaactctggagttcaatgagatcttcagttcagttcagttcagtcgctcagtcacgttcgactctttgcaaccccatgaatcgcagcacgccaggcctccctgtccatcaccaactctcggagtttactcaaactcatgtccatcgagtcgatgatg

SEQ ID NO: 38582 - DNA, 1206 bp, Bovine  19866880447369
cacacacacacacacacacacacacacacacacacacacatatatatttttaccagttgtaactttagggacaaaactaaagggacacaggctctaactcaagactttcctatacactttcttatcctttatgtttgggatctttttttaatcaaccacagatgtatagcaggcctccctatcttctaatattttttcatggtggcttttttctttttctaggttttccacgatgatgatgccattcctggatgggaagggaaaattgtagcctgggtagaagaagaccatggagaaaattaatgctgagtattagattggggacttgcagaagttggcacaccctggatgcttcactcaggaaagaggactaaaaccagaatacacaggaagtttgtgctgccaaaacagaagcttctccaagtgtgacagccataggccagtcctgtttgtgtgcctggcatgtgtggtacctaaaatctctgtccaaaagtagaccacaggttcttctggagttccttgtccgtgggaacacactgttttactctactctgcggacaacaaaccgaaggccttaaccaacggggatggatgatcccgctcctttgtgggcatggctgctattatctggaacccgggaactggatgcatcactcctatgtgttacagtattattttcattttaattggtctcagtggttgcagcaatcagggtcccagcatttgtactcacagacaaggtggaggtaccagcttttttgcttctttgcagctattgcaaaccaagaataactcaaaaggtggtaccaaagatgaaagcccactcttcaggaatttttttggactggacgtggatggtgctgaattgctaattggattgaaaaagggctgtccatattgtgctgtactatgctaaaaccataattaagaccttgggctgcctcttgcgtcttaactgattctgcaaattgtcctttagcccacagaaggcgtatttcatgtactgcttgtttttctctgtggactctctaactttagagccatttccccccctcttctaactgatgaactttgtgtttgaaaggaataaggagtgaaaatctcctttcaaatccaggcgggtaggaaaggtgctgctacccttatcttcttgactttctttctctcatgacttgtctttagcccaggcatctccttgcagtcaaa

SEQ ID NO: 38583 - DNA, 3116 bp, Bovine  19866880454771
ctaaattgtttgagcccattgaccatcaggtgtacctggtggctcaaatggtaaagaatctgccttcaatgcaggagaccccagtccctgggttgggaagatcccctggagaagagaatggctacccactccagtattcttgcctggagaattccatggacagagaaacctggcaggctacagaccacagggtcataaagaatctgacacaactgagcgactaacactactaaccattatggacaaaacgcctgctgacatggcctgacctaactttactctggcttcttccctcccctgaagagcctgaaccttgacccactttcaacctgagccagcatcagaacaccgcacagcccttcctgacgaaacctgttggctgctgctgctgctaagtcacttcagttgtgtccgactctgtgcgaccctatagacggcagcccaccaggctcccccgtccctgggattctccaggcaagaacactggagtgggttgccatttccttctccaatgcatgaaagtgaaaagtgaaagggaagttgctcagtcgtgcctgactcttcgtgaccccatggactgcagtctaccaggctcctccatccatgggattttccaggcaagagtactggagtggggtgccatcgccttctctgaaacctgtcggagacccttgcaaatctccggctccaagcactctattacaatagtgcccctcccctcattgccatagtcttttcaaataaaatatctccatatcttcctctagaattttttttttaactgtaagaaagtgctgagaggtgtacccagtgttataaatattgaggactatggaaagtgaaagtgaaagtcgctcagtcgtatccaactttttgcaactccatggactataaagtccatggcattctctaggccagaatcctggtgtgggtagccttttccttctccaggggatcttcccaacccaggggactgaacccaggtctccagcattacaggtggattctttaccagctgagctacaagggaagcccaagaatactggagtgggtagcctatcccttctccagcagatcttcccaacccaggaatagaaccagtgtctcttgcattgcaggcagattctttaccaactaagctatcagggaaggccagaggactatggggtatggtctaaatacttaaccagacaatcatgtcttagtcctattttacaggtaagaagatggaggtagcagaagtctaagagacttgctgactcacagcaccgagcgcagatttgggaatccaggtgttatttcttgtctcctaggaaacagtgctctttccagcatgtgcttgcaggctaagtcgcttcggtcctgtcggactctttgtgaccctgtggacagtagcctgccaggctcctctgtccacgggattctccaggtaagaatactggagtaggttgccatgttctcctccaggggatcttcctgacccaggggtcgaactcaagtctcctatgtctcctacattgaaggtgggttctttaccactagcaccacacagcacaaacatgctcagttctggtcaatgtttagagtaggtttggggaaattattgaaaagtgttggttaaaaacaatcttgtgtttaaagaaagggaagttgtatccaagagtgaaaaaaatcagtggaataccctgagcttcaggaaacttctgatccgtggaagtgaatgaagaccacccatatgagaacaagcaaaggctattgatttagagcttgctctagcaagggagttgaccatcatcacttgcacgtgacagaaactcaaaagcaggcagaagggcttccccggtggctcagtggtaaagaatctgcctgctaatgcaggagacgtgagtgcaatccctggtccaggaagatcccacctgccatggagcaactaagccggtgtgccacaactactgagcctgtgctctagagcccgggcactaagactactgaacccagtgctgcaactactatgtgcccagagcccctgctctgcaacaagagaagccaccacagtgagaagcccacacacctcaacgaggaatagcccctgctcaccgaaactagaggaaagcctatgcagcgacacaggcacaaataattaaaaaaaaaaaagcagaggttagagtgtgacagttttctggcggataaaaagggtaggaagccctgattggaggctgttagcgtggagaagcagtagataggccagtgagacatggagctttcctgtgtaattggttacgggtgcattctggctttctcctgtctgtcctatagcagaagtaggtacaaaaattagggaggctgtcagttattaatcaagtcctggctgtttgggatcaattgccacagggattaagatttggctttctggactggctactgttgttaggaggatggcttcctgggcagattgcagcaagctgtgggccagggttctatttttatttatagtctggccaatgtatgttcagtctctcagggctctacagggaccttgcatttagaagaggctttcagatatctgaccaatcctgcagaggagtctatatgcaggccagggatattggcaagaggttttccacttccagtctggagaagggaaagtattgtcgacttgaaaagtagttacaatttcctacctgacagaagggggcaaaggtggtcacttgcaacccagccaatcccactgctgggcatacacagtgaggaaaccagaattgaaagagacacgtgtaccccaatgttcatcacagcactgtttacaatagccaggacatagaagctacctagatgtccatcagcagatgaatggataaggaagttgtggtacatatacacaatggaatattactcagctattaaaaagaatgcatttgaatcagttctagtgaggtaggtgaaactggagcctattatacagagtgaagtaagccagaaagaaaaataccaatacagtatactaatgcatatatatgaaatttagaaagatggtaacgatgaccctatatgcaagacagcaaaagagacacagatacaaagaacagacttttggactctgtgggagaaggcaaggg

SEQ ID NO: 38584 - DNA, 2366 bp, Bovine  19866880490123
tactatatggagaaattcgactagaaaaaatggtgtatatcctgagcactcagccaagttgagggaataaaaagagagaaagaagaaaaaaatagaaaagttttgcagcaaaagagacactgatgtatagaacagtcttatggactctgtgggagagggagagggtgggaagatttgggagaatgacatttaaacatgtaaaatatcatgtaagaaacgagttgccaatccagattcgatgcacgatactggatgcttggggctagtgcactgagacgacccagagggatggtatggggagggaggagggaggagggttcaggatggggaacacatgtatacctgtggcggattcatttttatatttggcaaaaataatacaattatgtaaagttttaaaataaaataaaattttaaaaaaaaagaaaagaaaagttttgccagaatatcattattgtgatttaaatcttcataatttgcttttccatgttttccaattattttgtttctttgcttttacagtgagcgtactcttttttttttccccctattttaattctaaaaagtgggcttccctggtggctcaggggtgaagaatctgcctgcagtgcaggagacacccgtatgatccctggtctaagaagattccaggtgcctgggggcagctaagcccctgcatcacaactactgagcctgtgctctagagcctgggagccgcaactactgagcccatgtgtgcagctaatgaagcccgaacactctcgagagtgtgctccaaaacaagaggagtcaccgcagtgagaagcccgcgcaccactcccagcaccactcccagcactagagaaaaacctgcgcggcaacaaagacccgacacaaataaataaatacaattatattttaaaagacggaaaaactacagaggagaaatggaaacactttacctgataaatactctttggattgctgactttaggaattatctgaggttctttgttacaactgtcttcatcagaggaagcgccggaggagtagtctaacgtggctctattaacagcatcactgatttgttgggataatttccattcctcccatctgcctttgaaagaagcaattgtaaatggatgatttttctcaccatacctaagaaagaaaggaaaataatgcattcattagggactcaaattctcacaggtttttatttctaatcttttctggaaacagctcagtaacttacaagaagagttacttgaaaacaacaaattgtgagaattaggccaagaattagtagcaagaccctgagcttaccttctctcctgagcacaccaagattacaactatttagacagcagttattgatgacagactgaaatctagcagaaaagatcttctacaattaaagtgataaagaaggaaccacaaagagacaggtaagaggagtggagtacagtccagacgcatccctgcaggtgggcaacacacaaacagggggataatgacagcggttctcccaaagagcattcagtgggtgagccccacatcacactccccagaccagggagccgaccccaggaagatgagcccccagaatgtttggctttgaaggccagggcgcttactttctggagagccagatggctgtgggaaacagagacaccactctcaaaaggcccacacaaaatttcacatgctctgggacccagcgcagaggcagcagtttgaaaggaacctgcgtcagacccacctgctgatcttggagagcctcccgaagaggcaggaggctgtggagctcaccctggggccacagaaactagcagcagccattccgaggcgctcgttccaccatacgaacactggtgctggcgagggccgctttgaagtcctccctctagctgactagatctaggacccagacccgccactagcccatcagcaccagtgctgagcctcagcccaaacacctggccaggtggggaaacagtcccacctactgtcaggcataatgcccaaagacgagcccacagccaccccagaatactacactgtccaccagagggtgcagcacctggccccacacaccagggcaccagcactaatcccaggacccccagggccctgcaagcagagacctaggacccagctctgcctaccagtgttctggaaccaacctcaagacctcctgacccctgggcccacctgacaatgaaccagcactaacctgagggccaacttcacacaccagtggacatcaagacctctgggccctggccttacccaccaatgggcagacaccagctctaggaccaccacaggcccacagcctaccatgacaggaccaagcacacccaccagcaggctaacaccagctt

SEQ ID NO: 38585 - DNA, 3236 bp, Bovine  19866880508938
tttactcccaaatgggttattttagggacgtgggagttggaagaaagaatgtaactatggggtggtaactaccagtaactactcaaaaactgctcagtacactagaggaagccaattttctcccttgattcagttagcatttcctcattcatgtttatctcttgaagagtagtccaacagcaaacttctttcaaaatctgaacaaagaagtaccttcagactacttcacctggcagtgttctcctgttggctgcactgagtaaataaggtgtataaggtcaaagtagactattacaccattcatccgacaggtgtttatagaatgctgggtattgtgctaagttctcagcaggagcttacaatctagcagagataaaaagatacataagaagcccttcaataataatgaaaggcagtatgtaggcaaattttatttttttatttttttatgtaggcaaattttaaagtgagttatacaggaaagagattgaaatgctttcaaaagaggaaatcagtgtagacagactttattgaggagatggaatttcaactaggcctttaaaaaagacaagacttgaatatgtagagtgaaaagaattgttcctgggctccaggtcaacgagaacacagatctggaatcagaaattcacacgttctattttgagaatcaaaatgaagattagcctagttatgggttttgtggtcattagcttagtaagaagtccaccagccagtttccaaagtactgaagacaagggttcaaattcttcctacttccattaaaggcaaggagggaacacaggaccagaacaacacagcagctctatcaaggagaacagttccatacaccattgtggacaaaactgttacatgctttgcctgtttctagttttaatgatcatttaattcattatgattaaatcaattacatccttcaagattcaattaattgacatgcttaaggggatgaggggggagggctcagaatccttcaggcagaagaaacagtaatgtgcaatgacactgtgacagaagaagcttgttaaattcaaaaaaactttaagaaggcacataaccagttagtacactggggtcattcacagcccaggctctcaagtcacactccggcttcaagccttggttatgttgattatttgcttgtgtgctgtgtgacttgggcaaactgtgtaacctgtttctcagtatcctctgtcgtaaaatggaaatattagtggtccctatcttataaggtttttgagaggacaaagtgacacagtaaatgaacagcataatgtccaacacatggccaatgtccaaggagcgacagtctttgttgtaattgtttttaaggctcagacacagcacgtaatcatctttactggccttgttaaagttcctggactttattccaaaaacaatggaagcctctggaaagttttatcagttctaattggattttggttttaaaaagatggcttacttagtacctgctattagaaacctcaaaggaaaaatttattctagaatttactaccagataatgtttttctttctttgaagaataggtatcttttttttttagataaaattctgtagagggctacatcttatttttatctgacagccagaaagcttagagcctaaccggaagctgttaggcccttcctgcttctgtatttgtgttctcttctttcactttccacagctgttttataggtattctgattcagttctttattcttgtttctgttttagaatgattgcttttgtattattttcatttaaagctatttcaatcatctgcggaataaggtgcaatctaattaaccaaacaaaaattaagggcataaagacctgtagcctcataacgcatgaatcatgcactgtagacgcattctcagcatgccaccaaaatcactcttttggcctaaacctagtcagatgaggcaagaaaaccagatggcgcaggaaacctttctctatgcaaaggagtgggtgaggagagacgaagacccaaggcctttcccgaatgagcagggcagtcagggcagtcagcgccggaagcacatgggaacctgcaagcagcgaggtgtcgcgagctacgcacagactcaaggttagagtttttatttttcatatacgcatggtttttctcccaaaagtacttcaccctcgtcttaaccttcagctgctccactgctctgtttcttggctcatgagactcctttgttgcttcactcatctcgcttctgaactcggatctgacggttagccaccttaacgctgatcccactggccactggaacgtgtgcgggcctctggcctcgtcccctcccggcacccagcctggctcattcacggtgtccactgtttcccctcccgggttggaaagcactgctcattgggagtctaccatgaaggcactcccacagagctaatgatcgacactttcattcatcccctggctgtcatatgaacaccaccagctgctctgaacccttccccacaccacagtcttatgggttgttctttccctgatgtctcacttgctacactacagaattaagtctattctatacaaacaaactcatcttccttctatgtcccccaaagtgcctttgtagccatgtccttggtccaagctttaattctcactgagcgcgcacccctgcacaccttctcagaggaggaggaattcctctcctctaagccgaccattccctctgtgctcctcatcccgctgttccttgtctaacctgggaccttgtttcaccaactgtttcttctttcctatctgtattcttttctttcctagcttcttcaaacactaagaccaccaccacaaaccgtgacacatactgaattctacagaccccaatttatccctcagttttttccttttctcctttctaccttaaaaaagcctcaaaaaaagtttcataatacctttctcccttttctcaccatccataagtccataaccttttgaaatttggctttatttcccaatttattgaaaagtactctcttcaaagcactgatgatctctcttcctttttttgaccaaaaacactttactaaattggctttcaccttcatcctttcaaacttaggccaagtaaaaaataaacatcacacacacattagttttttccaactttgctgttgttgttgtttagttgctaagtcatgtccgactcttcttgcgaccccctggactctagccccccaggtgt

SEQ ID NO: 38586 - DNA, 1979 bp, Bovine  19866880522556
aaaaaaaaaaaaagaacatcctttaccttccttgaaaagactagctttcttgtcatatctgtgaaaagttatgcacctcgcccgtgggaacaggaagtgaacttctggtacgacctgtctcagaatggtggcagagcctgcttcagatggatacctatacctgtacatacttcatcacacattttctggagtttccaacaaatcagtgtttatcctttcattgcaccaggaagaattgtcgtatttcaagggatttgtacatttatgtatatagagagaggattaatgttcccgaactttccattcttgccctatttacaggcacagactgtggggctcccggtgaccgtgcattcacccagcgtgcgagcgatgcgatctgccctcctcccacaggcatccaccgtggacgccttcgcgtttcccacgtctggctgtcaggcagaggcagcgttcatggaggaagagtgtgttgacactccaaaggtacggacgtgtttgagagactccgagcttgcgggttggctggagccggcagcttggtctgcagacattgtactttggcttagctgaactttgtcatttcctcaaggcgctcaggagtgttgtttttgtgcagaagacctgagaaacgtgtccagagatgacctcggctccctctccatcttgtcttcaccatgattatgtaactcgtcagagctcatgtgtacttttcagaatctttcttccttctgtttccttaaccagtctcttctcacaagctctagatccctcataggtcttgaatttttttaagccaactgtaattctgaaaacaaaaacgtaactattgtgctgacttgggctttgcctgttactatggcccctcctctgcatgtgctgcagctacaaaataatgagccttttttgttcaactaaaatatctctttgtgtccagtttgaacatacctaaaggagataagtttattctggcgtgctgtataaagttggcttttagtatgtggaagatgatggcttctctcatttaatgggtgtttgctgttgtttagttgctaagtcatgtcctgactcctttgtgaccccttggactgtagcctgccaggcttctctgtccatggcatttcccaggccagaatagtggagtgggatgccatttccttctccaggggatctacccgacccagggatcaaaccctggtcttgggcttggtaggcagattctttagcgctgagccagctgggaagcccagtagatatttattccacttattatttgttttatatacttagcatcaagtgatatactgaagatcacattaatgggaaggtcttagagtatgtttaaaatagactcatttcttctctagctatgtgaacttggacaaagtgactgatttctttgaacttacattctgtcttgtaaaacaaggaaaccaactttatgagactgttgtgaggattaatttagagaatgcgtatgagattctaggcaaattgtagatactcaataaatattggtttcctgtcttttagcctcattaggtaataaaaagatgactcagacattaattctgcctcaaagtctgtagtctagcagaagagacatgatgcataactaacggcagtgatgccgagaactgaataaattgatacctaattggtcccttaaagagacaaagattaaaatgctgcaagactaggagacagttccagtttgatcagtaatgtctttgatttaactgtcagagctgggaattaagagacaaaatcaggatggatggaaacgagggtgtgctggctctctcagtggaggggaaatgtcaggaaagccccatccctacaggtcagagccggagctcagcatggctgagggagcgggcctgtgaaggggagtcgtacaaaataaagacaaatagcctgccttgaatggcaaagccaagggatagactctctctagtctgaggctctcagcatgggga

SEQ ID NO: 38587 - DNA, 3199 bp, Bovine  19866880545967
acgactgagagacttttactttcaccttggctgagatgcttctactagggaggccggacagcacctattactacaagggaggctggaggcctccttttccagaaaacccacttaaactgcattagcccccaggtcctgaatgcttaggcttattcacagaccagaggggaaacaccaggagaaaatgaaaacaaagcaggcttagggctgctcttctctgacaggcctatattccacggacagtggaacatccgaattagcatatggaaacctgttgtcctggtacagggaaattttagagggaaggacaacgcacccagctgaagtccgccacaaagaaagggacctctccggccgaccaccgtctctcacctatgttcttgcagctgctgttccaggctccgtggcggttctttgcaataaagctgacaggtgttctgggcttttgacagaaggctgggcttctagaagagcagaaaaaatacaagcatgacatgttgtcatctaggacacagtcatcagcctgtacttctgcctggagtatgaagccacgtgagtcctccagaagctgcaggctgcagggactgacgcttgctcgctgagagcacgggagagcctgggagagcactgcgtcagcaggcctggggtggtctcagttccaacctgctttacttttcctgtctctaaagtcctccaggaccaaggaggttcatggagactaagaacaatgagaaaagtggaggttaagtctctagcaaaggcacctactgaatgagcaaatgattcattcttgggtgggatctaatattttcaagcaccaacagagagcttatggtacctttttgctaagtattaagaggcataagggcttcctgggtggcactagcagtaaagaaactgcctgccaatgcaggagagacgtcagagatccaggttcgatccctggatcaggaagatcccctggaggagggcatggcaaccctctccaacattcttgcctggagaatcccatggacagaggattctggtggtccagggtcacaatgagtcgtgactgaaacgacgtagcatgcacgtaagaggtgtaaaacagaagcaaagaagccagagttcccttccctgctgctcagtggcagtaccctttccaggggtctgaggacaagcctttttctgctgccaagatagagcataaggctaagtttgaacatgtttctagaaactataaatgcagagtcagacctgcttgcctataaaggaattaagcagctacccaaaataaataccaagcaaaataggttcctgctgtgcagagaggcagagtggggatgatcacggtgagccggagcgacaagggggaggaggatcccacctggagtcggtgctgcaggtactgggcctccaggctgtggcgctgggagagctgcgggtgtgcgctgcccccggggagcgcagacacgctcttctgctgtggaggcgcttcctcctggggagcgaagggggggggggggacacactttcagtttcccacgtgggagaaagtttcaaatctgagtgaaagcaccttggcaaatgtccaaggggaactccagctctgttaagacttaatcctcaaggtttttatgtaaccagtaggctgagggtcaatcactttgcagaagaggaatatgggcttccccagatggcttagtggggaagaatccactggccgatgcaggaaatgtaggtttagtccctgggtcgggaagatcccctggaggagaagtggcaacccactccagtgttcttgcctggagaatcccatggacagagcagcctggtgggctacagtccacggggtcgcagagtcagacccgactgagcgactgaacaacaggatgaatgcatgctgtttacccgaagtaaacgatgaccgagtcaggacaggagcaaaggcccctgccgtcaccagcagtttattcccttcatgtggccatcaaacgcactaatatttttgatgtactgaacatgggctcacataaaatgaattacataaacagccatatttttttgtacttttagcacaaataactcacaatatttaatgaagtgatatcacatcaaaaataaatgtcaacaagcttctcatttatgttattactggtaatctctgtgtgtgtgtgcgtgtgaacgtgcatggtggagggagggagttccagggagactaagagggaatccatatagaatctgtgcgatgaactgagcagagcatgagtgtctaggcttccatgtggtactgaccacctgggccagtgggggtgggcctacccagcttgtcaggcagacaacagctacccagaaagctttcaggctgcaggctttccaaaaggacgtgtctgctccaggaggaggaaatcctcggaatgaaatgacacacctttaggacagactcatgcctcgttctcacacagccatgggggcagggcccagagcacccacctgcgggcaactgctggccaggtcctggagctgagcggcgggagaggccaggctggggtctgcctctgagcccatctgctcataaagcagctgcactttgttcaactctaggattcctttggttctagccagattctgaaggtgttgtctaaatgctacaattcctgaaagaaagaagagtggccaaatggtttaaatagaacacaaggcctttcaagtgagcacaggtatgaagccaacatggcaagggaccccatggagtcccacagaagcgcccagggccagcggagagcgcaccttgggtgagggaggtgtccgacgcccggcggccctctctgaagctcactggagacctattgtgggcctcgcgcttctgggcgctcagggcctgcatggcggggttggcaggtctcaggctcacgaagggagatgtcatgcgcggtgagggcgggttggctaacatcatgtccttgagggaagggttgtcctcaagaaagtgcaggtccctctgaacagaccccatatcatactcagagtccacactgtcaagggaggggttgtcactcatggagaaaattttcccttgaagagaaaaaaacaaaacaaaacaccaagatcaccaccaatacacagcatcttcttggaacatggaatacaaagcatgcacggctaccatgtcttccacctccaaccaaaatttttttcaaaacttttttacatgtca

SEQ ID NO: 38588 - DNA, 1050 bp, Bovine  19866880558413
gacacactggggaacctgctttgctgattttacataccttggctccctttatttgacacaagtacagtgaaaacctcgtctttgttattctgccactggtcttctgcagagtttctttggatctgctttccacccctctcagaaataagagcaaaggttaatctcgttttgagagaagtgacctgaaatgtgctcattcaaccaacaaaaaaacaccatgtattattccggaattggtcttgctccttgtctccctattaacaatacgtctctaagcctccttggtatttcctataatatgctcccattttttctctcgatgaaatatttgtggagttacatagaaaatgaggctggttctacagtgctgcttttgtaaaagaatcttgtggatttttaaaaactcagcccctttccctattccttgggacatttctataattgtgttcccagagcctgaaattaccagaggtactgtaaaaaacagaacccaaagtttaaatttgttgccatgctttttgggttttgttttactcccaggtatcagtttccagaaactcaacgcagcctcatctgcaatgccctagtatccagcagagggcaccctgcactcactagaagcttcagtgggttttttttcctccaggagtctgattagtttcatattagctgtatccttggtgtcaaaattccagtgtaaattgaaatatctgagttatttctatatgcctatatttctaaatataaatttattaatataatattaatatatacctaaaaaataaatatatacctatgcgtctaaaattgcacagttttcctgggaaaacccatgtccataatttgtgggagctggatcatcaccacaacagtggttccctgcttggtaaatgacccacaagtaaaattttcacagttaatttcccttctgtttgaagtgaccttgatggtattcaggcagtaaaagatatgtgtttggttaagatggggaagcgactacttttaaggggaatacaggagaccggattcaatccctgggtgggaaggtcc

SEQ ID NO: 38589 - DNA, 1827 bp, Bovine  19866880568028
taatgtttctggaattgcagctgccctcaccagtgcagtgttgattttaaactaatctttctattttacatccctttttttatttctggagttaataaaggtgctctaatgagttgtattaaaacatcaatttctccttttgttgcatccacaagtttatcatggtttttaatcaaaatattgagcgaatatgtaggaaggagcttaggatgtcagagtctgcctggatggagaagctgcagtgggagatggctcatttctctctgacactgtctccgagaagctgtttttccccttcggaagaggtctgagatcagggaccatttcatgggcgtgtgatttgtgtggttacacaggtgccaggctcagaaggacctgtgcttggtgtcatgctctgctgccactgtcttgagtcttaatgccttttaaaaaagagatctcatattttcctcaaccactgggccctgcagactgtgcagccagcctgtttgaggatctggcagaatcagcccctccttgagttagtgctagtgtggagtgggcaagaagtggatggggaagcaggtggggtgaaatcttagaaatatatatatgcacacatccatatatatacatgtcccttgcttccatttaaatcaattatgcatgtgttatacatgcattgttttggatcttcctttttttgcctcatcctatatcttggagataatttcatcgcaacaatagatttgtctgattgaaagttttgcaaggatttaaactggcatccgtgtggaatagaacaaggggaatggagggagaccaactgagagggctctttcaattttccattcatttttattcatacatcaaacatttatttaagtctttgctgggttctgtgatatcaagtcacataagaaattagccttgccttcaaagagctcaagggagctaagacaagtaaacaaataaatcataatgccagtgtgcccaagtgttgtaaccagagtgaagtgacaagtatctggactggggtgtctccaagagataaaaaaaaaaaaaaaaaggaggttgctggaatactttttctttggaaaaagtgtcaacaggtgcagtctgataaagggtaacgagcattttggaagggatagactgacacatctttcatttattttatattctcctgtctccccatgcccatgcccacactgtcatggtgtctgatgctgaggagtgttacctgacagagaacaaggctaaggagaggcttgagatagggatcagtgggttctcagccgttgcctatggcatctccagctcctgcctggctgcagtagaaacagtgagcgaattcttgattatgcagggagatgagcctctgattcatttttgatgttcaacattatgaggcaagctccccagccatctgttcaaaggagggatgtgttacatattttgattaatttatttttatcttaatcaagtggcaacctttccgtcttggtgcatcttaacctggagcagttgtggcttggagggcgacaggcttgagcagattgatgagggaggggggaaggtgggctgcctggtgcgaagctagtgtcagatgcaggagcagagtctcccctgaactgccctttcacctccctaattagggaagaaatcacaagccctccagtgggcactgaaatgcttagagcgccaacctcctggggctcattatacagataggggcagaaaaccaaaacagccaggatctgctgcttatggccagcgggccacagggaacccaggcttgggggtgagaagcatgaacagcttcctgaaatggttacatacaagtga

SEQ ID NO: 38590 - DNA, 2833 bp, Bovine  19866880584922
cactgtggctccgttatattctatagacgtttttgggtattcatttccattatggtttatcacaggatcctaaatatagttccctgtgctctatagcaggaccttgttgtttagcccaatcttcttttctactactctatttcttctccccaggaagctcactcagctctgaccagtcacttgctagatgtatgtgactcacatatctgtatcttcaccacagcatttcttctgagtcatatttccactttccccttttatctgactcatccttataattaatgttcccaacactctgacacatttttttcctccaaccctctttccagtatcaccaacccatcatcattgttgctgttgtttagttgctaagtcgtgtccgactctttgtgaccccatggactgtagcccaccagcctctttgatccataggattctccaagcaagtatacgggaatgagttgccatttccttctccaccaccagcctcccagttaccaaagtcagaaccttggaatcagccttaaccgtgctattactacgtcctatctctcactaggtcctgtaaagttcgcctcttaaagacttcttggatctgtcggcttctccacatccccactgctacagttcagccactctcattctctcccagtctctctgcttctttccaagatgcaaaaatttctctactgcttttcatcataacccctcttgtgactgccctgcctacagttaagacagacacgtaccctccccaggctgtctcctgaggcctgctccttggtttctgtgaccctgttgcactgaccttgcagttccccaagttcactaatttcatggactagatagaccagagggccctgggaagcagaccagtccaccagacaaattcctggtccctgtctgcctgtttgctttccggtcccttggaccctgggaaaattgtgttgaaaattgttgggacagaaaacattaccagaaaaagagagacggttttaacatttggaggtgggggagctgtcttcaggagagattttgggttctgctttactctcaggttgtggcagtttcttggagaactaccatttcatccccgctctttggcattaattgttgggatcgatgctgcagcggttatataatgtttattgcaaccaccacatatctgaggcttaagtgttgctaaatgtcactttcacgctccccagtgtatggtgtgtaattataactggttcactaccttctttgtgagggaggcagatgcttttagcctgaaaaggagaagagagacgcattgtctctaatcttacgaaaagcactcatttccggagagatcctgggtggagggagaggagcgtgacatgggctcttcatcacaaacacctttgctgggtgtcacctagaaagtgcaggacccctcctccctgccttccccccgaggctgcagtgggcatctgtgaccctgagatcaaattcaagggcagagggagatagaccaactggggatcagagtgacagccagtgaagcaatgaaacaggtgtcatcacattacagaaatgtgacctgaaagaaagagccatgggtgggcaggcggtgatgtggcttgggtctgtatctagctgtgtggccttggataagtcactttgactttctgatttcacttttgtcatatgtcaaatggggataataaatgctgcctgtactacctcagttaaatccaaccctaagactatgatttattgagtgctgctgtattcaaggtaccagaggacccagcagtgcacacagcaggcatggtcctgccctcggtgagttgaggtctatggcaggaaaactgagttgcaagccaaatctggcctgggccctgtttttgtacaacctatcagctaagaatggatttcacatgtttaaagggttgtaaaaaaaaaataagaagaataagaatatgcaatagaatgtgtgtgtggctaaaaggctcaagatgtttatctggtcctttacagaaggacttttgatgacccttggtctggaacttgacagccaccacgtgggcaccgagcacttgacacttggctggagacgcgctgtgatcctccgtgtcctgtggtggggctggtgtgtgtgccatgaggttcctcccccgcttctcactgcccccctgtgccctcctcctgttacccagcccccaggcctctcatgcccttctgtaacccatgtggctcagtggtaaagaatccgtctgccattggaagagatgcaagagacacaggtttgacccctggggcagaaagatcccaggaggaggaaatggcaacctactccagtattcttgcctggaaaatcccgtggaccaaggagactggccatggggtcccagacagttggacatgacttagcgactgagcaggcaggctgtaattgatagagccactctttcctcctgaagtgcctgcatttgatcttggaaaagcaaaggcttcaaaatcctaatggaaatgccgtaggagaaatacattttattaggaaccaggagatctagatgaataaaacgccaaagagccactaacattaaggtcttgctaagtgtttcacaagcattattttactgaatccaacagcaatagcaggagaactcaatgtcctgagtttacaaatgagaaaaatgggagtgcagagacctaagtgaccttcctggctggcaggtggcagaacctccatccactgacctgagtatggtgctcttcccgtgatcttagaggtcattcagggtccagggtttgtcctgcatgaggggtaataagggaaagcaggtagggtattggggttagtcgg

SEQ ID NO: 38591 - DNA, 1512 bp, Bovine  19866880638723
cctctactttgggtctagcagccctggtggtagcatcagaatgaccacattccttggctcatgagggagcaggctgcaggcaccccctcccaagctttacagggtcttcagtcacattcccccagagctttcagagacccccaggttccctcctacctttgccgtctgcatcttccatcgaacctgccacgggtgtggcagggccagcatccctgtcactctccatgcccaggatgggcaccatgagccctgagccctcagggtctgggatctccatcccatacagggcagggacccacagtgctgtccccggatagcgcatcacccctaaaacaaggtgagggacacagcggcaggaggtgagggtggagggccacaccaaggttcgagtggctgtgtctctgttcatccctgctaagactgcctctgtttgcccaccttagcattttgaattcatcaaggaaggactgaatacttaaaaacaaggcaggaggtctttgggaggagctgagaacaatttctaggctaggctgaaaaggtggaagacaggggacagactttcttgaaacacctacatgtgccaaaatctaagctcagaactccatataaaatgtattttatttggtactacaattaaatctctaaaggatgtactattttaatcctcattttaaagatgctgtaaacagaggcagagggaggtttagtaacttgcccaaggtaaaagaggttataaacggtggggcaggtcttcaaactcaagtcagttccgatcccaaagcctggttcttttctgacacatcctgggcagaagtttctaggagtgtgtgagataagctccaggaagatgccactgctacttcctttccctgcctttccttgtgctggtgctgtaggggaggtagaggagttgggtgggctcctttcctgagtttattcacgggaagttgaaggctcttgacaaggagactggggactccagagactcaggctttaggcctggctaactagctacggtcccatcacttcatgggaaatagatggggaaacagtggaaatagtgtcaggctttatttttttgggctccaaaatcactgcagatggtgactgcagccatgaaattaaaagacgcttactccttggaaggaaagttatgaccaacctagataacatattcaaaagcagagacattactttgccaacaaaggtccagtctagtcaaggctatggtttttcctgtggtcatgtatggatgtgagagttggactgtgaagaaggctgagcgctgaagaattgatgcttttgatctgtggtgttggagaagactcttgagactcccttggactgcaaggagatccaaccagtccattctgaagatcagcccctctgggatttctttggaaggaatgatgctaaagctgaaactccagtactttggccacctcatgcaaagagttgactcattggaaaagactctgatgctgggagggattgggggcaggaggagaaggg

SEQ ID NO: 38592 - DNA, 1082 bp, Bovine  19866880749136
ccatagttagaatccaacacagtaaatgtttattggagaaactctcaaaagttgttttcatgccacattgtgttcataactagagagttctgtacagagttctgaactgatccgtgttactgccaacaggaaagtgatttcagagtcagacaaagaagaccaggaagaagtcaaagccttggactaatttgattgacacctgggagaggatggctcacttagaccttcacttttgaaacaaccagctcttacatcagaatcaccggaatcaattaaattagaccaagaaataaaagttaaatatacagcgcttctaggagtaccagctattgagtacttgtgtctgttttacttactcaaaaccactgcatttgataccacacagttatcatctgtctcattttatatattctcaagctccaacttaacttgctttcgtttgaagggtatttccagaactgctatatttgatctatattatgaatatcagataaacaagaaacaaggactttatatgcctcaacttgtagaccaccataaaaacaagggcttcccaggtggtgctagtgctagtgctgccaatgcagcagacgtgggttctacctctgggtcaggaagatctcctggaggaggaaatggcaacctgctccagtattcttgcctgggaaatcccatgggcagaggagcctggcgggctacagtccatgaggttgcaaagagtcagacacgactgagcgacagcacaaaagcactacatactccacaaaagtaaaaacaataaggaaatagagatgaaagatcagtcctgaaaactttaaagttcttcttgctattaaaaaaaaaaaatccattatccaaaacttggtttattcagcttctgggacatgtctgaagtcagaagtgaattacttccagttttgtgaatagctggctcaacatccccatgtcttatacacatgtccataatcccagtgctaacctacctcacttacaaaggtgggatacactggaaaagagaagggtaagactttgtcccttctgcattgcccaactggcaggcctactcaggattgtacatgaga

SEQ ID NO: 38593 - DNA, 4790 bp, Bovine  19866880752506
ttgacatgtggtcatgatggttgtttttgtccataactcaaataatatgcttgcatttctgtttcttgactcatcactttgaagccgctgctgctgctgctgctaagtcgcttcagtcgtgtccgactctgttcgaccccacagacggcagcccaccagactccgccgtcctgggattctccaggcaagaacactggagtgggttgccatttccttctccaatgcatgaaagtgaaaagtgaaagtgaagtcgctcagttgtgtccgactcttagcgaccccatggactgcagcctaccaggctcctctgtccatgggattttccaggcaagagtactggagtgggtgccattgaagcagtagctattaactccctactatgatagatgaggcatgtatcttctcctggcttctttctgccaatttttgttacatttttattcttctacttattttctctctggtttagaaggaggtgcttaaactttcatttcttgattcattaacttagtatctcttgtttctccaccttgtaacatgagaccattactccacattgcctccttcctcttccttcccatctcagtaagtgctaactttatgttatcaaagtttagaacatttatatttcatactgcaactatatagttagtcttcatgttttgtttatatacctgttgacgctgaaaattgaaaatcagcacatagctttaaccggtattgtgattttgtaaatattattcactgtggaatcagtagagtaattggatctatgtcgttgttcagtcatgtctgactctttgcgactctgtggactgcagcacgccaggcctccttgtccctcatcacctcctggagtttgcccaagttcatgtccattgagttggtgatgctatccaaccatctcctcctctgtcgtccccttctccttctgccttcagtctttcccagcatcagggtcttttccaatgagtcagctgtttacatcaggtggccaaagtattggagtctcagctttagcatcagcccttccagtgaatattcagggttgatttactttaggattgattggtttgatctccttgcagtccaagggactctcaagagtcttctccagcaccacagtttgaaagcatcaattcttcaacactctgccttttttatggtccaactctcacatctgtccatgactactggaaagaccacagccttaactatacagacctttgttggcaaagcgatgcctttgctttttaatacactgtctaggtttgtcataacttttctgccaagaagcaaatgtcttctaatttcatggctgcagttaccatctgcagtgattttagagcccacgaagaggaaatctgtcactgctatgactttttccccttctatttgccatgaagtgatgggaccgcatgccacgatcttagtttttttaatactgagttttaagccagctttttcactctcttctttcatcctcattaagaggctatctagttcctcttccctttctgccgttaaagtgatatcatctgcatatctgaagttgttgatatttctcccagcaatcttgattccagcttgtaactcatccaacctggcatttcacatgatgtgttctgtatataagttaaataaacagggtaacaattaactgccttatcatactcctttctcaattttgaaccagttagttgttccatagaaggttctaagtatttcttcttgacatgcatacaggttctatagaggaaatgtaatcctagtcatcaaatctgggctgctgaaaggaggttgttccaagcatcaaggtcaagtggattactgctgtactctatcagttctttaaaaaaaaacacacaaaaaacaacccactgatttttgtacgctccgtttcatatctggagcatacacctgactctcatcttggaattactaattgaaattctcccttttcttattgactgaagtaacaaaggacttcttcacatattactaagaatgtccagcttcttaatcattctactgtataagtatgaaatggccaatttcaaatagatttctttccaactggatcctgagctttttcagtgcattcctgacttagctccactgtttattggatctcatacagtctcttagatttgagatggacaaatggacaatgtccagatgatatgaaaaaataaaatctgcagcaaccaacccaggacaccagcccattattcacagtaactcatccaggaagccagcatgttatctatatgttagacttgtaggagagttgaccactatcgtagcaaaccagcccatgaagccaaacaataacctctgaaacaataggaccaatggggcaggactggattaatatctgaaagtttccccatttttgttcctgattccaacttaggaccaaccagggacagccagtgtccacctgtaaccaatcacacaggaagttagcccacccatgacttccccacgcccacagcctccagtcagcgcacatctgaagcctttactttttccaacatacagctttcttgttctgccccacctgcgtctctgccagacacaagtgatggggttgactcccttgcaagctctgaataaataacctgcggttgtccttatttggttggtgtttatttatttccacaggttcatttttgcttgtttgcttttctggagtatatcctcaagtaatttttctcaagtaagatgtctgggtcttaccaggtgtgaaatatctttattctgtcctctcccttggctgacttctgggttcaaaatcactttactcaacattttagaggaactgcccccactgtcttctattgtctagagttgcgactgagaggattatcaatcctttgtagataaaatgtttcccctactggctttagaatcttcccttaatccacgttctgaaagtacatgaggcgagatgtaggaattatctttttagaatcatcgtgctcaggacttggtgggccttttagcaatacagacctcagaagtatttatttgactcttttctccatttcttcttttttggttctctctccctggacttctgtgagatggatattggctctgattaatcttttatatcttttaatttttctctcatggctgtttatatttttgttttccacattggagtacttcttaaatttctgtttcaacaattatattttcatagcatattctttatgaatacagtttcttctcaaatctctttggggttactaaattgagttctttgagttctacacacttccttagcaggctttcctggtggctcagtgttagagaatccacctgccaatgcaggagacataggttcgatccctggtttggaaagagcccctggagaaggaaatggcaacctactccagtattcttgcttgggaaatcccgtggacagaggggcttggtgggctagtctgtagggtcacaaaagagctggactcatagtgactcaacaacaacatcatcaacatttccttgagtctatgtctttgagctgtttctttttttcctgttctctttgagggtctgctgacccttgactgtctgtgcacatttatggggggaggagcagactccccctcatagggagtctgtatgtaggtttcctggctattgcccttcatctgaaaaagagggctgagtgttgcaccagttttacatgcaggcttcattttgggtgaagttggttggatggcatcactgactcaatggacatgagtttgagtaaactccaggagttggtgatggacagggaagcctggcgtgttgcagtccatggggttgcaaagagtcggacatgactgagtgactgaactgaaccaaacttcattttaagtgtgtgagtggggagctgtaggcaagattgggatgaccctactttaggatgccaattccactgtaaagtgctacccgtttccagaaagaactttccaatttcttctgatttttcagattcagcctgggggcaaaatgctgggaagcccaacccttgaggagcccacttcagtccgtccttcctggcagctcctccttcaccctgaggctctagctgctaatttttgggtggagatggtgaggcagggtctctgccgccctcttgtctctgctgtttgccgtcaatatgattgaattcaccgtgtgacctctttggtcctttcctaccctatcttctgctttgagcattttgatgacttgattccctttgtactttttaaactgtcattttggttgaattttgaagtgttctgtttttttctactgccttttaatggattcgagtgcttttctgttagatttaggactgaggtagttagaacaaagtttctgtgaccaaaggcaaatcaatacaatcttacactctatgctatcaccccaaagcacagtcgaagccacaaagagactgagaacttgggataaagaggcggtgacaaaaagagtgggagtgctcttcctccttaccttttacccggggtagatgcggaccccatgggagcacacccgtggcccaggaaggtttaccacgtgccgtcacctcctcactgctctgaggatggttagagaatattgtgcagaactgcagtggtttttggaagaggcatgtagagtctatttcaccccctcctagattcttccccctggcagaagtcagagttatggtagcctgacttgggaatagcaagacagatatgtttcccagaacaattcaaaaatgcattcatcaacaactttgcagagggggagaaaaagaa

SEQ ID NO: 38594 - DNA, 1233 bp, Bovine  19866880788358
agacagtgctccgcaacaagagaagccccacaatgagaaacccaagcaccgcaactaaagaggagcttccacccgccgcaaccagagaaagcctgagcagcatcgcagacccagcacgacaaaacaacaaataaatcaatcttttttttttaactgtcatcagaaatcttgcagcaattcttaaattctagtataactactagctttggaaggaacggtttgcatttgggaagaagcagaattttaaatctccagaagcaaatctagaggatatgatggaatgtgaggctgacactgccatctgaagagccctctttctttgcacccaccttgagaacatcagcaccaaaacaatctcaggggttgtggggtctgcaggcccagccccctctcaggaattctttccaaatccatcacccagacaacagtgaaagtgtcttggattcactgacccacttaatgtgcccctgaagtctcccaggctaatcctcacagccacgatcaggagttaacatttcatcttcctagaaaccacgaaaaacaagagccaagcacagtggaggcagccagtgatttcaaaaagctctgaagcagcctgacgactagtgtctcaacctcctcagtgtcccgggttttgggctttggtgggaatgacctcaaccagtaatacactctcatccttatcagaaccatatgggaaaaaagttgtcttttgctcctgcaaattaaaaaaagtgtcacttaacaatatctataaatttacaacccaaacaggcagacaggtggagaaaggcaagaagtgctatttagaaaaggaaattgctccagggaactctcttatccatctctcaccacttaggcaatctgacttccaggtcaacatgaattagctgctggaaaagcaccagtctaggggtaccattcacaagaagaatagatttatgctcttcaggcctcagcattcaccttcttatagaaatggggatccgagtgcagaaagaggcctgcaccccagctgctcctctttgagaaatggtaagaccacactttcccagctgacaaggcgctgtggctgacgggtgcccctgcctgcatccggctggaccacagtggatatgtgtgagacgaagggggtggggggtgggaggagtggtgtgaacctaggatgcggggaaaactgctttcctgagagcagagacgcatgctcagctagatcagcccagcggctccctc

SEQ ID NO: 38595 - DNA, 3167 bp, Bovine  19866880795378
aaaaaaacattgaaactaatttgggtactaatagtctatttctggagaaggcaatggcaccccactccagtactcttgcctggaaaatcccatggatggagcctggtaggctgcagtccaagcagtagctaagagctgggcaagacttagcgacttcactttcacttttcactttcatgcattggagaaggaaatggcaacccactccagtgttcttgcctggagaatcccagggacgggggagcctggtgggctgccgtctatggggtcgcacagggtcggacacgactgaagcgacttagcagcagcagcagcagtctatttcagtctcagtgtaaatatctcattcaagagaaaaaaatatatggaggtttgagaacactatcttatctactctacaaaaaatattttacctttcacatttgggcaaatactttctttaagtgttttactttagccttattaatgtggttttaaaaactatctttaacatataaaactggttgtggtcagcctttcactatttggtttttataaattattatttagatacttttagatcaggcctgggtaaactataaaagataagaaaacatgaatgctattaaaccaaaaggtaagatatgaagtaaaatagaaattaccaggcagggtagatttcccaacatgttagaattaacaaggaaaaaaaaaatataacacagttaagttcaaacaaattgaatgacctatgcactcaaaagttttggaaatccccaaagaaatgaaacttcttgcctctgagaagaactgcaaattttctctatttgagactttcaagtgatctgtatatgtgtttgttgttttatattttgcttcgtttggtgtaactgtttggagcttgtttatttccaaagatattttgtttaagatattttagcctttctgaatcagcagcatcctgcatgtggctaaatggtactcggggtaacggtggtggtgataatggtggtatgatcttcacactcctagaagcaactcgattctagtattgctacagaacagtgcattataaaggtgaagtacggggacttccctggtcgtccagtgggtaagaatccaccctgcaatgcaggcaatacaggttcagcccctggttggggaactaagatcccacatgccttgccacaactaagacaggatgcagcccaagaaacagaacaaatgagtgtgaagaatgtggtactgctttttttaaaaaaagagtgaagtaccacaagaaaaattctgtctccaaaatattagtagcatataaatactaaatttctgatctaatatgctaggagtccttactgagcaatacggagtacttacttgaattagggggccaggactcccggtactcactacctgcttgagttctgggtgacttgccccgaacctggggagtgacgcaaaatcacaagagctatgatcaatgggagaatttaaccaagaaatttgaatcataaaagtatacttaaaatatatacttttctaccacagctttttccacagaatataaaattggatgtgtttatcctagcaataacaacgagcacgtataaaaagcattctagttttcaatgcattgtctcgtatatttcctcaaccaatgccaagctcattcagggggaagaggacagagagtaagcagtaaagggagacctgtgggtcaagagccacaatcccttagacagctacacagctgcttagagttatctgtgaactccctccttgactgtcataccatgatgaacggtcagctcccctgagaggaaaaccaaagagaaaagcaactgtaaccttcagcagggccttctatcttagcactgccttcatctatatcaaattgacaagagcaggcttcttcgggggatgagagaaacatcacagaaagagggttacccttctttcttgcttcctctgggtctccacggcatgcaggcgctccatgaggctggagatgccctgctccaggctgtcgatggtgtggtgctgagggtcgtggccactgaagctggtgcgtaggctgcggagggcgtctcgcacaagctgcaggtcgctgctctgtgggcaaaaccatgggcccgcggtgccaccttattaaccacatcccaaccgtggggctcaagagcatacaggggaggggttttcaacagatctcttatttttgatagaggaggtggaaattgtaggaaaactttttcctccatagacgcgagcccactgatggctcactaattcttaactttggatagtaagtgcctcacagctttacacacccaacagatgcaagaattggggaacagggatataaaaggccgactccactggcgatgactagggtacccttttggttttggctggaagtggcaagtctgtactcaaatcctaaagacatacccctctgtgaacgactgaagcagctccttttcctgccgctggaaggagaaaaccattgctttgagagctgtgattgttgtagttggtcacctagagcagcaagaagaaaggatgcttgtacaagggaaaattccaaagcaattcctcttatttttcttctttacacgaatcacttcctgatgtagtgcaaagatctttttccctttggttcactgctgtatctccaatacctgacactcagaaggtactgctgaatgcagagttaacaaaatgaaaacctccatttggagtccctcgcctagcctctgcctggccccaggaaggcctgagaatgctgctccagcatctcctgcctttgcttcagtaataaaaagaaaaaaaaagaacagtgactaaaacgttttgagcccaactctgtgccaggcagatctaccaggactgtgttgttacttagatggactatcttatgtattcttcatcatggcagagaagggcactgctatttccattttccagatgagccttatttctaaggttcagaagctaagcaacttaaggtcacacagtgggaaagtgtgtaaaaaaaaatgtttttttaaaaaaagaggtaaagctgggatttgaaaccagattttcttatcccagaacctgcacttttatcctccccatcaaacagaaaccaacctgtggtgctggttcagccctgagttaataacgaatctccctccttgcccccgtcaacg

SEQ ID NO: 38596 - DNA, 917 bp, Bovine  19866880802239
cttcacaagactgcgtatataaggggctggctgcagctgcggctgaaggagctgaccagccagctgacgccccacactcacctaaccaccatggatatcgccatccaccacccctggatccgccgccccttcttccctttccactctcccagccgcctctttgaccagttttttggcgagcacctgttagagtctgatctcttcccagcttctacttccctgagccccttctaccttcggccgccctcatttctgcgggcacccagctggattgacactggcctctcagaggtaagtctccccttttcccggacaggagagttcattctggaaccttctggaagcatctccatccactgtccttttcctcctggcctaaatctatgcctaagggtcctacatgtcttaggcacttgtgtgtcctgcagtgaagacgggtgaggcccctagttcctctcttccccagtcacctatttgtatttggtgtgctcctctgtatcctatttgttacattttccatgcactatgaaggccattctctattccttatcttctgggtaggatgtccctttctggtttggttcataacaatctacagggaaagagttgccttcagactcctttgctcaccccttctaacacctcacactcctgacaaatactgtcatctcacgtttcagagccaggaagacagtcttgcctcatcctgagctttccacccctgctgcatggagctggagacagcaaccactattttcttccttcttattccctcacctatgattttccgggtttctaagggttgtgacagggcgctggcctgggtccaagcctaatgagaatagaatgtaggtccactttagggacccccccctccagttgtcctaagacggtgggagaatgggggaacagataag

SEQ ID NO: 38597 - DNA, 2618 bp, Bovine  19866880809646
tcggacacgactgaagcgacttagcagcagcagcagcaggtataccaagggcttccttggtggctcagatggtaaagcatctgcctgcaatgcaggagacccggttcgatcactgggtcaggaagatcccctggaagaagcaagtggcaccccactccagtctcttgcctggagaatcccatggatggaggagcctggtgggctacagtccatgggtttgcagagagtcagacacgactgagcgactccactttgactttcacttttgagggtatccagggagttccatcaacaatctctaataaccaatatgggggaaagtatgaatgtgaatagatatatgtatattcaaaattaaaggccacattttgaacaactataattcaaagaaccttgcattggagaatgagaaagtatatttaatgataattacaataaggacttcaggtatatttattaaaagacagaaacacacaactttgtgtttattatgatcgactcccctctaatgtaaaaccccaatttagtactttgataaggctctcattgcctcagtaaccacagttggacaagaggaacctctgttgcccttgaccattctctccaacagccacctaaaaactcttccttacgggcagttaagattagcaaaatttgatgggctctaaatgttaacggccatcaaaaaaaaaaaaaaatcaggggaaactaataaaaaacatgaaacagggcaaagaacaaaatatcaaaaggtaaataggtagagccatgaacggggcagggtcgggccctggccggtgggcgcgagtgtcctgccttgtctccttcagcgcgagccaccgcctccacagcaaatctcttagtaatgaagaaaacttgaaattatttgggaagtgcaacaacccaaatggccatgggcacaattacaaagttgtggtgacagtacatggagaggttgatcctgttacaggaatggtcatgaatttgactgacctcaaagagtatatggaggaggcgattatgaagccccttgatcataagaatctggatctagatgtgccgtattttgcagacattgtaagcacaacagaaaatgtagccgtttatatctgggaaaacctccagaaatttcttcctgtgggagttctttataaagtaaaagtatatgaaaccgacaataatattgtagtctataaaggagaacaactcttagagattactttccatccatatttgaagaagatctttatccccttgagcaattaagaagacatcaccttactgctgtacttccacattgtgttgaatcattgtgactgagtcctgttctagactcaaatctaatttaaaaccaagtttgtaatgtattctgagtatcatttaaagagtctttcatctgtagattaaaatcacttcagcaaagtgttctggtgtagaatcatttggaagcaaaagaaaaaaaaagtaaataaatttacaatgcttaaagaaagagtacactaaaattacttaatgtggtaaatcagagagatatgaaaattaaaatgacaacgaagtatcacttcagagaactcaaaaagaccactatcaagaagtctacattcaagaaatgctggtgtcaggtttaaaaaggggaacttttttttttttttactcatgggatgtaactggtcactgtcattacacaaactaatagggaagtgacttttttaaagtcaaaaatagagctgccacatgatctggcagtccattcctaagaataaatgcagaggcatcataatttaaataactaaagcacccaaaagtacactggaacaggatgtctgttagccaagacaaggaaggagacaaaatcatgaatggataaagaacaagtcataatgtgcactacggaatacgactctgccaggacagacatgaacaagtgtcatttgcaatgatatggatcagtctagagataatcacagcaactgaagtaaatcggaacaagaaaagtaatatcctatcatatccatcgtgtgtggaaatgagcaattgttctcaatgaactcactcacatatgaaatgatcatattgtccaagtaaacaaagttataataaccaaaaagaaaaggcaggttgaaggataaaattagaagactgtaataaaattataccaatgattagtgtaaaacatattatcagcataggctgacattactacgagagttgtactaaacactctgtaataacctagttgtaaaaaaaaaaaaacatgagaagatacacgcctggctataaggaaacaagattctgtaccactagagcaaacacagcgttggaagtcaactttactccaatcaaaaacacattatttaggaaaagaagaaataatcagacccgagctttggtggctaataatctcacattccattctaatttgtgatcaggaagcaggactatccctaaaactctggttaccgtagcacccagacaaggtcgtaaagtaattccactgccctgtgctatttcctaaacaacaaccttaaatctattgttcatgggcacctcatagtcatacagagcccacaaatactggatacctgcagttaaaacattttcagggaaacgaatcaaaa

SEQ ID NO: 38598 - DNA, 716 bp, Bovine  19866880810284
ctgtggcaagacaggttgggtagggcacgtaggggaggatggcagcttctgaggttcggacacccaccttggacagggagacagggaggtgttaacacacgctggcctgtctgcatccctcctgagcccagcagggcaggggcagagagcctctggcatgagtttctttcatctgactgctctctccagcatggtacctttgtagcaaggatgttaaagggagggagggggagaaggtgtttactgctctgtgtccccaagccccactgcccaaggccagagccctgcttcccatgctgtgtccctgggcgggttcattccggatagcccacactgggtggagttacagagtggtaggagtctcaccagaactgcagtcagtggtgggcaccagggttgcttcctgcacatcgtaacctagatttccagcctcgggcagcacccgccctgtgtcagggtggatgaagtagccttggggtatgggcgctgcctggccactggctgggagcatcacacagtccgggccagggaccatcaacttggtgacaggatgcacaccgatgtttttggcaccccctggagagcttgctgaggctgcaggaatgcaaacaccggcttagccctgggtctgaggccacatctgagaggtcaggggctcccttggggggagtggactggaaggagccggtgagaccccctaaccaaaccaaccctgg

SEQ ID NO: 38599 - DNA, 1283 bp, Bovine  19866880822088
tgctgtacaccttgaacttatacagtgttgtatgtcagttatattgcaacaaacctgaaaaaaagaaaaaagattgtaaatataaattctgaccccctcatgctatcattttaagaattaataaattaaatgatttaaaagccttataaaattccatttatgagcacaacaaaagcactgtggttagaaatgagaattcttttgttatgaaattaacaagtaaattatttattccaactaatacggtaaactgtaagaattttctcttaccactgaatttatttaattatcctggctgagagttcttagagtagttggaaatgtttttgttctgatgacacagttgcctacaatagttttgttatttattcccaggaaacgtatccaggaagcaaaaatcaaatcatatttgaaaactttgtttctggtgcatattatattataaaactgattatatattaaaatctattataattaaaaaggacatgaaatcaaaatttaaatgaatgaattttaccttactattatttagaatcttataactaaatatttgaccgtttatactagaagcattatgacaatatattaatatcttgcctgtgactaaccaatattttctattacacagaaaataatcatattagtttttgtttataggggattttaagaactaaacttcctactgtttaatttcaatctctaagactttttttttgcttagactagtaattgtgtattagacaatgtaatggtttcattcattcatatttcatgactcaatcaattcagcagaaattcattgagtatcattgacaaggcactgctaagcttgaaggaaggataaaaggatgagtaagactttgaaagagacatggtagcagctatgagataaagcaggcaaagtaagatcaatactgtaataaaagtataaagtgctatgtaatcacagtatgggagcatttaattcccactgattacatgtgtaatggaaaagttagaaaagaaagttaatattgaatgtgctcagtcattcagtcatgtctgactcttttcagccccctggaatgtacctgcccaggctcctctgtccatggaattttccaggcaagaatactggagtggtgtatcatttcctactccaggggatcttcctgacccagggatcgaacccacatctctcacctcccctgcattggccagtggattctttatcactagtgccacctaatacctacattgaaagtatcccaggtctttttctataaatgctattttattcaatc

SEQ ID NO: 38600 - DNA, 1053 bp, Bovine  19866880958050
cggacccagacagatctgctgatacaattcaagtagcaatctttattatttgaatcaggtaaatgaaattttcactgaactaactttgctccacccttataaattaaatcaaatcatctgactgaaaagcaagaaattaagttgctaaacattgtgtagacaatattaggttattaagtgacttttccaattttttttttcagaactttaaaaaaatcaggggagaacatattcatgttttctttaataacatctgataacattaatggaagttggcctcagtaccaataagatcagaataaaaattctattacttcttgttaatccatgaatgtagtatgcaaataaacatctgtcaagttaatgttgagttagacacattgggtttcagtcataatacaaagatggagacattttttattagggattctttagtcattaacaggtgatagccagtttcctttaaactcttctggaccctgtgcctggtgctgctgtagcagtattctgggaataaggcgattaacactgaactgtgaggctagcccttgctacatggattaagatttagcaattttaggtatgcctttggttgtatcagagttgaaaatctagaagacatggtgttttgccaaaaatgagagggctcagtgtcggtgggagagaggggagctgagagggtgtgagggcaggtggatacagttccctggggtgagaagggagggcaatggaatgtgtacagaggctcaaggctgatctattcccctgtttgcatctacttatgcttttgtattacacagataagcgaacacacacttctatgtagatgagaagaagaaagttttctcaaagcaagaaatctctaaaacggtgagcgggtttttataaagatttgaagttagggagaaaactgagtaaggaaaaaagaagcacttcttcctgggaaaccagaaaggtgatggaatttcagttgagctatttcaaatcttaaaagatgatgctgttaaaatgctgcactcattatgccagcaaatttggaaaactcagcagtgg

SEQ ID NO: 38601 - DNA, 931 bp, Bovine  19866880959576
gatgtcagggttgtgggatgtgagaacactgggcatctccttgtagcagcaaaggggaagaacacttccagcctttttagagggaaagctttccccagttcagcaatgagtttctcatttatggtcttgataggatgacatgaaggtgcttctaggaagcccctgattaaacacacacaaaaataacttttaaaattataaataatgataatgtagctagaatcaaaaagaatagcttaataaaaagaatcatcaagttgatccagaaaggaaacaaagaaaccatctactataaagaaagatggcatgggtttcagaattctgacagcctataatataccagaaaatatgataattaaaaaaaaaatttactggagtatggttgatttaaaatattgcttttagtttcacatgtacaaatcagttatacatatacataggctgtgctgtgctccgttgtgtcttgactctttgcggccccatggactgtagcccaccaggctcctctatccacgggattttccaggcaagagtactggaatgaattgccatttcctactccaggggatcttcccaactcagggattgaaatcatgattcttccatctcctgcattagcagatggattctttaccactaataccatctgggaagtcccatatatccactctattttagattctttttctacataggccgttacagagtattgagtagagttccttgtgctataaaataggcccttattagttatctattttatatatagaaatatgtgtaagtcagtcccaatctccaagtttatacccccctgaccctttataaccattggagaaggcactggcaccccactccagtactcttgcctggaaaatcccacggacagaggagccctggtaggctgcagtccacggggtcgctaagagtcgga

SEQ ID NO: 38602 - DNA, 1547 bp, Bovine  19866880983312
agaaccatcaacaaccaaatattcaaagtgtcttatcatagagttatgaatacaacgtctttcaaaatttgtcttaatatggtcttaaattggtctttaatatggctttgtgtgtgagactgttttatcctagtaaagtctgggctcgctttaaaatagcatgacaatctagtcttaatcaaattctatatggccctaatagcaagacactggcacttgatatgcatcttgtatagtattttgtccctttaatagcacttgaccttttcttgaatataagaaaatagtaagaatgctcctattcctttgcggacagctcaattcatgtcagcatcttctgatggatgtcacagttgaatatatcactgctagatccttatgttttgaggaaggcgatggcaccgcactccagtactcttgtctggaaaatcccacggacagaggagcctggtaggctgcagtccatggggtcgctaagagttggacacgactaaacgacttccctttcactttccactttcatgctttggagaaggaaatggcaacccactccagtgttcttgcctggagaacccagggacgggggagcctggtgggctgccatctatggggtcgcacagagtcggacactactgaagcaacttagcagcatgctcttatagggtagatgttacttttattcttaacttacagatgagaaatctgaagctcagaagtattaaaagcctctttcccaagacagagatagttgtggagcttgtattaattagtactctgccaaccaccatttatgaagagatctcattttattttaagaaagcagaactgtatatagtactctgaggtactggcgagaagattcaagagtgcttagaataaatgagagcaaagatcttaagtttattataattcatctttcatactctctacagtatattaagaaaaacaaagatcttctcctttttacccacatggaacacttcctaaaaagcatccttgctgcagagcaaaaactcccaaaagaaacaagagatcagcttgcagatgaagataaggtgagatgttcgggtgacctacagcactgagaccatactttgctatatactttgcaacatttttgtgttttttgtttgggactatgtttatcattgaacatgtcagcagaacacaagattggaaatgaattgtggtatgaacaggtaatatcatcagtcacttataaaactttatcaacagatggtggatcttaggtcccagagttaatccctctgctttcgggcaggtcaggtattaaccttaaagaactggagctgagacttggacttgccctagttcacccagctggaagagaacagacagtcaccagatctactgccttctcatttgggattctcccactgttccataatgatacctactactgttttggttttaatctgaagcatttaaaacattgttatatctttaacaatccccccatactttggttccaaggaacaaacattaatattttgtcacatataattgcaaagagaaaaattcccaag

SEQ ID NO: 38603 - DNA, 1138 bp, Bovine  19866881015393
tgacaaagactaaatagaagtcattaggtaaactatttcaagtcattttttttaaaaaagaaaaaagtaaccaagacattgaaaaccagtcttcaggctaagaaaaaagtaaatgatttccaggaatcaacacaacccaggcaacttttaatctccaatagtgtgttataatgtcttatttataattttaaaaatcctcctacagagaagcagatggctttcgtgttaaatttatccttgtttctaaaattgccagtagaattcagatatccagtcttgctgaagagttacatgtcttttgcagttattataataggagagaagaagacaattatgaggaaatgaaagctgacaaatgaaaagtagcagagtgtggagccagagctgacccactgcacaaactgaatgccaatcagccatcactgacgtcaatgcgtattttgttgcccactggcaagagaaggccagctgcacagtttactgccaaacatcagtcacctcctccctacctgacaggaggacacaagaacaatcatcacagctgacgtgaaatgtgatcctgctgaccagggtgaggcatcttgtttgtccagtgagagagtttagtgagctgagaggtgaattaaacgctcttcctcagcccaaaatggagtgaggaggaggaaggagatgaagaggggagaaataagacaaaaggaaacagaagcctttgagccaccttccatgttccaggcttaatgcctggccagggctaagcaggcttgaaggataaagacaaggtctcactctgtttgctgatgcaaagctctctgcacattttacataatactagtggcaggaggataacaaatggaagacttttaataaatattttactaacaaaacctgtttcagcctatcccacccttttttggttccagggcagaaaactagaattatatatacagaaatcatgatctccagttcttccagtaagcaggaagattgctagaagcaatcatgagagatgatgggctacttatagattacaggtcagttcagaaaggaagtattcctcttgggctaacgacaagagacctgtgatgcacaggttagacttattaggcttattacacacaactaattacacggaaggtcc

SEQ ID NO: 38604 - DNA, 1392 bp, Bovine  19866881059261
ttgcttttcggaatgttgggtctgtggcactatgtggcgcgtctgtgcgcgacgggctcaaaatgcaccaagggcaggattcggggctcagtggacggccttgcaggaggagccgggagctccgtgcgtgaccccgcaggctggctcgtcacaccagcaagaccacagggtatggcagggtccccgcattgtgcggctggagccccatctcttgggccacaccgtggaatcgcgtcttgctgcagctctggggatcgcctagccgcagctggcatagcctacccacgcatcagaagattccattgccttcagttttcccttcaatgcaggcaggcaccatagcccgctgggaaaagaaggaaggagaaaaaaatcaatgagggtgaactaattgcagaggttgaaactgatgaagctactgttggatttgagagcgtggaggagtgttatatggcaaagatccgtgttgctgaaggtaccagagatgttccagttggagcaatcatctgtatcacagttgaaaagcctgaagatatggaaacctttaaaaattacacacttgattctttggcagcacctgccccacaaggagccccggcattaacccctgccgccgctgctccatcacctgcaccttctgctcaggctcctggtagctcatctcctactcacatgcaggtggttcttcctgccctgtctcccatcgtgaccatgggcacagttcagagatggggggaaaaaagtgggtgaggagccaaacgaaggagatttattggcagagatagagactgacaaggcctctataggtttcaaagtgcaggaagaaggcaaaaatcatgatccctgaaggcacacgagatgtccctgtaggaaccccactctgtatgattgtagaaaaagaggcaggtataccagcgtttgctgactatcggccaactgaagtaactgatttaacaccaccagcacaccagctagcccatccatcttcaggccactggccagctgctccagctggaccaaagggaagagtgctccttagcccgcttgcaaagaagttagcagcagagaaagggattgaccttacccaagtaaaaaggacaggaccagatggcagaatcattaagaaggagatcaactcctttgtgcctatgaaaactgctctcactctagcagccgctgtgcctcccctaagtcgaggagtggctccagttcctacaggtgtcttcacagatatcccagtcaccaacatttgccaagtcattgcacagaagttaatgcaatctaagcaaacaatacctcattattacctttctattgatgtaaatatgggagaaattttgttggtacgacaacaaaaaagaagatgctacaaggaaaaagcaacatttccgt

SEQ ID NO: 38605 - DNA, 2644 bp, Bovine  19866881077606
cttgacagtaaagtgggataagcgttcccctgaggactgctgccctcttccaccttcactgaacagaagcctgaaagatctcagcgttggaagttatcagattcctgtttctcaaatggccattggtgtttcttttgctaacagaagaaaacaaagaagagaaagttcgattacctgggaaggcaagggttttggctgcacgatattctttaggtcatatctttcctggttccagttgcccatcagggtacggtttgaataggcatcttcattagtgttgcatctccatccatactggaaaaacttggacatatcattccaatccgtccacacttcagcatggccatctgcattaatgaggctgccatagtgtgggtttgtaaggaaacaggcgaggacctgtctctgggaaaaggtggcaatagaaaagtttgttgcacaaaccagagagcagaaaacacatccctttctcgtccttggccaagcataagtacaccttctaaagatctaggctttcctctcagtttaataattgtcatcctgtttccttccaagttcataaatcctttgacctaccctctcaatcagcagtagtagatgactaaatggattaaatacactcccccccaaaaggcaagagaacttcagtacccctaatactattggagaactagaaaataattctggtgattttgaggtgtaagaatttaaggactaattactgccatcttcaaagagaagacagagaagtgagagctggataactagataatatgatagatcaatgatcaacaaatgatggtttccttcctttgggcccagctcaaacgccacatcttaggatatagcattcccttttcatgatgccttacttcaagttaacttctctcaattgtctcacacagaactttatcttcacacttttatatatccataactttatacccggagaaaccaccggcacccccactccagtactcttgcctggaaaatcgcatggacggaggagcctggtaggctgcagtctgtgaggtcgctaagagctggacacgactgagcgacttcactttgacttttcactttcatgcattggagaagggaatggcaacccactccaatattcttgcctggagaatcccagggacgggggagcctagtgggctgccatctctggggtcgcacagagtcggacacgactgaatcgacttagcagcagcagcagcagcaactttataccacatgttagagttcttcaaggaagtgtggaatcttttacactgaaatatgcatcccttgaggacaagatctgtcactttttcattactgcaccctctccctctgtataccctcccaatcaatagtaatttgcacataccagatgaccaatgtctgaatttcaatttttttggtaaggaatcaaaagccaaccatttctaattttggttaaaagttcagtctggtcccttggcttaggagcaagacaataccttctctgaagatgaatactttgaagttgaggagcttgtgtctgaagattttatagcagagtaacagcaaaccttactctgacgttccatattctttaaaacaagagatgacactaaacctggccttcccagttctccaggcaaagaaagaatttagatcacccagatcaccaggtggccatgatttggtggtcatcacccacgcacctttccacagctagagacaaagccaacactgtaagtttaaaggtaactgcccgcacatcatgggcctttgtgaagatagatgcatgcacttatgtcaacaaacagcatgacaactaagagcagttggtcccacaaagtcctcaggccatgtactcagatgacactgtccctggggctgttaaggatagacatccccacccacttagttgtccaaacctgaaaactggggcttatctttgactcttggtttctccttcaactcccttacatctattcaatcactaggtcttgttgattttttaatcagtgcactaccctccatctccactgaaagtgaaagtgaagtcgctcagtagtgtctgactctttgtgaccccatggactgtagcctaccaggctcctctgtccatgggattttccaggcaatagtactggagtggattgccatttccttctccaagggatcttcctgacccagggatcaaacccaggtctcccacgttgtagacagacgctttaccgtctgagccaccagggaagtccatctccactaccaagtttcaattcagatcactaccagccctagtctccgttactgcagtaaccttctatctggactccttgccaccaaccttgttcttcttctatcacttctccataggaaagcagaatttttgaaaatgaaaatttaattgtgtcatcttcctacttcaaaatctttcagtggctggccactgttttcagagtaaggttaaggctataaaaaatgcctatatgaactggtccctgcttttcagtctcatctgttatccactctccctcagactacatttcagtcaaactcagctactgtgtttttccatcatgcttttgcatttattgttacttctgccttttcagtcctccgactcaggaaaggtgtagtcccccccagtcccctagcttcaact

SEQ ID NO: 38606 - DNA, 780 bp, Bovine  19866881088552
tttagagtattgcttggcacatagagtgtacaagaaaaatattttttgaatgaaaaaattgatgactgaattttaaaaataacacttattgttatgagagtaatacatgttcatcagagaaaatttgaaaatacagaggaatataaagtattagcaaagaaaaaaagcagcgaacattttccatatttctttctccccccccaatacacatgtacaatacacacactcacactttttttacagaacagaattgaggcctgagttttattgcttgaatttttttctcttaaaattatactgtgaatatttttctgtgccattaactattcttcagaacattattttttatggcttcgttatatagtattctataaataataaatcatgatgtagcctaacatattaaccactttcctatttttgagcatttggaaacgttttataagaccaagagctgcatttatttgtcgcttgctctgttccaagtgttacgatgattttcccccctcttcatacatgatctcattgaatttccttctcacagtgatccaatgaggaggaattcattatacccaccttacagagggaatacctggacatgggaggagtgaagtaccaaaggtcacggtgctggtaagtgacaaagctgggattcaaaccaggtcatgtctaatgtcaaggtgtgggtcctgcaagcatgactctagacccctcccctggtgtgtgtgaggaaggcacatgactccttgggcactacggggttgcagaaacacacatccg

SEQ ID NO: 38607 - DNA, 1905 bp, Bovine  19866881114348
acttccttgagaaggagttatattttcctacacattcagggtccactgactatgccattaaacacatggtttgcctgtgatctgctcgtggactagttgaggcgacccctctgtggcagacttgccaggtctggaggcggcccctgatggccacaagctggggaaacagcatttgctgccatgtcctgaaccctgaaacttggtaactgcagacagcttgtcaggctcccagcaaaatctcccttcgtcctcgcagcagccctgtgtggtgggtgctggtggctctgtttctcgggtagagaacctccccccaaccctgtcctgtctactgggtgtcttttccagcactggaggcccagctgtgctctgcttctgaggctccaaatcagtcagcccggtaaaaccccctgtcctgactcagggagccttccctgagtctgtctcactgaaggaaatggactccgggtgagatggaaagggaattggctgttgccaggcagagccctgtgtgtcaggggccagcagccaagtgagtgatccaggaagtcatccagttgcaaaccagaaattgttcttaacccctcactcactgtcagtggcacgtagcagattggcccatctgcccccggcggggtcggggtgagccccggctactgagagccctgggaactgcctccagtgtccactggcctctgggccctgcgggaaccgtttcacaacccggggcttggcctgcctcttgacccaagacaggatggccccgtgggacgagggccagttcctgcgctgacgggtgcctgtttggggcctcccagactggcccctggtggctgctctctgctgacagagctgccgacgggcctctgtcaggcgagggttaacagaggatttgtttattgaatcgcgaagtagctgtcacatgattttaatcaaaacaccatttccctgacaacagtgatgtcagtcttgttattgcaggaaggagcagctgtgagggacagtcaggctccacgctgagcccaggttcagagactcagatcaagtgaagcatcatctgttgaggtcgcaggcatggcccccctgaacctgctgtcgtgctctctctgactcgacagcctgtgctgtgcagacgctggccagagcccggccaccctgtctccactgacattgccccttctgcacccattcttccttccacccttttttttccttctggtttttccagttctccttatttgccccaagctcagcgtgtcattcatttgggcccctaggatctctgacccctgcctctggcacctgtctcccctctgtgttttaaaccagcagttcttgccagcttgaggtggggccctcctgctgctcgggaatcttggctcctttggagcttgcttcctggaggagagggacagcttgtcctgtctttttctctcccgagagcaggttggggggcctgggtgctgcctgagggtctccagggcagttctgaggagctcggctgaggacgtctaaagggaaggagctcctcaaggaagggccaaccttagggtaggaggttggttttcttgagcccagaatgatgagagaaggcctgcatccaatctggagatcagggcccagggaggggggcagcagaccactgccacagagcagtgtcctcagggcctgccgcctctccacacctctctcaggggtggggactgagcagctgtctctgcagagaaagactgtgggccctccagccctcctgtatccagaagctcagtcttaaaaattggagacggaggagaaaagccttctaggtgggatatggattctcacagctgttcttttatctgtggtacccatgcttagaattcatcactgaaaggagaaatcctaggcgaagttcttggttctttgtat

SEQ ID NO: 38608 - DNA, 1054 bp, Bovine  19866881237013
tacattgtccttctgaaataccaagtagcagaatccttaccatatagtgagacctttgaaattaaaacataaacacacttttcaagctcacacatcaaatcacaggtagaatctgaatataccagcctatgatttgatttaatagtgactgtgattgagtggtctacaacgaaacggtttctgaaaaaagtaaactgctaactgctaagtcgcttcagtaaaagtcagtagcaaatggagttctccagttacccttttagaataaataaatttaacttttttcccaatttaaaatttgacttgtaataaacatacactccttgacccaagaattccactgctatgggattattctaaggaaataatcagatagatgcacaaagatgtatataacatgattattctctgaaatactattttagaaagagaaacagcaagacagaaatgatctaaatgttcaataacaggaatttattaaaataaaatatagatggtcaaattcaaagatactatttaaccatgctttagacatttttctgtaaccttggggaaatgttaacaaacatactaagtaaaacacacagattttatgtataggtgacatcaattttattacatacatataaaatatgtgtgaacagctaagaggataggaaccaaatattaagtggctgtctcttggtctggatggtggaattaaaataagaatgtttttattttcttcttcaagtttttcaacaatgtctacaaagaacatacatatatttgtaactggggaaaaacacacaaatactatgtttactttgaaaaagaaaaaacaaattttagcatcaattttcagtttaattcacccaagattcatctcttaacctgtttaaagtatttttaaaatgaaaagtttctgatgaaattcccgaatgtaactgtctttcattcttgtaattatctcaaacgggatatatgggctatttctctttgaagggtgggaaagcattgtccacaaatgtcctgtataaagaacttttacctaaataacatatttcaaatatatgga

SEQ ID NO: 38609 - DNA, 1111 bp, Bovine  19866881253903
aattatgaatcatgctgactctttcatgcagttagtagttcctaaaagttaactagaaaaatgtacaagtaatccaattagataaggtaactatgttcatgaatcaaataaaaatcccaaaagaaaatatcctaagttttatacccaaggacaggctaactttatctgtctgaacttaacatttgcataccccttctgaactgtacattggtttaatatctttctacactgatatctaccatccacaggtacatgaaagcaacatttgcctatacatctgcataatagattatgtccagttaattaagctcataaaacacatgatgagctgcaactggaaaggcagacagggggctaaatcattatatcaattctatatgaactcttgattttacacactgaaggcaatggggaagaacagaactattttaagcagaaaactgacaaggatcagatctacattttagaaagatcattctgacagcaacatggaagatggattagatgagggacaaatttggaggtgaagagactttaggctgctcaagttattaaagtgagaaatgatgaaggtcaaaagtaaagccctgatgaaagacactggagaggttaaggacacatttaagcactactgcacctgggaccctagttaataattttaaaacccaaagaatgaaaacttaaattctggaattataaagtaaggaaaaccttcacaatttatttaaacttataataaaaggcaaatgaacaatttttcaaacattacctttatgctgttaagataaccaaaggctgcaaaaattgtcacttagggtgtctgagtaaccacgtgtctaaaggtattttggctaaaacaaagccccttttcagtcaccagagccagcatcctaatacatttccactgaaagggaaagacaggaaatgaatcaataaagctcaggcatatgcttggccttgaaagatacagaatatcaaggagcagaaatttgaaaacaaaggccctgaataatttaatcaccaggctgtaatctgctgactgcggtctaattgtttgaacagtgcccaaagtgtccgacaaggtgaccaccctaagattttgcaccttttt

SEQ ID NO: 38610 - DNA, 1262 bp, Bovine  19866881272306
gtcctgtggcgctgagctgtttcccgctcccctctcccctctgttgctccctctggtctcctttccctgtcccacacccatgacaaggaactagtggcccgggagcatcaggggcaaccactgagatgagacaggattggaggcaacccctgggaagcagtgtgatatgctcagcacaaaagcatggaattcggacacccacgtacagttcacttatccagtcaatcaaaggaagacaaggttagacttgccagttcttggtcagatgaagcatggagaatactgagaagcacaagctgacgggatccacagctctgagtgtcgcaatagaaaagggttagtcctaaggaagtctgaatgacgtcaccgtgttctcctgcctcttgcctcacgtttattagggttgcctcttctgcagagctctacaagtaagcactccttcaagcgctgatctgttccagagtcaccccactgggagcaaaggctgagtgcagagaaagaactgtgcataggaggttctctcagggcagacccagaagcaccattctctggagaaggccatcgagaaagaggtgggtggctcagttcaggcacggaaaaccagaggcatatacagatactttccaaccctcttcatttagcgagatgaacctgggaaaccgattcccaggtctgtacttaattcatggcagagtagtaattatcaccacagcattaatgacatttcaaatttatatttatataaagaatgtcttcattctgtgagactcaaatatttgcccctcaactctaccttgatattttcttcttctttctctttttccattttgtggcaaaattttaatcccaacgttatggatgggaatacttggcaaagaaaaagagactttacctggactcacacagtgactcaaagaagctgaagaactcataaccagggatgctcactatcataccttgctttatcccccagcccccaccatgccacagcttaccactgtatgtaaaaaaggtattggaggacttctctggtggtccagcaattaagactccattctaccagtgcagcaggcatgagttcgatccctggtggagatcccatgcgccatgcagtgtgaccaaaaaaataaacaataaaaaggtattggatttccagagcaaatctttctttgaattcttgggaagaatataattcttgggaagagatggttctgactcaggccagtctatacagtggttaagagagtacacagtgaagtcag

SEQ ID NO: 38611 - DNA, 1041 bp, Bovine  19866881274611
tgattttgccgtcttagaggcccacagcagtaagatggtggagggtgctactggcagacagcacgagggatgaacagagacggggtttgccatatgcaaagtcacttatgagcaattaaactgggaggagggtggagagcatcatgagcgtccttcccatctcggcgtctctgggagaatcctcaggcgtaacaacaggagcccagccaatgcacctgccccacatgcatgatcagaggcgatgtctccctctccacaaagcaagggctggtcaagcccccttgcagctgtttcccgtggagaggaaagcccctaagttcccaggcagtgtaaactgcccgtgtgtttatacaatatgccccatggcccgagaacatgacaacgcctcagacgcacaaactggcagctggtgcagcggggattcagggtgcttgggagcgagaaggagggcgtgggagacaggatgcttgaatgccaaatcagcgtggctctcctctggagaacacccaaatggatctaaaactgaagctctgaaaataacaaacatccaagccttttgaaacccaagttgtgcccagacatcttttaaagccgagtggctgacccccagacggtgcgctgagagggtgggcatggacactgcccagcaccctgggggcagcttctgctccctgcccgaggtctgcgggagcttcgctaaatgcccacctgcctggctgttgcaagagggagcggagagagcccactggtgagagggcgggagtcaaggagggttctctctctctccctgtagggggggtgggggtgccttcagatgagctgttttgtttcacgctgagctgagctcacctgggcgatgaccttgtgacaagaatacccggctgagtccagatcagcaaagggaggacaggaagaggaagaggaagacaagcggaggcagccatgcgggagcagtgactggcagaaacctagtcacaactgctggttagcatcgtctttagtccttcaaccaaagttgataaaacttggataagggcaagt

SEQ ID NO: 38612 - DNA, 1880 bp, Bovine  19866881277429
atgagaagagccaactcattagaaaacaccctgatgctgggaaagattgagggcaggaggagaaggggacggcagaggatgagatggctggatggcatcaccgagtcaacagacgtgagtttgagcaagctctgggagatggtgaaggacaaggaagcctggagtgctgcagtccacggggtcgcagagagttggacacaactgagtgactgaacaacaactctgtcctttaccttggcattcaatcccttcacagcatggcttcaacttaaccactccgactctttcatttccctattcttcagttcaagtgaattaactggaacaagtctatactggcccacttgagtacttctggtcacactgcttctgtctacgtgtgatgcctctagctgctgcctctcctgaacagctgtgaggctctatcttaaatgccatctctcccacaaagccttgcccgatcagatgtatctctctcccctttgccctttttctaaaaaacgttctatgacacatctacacaagttcaaaatgatgacattcatagcatcttctaaattttgccttttcattatttttgaaggattgctattcatgatgttgtcttattttgcttctataatgtaatgactctgagggcacatttatacatcctgagggcacgttttatacatcttcttccctgtagtgcctaataagtgaacctttcacagtaaatctgcaataaaaatttattaaatgaaattgaatgtacagattagttacattaattctcaacataaatgaatgattttaaaaaaagagagaagcctcttaaagaaaaaaaaaaactgtctgaaataaaattaaacccttacaaataggaagatggtaaagtttttgagagcctagtaaacgacagacagaaactttaccgagaaacaaggtgtagaggatgaaatcctagccctttgtactacgccacggaaaacgtgtcaaacgtctgaacaggcacacgcaccgataagactattggctaataaggcgttaccttggcaactgtttgttcggcgatggtgctaggccgacgctggcgggcatcaagtctctgctccacaggaaaactgctcctgtgtgatttcaggcgctccaccaacaagtaataaatggcagcaaagtggttatagctcttgttctgcaaagcctgcaagagaaaacaagtgccaaaggcggagaaccataaaaaccaattcagtgatttacacctttctaaaaaagagggaaaagcacaacactataaatcaactaatcttcaataaaatgaaaaccctaagggaatatatgtacacctatggctgattcatgttgaggtttgacagaaaacagcaaatttctgtaaagcaattatccaataaaaaaataaattaaaaaacagaatgcaaggagtctggctaaaataagtaaataaataaataaaaaagggagggaagagatcatgtgttcttaaaaacaacaacaacaacaaaaaaaagagtaacaagcaaagtctgcctcaaaatgaaaggtattccagaattcagaagagaagacagataacttcattaattgtataaagggtgatacctctgaatgacttgactggtccttttacattaattggatccatttatttttctgcattcagagaaaacgccatcattgtctcatgcagcgttccccaacgctgtcactgtggtcccatctcatggctgtaactaggctgtaaggctggttagcaacctgagcccacaggctctaattccacagcctcgacacaagcccaaagcactgccaaccctgaggtcaatgattaaagtctttggggaaatttctggtgattattttgggctggagaatgacgt

SEQ ID NO: 38613 - DNA, 1248 bp, Bovine  19866881310754
tagtcctaagataaaagcttggtttcaggattccccagtattatttttattcttttcatgactcctgttagttccaaagtcacatataatgtatcacttgaatgtatgttttcatgcaatggttaattgttctttcatgtagaaggactgaatagacccttaagttgttgagcattacatttttaagaggttatttttcatttctagagctctgttacatgtatgccagatactttatataattattgtgtttatcaaaagaaattggtgtctagtccctttttttaatctcttccttccttttttcttttaatcatttttcctactgttattcaaagtccttatttgaggagaaaagtaattacctgatagatatccttggtaattactatcagccttgagtagcagagcaggcagattaaaattgctgtactatgttcagtacagtaaaattggaatccactctgaatttaagtatgttcaaaatgcttctttaaaattaattcactcatatccattgtgttggcatttagaaatgatgttttcatgatctttagtgattgaatgaccccagcattttacctgtgagtttatgtttttatagggaagtaaatttttacttgtgaatttaaagattcattcaacaaatatacatttatcaaggctttatgggaggcaataaaactataaatctgtgactgtgggtgacaattactttttaaaatttaattttagtatataaaaaataaatgaaaaatccagaaaaatacttgaaatctttccctatcagatgtttcatcctaggccccagaattcctatttgaaaaatagagagagagacaatcccaggatcgtactgatgtctggcagaatgatgtggtggcaagagcactgactgggctgggagttaggagaagctgggactcttttctaaaattcagtgaaatgtattttattcttatatgatttcatgggtttccgagacccttgaaatagctttgcatctctaatttgctgtagctacacctgacttccaattgtagtgtttagatttcagcttctcccatgacctgttttctaatcaagatatttcatggtagaaagtgttatcttgaaacatgatttctgggccatgtgacctaatgaccagcatgggaagtctctctgctgtttctgtcccaaagttgagcatctgtgtcatggcacctgagtggtgatgttttgagagttggggaagacatggctgca

SEQ ID NO: 38614 - DNA, 664 bp, Bovine  19866881378020
ttgacgtttgacccaaccttgagccccaagtctttccgatgccccaagaggaaaatttccaggaagtctcagcagtgtgtcttcactcagctcagcagtactgacagagggtctgggtaacctgacccttgtctgtgggacccgctacctttcccctccaccagaaggatcaccccaagatcaggacagacgggagaatattcaacagcaaaggtaataggaaaagacagtgttacttcagttctgaaaagacagtttagttggagatccttcagtcacagtatacattataaaaagaacttcagatttgaatttgagtgttgtcatttctggagtcatcctgggacgcttagaatgaggaaagcagcctcttgttcttcctccatagctcagaaatgctcagtgacttgatcctcagcccttgttccatccttcctctgcactagaagaattgttccaacagcaggaaagagaagagacaatccaaacataaatagaagggcactgggaaagggaattgacattttcagagagaggcttcttctaacactgctataacgaaggcttgtctttcttgttggatggctatcagattacatacagacatgaatgtacatactgccttgcacagaagctttctaagaacttaaaacaatgaggtatg

SEQ ID NO: 38615 - DNA, 1651 bp, Bovine  19866881612306
ttacgaaaatagtattcccctaaaaagtagaaaggcttatttatttctaaaatacttctttattcctattgtagaaattataataatataataccctagtagagttgtaaaatctttggagtaatcattagtttagggaaagtaaaggcctggcatcaatatctaaatattatatttaatattataaacatttacatgttgagctcatgtaaatcattcttaacctcttctattttttctattcagaccactggtaattcaaatagcaaaatatacattctttgaattgattatgttgcttgtttttccctaagttattttatgtttaaagttagaaaaatacttttttataaaaactgtacaaagtaagtgaaaatagcaataataagcttaaagaaaggttgtattcaatagagctaaaaccaaagtgaactctacttttatgtttacctaataatatggctggtctcagtaggcatgcattttctagaagtagtactgtttcgttttgactttcagcagagaggaagagttgtatgttctacctttgatgttatgtataaaaattaaatttatttttactgcttttattgaatatcttataagtctttagtgaagagcacctctgagttcaagttagattaataatattgttaagttgcctcaagatatattatctttgctgaaatgcttaatatttcatatatcatatacaaggaagattggtttttaattcactagaataaagtaaaattaaaggtaatttacatttgagttattaatgtagtgatctataggagctgtgctgagttgctccagtcgtgtcccatgtctttgtgaccccatggactgtagcccaccaggatcctctgcccatgggattttcccagacaagagtactggattgggttgccatttccttctccagggatcttccccaacttagggatggaacccgtgtctcttatgtctcctgcattggcaggcaggttctttaccaccagcactacccgggaagcccagttcagttctgtaggagttagatgggctttagctgaggtctgatgggaaacttgctctttttagttttagtgcctttttttttaaagataaaataatgtgtttacttctttttggtccagtacatgtgtacaaaggtgaccattgtttgtccattcattctttcagtagatatgcagtgaacacctacaataaggcaggcacttcagtttgattaatttgtttcagtgtaataagttacggttttggctttaccaatgacaagtatattactctggccaggatgactttgcggctctgtagcatctggtaggtggataattttaatggaagtaattcgctacttcaaaagtattatataaatactacataaggataattgttagctataccaaggagccaatatcagatgctctttatacaaatatgtatcccatatcactttgtgattgaagatgacgcatgggtgtttataagatctcatctagacgtttctttataaatctgtcaaatttatggaaacactgaaaaacacacagtaataaaaatggataaatattaattatatatagatgtatctaagtgtatatacataaacagaatatgtatatataacaatgtgtatatatat

SEQ ID NO: 38616 - DNA, 1065 bp, Bovine  19866881887283
tgactttcccagagtcttaccaaacctggaccagaacctctgactgctccttcagcattctttcctataccatgctactcaagtctttttttttttttgtcctctcaagaataaaaagaaaatagaaaatgttttaagacccaaggctcaatagagacaattttgtggggaagtgagactgttaatacaattaacatttactgagtgcttactgggtaccagacactgttctgagtacattacattttaatgctccaaacaaccctatgaaatagaagaaaatgcgttgccatcttttctggaccctcactctgttgttctggtgcctttgttcctaatgactgggactcaagtttcttttccatgaagactggcagagggcctgagccacaatgtacatataggaggctttagcacaggaggatggatggacggatggctggatggatagatccaaatacaccttttcctaagttgaattgcgtcgttgttgtttaattagtgtattgttactgcacagaacagtcagtgaagtcttactgtctgcagccctcaaaagctctctgcaagatctccccaaacctcagataatgcagaaggaagagctgatacctgtgccgtccacagacctctctgccagggagttcgtggtttaccaacatggcctgtccatcctccacctcctcagcccccagcttcaggtgagtctggttctggtctctgtagagcagtcatccatggagtttagaagggcagggtcaccaggaaggaggctttgaggtagcagatattccttaggctgaagcaccggggacagagaacattctaagtctctcttctgagtgaaccattttaccaattgaaagcctaatctctcaaatgataggataatgggaagaagaatacaggcagagaacagactctcctctgatttgagagatcccaccactgcttcaacattcattgtctttaacatgaagtctgtatggactttataatgtagaaagcaactttgtatactttgttttgtttacacctagtaacctgaattctgggtctatgaga

SEQ ID NO: 38617 - DNA, 851 bp, Bovine  19866880439676
attattaaaattacgaggtgtttgatgatagctttcccatccccccccaaaataagaaatccatgaaagcttccttcccaatttcctaaccagatagtatgatacagagcgaacctatcttagtctgaattccaccaccaatgaacagttagtagcaagcaggcacgtccacaacccacacaacccatcctatgagccaagggacccctctgtgagctgtgttttagacacttggatagcctctttcataaaaagttcatttgaaatgtatgtgacaatcctgtcagtgcaatacttagctaacccagtcagacaggtgaacaaatcaacagtataatattcagactcaggactgcttgaacttcagagctcagggcctttccaagagactgagcaactagccttgctcaattcatttgcaaagctcatacaagacaggctcaccatgaaatgtttctaactatctaccttttttgaacactattattttcatcaatgaaaaaccattttagaaatccattatgctaattaacacacccgtaggtgctgagctaagccagataattgaagcacttagggaaacttcctctggaatgtggggctgtgatccttccaatgttagataactgcccctacagtgcagacgaaagcgtgcatgtgcatgcacacacaaacacatgcacgtggtcacatgcagcatattacctatgctttagctttagaagtaaatcacaggcaacacagaataatagccaccttgtaatgagaacttactagatgccaggtactgtgctaaagaccagaaagaaaactgatcacatttaatcctcactgaggaaactgggccccag

SEQ ID NO: 38618 - DNA, 1633 bp, Bovine  19866880451662
tttgcttttgtttgcagtcagttttgcttagaagccaagaacatagatgatgcaattttgtatcccatacttaggtaaaaagttgatgcaactgtggattgtgaagcctcagaaggctcaggaccatgtcctcaagtcagttgctatatcctctgtgtctggacaagtcagttgagcaaaatatgttgaattggacagcactggcgtgtggcatgtctcagctcttgcaggatgcacagtcaacgtgatgctgctttgttcttcttccctgtaggtctccaagcccaaaccaggacctaggtatcccatgcggtcatctttcagagcccaggcagtaatactgatctagatttatgtgtgcatctctactgtgtaatatggttgagtgtgttgcccttgaactttctgtgaaaatggctaccacagaccccagatctcagagctgagaagtctagtaatctttgctggcacatgtagagtttccctttccccttaggtcatttggacccagaccaaagaagataatgagactttatttgctctccccactaccctaaacttggatttcacagctctccaggcagctgcatagaaagaagacagaagaaagacctgtgtcccaacctcctaacacactgacccttctgaaaggggtttttcctgcagaaagggtctataattggagggcattttaccatgatgctgagccaggcacacagaagcatttttgtattaactcctttggttacagctttcttctctgcctttaaaactgccacattagtgaaggtgatacaggctgtgataataaacatttcagtcagttcagtcgctcagttgtgtctgaccctttgcgacctcatggattgcagtacaccaggcttccatgtccatcaccaactcccaaagcttgctcaaactcatgtccatcgagttggtgatgccatccatccatcttatcctctgtcgtctccttctcctaccaccttcaatctttcccagcatcagggtcttttccaatgagtcagttctttgcatcaggtggccaaagtataggagcttctgcatcagcctcagtccttccaatgaatattcaggacagatttcctttatgattgactggttggatctccttgcagtccaagggactttcaagagtcttctccaacaccacagttcaaaagcatcagttcttcagcgctcagctttctttatagtctaactctcacatccatacatgactcctggaaaaaccatagcttgattatatggacctttgttgataaagaaatgtctctgttttttgatatgctgtctaggttgatcatagcttttctcccaaggagcaagcatcttttaatttcatggctgcagtcaccatctgcagtgattcgggagcccaagaaaataaaacctgtcactgtttccattgtttccccatctgtttgccttgaagtgatgggaccggatgccatgatcttagttttctgaatattgagttttaagccagcttttttactttcatcaggaggctctttagttcctcttcactttctgattaggggtgatgtcatatgcatatctgagggtattgatatttctcctgacaatcttgattccagcttgtgcttca

SEQ ID NO: 38619 - DNA, 1685 bp, Bovine  19866880518473
atcctggtttcctgccaaccctccaaacacagctggggatgtgctgggttaatgtgtcttccttctgtgttgggagggagagcctagagccggcatagcagattctcaaggctgtagaggtgaggcctccagagtcgcatatctctaaggaagagtaagacagttggtgtccctgagggcaaagaggcatttctcactgtgactaaatcacattagacttgcctggaccttggagtcatgactgccaaagtgtatcactgaaacatttaggcatctctatcctagaacctggccctcaacctggcatgtctctagtgggcaagggaaaggtctggaaccagcaccaccccttcacagtaaggactggagaccagcacagatgcttctctgggtatcacagctacccagaacccaggcctccctccaaggcccttctcctctcccagctgtgaccagctggggctgtttccagccgccaatagctaattccaggattacactttgtaagttgatgaaatgtaatatccagaatgtaaaagttgtagacttgctcccagcagccaagcctggggtgtttctccaggggctgaagatcgcatttagaccgcagtagagcatggcctgcaccataaaccctttcatgacccatggtcccgtgacaccgagggaaaatgcaggcccagaagtattaactttatcacaacatttttttggctcctgaggaattgaaaaatctgctctaagtcacgttctcaaaaatgtgtggaaaaaggacagggcagggtaggaggcagggggttagggggtggagtttcttcgaggtgctttgacattctctctccaaagtttcacactcagagtgcatttaggaaaggggttttgaggatcatagaaagaaaagaagcatgtctaaaacagggagctatttctcatcttctgtggtgaattgacacctatcacaaaataacatcaatccatggaaaggcctttgttagggctgttttttttagtttccttctcacctgaagaatgatgacattttccccagattttttttaaattagacattcaaagaaatctaagcctaagaaaaattattagtaacaaaaataacaagaagaatcatagccatcattcatgaagcacctaatgtgttttaaggttttcactataatgcttacatccactaaatctcagtataacaatagctctgaagatgaaggctgttattatccattgttttatagataaggaaaccaagctgaaagaggcaaaacaattttatcaatgttggctaatgagtttccaatattttattaaatcatcatcagaaaaatatacacattataagtaatcagggggatggatttcatgaagtgaacactttcatgtaaccaggatgtggatcaaaaagcagaacatcatactagcccctgcaggagccccgtcttggtcctcccacctactaatccccaagggcaacctctactctgatttataccataaactaattgtgctcattctaaaatgcacagaaatggaattgtgcagtcaatagtcattcttgtccaaaatttcccacaatgtcccggtagtgaggttcacccgtgttgctctgtgtggtactagtctgttcatcctcattccagggtaataataccacggtgggatttccaaacgacaag

SEQ ID NO: 38620 - DNA, 2634 bp, Bovine  19866880520107
ccaaaggtagcctcggtcattacagcagaagaaggaccaagtcaggaagaaaataccccaaccagtggccctctgctggctttgggcatccgagggcagctgctggcagttcccattctctgatcttagtgcaaagccgccacccagttgttcccctgggagaaggggccaagtttcgggttactgggatggcaaaggccttgaaagcctgaggcaggtgagggttgcttgtgtcgagttaattaggagactcggctacagcgcaggcaagcccgaggtcagatatgcagatgactgtgcaccccacccactttcttcagaagcaaaccctcccctctccccaaaaacctgtgatatcctggagctacaatttctctcctctgaacagttcatttggggaagctctatgcctcacaggagagcacgagagaaactcctctgctctctgaaaaagcttcaatacaactcagattttcctgtttaaaaaataaaatgcctgaaagttatctgtaagaaccatatcaaagacaaaagtctttgccacgaagccattgttccattttaactcccatgtccgctttgatcacatggtccagccctgggtttgactggaatcattagtgaaagttaatcaattccagctgtcatcatggcttataggatggaattttccagaactgtcactaaattgctttctaactttgaagagtcacagcttcttgatatctcaccagggcacggctgtatgctagtggatctggcatttgcaaattcaattacatgtggtggccaaaagaaaaagggaaaatgaaaaaaaaacaaaaaaagagggaggggtagaaagggaaataattgaaattgtgcaaatgacttggccctccatccacttgatgagcatatgttccacagagaacaggagactagaaataggactcagctgtcccacagtcactcgaagcctgagccaactcttaatcacagctggtctcaactgaaggaaccacagcgagctccaattcggagagagaagttcactgtgttgggactatgagatggaactcagtggtttccaaaacggagccttcctaaaggattttcaaggatgacacgggctgctctccacgtgctgctgacacaccgctggcctttagagccttccctggtgcaggaatcaactccgacgagcatccatgggcaacaagactggcaagttctgcagtgcctgacaaatccggaagacttctaccgcagcctgatttatttacacgttacagcagtcacaccttcggaatctctgacttgacccaaagggcaaataattattccttttaattgtgataaatcaccctagagtaggcaaatatttgattctcaattaatttccaaagcactctgagagttggcaggtgccgttgctgtcactccttcccctttcccgtcaggactcggtacggacctgagtgaagggacaggcggctgacagtgacttataggggacgggctatgctcggcgagcgtgtgataaaaaccaaaattatgaggagattaatatgcagctcagaattggcatttggatttatcagataaatcagaggccatcctctgatactccaaaactgctagagaagaaaacgtgctgattgtgggatcagcatttttgtgctcccagtgccaaaagaagcgaccgtttctctgaaaatttggttgcctgctttcctcctcttcaaagactggggttatacagaggagcaggggatcaagagagcttttttctggctccactcctcactaactaagaaacagtattcaaattacaaccctatgtatgattccctatgaatgagtttctttgtctataaaatgggaagtcagcgcctacatctaagggtggttattaggacctgataagtttttataaatattcgttgcataaatgaataaataaacattagtaacattgtacaggaggtagtgatcaaaaccatcctcaagaagaaatgcaaaaaggcaaaatggttgtctgaggaggccatacaaatagccaagaagagaagcaaaaggcaaaggagaaaagggaagatacatgcatttgaatgcagagttccaaagaatagtaaggagagataagaaagtcttcctaagtgatcaatgcaaaaaaaatagaggaaaacaacagaatgggaaagactggagaactcaagaaaatttagagataccaagggaacatttcatgcaaaaatgggcacaataaaggacagaaacagtatggacctaacagaagcagaagaaattaagaagaggtggcaagaatacacagaactatacaaaaaagatcttcatgacccagataaccacaatggtgtgatcactcacctagagccagacatcgtggagtgcagagtcaagtgggccttaggaagcatcactacaaacagagctagtagaggtgattgaattccagctgagctatttcaaatcctaaaagatgatgctgtaaaagtgctgcactcaatatgccaacaaatttggaaaactcagcagtggccacagaactggaaaaggtcagttttcaatcccaatcccaaagaaaggcaatgccaaagaatgctcaaactaccatacagttgcactcat

SEQ ID NO: 38621 - DNA, 1548 bp, Bovine  19866880570112
ttccagcatcaaggtcttttcccatgagtcaggtctttgcatcaggtggccaaagtattggagtttcagcttctacatcagtccttccagtgaacactcaagacatctccttacgatggactggttggatctccttgcagtccaagggactctcaagagtcttctccaacaccacagttcaaaagcatcaattcttcggcgctcacctttcttcatagtccaactctcacatccatacatgaccagtggaaaaaccatagcctttgactagatggacctttgttggcaaagtaacgtctctgctttttaatatgctgtctaggttggtcatcactttccttccaaggagtaagcatcttttaataaaattaaggctacattaaagcttagctttcagatcgttttagtcaaggactccatccaaatcagatgaacagccatttctacttacaggattactgctgctgaagcttttttctttcactgatcttttagtgtggctttcctcaaacttcactatgctggtgaattccttggggctcctgtaaaagtgcagattttgactcagtatgtctgcagtggggcctgagactctgcatttctaagaagcgtccacgtgatgctgacactactggtccgtgaatcacgtgtgcagtcactctcttagcaggcagatgcctcccacctcttacttgggcgccctccctcctagctgaggctgtgttaatataatagatctaaggcctgtcacatgcagctgcctggccacatgagtgtctcggttttgttgtttagttgctatattgtctgacgttttgctgccctgtggactgtagcccgccgtgggatttcccaggcaagaatactggagcgcactgccatttccttctccaggggatctttccgaccaagggatcaaagccaagtctcctgcttggcaggtgggttctttaccactgagccaccagggaagcccgagtgtcctggtagcacgtctcagttcctctggttttattctttttgtagatgaaggaacccctgggagggaggccacgctcagtccccacctgcctgcacctggggtggagggaggcagctgatgacatcagaagccaaaggatctacctacccttagcagtgggcatagggttgaattgtaaacagtccactcccgtgtttcaaggggagcctccagagagcagaggccttctttgctttggtttattttgtaattaagggaaaaagagcccaacctaaaacgttgcttgagggtcctggcttttaaatttatgtcactgaacagtctgtgaatcaaggggctcagtgtgaaactgtcacttctgatatcagttccctcgctcaatggctgtatgcaaatacactgtgctctccaggcagtatgcttaatggggacatgagacctggtccatcctaagctgaatgagtgttgggtgtgcactcatgtctgactgtggagctcctgctctgcctcctcagcctggggtatggaggtaccttagttattccaaaaacctgtttaggggaggg

SEQ ID NO: 38622 - DNA, 1406 bp, Bovine  19866880802360
ttgaaccaagccaaatgtccactctaatagataaactaagacggtatatccatacaatggaatactattcagcaataaaaaggaattagctactgattcacattacaggatggatgaacttcaaaaaaatatgctatgtgaaggaagccagacacaaagggccacttaatgtatggtcttatttacctgaaatatccagaaaggcaaatctatagagacaaaagtaaattatttctgatctgcagctccaggcaggaagaagggttaactgtaaatgcacagagagattttgttgcagggaacagaaatatcccggaagtggattaaggtgatgattgctcaactcagtaataaaaaacgctgactggtagacttaaaacagagtgaatttaatgaaatgtaatttatgcctcaaaaaagtttttttaaaaaaacttaatggaaaatttggtgaaagttcagaaactaaaagatttagaggttttgttgtattctggtgttaacatgaaagaagaggatgaagaaagagtgattagagacttcacaactgcaaaagagagaatctggctttatacaccgtggttatctgtccagatatttgggatggatatggttttttgttttgatgccagggaagaaagcttatctagatttagacacaatgaatcatgattctatttccttaaccaactgtgggttcctggagaaaagaaactaagtcctagccttgagtattaacttttgccaccaatctgctatgtgaccttctcccaatcacttcatttttctgaatttcagtttatcttacagaagtgtgagttgtactaaatggttcttatagccctgttcagctgcagaattcttttcctgggcattcacccctcccaaggattgccctagactcttatctagtcctaatgcttgttgcttcagtttctgtatcctccacatcagataaagtgacctggttccaccccatttatctgtattttttcccctgggagcctttgctcaggccccaggtttatcagaaatgagatttttctaattgttcacccccctacacatttctctatctctggatctctctcactggatttctacacttgattgtctttcattgctattctgtttatcccctgctgcattgcaaaacctccctcaaacctaacaatttgaaacaacaatcattttcttaggctgaaaattttgtgagtcagaaattagggcaggcaaagtggggatggcttgtctctcttctgatgtaactggggcctcagctagggtggctcaaatcctagaggtggctgggatgggactgtaagcttcgagctgtgtttctggctaacagcaagatttctctgttcttcttcatgtggtatctgctgaggacttagatgtccaag

SEQ ID NO: 38623 - DNA, 2530 bp, Bovine  19866880846538
gagacctactggcctgatgggcacacatttcttcattttctctctggagagtctctgccttcactctgctgaaactcacattagccttgtttagatcccacaagaccttttcttggcgctgcccatctttaaatggctctcccagtgctgaccttagcagtactttcacaacaaaagaaaaacaagaatcattttcaccctgttgtagcgtgtcatttctcatcctcttcacttcctttctcttgtttgacagatgccttagatttcactgctccaagctaacttcactttttagtttgttccgtttcacactccccgccccccaccatgctgcccaaggcctgcctcgctgcccctcctgtctctgtggttgaggaggtggtgtcaggcaggtgaggaagcagaggagagagaaagagtccaggttgtcctgctcagggaagagatatgtctgacaaattaaaccagaactctaaaaatgttttcccctggaagccttgctgcacgcttgtaaactctgtattgcgagtgctctatttccagtttattttgaattgagtaaatttgtgggctgcccagagaatctaactatgatttataatcatgtatctttaggaaaattcattctgagcctcctaaaagtaaattgtaaaagaactcttggaatgtagatttttccaagtttggggatctgttttttccccagaatgtttgtgctctgaagtattcagatattctggatgtgacttccaaaaatgaaagagcccctgggccccttcatttcactggcatgtgcttacattaaatgttggtgatgtttcgttgttcagtcgccgggttgtgtacaactctgtgacgccatggactgcagcaggccagacttcctcgtcctttactgtcttccggagtgtgctcagatttcacatctgttgagtcagtgatactatctaaccatctcatcctctgccacccttttcttcttttgccttcagtcttgcccagcttcaggggtttttccaatgagttgactcttcacatcaggtggccaggcgctcagccttctttatggtccagctctcacatctgtacatgactactggaaaaaccatagctgatgttactttagctcaatggattgtggtagggctgagaggctttttttgagggttttttttttttattgcaggaattctgatggtgtggagagttctatatcttagtctctccctggaagattccatatagctggtttcattgtagtgattttgctgtgccacagctgttgactttaagcctgggcatcagtcaccaaccagtcattctattttcaagtctgttttaacagtttgccttcaaccctctaccaagttatttcccttgatttcttttcaactaatagtcttcaagctgcttccagtttgcttacttatcccttgcagttggtggtgggaatggggagattgaagaaagaaaaaagagctttagaaatattttgtattgtacaagttttcttcccttcataattctagtcaaaagaaaaaagactgtatggattgtaggtggttttactaatacaggtgttttttgtagagttggacttaggaaatgtggtaatgttgaatattactttggattagatttttaaattttcaagtggaaattatgtctattaaaattgtccttaaaaattcttgttagggatgaaaaggggcaaggaaataaggacagatcccaaagttggcttggtcttgggggattgactaaaaagattgcatttctcttcaaggggagtatttacagggacatgaaaattatctaagttttgggttgctgacatggcacccctggcagcagcagctccatcttgggtctagaaatttatttcaacttgcccttttataatttttaaatctctgggagtaaatgggggaataaatggagaattagatgttcctgtttgcttggagaggtttattctgttctggttttcatgttaaacttttatagctttaatccatgttaatcagtttgtttgttgtaaggattaaatgaaataattgatgtgaaagcttctaacagggcctggcaaatagtagatgtttaacaaacatttgctggatttgaatttaaatgtcacaggtggtataatgacttatctatctattagattcttcttgtgtttgggcattttgtacaaaattagatatctcatggctcaaataggagacagcaattattctttctttcctgggtgttcttaggatgaacttgagtgatgttatcgatattaaggatccagatttcacctctgctgctgaacgaaggcagaaacgcctggctgctgagctggccaagtttgaccctgatcattatctgtaagtattgagttttattttttaaggtttaaataatttacttgaaattgagtatttaaaaaaattttgagtgcgttcttgaccatgttggacatgtgctttttggactccagaaatgagtgatagctcacaatcttaattgacatttaaattaa

SEQ ID NO: 38624 - DNA, 1586 bp, Bovine  19866880849809
tgtatatagcactgtaataggtttataatacctttcacacacatagtacagaaaaacccaaacacaaaaagtaaaacattttcaatctaacagtatggtaccctgaaaagtaccgtcgtaccagctacatcactgctggttttatgtttgcttccagacatcctgggcttgaaataaagatactgtactactgtcatgaaatatagatatagtcgtgggtactgtataataaagtaccccaaagcacagccacttgtagaggaggcacgcacaagaaaatgcacaccagtcacgtgaactaacttaggggatcggacatgcaaatgcatgtttgcatctttgaaagtttgcagcttgaaggcgcatatgtaggggactcattgtagacctttgcagccagttacttgagatctggttgaacgtgggatgcagaggacaaaaggaaaaaaagggacactgagtaggaaattatattctccaggtttcttccaaaggtcaggcggtaaaatacccacttacatgtagaaaacttcccctaagatgcctatggaaaaatattaaggtgcaatgaagaattgctggcaaaagtaaatatatactttcttatactttctttgtgtgttttagggagaggccctttgaaataaagcagcatgagccaggtccttcttgtacagagaatgaaacaataggaagggatgctgactttcagagggatctcagctcaggactttgtaattactttcatcctgataacatcgcagaccaggatgtttttattgcttgcaaagaagtgccctcaagttatctgctactctagtcaaaggcctgtttagaatggtattgaccttaagacaataataaagtgcggagttgcaggagtgtgaaggcatattgggtttgttggggttctaagggacgggggttgccactggggaccagaagggcagaacaggactggagagctgaagccgagcaactgatggaaactcatttggattcttttattttgttctgacttggcggggccagaggtagtcatacagcagagatcatcctggtgcctggtgtgcacacagcttcccttacttcagcttcagtgttggaaaagtgcaggaagagaaggggatttaaaaccactagttcagggtgtcatattgtctccttttccagaatgtcatagagctggaattacagagtatgcagccttttcagatcaaataaccacattatcagtgactgatttggaggcatttaataaacaaataggtgtatttgcttaagttctgcaggtgaacatgtgtctggttgctctgaaggctaacggaaaagtgtaaagcgaaagttggcaagctttttctggaagggaccagacggtaactattttaggcgttgtaggtatttatataaccatttataatgtaaccatttaaagatgtcaaaaaattcttggctcatgcatcctgttggatcaggcccacggctatagtttgcttacctccaatatgataagatttagagagacaactcagcatacagacaattgccccctcttcagtggccatcaaccactctcatcccataag

SEQ ID NO: 38625 - DNA, 1244 bp, Bovine  19866880921428
agcaattaggtagcaggatagcggtagaatgagacagtttggatgaagctgaaaaaccagcaaacaatattgcgtgttgttcacagacgtacggagtaaaagtcatcatgttatgaggatgagaaacatcaaaaaacaaggcagtggttacttccggggcacttaagtttttatttcttaagatgagagcagggtacacagaaatgcatgatgtaattgtctgtattattcatgtgcccaaactatgtgacaaatacttaattttcttcttgattaaaaaaagcttgcacttccctgcagcacagcaggccacttttctttgcaggcttcagtgatttgggcctgcatggtacacagagcaggagctggggcctgcagtcctttttggtgtctggtgacaggtactaaaaaagacaaataaagcttctcctggtggcagttcaagtatcggaggctgggatttaatgagacctttgctgccccctactctgttacctctcatgttacattaaaaattgcaggcttcaggtaataagcgtttgtgttctgtggccacaaggaataatcaagtttaagggtgctgaaatggtgtgccttccaccaaatcttaccagtgggacacaagcccctctcaaatgtcacctgaagacctgcaagggtcaagggatgtccaggctacagacctcagacttctaaacctcctgagttgccaggtgttggtggggaatgggagatgggaatcgtacttgaactgctctgactgatggttaactatgtccttctttacactttataaaagaagactggagtagacattggctgtccaggagttttacaggcctgctgctgaggctgaagctgatggcaatcaactcagctaccgcactggtagagcctggatgggagtcaacagggtggaaagcagagccaaaaggaggcaggtcagatgtcaaatggcataacttgggcacctgaatccaggtgaatggctttaaccctggaaggtcattgatcaagccaacaaattttcttccctttaagtcagtttgaaacgaacttacaacttagcaataaaaagagtctacataggtcttagaaataggtttcagattgccttagactcactctgcttctcttctcaaccttgagtcatcctttgaatgctctatgaatccatcccctctctgaggctcactggttggatgacatcaactcaaggacattagtttgagcaggctccagga

SEQ ID NO: 38626 - DNA, 2503 bp, Bovine  19866880940368
accaaaaatatcttaaaaaaaatatcttagaaggtaaaaagaaagaatatccaaaaaaaaaaacacaaacaaacaaaacagtgtgtttccccagaagacagattcctcaaaggcagtagctcttctgttctataatcaacaatcctttaaaataaaatactgctagtctaaaccagtaggatgaatttaaaaagatctttcacttaactatgattcatttttatgattatcatctattttaaaagaatctacttcaaagatgacttttccccccagggcaggaaaactatgggtcacacagaagtcaaagaaaaacctagataaatcctaggagggagaaaacagtacagatgtgattattcccattaagcctaatgatataaaggaacgaacttcttcctttctccttcttaacctcaagtctgaaaactaaacctccagaagcactgttatctaaagacaaagaaataatgagactccctaaaaaaaaatataagaaatgaccataaagtataccaagtgagttttaataaaaatgaactaatacatacaaatggatgttgtcccattaaaaaagtcattaccttggaaaatatatacttaatccagtgatgctgttataggcacttaggaatttgtttcagagcttagaattttccacatccttaaaaatagcaaacatttgtcttttggggtttgatttagcagtaatcaagtaaccagagtagctgaactttctctggagaacctttcctgatctgccaaatccaggttctgtgcccctcctaggatgactgtccttcctccaacagagaacttttcactcaccgctggaattgtttacttacttaccattggtcaccttggcaaaactgtaaacttcacaggagcagggaacttacttattaatttactcgcaaccctaaaataaagcctagaaaattacaggcatctgtatgacacagaaatactgaatgatacaatctactatatacaagatgttttggaacactgtctgtatttaccctccccactctcgaactctaaaaaaagtaccacacctgtctgtatgattatatacctatagagagagacaattactttatataatacctgagaggaagagtgtttggattgaatgattttcattacttatttttgtaaaggaagaaaagtaaaaatcaatgactacatcctcacagactaaaaacatttaacttttcactctcaaatttgcaagcataacatcttacctagctgcaatatctttatagtgtctctgtaggttttcatcaccagcttaaaatggcggtacagtggataacacaaaactcttcttccaaaagacaccaggatttcatgaacgttggtccaagtctgtgaagtatcatttacatgaataatcatttccatattacacaaaacaaaagcaccacaacaaaatgtaaaactattctcaattaaaaaccaagtctgagtcaacatgaagccaagtggaagataaatacagtgccatacagtgagactctttctgtaaacttataataaaatttttatctcggcctttgtaattcctcatactttatcaacatatcacaagtgctccttaaaaatcacattcatagcaggaaagtttttaaagtcttttaagaattaccactatgaatgtgaaacacatggtactaacaaaatacagatgcgcataaaatgcatctctaaatgatacatgtttcatgtttttgtcctttaggaccattcgagataatacagatgaaaaatgcagaactctttattgcaacgtgttcagagttcccttctttcctctctctctttgtttttctgctttgggcatgagtaatacatggcatttacttcagtaatctactttcacttatcaaagcgaaaactacccatttctgtgaaaaggctttatcttgaatggtatcaaactgatgccatcagcaatgtaaaacttaatgaaaacacattttctacaaaattgttttttaattgggttttgatttaaaatgtataaaaatgttaacctgcaaataaaacttaacatataacattaaaggagtacaacatttccatgtatattcacctttaataaatgagtgatctgattaagaatactgagtactcaacaaagaatagttgatataatataaaaaacaatggtgaacttctaaaaaattctggcaaaaactaaatacttataaaagtttgacagagctggttatatgtatgacaatagcaagttatctaaaaaacaattaaaaatgtcaaaataaaatcataaatcgatgaactttttcatgcagattttaataactaaactatgaaatgatctagtcaccaactactttgttttcaatattggaataattactgtgagtatcacaaaagccgatttatccactatatgctgattgtggaaatacacagaacccaaggaggagtccagagaaaagcacttttccatcttaaatatgcatatgaa

SEQ ID NO: 38627 - DNA, 2048 bp, Bovine  19866880955445
tagtgcaagttgccctggcatcaagtgacaggcagcctagggcaccaccgctgcacgtaatttttgctcttatccagaaccccgtccactaagtgaacgtgaacctgactgcagcgctcaccaccagttttcattttacagcacaagctaactcgtattccaccaggaagaagaaagatttcagattccgaggctgtcagacatttccacttatgaatttagcgaggctcctaaatcatgactgagccacagcttgcaatctccctcccctcattcgcaggctttctaatatttcccctgctctttgggtatcttggagcaatcacactaataggaacaatttaatggagtcctgggcaggcaggggtttggaggattatagttcaacctttggcttcttatcatagagaaacacccttccttaacagatgccctgggttgcagactggctcttttctctcttcagcacatccagctgcacctgacgaatcaaaactctggctactgctcctcctttaatctcagttccagtcaaggatgggccaagggcagaataaatgccaatcaaaaatcaggagggaccatcaacatgcaaggagctttccagatagcactagtggtaaagaacccacttgccaatgcaggagacgtaagagacacaggtttgatccgtgggttgggaagatcccctggagaaggaaatggcaacccactccagtgttcttgcctggagaatcccttggacagaggagcctggcggtcaacagtccataaggtcacaaagagtcagacacgactgaaatgacttagcatggtttcaaagaccctggtcttgatggttctattttatgccagttacttgccatggattctataaaagtacacatcttctgttgaattctttttttttttttttttacagtaagcttctgtaaatttagaataaaatccttaatgcagagtggtagctttccagctgtgctgcctttgaacctttgtgtttttgacctgcgccagagtgacctgttcctaaaaggtagcctgttcccagttacccagaaaaatttagttactagatgtaataattatctgaattttaattttgacttgtgtgtaccagaatctagtacacgtattaaatatacacaaaaatagtatctagtgtaaaagtattgatatatacttattttccttcaatgattgtatcttaatccacgttctacagagacctcaggcctcttacctgaatagctttgagagcctaaatgcgactatgttctggcctctaagtgggcagagacctcaggttcctctcctccccttggagctggaatcagcagcatgggatggcatcagtgttgtttagcatttgtctgggaaggtagtactccacatgtctttttagttattttgctagtcctaaaatggattcttgtatgagggagatacctgggagtatctttagttttataatttcagttgaggatgttaaggcacaaataacttaaaggcaccctttgatacagagcctctgacccctttgctgagtttttttttttaatttattttaattggaggacaattactttacaatagtgtgatggtttgtgccatacatcagtatgaatcagctataggtatgcctttgctgagtttcttaaaccacgctgcctgttcactgtggttcttgttgggattggtactgagctttcttacctagtgctgggtgaagcccttaaacagcagggagaagcaggtctgcattttcatgtagagttaatagaaatgcctgcataaaatgttactgtcacagagaccctgaaggtgggcaacaagaaagttatgtggtgaaataactagggggacatctagaggccaaaccgcctatggcagtggatgacccaggatgcagagcagcgctgctgtctacccgggtgtggctcttcagaaggcttctgagaactccgctggggtgcaggcggctgcgtggacagtctcagaagactatcagaggaccgacttcctctcaaacagattgtcaacggtgg

SEQ ID NO: 38628 - DNA, 3044 bp, Bovine  19866880998649
tccttgtaatacttatttccttttttctgtttgtatctttgatctgtttggggggttcatcctctgtgccatgtgaagtatagatccagctttattttgtcatctctttaagctgtggaccctgttatccccagactagttaatgaatagtcctaataattgttcttaaaatggttttcaaggtccaaaaagttggcagctcttgcagaagccttaaagaaagcatccctaaccaaggcccagctggggttagaactggaggagctggaggcagcagcatttctggtccaggaggaagaagccacatcaaaagcaggagtccattccacttccaggcagcagacaccttcctccagctctgagacgagtggttcagaagaatcagagggcagtgcatcacttgagactgaggagtcagactcggaacaggaggagcctggaggcggtgaatctgagacagggcattccttgctcggtccctttgttgaagaaagcagcatggccctgcttcttaacgatggtggtatgtgtagaagcaccactttcctggggtctgatggtggtcgaggacagccgctggcctcccctggggctcccatagcatttgggcctctgatccaggagcttggagaacaactggagacttcggttcagatttccgagcccaaagactctgctgctggacagcaggacagtgtgctggagagagaaagccggcagacacctgaggattgactcctgagtggtctcatttgttattgagaattatgtcagatttggttttattgactgaattaaaattcttcattttcactttgtacttttccttggtatatacaacattgtttgtgagctaacattgacaccagttggttttcttgtacctttaagaacaaagttctaaagcaaactgtaattaatatcaggcttatttcatgcagtgttgttattttgagattcatcaatgtagcatgtattgagggtttgttgtttttttttccgtatctgagtagtatttcattgaatggacatttgggttgtttccagcttttggctgttccaaataaagctgttatgaacatttgtgtgcaagtctttgtgtggacatatgcttttatttctcttaggtaaatatctgggagtggaatgatggagccgtatggtaggtgtatgtttaacagtgtaagaaactgccaaactgttttccaaagtgactgtaccattttgcacgcccaccagcagcctgtgagagccctgcttctttctcattcttgtcatcacttggtatcatcacttggtgtggtcaatttttaacattttaataagtgtgaagtggtatctcattgtgattttattttgcattttaagactacttgtgttaagcatcttttcacatgtgtgtttgtcattcacatatctttggtgaagtgtctgtttaaatctcttgccggttatttttgacctgggttgcttttcttatttctgagtttgcagaattctttataaattctaaatacaaatccttaaatgagtcatccttgcctgcctgataatctttgattggataaacattgtgagttttacctcattgggtgctggatatatgtattctcctaagtattctttagctttgttttgggatgcagttgtttggaaatagttttgatcctttgggtcttgcttttttaatttgttatataggtctgaaacagtgctccatctaggacaatttcccagccctaaggaaagatttttcccatgccccagggattatgtgttttgcagtccggctgatgaaaatagacacctgtgtgaatactggtccctctaatcctttcacatggctctttcccagcctcattgacaggctctcctcagtgagtagttgaccctctcctggtatctggtgttctccacagctctcacctttcccatactctgtcttgtagactcgggccaagtccccagctctgtctcctgaactgcagagtccactgagttctctctgggttgcccctcgctgtgcagcctggacaatcatctgggacagtaggtgaggccctcttaccctcctagggtttggttttccattcctcaggatcactgtccttcattgcctcatgtccagtaccttaaaaacccattgcttcatgtactagttctggttttcttttttggttatatcagaaggggggaggttaaacctagtccctgttactccatcttgattagaaacataaacttccattaatattttatatgtgaattttctcacttgagtgtaagctccttgggaatgatgtctgtgtcgtgtcttgttaccactgaatcatcagcccatattctcagtgcaccataaatatttgttgagtgaatgaacaaatgaaataaaccaatttactttggggaggaaatgaaatgaaatctgatatgtattaatctcagtagcatttttatttcaggaaagtgtatgatcccttttattctacttctctgtgggttgcgagtatttgtatttccactgtaaattccagcttgtattaacaggatagttggggtgactgtgccatttgacacgcacgttaactcctgaacactgtaacagctttgttagaatgtgttcaagacttttctcaggctcccggagagcttcaaaatccctatgaccattgaaaatgcatttctcctcagtagcacatgacctgaggccagtttgaaaatgcattatctgttattcctctcatttactactactaatgtcaagttgaacaaatctactcttgtctaaaaatttaaagctgtggaaatttctctttccatcaacttctgtccttacttaggaatctaaagaggatctactttggtgagactcaccttgggtggaaaaatctgtgactcccttactcagaggatgggcaaatgtgatccttcctggacatcctcaaagcattcttatcaccatacaagtctcatgcattggaaagacaaagagaatgagcactttaattttagattccatgtctgcagcgtttctcttaccctgt

SEQ ID NO: 38629 - DNA, 1014 bp, Bovine  19866881036240
tccctttatagcggtgatctttcttcctgctttatattacaaccagagtggttccttttccaaattgcctggcagccaggggtgttttatgcatacttgggtttctagaaacaagccgtggtcccacagcctggatttctccatctccaccggcctgttacactcatcctcagacaggcactcccttgtccttaaaatgagaagcgccttctgtgatggttgattctacgttttcctgagagtcttagttgatgaggacaagaccagattaaatgctgtattagatggcatctccctttatatttttaactctcttcgcaaagggagtctgtgtcactgttcgccatgacgtgccctgtaaagagaagggcatgtcagaagtcaggcctggattaggatgggggatattaaattgtttgtattcactggccttaaaaaagaatccctattcctgtaaaggaagcttggccagaatgggatggtttcactagctttctgcttctcacctgcttgttatttccagccaggaaatctttctggggtaggcacgttcgcatttctactttcactgttccaaaagtagctccagttttgtctcgtctaacctcatttcttgctacttgcaggcatgctaagcatgaactatgccaaatcttttagtttcttgaataatcctcgtctccactcacctcttggatctgctcacgaagctcgtgtttcctgaaatgtccctctgcctggaactctgcccaccacccgctgttcacctggacctctcccttcagtctgagttgacacacaacccctgggaccctctctcaaaagggaaaatgaggttggagccattctcttgcacacatgctcagataagactctaattctcccaccagagcactcatcacaactgactgttagcctgatgacttgttagattgaccccctactctctgttgaggttgggacaagccaccatgtttgcatctgtatcttctgtgtctagcaaaatccctgcac

SEQ ID NO: 38630 - DNA, 1265 bp, Bovine  19866881085872
tcttcacattgatgttattaaaatgcaataggttgaaaacaaagacaatgaactgaggtggaaaagcaaaggcaaacctcaaaaaccaaattatgtccaagatgaaacaaatatatctaatactgaagaagtgaaagtactgcagattgatgaataattaaacacctcaaaagcaaaccaatgaggggggaagagggtactttaaaaaaaaaaaacccagagatttaaaggcataaatcatgatttataacccatgccaactctgacctcatagaaagcaagaaagatcaaaggtgatgcttcatcgtgtatttattgcttggccaaaccattattcatccatcttcattttgaaagatatatatatggagtacaaattctaatagaaccatcacagggaaatttttatgtgcagaatttatcatgaaatctgcagctaatagcacaatatgcctaatttgtaatttgcctgtctcttctcagatttatagcatcacagctttacagccaaaagatgcaagctgcaatgtgttgggagacggtagctgacagttcaaataaagtcactataattccgcagagaccttattctttaattctctaatgaagataccaggaaatgaccaccactgctgccaccatgcacacccacacacgtgcatgaaaactccatttggaaagatcgctgcattgctgacttcaaaaacaaagtcagatgtcagttttgagtgagattgcttttttaattaaaaatgcatcaataaaattatattaatagaattctcttttctattcatcttggttggagaaacataagatggcatgagagacgtgtctctaatcccagaatacaggtatctagtaacaaaacactgaaacctacgctgacccaaagtgtaattctgaaacactcagaagagctctagctaccttaagtgatgtcaaatctatttaaatccctttcagcaattttatgaggcgacctagcaaggtgacaggcctgtttatttgaggagaagaaaaagtccagaatttctggactggcaccaaagctgcccagcatggtgccaatcaatgtggcgcagcacttgtgttagcagaacacctccccccattgccttacagcagccacgggccctgggctgctcatcttcaggcacgagcatcctcacctattcacccagaagggaaaatgggggtgcagtaaagttttcctatatggtgtccatcagagacatactatgatggttaatttcatggatcac

SEQ ID NO: 38631 - DNA, 2077 bp, Bovine  19866881099853
tagcttagaatagtttgcaacaattgctttcaataagtaacagaattacagtggaatcaaggaataacgggtttcctctaacttaggaaagacgtgtcatgacaagtcagaaaattgtgaaagtaaagctctatatagcatgtcctggaatagggttctaatgctatttttgtttgtttgttttagctgctaagttgtatctgactctttgcaaccccatggattgtagcccaccaggctcctctgtctataggatttcccaggcaaggatactggagtgggttgccatttccttctccaggggatcttcctgacccagggtttctaacccacatctccttcactggcaggcagatccttaaccaatgagccaccagggcagggcaaaattagaaggagtgtgtgtgtgtgtgtgcacgtgtgcgtggatgaagagaggaacaggtagaagataggagatgagtaaggtgaatggagaattctgctaccatttttctcccaggaaacaagtgatatggccaaatgggatgagctagagtttggccctcaggtcaggatttgaatatggcctctgtaagtgattttaggcaagtttcttaacctctctgaatctgcttcatcacctacaaaatggatataggaatgctttcctctgagttgtaattaaagcaaaaggacctgaaaccactttgcaaaatatcgggtacagaggtgactctttattgaatggcatcaggggctgtgccaacagtatccaggttacaaccacaaacaggtttcccagagtttacaaactaacaatgataatgaactttaccaagttgtttcaggagaactccccagtatgactgttaaaaatgcaggtgataggacttccctggctgtccagtgaagactccatgcttccactgaagggggcaagggtttgatccctggttggggaattaagataccacatgctacaaggccaaaaagtaaataaatactaccaagatataaaaaaaaacattcaggtgatgatgagttccatccaggcctcctgaatcagatgatcagtgggtaggctgggaacccatttttgagaagtcccccaggtaattctaatgaaccactgacttacactctaattcctacattaacttcaggtttagcaaagcttccacctcccttcaaaggctccctggcccgtgagtctgaccccgactgtgcccacatttgtgggaggcatcacccacttcacagtctgaacccactccatggtaatagaggcaagagagttactccttgttttgcttgttttgtgggcagtgctcatatatcatcatcagaaacttcaaaagacttggctgagcatggaattgacacgttataacttgagttatgcaggcttcagtgtctaaactctgtcaacctggagaaggccctgcttttcagatcagtatctaaaaatagcgaaaatctagtcagatgttgctactgtctgcatgtgactttgggatcatttttcctactctctcacctccttaaaatcatgtgctatgcttttatttgcctaaagaataattcatatatccaccatagaaaatggaggaaatatagcattgacacagtaaccagagtaaaaagatactggggatccaggttgtcccctccccagataacccaccatgaatatctttggtatgtttccttctcgctttttttcggtgtacatgaatacaggtttttgtttttttccttgccacaaaaatcaaaatactgtgtgtgctgcttttgactggctcttttcatttcagaacatgttttaaggtaaaacattaatggttttttttataccatgaaataatctacaacagtggtttcacactggttctagctttcatgctggtcccaacaaaaccccccaagggtcttacaaagtacctaatgattacctgaggtggaggatggggggctggtggggaggccccaacaccttgttttagtcacagaagtgccacttggtaactggaggagccatgtagggattccatcacaagaagattggaagcaaaaagaaaaaaaagcaaaaccaaaa

SEQ ID NO: 38632 - DNA, 1621 bp, Bovine  19866881103583
tgattttggagcccaaaaaataaagtctgccgctgtttgcactgtttccccatctatttcccatgaagtgatgggaccagatgccatgatcttcgttttctgaatgttgagctttaagccaactttttcactctcctctttcactttcatcaagagcctttttagttcctcttcactttctgccataaggatggtgtcatctgcatatctgaggttattgatatttctcccggcaatcttgattccagcttatgtttcttccagtccaacgtttctcatgatgtactctgcatttaagttaaataagcagggtgacaatatacagccttgacatactccttttcatattactaggtaagcacagtaaaacagaaccacacctgagtgcaggccatccaggaaaagtcggccctggcgctgtggttgtcaccctggaacatgtcactattccgattccatgaccctgccaccagacactctgattcaataggcttcactaagtcctagaaacctgactgttataacaaactccccagaagattctgatgcagatggtccccaaacacatcataataaacatcctaataaacataataaacacacatcataataaacactgtaatggtttaaccatcacaccgtgaactcaaaacaaaatgatgctgatataagaagcacttctccccatcagctggaggaggagacagagggattatgggatgaagctggacgggaagtcaacgttgtccactccccagtacgcctctcacacacacttacacaccccttgtctacgtgtgcaagttgtacagcagcgtgctgcagggcatgtgggattcccaggagtgatagtggctgtggtgactgtttataaggcggctggttgtgaacagacctgttcctaatgaggacagaaggggtgtctgaaccacagctggtgtagttaattggtgggaaagttttgggctctctggttcaccgtttagggagctctgtttagtctaacacagatgacaacactgtatgtattgcagattcagcccgaaggtgtgtaatcaaatctattacacattaactcttactggcccaggtaagacaggttcttatagatactgattaaatgattcccactacaatttggcaaggttttggaaagcctctgagcccctggaattcatgttgttttagaagcctccaaggggttctggtgatcatcaggtttgagaaccacaataactctatcctctagatgagaaaaatgaagcgacatgcaacagaccccagccctgattccctagggttttaattcttacaaccctcctccccgcaagggaatcctaagagaatacttaaaatgcagccttttatacaatccaatgtctctggccttaccccagagcatggttccaaactgaagaatctgccctcgagaaaaaagctgatgtttgtacccactctacatctgtttggggttatacatggtgtttagtatgaaaaatgaagcaataaaatgtacacaggtattatcacattctctttctaaattttactccaaaaaaaaatacaaacatagattttaaaacaaaaaccaatgtttcataccctaccatttgtgctaaaa

SEQ ID NO: 38633 - DNA, 1541 bp, Bovine  19866881401337
ctatgactgtacacacaaggactgacttgaatgcactcttccaaattcctgaatgctgggtgcccctaaccttcacttacaacacacccaccttttcctgggtggtttgagttccagtttggcctaagtagttcattaaaaatacacagaaatatttaaattctgaacttcaaacaaagaaaccagagataataaataacaataacagcaaaccgggaaatcagtagagaaaccaaaagtctgagctccctcaggcctttcacattagagctataaatcatatcacccaaagggaaacttggggagatttgcacacagtcaggtccaaccaaggagaagcaccacaaataactacagacgcggtacacataatacttggatgcttgccaccacaattaacatttataataaagtcaagcattcatgtgactttagctacacaacatagcagctttgctatccagttcataacattttggttaattatacttctgtaaacaatctacagggtttcccaggtgactcagtggtaaagaatctgcctgccaatgcaggagattcaggagcgtctcacaggttcaaaccctggatcaggcagaacccctggaggaggaaattgcaacccgctcaagtattcttgcctgggaaatcctgtggacagaggaacctgctgggctacagttcagggggtcacaaagaatcagataagactcagcaactgaacacataacaacaaataatctacagtcaaacaaaagcctatttcgggctctatttggggaagaaactggtgccttaacatggaagcaaatggcccaagatcacctcccgagatgagaaactccaccaaaacatttgaagaccgccaagtggctcccaccaaagtggaaagtgactttgttacttcacttcaaacatcatctgtttttattatttttaaatctttgctgcctaattcccttcccaaacatccttgtcctctgtgggtcaacaaatcatacatgatctggctcctctcagagaaatgcaaacctattccattgtacactttctggaaacagatcaggggaatcagaagaaaaggtactgcactcaaacccttggccccagtggccagccccacagtgttgcagctttcagggctgatgctgacagtttaactccgcaaacactggtgccaaacaggatgtccctgctaggaagttcaccgactacgagtgttacgtggtgtcataacaagcgatcatgtgccaagattcttgagctgagattaaccgctgagacacaacatgggaaatgtggtaagttcatcctcatgaaaccagagctcagtgggagcactgcatttaacacttccatttacaagcctttggggagggaagatccagatcattacagaattgaagacggcaaggaaagtctcccgcgttgtaactcagagcgacgtgacgaatatgacaaaagtcataaccgaggcaatgacaggggacaaagtttatcacctaaggcttatctggaaatcaagacaatccagcttaatg

SEQ ID NO: 38634 - DNA, 947 bp, Bovine  19866881421140
tattcattggatgcaatgtttctattactattttgaataaactgtttaaccaattatggataagaaaaataaaagtttttaatttacctcacttgttccttttctgttgttgttgtcctcgtacagacccaagattctgacataacataatatgttttctctctgaagaacttctttttaacatttcttgcaagttaggtcatatagcaaaaaattcccttaattttcatctgagaaagtctttctttttcacttttgaaggctaattttacaagacctagaattcaaggttggtattttttcttttttctctcaataccttaaacattaccactccactgtcttcctgcttacctggtttctaagatatcagatgtaattctaacatttgctcctctataaataaggtgtttttttttttttttttttttcttctggctttcttcaagattttttctttattttttattttctgcagtttgaatatacctgcctaagtgtaggattttctggcatttatctgagcttcctagatcattgatctgttatccaatgtaaatttaaggaagtttcaatcattattgcttcaaatatttcttttgtttctttcttctacttctgatatttccattatatgaatgttacacctttgggaattgttccaccattcttggaatttccaggtagctcagtgataaaaaatccaccaatgcagaagatgcacaattcttggatattctgttcattttttaagcacctttccctctttgatttagttttgaaagtttccattgacataatctgaagttcacggattttttcctgagcagtgtccagttcattagtgaacccatcaaagtcagtcttcatttctgttaaaatgtttctggtctttagtgtttcttttagattctttcttagaactctctgctctctgcttcattact

SEQ ID NO: 38635 - DNA, 956 bp, Bovine  19866881500163
gggccacacaggctaactggggaagatggtaaaattgtaaaagtgaagccacagaaaggtacccaagtctctgtccttgattgcagggctaatgctctgcctgatgcagaaggaaaagggagcacatgaaggggcctggtcactgtggacagcgctctgtgcagcccttggccctgcccctccttggctccacggagaaggagataatccttcatccatctttttacccagcctcctgtggtccctattggcagcagctgcctgacaccacctctgaaagatgcttaagactctgccaacccagtgtttaatgcatgcaaagccctttccaaagaagtcacttaaaaagattacagaggacaggatcacccctcccgcctccagcttagggagtctttgcagctggcctggagctaagctaaggaagcagagtctttagcagcctgaaaataaagtgagccttcatttgagaaatcactcagaataccagctgcaagggctccattcattgatttgttcagtaactatttgctgcacacaaaacaagtgcaggcactgctctgggcactgggacagcctggggacacaggccctgccctgctgcggctgacattccaagagaaagtccccactgttaggagccctaccttcccatgtgcttcccttgtcgtgggggttctttctcctgctctcctctgagaaaagctcagatgctgagaagaaaagcgcttctcacctgtagcactttggggaagcagtaagattcatgcgtgccctggggaaggagccagtctgatttctttttcttttcaatgtctggtctctctttggggcttcccaggtggtactagtggtaaagaacccacctgccaatgcaggatagtaagagatgtgggtttgattccctgggtccggaagattccctggagaagggcacaataacccactccagtatt

SEQ ID NO: 38636 - DNA, 1319 bp, Bovine  19866881940854
aactgaggttccccccaagaaaactgaggtgtctttagcagaaacacctggaaatggatgctagtaagaaacaccaaaaccaaaagcagagaaccactggaatcaataagcccattttacagatggaaaacctgagggttagagatggtgaaagtgttggcccaagagatggaacagccaagtcacagacctagaatttgaagccaggtctatgtgaaactagatctatattgcttaaaaaaaaaaaaaactttatcaagggagggtatttattggttcacataccttaaaagtccagtggatatactagcttcagacatgatttgatctttacttacaaccacactgtatttgagaacacttacaaccacactgtatttgaactgttttcttgctttccagaatccctttgaagaagatacctttaatgaaatctctctctttttttaactttgaaaattgtttatatttataagggaaaaaacagattataaaagttatctcatttttaatgctttctatatatttatgtatgtataaacacatacccacatatattggttatatctctggaaggtggtatctgcctgtgtgctcagtcatgtccaactcttcgcaaccccatggactgtagcctgccaggcgcctatgtccatggaattttctaggcaagaatactagggtgggtcaccatttcctcttccaggggatcttcctgacccagggattggacccgtgtctcttgcgtgtcctgcattggcaggcggattctttattactgcaccacccagaaagtggtataccagaatgttaacagaggttatcaaattgggtacccctttttttgcttgtctatattttgcatttttctatgctaaatatatggattacttgcatattgataaaacaatttaaagtatattagttatcataaaaataaaaaatcccttattggcctgaggcataagaagatggaaattagttggggaaactacttttcctccctttaggttggtaggtccttcatgctctgttttggggaatgaaatagaggtgcccattcatggaatatataatccacactcttccccctcatatgtcaccagacatttatttcaaaccagcgctctggttcatattttaaaaatctcaatagcatcttaatttgaaaagaaaagggagatggagaaatagaattccctgtgtgtcaggaacaatcataagggggaaaactgaagcgagaattagtccaggcagcatcctaaaattttggaagaagaattatgaactcaattgtgtacagcctcagctaaggacga

SEQ ID NO: 38637 - DNA, 2172 bp, Bovine  19866880346120
catatctggacaaaactttaattcaaaaagatacatgcacccctatgttcatagcagcactgttcacaacagccaagacatggaaacaacctaaatgtccatcaacagatgaataaacaaaaaggatgtggtacatatacacgatggaacgctactcagccataaaaaataatgaaataatgccatttgcagcaacacagatggacctagagattatcattctaagtgaggtaagtcagacagagaaagacaaataccaaatgatatcacttacatgtggaatctaaaatatggcacaataaacatctacaaaacggaaacagactcagatacttaaaaacagactttgccaagagggttgtggaggggaagggatggagggggaatttggggttagcagatgcaggctattacatagagagcttataaacagagcttactatacagcataaggatctatactcaatatcctgtgataaaccataacagaaaagaatataaaaacaaatgtgtgtatatacatatatatatatatttcagctatacatacattcatatatctgaatcacttttctgtgcagcagaaattaacataacatcgtaaatcaactgtacttcagttaaaaaaaaagatctttccttcaccatgttgtttcatgtaggtgaaatgtattctttacactgtgtggcatctcatattggggcttccctggtggctcagcagttcagaatccacctgccaatgcaaatccctggatcaggaagatcccctggagaaagaaatggcaacccactccagtattcttgcccaggaaatcccatgggcaaagcagcctggcgggctacagtccatggggtcacaaaagagtcagacatgacttaagtgactgaacaacaacatgtcatattatgaatatgccaccacgtttttatccattcttctggatatttcattattcccagttttggaacactgggaataaaattggtgtgtgtgtgttagttgctcagtcgtgtccaactctttgcaaccccatagacagcagcccaccaggctcccccgtccatgggattcttcaggcaagaacactggagtgggttaccatttccttctccaaaaggaactatagaaagaaagaaagtgaagtcgctcagtcgtgtccgactctctgcgaccccatggactgcagcctaccagtcccctccatccatgggattttccaggcaagagtactggagtggggtgccattgccttctccattaatcagctatactccaatataaaaacattttttaaagatacactgtatattaatgcatatatgtggaatctagaaaaatgatgtagatgattttatctgcataagatagagacaagacatagagaacaaacataaggacaccaggtgggggcatgaactgggagattggggttgtgattggggtactatctataaaataggtaactaaagagaacctaccatatagcacaggaaagtttactcagggctctgtggtgccctaaattggaaggaaatctataaaagaggggatttatctgtacatatggctgattcactttgctgtacagcagaaactaacacaacattgtaaagtaactaaattccaataaaaattaatttaaaaaaaatttttaaaggtatcctggaagagaagagaaaacctagggagatggacgcaaggataaatacacattcctaaaattccatcaccatttgcatcattcacatatatacaccccaaccctcaactctagagaagtactttctatgaaaacataatattactatgatttcaagacttgttttttcaaattagcaaagctcacatttctttagctagtttacaaaagaatggcattggttagtgaaaaaacagacttgactaatgagtgaactctgggaataggctcctgtgtatctgagaagctttaactcacagaaataagttggaacaatgcctctggctgggaaaagaacaaagatggaacaagcagttgcctagggtagtgaattaccaagggcagcagacgttcaagtggcttccgtgggagcaaaggcagcctttgaatttggatgtaacccactttgcttggggtaggagagggtgggatagggtattcacgggaagttaagcaaccattccacggg

SEQ ID NO: 38638 - DNA, 1097 bp, Bovine  19866880417861
atggtgggggaggttgtgtgcagaaatgatttctggtgccaggtgactcatttttaagcaacttcccccattttggcagatggtgctaatgccagcgcttaacgatagagctgagcaaatcaggacggcatgtttccacacttctcagatgcttatttctaaacagtatgttaaaaccacatctctggctacctctctctgcagtgagtcatggagcccaagtgaggctgctgcctctggagtccatgctggcaacggaatcctacagtgaaccacacgtaaaagatccagacactcatttttcagatgctgaaaacctcaggccatagagaacatttactacagacattttctgtcttggccatttctcacatgaatactgccctattgaaaggacctttaccctcatcaaattctcatgtatttcagacaaataacatcatgtaaccatagaacctatgggatagaaggaatttatggtcattaagatcagggcagaaataactctttgctgaatattttgtggtccctgttccatgctgcagcattgatgctgaaacatgtctgcccaggtacccaacatatttcctaaggccccttcacagacatgtgactagtgttggccaaaagaaagtgagcagaagtaacatgtgtcatttctggccaaaacagttaagaataggctatgttatttcttctcctctcccctttgtcctggatacagaggtgcttaagcctttaagggatggcaaagccatgcgataagacatgcctgggtcactcagagcctgtcatactgagtgaagtaaggctcagacagagaagaagtatcacatatgtggaatctaaaaagaaatgatacaaatgaacttacttacaaaacagaaagagactcccagacacataaaatgaacttatgggtttttgggggaagggatagtaagggagtttggggatggtcatgtatacactgctatatttaaaatggataaccaagaaggacctattgtgtagcatatggaactctgctcagtgttatgttgcagtctggataggaggaagggggtctggaggaaaatggatacatatacatgtat

SEQ ID NO: 38639 - DNA, 1433 bp, Bovine  19866880434699
ttgctgctgtcagaactaatacacaactcaagaatgagtatgttaaataccatatgatgaaacttacatgcgaaataaagtatgacacaagtggatctgtgaaacaaacaaaatcacacagagaacagtcttgtagctgccaaggggagggaagtattgggattagcagatacaaaccattatgtataaatatatatgttttcacagagtggataaacaaggtcctcctgaatagcacagggaactatttcagtatgctgtgataaaccatgatggagaagaatatatgtgtaactgagtcacttttctgaatagcagaaatcaacacaacaatgtacatcaactatactccaataaaaatttttttaaatgaatgaatgtcataatgtctgtacacatcttgggcaaaagatcagtgatgcaggaactagacccaaagaggaagagcagacatagctaagtcctctgaaaacagctcagtgtgtgatcataaatgaaacatttacctctttggggtctcccagaaatatgtgaggggataggacaagaagagttcattgccagcaatcacatgagtggaaccattatattgttatcatttttgtatcataggacgtaatcttttttggtgatgtcacaggcctgtacattgggattgtacttgcgttgtgcaaaagaaaaagaaaaaaaaaaaagctgacatcagcacccaggtccaaaaatgatcatcacagtcatccccttgcaaagctctgcttccatgtatctcaagggccttgagatcttggtgcagctatacagctctaaacaaataaaatgcttacatttctggcaagttagaggaatctgtcccagagcatgactcgctccaccaaatgggaatccacttccaacctaggccttgaggaagggctttgacacttatgtcacaagtcaagctcatatttactcacgtggtaaccagccaacatatccctggaaccaatccaaataagcagttgtatgaaaaatacgcaaagaaagagtgatagcctgtggaaatcgcatcctcatgtatgacaaaggccgtacactcttaaatattcacaattattcagacacccctccagaggtgtaaactagcaatcatgtagtttgggtatgaggaaacctttcatctgtatttacaactaccagcttatttcataattttaagcagaaaataatcaaagcaacatgattgcatattcccaaccaaacttgtgtgatttagcaaaaatatgaagcgcgacctcttcatctctctccattagaactgataaaagcctcagaacaaatccagtggtccacatttggttccagtccattagtctgcctaccttcaagataaagcaaactaaattttttattgtgtagtgctaagggaaatactcccccgactagagaacccacac

SEQ ID NO: 38640 - DNA, 2150 bp, Bovine  19866880635427
gaaaaggaaggaacttaggaaactaacttgacttttgtgtacttttccagactctgcagaatgtccattcctacatggaggtagaagggattcttggttgcctagagagaacatgagagaaggtgatccagggggcctgggagacacgccacccatacacactgtgctgcctgcggggctttcccgaggaggcacggccactttatcctgcagggtctcgaacgttaaaaggactaaggtatacggtgaattctggtcaaagtgcacctccaacctgcttaacttgaatgtcgggctggggatggcaagaaggcctgcttccagggcagatcaaccccctgcctttggctttcctgatcccccatcatgacagtcctgcgtctaaggacaaatccagtttctgtgttgtctgagaactcttcagaaacctcaaccgcgagcacagaaaacaggactttgcctccattccacacacagcgctgggaagaactgcctggggacaagatttctgaagcatctgcaggagcctccacactctctgtcctctaatcacccccaggacgcagacccggggctgctgcctcttctgtcacagactcatagatggttttgtgagggaaagaaaaattctctgggaggactagactttcctcccaaaacaagtttaaaagttggggataatctacaatccattcccagtgccaagcccgcaggagcagcagaagcaaacaaccacaaagtcactgtctctggattaggagagtgcagggagaggcctcagagggcaaggcggtaaagccgaagatttctttggcttctaagaaaataggcaatgtgaagaagaagctgcaagaggaaagaaacagtgacagaagccaagagcctaaacccaagggcaacagacctcagcttaaggggaggccacggacggtgcccgagagtcacccttggagcgtgagtggcctgactcggccctgagtccagggaggcagagtcacaagctggctcctcctctgacaggttacaactcacaaggtctctctacccccgtgaggtcaattaccagctgcacaggatttctgcctcttttagaagcaaatggcaaggattcggtgtttttaaaaaaaaaaaattattgaataaatctaaactacaacactgggaattcttcagtggtccagtggttaagaatcctccttccaatgcaggggacatgggtctgatcctgggtcagggaactaagatcccacatgccatggggtaagtaagtccatgtgccacaagcactgagcctgttcgctctggagtcgaagcccacgcaccacaaggaagacccagtgcagtcaaaatgaaaaaataaaaataaactacagcactaatcctgctagcagagctcgtaagatctccttgcaagggcctgctcactacacacgtcattatacggctgctgaacacacggagggccagcttctcagaaagtgagcagctctggtgctatatttgcgaatggctgacaactctcggtgtgtatacatgcatggcgtgcacagaggtataaatatctgccttaaactgtgggggagaagattcttcacagttaaagtgacatttcctctggcattcgtaatttcacaaaagaaaaagactgttttttttttaaaggattaaacaaaaaataggtattcagatgaatcccaggtgattccctttccagctaaggaacagacttcgttcgtctgaataatttacacagcccagggttccccagggagagttctttggtccaatatatttggaaaacagtgagtaccaaatgtgcctcttgattgttttaagggtgggagaaacaagtcctggagtgaagataggagccagctttgcagaatgtgggtcacatgcgtacgtgaccgcagacgccttccctgtcctgtggaaccacagctgacgctgcgcgctcaccaggctctgggcgggcagtcaccccaacggtcactgtgaagtaacttggttctccacctgtcggcaagcactccctgtgaaccaactgctccaggccttcccagcagtaccctggtagaggagatacgtggactccaccagctcgggcctcagcggatagaagagcacgtcgggggcctgcagctgccagg

SEQ ID NO: 38641 - DNA, 1179 bp, Bovine  19866880678690
cgtctgcctacaatgcgggagtctggggtttgatccctgggtcaggaagatcccctggagaaggaaatggcaacccactccagtactcttgcccggaaaatttcatggactgagaagcctggtgggctatagtccatggggtcgcaaagagttggacacgactgagcgacttcacttcactatagaaccatgtacctcttatctatagtacttagaatactagcaaatccacatttgttgctgtaatacatttacaatgtcaaacacactctgcatttattcccggtgactgccatagtatttatactcagcaaatatttgctggataaataaagcacactgctccatgatcaatatagttgtgggtaattctgcagcagaatacttccataaaatttcccttctcaatttgatcattctaagtccagattgtctaaaaagaaagaccttgttaaggaatccctcatctgtatttttctgccacttacaatgcaaagcttaggaagcgatgctccattgcaaaccatcttcagatgccatgtcctgactttcagaggcactttgctctactaacatgtggagcagattcttaaatcttttgttctcactctgagaaaggatctcattaatgaaatctgtagccctgaattatgcacaagcatttgatttcaatgcatacagcatactggctctcaggtttaaaacacctccactccagtagtaatgttttttgctcttttcaaaaggagaaagctttgtctctaacattgagtccaagcactgactcaactgaagcctctctttgtgaccctgcaaattatcttttaaaaaagataacttagagcgcccccacctggcacccatctccttgtcaaacaaaagccaaactactgagctcagaattcaaagccctaggattaggcaccaatctgctttgacatcctcccttccttggtgttaccctggtggctcagatggcaaagaatctacctgcaacgtagacccggttcgatccctgggttgaaaagagcccctggagaaggaaacggcatagacagaggagcctgatgggctacagtccatagggttgcaaagagttggacacagctgagcaactatttgagcttcccaggtgacactagtggtaaagaacccaccagtcaagcaacagatttagag

SEQ ID NO: 38642 - DNA, 1004 bp, Bovine  19866880692547
atgaatcttgataagagattttgggtgggtgaagtcaagagggggtcagagagaccaaaatgcaaggggtgttctggaactagtgggtgacttactttaagaggcacccaagtggctggagggtggcctctcagatgggaaactgaggcaagggtgtagcataggccagagtaaggagttggtagaaatctagagatgcattctcttagaagcctgaaggacaacaattcatgcttttccgtggctgtctgatgtaactgcattctcctatccttccagggaactattggattgtaatcagtgacaaacaaggaaactagctctcttaggctgaggatccagtaaatgaatggcttttggctgtaagtcaatgaataatgttaatatatgcagtcaccaagtcaccattaacaaagcactgccgagtttcaatcttctcatcagaattcctgaaaatcttatttttaaggcagttcaaacagaggcgaggcagcctagcctgccaggaacacagagtcctgcctctgagggcgcccctgacttggtgcgtgaccttcggcaaagcgcttctctctatctcagctgccttggtaataaaatggggataacagaccttcgccacctcacaggagtgggacggagcgcaataaacgtccgccaaaagctttcaagataagtgctcctggaaaatgagttgggaagagttctctttcaagagttcaagaggggaaaaaaaaagattttaaaagtcaaaataggtcactgtttacggcttctaagagtcaaaagcttttcaacacagaaagggtcgttgatggaagaaacagaggctgcagatggctaagggtgcccctaaaccagcaggagggttctgtgacagtgttctctcacttaatatgagggcagaaattgtttgggtttagggtaggacaggatactaaaaagcagacagcactgccctgcacgagagggctgcacgtggcccgcagtatctactttcacag

SEQ ID NO: 38643 - DNA, 792 bp, Bovine  19866880731907
ccccatcccacccctccgggttgatgcagagccccagtttgagtttcctgagacatgcagcaagttccccactggctatctattttacacatggtaatgtaagtttccatgttactctctccataggtaggtttaactgggacaggatgatggggtgatgctttagaagacagttcaggacagggtgccatagaggtcaggtgttgaatactcagaggatagaggatcagaattagagtggattctttatattttgcagttttgaccaataggggctttgacattggacagataattctgactttgtcacttttgttacaaatagtaaacttaccatgaagccaatacacaagttaaggctctgtggatattatagaattttaaaatgtgaattcagttttcttacatctctcttgggaatattttttgtctactccctattataattttagaatttagcattcattcttttgactttaagcaaaggagttaattttgttctgaaaaacatttagttggaagggtgtaaaattccctgttctgtgatctttttaaaaaacatataatttgtgtgtaaaggagcttaagaaatatcttcatctttttttgtctctaataaatggtttttaaaaagacttcccatgtggtccagtgactgggactccacactccaaatgcagaggacctgggttcgatccctggttggggaactagatcccacatgttgcaactaagcaaccaaataaataaaataagaaatactaaaaaaacaaaacctaaaaatagagctac

SEQ ID NO: 38644 - DNA, 3238 bp, Bovine  19866880731978
gatgtggttatggtcccttgagattatactataattaagataacaaatacagaaagtagagaaagtagaaaaaagatgttatagactatagaaaagagggtcctacataaagataattaacaacctgcaagttcagaaacaaacaaaaaaaaatgatgtattatataaatacaaaaataaatgatgtattcaatgataaaatacaagagaacctccctacccccaccaaatgaaaaatttacagattaaaagatgactagattctggaaaattctgatacagattgttcataatgatacatggcagagctaagctactttgaacaaaaagaaataactcataatgtgtccagaaataaagaaagtaccatatagggggagataaatcaggctggccttagacttttccttgatgaagacagtggaacagcttatatcaagacatgcggaaagtagtgtgaccaaagcatgtcataccaagggcagatgtcattcaagtgtaatgaacacaggcagaccttctcgagagagaagcagctcagaatcccagacacaaggacttttcttggagaaacaagttgacaaataatccagataattattaataacacactcaaaatgaagaactcaggaatagagagaccatggtggaaggggccagtgatgaccactgaatatgtctaattattgaatgattaccaaattactatggaaattatattttctgaataaaatataatcattatcaaactgagcacagttactaagaatatacaaacaaaatttgggagatggtcaggaagatggaagtaataatcttagagaggtataaggattgcataccattcaggcaatccattacaaatactattaatatttctctcaaccagactttgaaaaagcacttggatgacaccaattgtgagcctgtactccctgatagatggttggaaattaaatttatgagaatagatccattagcttgtggagttagcaagcctaacagatccataagcttttagagttaaaaagactaatagatccatcagcgtttaaagttagcatggctaatctcagttagttgatctcagaaagtaggcaaaaccacttagttcccatttttactttcatggttttcagagagaatagaagaattcaaatagaaagctgaagaaaaacatataatgaagaaattttagcccaacatcactgaggagctatagaaagggacttggtcacatgagagaagcattctcatttctggagccagaaaagaacatcccagagcccagaagaaccacaggtgtgatctcaggcttctgagatctcacagcaaaatcatggagaatgaagaagggcttgaacactggaaacagaaatgtgatcctgcttggcaaaagagaaagtagttgaattaagaatatggactaacaagattgaggtctggaaaaaactcttgaagagactgtcaaatgatgaatgggcttttaggaaacagggaactaatttttaatgataatttacctatccaaataattccattccccataacaactgtgtgatgtattcattgttcttatcaaagtgaagacggagaaacacagtgtcggagaaacacagtgtcagagaaatcagttatttgttcaaggtcacacagctagtagatgctggactatttttggttggtggtattgtttactcactaggttgcatctgactctttgcgaccccatggactgtagcccgccaggctcctctgtccatggaattttccaggcaagaatactggagtgggttgccatttccttctccaggggtctcaccaacccagggatagaagccaggcctttctgcattggagacagattctataccatctgagtcaccagggaaacccgtgtgtgtgtgtgtgtgcgtgtgcatgtgtgtgtgtctgtgtgtgtacatacatacgtataagtattataaactagaaggacagttttaatttggctggccatgtgaaaacaagtgaacagaccaccctaccaaagcaaccagcaagaacattcatacttagtatattttgaatggattcataaaattcttattttctaaaacacatagaaatagcagctaatacttatgggacttggaacttggtgtgtcctcaattgataacaggctgcctgggccatgctgagttgtctccagtttatactaaatgttgctctttggctttaatggacctatcttgtaatttaagaagtttaagcaagggcatactctctgaaactgtagtcccagtttaggaattttttgtaaaaaattattcagaggtgagttcataaatttatgtatgaggaagaattatttcaatgtaactcaaaatcataacaatttgaaacaacctaagtgtttcaaaacataagcaaagttttagatcatttatggtaaatggtatcatgagatattttccagacattagtgagtttgtgaaagttgctcagttgtgtctctttgtgatcccatggactatagcctgccaagctcatttgtccatggaattctccaggcaagaataccagagtgggtagccattcccttgtccaggggattttcccaacctgctgatcaaacccaggtctcctgcattgcaggtggattctttaccatttgagccaccagggaagcccaagaatactggagtgggtagcctaacccttctccaggtggaatcttcctaacccaggaattaaactggggccttctacattgcaggcaaattcttgaaccagctgagttaccaaggaagcccagacattaacatacgatttccagacattaatgtatggctttgaaagatgggaaaatcctcatcatctaagtaacctgatataaatgtaggatataaaatttcatattcaagataacaagtgtgtttaaaaaatacatgcttaaaaactagaaagaaaaattgcatcaaatttaacactgcttacctcaaaaagataggattatggatgatttgggtttttattatatttattaatattgtcacaagttttattgtgtataggacacatttttatcagaaaataagagagatgttaataaaatctagaaaggaaagctaaaaagatgatgtcaaacaggttaactagccagtgtgattgggagatcaaaagcaattcaagagatattaaacatttaacacaccagcctacatttcagtgatttccttttgttgcccatgttag

SEQ ID NO: 38645 - DNA, 2193 bp, Bovine  19866880769135
tgaagaagaactaaagagcctcttgatgaaagtgaaagaagagagtgaaaaagttggcttaaagcccaacattcagaaaactaagatcatggcatccagtcccatcacttcatggcaaatagacggggaaacagtggacacagtgtcagactttattttcctggtctccaaaatcactgcagatggtaattgcagccatgaaattaaaagatgcttactccttggaaggaaagttatgaccaacctagacagcgtattaaaaagcagagacattactttgccaacaaaggtccatgtagttaaggctatggtttttccagtggtcatgtatggatgtgagagttggactgtaaagaaagctgagcaccgaagaattgatgcttttgaactgtgctgttggagaggattcttgagagtcccttggatgcaaggagatccaaccagtccatcctaaaggagatgagtccttgggtgttcattggaaggactgatgctgaagctgaaactccaatacttcggccacctgatgcaaagagctgactcatttaaaagagctgaccctgatgctgggaaagattgagggcaggaggagaaggggatgacaggatgagatggttggatggcatcaccgactcaatgggcgtgagtttgggtaaactccgggagttggtgatggacagggaggcctggcgagctgcagttcatggggtcacaaagagttggacatgactgagcgactgaactgaaacgaagctatccatgcatgctgcttaaaaaaaaaaaaaaagatacactgttttcaaacccctggagaatgttgcctgagtgaggaagggaagagcaaggcagaagtaccagtccggtggctggagtaggaggaagcgccctttaatgaaatcttgattttctgtggctttttcctaagtaggaaaatcactggaaattgtaccaattttgcccctacccccctttttttgagctttcaatctactgaggcgccctgccacctcatccatctgtaacttttcaccactttttcctcaaagtaaggaatatgtcccagaaaatgcacctctgtgacttagcgaagtgccaaagtcatctgagccttcccagtgttccaaagaaagcaatgatttgaattcagctgctcaaacaattaacctctaagcaggcagcttgaaacatccttaaagtaacagaacagtgtagattctggaagggaaatcagcttgttggtaattgttttaatttttcaattaattgattatacatctggttgtatatgatcttttgaacctgatactctgctaaattaacgttgatgttatagtaaaattgaagcagaaccaatttctgttcaatgaaattatgtgttttctgacactggatcgtacttgcagatacatggtaataatcatgttcatatgacccccagttttactctaacagtgtatatgttatatacacacgtatgtgtgacatatacacatataacttatagaggtagcaatgcatgtgtgtaacatatttaggtgtgtatgtatatgcactccaaaattacaatattcacaatagcactattcattattgttataagttggaaacaactcaaatgtccatcaactgtggaatgaagaaataaattgtgacataccatggagtattacataacaatgagaatggctgaactactgctacaaaaacagatgaatttcacaaacaaaaccctgagcaaaagaagtcagacacaaaaggacacgtacaataattgcatttatatgcagcttataaacagtcaaagctagtctctggaaatctattctgatagaaatctgaacaggaggtgtctttggatggagacaagagagattctggggtttggtaatggttgaaagtcactcagttgtgtctgactctttgcaaccccatggaccatacagtccatggaattttccaggccaggatactggagtgggtagctgttcccttctccagcagatcttcccaacccaggaatcgaactcaggtctcctgcattgcaggtggattctttactagctgagctaccagggtagctcctggtaatggttacataaatatatttgctttgtgaaactcattaagtggtacaataatgatttgtaaacttgtatgtatgcatgttctgtccatagaaatttacttaaaaac

SEQ ID NO: 38646 - DNA, 1214 bp, Bovine  19866880775136
atggcgtatttggtaaaaacagtactgtttgctgcttgtcggttgtgcattgaggatggcagagaagtgccatttgaagctgcagcagcttctaccctgtgcctcctctctcttcctgggtcttcccctgtgcacttggcgtctattaagtggccagagcaagtgacagctactgagttgcttgcttggtaggattttctcggacacatttccaccctagctgttgtatgaacaggcaagtgctatgtttaggtaaaaggctgtttggccagagttcagtcctttttattttttaaagcccctgcatttactaaatcgagtggtaatccctgagctccttggctctgatgtgctcctccaggcccaggccctgtggtgtaggattctattagagacgagactcttctgcagaaagaactaggcttccccactcaggtcaagactgactcactgtatataccaaattgaaagtgaaagttgctcagtcgtgtccaactttgcatccccatggactatacaatccatggaattctccatgccagaatactggaatggatagcctttcccttctccaggggatcttcccaacccagtctcccacattgtaggcagattctttagcagctgagccacaagggaagcccaagaatactggagtgggtagcctaatcccttctccagtggatcttcatgcccgaggaatcgaacatgggtctcctgcattgtaggcatttaccaactgagctatgagggaagccttgtacggaaatgcttttgcattggctggaaaatataccaaattacatggaaatattactcaaacctgcatgtcaaagtgctttctgcaaagtgcagtgacaagtcaatgtgttacgatggccaagttcggaacttttgtcttacagtaggtgtcatctcgtgctagagtactgtattgacagggagaggcggtctgtctccaaaggtttaaagactgtgttgggagcaaaggttgatgttgattccactgaagtgaagctgctgggggctgatggaggaacagggctagagctgtgtctcttccttctctctgaccattctgcttggctcctcagtcgggaagcctgtaacgagggagaaggggacccgcccctctacgtcaacgtgaacatgttcagcgggcagctcatgaacacgtggatcgactctctgcaggccttcttccctggactgca

SEQ ID NO: 38647 - DNA, 1374 bp, Bovine  19866880802375
cagcagctgatagctgcactgctccagtctctgcctcaccttccatggccatcctccctccatgcctcttctgcttttctcataaggacaccagtcagactggattaagggcccacccaactccagtatggccttctcctaagctacatcgtagttacatcagtgaagaccttacttccagggacttccctggtgctccagcggctaagactccgcactcccaatgcaaggggcccaggcttgatccctggtcaggaaactaacatacatgttgccacaactaatcgtttgcatgccacaacttaagatcttgcatgctacaacaaaaatcaaagatcccacctgctacaagtaagacccagtgcagcaaaataaataattcttttaaagattctatttccaactaacatcacagataccaagagttaggactccatcatatctttcaggaggagaaaccattcaatccacaaaagcctccaagatggtttcaaagcaatttcagacaccatctgcccccttctccatccagcatttgaaacttcagcacccctactctgatcaacataagctttctgcagtccactgcttattaaaacattgagagtgtttatgaaagttttcagtacagatgggcacttctcttcaagagcaggttcagctttctagcacaggcatgaggcagggaggggcggggggagagcattgtgtcctgttgtcatttcaaaccacttaagtgatcatttatggcaggacataaaaatgatcactgttttgaaagacaataagctagtattccaggtaatgatacctccaggctaactcattctttttcaggagttttaattatcaggatgggcacaccggtgtttattcaattctctgtatactagagatggtgtctgggaaagatgaatgccacccccttttcggctatgctcagctgaatggattgttctcattttgcctcttccctcatcagttgataaaatcaagaacaggatccaaaacaatatgtacccacacaggacaatgtatcctggtgcctgtgggcaggaacagggcccccacttacagaacccaggttccaagccagcctccatcccattcagcacatcgcaccactacttctgggattctcgtgtcccacagaggtgacaataataactatctccttggggtttgtctacaggcgatgtggcataaggactgatgttaagatctcaagttcaaagacacttaaagacaaaaaggagatgtagcctcagagagctgattcatttctcccatccaagacttgtagacaagcctttccagtctacttctgttcagaaacaaaagcaaactcctcacgtcaacgtggcaggatcactg

SEQ ID NO: 38648 - DNA, 3540 bp, Bovine  19866880821037
tctgcaggtgctcttgtgcagggcggagaggctggtgtgttcaggagcacactgtgcggcctgccccaccctaaatagctctgtggcctagggcaagttacttcatttcctggggctcagactgtccattctatagattctgaagattaagtgagttagtaaatgtaaactgtttagaactgtgtctggtccataaaagagctcaataaattatgttggtattgtttagttgctaagtcctgtctgactctttgtgactccacgcactacagtatgccaggatcctctgtcctccactatttcccagagtttgctcaaactcatgtccactgagtcggtgatgccatccaaccgtctcatcctctgtctccctcttctccttttgccctcactctttcttgacatcagggtcttttctaatgagttggctcttagcatcaggtggccaaagtattggagcttcagcatcagcccttccaatgaatattcaggattgatttcttttaggctcgactggtttgatctccttgcagttcaagggactcttaagagtcttctcccacttcccaatccaaaagcatcagttcttcggtgctcagccttctttatggtccaactctcatatccatacagtcaattttagataatattaataactattattattatttactatatctgagaactactcccagaccttgatccaattaaactatggatttgtatgacttttcttacttggttttccagctatgcacattcatctaattcatccaatagccttgctctcaaacttcccagatctgaattttgtctttgctttcttagcatcttcactgtctcttacctttaggctacaacagtctcccccttctctttcctaacacactaattcctccaccagacactcaaaactttgctcagctcccctggctcaacacacatgcaatgacctctattatgctatgctatgctatgctaagtcacttcagtcgtgtctgactctgtgtgaccccatagacggcagcccaccaggctcccccgtccctgggattctccaggcaagaacactggagtgggttgccatttccttctccaatgcatgaaagtgaaatggcctcattcaatatgcagttagatctgttgagagaatctcttctgattggtgcaactcacagggtcagatgatgtttcttcaccatacctttaacgccctcccccaggtctccagtttccagaagctgggaacattttaaataacattgtcatttaagttaatgaactttggatccttgggggaaactctcccttaaatcatgcttctgaacacattttctaggtgtttctatatatttttgcttccattctgctggcatacacattctgtgttggagaattgtccttgaatacgtgggcaggttgagttggcccagggactggtgcttctcacctcagctatacattggaattatcttgagaaacttagaaaatatcgttgttgggttcccaataccaaatacggtgatttaactgatgctgaagctgaaactccaatgttttggccacctgatgggaagagccaactcattggaaaagaccctgtagttttctgtttttttttttttaacatgccttctaatggattccaatacatgctaaaatttaacaactgctaaacttgagtattggagaaggcaatggcaccccactccagtactcttgcctggaaaatcccacgggcggaggagcctggcaggctgcagtccatggggttgctaagagtcggacacgactgagcgacttcactttcacttttcactctcatgcattggagaagaaaatggcaacccactccagtgttcttgcctggagaatcccagggacgggggagcctggtgggctgccgtctatggggtcgcacagagtcggacatgactgaagcgacttagcagcagcagcagcagcaaacttgagtgtacgacctgatcttggggccgtttaacacttttcagttgggcttcccaggtggccttagtggtaaagaacctgtctgccggtgcagaagatacaagagtcatgggttcgatccctggattgggaagattccctggaggagggcatggcgattcattccagtattcttgcctggagaatcccacggacaggggagcctggtgggctacagaccatggggtcacaaagagttggagacaacttagcaactgagcaaaagcaaaaaaaaaaaaaaaaaaaagggtctcctgtgcagcctgtgttgagaaccactgcagtggttctctctggatggcataatcataagagttaccagcttttaaagattagtcgagcttttgataacaaaggttcttcctaaatagaagtaatatttttcatccatttgtgagcccctacatgtgctaagttgagttacccaactgtttccaaatgaagttttcagctttctaaggcagaatagattttgctattgattcctgtgtcatcttttggaaaatggtctattattgataaagttttggcatgggatagggagttcagtctctggttgcatttcacccagttcctaaagaagcctttttatatgaaagactcgacagacgagacttgaagttaaatgtattgatttgcatattgatttcctgtgaatcttgaggttgccactgtatatcatacccgaccaaaatctgctctgtttggataagaaagataattcagacggttgggtttattgcccaggctgttaaattgcaaaataaaataaaagttgtcaaccattttcgtttatggctgttggaagaaaggtttagattaaagttaacattgaagaggctgaatgttgacaggctgtatttctttaccctagattcaacagttctgttcatttctgaaatagcctcagttaattctgtagcagtggttgtctactgatcatatttagaatcccctggtgggtttgttaaaacacagatcactgggctccagagtttctgattgagcaggtggaaggtgggacctgagacttggtgtctaacaaggtcccaggtgacatggctgctctatgggctcgtggggctgtggggtggaggggaggtgtgtgacacactttgaaaagcactgttctaaagcattttgtattaaatttcatagtactttattctgtaggaaatatctgaggggaaaatggtaaaatttatctttataaggattacccaggagtgtgtttcatcacaggaagtagaaatatgctagaataatttagaaatgtttcctctacaaatttgatgctatcctgattccatgtgtagtgatggggacccagagtagatacacaaaaagcagaggtttatctgtctcagtgatttgtgaggcttttatgaccacaccatgtccacgtacataatgggaatattctctgaaatgcctaattcaaaggacaaatgcttttagaaaatgacgtcagtgtagcaatgggtccacatgagaggacctttttcaatctcctcctatcatatcccacataga

SEQ ID NO: 38649 - DNA, 1501 bp, Bovine  19866880855366
cccagaagaacccccgtgcagtagcgactgccactggtgcccattttagagatgaggagattgagtcaaagaggagctaagcgactggcccaaagcgacacttgtcagtggtggcaaggctgggatttgaacctgtctgatcccaaggcccaggtttttaaccagcgtcttccactcctttttctgaatttttggaagtgtccttagactgtgattcttccacagctggggccctgtcgtatggatgtcttgtgggtactccacactccatgcttccctgtggctgcagctcgccttcctgttctcataagcagggcttctctcggtccctgccatctgctggcccagttccctccactggcctgctgctgacactttgactcccaactgggtgacggggacacagtaggcactgtagtaacccaaagaatgacccgaaggcctgaagttctcctaagagttgtgtcttcaaggaagtgtttctcaaagcggatggcatcatccttagagggtgtttcctggtgacagtgcttttagttttcacaaggattgcagtgctgtggggatggagatgaggaagtctcacatcctcctggctttgaggaccagtatgagacagaactgtggggcaaagagctgtcctgtgtcccctcaagatttgaaatgcacccccccacaatgatatagattaagaacttatttttttttaattatttgagcacatatcttaactttttctttttttttttttcatataaacacaagcatggttttagtaggcaccatgcttcctaggaatgctgctgccactgccaagtcgcttcagttgcgtccgactctgtgtgaccctatggacagcagcccatcaggctcctctgtccatgggattctctaggcaagaacactggagtgggctgccatttccttctccacctaggaatgctacttctgtataaatggaaggaaggctccagcactttaccaagagttgttcgccattttgaaaatgacgtcatgaacgcagtatcacattcggaatctgagtcactagggccacatggttacatcagttttcatttatagctgtttcattcatggagagtctgcgtatgcctctctagcccttatttggaaatagcatatataaaacaaaagggtcaacaacattcagtcaaatatggtctaattcctctgaaattcagatgtaatccttaaaaataggtccaaacattggctactcacctattcatgaatcatctgagcattttcatgttacaaaataattatactgtaaactctattttttgtatctcccttatgtgacaaaacagtacattgatttttagaaattgtttgtaggtagattataccagctgtgaattgcaattcaggaaagtaaggacaatgttacaaaaacattgttttaagaaaaaggggttatgatggaattttgaactatagttttaagaaaatgagatcgatttcctaattttggcacaag

SEQ ID NO: 38650 - DNA, 1916 bp, Bovine  19866880881467
tagttttttttcttctcacctgcttcctgtacttgctctttactcgagaaaccccatgagactttggttcttgagagactcactaaacagagtggttagtactaaactgggttctacctccctatttatgacaaggaaacccctagaaatttgtcatctccagtattgtcatgccatagcctcagtagaaatgcagcctgacagcctagattggattctagtgtcataatcttgtcagaattctcatttcagagtcttattatatactataagggtgtaagccatccaagttaagatataagccaaagtagtaaggcaaacaagagtaaggcaagtgggttttctaatagtcaaccccagaactttacagcttctgctaccctgcatggcattatgatctcctttgtccacgagggtggaggaaaggttgggagcatcgctgtctctggagctccttcatgtggagggaattgtccactaatacttcaattaaacaaaattctgtctcatggaatttgtgtattctaatataaccatctagcttgaaatacagtattataaattaccctgaattcaagcattagaaaccagctgggattcttgagttaaaactccactaatactagatttttcatgataaatgcattttggaaggaaaaggtgttcagagctcagagcagattaaatagttcccgtgataattagataattttaggcaaatgttggtgagagcccttccttcatgtgccatttagggtccgtggtttttattggtcagaaaccaatgaactttcattatttagagaaatagctattttacagtggaattgccattgaagctcctccatttcctttaaggggagccttggggctgaatgtgtattcagagttatcacaaagtaaggtgaagggtgggacttttattttttaatagaagtatagttgattgacatttctatgttggcttcaggtataaagcctagtggttcagtatttttgcagattatactccattacaggttattaccagataatgactataattccctgtgccacagagtatattcttattctttatctaatttatgcattgcagtttgtatctgttaatttcatgcccctaaattgcccctccccaattctttctccccttgctgctgctgctgctaagtcgcttcagtcgtgtccaactctgtgtgaccccatagacggcagcccaccaggctcccctgtccctgggattcttctccccttgcataaccacaaatttgttttctgtatctgagagtctgtttctgttttgcatgtatacatttgtgctgtattttagatgagaggctagggctttgtgcccaagtgaaaggcagccattgagaaggcctgtgaccctgggtaaggcagttccctgcagccagggggtagtttgcagcaagggtgtcaggggtgaacggccacagctgccatgcctagaagctgcaggtcagcagtgtgcaccccgggaggggtcttttggtgagccccacaggctccactacatgtaagtgtctttttctagatcagacacgcagccatgtggctaactacataggtaaactgagtccaagacctccagactctctcactttccactctgagagactccaagtcacatttcactcattaagcatctctaatcaggttagatacctgctgtgtccttaaatcatcaagacaacaggggtgttcaggatacctgacttgtgggttcctgtcagagtggcattcaaggctgattgggctggagacatggatttagagagtaacagatagcccttatatagcatttactgcactaagtcctctgcatgagttcattcatttattctcccttagcatgatgtgacaggtgtattctcattttttatagttaaggaaag

SEQ ID NO: 38651 - DNA, 2971 bp, Bovine  19866880898617
caataaaacagtgtgactggatctctcattctgtttaccacttatgataaaacagggaaacaaatacttcttcactttaaaaaaaaaaatagcagcacggccgagatgataaattacagcaacactcatgtttcatttggtgatacggtagggggaagtggggactgtggcaagcaagagacatacccccgctaaaggacaacttcctctccagtcccaactactgtcatatgaaatggcagctcagtgttaggattcctatttttaagagaaatgagaaatctaggtttttgactgccttgtcctttgaatgaaggctcaaacatttaaaagatgacaaactggaaaatagactagtgcacagaatcaagccattatgcctctagcacctttggctcagatattaaatgagttcaaaagaagactagctctctctgaattgtaccaatcaaagaacgcacagaacctggaagacctgagatgaaccctgagaagtaggaatgttcttgacaaagagagggagaatattccagtctggaggagtttctcattgaatgtgaagctataatcaaagatcatcaaggtatttccaacccccagctgggtcataaagatggggatccatggcaatgttgccagataaagaagacacagatgtataaaaggtttaaaaaaaaaaaaaaaaagctggtaaagagaaataaaagagccttcctctttaaactctatgcttatgtagatcatgtggaagagaagaggttcctgaatcttttcaagctcacacatattcagaggaaaaaaaaaaaaacttctgatgatcattttataggaattctaaaattcagagacatcttgtagagagaaggaaaaagaggaaagtggttgacaaagctaaagattgtgtgtacattcatttatttatagtgtggagcatccactaagagccaggagttattttaggagctgaggatggagccctgaataaagtaggtaaacccccatcttaagggagactctatcccagtgaaggaagacaggtatcaaataaacatataaatacataatatgtcacttgtgccagccacgggactctctgggaaagagtttcagacagagggaacagcgagtgcaaaggtcctggggtgagactgacagccacatgcttgaggaatcatgtaggaggcagaattctcctcccttccctgattactcccatgactatgcattgggttgtccgaaaagttcattggggtttttccataacatcttactaaaaaagccaaattaaatttatggccagcccagtatgttaaagtaattctgccactgacattatgattactaatcaaaaaaattactaataatttggccttcactgaggattatccaagtggacctaacctaatcatacgaatattcaaaagcagagagttttctctggctggatacaggagggggagtcagagagattcaaagcatgacaatggtccaaggcacccttgctggattggagatggaggaaaccatggggcaaggaatctgggtggcctccaggagctaagagtggctctcccttgacagccagcaaggaagccgggacctcagtcctacaaccacaaggaactgaattctgccagtaagtggaatgaattctggagtaaacttttccccaggggccctagacagaagtccagcacacaagctgattgtagcctaagctgaaaatgtggttgagcccacttgtagttctgatctacaaaaatgtgaactaacaacgcatggattgggtgttgggggttttgaggtgctaccattgtaataactgatgatgctgcaacagaaatccaacagaaacagcaagggcaggagtggagttagcaaacaggactgctgagaaggatgaaatctgagagagagctagaggctagaaaatccaaagctttgtgcaccttggtcagtccactacatttaaggcaaataagaggcacaggttgggagggtttaaacagaggaaacgtgaccttgacttgatcctgagagttcagtactgcttgatgaactgatacccagagaaagaactccactgaaagagttcccgaggagctccagaggcactggtacataccagattataaaatattcagaagaagccagcaaaacaaatggagaacaggcagagagtttgggagatggagcatatcaaaaacagcatttaagatacgccagcaactgagaagagtgaatccatcaagagagattacatgaggcagcctgaaacacaaccacacttcccactttgctcagttcccacgtgcactggagaaaatgcttttggtccaggcatgtttctcgaacagacatatctatactgtatagattcagcctcaggaatatctcgagctttcccctatgccactctggtaaatgattaatgtatgattaaacctgatgattagccacggccaggaatttgatagctaatagtcagagactcgggggagggcaccttttattagcagttgagtgccttgcagcaaatgcctcctagagggaactgggggattggaaagatgactaaggagccccatggtgggaaaaattaaaccatagacccatgagataataacagcaatagagagacaggcaaagcttcccacgcacatgcaccaagtcagaaatacctcaggtataattaaacccttctccagaatttagcacctttttgttagaagaatctttacttgcagttctcagcattctgttgccttggcagaaaccctatctcttgacatttgagaggtttctgtaccctttttcaaagaacagcactggcaagcatgcttttgaaaatatggtttgtagccatggatgactttaccattgagtgtatacactcccatcccacctgaccccaggcacaatctgttcattccctttatctgccttctctaatttcatacccacatttcac

SEQ ID NO: 38652 - DNA, 1204 bp, Bovine  19866880912373
ccaggccctcgcacgcgctaagtttccaataaaagttttctcactttaaggttggaggggagtatgcaaggtgtgggccctgtgtctactgagtggcttggagaagaaggagcagatagggttctgggtgtgactctgctccactgccgggactcctctgccgcggggtggggaaggagaagcgcttctcacctccttccttcccgcgcccaccatctctccgtgcgctttgcaggagacctacaaactgccgcaccggctcatcgagaaaaagagacgtgaccggattaacgagtgcatcgcccagctgaaggatctcctccccgaacatctcaaacttacagtaagtgagaagctggcccctctccaaaccagctcctctgcccaaagggcgggcgagggtcacccgccgcctgcaggctctgccaggaactgcagaccagatggctggatcctagctagtggctggctctgtttgggggtacccttctccagtctcagaattttctggcaacctcctgcaaatgagataagaatcatttgtacttgtccagcttggcaccaacaccagccggccttcctttgctagagtttaaggtgattctcagggttctccttttcccacattgagcaaatccagcaacccactttttttttttaacccccttccccgaatccctttttaaaataagaggacttgttttgatgtgtcccttttttttttttacgtcctgtcctttcttggcgatcctcaatagattattagcgtggcagcctttggttggggaaagaagaaaaaagtagaatttaggagaaaaactagtatttaggaagcaacaaaaaagcgtagatgagctagaagttatgacagggtgtcaggaaagaaactagggaaagccttttggctgccagacacagtagaagtctctactagggttgacaccactgcagagaaatgttatctccggattcccctgagttaaggtcagcaacggctgctggaaaaatttatctgtcaaagctttctcctgagctagctgctacttccaaaatgcctccaaagatgggggacacttgtttgctgtcctctaatcaaaaatatatgcatatatacgtatttttaaacatcatctataaacttaaaacttaatttagccaaccaagaacagtttttttatccccctttagagacattcagtggggg

SEQ ID NO: 38653 - DNA, 1671 bp, Bovine  19866881106525
tttctggaggctggaagtctgagataaggtgtctcagggttggttccgtctgtcccaggcctctcccccagctttgggtggtttgccagcgatctctgattccttggcgtgtggctgcatccctccagtctctgccattaccttcacgtggcatcctccctgtgccatgtctgtctccttgtccaaatgtcccctttttataagcacaccaggcacaagggcccaccctcatgacctcatgttaacttgcttacctctgtgaaggccccctgattgcaaataaggtcacaagatctctttgtggaggacacagttcaacccatgtgctccagcactcagtcatgtgtttgactctttgcgaccccatggactgtagactgccgggctcctctctccatgggattttccaggcaggagtactggagtggattgccatttccttctccaaattccacccataacaaacaccatttctcatcccctgctgcaccctaagagacatcctccttatctatgccagctcaggtgagccttctctgaacaccccagaccacacccagccctgctgtctgcccttgaatgctcttccctcatatctgttgtggatagctggtatctgctgtgtcaggatctggtcagtgcctgtgtcgccttcagagactccccttcataagagcagaagcgtgattgttctgtctgcaaccccaaagcccaaaaccctggactattgacaaagagtatcagtgaatgcctgtggcctgaatgaatgaaggattgagaagttaatcttcatgtgcaagaaatattatgtgctcagtcatgtctgactctttgtaaccacatggactatagcccaccaggctcctctgtccatgggatttcccaggcaacaatactggagtgggttgccatttcctccttcaggggatcttcacgacccaaggatcaaacccgcatctcctgcattggcagatgggttcttttaccactgagccaccagggaaggacagattaatcttcattaatcacaaaagagaagagacaattctaagcaagggtctcagaggcagaaagattagtattccttctggagagaaaggatttgctccagcatccaccaagggcccaacccctgccctcacacacccctgactccctgactaatggtcatggctttcccttctaccctgtcacacagggagaatccgctcagcatagctttgtagggaaggcctcaggaacgttggggaagctggaggtgagtcagaaaggccggtaaattgaacagctctgaaacccgacccttggcattgagctgaggggtggcgggtttgcagaaggtaacagtgcttgctttaaaattcagggggcccaagggagcatcatcttgcagaaaaccgctctagttggtgaggagccaagtgtggtccaggctccaggtacctgggtttgctgtcccaccctggcctgtgaaggtgacagcatggacgttgtcaggtctgcccttcccccatagctgtcctgcactcacctggtaggaaatgaagctttaacttttgtagcctctactctcctgtgtgtgggtaaggagaccaggtagctacatcgagagaccttcatctgtctcagttgaacccactcaacctacccacccacaaaacaattccagcc

SEQ ID NO: 38654 - DNA, 1009 bp, Bovine  19866881132358
ttcatacattttccattactgtactttttacctgtcttcccaaatatcttgtgtaatagacctaatattttgacaaactcacaactattttctaccataaaataagcctatattttctctggggttgggacaaagaggcctgctttgaatgctttgcaaatatcccccattcttcaaagcaaaactttaacttgtcaaggtcctataagaagaaaacatggagtgagttggggcagacgcaaaatactttcttcagagacttaaaccaatagctaacaatgagtgtaatgagaatagcagaaaaccacagggatcaggttaagctatgacactgagcccacactttttgaatatgtttacaacatattcaaatgtttgtttcagtgaaatgcaggcttttaataaaatggagccaaacatttcataaaaagttagggagctgatatctaaagtatgcaattttctaaattgctgtaattgaagttattgttaggtttcaagagagatgacttcaggagatccctaattggtccccaagcatgccaagatttcaccagataataaatgctcccattaacacatgctccctacaagtccccagagaaaactgcttgttcccaggttagtgaagatgccaaacctttcagtgctctgtgttcctgatggtgagctgattcagaagagaagaaggctcacatatacttcttcctagaagaccaccacaggttgttttaggtgtttggtgagtaggtggaggagacaaccaacaattcatgacattaaattcaggaagctttccaagggcatcagagacattgacagctatataattatgttgtttacaaagatgtgtcataagtaattaaattgaggtactaacataagttctatatatctgattgctgaagaagccaggcacagaaaacagaagcctggttgcacatatcctgctcagggttaatgactttattgaacagagattgtgttttcctctgtgaacttgcctgga

SEQ ID NO: 38655 - DNA, 797 bp, Bovine  19866881209802
tgtctgcttctctgctataacgccagcacacagcccagggatgcttattacacctctgaataaagaaaaaatacatgacaaatgatggggtagatagatgatcaacgatactttcttaagacaattaatgtctcttcactaaaaacaaacttccttctctactcacagatacatccccatacttcactcaaccaaagagaattggaacttagcacttctccatttttctatcaaccaccactcccagatgcagtgcattctggggacctcccatggcatgctaagccacagggaaccttgccctccctcccacacctgcagccctttcttctgattctttttaggaccatcttctacaagaaatcccaactgtcagacctagaaggtccatgaatgaaggaaccagccctggtttccacctgcccacgctgacccagctgaagaaggctgaagctcacaacaaatgaagcatctcccgtctgattgcttcctcactgcctgtctgacccaggctcaggaagcagatgaaagtgaggacaggatcattaggaatcaaatctgtacaaatgaggttgcttacagcagattaaaaaaagcaactcagggtcctttttctgggtattgcatcatttctcacaaggcgcctttgcaaacagcccctaatgatagagcgggcctcagaaggaccacatgaaactgaataaaacatcagtgctgggccaacaggggttgatcatgcattttaaaaaccccagtgtgcagagaacagagaattggctccgatcagccagacacat

SEQ ID NO: 38656 - DNA, 956 bp, Bovine  19866881449077
agtaaagaactatattttgatgtgaataaagtctctgaaactgtatgacctgggcatataaatgtccactcagttattctaaaaatatttactatgcacttaccttttgcacagggtcaccataaaggctcatttcctttcttgtttgtaatttatgttcactgtgtcaatttagaatatacaggaaggcagaaagtaaactaaaatcatttataattcaatcacctagagagagttattactattttgatgtatacaaatccagactcttttctccacacataaaataataatagctattatttattgagagcctcatccatgctaagaattaggctcaatactttatgtgggttattatttcttttatcctcacaataattcaattcaatatcctgattttatagtttgggaaactgagacatagcaaagttaggaaacttgtacaagattacccagctgataaatggtggggctagaattgaatgaaagtagtctttattattatttgaatacaaaaaaaaattggatcatactttttttttgtattttgctttatttgctcaaagatatatcttgaagatctttccacataataaacctatcacttcattttaaggcactgcagtgcattctaagacatgagtgaactccaagtcattcaaccaaatgctcacaaagacatttaggcctggttttcattttcccacagccatggtgcccataggccaggactggctaggccagtcgcctagggccactcgcctgtctcaacaccatggagttgtcgcttctaggcaccctgaatggcaggccctttcctgaaagacatatcctttccccctggctacatctttactttaagtctctcattattcaaaatttcagaaattctcaatcctcaaatgtcacctgacacttttcctgattccttgctgggtggcttgccacttagg

SEQ ID NO: 38657 - DNA, 1756 bp, Bovine  19866881493079
ttggaaaaagtgacttgccggccagtcaccatgtttttccccagtgaaaggctgactcattgcaacaggcctgggctggctgggactcgagtcagtggcttggaacatgcctggacagtcagtgccttgtctgaaaggctggtctgtgagaagccacgggtcaggggagctgaggccacagctctggggagcactcacatacaaccccaggagccagaggcaagtagagggtggaggtccctatctttcctccctccttgggggcttggcctagcacgagttgggtaaggtctgcaggggccctaccacccagggggaattaagtcctaatgtcccgagacattagtattatggttcttcctcctcacaggacatgcaaacaaaaaaacactgaacgtatatgtacagaaaaccaatcgggcttgattttcttcatgaggttatcttaatactttcctttgaaatatcaaagtggaattgttttacagtctggggcaagagggaggggaactgggaccgctttcctagtgtcccaagaatgtgtttgtctgccgatggggtaattccacaccatgcagagtgcaaagtctgactgtgaaggatccccactccccctccccagactgtcttccctcctcatgcctttgtccatgttgaccttcagggctctttggcaaggactttttgaatcatagttggcttaaatcctggctatgcgatctgcttgctgtgtgaccttaggtaagtcacttgatctcaagtgactaaatttctgtacgtgtcacatggaaagtaggcaagataaatgcatgcagagtgcctggaacagcactcagcacctagtctggctgacatactagatctcttctggcttctccctttattgccctacaaagctgctttttaggaaaaaatactgtcagtcatttacactttagtgtgaataagctcctgtacctactttgtgcagatttttctttctaacctcataacagtttctgcgagatcattaatattctcatttggtgatggaggaaacagactcagggaggtgaaagaacgctcccaaggtcacacagcagaacctcgttcattcaggaaacactgattgaacttctgccctgcctcaggatggggactaggagcacagagatcagtgagtcagacccctcatcttaagaccctcatgggtaactggctgtatttgaatgtttctgtcatcattctaattgttcagatccctgtaaaccttgtgcatataggcagggagagccttcaccttccctccaattgcctgttccaaagagtcattttcttcctagtgtgcaggactggccctgcccgaggctgatctaccagatcaaaaaagcctcctgccttttctttccacatcatctcctggggctctgctgagtacagatttccaagtctacatcagaattccattcttgtcccttcttttgcacttcatgatataatatatattacagaaacacatgtctcattgtaaaagagagagagacagaagagaagagagaagagcaaaattttcagagtaacagtaactccaggtcttgcaaagatggctaaaattttgttgtattgtctgccagaactttctcttatgcaattagaatataattgtgataataataataaataatataattgtgataataataataataatactctaccacttattttaactacccctgacttggagcttcctctgtaccagatactgttctaagca

SEQ ID NO: 38658 - DNA, 1038 bp, Bovine  19866881802853
caaaatgtttgcgaaagtcaatggcttgcttacacagtggctccttgttggaaaaagtgaccattttggttgatattatctatgatttgataatttaaaaatatactattgaaagcatgtgatagagtccagagtttgactttttcatttattttcatctttttgtttcaacattttaagcagttgttggagaatttacttgctgatggtacagtttcttgaatttggcttcaacaagctagttgtccttggtctcatttttccagttcaacgtatattatttaactgagagtacagtatgaagtgcaacaatcataagaaatagtcgttgaaaatgtaccatttccattcaatatttatgtttatcatttatatccattttatttcaccattttggatactgaggaataatacagtgttaatgttctttcatcttagttttatgacttgtttcctctatttttcttaagagaaaaaagtctttctgataagtgaagccttttaattgtggtagaaatcctgactatttataatgttgcattgagaaacagtagtctcctttaacatttttgttgtttttttctttgtttcaaatgaaatgatcaactcttgcaatgttagtgtggcccttagccaaagccatttatttcttactttaataaaggggtcaaaaattttaattgaatgtatagcaagtacttcagaatctgctcataaaattgatattggatgacaagggttgtagacttcagaaaaggaaaagtaaatttgtgtctaccctgtgctttattaaagtaaaagttaaaaatatagggaattagtagtagtagaaagcactgatggataaaaataagcccttagactttgagcaacatgggttaattaatgatacatatatgtatatgatatttatatgtgtatgtactattgtgtgatttacagaatgctttcactttatctcctctcatcatttcttctatatcattttgatataggtcttgcttaatatcattttgatataggtcttgcttagtatca

SEQ ID NO: 38659 - DNA, 1200 bp, Bovine  19866880396959
atgagggatgggaagagggtataggtgtgtgcaagcatgccaaatcagttcagttgtgtccgtctctttgcgacctgtggactgtagcctgccaggctcctctgtccatgggattctccaggcaagaaatactggagtaggttgccaggccctccttcaggggatcttcctgacccagggatctaacccaggtctcctgtgtctcctacattgcaggtggatatttttttaccactgagccaccgggaaagtcctgtgaagagatttgacattcaaaagatataaacatgtacatacactgtatctagaaatttctcttctggaaagaacttgaagaaaattcactagcatgctcaaaaatgaatatataaaactgtttattatagtattattataataacaaaagaggagaaataatctacatgtttaacaaggggttgattaagtatgttacatctataggctggaatttttccacttaaaagctgacatacgtatgtatatttatagctatgggagataattagttaaatgaacaaattagattttgactatgtgtgcatggagccatcaaagtattatttatcctacaacaatagtagaatcaataccaaaatattatcaatatttatctctagatggtgtgttacaactgcttttgctatttatttatgcttttctgtgtttttcaaatgttccatcaatgaattgctttttcaatcattaaaaacagtaaattctataaaaatgtggaaaaaaaaaaggcccagcatgaaactgaattggaccaccctgcctgcccaactttgcctcttctagctacatggaagaacatcaataatgctactttcaaatgcaggaatacatattttttcacaaatgtttttgcacgcatattctatacattgttcaaactttcaatatgttctactctgtaacaaaaaattattaataccagttcagactttgctttagtgaggctcaattttctttatttcactatttgacagttgcattttttccatttattcagaaaacaaaaaaaaaaattcaaggaggcaaatgaaataatgagctttccttgcactattggaaattaatttgctaagcagaattttgagtgggatgaactattctcaccccatccagtaggcatgactaatggttacttattattagcctctctggtggtctaattat

SEQ ID NO: 38660 - DNA, 2509 bp, Bovine  19866880484911
ttataattttatttattcatttatttttggctatgctgggtctctgttgcagtgtgagcttttttctggttgtggcgagtattagctactctgtagttatggtgcgtgggcttctcattgcggtgattctctcattgcagagcacaggcactagggaactcagggcttcagtagttggcggtttccaggctctagagcacaggctcaatagctgtgatgcacaggcctagtggctgcatggcatgtggaaccttcctggactaaggattgaacccatgtctcccatattggcaggcaggttctttaccactgagctacctgggaagcctaaccatcgggattaaaaaataggaataccctgaaaactttttaatttctgtaaaatgttatcaaagtttggaaacataaataattttatttccttggatactttataggatcataagagaaagaacgtatgtgatgagttgagaaagcaaagattaagacaaatgaattttctttttaaatagagtagctagttttaataaataaacaactgagtttgaaaactgccatactagtgctcataattattaggtgtgtagtgaggatgaagacttttgtattaataaacgtgaattataggcaaatgtagagatatggctctattaccatgccatatccatcatgtggccataggggtaccacttttaaagacagtagaactcccctgcacacactgatatctgtgaagctgtaaatcgactgcaatgtcatggctgataatccatctggagagtttaggagtttgtttccagtgcttaggtggtctggcccaatcctctgtggcccaagctgtttggagaccccagcctggaagaaggcagttctggggaattgttattgatgtaaatatagctattgcccgcaaaatcttaaaggctgactttgtatacttcatcctacacaagccttacaaaagccctatgacatcataagcagcctcaggggctgctgtcatccccattttacagaacacaatgcttctgttaaatcgatcactgcagggttgaccagattagcaacttcattagttactctgcctggggctcctataccccagctcctaaggcaaggtagggtcctcctccaactgcctggaaaaaaaaaagcaattccaggcataagtatattatcagtgcatttgtcccaaggctgaaaagaaaccagaacaaaaaccaacccaaagacctcaagatttctatttctgtttccagctttctttctcttggctgtgtttttggttccagaccttaagctgtcaaagcaaaaatggaaaatttggaaagtcgaggacaatgttgaaactggagataagttttaaaatttttgaaaaattaacttctaatttattttgataaattttaaaaaattgaagtaatttgaagttcgtatctagttctcagccatgattttattgtattcacttaagggaaaaaaattcataaattgagaaaagatgttcatagtcctgctaattgacatatatgaaaatgaaagtgttgcctgttccaattcatagttctcctaatgacacatatgaaagtgaaagtgttacttgctcagttgtgtcagactctttgagactccatggactatagcccaccaggcttctctgtccatggaattctccaggcaagagtattggagtgggttgccatgtccttctccaggggttcttcccaacccagggattgaacccaggtctcccacattgcagggagattctttaccatttgagctacttggaaagtccaatgacatatataataactcttcaacttgttttttgaataaaattactgacgtgaaagttttagaaagtgtttcaaggaatgacatatttgtcatatctcacatccatttgtccttcttttctttgatcacaactcagcccaatttttggtaatcaatcagtcattatgagacctgctgctgctgctgctgctcagtcgcttgtcgtgtccaattctgtgcgaccccatagacggcagcctaccaggctgccctgtccctgggattctccagtcaagaatactggagtgggttgcttccttctccaatgcatgaaagtgaaaagtgaaagtgaagttgctcagtcgtatccaactcctagtgaccccatggactgcagcctaccaggctcattgtcaaagaatttctctgcatctattgagataatcatatggttttttatttttcaatttgttaatgtggtgtattacattgattgatttgcagatattgaagaatccttgcatccctgggataaagcccacttggtcatgatgtatgatctttttaatatgttgttggattctgtttgctaaaattttgttaaggatttttgcatctgtgttcatcagtgatattggcctgtagttttctttttttgtggcgtctttgtaaggttttggtattagggtgatggtggcctcatagaatgagtttgaaagtttaccttcct

SEQ ID NO: 38661 - DNA, 1878 bp, Bovine  19866880581918
tctcttctcaggatttaaaaggaaggccctgtaataaaagaacgtgtaacacgattgaataagatggtgaagatgaaaagggcaaaggtttcagctgtttgtgtttttagcaacttgcaaaacttgctgctaattaaacaagccctatttgggttttctaaaacaatcaagttgaaaatgtgagtactagaagccaatgtggaactggaagaacccaagtattttctatttcggggctggtttggatcaactgagctctgaacaatatctgggagatgacccagaattctgaatttttttgcatagtcattagtttaagaagtaagccagctatatataatactaggaagtcttctgggtgccgatagtagtgaaaacatacggagttaatatgcagagacttgtatgactcagatttcctcttcaatgcataccagataatgaattgattggacttttaaactagtaatagatttctttttctgctatgattttcttgtctttggaaagtgctttattttgggtaaaactgctttctagggtgttggatgtagttatttgtaatacctgcacacttactctgcttttgttcctctggttgaaaagttagctctgttgctgttgaatatatagtccctgaaacatatcatgcatctttttccaaataatggcagaagtataaatgggctaggaggcaacacaaaatcagaatgagatctggccagacctggcctggggtgcaatgactcacttgaccagagcaaagtaatgtgcagtgagagatgctgcatcaaattctgctgcagtggccatctctgttccactcagggtcttcacctctggtatttatagtgtgtatatgtggcctcttgaggatcatccatagttcacttaaaatactgcaaataggcaacttgccttactatttttgtttttgaagaagattgtattttctgtggcttagtctcttttactcaatttgtatctacttattccttctttataatatgcaaagagtaaagtgttggggataactatattttatggggaagtcctaaggcagtcttagacctcgagttggggtctttgcatttttacctctaatatttaatctggtgttaaatgaatggacaaaaggaagattgaaaaaaatgtgttcaggtgaaccctggctttattttgggtggggcttctttgtgccagcagactttgacaatagttgttaaaagtattgtcttcctgtgaactcttatcatcaattcttcatcatcactggtatcgcaattaggaaaaaaaaaattacaaaaccctgagtagatgtctgccaacctaggtttcaagttcgtttttctttgtagcagtgagtaggccttctcttcctgtcaatcaccttttgtaacctgaagaaaagagaaagttactgactgacaccaaggagaatttctttacattccattctcggtatccaaggggctctgggatttgagactatcaaattagtgtcaatttgaaacatttctgagagaaggaggaaaaaaattggagattacctgaattcatcttccatgtggcccattgctaacatccaatcatagcggctgtcagtcacagagaagggcattatatttcaatgactgggtatctctttaattatagaaatgaataatccagctctcttcttaacagctgcagcccatgaaatgaaaggtttgaacctgaaggatcaacacaaacagaaaatgcagcaatttctattcctagtttctttcctattgtctgaacacaatatttccttactgacagaggaaatgaatgaggtctgaaaacacttttctaggcttcagtggcatttaatggcattcccttcaccttctcagg

SEQ ID NO: 38662 - DNA, 765 bp, Bovine  19866880694840
actgtggaattatgtttctcctttaaatggataaaaagtggaatttgataaaggtgtaccacatgaagccacgtaggagttatctaagataagggtatgcttttgatgggttaaaatacttagctttatttctaaattaccacagtgctaaaagtaaagtcttaatctaaataggactttgtgtattgaacaaataatattttataagtagaaatgtgagttctacttccttttactcttttaaatttagttttaggagaaaaatatgataaaacatattcatccttaagttctgtccactttaaaaatatttttgctaatttgttctgcttaaaaagaaataacaaacactggttttcagcatccagttcctccaagtcaggcagatcaaagttttgctgtgtttgaggtgtgtcattgaacagaaagccccaggaaccatatgttctacctgtgtcttgcctcttcaccaaaacttcacctgaattaaagagatgaataacaactgcttttgatcatacatcaagaaaggacatcctaagtatattaataatttctgtttgaaacaaaatcttgtcatttgcatatgtaacccatggtgactattgaatattctctttaattaatttgggtgcccttgatctacttgatgaactgccctgtatattcacatttgctgctacaagaatgacaaaacaaatgcaaaacttgaaaatcttcccaaaagataaatattctttgaatcaacacagatgtgtttagacc

SEQ ID NO: 38663 - DNA, 1792 bp, Bovine  19866880720732
aatgtttttactattaaatttgtttcagtatattttgcgtgcgtgccaagttgcttcaatcgtgtccaactctttctgctcctatggactgaagggcacccaagctcccctgtccgtgggattctccaggcaagaatactagagtgggttgcccatttccttctccaggggatctttctaatccaggtatcaaacttgcatctcttatgtctcctgcattggcagatgggttctttacccctagtgctagaggtaatgataattatcttgatgtgttcagaattacataaacaagaaaacaataaaaaacctttctgtaaagtgaaaagtaggtttgaagaaggagaagctgagagatctgatagcttaaaatttgcccacttcatgaagaaccatgtagtcatgctaaaagagatagacactaccctaatagcaaagggaatcactgaaggatttcagggaagaatgattgatggaatggcactacagaatttataagaccaccatggcagaaagtagagcatcaaggcagagaaaaataattaagcatttagaaattcctataattttactgaaagacagtaaacgcctatataggaaggaattgctgaactcagggaaggatttctgaagaaatttcatttgcggatcatttgtaagtgaataattacaaaggagatttccaataaatttaggcttgatgaaaaatttcagtcaaaattaacctaaaaaacacaagataattcatattaaagaataggttggtgctttgtaggttttaaatatatgaagtttgagttgactgtagaactcctaagtagaattcagtgaaaatagaaatcaaaggaaacagtggaaaacagctgcaaataaggtttaaggtttagcattggatcctagtaataagtgaaattttttcaaagagggataaaaatgttaaagggagtaatctgggaagaatctggtcactaggatttggacaaaaatggaaagaaatagtttaggcagaagacacaaatctgtaccaaacttggtcacaccattgtgtttattctatgagcagattaactggttttattcaatgagaagcaacatttctactcatttcatctcatgttctttctgactgagatgaaataaaatgaaaaatcccaggactatatttctggaatcatttccagtttgaaatgccttggcttatgttttggctcaaatctcaaagggcttcctttttttgcatttctaattatggggcatgatataatataattttccctaaattaaatctattaagcttgatattataagcactcttcctgtgccctctctccctcaacgaagtcagttttgcaacaaaagtgggtatgaacctgaaggttttgcttctttgaacagttgaatgatctaattggatatgcatcattaagtttaaaaatttataactattgtggtttttctgctgagtgactttcttttttcaaggcttattagagaatccaagcccattctcatatcctcctgatttccattgccacatcagctcagataaaccattgttgagaatgctgaagtcaagagcacgctgatctttcatagtagaagcaatttcctgttttcaaaaacttgtaatgagatttaaaaaaatacaaacaaatctaatatatccgcagtagagattacagagttggataaatgcagacaaactgatgtttaaactgttgtaaccgtctcgaacatcctattattattttgccagcttgattctctactcagggagtgggagagggtctgg

SEQ ID NO: 38664 - DNA, 3380 bp, Bovine  19866880803428
tgaaagtagaccatgaggctggataaaggcaagtttttaattcttaaaaattaattacatggcattactcttatcagtacacagaatgcattaattatacaattaataaaaagatgaaagggctgtgttttttttttaatttttttggcaattgtaatgcacaaggggacatttgtttttatacccaaaattgtccttcaggcatttctataatcttcttaccaggcaatgtcaagaccttaaaccagttagtaggaatactgaatggagtgggtcttcatgttagcgcttaaacacatttcagaaaggttgtggatttccatgtaattgggatctaaggtgtaataggtttaatttgaggtcctctttaaaagaacaacaggaaaaggcatcttcagcaacgtctaatagccagtaagaagagacaatgggcttccttaaggatgaaaaagtgattatcttagtacagcagtcatttctttgagtgcctccatcatcagcatggcaccaaaaatgccttgtgtgtgctaccattttatccttggaaacatcacagaagaaatgtggtagtgaagacagctggttctcaggagcagagccacaggccaagcccattttaacaaactctgagggattatccaaattctcttgctatcttgcaactatgttttattgactattacttggaatgaatggtcaatcagccaaggctaggaaatctgtttttgttacataaaaattgttgatgtaatgtacagcgggacaacacagtcatattggaaaagtatttgacttagttgacctgccaggaacattgtgtgtgcaaagaacactctacaacttcatctcacctgaaaagatgtctttcagctactttaagactatgttgtgaacacgtgaagaaaatactgaaatagactttaaataaccccaggcatttataattttagaacaaacctggagcgatatcccctctgtaataacaatgactacttcgctgtttgggatagagaagggggaaagccctaaaaatagaaaatataagatcacaattagtgctggtatctaagaagtgaataaggagcaacccacttcctcctctcccattatctctaccagtccccagtctttgatttgaattattagtataaagtgatatccaaactcagcttcaactccctttctatgtaaatctgattgcataggctatgatccctaaatattcagaaatataggatctactatgcgtctctactgccaattctacctgccctcaaccccaagccacccacagacctacacacactacaaatactgtttgtctttcctgtaacctgtcatcttacatcttgttgctttctgcttttctgtccctaggcatatcaacagtccaaggttaatgatgaggcaccttgggaaagtggtgtttgtttagcttaacgtaatgttttaaatgtctttctgtgtgtggcagtctcattgcttctaaaacaaaacccatctgcaactaaacctgcattccatattaacacctcagacacattgctgtagttttgtgggggttttttttgtcatcctgtcctggttgaaaaattatatgtgagactggaggtggcaaacaatagattcagcttgatgggttcaaactttgaaaatcacatttctccaagccttattatcaaagtgatgtgctgtagcagcatgtccttcctaagtttcctgaattcctggtaaatagactaaaggaactgggtatttagccagagctcacttataattctcttggaattataaatatggattttagtcatgttcatttatgaggttttcaattcttatgagagtaggtaacaaaaatttcccctagatattacgaaattctttactttacagagatgaatttgttcacagtatcaaatagggaagaccttttatttccaattatctgtctcacagttaagctaaaaggggagagtagctgtcaccagggcacatatttaccccccgtcccccaccccactctgtgtctaagtaggtaagtaggctgtggctctctttggatagtgttgttgatgttcagtagctaagttatgtcccactctttgcaaccccatggactgcagcacgccaggctccactgtccttcattatctctcagtttgctcaaattcatgtccacggggtcagtaatgctatctaaccatctaatcttctcctgtccccttctccttttaccttcaatctttcccagcatcagagtcttttccaatcaatcagttctttgcatcaagtggccaaagtattggagctacagcatcagtccttccaatgaataaagaaagaaagaaaagaaatacctcaatgaatattcagggttgatttcctttgggattgactggtttgatctccttactgtccaagggactctcagagccttctgagcaccacaatttgaacatggttagccctcagccttcattatggtccgacgctcatgtccgtacatgactactggaaaaaccatagctttgactatgcagacctttgttcccaaagtgctgtctttcctttttaatactctttccaggcttgtcaaaggtttcctttcaaggagcaaacgccttttaatttcatggctgcagtcaatatcctcagtgattttggagccccaaaacacaaaaatctgtcactatttaaatttttccccatctatttgccttgaagtgatgggaccagatgccatgagcttaatttttgaatgttgactttcaagccagccttttcacgctactccttcacaatcagcaagagactctttagttcctctttactttctgccattagagtggtatcctctgcgtatctgaagttgatatttctcctggcaatcttgattctagcttgtgaccactgcaccacctaggaagctctctttggccagtgacatggggccaaaagagtctattgctttcttactaacactttaagatccaatggtcgattcatctcatttcctttcccttgccaagtaaattctgggagttcatttaaaatggagtgtccacaggcttcggattcccaggtggtgcttctggttaagaatctatctgccaatgtcagagatgcaagagacatgggttcaatccctgggttaggaagatctcctagagaaggaaatggcaacccactccactgttcttgcctagaaaatctcatggacagaggagcccagtgggctacagtcaagggggtcgcaaagagtcaggcacaactgaacaactgaacatgcatgcatgtccacaagcttagattagcgggtaacgatagttcattgagattctactggccctgactgagaatgaaaacaaaacaaaagaaaa

SEQ ID NO: 38665 - DNA, 2044 bp, Bovine  19866880810520
attacattagggcaaaactgttaagatcttataattcaaatttggaaataatcaaatttggataaggcatggtagtggtggtagtgatttagttgataagttgtgtccaactcttgcaacaccatgaactgtagcccgccaggctcctctgtccatgagatttcctgggcaacaatacaggagtggattgccatttccttctccaggggatcttcctgatccagggatcaaacccatgtcccctgcattgcaggcggtttcttgcattacagatggatagtttaccaagccaccacggaaggccctgcatagggcataactttcaacaaagtgaagtgattcacaaagatacaaagctacagaattaactggaagagcaatcacatgtaaacaagccaaagtttggaccctcaggaatttagaaagatttctacataatatcccaccatgtctgcttcataggcaggcttacataggaaatttttttgttgttgcctttgctcccagtgaaatttgaatctaaaaaaatccacaactcaaccattccatttcattattgtgcattgattgctcatgtgtatccttctaagaaagcagagaaacacagacggccgttacaaatcctcttactgtagaccgatattctagtttaaaaaacaaaagtggtagaacacaattaaaatgactattgaaacgcatcttgaatcaatataattcctctaatcagataagttagccaagcaagaaaggagaatcatttctctgcctgccatctctggttcatacctactaagctccccctaaaacacaaacaaccgctgaatggtgaatagcaaggataaattgttttgggaacttacgtgaaggtaaaccattctgaactgcagaaatggaaagcaaggaatagaagttgccaagatttttggaacattgctccttacttctgtgttttttgtatctaattagtttagccttttttctccttaggaaatatgagcattacaaatctttctgctgccaggcaaaatactttaagtcacaaattatgacatttcacacatcttccaagcctgctttctttgctggaatactgattacctaaccgatttctagggactctgctttccctcttctctaattggaagctctgttccctcctgttcaataatttaacttgcataattttgctttggaaaattagacctatctaattttccatggttttccaaactttaatgtataattttattaaatacatgtactatatagagtgttaactttattagaaatacatttggttttgatgtttttatattcctttatgttaagtgtaatattttatattctttatcttatctttatattccaaaatatgtgaaataaataaaaaatgttatactttttgaacttagcttaatgaaaacagtgtatttgtttcatctttgtcattcttaccagcatcctgggtcagttgcatcagttcatccctagaatatttgcattattctcttttctaatctttctgcatctgttctattccatgcttattttttataccacccatagatgcatcttcaaaaatagtgtttcaagccttcatgaataatacattacttagaagagaacactgagttttctagagaacatagagttttctagtagttcagagactagtaaaatctggcttcgggttttcctttctaaaatctctcccactcttctccacttatagaaaaaaagtcagttatgatgcccaaatgacattttgcttatattctgacacttgcctgagaactatgcaacttgaaggatcaacagcacatatttacacaaactttatatcaactctgaactccaaatttctgtacaattatcatttacttagcgtttactggagaagactgttcagggtcccttggactgcaagatccaaccagtccaccctaaaggaaatcagtcctgaatattcattggaagggactggtgctgaagctgaaactccaatactttggccacctgatgcaaagaactgactcatttgaaa

SEQ ID NO: 38666 - DNA, 1978 bp, Bovine  19866880849974
aaacatttaaaacattcagaagggaataggtgatcaatacgggttgacaggtctcacatattcatattggttagagctcaaatggtataacactccatgtgaagattaatgaattttccacccatctgttatattttgtgaattaaggacatagtaaggttatagtattcccagagttagggctaaggcccttttactgaaagtcagactgcataaatcaagttgattcttttgaagagtaaattgtcaatgatctaaatttaatatcaatggttcttctttgaaaaacaaagatttcatagttaatgatttatttgaaaactaaagatgttatttaattttttaaagatacctgcaaaaattgttgaaatgcaatgttagactactccaattagtaagtaaaaatgggcttattaaaggtaggccagaaccttgtatataagaaaataaagtatagaaacacatttttcacatctgttaatcaataaacatctctctgtaaccaaaataaagtcataatatattttctaataatatggaaaacttataataaaagactaaaatgactcagtcatgattctagaaatgaggaaataaaaggaaaattaatgcaaagagatagtgtcccaccatccccttttacttccctttatatataatgatcacataaagtgaacaggaggaaagtcgggcttaatttatacagaacagaatggtgacttttgaatctatatttccaaagaaaattagattttgaaataaaaattggcaatctagctaaaactactgaaagtcagtactgaaagtcaggtacagtcaaaaaaagctttaagaaacaaattaatgtggaaagatgtgaaaacaaaactaaatttctaagtggaaaatggccacttacatcaattcttgtcatattagttaagtgttcagttttgctcagcacatgtaaaaatgaaaggggacttttaataaattactacagaaaatgtaatggatcatattttgatttgactggaatttattgtagcttctgtgatgatccaatattcatattttaatttgtaggtatgattaggacataccttttttaagcctttcattttctatgaaggaaaaagacaagataatttaaaaacaacttaatattcctgaaatgtttggcctgagaaaatgaatagaatgtgtcttttgattattgagcagtgttattttaaaattctcatgtaggtcatttcttactctagaattggatcaatcaaaggaaggtgaatcagcaaggcacaaaagaggaagccaccttgaaatggattaagtgaaataattttgtgaacatatggcctggaaattaaattgattcagctaaacaagttatattaaatagatcaggtaattttcaggcatctgatcaggtgatcacaatttaaagcaattacactatttgaggcttgtagaaagtggagactactagtctatggtttatggatagagaccacaaaataaaattgaagttgttagtaaccttttaagagttttccctttatgaaagggtgcatgtaaatacaagattcttgatggaagccaccaaagaggttttctaaataaaatttatcacacatccaagttgtcaatagtttattcatttatttactcacttaaatgtttattgagcactgtctctttttatcctcattttaaaatgttccagttttcaaatttcctattctagactgctgagtcaaaatattatatgactttatatgtatttagaacagaaaaacaggtgtctttaattgataaactttacctgcagaatctcctctgccataatgatattttttttttcttggtcttatcttatgtttgagctcaatgtaaaatacacatttagacattacctctcttcatttggcctactgtttccaaatatataggtatttcaaaattaccagaaaggagctggttactttggtaacttaag

SEQ ID NO: 38667 - DNA, 1114 bp, Bovine  19866880854318
aagagaaagacacttggcattcttttgactatgcctagcctggtagagagaaacaccccatttcagtatcaattctggatttaattcttagctgtggcattaagagttatgtaaacttggatgaattgctttgtcttatctgagcttcagttcctttatcttcaaatgaagatacttaattcaaggggttatataaggagtaagtgcacattatgtgctccaaaagtagtggctactctctattgatcacacaagttgggctgaaaccattgcttcatttcaaaggagtcaaggaaaatgcccttggaaaggaggcatttggttgatgaaaggctcttgaaaaggaaataaattttgactctattctatgtagatatgagtagcaaggaaagatttttgagatagaaaatgacataatgcaattgatattttagggaggctttctggcaatgagaaatccatgaagaattgaacaaggaagaagctggacaaagatagttctgttcagggaactccacgatcaatgtttttaaatgtctatcaagaatatagagttttcttttaaaagcctgtcccatatattttatttgacatttctcaatattctatgaaatataaagacattaatgccagatctttacatagtgaaagtaacagaaaaaagatattttctggcaataactgaggaactgaatgaccttcaccttccattagcaacaactggaatctttgaagtggcatcagtaagaaatgaacaatgagaatgagaaatgaccacaaaaaggaaagtctattaggaatttcctgtaaatggcaaggagtaaacataaaattactttctttcaaatgtgggcatagttataaaatgcctggtttgacatcagaaaatatttagaaattttaaaataaaggaagcaaacataacacagaaaatcatctcctattataacagcaatgcatctcaattccatgttggtgagagctccaaccaaaaatacattcacagtttcctaagctggtatgtactttagtgtttactctattttctagtattgagtcacatatgcttcaatcaccagaaggaagcatttatcagcttggaaaagttcctatc

SEQ ID NO: 38668 - DNA, 2686 bp, Bovine  19866880901092
atccttatagctttaaaattatgtgattctaaatatcaaagatgtttcaaatttttccttcttttggctctttgaatcaacatttggacatagacttaatttgacagtttcccccctaaaggggtattagattaatggatggttagaggtagtttatatattctatccccaaagtaaagctttatctgacatcctgaaagggttctgggtacattagggaaaataacatttccattccagattcaatactgatccatcaaatctgttcgcctgctgtcagcagaagttattgccagatgcttgagagaaatggccagaacattcctgaatgccaccagttagctgcacagaactcagctgtggggaacagttctctcttgttcctccagatactgcttagacattatgaattattagctttaattatatttttagtagcatggctctgagagtaaggatcagttactttcaaatcctccacaaataagttgtaaaaacccagtcacacagttagcttaactgtttcagtaatagataaatgttccaatgtgttctaaataatcccaagaaaatatgctggaatctgtgccagtttatttcccacttctggaactatattgctttaatgaatttcaactttttaaaaaacatagattttgatgttttggttagagagtaagtccaagtagcttcaagttcagagtgaatgagtatggatgcatgaggcatgcatacgtttacatttaaaattattttcatttttaataatggggcaaagcagagttttagctaaaatgatggcagtaaaagcgatccccactgccaagggtgctgttttggcttctctaaggttgaactagctcagagcatgaataggcaacttcatgagagatgaaacgccaagtgctctaaggcctaaatcaaataaagatctagttaagtgcctaatgaacctctcaagcagatgtggacagtttcaatatgctaactattgtataaggttattaggcagaaaatgcaaaataaaatcatattaaaccattacactagatatggaaaatggacaaagcagaatggagacttttcaaaatgcttttggactgaacttcagttcaagcttttagcatatgtaagctctgaatggcttcttttaaaaaatgatttcaaagatagttcagacttaaaccaagttaaatcccaattgtttcagctcctgttagagatcttactttttgattcagaggaaacaaaaattttaagcttcttccaatatctataaattagaattaaatctgatcctgttgaaaagaaacagctatcatcttttaaaggtttccacctagtggcaaagttattatgagcaagagataggacctcgatgattaaaacaaatagacacagtctaattacgaaactgtttaacccttactctttagtaaagttgagaactgtgcattaaatacattgcagatactaatagcaaaagtaatccactaaccaggcacttagaataagacctctttctcttgggttcacttagattgccagctttgttatatctttgtgccttctgtgatttatacgattgaactatattaaagataataacaaagaaaaaggcagagaatacacatgttttcttcataagattttgtcacaacttcactattgacttatgtaacaaaatcttataaagcacttggaatagaatttggaaatatatctagagccaatactgcatttaggtgacatactcttatggaactgatcctagaattgtaaggatgatacttgtttaccagtgtgaccaaagacttccattacttaggtgaccagatgcaagaaatgcgggttttaaatgtttacactatttaaggctatctttatttgaagtatacattttagcaacacactctgtaaattggccagggagagagagagggagtatccatgatttggatacttcctgtggacaatcaatcacatgtaagattcataaatccagtgattaaaatgaaaagagtaccacagacacttacatgtaactaacatagtctagcaagttaccttgtatgtacattaatcatacttagtgtagaaggctcctatcagtccaccttaaggaaaagggcaacatagtgactgtttcacattactttcccaacattttgctatgttgttttcaggtaaaagtggctaaagtcggccttgaaatgccaaagaaatactaagtgcattcaggcacctgagctcattgtgcttttgaaattgctccgttttctctgcaccgagtacactgaccactgaggttaatcgtcatcaaacagggctttctgacctattggaaatttagatcttagcttactttgtgttccagcgtcctgtgctgatcttcccagcctataccacgagctgtagaaaacaattatgggcttgggaagagatgaagccaaagagagcaagattagcgtcctgaagtttgccttttctccttttcttcacattagtgtttttctccacaatgagttaacagaatacggtggagaaaattctcccatagtttaagaagttgaacctctttccttgcttaggtgatagcactgacacttcacacagagggctaatttacatttaatgctcggaaattaattacagaggataaagataatgtaaaatcacccccata

SEQ ID NO: 38669 - DNA, 987 bp, Bovine  19866880935805
ctgattttatgctcttttagtctcctgctcaccatccctaacaagcggtgatattacccaataaatcaaagacgtctgcttgtcactgccagatgcttggccacatcgccgccgattatgagacatacaaaaggacaatttcatgtagggagctcagcagaggtgttccactgatattctgtttgataggaaatcagcgtgaggtgaatgtagtaaaattcaataacttttatgccttatagcaatgaagaactaagtttaaataaaactgggaagtaaattaggacctcaccttcattgattctttatttattctttttatgattctaaatcgcttcctttatcacttcaatacaggttagagaaagaagatatattttaatgtaatcagtttatttttctgggtccaataattcagcttcctttcctcaatgcatcaaaaaggacattttcatccatttattaaaacatacattatttctaaagaaatatgatagcatagtaaacttgtgtgaatggtaatcaatgtacaagaactattaaaagttgctttcaactattcaaaactatccattaggtattaattgcttgcattttccaatatttgtctcattagccaaattcctgatctaccataatgtacacataccttttttgtagtataaataagaacaataagagcaaaatgaattcatagtgctcaaatgactatgcaagatattttatgaaatgttccttaataaaatattgaagtttaaaagaaatacaagaagttcatatttttccttccttcaaattatggaaataaagtaaagtagagatatttttccttaaggaattactgtttttcttcccagagaggtatatttatacattgattatataactatattaatttagcatttttgcaatattaacaaattaccaaatacagcctatgtaataaagctaattttatgtagaattacaaaaaggcttatataatta

SEQ ID NO: 38670 - DNA, 4519 bp, Bovine  19866880949525
aatttactttcttgccttgagggatgtatatgcaggacaattaaattcaaactgaagtaacagagttatcatgtcacatattctatcacctttcataacattcaggcaagaattgggagaattgaatatctctaaaactgtatttgtaatacaaggtaatctacttgaatcatcatgtcactggaactctaatgtatgaaactttatactggttcaaactaaaatatccccatggtagtgtttgtatatctctgcatcatttacttcttatttgtctgtgaactgatgtgtatatactctatttaaatgaatgaaaatggtaaggatgataaatactatattcaacctcaacacccacattatacttcttttttatgctgcctttacatttgtaatactcaaatataattccccaaactatatttttcctgctactacaataatttatgcttatttaactgtctctttttgactatgctttatttgaaggttgtcctcattttgtcaaaaacatatcaacaggggagtttaaaaacatatacttataaccaatataaattccaccttatcccaagagtaaattcttattttgtattatttactattctagaacttaaaatatcactgtttgggaattttttttaatggaaagagtattaaataatcaacaagatgttttttataaatttcttttatttaaaatgtagttccacagactaaatagcattataacctggttcaaatctattttgttggacatgtagaagcacatgatcgttatgtaggctatatgtccatttaattttgataaggatttatactattagaaacaaaaagctttgtgttttaacaattaccatgtgaataattatcataattatggtcctaatgcatcaaagtagagaacctaatgtcaaacttcatataataatagacttatgtgattcttttgaaaactatagtgcaagaacactaagaaatgtcaccataatgttagaaaagagtgtcattttctcttgcatttgggaaagaatcaataagtattttactttattttttctcttttatatatgtctttttactttaatttttcactgggggaaaattgccctacagtgttgtgatagtttcttccatacaacaatgcaaatcagccataattatacatgtatcacctcccttttgagccttcctctcttcctctacatcccaccactctagctcatcacagagctcctgactgggctccctgtgctagagagcaacttctcaacagatatctattttacacacgagagtgtatatatgtctatgctactctctccattggcccactctctccttaatgcactatgtccatgagtccgttctctatgtctgcatctccattccttccctacaaatagcttaatcaatactattttcctagattccatttatatgtgtgattatacaatatttgtttttctctttttgacttcattcattctgtaagacagattctaggttcagccacctcactagaacggactcaaattcgttcctttcagttgtgtgtgccacgtcttcttcatcctttcgtctgtcagtggatatctacattgcctctctagtatttgccttttgttgctacatttcaagatactgttaatgagtgtagggtggatacatatgaagcacagttttgtaggaacttactataagcctgcagatgattgtaagacagatcaagtaatgtgtctttggagagtacgagtgttggggttcaaagaaaggagagtttgtgaagcacatggaagggaactttttgaagtgaacattcaaatgtagataagcatttggcatgtgaagatacagagaaagtaagtggcaaagagcaggaagattaagaaaagaaagagtgctggggattggtggagtggttctgtgtgtatgtatttgtgtgtgtatgtgcttgtttgtggatgcacgtgtgtgtgtgtgtgtgtgtgctggagtacacaagagagatgattctagtatgcacagaatggtccatgcattttgaaattttaaaaaactaaaaaaatttaagttaaaaaatctaggatttaaaacaaatagtgctacaaattaaaataactgttatgtatcataactattcacagtatgtcaagaacagtttggcacatggagctgtgaaataaacagcttaatctgttggttatgtgcaattcttatattttatttgtgttttcattattatctgtcctttttacttcctcttctcaagaaaaacattttggaaagcatgggaatgaatgtgttgcatgcatgagttcacactgaatttttttaaaagtatatcattcacaaacttaaggtttaaattacaattgataagtaatcatagatgatatacttcacaacagttgtagtatgggagtctcctaacatattctggaggccagagacaatgaggactaactggagatttcaccgtctctaagattaagtaaagcaatggaaattgtgctttggatatatggctttgactttgtgtgaaatgaattggattgaggagagtttggcaatctaaatagagaagatgaacttttaataaaggctgatagcaatggatatattaatagaaaagaggaaggtatacaagtgtgactatatatggaaagaacaagaacagtccattaatgacaggtaaggataaaagaagtttctgagagtagattgctgacagcatggtagtgaacagaaataaggcagttagaaatagtagacagctggatcatatccagtgttagataaatgaataggatagagaccaagatggcctactgacaggataacatttaattttgaatctggagagagaagtgtaactataatttggaggtaatagttatagaaatagattaaaggagcagcaaataataaacaaagaagaaagatgaggactaattattaatctaaagtatttttatctaagtaatgtatctatttagaacaaagagaaagaggaaggaaaggatatcaaaggaactttgggaaagaaaagaacaagcatgggataattcaaaataatccaaagggaaataaatgtaggatgaatgaagaaggaaatctatcaaaagctcaaaggttatagagattgtgctatgagaaaaaagctatcatatttatcaatttggtggtaaccacaggacttgaaaaaatctcatagcatataatacctgagcattatcaatgtgccagaagttgtactagagtctgaagttataagtatagggatgaataaagaaaatataataatatataaagacagatttttgtactcatggtttttaagtcacagagataatggaaaataagaaacgtttatgaagtgaataaaaggcaaagacattaaataagtatgtgtatattacaagaaggaggggaaaaaagatctgtagtatgaatatacctttgtttttcgaggcatatgtatgattatattaaaatagctttcttttctcttaaacaaaactaattatctagttgttagagttctttgttgttgctcagtcatgtccaactctttgcaaccacatggacggcagcatgccaggcttccctgttcttcattatctcccaaagcttgttcaaactcatgtccatcaagttggtgatgccatccaaccatctcatctgtcatccccttctccttctgccttcaaattttcccagcattaggagtcttttccaatgttggctctttgcatcatctggccaaagtattggagcttcaggttcaccatcagacctaccaatgaatattcagtgttgacttcctttaggattggctggcttgatctccttgcaggccaaaggactcacaaaagtcttctccagcaccacagttcaaaagcatcaattttttggtgctcagccttctttatggtccaactttcctgtccatacacgactactggaaaaaaaaaactgaccatacagacctttgtctgtaaagtaatatctctgctttttaatactccttctaggttggtcatagcttttattccaaggagcaagtgtcttttaatttcatggctgccgtcaccatccacggtgatactggagcccaagaaaataaagtctgtcaccatttccattttccccatctatttgtgatgaagtgatgggaccagatgccataatcttcgttttttgaatgttgagttttaagccagctttttcactctcctctttcaccttcatcaagaggctctttagttcctcttcattttctgccataagggttgtatcatctgcatatgtgaagttattgatatttctctcactattcttgattttagcttttgcttcatccagcctggcactccacatgatatactctgcacataagttaaataagcaggagaccatataaagccttgacatattcctttcccaatttgaaccaatctgttattccatgtcggttataactatgcttcttatctgcatacagctcataagatag

SEQ ID NO: 38671 - DNA, 1062 bp, Bovine  19866881030022
tccatgaggtttcacttgccctttatatctgatgtccctttaattaatttgtatcatgcttcttaaaggacccggcacggcacccatataccccatatgcactcaaagtcttaattggaaataatgataatgatcaaccctcatgaaacattttaaactctgtccttgttcacctggcaagctgtgaacatgaaagatgggcagagaactattcactaggaagcaaaattaatgagcagggacaatgtctaattctatatatttttaatcgtgtctattacagttctcactcaatgcaaattaataacattaagaacagaatttgtagttctcttataagtccatggccaatgtcctaaaagacaatgaactgttaggttacaacagtcatatttttcatttgttctttttttccttctttcagcttttccttcgaaatgttgaagaattattttaaagtacttcagaatcatcaccattttcccatttctttaagtctatcaaaagcagatgacatattggattctcttccagggcatttcttatggatttataaagctattttcatataaccttgacgaaccatcttcatttttattctgagcgatttctcacctctctgagatactgcttcacttgcaaaactgtgagttgggaagaacccaacatggtaaaaacaaacgtcatgacctggatgtggcgcacagacctttccagggtcagtctgagggctcagaacggggatcaagtaaatcctttgtttttcctttttctctttcagtctttgatgatgtgtacaaatgcacatgaaggataaaagtggttacagagcttgctttccctttcaatggcctgtctcaaggagatcaggggagatgacatattttttggatattcttaaactctgcatcggatgttattttacacactttttccataagacagttccagtgatagaaattagtcattgtaattgatttattacctaccctatgaccaaattatgcttgtttagaaaaaaatctgatacatacatagacagaaaaacactggaatgacatg

SEQ ID NO: 38672 - DNA, 1219 bp, Bovine  19866881047087
cttgtatatgcttttttggaattcttttcatatctacttttcctttctgtattgcctatcactatgctaattcagactctcattaccatttattagaattaccataagaacagcctcctaaatattctctctaatttttctcatgccatatcgtctacaactaaaatgaataatagttactattcactgaagatttctaatataccaggtatagtgctagatataggtcatttatattgacaatgccctttaaatagagattttattttctttcccatgtggaaactgaagcactgagagattaagaatcatgtctaaaagtggcagaactgtaagtaaaaaatccaaatctgtttgattttcaaatgtcttccagtggaacactgcttctctctttctttctcttaatcagtatgagaagctgccttgtgttaaaattagagtttccttaaactctctagtctattgtatgctccctgaggacaggagttttatgtgctaacacaaaaaattgtcctgaaaattctaccaactttaagtcatttacgtgtcatgtacataatagaataatgaaaaggataaattttatttcgaatttgcatcattaattttttattttctctgagattgtatttttattttaagtcaaacatgatctttcatctttgaatttgcttaaaatacccattatttaaatatggcataaatatgaatatcagctccttcataataaaaatctccatgattccaaattagtaaattaaaatattaagaatgagattatttagctgccaaaattgagccttcaaaattattattattttacatggagattcaatatcatcagtacagcctaaggcacatattatttttataagcataaaataattaccttaagaagtagaaatataattttacatctattatattatcctagttatatgtaaaatatgcacagaaaaggactgagaggatatggcactgattgaaatgttaagtgcttgtaggacagtgggtgatttttttcctaccttcagcctttctgcatttttgaatttttaatttatttttaaaaagttttattgagatacaattcacaggcaataaaattcacccattttaagtgtaacagggtagttgtttttagtagatttacagagttatacggttgtcaccattatgtaactttaggacatttccattatcccagaaaggcaca

SEQ ID NO: 38673 - DNA, 1830 bp, Bovine  19866881111743
ataatgaaggatattttgggaaatgatatatgattggattagatatcgaatataaaattagattaaaattatttatttttcaaaataattagattgatcttcttattttgaagactgttcatttcacttgttattagttagaaatagcatttgaggtagtagaatgaatagttttatgaaaaatcattttcttttggaaagttttccaatattcatatttctaactttgtagtgattatttgtaggcttattcttatttggcttgaggaaaagattttgttcatatgaactgaaaaaattaaaaactttgatactatatataaaaatttataacttaaagatacagcctttatgcttaaattcagataaataaggaacacattttaataagttgtcattcagattaattcgaaaccctcctaactctgtgcatgtatttccacaaaggtcagttcttacaaggaaataatttaatatagatgaaacttgttagccccaacatcacgaactaaattttctcaaaccataattagctaaagctaaatgcaagaaagcaaaaattataacaccgtttttattaataacaaatgttacttgatcttagtttctgatgttcattaaatagaaaagtaaaaactacttcatgttcatctaatgcataaattttaggtatccaggcaaatgttaccatttacaaggaattaataaaaatattttaattttctaaacatcttaacattttaccagtttagagatgctgtgctgaattctgcttgttactgtcttacagtaaagggctcattacaccagtgaagatttctataatttacagacttgtataccagattctctccatcttgaagcctcaatcatgagaactttcctcttaccttcctaaggatttatcatcctaattttttgagtcatcttgtcagactagatgctaaaaagaaggcccgacagtatacaagttttatgtgctttcaattattcagctgtctgtcatcttatgtggaatctggacaacccagatcaagtgaaatgcaataataagtagcagcaacaagtaaacctaccccccatgataggcacaggatagaaaaggtgttaggagcatgctattcagtaacaggagagccacactaacttctaatcttacaaagggatttgtattgagacctgcaattacaaattctaattacacttgcacacccactatctctctgcaacagaaggttttgaagcctgaggatctttctaccaatcttacaaataattaaatggtacttcaaaattatctgattccaataaaacccatgaaataacacaggaaacagagctttggtgatgccattattttggataaggaaaagttctttcctccttttcaaagcatttaccttgtggtccccctgcctttccagctcttcattctctccttcacaagttcaactgtttctgccaaggtactgctgtcataatttctccaggctctatccaaattcatttcttcttttcactctatacttgctccctcacaatttaatgcatatccatgtcctcaattgttctctacacatatctctccagagctttagattcataataccttaattacttgaaatcttttttgaatatcatggctgcgtgtcaagtccaaaatgtccaaaactgagcccaactgagaccatgagctcccaaagatctttagtaaattatgctttttcctcctggaattatttctcctgccatcttcctcctgttatctcctgcatattcattaatctcatcaatttctaggtcttcttagtaaaccaaattctcttaaac

SEQ ID NO: 38674 - DNA, 1538 bp, Bovine  19866881177375
tgaaggaaaattttgcgatgcaatgcagagaatgactgtcatcacagatactgcgaagttaataaagattaatgcagagcaatataagggactagcaactacagagtggagcctaaggagttaggcatttatttaaaatgcagatgcatgacttatctgtgtgtgcctcgtctgcaagtggatattaagcagaatattcacctcaatagtcttctatgaatcttcagtaagagtatctcacagtgaaagttcaataaatgttagccataactattaatgtgacttagagaatgttttaaaaatgggaatggaagtgggaagacctgagaaaaattgttggattcaatcatcagcaagtctcaggtgactttccaagggcagcttccgccagctggaaaggaaaggcaggaaggcaaagtgcagcaggttaaggggtaaataggcaataaatacttgccatgaagaaatcaatagaagcagaaatcaatgcagccaaggaagttcatccatttcagacttggagagtgaaagtaaaataataatataaagtaaaatggtaatgtggtaaaaacaggttttctctcttttaaggaaagggtgattcttgaaagcagagggcatttaagtggcaggggtgagagagcaggttctggtgagactgagggtgctttaggttaatgctttaagagtcttgagtgaaactagagggaggctcagtcttaagagcagcatgccatcagatttatatcctgcaggatcaagggtatttccttactagacagagtagcttcccactatatctaaagctaaaggaccatgaagagtcatatgacccagactaaaggttgctcagggatatggcattaatgaattaagttgcaggaccttagaatgtgtttagctgtcatttgagcaaatggttttaagtaaagattaagccccttatggcctgctgctggaaatgtaactggcatcagtagagaaaaactaagtatggtaggtatcaaatatgactatttatgccaaatagatgtatttaagctgctgctgctgctactgagtcgcttcagtcgtgtctgactctgtgtgaccccatagatggcagcccaccaggctcccctgtccctgggattctccaggcaagaacactggagtgggttgccatttccttctacataagaataattatctgttttatttctggcttccatacaaaaagtggccttcaacagaaaatctcatgtttactcttcaggaacattttttatgtctttacaaagagtttgagagacttggagtgtcattttctttcatgtcaaagacctattttaaaggcaattataaaatatagtagcaagcagatgtccattcttctaggctgttgtgatgagtcaaaacaaatctatcataacaatttgtattaaactgtgtaatctgctcagtgaagtgagtaaaatatatggattacagacagtatccagagggacatgattacagaagttataaagacagaacaataatagcccttgtgtggctag

SEQ ID NO: 38675 - DNA, 737 bp, Bovine  19866881240819
tttacagaaagatgctgaaaccaatccctaaaatactcccttgataaataaaaaggttatataaaactcaatatttatattgtagtcttaagaaaactttaggatatacagatatatttcacatcctaaaaatggtgaaatgtttggtattaaaatgaacaggcagagcaactgaaaactccattaaatagatctgattttaaattccatcaccaacagaaaatgactctggtactcccaaagtaataaagccaagagttctttctgcgaaactctggaatgcagacctggggcaggtgaaagttacagaaaggctgatttcatcttcatataaggtgggagtgatgatgcatgatgagatagagtgcttccaggggctatatacaattaaatagaggatagatagcttctgttagacaacctagaaaaggcttctgactagaggttctcagtgtttttccccacattgaagattgtataattctgtgcttctgtaacctttgtagtgaccctgcaggaatatttgagatgcaaaccaaatctattaatatactttgaatatcaagtccttattaagcattttttaaaaaaacttgtcatgctcttcatgaatgtatcatgatcacttacacatgagctctcacatttggagtttcctaagtctcaaacatgctttagctccttctcttttccagcaaatcctcaatatactataggtcatcattgtgaattacctt

SEQ ID NO: 38676 - DNA, 1267 bp, Bovine  19866881257859
aatttaaattaattggtcacatttaaacaatatcacaaaaatcacatttgatttatcttgaaaaactggaaggcatagaaaaacatttatattatttcctgggaaactgttaataactattgccctctttaggcaggtaggcactctttaggtgctaatacttaatgtgattatttgtttgtaatgctaactttgtcctctccacatatttatactgctttgtcaccctttacactcactttagactttaccactgagggtatgattcctgtttctttggaaactcaatgataaagggtatacaggtacacacaaaaataaaggcatatcccatttactgtcttttaaaatgaagtggaagagagttccataaatatgagtaataaataaatcaaagtcttgacagcccctttggagatgcattctctacaaagtgattgaaaactaaattaacataaaagtatgggataattgactctccctcactctatacagatgttgaaatggtagagcaagcagatagagcaaggtcccatatccatctaaggttcacacatgtgatgctgcatgtcatcctgtttgttcactatttgagaaattgtcaatatatttgttgaaaatcaaatagaaattatcattagcttagaaagtttgttaatagcaaagcgactcaagagcacaaacaatgcagattggcaagtgccattcaaactgagaaaagcacagtattacactatactaaacagctatgaataattggtgctctaaggatgtatacctgtaaatatgccattaagcacactgctataatagatgcaaaaagaatggggcataatggaggacaaaagatagagatcaggaaagattaattctagctgggagttttgtggagaccttggaagagggtgggtatgaacagggatttaagtaaatcaacataggctaatgaagaaaatgaaaagatgtataatcgctcatcactcaggataacattttttcttgatcctaaattaaacttgcacagagataaacatttatgacaattagggctacagcctgaagcattttggctcacaaactaagtgcaatggttaatgagcaaagatttctgttcctttgcatgcatgaatactaagtgtagaatttatcattcactaaatcatatccacttttttcttatgcatttcaccagtggttacatcaattgtcatttaactgctctaaataatgtgttctcttccctgttgaattaagcttttcctatcaa

SEQ ID NO: 38677 - DNA, 2149 bp, Bovine  19866881371289
tgttttaaataatagaagtcgctttccaccctagtcgaaaaattgaaccattgattgagtaataaatgaagtcaaggaattaacatgaattttgttaatatcagtgtgagtacctaagaaatattcatagtttcaagatgcctaccaaagttttattgaggaagaacagtgatcagaatttgcttacactagactatatatactatactatgtatactgcataaattctgtctcataaaaaataagtatggtaagttcttgataatttttgaatctgagttatatgttttgtaactttgaggataaagttcttcaaaatggtgcctttttttttttaactaggaaaattctgtatttagattacacttatcattctaattgaactttcaaaaaactcaaccttgaacttttttaactcaatgtttcaggggtgggatttatgcaagaaagccacctttagggctcctttagaatctactgagaagaaaagcttgattctacataaatatgttgacacaagagtatacatttatttgtttactttatgttcagataaaatggtaaaaaaaaaagactgagttgtagcctcatttaacatgtttcaatttttcagaaaaatgccttttctttgtccttgtactgtatgccagaacacactctgttggctgcctcctgtgtgtgggtagtgatacatccttcagcagggtttccctaaccacccatcccctccccagaatacagatattttcatgtatgttttctataacaacatttaaagtattttatgtttattacctgttatattgccagcattggcaaatatttgttgaatgaataagtgaattaacatagaaacaaatactgcttttaagacccgggaaacccaagggatgaagttgtgtctgtatagtctgctgctcaatgcttcctagtatataggatcatttaaaaataatagagatcaatacaatattgtaaagtaattagcctccaattaaaattaataaattaaaaaaataaaataaatttaaataaatatattaggagatcaaatcttgacttctaaaacataaacacattcatctaaagcctgatctactctgtgaagcagccatattataatggagtctgtcacggcttagaaaatattgttctagttttgtgcccaagcctgagttttctatgtaacagacaaggtacactcagtgatactttctggtctccaacaccatcttctttactgttgaacttccatgttttacaaaggacaaccctgtgtcgaatcatgttaattgtactgatttcttgttaaacactgacataaagaaaagatgaaggtaatttaccaatacttgcagcctaagatgtctcatgcataagcatttctagtctcagtgttatgtatcttgttaagagtaaagtgaacatggatgtaaacaaggaagagttttgcactctaaaaatgaagaaaatgccatgtagagcataaacgaagaaacttcagtatgtaaccaacagagcatatctgtcaaggaagaattcattgcatattaatcacagactggattttataatggtttatacttgtttcaaagtcctatttttgcaaccccaagttattagtgttttttcctgattaaattggatttcttccagtacacctcagaatagtgagctagatttcttcttttttctttatgtggcaaaagtaacataaatagcaggtattaatataaagattttccttcatccatccttaaaattttaactgaaagtttcctccctgtattaaagtattccagccacttgacaagataatgctcctctgatgtgtatctgatctaacccttgtctttgtcaggaaaagagagatttttcatggagatgtctcagttttaaagaatgcagtttgtctctttaatagtcagtgagggagttgtagtgtgatatatgctgtattttggcataggcatatgccatgtaaaatgaagtgcttcatttataaagtaataagaacattagctaaatttgtgttcctaaatataaacagacaagtcaaataaaggttttaattcaaacaaaaaatcccaacctgtcacattgttaggtttttgacagttgcgattgatggtcatctttcatcagtcac

SEQ ID NO: 38678 - DNA, 2983 bp, Bovine  19866881532840
tctccaggttcacaggttgtatcactgaacttgtttttagtgctgaagaatatttgcttgagattttaacttaggttctttggtaggatttgacatatatcaggatgatctaggatgctgccttcccaaaggaaactgccttccaaagaaaattgtatagcctcttttctgggcaggttaaattgcagtagctaatatttactaagcaattactatggcctatgtatggccccaaacacttgtattagctcatttaatccttcaatggggaaagttttatcatgcccattttataggggagaaatggagtggggatagaaaaattaggtaaattggccaagctcacatagtgctgtaagtgacagagatgagactgaaatttaggcagcctagttagaaatctcctgcattgcagacagacactttaccgtctgagccactagggaagccccagttataaatctatgctcttaactactgcctctgaagctgtgtatgcaaattacttaaatagtatttacttcattaaaattggattcaattttgcaggaaaaatcagcaaagtgtttattaacgcattaagtatatagaggctactttacagatatgcctgagtcattcaggagttcaagtccagtggggcattgtaaactattgagtgataaccagaaattacactttcagccagttcttttgcagtcttcgaagtgtaatccaaatctgtcattctataaccctctttggaacactttctgcatctttctttggaaagccaaattgtttccagggatcgtcaaaaggagaaattgtaaacaacagatttttactaacacattgaatcactctctataattttgaaacttgtataagtggcagatagtcatttgagaaggtttatgctgtctttttgacttgactaaggtgctaacaaaagaaatgggtcatcaaagtgtaattacagattgtatgtattttataatagaaagtattgtctgagcctaagggaaaacaactgagaaatatttttggctttccttttcctcactggcttaattcaaatgtggaccactgttgcgttctggacttcctctttaagttcttggctgaacgtaaggggggctgatcatgagtaagataaaccagaaaacctcccttgattctcgccttcctactggggtgtggatatggtggcctgtttaaacagatgattacaatacctcacccaggagtatagaagccaggatcagtgcttctaatgggaaagcatttctcagaatgctgaggaagaattaaaatgtcaaaaatcagtaaagccaaatagattggagagaaaacgaagaactccccagcaattgcccagtgagattaagccagttaaaatgtgttttggtttttttttttttttttcattttgtatgcttttcttttttattaaacgattaaacaattttgctatgtgaaaacattctgccatgttatcattcatccaaaaagcaatttcttctggctacataaaatgccacatttgggctgtcccagctaattttataaaaaagatcttaacaagttatttggaaaattatactacaaagcatctatattgatttgttatcttccaatgctcatttgaagtcaatttcgaagttcaaatagcaaataaatgtttatatgaatggaaaaaaaattttttaattgaaatagccgtatgcagctaaagtgcacagatgtaggccacgggatgaagactccaggagaaggggtggggagaggagagggccagggctctgaccaccttcatggtatgcccagtgagccagagaaaaaaagctacttgtttccttctcatggtgatgtatctgtgacagttgattagttgaaaactgtaggacaagcattgtagacacacactgccaggctgctagcaacagttagtagaactcagacatgaaggtacagttcttcgttagtttctgctgttatcttaaaacaaaaaacaaaaaacaaaaaactccatactcttttctggattttcattaaaaaaggaatttgaaggaatttcaatgatctgtttccgattagtcatcacatattagatgataataccaggagaaaaagataatttttaccactgtatcctcccacctcttatcttttattattgactccagttgcaggtataaaaaataagaaaagtaggtctgagcaacagtatacataattaaattcaaaaccatctttgtaaaaacagaacttttttagttactcatgagaagttgaaaaaacgaggaaaaaagtttgattaaattccatttattgacgcattacatagatttcccctaaaaatatgatttattgagggtattatagaaaaaataaagacaaaaagtgtttggcaaagcttttcagaagaaaatgtttttgtaaacactaaggggaagagaacaagaaagtccagtgagtccaatgagatatgtagcaagcacttgacaacggtaagaaaaatagcatgagggtcccagggccagagaagtaactggtgaccataaaagcctatgatttaacatgacttaagatagcattttccagctctgataagggaagagaaatagctaaaatggaacttgagatagatggttcttgtagttttacctaacatgactggatgaggggagaattacaaaaagaatgtttcagtgtgcagagtcaaaagaaagggcaaaaggatgaaacagaaaagagaaaattgaagaagcagagtactttataaatcaattatttcccacaacgtatttacttgtttgaagaaaacaaacctgctaacagcactgtgatgtattctaatttatctctcttctacagtacaatttctttagctgtaatttaaaatttaattatgttcttaattagccatttctgctcaaggagtgatatgcccatagagtggcagtaaacaattattaattcaccaagttcacattgagcg

SEQ ID NO: 38679 - DNA, 1381 bp, Bovine  19866881624530
tgtggaaatgaaaatgaaaatgccctcagaaatctgcttcagcaaaataggccaagttaaatgttgaattttaataacatactgttaatcatgctttcctttctgtcttcgacaactatgtacttacacatcccagattagaaatggaactttttgacatttcctaatattttaaaatgataaactgagattaccctttggaaagcataattgttagtaataaaaagctgctatatttctctactatgaaagatgtgttttaagcacaagcgggatactttgtgtcttggctgttcttgcacatcagttaaattagaatgctttgatatgttaattatttatcattttaaattatgcatcttcgaaaatcaaagaaacacataacctataatttattattcatttagcatgaaaatgtgtctttatgtggcagtttctcttctaggtacagaacttctgttttgatgtaaaacttatcaacatatggcttcaaatgcaggatagaaaaattaagttatttgaaaaacttcacacacaaaatctctagcaattgttttccaatgtgattttgccactttatatgtcttaatgatgttctaaacctgtgcctctgtggatagagacagacccagatacagatacagtataattaggtatggcatccgcatctgtgtcgttgcctgcacctctatctatgtatctttgtgtatatgtatgtgtttggtttctgcaaaaataaacattctggaattcagacaaatgcatcaagttcatagcatgttgaaatgaatagagggctctctataaataatgaaatatataattaaatagcgtttcctctacttctaacaggcaagattctttcttatctgtctttacagtaaagggagccatataactagaaaaatacaatgtcctttttccctaaaaacaatctaaaacatctaaaaacaaatgatctaatatcagcatctaatcccttaaacaaattagtacaacatacatcatgttaactgttgatgtatatgttagggatcacccaaagaagaaagtgataaacacgtatagaaacggaaagggcttgctagttaagaatttgagttatttaggagtgtttatgcaaaagtttgagagacaagcctgaggaatggttatactacattatagtttttccccaactttgtttaatgccgtattagaagtgataactatcctttgtcacctaaccattccaaaagaaaaggatatcaaatgtactgaatactttctagttatgaacactaactattgagctccatttatgtttcatatcctttagagtatttttctacaaattaaactttagacctttttaataaagaccttgccccttctaatgtaa

SEQ ID NO: 38680 - DNA, 991 bp, Bovine  19866881653436
tttcccaggtttgttgtaatcataattctccataagacctcagaaagcttaaaaagtatttccaaatctttcctagaggaatacattttcctctatattcattcttgggagagtgtacctgcactttttgtagagggtttttgcatttgaaagtactaaagcgaagcctatctgttttcttttcttcatctttcttcccataatttaaagaatacaattgctttatttccaaagctgctctttaaacaagtccaaatcatggaattctagaattttaagcatcttttatatatctgggaaatatgcagataaggggattggtgggcttgtgttactacagaagtgaaataaagtcaccagccatgaaaacacaggataaaatgaacaacaaagggaagccgtggcaggatgacaaagagaagtcgaaggagattgtgattatttaccctggcagagaggccagagccacgagtaatgggatggaatgctgaaacgtgaggggaagagagagtcttgatagaatgtgggtaaaaaaatgttctgacaggagagaattggattcagaagtactgtcctaagggaaatggtggaaaatccattactcagtacacgtgtaataggacaggaccaagctctggaaactgtcgtaggtagtgattctgtatcggctccctggggaaaagtggagaagcttttggtgcaatctgatttctgtcactatttttgacctgttccaagtaacttgaccattttttaaatttatatacatgggaaactgaaatccagggaacttctgatgaaagaaagatggaggaagtacaatatgcagtgcctttaccatgactgatgagtccagatatgattatcaggaggatggcggtaggacacagtcatggtcgagtccagtgaaccaggcggtgccctgaccctcaaggattgtatccagccatcgctgatggggctgtccctctgtaatggaaggggatcgttt

SEQ ID NO: 38681 - DNA, 1001 bp, Bovine  19866881797375
gggaaactgattgtgtaataaggaaatgggggaaaccttcattttcttgaatcatttcaaataacccgtgaaaagcacaggataatacagcaaggactggcctctggagggtattagatgacctacagtaatagatcatttccatccttaatgtctgtgattaatatgtcataattttgaatggtgtattcaggaagaagagagctactgaatactaatacaaagagacaagccatagcacagagaaggggcgtgcaatactagtgactgaaataataaggctaggaagagtgtatggagagatcttctcttcataagagattggttaaactatgcttctaagattattctattttcttcttatgtgtttttctctgcttattagctttaaacatgttttagcactaagctcaaaatgtgactataaaaaaataaagcaggtccagcagaacatgatatagtttacctacaatttttaaaaataatattcaatgttaaataaaggtcaaagaaaaaaatcaaagtgtaacaatattaccattaagctcttttattgttggaaagatgaaaataaatgtttatgaaatggaaacattctacattaatgtgaggaacaagtattcctttttgtttatttgcttttatacatttattgatgaataaaccctactttaaaaaaaatcaagatgattttgttcagcatattgtaaaacatttggacttctcataatctgccagcatatttcctagactatatcacatattttttccttcaatgagataaccccaagaataataccaatcccaactagtccataactaaaaattgctaatttatttgttgactgctcattgattattcatttgggctattatctatatctaattaatataaaaaagaatgtttaatgttgaatggaaaatgaagctagctattgaattttaggtaactttttacattttatattccagaataatatgaaaaccatgtaagatcatga

SEQ ID NO: 38682 - DNA, 974 bp, Bovine  19866882035970
ttgtgttggtttgagtttccttattttaaggctcatagaaataaatgctaacacatcttcgcataggcattcctttatttgttgttttgttttagtttttagcttattttggtggttctcaaatattcggtgattctctaaaattactgaagaaggttttacacatcagaccatgtaaattttataggggatttagggaatttgcaaagataattttgaacataatcagttttcaatgctctaacttgatatcatagccaggaatcagctgcaccatcatattatttgaaaagagttcagaaaataatattttaaaattcgacacttaacttgcaggataatttgcagggcagaggccattttgtatttgagattctaaatgaataaccccactactctataaatgtcaattcatttattaaaaaatgaatcacatttccttatgtgaattatgtgatataaatgcaaagcagagctctcatataactcatattgcaacactgtagagtggctcaatgttgctaaacataaagaacttaaataaaatgaatggattctactctaggaagaaaaaaaaagaaaaacaacccatattgtaaccttactacatgtttttgatcacacaaacattatttttactgcttgatcctgaaatttcctatttgacacaaatgtatgtcaaaacaaattaatgtagatgggcatcatgtttctttaaaggagattgggaaaggactcaatcctgaaatagcaagtttgaaaacattagttattttgttgtagcctgttgtttttatgtaattcagtgacagtttagcattgatacccactgctggccttatgttcctgcatctgctgtgtgaagaaaacattttttccttaaagtagcatccaccatactaattgttttcattttcagttcatgttaagtgttagatgaacaatttttctttcaaggcatgtacgtgaaatca

SEQ ID NO: 38683 - DNA, 1182 bp, Bovine  19866881094233
cagcccagttctggagccgggagctagggcgggactgcggggtccctgccccggggctggggccggggagtgggtcgtggagagcggcccctaaggtcggaggatggtttccgctgtgcggtctcttgaaccctgggcctggcggaggggtctcgaggacccagtccgccttggaagaggctgcggggaggatcccaagctccaggtggccaggctctgggaggggcgttcctgaacccggggcggggcaagcagagggtccttccggaaattggcgcgcggaatcagacggaccccgacctgagacgcgttaaacctaggccggagatcacgcttggcccttcactgctcctccggcccatcgcctccctgagcctgttcgtagggacagggccggcgatagagaatggctggttccgggccgggtcgtggccacgcgggcggcacctcctcctccgcgcagtccccccggccgccacctccgcagccgccgcgctcgccctccgcttcgctctcgtcggagttgtcctcctccaggtagcggtagccgcgcactttgtgttggggccgcgggatgcggggctggcgtgggaccacgcctcgccgcagcttctgctccatccacaggtacgaggctgcggacgccaccagcgtcaccagcagtaccgtcagcttagcctgggccaacaggggttaaatgcaggggacccgcggccgccggccccgcccctcgcccggataggcacgccgcagctcctcggctgcccttccctcctcctgggggccagccaatctctgggtaccgtcctgccggcaaggcccaaaccccagctctgtcccttatggccaccctacttctcagggcctcggtttcccttcctgtaatgataatccttttgcctcccgaggtagtacagagtttgactgtaacaggcagtcagaaataattttacattataaggcagtacattcacacatattcacaggcatactccctgctattctctattctgtcattaaaaaaaaaaagtcggccaggcatttccctgatagtccagtggctaagactctgtgctcccaatgcaaggggcccaggttcaatccctggccagggaactagatctcacatgctccaactaagatcctgtgtgctgtaactaagacccagtgaagccaaataag

SEQ ID NO: 38684 - DNA, 2347 bp, Bovine  19866880599175
atgtgattaataactgatatggtttaaatttgaaaatgctctatagatttagaggagagatgtcactcccagctaatgtgtcaaaaatagcagtaggtctactcaacaaatcactttataaatcacttatttgatcattcattcattcgagatatttattgagtgactaccaagtgtaaagccctatgagagtcccaggagatccaaaactgaattggcccttccctgctgcagattatattctcaggaagaaggtaagatgtgaacaaccgattatacaatacactcagggtgttattaaggtcaaaggcacaggaatgcatggtgctctaagagcatttgctgcagttgtccgactcttttgcgaccccatagactgtagcctgccaggctcctctgtctatgggatttcctgggcaagaatactggagtgagttgccatttctttctccaggggatcttccagataaggccacctaacctagtgggagagatatggaatgtgtgcttgaggagtgctggtaactgagctttaaagggttcagagtgaattcctaccatgaaagacaaatgaaagaagtagaaatggggtctgaatatggagagtttcaaatgcaaaaggctaaaaatagaaagggacagaagttattcaaagaactgaaaggaaaccagcgtgccttggagtgcacagtgcaataagaaggtagtcagagattaggctggtgaaacaggcagcggccagataccacaaggcaaggtttcttaatcgtagtgctactgacatttgcagtcaatacttctttattgtgaggacctgccctgcacactggaagatgttcaacagcatctcttgtgtctacatggtagatgccagtggcactattccctaatcctcacatcctaggagaatcaaaaatgtctccagattttgccatatgtgcccttggggacaaaaccatccccagttaagaaccactgccataaggccttgtaggtgatattaatactgagtctgacctttatgcttcaagcaatgacataatactgaatactataaggaaatgagtgatttttcaaacaacctgggtagggcaagaggaaattaaagagtgaagttctacagctgtcagagaaacgatagctctccaaacctacagaagagaaggggtatcagttggtcgacccctcctgagatgttctaaatgaggtaagctgcctccttggcagtggacacaggaccactggttgtatatttcctcattgtccattcacttatctgcatcatttagacttcaggcgccttttgtgcatctgtgttcaccaaacagcctaggagtaatgctgggggagtgggattttgctaaaacttagtatgggaaataaattgtaaatgaggattataaaatatagaatatgtagcaatgattatgggcttccctggtggcttagtggtaaaggacctacctgcaatgcaggacactggggttcgatccctggatcagaaagatctcctggagaagcgaatgacaacccactctagtattcttgcctggaaaactcgatggacagaggagcctggtgggttacagtccatataatttatgctcctttgagtatgtcctcatgtgtgtgtgtgtgtgtgtatacatatatatatatatatatatatatatatatacatgaatatactctcatactttcatcacaaaactaaaaagatcaaatttcaaagccagagcaaatatcaaatactgaaaatgaagacatcgtgtcaccagaaggagtaattcttttttaaagaaaaatcccatgtactaacttgagacctttattgtttagaacagaatgtcagtcaactgttttcacccttattaactcggttccttctgctttaagaaaagcatgtaatttgtcactgaggtttctttttacttcagtcctgctgcattgttagtgatttttatatagtgagtgcttggtgggtatttatcatgttatttagaggcaataaattaagtaaatctggatgagcttctaaaagacttgatatgtacaccctcattaagaaccataagcaaatgctttctgtcataacactgaccaggtgaaagttaattttgtttagtgcctccaccttcagattttgtctctttttctctcttgctccttcccatgtgtgggctgtgccactgaactttttgttccttctccatctgtgctcacaaaccatggcccatctgtgcaggatgagtttcattcaaaccagtaaccaagaagcaagaaccagtgtccctaagcatccaactgggatggataaacactgccagttgaatccctttgacccaag

SEQ ID NO: 38685 - DNA, 1043 bp, Bovine  19866880686618
gccttctctggcccataatactaagtaaagcccccactactgcccactagaataatggtataatactaatactataatactaatcacatgtattataatatttacttaattacctcttttccctggtcacctgtaagctctatggaaataggactgtatcttggccactgcagcaggcacataataggtacttaacgaaaccagttcccttccttctctcaataaaacaggtacttgatctgaggttgtgaacaagagtctgttgcacgaaagagccagttgtgtgtgtgtgtgtgtttccaaatgacccaagcaaagccacattcttagcaaaatctgacccctctaactggataattcaataaattgcttagcaatccagtgacaggcatcagaagattgccatcagatttatgatttggaaactcaactactcaacaaaagtaaaaaaccccttcatcacaaggttatagagccagcagagtgttactacaacaaggtgagaaagatttggaaaattcattataaagcaatggattgtttgaaaatgaaaataaacattgaaaagaaaaaacatgtaataaaaaatagatcttatatctcatggtaaaacaaccaaattaaataagaaaacaagctttccttttagaaagcaaatttagaggctgatttaccacctttgaattatccccacttatggatatcatcagctcaattaagttagcaacaaagcttgcattatgcaatcatgcaaaaaatcatatgaagtgctcttagaaaagcgtatcttttgaccggtcagtagctagttaaagaatgaggacttatttgcaatgtgaactacctgataaagaatgtaaatctcaggagaaatcatgtatgtatagaaggaatgcctggctccttcaccctgattgatttttctctgctctctgtgtctcaagagaagaatgctctttttcatgccagaggcatcatgatgaatgctgatgagacgatatttgactcatcactgcctagacacttattttgcatgcaatttt

SEQ ID NO: 38686 - DNA, 796 bp, Bovine  19866880804349
ttttactgttatacaacaacaatatactgttatacttacaaagcagaaggaataaaaatataacttctcatccccagaagtatccccatgggctagtgaggacattatttagataagatagtttttctgaaggccctgaagatgtaaatagctgcctaaggtagcaaagtctctgagaaaaaaaaataatatgaaaccagaacctctgaaaaggagaaacctcaaacgtggaattctgatagaaatgaagcctcaatgaattttagattcctccaggatatcagtccagatttaggtgattaactttctgagatatttaatataaatgaaaatattgcatattcttctaatcctagataattatttataaattcatcagccataaaaagaattattcaacactagataaattattaaactcattaattaccaacctagagaattattgttggctgacttgattaggtctctctttaaaaccaacagtttaaagaaatttcaattaatttgacgctagtgatttcagaagctgcaaaacatatgaacacagcttgatgagatgcttttattctgtgttctgttttcattaattgacaaagaaatattcacggatattttggctcaaagtcactgcatatgctgtcttttacataagagtaaattaaaaattaaagctccttcttaaattagcaagtaatgattgtttaattacaaaagaggaaatgcttagtaacttctttctgaatatttgaaaggaaagtaatattgttggtgaagaaatgaggattagcatcaa

SEQ ID NO: 38687 - DNA, 965 bp, Bovine  19866881059425
tagaagatgtcacagtgcgtgatcatatgttgaaatgcttctattttaacaagtgttgacagtgtcataacaaaaaaaaagcaataggtactagcatatgttcacacatttaaaatgtatatttttttctatgtcaccacttttcctttttctttctcaagaagcattattctcttaaaagctttatttttaaaagaacaagaactatgtgaaatatttaacatttaaccacttaactacttccaggaatgtgatatttttatagttgttttttgttgctatattttatttgtcttaaaatgattgatcaaaaggaaaagacaatacagtattccaccccctatccttggggaatacattccgtgacccccagtggatacttgaaagtatattccatggatggaggagcctggtgggctgcagtccatggggttgctgggagtcggacacaactgagcgacttcactttcacttttcactatcatacattggagaaggaaatggcaacccactccagttttcttgcctggagaaccccagggatgggggagcctggtgggctgccatctatggggtcgcacagagtcggacatgactgaagcgacttagcagcagcagcagcagaaccctatatactatgtttttttcctatacataaatacttatgaataatttataaattaggcccaataagagataacagcaataataatagaatgattataacattataatttaataaagttatgtgaaagtggtctctctctctacatatctttactcagccttcttcttgtgataatgtgagatgataaaatgcccacatgatgagatgaaatgaggtgaatgaaaggcattgtgatgtaccattaggctaccattgactccttttttttttaaaagacttaagttatttgttacttattttttttaattggaaggtaattgttttacagataaatgtc

SEQ ID NO: 38688 - DNA, 2573 bp, Bovine  19866881105579
gtttaagccactttttactctcctctttactttcattaagaggctctttagttctttgctttctgccatagggtggtgtcatctgcatatctgaggtgattgatatttctcccagcaatcttgattccagcttgtgcttcatccacaccagcgtttctcatgatgtactctgcatataagttaaataagcagggtgacaatatacagccttgacgtactccttttcctatttggaaccagtctgttgttctgtgtctggttctaactgttgcttcttgacctgcatacagattactcaggaggcaggacaggtggtctggtgttcccaggtcttttaagaattttccacagtttgttgtgatccacacagtcaaacgctttgatgtagtcagtaaagcaaaagtagatgtttttctgaaactctcttgctttttcgatccagcagatgttggtaatccaaactctggttcctctgccttttctaaatccagcttgagcatctggaagttcacggttcacatactgttagctatccacatgtaatttgcatttcggtcttgcatttggtatgttaaggaaaatttgtttgctagaagctagagttttttgttttgtctttattttttagcccagaggtttttgaatgggattccatataggtatatatttttcagagttttgagattttagactaattacatgttacagaagaaaatcttattgatttcagtgtagtaattgttttataagcatattgtcctctagggactgttctagatctattaggtattcctaagtgaggacttgactttaggtcttttgattttacctgagttctgaactcgtaagtttgcaaggcagcttcatacctccctagtctcttgagtgcattattctccttaagttgcgattaacttgaattttacatttcttctttaactcttatttcatgctatatcctgtgaataattaatttgggcctttggtgaatttgttctaatttcaagactcttctttcataaatattaaaaaaaaataagtatggtttttgttttgttttttaaaatacaacatagagggtttggtgaagaaaagcagtattattgttactattattatcgtaaacttgtctggagttctagaagtggacatttgctgattcccttcctagcattcattccctcttgctttcttcagtgataggctgcacttatccttcattttcaactctttgcattcagatgaattaatctcgttccgtgctccaggataccttgagtagtttgacctgatttaacctccatacccacacttaggtttctgcccacacagccacacccagtgccagtgtgtgctcctgggaagggaaagctcccttctgttcctcaagtgctgcttgaagagatcttttctctctttctgggtagtgtcatatgaagttgtgaggtatagaatggctggaactaattttattgccaagttttggagtggcctgaggatgaacctcctcatggaacagacagaaccaagaggatggcagagaagtgaagctatagttatgatggtgatttgactgtctggatcaaatttcctctgcatttttcagtgagaggacagtaaagtccctccctctgtttagaacttttcctttgcttatttataaatgtttatatatatatcctcaggcttccttggtggctcagttggtaaagcgtctgcctacaatggcggagacccgggttcagtccctgggtttggaagatcccctggagaaggaaatggcaccccactccagtactcttgcctggaaaatcccatggatggagaattctggtaggctgcagcccatggggttgcaaagagtcggacatgactgagcaacttcacttagcttagcttatatatatatattctctgtttgcataatgataggcattagtaatatggggagatgaatgaaatagattttttatcctcacagggcttacagctagattggagaaacagacatgtcataggagaaacagaataaaccgtaggtacaaaccatagatggctcacagagatggaaggactttttgatacttgctatagaaaaacaagttatggaagaaattatttctgtcactgctcctggtgccagaatcagagacgcctgcaccatcttcatgttgttagcagtggtttaatttcagcaaagcattatttgtcacattaaattactgttcactttatttgtgaatttgttggctttataatttaagagttataaaaatacggagtttataatttattaatatttatgcctacttaaatttgtcagcaactgggtaggtccatgagacttatttctttttccttttgaaagatgtccttacactattcagttttcagagacaccactagacgtggactcggggggccattgaagagcaagacaattgaggatggatggaggacaaggttttaagtggagaaatttcttactttagattgataacaagaagtttgaactgaggtgtagaaatgacatttagaagaaaaaaagcacaagatgtgttcactacgcagcc

SEQ ID NO: 38689 - DNA, 733 bp, Bovine  19866881161025
cctttttccccactatatcctgtaaaatgctaaccctgccccctttttaatccctgattgccagctattcagtctgcttcctgctttcatttcactccagtctgccatagcatccactccgtgaacctaaagcagatttcacaaaatacaaagtgaaatattagccccaaaccctgagtttaaagactagatgtaatcagctgcaaggaaagataccagacaaagatgactataacttaaatagccttcctagatatataacagaaactctgctccaaggaaaaattcaccagtatacattaagcttgactttaattctacttattgatttttaaaatctttcagtactatacagtacttaaatttttcattaacctcatatttgagattgagttggggaagaagcatagatctatctttttcaatatgttccacaatggccctagttcaatagccttagatcttaattataaagtatgtttttgaacaataccaagaaaaatcagatctagtcagtgtaaagcctgtcctttgactcacattaaaaagttccaaaaatatgttttatatttcaaagactgaagacattatgtctaagggctttgagcaccttttgaagcatacagggatgctaaatatatacaatttaatgcaatcttttacaatgaaaacaacacaatccaactttaagtttttaatgaactaatcagtgacgtttggtttttagtataca

SEQ ID NO: 38690 - DNA, 2921 bp, Bovine  19866881170040
ctttttcctctcctctttcactttcatcaagagactctttagtttctcttcgctttctgccataaatcatctgccataagtgatgtcatctgcatacctgaggttattgatatttctcccaaaaatcttgattccagcttgtgcttcatctagcccggcattttgcatgatgtactcctgcgtagaagttaaataagcagggtgacaatatacagccttgatgtactcctttcccaatttggaaccagtccctgttgttccatgtccagttctaattgttgcttcctgacctgcatacagatttcttaggaggcaggtcaggtaaggtaatagtggtcatggactattataaaaagcactttgaccaacctgtgccttgagttgtctttccttctttaatcagatgttcagttcagagagaaccctcttggctaaaatcgctaatcagtattgtgtaaagaacaaacaagactgattagcattttttttttagaacagccagcattccatattcaactgtgaaagcgattgtgaagatagaattagctaagtggcgcatttgtcactctttcttttaattactacttaatacattctctcaatctatttttaggctaatggtattctgttaaagttatcactattcattttaaatacaacttgctttcagttatattgtttataatatccttattataattattaaggtgcaaaaatgttaaagctggcattgctaactcaaaggtgacttgtggcataggaatgatttacgcttgtgggattgcagagtctaaaaatagggcttgatgttgcatatgtactgcagtatggaggcccaatagggtcagaagaggatgggttttcatctctgtctatcagttttcttgcttttgtctccaagtctgagcagcactggaataattagattgcccatttgtatcatttcccttcagtgcataccttccggccccgccaactcccaggtgtttacaaggaagcacatagtctgtaaatagcctttctatacaaccctaaatactatcttactttgaagatgtgcttagttgctcagtcgtgtccgactctttgtggccccatggactgtagcttgccaggctcctctgtccatggggactctccagcaagaacactgcagtgggttgccatgacccctccagaggatcttcccaacctagggatcgaactcaggtctcctgcattgcaggtggattatttaccatctaagccaccaggggagcccatgaatactggagtgggtatcccccatctactgaactgggtggtgatagacccttgctgttaggttctggtgtggttagtgtgggactttaaccttaggatgacactttcatcagagtgtctagacatagagcaaatattgcaaaaagaaggtatttctgtaagcaaggtgcatgacagcaattctgggcaaggagcatttctgaatgaacaacacacattttggttcttgttccttctggtttgatgcatctgcttgtggctaagtgtgagatgacagtgttgacagatgctttccttcaacctttccaagtatgaactctaatcagatgagtggaagtcatgtaattgagttcacagatctattgttgatggggccagaagttgcatgagcataagggtgtgctatagaaagggaaatcaaggccagcaccattcagaatatatatgggtgactcaggaattgggtagtttatctcctcattggctggactggattggactgtggataagacagataagctgacggagcatttatgttcggtatagttccaggcccttctttaatgaaatctgtgaggattaaacatgatagctctgagtttgtgtagataccatgagtcactagcttagtttttctctatcagaatatatttgattatgtttcttactttaaggtgatggggccattgggttcaggctatattattatcctgtgaaagaggaattgtgtagattttggaaatagctctggagttctgtaaagttgtggtaatttataactgttctgacactgttgtttaataggtagttcagctcttggagtttcctggaagagatctcagggatcagcctctcagcaataattttatgtcagtgtaatggcttctgtgttgctgtggtgtaacaatgtggaacctgttatactacttgccagctgccaatttaaatacacactggggagagtaatctaattttcagggagtattaacctgatcttaatgaatgttgatgtttaatttaattgtgaccttttaagttatactttttgaagaaaaacgtctcatgttttcacaacatgaactgttgcagagtcaagacactgattttataatggatctcgaaaaacattttaagtagaacaatttaaatattttgaatctagcccattccattttaatccaaaaaaataaacttagtgaatctctcctactttacctactttaaactcaaagaaaatatagtcaaaggaaaacaagcactaatatgagagcagaaagaaaaatttcctctcacacacttataattagttatacaggaagagtaagattactcccactagctctatctcagcttcttaaccaggcaaactcctacttgtcctacaaaacccattgataaaattccttttttttttttctcctgtgaatacttcccatttcctgggctacccacaggcagagttcattactctcccagcactttgttcatattttgttagcactgctatgttttaagaatttacttttatattttcctctttcccttgactatgagtttcttgaggatagaaactatttcttacttatttcaatggatcattggggaatggtaaacttagtattagacgtacagtagggactccaaaaatacttaataaa

SEQ ID NO: 38691 - DNA, 1494 bp, Bovine  19866881235798
ctgaaagtttgtggttaggatgtctgtctgagaaacaaagtaaatgtttgttgtaggttggattgagtggaggcagatgctgggacagagtttgggggacagtgtatttattgaggatccaccccctgtgaagggaaagagaaagaaacagaattgggtgaagggagaagtagaatggtgatgtaggtctggcaaagccttgctcctcctgggcgtgagctttggaccaaatatcatgcttcagagttgtcctgtatttgcccaactgtttatcctcccaccttgcttgcatactggatttgggtgctaccagagggcttgatggaggaaatggcagcccagtgttcttgcctgaagaatcccatggacagaggagctgggaggactgtggtccatgggattgcaaagagtcaggcacgacttggcaactaaacaagagggtgtgagctccagtgaggcagttctgcagctgatgggaagctggagaaactgagagcttaagctgttctttttgttgggcaggaggaaatccatctttgaatgtctaccagaacattttagaatgaagaaaactgtcattcctgttgcagatactccctcacaaaactgcttcttatctgcagacattggtttggggaggctgggataaaaatttaattcaacaaccgaataacaggaaactgctaaagtatttaacaataaaatccgccaagttcccaggacaaacctctttataaagcacactcccccaagagcccatatgctctggggaagtgaaatatacactgcccctctggtgttgtctttctaaggtctttatattaaaaatacaaataaacaataataaatgaccatgacctttctctgtctttcctcctgctacttaaaagaaaggtaaaccaggatgtcttgagtactcaaaatatagtgaaaagatggttgattgggggttaggtgactttatcttggtcctggctcagtcactgtgtaagctgggttagtcacttctcaagtccagacctcagctatcttgtctgtataatggaaaattgggccggatgccttccatctctggtgtgttggaataataagaaagcttctctctaaagtgttggctccttggtctttttttaaaatcgcatgccatggtttcaagcagtgcttgttgttaagacataggtcattggtcccacaacctgctcactggagaaaatgttcctctgctgtagactttggctaacatattcttattatttccaaccagtagaagatgtagttatgaatgtcttgatctgttgtttaattttatattaaatcagtgagtcaactataaaagagtaggcataaacttcatattctgtcataaaattctgtttctcttttctagtaaaaacaacttggagtgctgattctcaggggtagaatgtttcagtttatcctgctgctgctgctgctaagtcgcttcagtcatgtccaactctgtgcgaccccata

SEQ ID NO: 38692 - DNA, 1118 bp, Bovine  19866881297154
caaattctgatgtgcaccaaaatctgagagtcattcctatactttaaagaatagagcaataattaataattattgctgaaacaatttattaattggtcaagataaaagataattgacaacataaattttcatacctgataatttgacagtttcctctactagactgaaatctctttggaggaaacaaaataccataaacaccttttgtaccccatactagccatatagcagatactcaacaaatttcagaaaaatgagtacttatctacatacatgaatatcaactctaatcagttttcttatttcatttgtatataagaaaaacttctagacatacataaagcaagaggaaaagatggaatgccaggatcctcatttcattttatcacttagaggtgctatgcaagaaagtacaacatatcaggttcccaggaaggaaatccatgttccgttcacccatcttttccaccatgagtgtattttaagtctcaattattacaggaaattaaaatcagccatttgtacatgatagtcatcaagctcccaggaagaaattagattactcccgagttcctcacccagtcatctcccatatgcccattcaccgacctgactgctcttcatggcattactgttttgtaatatctgcctcagaagacgcctgcatcttttctaaaacagtgtaatagattctgtccttgccacaagtggcccacaaaggatattctagatcccacattcgatttgagacatcagcagctcaaatgcagagaaaatgcagaacaggaaatgcagaatcagaattcctaatatgcatgtacaaaatgccacgggtacactggattgtgaggatatacaaattcatctgatgtgtcaaactctatgcaccatatactagttctctattttatttattctgaacccatccaacaatgacaaatattcttctacttatagagcactccatgaaaaccgctgagtaaggacactctaataggttctccgttcctaataaatcactataatttatgttacacaggtccccctggagaggataataagaggctgatgtgcataacatatttcctcaaaaaaaaaaaaaaaagaagaagagaaat

SEQ ID NO: 38693 - DNA, 1245 bp, Bovine  19866881303716
aatacatgagaaggctaatgccttgagtcagcctcattgagttcttcccctcatgtcttattcttttcccttacatatttttgagctacattatacttggatcatagttgctagaactatttgcttatctatgctaatttgacttttccaggcaatacaaagcaaataagaagggtttcaacttaattttaccatcaaagttcaatcactatgtggacatttctgttgttaaactaactcttgtataacctccaatcacttgaacaaatgatcacttgatcatttgtactgaataagaatgtataattagtaactgttaataactgacatttgcaagggacatatggatcgcttttggtaaaaattgttcagtttatattctccagattgtttccttgctataattatgctaaaacggtagccatccatatattgcttgggcatgcctgcacatgaattgtgtataattacaggtgatagagaagtgagcaatagtggtgtagtgggaatatctctgttattttgttattgttgttagaagtcaggtttgagtcccagagtaactttataaattataatctttggaaaatgactttaatgctctaacctccttttacacatctgtaaagcaggaaataagtttgttgtaaaaaatcaaatgctttaaaatacattagggtctttgtaaactataaaattatacaaacatacacacacacattgaaaatctgacctcaaaatggtaaatacgtgtcactcatgacagcgttattctactagttcatagaaaatattactaatttcagtagtctttctaaggagtgtatgttcgtgtatatacatatttatttacatatttacatttatagtcagagtccttcttaacatagctcccagttggtcactaccaatcatccagagatgtccactagtttaactttcttccttttccttgtttaatttagcaaattttatttgtatttggagaaattgtgattcattcattgagtcagcaaacacttattaagtaccagaaaaggtacaggatgctaatgattaaaatacaaatagagtatatttctgatctgggagcttctgtctgatggaagaggtggtgggaggagttaacatgattatggtagggtgattagcaatacagtgtaggaggcagagaaagaaatgcttatttatgccccttgagattacagatttgattaaagcagccctcagggcttgggcgtggga

SEQ ID NO: 38694 - DNA, 1688 bp, Bovine  19866881327434
ggtaagaataaacatcgtattttatattataagccagactctccttgactaaacttgaggaaagtgaaaggaactgaaggtttaaaacactgtcctagaatttaatttagagagatggagaaggtgaaagttgctttgaatgtgaagttgggctgattatgcgatttaccctctagaagccacagttcattcgtgttgatggacaatgctgtctgacaccaaatgaaatccaatcaaggagacgagctgctgcactgagagcttaaggactcagacctcaaggctggatagcaatactggatttattttgatttgtatattatatcctaaacatggataaacaaaagaaaatagaagtattttgcaaataatttccactagaagtttattttatcctttatacactttatcttctggaaatcatcaaggacaaagtattaagcaacagtcttctagtcctaaactcttaggggagaaaaacaaatttctttaatttatactgtctatcatcatgaaatacactgaattgttatgataattctgtatggtaattttttaatttgcctatttgtacatttcatttttaacctttattggcatatacttgattcacaatgtatgttactttctgctatatagccaagtcaatcagttatacatatacatataccaacacttcttttagattctttccccacataggtcactacagagtatggagtagagttccctgtgttatacaataggtccttattagttatatattttatactttagtatatctaaaatgttatcagttcaacatgtaattaatatgaaaattagtaaggtattttatatttttaattgcatcaaataaaaataaatggtgctactgtatagtatgaaaaaagtgcatgtgtctgtgtagttggtcaatagtaatgaaatcacaaatgtaattcaatcttcagtacgtggtatttattcaagcagaaatcaaatacagtccttacaaaaagaaggctcttttgaaacaactcaatatacatgtattagaaattttcactttcctcttcttcatggctatttctctcagatgttaggatcagggtatgtataagagagataattttttttattccaaaaaatatatttataagtgtataagagtcaaaagcataccaattctctgtttgaaaactaaaatcattcaaatttcgaagaattacataaaaatctgatattatataaatcagccttgataaaagtcaaaccaaggagaagacaagcaaagcttctatgtcagaggctcacattcctcagcactaaagccaccacctgataaaacgaattctcttggtcaagaaaaagagctccagcaaacccacatcttggggaattatttaaaacagaagatactaattattttctctaagaatctcatctgagatagctgagtttcctcctccaaatataaacaaagtcattaaaatcataattttgttatagtttttaagcatccagttttataaatgaggaggataaaaataacctttgtgttcttttcaaaattcacagaacaagcttgcggtacagttttcagaatcttagtgcagcaagctccacgactcataaatcataatgtgcttcctcttggcatccttttcacatgtggctgaattaaaaaaccaataaggagtggtgag

SEQ ID NO: 38695 - DNA, 2621 bp, Bovine  19866881422644
tttcactaactggcttccttctgggtgcttttactgccatgactggtggcctggggtgagggccatgctggatgcttaccttgtgttcagagtgcttttctttttgagatcgatttttcttttttctttcacttttcttattttctctgttattttcttaacttcctccttatgaacactccttccttttccaatttgaatgacattttatccgattcagaacattttaggggcagtacttcagtgacttactagaacatatattacctccctctttcacactctttctatgccctggtacgtagatacactggattttagcatttttaagtagaaaaggtgaacttatgcagtcagttttcagttctgaaatgataatacagaaaatgaatcatcttttcaacacattttctctatttgactttgtttcttttttattaatattatttaagtattcattttattcatattcattttattcatattatttaaataatatgatctaaaatccatgattttgagatattctttagtggattaatttttaaaccttcattgaagatttctttcccttgttgatccagtaaggcagtgattccttttctcatacacagattccacttagttattggttctccaaggataattactatttaactaattatgtgctaagtgctctgcagtggtagggtaattatacaactgtactgcaccataataaagcaactgtggtgtttgggggagtttgtttgaccagaattcattttgatggtaattcatttgatactaagagggcataacatcaagttatttgtaagaaaatggcaaatgtcatttagtttcacattataacctattatagtttagcactgaacaagtgaagtgcattctctcatgaaaatgaatttcacacacattcttggttactggagagctaagcttttggtttttccgattaggagatagttgcaagggttcatttaggaaatattgactatgtgtgcctagtttgaaatgccatgcacatataggcaagattaggcaagagtcagtaagcatagccactgctcacatgagacttcggttcttgcattttcttggagtacagtgcatggactgctgctttgcagtcactggtgaggacactgagcctcagaggggattcttctagggttttacccttccccccagcgccctaggttccaattcaatagtttacatggagccccagaaatctgcattttatccacgtagacttaaatgctccccagttgagtccaagacatcttcaactttgatagccactcagcgccacaaggacaaccaggttaatgcatgtgagggtgtgtgtgacctgtgggttgcttgttctttattgtcctcgccccagtgcttctctctgacaaagatgtatgtcacatcttctttctgatataggaacatttatcctttgttttcaatttcaaaattcatgttcattttgaaaatgattaagtcccccatttagagtatttgttacaaaatattgtgacattaatagatgtatatcttggaatgtgggatatggtgtgtatgatgaatgcagctcctggattcaccagttattttagaagtcatttttagagggtgttaggctttttggagatcattattaaattctcctttcaaagtaaggattaatttaatttggcagttactcagaggggcagagtattttatgtacatcatcccttttaatccacctcctcttgagagagtaatattacatttatttccacatgggaaaatgtggtatagggaagctaagaaacttgctcaaaatcacacagctcagtaaaaattcattgctaaacaaaatctcggtaatgctgctatggggaaagaaaaataataatttttcctcaacccttctaggttcttggctgagacctccctcctttaataaataatagattaacaggacaaaaacaaacagcagatgacttgtttacttcttatatacaagggagatacgtaggaaaactaaagtgacttcccccaaatgacccaagctaccaccttaaatactttcttcagagaaagacaaaggagatgttgggagagagagaggaggtcagttttggaaggttgccaggggaaacacagcaatcaagggtaggattgttatgtggatttaaattcatgccttttccactgataagagattctagagatttaaacatcctccctcctggtatggaaagggagatgtggttacaaatggagacttcctttgtaaatatctcttacaaaagggtgacttctacttgattttcaagagcttttcctatgtctgctatttcttaagaataaccagtaccctaaaataatccttatgccaaggggacatatttgaggtaaattctgccttccttcactgcttctgacacccataccatagacagtgttgtggggctgttttcatgaaagtgaaagttgctcagttgtgtccaacggtttgggaccccagggactatatagtccatggaattctccagggcagaatactggagtgggtagcctttctcttctccaagggatcttcccaacccagggatcaaacccaggcctcccgcattgca

SEQ ID NO: 38696 - DNA, 1701 bp, Bovine  19866881853099
tattaacctccgaacctgacctaaaacccaacacttaacaaatactcaatatgtattttgtatattttaaagtgagaaaaggaggtcacaaaattttatacagtttttgaaagcgtaacagtggttattttggaacatgaaatcatgaatgactcttatttctgcctcttttgcttatctatatttttaaaatatcaattattgttgttgttcagtcactcagttgtgtccaactctttgtgaccccatggacgacagcatgccaggcttccctgtccttcaatatctcccagagcttgatcaaactcatgtctattgaggcagtgatgctatccaacaatcttgtcctctgttgcccccttctcctcttgccttcaacctttcccaaatcagggtctttgccagtgagtcagctcttaagtgtcaggtggccaaagtactgtcgttagtaaatatttattgctttggaattaaaacaaattttgttttaatgaaaaaaatatattttgtttattgggtaactggttggacacataaataaactatcaaatgaaccaacaaataaatcaagaactaccaaaaggaaaaaactaaatggctgctctctcatgtaggctttaggctgaaaatcacagtttaaccttttttctgaaaaaatttcatttaatcaaaagttccaactcatattagtaatcacctaatatgacactgaaggataacatataattaaatgaactggcaaaaccaatacaatattgtaaatttaaaaaataaataaattaaaaaatgtgtgtgtgtttaactctcatctgtgtatcagttcagttcagtcgctcagccgtgtccagctctgtgaccccatgaatcgcagcacaccaggcgctccctgtccatcaccaactcccggagttctcccaaacccatgtccatagagtcggtgatgccatccagccatctcatcctctgttgtccccttctccttctgcccccaatccctctcagcatcagggtcttttccagtgagtcaactcttcgcatgaggtgaccaaagtattgaagtttcagcttcaacatcattccttccaatgaacactcaggattgatttcctttggaatggactggttggatctccttgcagtccaagtgactatatcccacactaaatacagatcactttccaactcaaacattcaatgatgattcgttctatctaaatttagtttggatatgatgggtataggaagaaaagacaagaaaacagtcttctaagattatgactgtttttctattgggaacttggcattctaaactgaagtatttcctctctgatctccactatctgaagctatacctgatgtaatttcttccaaggggaaatagtgcttatactttttgattggctgtcacaatgctctgagttaatcactacacccttcccaaaatgcccagcctgaaacaactgtgagaattcaggacagaatatctgtggagatttgtctgtgggtgagggacttttagtgcccaaagctcagaagactttattaagcaggcaatgacattttctgatttttagatatctcatttttcaaatacaaatgctctagatttctacagtgtttctacattgtgttaaaaaaaacagagtaaaactattctgcaattggttgctcttgagaacacagtgctattgcactggtatt

SEQ ID NO: 38697 - DNA, 782 bp, Bovine  19866881886097
tgtgcgggcttctcgttgcagtttctgctcttgtttagattacaggctgtagggcctgcaggcttcaatagctgtggctcgggggctctggagcacaggcttaatagttgtggcactcaagcttagttgcttcatggcatgtgggatcttcctagatcagggattaaactgtatctcctgaattggcaggtggattctttactattgagccacaagggaaactatggtataccatttctttgtgaaccaattttatatataaagtgaagtgaaagtcacttagtcatgtctgactctgcaacctcttggactgtagcctgccaggtctcctgcattgcagggggattctttaccatccgagctaccttggaagacttttacacaaaaggtggaggttaacttgatttcatttagagtagaaatcaaaataagcaatatacgaaatgcccgtaaaaacaaattaaatcctagtaggaatgcaaaaatggaaatgggagtggatatgcagagcactgattatgcttgccttttccacattgccattgctttccaggcatggtgtgtgtatgtgtgagtttgtgtgttccaattagttaaaatagatttttaaatatgtcttgatgaagggattagggattcttagttgtttctctcctttttataatcattcttactgtatgtgatagaattagcaacttcagttactactgtgtaaggttttcgtttaggaaggcattgcattaatataagtaagtaatatcagaattttgggatagtttatt

SEQ ID NO: 38698 - DNA, 654 bp, Bovine  19866881992734
ttagtgctattataagaaaattaaaaaaatttttaatatagataatcctgaaaatccaggattatcaaccttctgtaagagatccacggcctacaaataaagttacatatgggaaaggatgactttaagtaattttaaaaaaggttctttcttttacctggttttgtgaaagtggaggatcatggttaaatgttaatcctgctttaataagtgaagttaaggcttctgctccccattctctcattcgagagtttggatgctggcacacctaagggtacatacatatggaacaaaaattaatctttaatttgtatacttaagctatacatcacacattaatttaagaaaaactaaaacattgcatttcatactcttccacatttaaaaaatcatataaaatgtttgtcaataagggttgaagaaattatgaaaatatacaaaatgtaagtaagcttaccttctgaatacgaggcaagaggaagcaataaagagatagaagataaaagatgaaactaaacaactcacagaaaagaaaggatttcataaaagtaaatgatgtcaccacagtaaacagaagaagcagacactaaggttcctaatctgctctatcttcataatcaaatacttagctaaaattttaaaaacgtatttttt

SEQ ID NO: 38699 - DNA, 1022 bp, Bovine  19866882117479
tttgcagagcctctgaagactctattaattagccttgctttttttttaagactttttcatattcctgtctttaattctatagacttaggataaattcctaaaagtagattcattttcacctatgattaaaacatgtaagttcttttacttgttgctcaaaaactatttctcactaattcccagccaggtggctatgccctagatgttattaataatgtataataatcactacagtttgagtgtctactttattctggctttgtgtcagattctttatatacactgtatttattccttacaacagtcctaccagtatgtaatagtatttatgcattctgtatgtgggcattgaggctcatagttgttaagtacactcgacagaggcattttcctattgtatgtcagagctaggatcatattcaggtaagcagttctgccttgcaagccatgctctgaaagaaggatctttgaagaaatagtagtagtgctgatttagcacataactttcttttaagttcaagccatcacacaatttcttattagttttaatgccattcctatttgaaaaaatagatggcattcccattttataggttgaaaaggaaggtaagtgattcagttgtaataacatgcacagcaatgtggtttagcttagccctcgtcatttcaggtgtctctcataaatgattgctttattttgcctatagtgtttttgtctgttttgggtattagcacttggagccttagaatattgtatgtttcaggaaaaatcatttgaaggataatacatttctatttcctatcattatggtctgtaggtggcaaaggcacttatgtaaaatcagcactttggttgtacattactaggcatcaagcaaaagcactcctggattttctatacccaccaaaattgcagtattgtaggaaaatgaatggaagtataaattttgggtgaaggaaggaggcaatagtggttcttaaaagaggcttatatttgctggcaggcaatcccttagaaacca

SEQ ID NO: 38700 - DNA, 947 bp, Bovine  19866880417418
acatgaatgtgagcaaactccaggagatagtgaaggacagggaaagcctgacgtgctacagtccatggggttgctaagagtcagacacgactaagccactgaacaacaacaaattggccacctgtatgtcttctttggagaaatgtctattcaggtcctcggcccttattttgagcagattgtttgtgaaaatgactcttagatttgttatttcccacttaagaagagcctttgcattggcctagtctgtagaggggactgccgatcccaaacactccagaataagaaaaagacagtggtgacattgtgctggggaagacgtagctgcctgttccccgagccacccctttgcctccggacttctctggggccagcagccacccaagcaggggcccggggccgcggactcagccgactaccatgggctctgtgtcaaaccagcagttcgcaggtggctgcgctaaggtgccggaggatgcggcccgcgcggcgaaggagccgcggctgctgcacggggcaggcatctgtaagtggttcaacgtgcccatggggttcggcttcctgtccatgaccgcctgcgcgggggtcgccctcgaccccccggtggatgtctttgtgcaccagagtaagctgcacatggagggcttccggagcctgaaggagggggaggccgtggagttcacctttaagaagtcagccaagggcctggaatctctcagagtcactggcccttggggggtgttctgtattgggagtgaaaggcggcccaaagggaagaatatgcagaaacgcagatcaaagggagacaggtgctacaactgtggaggtctagaccatcatgccaaggaatgcaaactgccaccgcagcccaagaagtgccatttctgccagagcatcaaccatatggtagcctcgtgcccactgaaggcccagcaagctcccagctc

SEQ ID NO: 38701 - DNA, 1069 bp, Bovine  19866880473327
atcccaattaaacacctgtctttacagttgcctgtcattaggctcgagttgataagatgggaaagtcccaattaagaggcgtccctaattaagcatacgttatgtagaacagattgatgactctcaaactatcttttttcctatcctaacttcaatagcatttttattcattacttatatttttccacttaagtagttatgtaatatttttctcaaaaaccttttaccagagtaaagaaaaatcacttggcagaaatggatcaaatatttgaaaattcgtttctctaaccactaagctaaaagcagtgtatataagattttattctgtaatagtttttattatatttattctggattttctatataatacttaaatttgcactgaaatttaaacctcttaaaatcataggtagctatcatattttgtgtaatgtttgtgaagatgatgcaatattgttcacctagtgcatgttttattcctgttatattttacaacttattaaaactagtcagattaattggttaaaactgagactttgaaactaaaatccatagatttctaattattcagaagttctaattattcatgcattattaactggaatgaaatatatcattgggaggaatgaaattgcacaaaagctagtctccaagcctctcacaccaactgtaccaatagaaacataattattatttgactttttaaattcattgagttttagaagaaaagttcagaagaatgagtatattatgtatttattcttatgaaacaaatctcaaaatgagttggcttaaaaaaccaaaaccatttattgtcttacatgttaataggatatgggatttcgattttggttgattgtgatgctctggctaggggacctacacaagactgtggtatgtatcatcttgactgtagactttttatatcatacatacatctataggattaattgccacagaagtcatacaaaagtaacttcatgtacttgggaagttggtgctggtggttggctaggagccttgcttcttctatctgtggacctctttaaggggttaagtgtcatctcag

SEQ ID NO: 38702 - DNA, 1064 bp, Bovine  19866880640698
ttctgttggtgcattcagattttttatgtattctagaagaagcttcacttttgatatgtgtgatagattgaatttctggccatccatgtccctactacataaattgatatatattaccttcctgttcactttgggttttacattttatgccttcttaattgggtttggaacactgtcccctactttcacaatcacacacatatacaaacacacaactgcatatatttggtttgcttctgactcaaaaaatgttattcacatgtcctaaaagttttaaccactccagtgttcttgcctggagaatcccagggacggcagagcctggtgggctgccatctatggggtcacatagagtctgacacaactgaagtgacttagcagtagtagcagtaaagttttaaactaggtgtcatcagaaaaaaacttttccaagtcattatacatttggtatagaaaacatggcctaacattgagattggtctgaagaaaatagttatttaggaggagtgatgacagaaaataaatcagatatgaataatgtaaaacttaatattgcatttgaattttagatatacttttattcttagaaaaatatttggctatactttgcattatttatgagcatacacataatggtatttataaatttgagtgattatatgatgaagatattaaggccacagccaagtgtgtaatgatcatttctgtgatattaggcaataagaatctttatgttgtactttaccacctgtaacatatggggtttcataataatataaattttccatagttggtgtaaggaatattttgttatgtatagagtgttcagagaagtttctgatgcttaataaatgctcatgtgttagctcttattttgtttttttaaatgattaaagcatagtgtcatggtactatttgtatatatcaaaaacatgtgtgtaaaataaatagctaatggggaagttgctttttaccacagggttctgtatattacagcctggtgctctgtgatgacctggagggatggggtgggaaaaaaagctaaaaaggagggcttatgtatg

SEQ ID NO: 38703 - DNA, 1407 bp, Bovine  19866880642879
ttcactttcactttttactttcatgccttggagaaggaaatggcaacccactccagtgttcttgcctagagaatcccaggatgggggagcctggtaggctgccgtctatggggtcacacaaagtgggacacaactgaagtgatttagcagtagcagcagcagctaaaccaaggtactaagcttctgtctctctctccctccctctctctctctctctctctctctctctcacacattatatccatgctgatgatgttaatttaagtgacttaagccacttaagaggagttaatatgtaagtccaagaacccatacttgcttatgagcaagtgacttgtacttgaacaacttgatacttctggttaatgtttgaaaatctaagaagttaattagctaaaaaacagtaagtgagggagagaaggtgggtacagtgtacacagcatatactttataatcactctatatatcactgggaaataaagatgcaaactggtcaagctgctgacctgacagttctgttctacttctgccacttaccttggtttctttccaagctaacccacattctgaaacattcctcctctatatttttgctttttttttttttttttactatattatgtatgcaaacccaggagccataggctgccagtgaaagtgattccctcattattgtcctttcattctttttatgagagtaatcaagcttttcacctggagcaataacatgtatcagcctggaggtctctctatgccatgcattgaattcaaataatttattccttagataccctgcaggatcgatatatattttttctgatttaaaagaaatcaagacagcagggaaagagagaaaaaggagtggaaagaaacaaaatgaagtaaaaacaaagagcaaaaataaacatacaagacaaaatcagctccaagtatcttctcaatttgcttgctgctgctgctgctggctaagctttttcagtcgtgtctgactctgtgcgaccccatagacggcagcccaccaggctcccccgtccctgggattttccaggcaagaacaatggagtgggctgccatttccttctccaatgcatgaaaatgaaaagtgaaagtgaagttgctcagtcgtgcccgactcctggtgaccccatggactgcagcccaccaggctcctccatccatgggattttccaggcaagagtactggagtggggtgccactgccttctccaatgaggtcaatagtcaaatctaattaaactgtacatctaatatttgtgcattttctaatatctaaatgagacttcaggaaaaaaataacagcattaaattaatattaacacactcatttgtgtgtttaaagtcttcatcttaggagcatgttggtccctggcttctcagacatttcatt

SEQ ID NO: 38704 - DNA, 884 bp, Bovine  19866880805514
caggaactgtgcagaaagtgacctgggctgatctgaggcacgtgtattgagagctttaggaaaacgacttttcctctctaagcctcggttttcactagtatcaaagtgacagattcaaatgtctctcagaagttacttatatgaacaaaatgaaatattctttattttcataaagtacttagcctcacacctggtatacagaaaatgtagaatatatgatgattaaatatccatccccagagtaaaggataaactcatattttcccaaagcagtcttagatgacagcatgaattcgatgatagtagccaatccctttttatatcgagaggaaccgtagcgttatggggctgagaagtcttatttagactataaattaggttacaaacactttgcagtcagggaccaagtcatatatgatttctttatccccagtgcctagcaaagtgcccagtaaacagtagatgcaataaaactttgatgaatgcagctattaaaagggaaaaggcagagccaacaaacactttctgcccatcaactgtggcaaatgggaatagaccagtttagataattttagttgttgaatgagaagtgagtctgaagggcttgacatagccggctttgaattgagctgtgatactcttctgtccaccagggactgaaacaatcatgctgggctagcaagttctcagaacacttctagccacagtagctgttatgtattatgatctaattgccattgttttttctgcaaggatcttttccactaaactatgcaatgatacattctattaaaataatgtgtgtgtatatatatatatatatatatacacacatatgtgtatatatatatatacatatatatatgctccttccttaatgcaca

SEQ ID NO: 38705 - DNA, 851 bp, Bovine  19866880922290
atatgtgaagcaaggacaagatctttaacgatgctgggcttttccttcttagcttctggagagaccatcagcaatggcttctttgtggttcccagagccagggtcctactctgctgcagcagtgattagtctcatggcagctaaaggagaaagggcggtgggggcggcgggttcgtttacaagctgtgagatcactgcagacctacctcactgtgttgtcacggggcaaatgcaatagaacgcattgggtgatgtgtgtctgatccttgtctcccccagctgctgcccccctctagttattatatttgtctgggctttgtaggacttcacaagtagctgatttggtgactgctaggtggcctagtttgtgtaaatataatgtgttggtcttctccatgttcttttggggttttattgtttacaaactttttatattgagaaaaatagccaaagcatctttgacaaaatgttctgcaccaggcaaagagatctgaaacataagcttgggggcccctcttgaagttggggggggtcttgaactacactttcttttgtgttccccttcctctatttcctatttcaaacaagatctgtcctgaaaactagattcctattccctcttctttccacctttgtgcccccccgaaatagaccatatacctatacatttaatttgtggggtatctgtgattaagtgatttgtgcaaaaatcctgaaaaggctaagattgctccatcccttgttcccaatttcgagtcctgtccattccttgatgtaactcatgctaaatggactgatgtatttggttggattaagaccaactccaaaggtagagaggagcaatgaagggg

SEQ ID NO: 38706 - DNA, 1136 bp, Bovine  19866880948598
aatatagacagaaattccaagtagtataatgaaaagctactgttagaaacttatggttgaaatagaaaagtggattggaaagggaagtcagtctccttaaaagaagagatggaaaattggtaagcagagttaacagaaacattcaacaaaaggtaaaagttgtggaaatgtgtccaatatatatttttccaaaataaaatattttcagtttaggagagctgctcttcaaatacaagttcaagtacagcagtgtattgcacatgcagacatttgtagcactgcttcaattatagtctataagtgcctttaaagcataaatgtttttatgattgacatggggagagtagtaaagagtgaaggatgcaatggatttctggtgcaacaagggtgtgtgcaattcataaatacactaacaagactgttgtatcaaaaactaaatatataggacataaaaaaatcttattttacagaagcatgtttgtcttttgctttactagtgttgttataacacattaacaaagaaaagatgttgttttgcaaccttcccttcacacatttgtaggtcctgctgatggcagaaacaagttttgcctttcctctttgtagaattgaacttgatgaaactactccacttatctataattttacttttaataactttcaagatttcaggggctaaagagagcatcatttctatgatgcaatcatgaagaaggttgaatgacccaggtgaattacaattttgattcattttgttttgtagactgctgagtttgtaacaaaatgctcagtcaagagacaatctatctctttgcactaaaatcccctccttaaaaacctgtgattttaggcactcactgttccttagctttccctttaggttgctgataacagctttcatgtgaaataaactgtgataccaaaaatatgccatgatatcgctctaggctttttagatcaccaaaaaatatgctgtttttatgatcactgagttcttgtgctttgtgtcttctactaggtcaagtattaatttcatacatataatattattttaaaattatcaaaaaattcaaattacaaatagcttattttaaaagttgatatatttcacatataaatgtaatatcacagaaatg

SEQ ID NO: 38707 - DNA, 1099 bp, Bovine  19866881179598
aggtaataaattaagaacatgtgagaaaatttcatggaaatgaagcagcaggcttacatatactaagtccttgaatcatttctcaaaagacatgtaatccataaaattattgtctactttgttctggagcaaggcaaaaatgcactattcactaaactatctttgataatataagggaagattgatttcatctttttcccttttcatatgaatagtcattctccccagagaatgcctggtgtaacttagtgttaaaaaagatacaaatttatgtgcaccatatgcttccttggatctgctttatggcaaaggctaaaaattattgcagcaaagtagtgatttgtgatcaaagggtacagcctcagctagttcacagaaagggctgcgtctgctctggactagaactgagtgagttcagtcacctgaagtcacagaaattaaaactgccatcccaagacattgaaagggctgtttctacctttctcaaggattctgcaattttgtgccttaattctgccacctgctggtatgataaagaattgaaaagagttgactagacttcaatgtgagttttgcaagaaacatcaaattgtttcaaattactttgacaaaatagctcatgttttgtcagcaaagttaatgtgtttcttagactttatgatttcttaaatagttatataaatatatttagtggaggaagataaagattgtgttttatgtcaataatttcctattttccataatttgctttaaggacttgatgttaaaagattttcattgtcagggactcagaaaatatgcaacttatcaagtaattttataggaaattcaggtaacaaatacatatggcttgcaaaactaacaattaaaaaaatagtttgtaaatttccttggtcttgccagtttcttggcttctcatgccttctacggtaatgtgggccagggagtgtagccacaatacagtcacatgagaagaagctattgtgttgttgctgtacaataatcatacagaagaggagctaaatctgtgctgagagaaattataggggcactgtgtaattatggtttgcaaggaaacctatatgattataatttgagg

SEQ ID NO: 38708 - DNA, 1154 bp, Bovine  19866881866079
ttctggaatctattgactggagaaattgtaaaatccttaggaggaaaattttgcaactgaataccaaggttacaccatactgattcctccagttctttccaaaaagaatctatggccattcacttggtttactttacaataaggaaaggagaataattttatattttgacaactaatgaacacagttttgagatggcatggattcccagagacctagtatatcagcatggacatcatggtggaggcagcttatggggaccaaataataaatatcatagttgaccatgggccctgcctgtgggggtaagagttaacactgcagaaattcacatccccgtctccgagtttcacaaagcaatattttctgtgctttggtagaaaaatgaatgaactaacctggaagcaaagagagaggaagatactgtgatccagccaaaaaaaatgtgacagaagtagactaaagataaattgagaattaaatttaaaaatatgctttaacaactgtgtctgcttcaaaggattagaggaacaacaagggaaattaaacattaaaggaagatcataagtatatctaattgttatggtaaaggaggtctcaagtaaagagtgtttatgcagtcactgatgttctgcaagttatttgagacatgggaaactcaaacactgagggaaggcagtgctttggggagaaccagctggtagtttctcactggatgcgtaatgtaacagaatttagaagaatcaatacagtcagcttcagttcagaaatctgttaatgatgatttttcagttggtataaatgttcagagaagagggaagtttttccaaagggctgaatttatggacctagagaactcaggaagagaagagaaaaatgagtgaaagttagtcaacaaataaaatacattccaaaatggccttgagtttctcataaaatggaagaaagacagactgaataacatgagagtggattatgttaaggctgaaaatggcaactgtggcttgttctcaatttagagtgccctgttcatcatagagaacatatttatgcattgtgattcttgcatggagctattaaggaaatggaaatagagtggtttcaaatattgaagagctccattatgggtagaaagcataccaaactattgttatta

SEQ ID NO: 38709 - DNA, 738 bp, Bovine  19866882123952
acatggagaagaccacacattatatttacacaaactaggcccctagcagtcaccaaatcagctacttgtgaagtcctacaaagcccagacaaatataataactagaggggggcagcagctgggggagacaaggatcagacacacatcacccaatgcgttctattgcatttgccccgtgacaacacagtgaggtaggtctgcagtgatctcacagcttgtaaacgaacccgccgcccccaccgccctttctcctttagctgccatgagactaatcactgctgcagcagagtaggaccctggctctgggaaccacaaagaagccattgctgatggtctctccagaagctaagaaggaaaagcccagcatcgttaaagatcttgtccttgcttcacatatccatccctggacagctcaagatgggtacagaggcattattcttataaacctctccttaccaacttccattttttataaaaacacacacaccctgttgtgcatggtcggcctagcccagtcaggtggaggatggatctggtatataaagtgagtaatgtgccctaggattatagatctggaacaggaatcctttgtcacacatacagacgacctttgcctaatcttggcttcccctctctgcacttcttacctggcccagcctctcctaacctctctgcaccacgttttcctgttcagaccaatttccaatctttcagtaggaaggagaccaagtcatgggg

SEQ ID NO: 38710 - DNA, 1496 bp, Bovine  19866880437880
tgatttttttctcattttttaaattagttggagagtcaaaactctcttttctggctcaaactgttcataggcttcctacccatctatcatggaagaagcacagtgccttttaacaaaagaggaaaaataaagcataggatgcaaagtacatcaaaattaagactcaaattaattgtttaagtgaactgtaactgctttgtaaaaagataaaattgccctgcaagatcagataattttctattcacttagagaaaaataaaatgtgatttccaaactagcagaaagggcaactctactgaaaacagaacgatggagactactggctgactgcaaattgtatgttatttaattaaactgtattacaaatgtataaattttctataaaatgtgaacatatttacacccaaaggaggagatattaaaaactatgtctgaaataatgtcatctcttagaaaattttcatcaaatctgtaccttcctaaagtgtctacatgattaatgccatcctaaaccctttctttggctttcagactctcagtgcctctgtttcatctgatccttcaaatcagtcacccttcctcatcctttaacttgttcccttccacacctgtcttttgcccttgattctaatcaagacatatttgggaatctcaataagcttaaaataagagaatagtaaacaaagggtacacaaagatataaggtgatctttaaataaatctcatttcaccatattgtagtagaggaagcatttaatgagttttacatctggcaccacaatctaaacaccctgaacataattttccagaaaacgactagttagaatctgttggagagcctagacagagcctttagtcagctgatgctcggtaccacacactgcgtgagacggatgtacgcttacttggctaataagtccaccttcaaactcagaaaactcaaactgaaataaataatcaggtaactatctcagcagccacagaaaaaaagtaaaaaattagtaagtttctctgcaaagaaatatcacacactacaaaaaaaccctgtttcaccacttctaagaccttgtcaatgataagatgcactcttatttgatattccagcaagttttttttttttaaactgtcaattcaagtatgacatgctttgattccaagatgcattctgatagaagagatattaaatgtgaaaagaaattgtatctcctaaaattaaaatgtgataatctttattttgactttagcctttgcctcttcaaagggaagtctcagtctcaatcgtagaatttctattttcaaaatttgcttaagcagaaaatgactttataaatgtagacatcaaagcccaaagagtgacttgatctgatatcagagttgtagacactggagacaaggagttaatataacagaaaagaaaaatagtctttgctttttgagggctaacgtttgggggggtgtgtttactgtatggttctccataccctatttaattctat

SEQ ID NO: 38711 - DNA, 4498 bp, Bovine  19866880468515
cttaatttgggacacatacattttcatatgttatagaaaaacagaatggcagaaaacaaagaatataggaatggatcttgaattacagttctggaagggattgtataaaatgagtccaacattttgaatttatgaagaatgtaatatcccaagacactaagggatgtgccccaggtcacagttagctaattgcagaaacatttctagaaacactaatcaggttacaaggctccaaatcaatttctttctctgttgtatcagccttttgaatatgtttaagttgggccaagtcattactcatgtgcattctcatcttagtattggtcatagaaaagttctgttagatctagttggccccatgagggtagccacttcagggttacccaggtgacccctggataaagtcttaaatgacttgctgcacattccagctcagttccatgggcccaatactgatggttcttcatcaatgtgtttttaagtttttgccaaaatatagggtgagtgaatttccctcatgtctcacaggggtgttgctaaacgacttcctcagacctacactctgtgatactttcccatgagttgttcccagtccagtgtccagagttagcaggtttttatttcttcgtttggttggattgagaaggaatcttcactttttgacaccttcaactttgtatataaaaaactactgcaagaacatcctgtgcctaggtctctccaccttggaggtttacctgtggttctactcctgtgaggatggagtgccaccccaccccacccttcttctgctctgctgccagttacttagctgatatacaaacctggtattttttgatctgcaggatatatagttagtatacctgcaatatacatacatacatacatatatatatatagttggtatatagtaggtatatagttgtggtgggagactgttggctctttttcaaataatatatttcactctttctcatggtataatgtgcacaaccagtatttaaaattttggttctgtttgatcagtctgaagttagtgtaaatcttctaagttttggtaataccttgattttcatttcttcttttcagtgttgttctgaagttttttgttttgctttttcttatgctcccaaggtactttattaagaagaaaggaaaggctatatgagaggctgatacagttattaatatattgtaaactggaagcatttattatttctgattttataatcataaaactctctaaattactttctatttaatatgatacagatttcaaacataatcagaatgagggcagacagtattaactctgaagagtagatataaaatgtgtgcatgaacagaaaaattccataaaatgcttatcatgttggtttaaaaacaagtgtggaataaagtaaaacttcacccaaactggttgattttgaaccccaaatgctccaaataggaagtaaaatttgtgagtttttaatatattctcctttaagcttaagagttggaaatagattgtcaagaaatgtaaaaatcatgcagcacattgtgtctgatgcatagcagtaatcaataaacattattttctctccctttgttccttctttccattggcattcttccttttgttcaccccttcttttctttttgaattttgacttatactgaagatgcaaccctataacctaatagcatgtgtcaatgtctttgttagtgggagacagccatggtgcaattccacttaagtgtttattgtctcagatgaataatactaattttttaagatctgtctatctacccatgcatttatccatccatctgtctcttctgaggaataagtctttggttactaatttttgaaaaagtaatagtgggaaagacttcttttcaaatagtcttatatttcctaatgatggcagttcagtagaagaaaaatgctagaagcaataccactaatttcaaaagagtagaatataaattatatatgatatctctttattaatacaagagtaatgactggagaagtatttttgctatttctttcccatctttaccatttttctcagtacctaaactttaaatatataattattaaatctagtttcaatatttgacaaaatactttgaaagaaggtatttaaagctctatagcttgactgctggtcttttatacaccctgggtggctaaagccagctgtatagaaagttcttcaggtgtcttgaagagctatcaatggaccattaaatggccctgtggtgccataaagctatattcctagcaacagttgacccctatcaccatgttcttccctgcctgtcttctaaaataacagttcgacagctttatgtacccatgtgtagcctggtaatgggatctcaggcaaggtgtcaggatcatgttcagctcagatatgttgacctgtggtcaaacaatggataacgtgtcagtcacaggattcattttcaatatgagactttgttctaaactgtgacacatttttggtatatgtcacttttgtgtaaatcttcaggtgaaatcataattttgaggaaaagatacaggtaaatgtatttgggggtcctttctgtttttcttttcttaatgtgtgtgcccctgtcaactgccagtcaagttcatggaattcacttcatgcatatctttgggaatgctttatggtcattagagtcaaatgggaaagatggcaaacaaagcacagataatgacaactaaaggcagcatgctaggtgaatgtggtgatgcacaatttattgctttgaaagatgggtaatatacagataggtcaaatagataggttaggtgatggtgggcaaaagggttttaggcttgttgtggaggaccaaattctcgagaagagtagaaactcacacaaaatagtatttaaggaagattgataaaacagtgggccatcaagagcctgaaatagaattatgattagagacgagagactataaaactatatttgcctacatgtaatgacatgggctccaaaatcactgcagatggtgaccgcagccattaaattaaaagatgcttactccttggaaggaaaattatgaccaacctagatagcatattgaaaagcagagacattactttgccaacaaaggtccgtctagtcaaggctatggtttttcctgtggtcatgtatggatgtgagagttggactgtgaagaaagctgagcactgaagaattgatacttttgaactgtggtattggagaaggctcttgagagtcccttggactgcaaggagatccaaccagtgcattctgaaggagatcagccctgggatttctttggaaggaatgatgctaaagctgaaactccagtactttggccacctcatgtgaagagttgactcattggaaaagactctgatgctgggagggattgggggcaggaggagaaggggacgacagaggatgaaatggctggatggcatcactgactcgatggacgtgagtctgagtgaactctgggagttggtgatggacaggaaagcctggtgtgctgcagttcatggggttgcaaagagtcggacacgactgagcgactgaactgaactgaactgaactgaatgacatgggagccatagggtgcagaagaaaggtgatagcccaaaaagaaagaggcagattcaaaaaaaattttgtgaaggatcgttaaaattcagatgcgaggcataagtggctaaatgaaaggatgatagaaggaggaatctaaaaattagttctgctggaatgtgtatccctaaatttttctctttacattatattttcataaaatagtcaacgatcttaacttatctttccaaatacatggcactaacatctaaaaggttacagcaaatatactaataatggagagaaataaagaagtaattgagattggaaatggtgaaaagagaatgatgggaaagcaggaatagatattgcccccctatagtcttgagagataaaaagaaactgccaagtacactgaggctttgatattgcatccctatgtccatgagtgtgaagagccaagctggagccaggtcagaagttgctgatgagttcttacctggtttagagtcatcactgcagccctaaagctctgtaaccctacattgctagagaggtggttggagaaataccatagcaaggtcttcctttaatagcacacatttcttgtttcctctgtgccaggcagtcttcatagatctttatgtgttttcatttggtcatcacagtacttctctgtggtcagtatccttattatcccctattttgtaggcaaagaatctgagacccagtgaagttaaatacttgatttctgttacaaagctgatgaatgttagatatgaattaaaactctgacaattatcctgagttaaatgaaccagtgctgctcacccgaagctttttctacagcaaatatcaaaagcacactgaattactaaggaccccattaaaatcagaatggagagtcaataaggcaatcg

SEQ ID NO: 38712 - DNA, 3607 bp, Bovine  19866880554133
ggagagtgaggactccatgagatggcaacatcacgaggagggagagggacagggtgtactacttaagatgacctggtcgccatgtggttgtaagccagagcctcatccagagagctgggtgttgtgaagcactgacctagattagaaattcacaggggcgtttaagagcactctccacattgatgagaatgtgattttaaaaaagactgaagagaatgtgtccactggaatgggtaaagggaagatatatttgaggcaagactcttgcaggggacatatccttaggtctgcaatgttgtagcagtagacccatcagaggcaaggtcttgcagagggcacaatgttatgtttttatggtttccttttttatagcagatattacctaattaggaaaaagagattttattgcagattttactttactgtaaaagtcaaagcactttcaggaaatgaatgtagcattctcccaaagtgcttagctaaatgagaatttcaaaaaatagcaactggcaaaatcttcccctttccctgtgaatgattgaggaaaagagaaataatagaataatctgccagaaaaagataaatacctgttcatgtagatgaactctctagtgctagacattgtaaaactgttcagtgaattcgatacaaatatcagcctttatgggaatggcagagttgaacttacatattcattcaattttgattatttactactcacagccttgtgctagatgttattaaggtggctccactaatgcgctctctttctgcattaaagttatgaattcattaagaaatatgacaaagaaatgggtttgtcctaggattcccatccatttcgaaatccccacggagactatcagtcagtagttcagcttggacacaccaggtgtagaccacgagtttttcacaaagatactgttaaagcaacactgatacaataggaagggttataaagaaggggaaggaagaaggatttgataggaagagtttcaaactgctgtgcagctccaagaaacttctgctaggttgatccaaagtgcttcctgcttagacattcaaaggaatggactgtagtgatatacagtgatatacccacaagtttcagttatttgctgtgatcaacctgatgtagcaaagcctcaaaatatagggtcatccagagtgcagctctgcaggctgactgcccatgacctcagtagcaggagaccagggagctgccattcctgtcaccatacccggtgtggtactgtaattcttttcctttcagactaaagtccagtcggtatagttatgtactggtttaaaaaaaaaaatcattttttccatctgcaaatgtctttgctttaccttcatgctttaagtatattccctgggccacaatactgtatcagccgattttacttcagtcttttgaaaacagtgtcgcagagtcttctagctttcattttgtggtgtatcagttttcagtctaattctctattttaaagtaagttactctttctggttaattttaagacccttgtctttgatgttctgcaatgtcagtacagtatgcccaggtatcatttatttatgctaacagatttgtttgcattcctgaatctaggcattcacatctattatgaattctggaggttttaaatttttttcttctgcttccattattattttttttttctggatctcaaattagacttacattcagccttttccctgcagttgtaggaaggtacatggggatagactttgctaaactgaaggaaaaactgattaaaattatgatacttctaaagatctcctccattgcctaaggatgtagtgagagtgttgtgttagaaatgtctgagcagagtttgggtgtgcctgaggaatccttcttgctaatattccaacatgataaaggtgaatttataagataatcttcaacttccttaaaatcttaaaattctaattttagtataataatgctcaaataattttatttctaaagcctctaaagagttgttaaatatagtactttaacctacatctcatgataatatgtgtaaaaatggcctatcttaccactctttcaagaatgccaaacttaatttaaaatgttctagacagttgaccttgatgttcactcagcatggattactgttgacatgaatagtgcagttacctgtcaaaattattttagattgcctcagtgttcttgtgaagctttaatcaatttaaaaatgtgtattaaaaagcaaatcttccctctttggctacagttcccatttactgttctgtaagtcttaaaaaaaaaaaaaaaattctggcctatatggtctttgaaaacagaaccagtacttctgtttatccaaatgttgtcttcagaaagcgtgtccaccactgctcctgatttcttgtactctttaggttcatcatgtaattcatattgtttcaggaaaagggaccccttccagggcccaaaactgggctcttgtctaacactcagaaaagaatttttcaaggagacacatgctgacaaagcaagagattttattgggaagggcacccgggtggagagcagtagggtaagggaacccaggagaacagctctgtggtgtggctcacagtcttgggttttatgttgatgggattagtttccaggtggtctttggccaatcattctaattcggtctttcctggtggtgcatgcattgctcagccaagatggatgctagcgagagggattctgggaagtggacagacacgtggtgtctcctttcgacctttcctgaactcttcctgttggtggtggcttattagttccgtattccttatcaggatctcctgtcataaaacaactcatgcaaatgtttactatggtgcctgtccagggtgggcggtttcagtgtgcttcccctaacaatatcaacctactcccccccaccacccgccccatactgtctttattatcactttcttctaagtcaaacaaacaaaaagtaaatacattaataggtgtagaacatttaaaacaatgacagctgatacatgagagagtgacatatgaaactgggagaagagtttgtggcatctctagccttgttcatggtcatttgggtcatctttatcgtgctgtcctctgtgactgatggtgtacaacgcccctctgctccctgtctggttaaaggacccctttagttattgtacagaaacatgaccgtaggagcaacctacacacatgaacactggaagtcctgcatttccgggagtgagaatcagtgtgttgggagtctgtgttttctgcaaggattgtgacctaaagctttttaaagaaccatccacctttggggaagcgtttgtgaattatccatcaccagctgtttgttcctggataccaccacaaatactagattgacagttaaagcggttatttaatttgagacacctctggatctggatgagacattaaattgtcttcccactgccaccccccgcccccccattaggtgaacagtttttaaactattagttaaatttcaagtcttcagaaaagtatgtgcatggcccatagcacagtacaggtagcattagtaacagtttccattgtagaaggttttca

SEQ ID NO: 38713 - DNA, 1102 bp, Bovine  19866880629627
atgttgaaaaaaatacataaataatgtggagagactatttggagaccatagcatcattttggtgtaaactgatggtgacattcagtaaattggaggtggcattgaagttgtagagaaaaagactagtaactaatgagattttttgagtgaggaaattgtggtgcctctgtttctatcttgggcagttgggtacatggtgccatttatttaggaaaagaaccattgagtggaataggatacatttattttggggcaaaggaaagataaaatattatgcattcaggataaaagttattttctcaaccacttattatttatcttttcagttattaatgatgatggcttgaatcctatatgaagcttcgtgcttgcctatgtctaaggctgctagtctttgaaattgggtatataaaaagtctgaatacaaacaaatgaaaagcaacaacaaaagaatggcaataaaaataattaaatgcattgtagtaaaattaaaggaaaaaattttatatgtacagaatttaatactgtgtcatccaaggagcaatagcaatggcaaagaaaacaatcattaattaatggtactctaaattctctttactcttttttttttctgattgtaccatgaggcatgtgggatcttaattccctgaccagggattgaatccgtgccccctgcagtagaagtgtagaatcctaaccactggaccacgtgggaattcccatgatactttttatgcttaaaatattaagttttaaatctaccttagttagatgtaatttataatgtcaacagctctaaatgctgattcctatttatttcatgcaagacttgcatggtgttctataaaacttggtatagcacctgtgaactaaagttaagagcctaataaatatgcttttaatgactccttatctctcacatttcactttcatttttatctctcacatgaatacttgtacctggctatttaaaggtaaattctggtatcaaatttaaccataccttataactaagtgttgggcaggaagtgtagtgatgtgcacactaaaaatgtgatttcttttacaaggaaaaaggttaaattagaagttaggaggccaa

SEQ ID NO: 38714 - DNA, 2846 bp, Bovine  19866880652615
tgaaatttctcttaatctcttgtttaactatttatttcaaatctgaaacctaaatctactgggtaaaacatacacaaaaaagaaaacttaaaagattatgcatcaatctacatacggcagcatccttgttatctccaataatgatttttccaaatcatgaagattaataatatataagtagtttaaaaataaatgatggtgagcaaggaatattacagtgagtgctttaaagaatacttttacattaatttgaatagaaatgattctgtagaaattaatgcctaacactatttttattgctataaagaaaatgtatatatcacagtaaattgttggaatggctttttgttcactataaagcattcatctgactcattaaaaaatgttttctatgttttataatttctctttgtgttattgatcctttttcccacataaatattcacatttttattctttatgagttaccaaaatgtttgataccgtcagcagagctgggatttgtaagcaaactcaaaagctctgctatattctgatatttcttaaagcaattctctattcagcttcattcacatctggttcatgctttgtttcaaacaaaataaattataataatgtaagcttagactatttcaaaactatttcagactactattggttttgttgttcagttgcccagttgtgtccaattgtgcaaccctgtggactgcagcacactaggcctctctgtccctcaccatctcctgaagttcgcccaagttcatgtccattgcattggtgatatgatccagccatctcatcctctgacagccctattctccctctgccttcaatctttctcagcatcagggacttttccagtgagccatctgtttacatcagatgaccaaaatactggaatttcagcatcagcatcagtccttcaaatgagtattcagggttgatttcccttaagattgactgggtttgatctccttgctgtcaagggactctgagcagttccaacaccacagttcaaaggcatccattcttcagcactctgtcttccttacagtccagtgctcacaacagcccatgaccactgggaagaccatagccttgactatatagacctttgttggcaaagcaatgtctccgctgttcaacacactgtctacgtttgttatagccttccggccaagaagcaactgtcttctgatttcatggccgcagtcaccatccgcaatgatcttggagcccaagaaaatgaaatctgtcactacttaaaccttttctccctcaatttgtcatgaagtaatgggacaagatgccatgaccttagttttttttttaatagttttaagctggctctttcattctcctccttcaccctcatcaagagggcctttagttcctctttgctttctgccattagagcagtatcatctgcaaatctaaggtcattgatgtttctcctacctattacacttattccagcttgtaatttatccagcccagcatttctcaagatgtgctcagcatatggattaaacaaacagggtgatagcagacagccctgctgtactcctttctcaatcctgagacaatcggttgttacataaagggtcctaaatgttgcttcttgacctgcatacaggctcttcaggagacaggtaagatagtctagaattactattacatgcattttagagaagagaaaactgaggtacagaaaaattaaatatttggtttcattaggcatttcattggtatttctaatcactctataaggtgactgagtagtctgcagaactttgtcccccatcctcactaatttctatgactgtaggagagacttacttacatgttctactgatgatttttctcttcattcctctctcaacgtttatgttatttttatgaggaagaaaattgcatgagatgattctggtaaatccctttgctcagtgttgtccaaaaaaagtaactgctccattatatgtttatgatgtggatgctgatagcaaaaatttaggataacagggagtattttgtaagctttaagcaaggttctaacaatttgtaaattccaggtagattgtctacaaatgaattcctggaatatagcctttctattagcagtaaagtcacttttttattcctttgaaatatgaaacctttgttaatgtgtggtggctggatgacaaaagggtacacaaacagctgctgtattacaggtaaaatgaaattgctttcgacaggatgggcaaaagaaaccccagcaggctacagggcaagatgcagtgtcagcttgcataagcacccacactgaacggatgcaaagaagctggggcaagacagcagcagacagaaccacacaactcagaaacatcagacaacttggcggctcactgtggaaggaagaaaaagaaaggaaacgctgtttgacaacagagtaaaatcagtcttcatttgtatgcagctggaaacaagggtctgttggctttcacttgccttttaaaccagatttgcacagacatatagccacattatctacatatgatacgaaagtgaaggacagtggtacatgtgttaatccttctacctttatcccattgctttgaaaattctccaaaaaattcttaaattcaacaaaataattcaagtgcccaggggacaagtgaagtcactccccagcctggatgacactgaaaagatattcccttcttgatggatacaaggacaatttaatggcagaccagacactggctattccaggcagaagaggagttatatttggaattataaaaagattgtggctaccttcatcccagagtttaagatgacatctcactttactcaaagtt

SEQ ID NO: 38715 - DNA, 1500 bp, Bovine  19866880664857
tatttcacaggagagttaaatccagttcttgttatgaatcagtatgtagattgtttattacagaagtttactctgttctaactactgtaaaaaattattataaaaagagtgagctgaataacttgaaatatgctgcatggtcaaagcagtcaggcagctattgtagcaaggacacagataattcaggttggatagctatatacctctcttgtgtcagagaaaatattttctacagctgtcacctttgataacttggaaagcagactacatgcctactaagtttgccattctagaagaagcatttgtatagagccagaatgtcaacatgtatcagtggttccttgaggattatagcagggtactataaaaaaaaaaacacataggtttaggcaaaatttgtatgctttagaagcaagcagtggagttaattaataattcaggccctttaaggttggaaagctaactgcaatttcattcctcccaagactggtgtttcagatagcctcaagatatataccattgtgtatgtatatgtatgcatgcatgtgtgtgtatgagagagagagagggagagaaagtagagcataaaaataaataaatggagcaagaataagttccatatccagaaaagattttaatgtgaatattagcacatagatcttactataatcacatgttcctagaaactttttatattttttggagaattatattactgatgaaatctaaaacttagcctgagaagtatgtgcctaattgacatttgatataactctttggatcccagacttacaccttttaaaagtagactatggaagagtctcattgcccaagaaaggcatactctcctatttacactaaactgttgtattaaaggatcatggctaagtaaagaatgtctgagcaggtgaattcagagccaagaagagcaatggatgatgtatttcctttgcttgaggtattttctccatttatagtgaagattgccatggttaagagtaagctggtcataacttttgggctagcactttgactcaaagagattatctgagaatatttttcatgtgtgtacaagacatatgtaaaaggaatccctttctagcattatttataaaagaattactcacacaatgcagctgtaagaaccattttatagatatatgatttcaaatgtgggaagatctctaaaacttagtaagattttttttttaaaaaagattatataacagtatccatggtatgctctatttctgcaaaggaaaaaaaaaaaaaaaacaccaaggagtgaactgtgtatataaaagtgcaaatgggacctaattaaacttaaaagcttctgcacaacaaaggaaactattagcaaggtgaaaaggcagccttcagaatgggagaaaataatagcaaatgaagcaactgacaaacaactaatctcaaaaatatacaagcaactcctacagctcaactccagaaaaataaatgacccaatcaaaaagtgggcca

SEQ ID NO: 38716 - DNA, 921 bp, Bovine  19866880696570
aaatgtaattatgtcactgaagtacctccaactaagggaaaatgagaaaataattttcttgcaatgaactatgaagcttgagatagggacatgttctcattacttttccattttatttctctgggactcaatttctcttggaaatagaatctatttataaaaccaacacaaaaacactgctacattcttttaaagatactgggaactaaagggatactcctaaattcaaaaccactattttattaatagccgtagtgaccattaatttttttgtctcttttcctaattgattttgacctgccaataaaaaaatttaactcctgaatggaaaaaaagaaaaaagaatcactgttatattcttttagatttcattctttagatttcatttattagcttaaaaagctaaaccatagaaaaatcagtacgactggttaacctaaacaaagattaaaaattttagtacctataaagtgatataacctatacttgaatagaactttgttgtcttagtagttatatcacgtatatctgaaatactaaaaaatgtacagtccttaagatatcaatccatttcatacagccctggcaaaagacagagaagcgatgccagctgattctcaaccctgtgactgagagggaatgattaagaacatagcatattaaggtttttctggagaaagagaatcaataagagatcagatataggtagatatggatgatatagatttattttcaggaactgactcacacaattgtggaagctggcaagtctaaaatttgcagggcagaccagcaggctggagaccctaggagagttaagttcaagttacagttcaaggccacaagccaaagtccctcttcctctggaaaactcaatctttttcttttaaggccttcaactgattagaagaggcctatcta

SEQ ID NO: 38717 - DNA, 1550 bp, Bovine  19866880703606
tgatcgtgcgtgcgtgcgaagttgctttagtcgtgtctgactccgtgtgtccctgtgaactgcagcccagcaggctcctctgtttctggggttctccaggcacgaatactggagtggattgccatgccctgctccaggggatcttcccaacctagggatcgaatatgcatctcttacatctcatgtattggcaggtaggttatttactagtgccacctgggaaacctgaaaccgaaggtaatttcatggtaaatcttcctttgtgaactacagaattaaagctgtgaatcagttcatattgatgtccccagtgccagcttggtaacagtaagaatttccttactacctctcgctggagttcaagatcatttaagaatctgtttgtaattatttcagtcttcttgttattaatattagtgtactaacatcagtgctgttaatattaacagtataataattatactaaaatactatgagcggtaataatattagtattgttactgttactttcccttacaagcattccttgtaaaggaatagttctggagcaaactgtgcttggtttatgcaagtgttttcacctagaacagccgtgaatcaggctattctaggcattttctttcacaagtcttaaatatcttgggtgtaggaattcaaagaggtgtctgtaaaatcttcattcttagtaccatataagccacaattttagatctaaaaaagtcatgtgacaatatgtttggattagtaagttcatacatcctgaaggctaaatttccttacaataagtaaaagtgaaatggttatatggaaactactatagcatacaggaaaaattgcaggctttgggaaagcctttgggaaacattaactcaaattctgttttgattttaaaactttctgtattctagctacttggccttatcacctttggcaaaatgaagaaaataatgccaacttacagctctattgggagggtggaaaaggtaatgcatgtaaagcacctatattactgccacagaatagatggaaaataaatataacttctcttttcttttttcatactagcagataaaactattaaacattatttttcttaattagaaataatgtaagtgtatggtgcatgaagattttaattgattcaacatttaatgatttattaagttgaaaatagcaatcatataaaacactatgctattttaaagtaaagcaagcaaaattgcagatataaaaagagaaacattcttctgatgtagtgtgaattaagttgttatccaggcagccttgagtttggattctgaaaacaacatttttgaaaaattcaaagttcatcctttgaggaaaaaaatcaatgatatattgtcgacttagctacttcagttatcattcctattagataggaaaccatatggaagaaggggtaaacactacttcaataactcagatcttagaatcaatatggtgatggaaatgatacctatgagagttaatgaaacacctaggacacctttattgggggaaacactctagaaaagaaatgggaattgaat

SEQ ID NO: 38718 - DNA, 588 bp, Bovine  19866880713102
caaacaataaactgcacccatgtagttaaaagaaatgtcactctggagtcactaactgggctgatgctaatgtgtgtttttctgaagcaaaaatactttactgtcaagcttggagaaaaacacagagtaaagcttgtaactcaccactcctttgctgatttcttttgaagactgataaaagtttggcaatactgattttatcctctaataatcatcctgtaagcagtatttcagaatgtcattacaaccccaggaaaagagagtgagaacaagtttaacgctctgtgtacccatttgtgtggcactagtggtaacaatttctgataatgtgcctccatttataggagcagtcatttgagttttcagcatggctggagtagttttttagtttacaagaaggcagtaccgatccatttcagaaaggatatgcgttaatgtgtatctaccctggaagagcaaacacggcacatccacaggaggcttggtgtttaatctaaaaagagaagcaaagggtattctcagttctgagaactgtttctcacataaaattgtgttccctagaaaataatgaaagtcatttttgggaat

SEQ ID NO: 38719 - DNA, 1395 bp, Bovine  19866880758999
attggcagatgcaagctactctatataaaataaacaagaacgtcctactgtatagctgctgctgctgctaagtcgcttcagtcatgtctgactctgtgcgaccccatagacagcagcccaccaggctcccccgtccctaggattctccaggcaagaacactggagtgggttgccatttcctccgccaatgcatgaaagtgaaaagtgaaagtgaagtcgctcagtcatgtcctactcttagtgacctcatggactgcagcccaccaggctcctccgtccatgggattttccaggcaagagtactggagtggggtgccattgccttctccgtactgtatagcaccaggaactatattcaatatcttgctataaactataatagaaaaaaatttttaagaaaaataggtggattagggagaatttcataatactgtacagcattgttctaattgtgaaaaatacagagtatttcaatcaatgcaagacaaaataattttcttctcattaaaaaaaatttttttggctttactattgcatctgacatttttaggtcctattttgtttctctttttaaatttgaaacactatgttttcttatgattaagtgagcaaaacatttttcaaggtaatcttaaagtgcagtgttaattttacatcccacagagtcagacacgaatgaagcgacttagcagtagcagtagcaacagtaagacatttctgctgtagaaatcatgagtgaggatcatggagtaaatgctaaaagctggaatacactttctccctgaatatcagactatcttgagtgctgttcatacgcccacaggcagttttcaagttgataatggcatgaggatctttcaccttcacgtagaaagtggacgttctatggcccatcagtttctggttattctaaccactattggagtcatgaaaaaaacatgaacaactttcatttcttctcttctatttattctgtcatttgcagaatttagctgaggtaaagaggcacctttttctcattaatcattgtaagttatggaataattttattgatgggaatgttttgggcagtgtgcccaactcaaagtagaacacgttaagccaacccattttctcataagatgtatgtttctgtatcttcaaccaatattccttagcctgctgaaatacattaaaaaataggaaagataaatagtcccatctggctgttttgaggtagcggattaaactataaggcacgtggaagagataggttcatgcctgcttatagtacaataaataagtccaaaaatggacaaattctttataaataaaatcttgaaataaacccaaagccttgaaatataaaacactgaatgatcaagttgaaataggggcctcacttcacttagtaac

SEQ ID NO: 38720 - DNA, 753 bp, Bovine  19866880807287
attgaatggctggcagcagatgctgccgtaaaagctcaataattaggaacccaatatggagtgatttgattgaagaaaatttcataaagtaaagacatcttaggattttcttacagttttatgtcattttactttcttcatgattatcactgtttcattattcccaaatgacttttagaaatatttttgcagcctattgatatagaattatttattaacaaatgaaatgcttgtgttagattttctttatttcacaaagagcagaagtaattatgattaaaatgtagtccaggtgccttcatctgtttttcgaatttcttccttttatttttatttcattgaaaatgtattcattaccacattggagaactgatattcatatttagttttattaaacccattttgtatgtatattcttgaaatatttcaaagccattgaagatattgactgatgaaataccatgctggtgacatggcagataatgatttgtttttcaagaaacactttgggcatagtagatgatatatttattgatttatcagtatatgtggagaaagagcacagtaatataaagtaaaacatgagtctcttataccataaatgtttctggtttgaagtattcaaagtaaaatatgggattcaataggttgattttgcctgaaatgtaatgacatgctatgtttacatttaagaatcttaaatctcaagaagacatagttgtctctgtcccctatttttgccagagtgatgaa

SEQ ID NO: 38721 - DNA, 1570 bp, Bovine  19866880905244
ttttgagtgttggtaagcattcctacagaatatgaagattaaggaaaaaccaaatcttccttaagattgtaggatataagagaatagatgccagttgttctgttcaaagtgctgtgtgtccattttaacagagaagatttcaattctgtcatctcaaagattccttattaagtgtgcccttgctttagaaattagatgagttgttttttgtttgtttggttttgatagtaaagtatggagacagtacatttgtctcaactatctaaaactatcagggaagataaatggtgtttctctagatgccttgtcagcattaaggaaaataaaatagtggcttttcagtctgttgggtggtatagtctgtgagggaaattgatatttctcatgtactcacagaaagcattgttttcagctaaagtttggaaaaacagttcttttaaaaccaggcagcaacagcaccagaaatggccatttaaaacatggccacatttgacacattgcatggttaacaacactgtcatcaacaacaaagttcattttgatgataagtgaaatgtgacagttttaacttttttgactatttgttttcttcagtggtagcacatcagaatcacctgtgaatttttcacaatacagataattgcctgatcccacctcagatcctgattcaaaagtgttgggagaggcctaagtatgagagattttttaaagtcctatatgaaaaataaataaataaataaaagtcctatatgtaattctgaggtgtggaatctcagggttgagaaccacagatccaatggaggtgagtactattaataaaaaaaaaaaaaaaaaaaaagaggtattttgggatagctaagaatatagcaggaacttctctggtggcacagtggtaaagaatttgcctgccaatgtaggagaaacgggtttgatccctgggttgggaagatcccctggggtaggaaatggcaacctgttccaatattcttgcctgggaaatctcatggacagagaagcctggcaaactacagtctgtggggttgcaaagagatagacatgacttaacccactgagcacacatgcaggaatatagcatcaggttcagaagccagaaactattttagttttatagtagtattttcatagccattctaagtgtccttgtttatttaactggaggcacaggccaggttttgaagttactttttaaactcaagctagtcatcttttcaccaggccatgaggatttatgtcttttaggttaaatgatccagagaaggcactggcaccccactccagtactcttgcctggaaaatcccacggacggagaagcctggtaggctgcagtccatggggtcgctaagagtcggacatgactgagcaacttcactttaacttttcactttcatgcattggagaaggaaatggcaacccactccagtgttcttgcctggataatcccagggatggcggaacctgtgggcctgctgtctatggggtcacagagttggacacgactgaagtgacttagcagcagtagcagcagcaggttaaatgatcaacttgtaa

SEQ ID NO: 38722 - DNA, 1591 bp, Bovine  19866880938631
cctttttttctttccttttttatatgattttgttgcatttatatgtatcccttcaaaagcgtgttttccttttcttttcttcttttagttgtatttaactttctggaaaggtatgctacatgtaatattttgggagaatgtcccttaatgtaatattattttctaggatctatgctatatttcttttctcacttataattattttttcttctaggtgtgatgaatttaattaaatcaatttattttcctagtttaatttgttgtcactgggacaaatttatgaagaggctaggcctaaccctagttttatttgtcatggccatgaaatagtgaaattcaatcttaaattcaactttaacttaattgaatctttgctaccatcaagtaaatatcaatagtaaaatataattgaagtttttttggctttgcactataggacctttcctcagatggaccttagcgagatgattttagccaaacaggatagatgccgcaatttgtagtttgcatcctccagtcagaatgtacgtgaaatatgtgttaaagtagtagatactggatatgtcagttacagctgcatgtgaagataactgagtgatgctgtatctctcagatcaagcaaagttaagtacaggaagtttgtcatatttgaccactcaaactttttttaagttattctcaagttataggaaaaatttggcacctgattaagtgtataatatttgtgcccagtttcacaagaaagtatacaattccagcatttttctagccttaaatcaaaggctttcttgagcacctagaattgtgtatagttagaacacctcatgtatcagtaatgtatgctcttttagtgatgaatttgagatatattagattctcatttaaattttaatataagggtatgtactatttaaaatttatattttatagtatatatgaaaaagctaaagtatgaatattttatatccatgtttttatataactgaattatataatatttataaagtaattctgtttaagtatatatatagtaattggaatagaaacacagtctcattatgctttaatgaagaaatgagaatgatttatgattaatatttcagttgtttgtatgccatgcatgaaaacaatttattctagcaatatttagatttaaagagcttcctctgttaattttatttctctaaaagagggtttagcaaaactttcttatagagagggaatagagtgtagtagtttcaagcatgtcttttggaatcaaaactcatggttacaaaacaaagcctacctccttcatatactaactctatgatcttgggcaagttgcttaaccatatgaagacagtttcttgatctgtaaaatggtataaaaattagttctttcctaataggtagttatggcttcccttgtggctcagcggtagagaatccacttgccagtgcaggagccctgggttccatctgtgggttgggaagatcccctggtgaaggaagtcgcaaccagttcagtattcttgtctggaaaatcccatgggcagctaagcctggtagactacactgcacagattcagaaagtcggatcaaacccagg

SEQ ID NO: 38723 - DNA, 1051 bp, Bovine  19866880982763
aatgagtctgttagcattaaaaaatgaaacaagcaagttagccatagactgttcacagatgaaatcaataactcatccaaaacagcatgcatttctagaaatgtatttgttaactggttcacttgacctaccagtccacttccggtaactgtactgctcattacatttttctggcaacggggtatatttccaaaaaaaaaaaaaaaattgtaaacagatacatacatcttttgcaggagacctgggaatgatccctgggttgggaagatctcctggaggaaggcatggtaacccactccagtattcttgcctgggaaactcatggacagaagagcctggtgggctacagtccatggggtcatgaagaattggacatgactaagcgacttccctttcacttttcagtttcatgcactggagaaggaaatggcaaccctctccagtgttcttgcctggagaatcccagggacaggggagcctggtgggcttccatctatggggtcgcacagagttgacacgactgaagcgacttagcagcagcagcagcagcagcagagtgactaagcacagcacatataaatttttaatagggagaaaacttgaaaaaccacaggactttaaaggaaaactctgaggtggtagttctcattattgaatctggtggctttgagatgaaggtgctaattttatatctttaaatgctcaggaaaggggttctcagtgataaacagactaaaaaaaaaaaaagaagaaaaatctgcttgggtcctttcaaagttaagtgtgttttaccaaaggaaggagttaaatgtcaattttataaataaggaccaacatgtaaacttttttcttggtgagcaatcttccctaaaaataagtgctgttcactagctctggttacctggtgctatctgtttggagttactaataagcacatgcccaagtatatgctcaccaaataacaaacactcagtaatttagctttatccagctaattgagtaagtaattctgttttcttgcagttatttaccatatctcagaattcacttt

SEQ ID NO: 38724 - DNA, 1345 bp, Bovine  19866881005904
ttcatatttatgtgaggggcttaccctgacagtaaccataaaatggtacaagcctaagggctcaatctcagtttttcagttcttattaagtctctgttgtaggatggtgttttgtatttctgaagttgtgtactgacattacaaagggtggctttagtcctacctggacatgtttgctccagttgaattctgttttaagtctctgcttgctcctgcatggttcctgccatccagcacaatgagtctgttgattgcaaagtatttttcttcttcaggagccaatcttcctatcgatattgtttctctaaattacactttatggattttaggcaccactttcatctatttggaatctgaagtgtgttatcccagtactttaatatacagtagtttattcaccgaaaatatattctgacaatatttatttcatgtttgaataaccttgcctctccttcttgatgtttgtttccaaaatgtggagccattatagtagcctgcacgtctttctgtgaccattgttgtctcttcaaattgaagtacacagtcctagcaaactcagtaagaggtccagccagggaacaattttctaattttagactgtcactgcatatcgtttagtttcccctcagatttctgattgagattgttacaagggtattgtaaaaggaaaaggaagagggaagctttctctgaatatgatatcatgaagtatataaacttgacttacagtgggaaaattttgtgtattttctccaatatgaaatgctatttggcacagtatatgtttcccagtgtcatgttgctatagaatagttgcctatttgtcagaagctatttgtcagttttctcagtatctgcaggtggtaagtatgcttcagaattcagagaaggaaaattgtgtgctcccagggattcatgcaagtgcttgacaaaaatatgaccttatttctgaatatttgcacaacgtgaatgtgtgtagtcagaatattggctagtttttttttgctggcagggacagtttaatccatcttaatgagttgtggcagtcatcataacaatttagacataaaaatttttccacatatattttatttgttaattattgtattttcatttatatcaatataatttatataagaaagaaagtgaaaagacccaagtacctgtgagggagaagttctgttaatgtaaatatccttgtctggaggtttccatggacagaggagcttggcgggctacagtccataggatcgcaaagagttggacacccgactgagtgactaatacctttcagtttcactttctcaggtatggtagcatgtacatacttaggacaatggccttg

SEQ ID NO: 38725 - DNA, 1447 bp, Bovine  19866881026934
cttctgtaacaaagaaagtgcatcctcttttattatagtaaagaaaataaatagcttatatattgttaccctctgggagagcttctagttttcacttttagtggatctgctctggtacattagagaactttacctgaattcaatacagggaatgatggagggaattaccagattcagaagtgacctagtggtcagtggcaagaacaataatcaaatattttatgactttgagtcataaatactatatatcatcaagatatgcattcataactcatgtgtgtgtgtgctgagatgctgtgtatctgtcttttgaagtatcttcttcaattcatcatccaactccacagtcacctgcaaaaatgctctaggcaaagtgtgtcctttcaattgatctgtttgttattgtagtgacagcaccttttccgtgcatggcccagtatttcagaattaagagcacagtacaaaaacaagatacaatattcagtgaaatgtccataaaatcactcagctgcaccacaagcagcttttatgattttcaaaaaacaacatcaaattcactggagcaataagacaattacacttacataactgacatttgttgaggtgagataaatgcttcttcagactcaggaagcaacatacacaaaatcgtaggttggcataaagctgtgtatgtatgtgtgcacgtgtgtgcactaacacacctgctgctgactggtctattaattagaacccagttactgtgccccgtgatgctcgctctagtcactgcgtgcagccatttccggtaactctaattagtcatcttgtgcatgtgcctgaagaatgtccgttcaattgcaaagagttgaaaataaaagttatttctcaagcttttggtgtctcaaggccatttcttccagggccatggctccaggttctcaagagtctttatatgtcctttatattctattcagagtttgactgaaatctaaccatatttcacatcagactgagtgaggagttctaaagtggttttgaaagatagcaaatatcttagactattccagagatggttttaacatgcccaggatcattttatcattaggccctactggcccaatgtctaccaactactagtttcatagtggtttgaaaaaagttagaatctgggggaaaaaactgaaatatgaaaatattttaaactaaaaatttttaattatataatttctgcagacatggccttaaatcatcctttgagctgcatgtcaatgattcattatatatgaattacactgaatttgtgatattgtatacattttaatgagtgagataatatacagttgttctcaaagactgaaggagcctgggtgcctaagctctgcttgcattaatggtaagtgaagtgaaagcgttagtcagtcatgtctaactctttacaatcccacagactatagccctccaggct

SEQ ID NO: 38726 - DNA, 814 bp, Bovine  19866881060022
ataggagcttcccacccaccacatgctccctggctcacacttaagctacagagaaagagcttttcaaagagtgatatatttttgaagtaaagatgatacactttggcatgactcattgggatagatcatttaaatgcatgccctgtttagaactttgctgcaactcaggtaagtggatggtaagcttgtcaacctatttgtatcaggtcacataaaagacctagaacgaggtggcaggggagtaggtggtcatggagtacatctctctccatggatacatcaggaatacaccgacacaggaagtgcatgcagaataccagctgagagcagacagaagtacttgaccagtgggaaagaatatatagacccacgcaaaacttgataggatgaaggaactaggggaaaaaacagtggtgtcagtaggactggacctgccctcagcaggtggggaaactgaagcaggggtccgatccccacactggggcagttgtctgagtcagaggagaaacattaaggctgagagtgaaacagctgatctgtggcagcttaaatggaatgagaatcgtacagtccttgccgcagccatacataccccagacaggaacgctggtctcctggaaggggcagcggctgggagctggagtttaggaaatgtggaggaatcccagggcgagggctactgtttgctgtggtgagatggattgaggggatgtgagggaggagattctggtgggaaatgctggtggaggaaagccaggcagccacggaagcaaggcgatactgctgagtcatgcgtagcgggtggagccatcac

SEQ ID NO: 38727 - DNA, 1800 bp, Bovine  19866881080744
gtagggccttctccacatcatgctggcactaggtatcaaatttgtagcctccagtactatgagaaatagtacagtatatttctgttttttttagttaccctgtctgtgatatttttttacagccgcacaaatggtctaacatatccgctaatagttcagtgaaaatgagtttgtgcatattttttttaagtgctcagctaagcattgagaatctagcctagtcttctgtaaatgtttgcatttcctttgaaggttaaagccaagacgtatttcgttcttatgactctaggcaaaacatttatctctttttgctctagttttcttttctcttaagtaggaataccaatgaaatcaatctcaaaaggttgctgtgaggactgaattagtgcatttacctgtgtgtgtctgttttcagttgtgtccaattcttttcgaccccatggactgtagctcagcaggcttctttgtccatgggatttcctaggcaagatactggagtgagttgccatttccttctccaggggatctttgtggcccagggactgaacccacgtttcctgcattggcagatggattctttaccactgtgccacctgggaagccctgttaaatactaaaaagagtacttggagttaactgcttttgctcacttgagtttacgtaagctctttgaaggcagtgatttttgttactttaattcatggatatattctaatttcctagaaacagtcctgacacaaagttggcacttaaaaatttgtagatgggacttcgctggtggtccggtggttggggtttcaccttccagtgcaaggggtgtgggttcgatccctggttggggtatagatcccaggtgcctcacagccagaaaacaaaaacatgaaacagaagcaacattctaacagattttataaagactttaaaaatggtccacatcaaaaaaatcttgaaaaattttgtaggatggatagtatgagacattaagaatgttggtcttcagtagggcaaactgtgggtatttgttggattaatggcttgtgccattgaaggtctttcccacatgattcacctgttatgatctgcagggacatcaggagggtgaaaagtcatcatcgttacctggacaagtcatagattcggaaaaatcttagaggggtgaatgtggaaggttttcagaaatgtggatttaattgagtgtagagtgaaccacaaagaaagtttgaaaaagagaaaaagcctaaatcttgtcagaacttgcagatggtggtggggattgtgaagagagagagtttggtagaaaaaaagaagtgttggaatgaaagtcctccttggttttagccaagttccctacagatatactgaatttccaagaacatttaggatgatttgagagaggaagaattagcttctagaaataaatttaaatgtgaatgccacaaaatcctcttggaaactctcactgcttgccactctgagctaactatccagtcaagtctagattctatcaaatgaagattcttactttgaaaggaaagggaaatttgatcactgctgggagtaggcaagtcagtagctgaaatgaataagaaaaggacacagtttcaaaaagaaagtgagagtatccatctacactggctccttcaatatgtttcttgacagatgtgtcatcatctctgagcttcttttcttgaggaaggaagttaaggaagtgagtctctaacaaaggacggctctcaggtgcctcctcctgtggacggttgcatctctaggtgcatttggtgagttttaaaagccagagtt

SEQ ID NO: 38728 - DNA, 1111 bp, Bovine  19866881084230
tacaggaatgggtttccatttcctactccaagatccagcttttaattcttctaatttagcactttttacattatctaaaatcatttaaaatacagtgttagataaaaagaagcaccttgaaatcaagtcttttaattacttacacctctggttatttaaatcattaaaactgagctgtgttagtgttggagaaagtgaaagtattagttgcttagttgtgtctgactctttacaaccccatggactgtagcccaccaggcttctctgttcatgagattctccaggcaagaatactggagtggattgccattcctttctccagggaatcttcccgacccaaggattgaacccgggtcttctgattataggcagattctttaccatctgagccaggagggaagaagccaattctgactccatgttggcaactgttttattgacttgctttttagtgcttttgttattacagtcatacataatagcctgcctcagaaacactgccccgtgcctaactgcaaacccaaagaggctttgttcagctcatagagaaattgtctgaccctgcctacttgtgaatagctaaaacgaaaagagataagatataaaggagtcatataggccccatgattaccttaaagatatttaggagaatgaatttatggttttgaataagatgagattcagttcagtccctcagtcatgtctgactttttggaccccatggactgcagcacaccaggcttccttgtccatcaccaacacctggagcttgctaatactcatgtccatcaagtcggtgatgccatccaatcatctcattctctgtcttcctcttcccctcctgccttcgatctttcccagcatcagggtcttttttagtgagtcacttcttcatatcaggtggccaaaatattggaacttcagcttcagcatcagtcctaccaatgcatattcaggaatgatttccctggggattgactggtttgatctccttactgtccaagggactctcaagactcttctccagcactacaattcaaaagcatcaattctttggtactctttatggtacaactctcacatccatacatgattactggaaataccatag

SEQ ID NO: 38729 - DNA, 869 bp, Bovine  19866881119575
aaatacatctgatttagttgaagaaaattataaacaccttgaaaggacagtaattatttaattttaaatccactgatgaggtgcagaataataataatgaatgactttacatttttggatattcagtatttaaatatgtgaaaagttaacataacattatatattagcttgaattttataatttaacatgaacttttatgaaaccatacaatatccaaataattattctataatcattgtgtctataggattattcttttgataattatattattttgattgcacaaggaactagagaggattttatagtaagaaaataaaatgatctttgtcccatctcttaatacctagctctcaaaacgctcatatcaatttcagtccttttgtgactctaaaccccaaaataaaatcattctcattccccaaactgagtttaaataaaattaactaaagaaataaagtatcaatcttctttcctaggctgcaaatatgaaactttatgggaatgcaattgctagctaaaataaatattttactgtttaagtatgtgcaattctgtattttactattaggaaaaattctcaggtttctttttagttctgagaaaaatgatagaactttcctcttaaagttattgtgacagttacatgacttcatttatgtacgtctgttatcactaagacaggcacatactaatgtatcagttacggtattgacattattgtttattccatcacttttgtcattatttatagaatgatatggagaaactttaaagcaagtattatggtatcatcatttctttttcttgaaaaattgctgtatactttggaagagtgtgtgatataacttttactctattcatctaa

SEQ ID NO: 38730 - DNA, 1911 bp, Bovine  19866881164828
tcataatggaaagttttgaagtacattgggaaggtctctatgatcagcacagggcgactgttctgaaatatctacaggtatttaggaaaggtaagtaattttatctgaaattctccaaatattctggaaaatatgtttaatatttttcatttaattaagagacggatgaaggaaagttacatggctcaaaatagccaggagttaaaactccccttccagctcctcccccaccattctatgcaaaacaaagaactctctcaccagaagaaaaagatggacactaaggttgattatactcagctcccagccggtcccagactctggctgatctccagaattccttgcccaagccgtttaagagatatataattcgaacaaccttggagaagaacaggtccccttaagacatatttccacatatatgcctatacatacttattcttttcttgggttagggcagcagctcactaatctgattgctaccccctctcgcctcattaaaggtgatctgttcctatagtgccggtctcttttttctgaacctcaccttctctaactcccttaccctaaaaaggagaactctggtactaagttcaaaatgaggaaaggagaaggaaaaagttgagtaagttaccttagtcaaatgtgttggaacaactcactcttagacatcttgagtgcaattccacttttatgaacacatttccaaaattagtgttattagaggaaaattctttagttgacaatgttttacatattctgtgtattgaaattaaatgacctttatacctgagtaaaacatatgtaggagggaactgacaagaagagaatagaacagagagagtgaaaatttcagaaattcacaatccatccattaacttttctagactccgtcaattttcccagtttcaccctctcttcattccatgagtcaagaggacattgcagtttgtgaaaatgagggaaagtacaactgtagaaaaatctgggaccagaattgagactagaattgtaggcagtagtgaattatgcctaaggagcatttaaatcttgcatataatgccataaactttacctaagttttagtactggaaaggtgacatatttgtttctatgtgttgttaaatgccatcatgaactccctaaagggattcgtttgtacggctctagcgtggtttaccataatacagttgacacatgaacacaaaagatcacataacagaacccaatggaataataaatattaagtgaaataacaataaaggcctattatttgacctatgacacaaatacaactgtaacagaagaaagtggccatacctgaaaactcaagctaatatacccttcactgtgacattctcccggcctgctgaagaaagcaaaataaatcctgaacaaagctgacacgtggcaacatccagacaattcatgttcaaacactagtgtgtcatgatgtgtcttctccagtgcagatacttccctttacatgatacagagatcagtttcctatacaaaacaggggaagcaatgtgatttatgaaagcatattcactgaattgcttagcctgtctgaaaatatatgttcctcccttggtttaaaaagtatagatcaaagtaaattcatttttgtgaagtgacaacactatgtgacattttaataattctaattgtagcatctaagaattccggtcagcaaagataaatgagtgcattatttatgatttcattccatttattagattgccctgtcaatgtggtagccattagcaacgtgcagctatttaaatttaaattagctaaaattaaataaaacttcaaattcatttaccagcagcattagccatattttcaagttcataacagccacacatgcagagtagctaccatactgaacagtgaggatatgggaca

SEQ ID NO: 38731 - DNA, 931 bp, Bovine  19866881166014
ttgacataagtcctgaggtatttctttgcctccttcaagagcactagctttgtttcatgtcagagccctgagtgacaaatgatgaaggacagactggacagcgagccagactcccctgatgccacagtcacccagggtgctgccttccagagtcttgagacttgatttgcatatgtttcattatttggttgccctggagttggtgttagaatactcaaatattggaataatacagtgattatggcagcaacttggttaggtagatgcgcttgattagagaccaggctccaatgctgtgtgaatctgcacaagtggctgaactgctttttgcctccatttcctcagctatagcacaattataatagaacctacctcatgagtgtgttgtaaaaatgagttaacccatctgaagcacctatcatggtatctaactcatagtaagtagccgttcatatgactcttctcccaggttatccacagcaattgagccactctactgagtggcactgtttcccaaactatgttctgaagcccactattccctgaagttcagcaaaaaagaattctcttcttcaaataatcttgggaaacactgcctctgccttggaaattctaaatgcactaaaatgaactattaaagactttgagagaaagacctgcaagtaagaagtttatttcatttaaccctacgaatctcacatatataagagcacttgaccctctggttccacattcacttattcatctttgctagttcatctggggaatctccacttcaaaggcattgtcataacaggacagtgaggctcagatataacaatacatgtaataataataattttgccatttaaagtagtaatgcagatataacattattttatattatgtggaatccacatctgtctccagggaaacaagattccaacttctg

SEQ ID NO: 38732 - DNA, 891 bp, Bovine  19866881239622
atcctgtaccagagaaacaccatgttcaccttcaaggccttgaggagaagaatccattgagaaatatgaataaaatgtttcatgatttaactgtgcatcacatgtcactttgctttcaaaataacatttcagctttctgaacttgtaaaatgattttctgacccatgtctcaaacaatttttaaaagtaaattaatatctccattagacccagaatcactattgagctaaattctcatggttggttagacacttaatgatcatagttcatttgaccttaaatgaactaacgttggacacatatttaatttttttaaaattctgaagatatccttttacgggtagaaacatcctcttgaacccctagtctctaaaagatgtttttctgacaccaaattggaggtaaaataacaatgcagtaatttgtttgttgaaacatctgtatacattcaggaccgtaaatgcagagaagcataactgaaagtaattacaggcttgtatttacatctgcttgtggtaagacaaagcatattgtgcaagccaggggtaactgcacagtttacatttaacaagttatctctaaggcagctgtcattctagttaagataaggggctacacatcaaatgtaaattactttccacctcatcgatcagagtcaaaaagaaatgcataagagtaaacaaaaccaccatgatgctctccgctccacatgatttaagtcaacagttggcatgcatgctgaaggggaggaaagaattaaaaatacatgcagctcatgcttcatccctagacaaataactttcagacatttaattcaatcaaccaaatatttattaagtccctaccatggggaaggcagagcagacctccctgctttcacaagactacagt

SEQ ID NO: 38733 - DNA, 1077 bp, Bovine  19866881306499
tggtaaagctctaaaatcttccttccaaaaatagtgctaatttatataaactgttatgtttcaatgattctttacttgctttccgtgttttctcgtcctgacccttagataaagctgattcccatgtataactatgctccctccctgcataccaaacattctgtaaacttattaactttgcagcagattggatagataaagctcatggggctgtcgcaggacacagcaggtcatccttttccctgtgctgttcctctaccacatccttccacctctgatgtcctgatgccagaccctacccatccccacagactcatctacccaagtggtctaatcaaggcattttccaaacaaagtcagcttgatcccgaagtctcttctacaagtgccaagaactctattttctccctcattacaattctccaatgagcaacatgggagtgagaggttctcgcaaatttatttcctaaattctctccttgaaccttaggtgaggaaaaggaaatgagcacactgacaaaccagcccactcccttggcccagcctctctcctacctttcttattaatttttattgccacatagttgctttacaatgttgagttagactctactctacagtaaagtggatcagctatacaaatacatatattccctcttttttggattttttttcccatgtaggtcaccacagagcattgagtagagatctctgtgctgtacagtagcttctctcattagttatctattatgtacttagcatctgtgctgggcttagtcgttcaggcgtgtctgactctttgcaaacccatgaactgtagcccgccaggttcctctgtccatggggattctccaggcaatactggagttgccattcccttctccaggggatcttctcaacccagggatagaatccaggtctccctcattgcaggcggattctttaccagctgagctaccagggaagcacagtatctatagtgtatatatgtcaatcccagtctcccagttacccccactctccctttttcctccttggtggtgtccactaaaataatagacacaaacctaaaagttg

SEQ ID NO: 38734 - DNA, 1837 bp, Bovine  19866881495421
atgcatgagctcatgttagattaagttttctgtggtaattcacatttatatttcataggcctaaccatatgcttacataaagcaaatccttatccttcactccaaatcagaggaaatatagtttaatgctctagtcatgacccaagagctcctatttgaacctaaaatcatctttttctaccttgcttgtatcctaccttccctaagagaaaattgagttgatgtaacctgtcacacaaagaaaataaactctatggatcgttaccagcatccaacagctaatatcttaaaaaaaaaaaaaaaagataaaacacacataagcctttttttatgtttatgcttaaggcaaacttattggctgtttttctgtaagacatactttcttttactctatactgaaaagcttaaaaataacagtcttcttgtgaaagtagctgccaatagacagtttatgttctgcatcataccaccataaaacaggtatattttgattaaagaaaaaagattaaaactcagcataaagctaagttaagtactattgtggcaacataggtgcatgatttataacatatattcaaatgaagatgttttaaatggatggatttcgaggttttcattccatctgtatgacattcagctctagaactctcctgaggcagtataacagagcaggagggaatagatcctgaggtaagaagtcaatatcagtcatgtaaataatgtgtcgtcaacagccattgaatcccttcttgatataaggatttcaattactcctctctttaagtacaaatttagcacttgaccttttacacctataagctgaaagcctacagttaaataattaaatgtagtaaaatgaattcaaataaagtcaatttgaaaggagaagcagtaagtgcaagcctgattagagctgttagcccacttgggtactattatttgagtagttgttcaccaaagaaagataaagaagtatttaaaaaaaacttgaatcaaaacacagcaacagtttaacagttttctagggcaatattttaaacttcactacatagtttacacctttttttcataataaatggccggctgaattagttaaggtccagggtgatgctaagagcatttattgtgttgggctattaaaagatgaagcttaggatagtaatggatagcagaaaatgccatccccaaaggtgccactctggcataggattatttttagctgaagacaattgagaagcagatattagaaaaactctctggccccatttgccttaaagtaggatacaaatttgtagagatatctccttccgctccgtattagggatcccatgcacctcccctaccagagaaaactccaaactgtcctgagccttgtgatcaccatcagaggactctatgtaacaaaccttgctaaaactagcctctaactgctgttgatttccacatatgtttgccttactacaatttgctgccccagtagatcaaactccttttcctttgtcttgctatatctctaaaattttattgttcttttgttaagatgcatacataagcacaagtttttgccacctgtttgagatacacatcactgagtggtccttgggtgtgtgtacatgttaataaacttatttgtttttctcttgttaacgtttcttttgtgtctaatactcaggaccctagtaagagaatctatgataatagaaaacgatttattctctcctctataacagaatggcagtggaaacaaagaggctggaaatagtaactctaggtatttaacttagatttgtgtgaaaggagggagagacttaaccctctccctaccaagctgctgctg

SEQ ID NO: 38735 - DNA, 1994 bp, Bovine  19866881805084
tgtgaggggctgggaaaaatatgattatttcctgggactgcaccctgccctgagaatgttgccatctcaacattggagttgagttgacaaggaagaatgggatgggatggcaaggccgctgagcataacaaatacttttgctgcataagcccgtcaagagcatggatgggaacagcgtggatgggaactctgaccatgaagtagatctagttaatcacaaagcatggagaaaaacagcaaaatggtcatctctgagtattttgcatttttctttgcaaatccaaagtcacagttaataaacatcatactagtaaattggatagaagtagctttaaataattattttctgctatatttgtgatgaaagtatggagcctttcctggtttgaagcactaacttctcttagggcatgtttatctggtaacatcaggtgaaatgtatcttcttgggtaaaattgttttgcagctgcttggtatacataccagttatatgatgtgaatacaaataaggctcagaggaatttttggtagcacttgcgtaatcatgtaagctgaaattggcttatctttgatgcattaattatctcatgttatgggaaattaagagaattctctgactctttaagaggaccaggctgccgaataagctctcaaaacacttttcactcatagaacactccataaaattttctatttgagtcataagactttcaaaaactcatggcatgtatagtcagaaacatgcattacttacattttgcaattgggaggcattgcatattttattttaaaaataaaatctcagagtggtaacattgaatagtcactaagagcacagactttgaagtcagactatctgggtttgaatccttgctcagccacttaccagttattaggctttgaggactttgtgcctctgctgtctcatccataaaatggacatgaagttattatgaagattatgttggtatttttatgttcttcaaatagcatctggtccacagtactgtgtgcttccctggcggctcagatggtaaagaatctgcttgcaatgagggagtcttgagtttgatccctgggtcgggaagatcccctggagtaggaaatggcaaaccactccaatattcttgtctggagaattccatgaccaggggagcctggcaaactacagtccatggggttgcaaagagttgaatatgactgagcaactaacactttcactttccacagtacctaatgtttaagtgtcaaaaatacagatagacattgagtcacaggtacttgttttataaaaatttaaatataaattaaaagcatttttcagtaaaaagtaattcattctcaaaacagtattcctgtaatctgtaacatattttgttgtttttttctcactcatgcaagcatctacaggagcaattattcaacacatttttaatgagcgtctatattgtagtgttctttctggatgtgagcttattgagagcaacagtaatttaacagtctggcaaataatgtaccactgtgtgaagcttttggtaggccatcactaatgttctgttatctgaatggagcagtctatattgtcatatttattgtcaacatcaacacgtgttgacaaatgaaaaccaactgtagctggcaaatttagtgactaaagaaatacactttttaacatatatatatatatatgtatgtgtgtatgtatatatatttctattggagtatgatttatataccctgcattgtaaggaattaaaaatgagctgcttttgatgatcattcttgtgtggacctgaaataatgccaaggagagggggagagacatatgaaagtgagagatgtgttatacacaccagccctaaattgggaggcaggacacactataaaaaagagcatatgggagaagtgccaagggtgggctcaaccaaggcaagtggggagctgagggagagggaggacccatgggagggtgcctttgctggctgtcacagtg

SEQ ID NO: 38736 - DNA, 1037 bp, Bovine  19866880404002
acatttctccaaaaaagacatacagatggctaccaaacacatgaaaagatagaactagtttttaagtgacccataaaaatttgtataataatacatgacacttgttctggagagcttggttaaactggctatttattttactaactcatgtatgtcctgtctgcttagacaggatttaaagtagaccctgagactgacagcagggaaacctatgcttctcgcctgtcttggccgctaatagtccttatagcctgcagaaggtgtggaacctttttgagtcacagtttcctaatctctaagcaatattgatatagaagtatagggtggttgtaaaaattaaatgatatatgtagatatataattatatatgtatatatatttatatagagagtatataatgaatacatcaccatacgcaatgaaaaatgggtgtgtttggtagttctgaggagttatgcatgatgattaacgatattttcctggattctttatattttatttgaatctgtctatagaatgcagagccaaaggctaaagcaatttcataaaggaggtccttaacgtttcaggttttgtatctttgttcttttccagcaataagcttcaggtgttccatctcaccaagccctctgcctgaagcagtatgggcagcacagacagtggcctggctaactaccagcttaccaggaggggaacttgcttaattgcctgaatgctggcttcacaaagcagctttcacacctaaagctggagcagctcacatctgtgcctgtcaggcttctgccttgcagatgaagaaatcagctgtgcccggtccccacaggatacccagggggtccaagcctcatgcataaagtcaaaacacacaagctcatttccatatagaatacaaataacatattcatttaataagataactcctgaaacttcccacacatatgatttcaagcttctatgcaggtaattacaatcctgcttaggaaaaatcgatgaaaccattagatcaaaaccaaattctcttcattttatttgcacat

SEQ ID NO: 38737 - DNA, 1856 bp, Bovine  19866880471800
tggctcttcctttctaaactctgatgctcatattgtccccgttgaagtacgatcagtttcctcttccgatttctcagagcaggactcagcgtcttcttttttcccacctggttaattcaacctcggacaactcagaaacagatttactgatttagtacaactatttattttaatcaaattgtgatagcttttagacattcaacaagggattaacggttcttttccttgtgttttgcccttgaatcttcatcactatcttgagataagtggggaagatggcaaagagaggaaagcaaagtctttccttttaagaacctatgtgtaaggaaagtgagccaaagtccagtctctggaccaaactatgtctctacaaggatgctcagagaagaaagttctatcctccagcatgttcactcacagcagcacaaggatttatggcagtggaaaatgtaaaaggagggacaggcaaacagcaagttaactaactgttgtgagacaataaggatcagagtaccctttatgtgtacaagttccagcccagtgagtcaaccgatgagagcattcgaaccatctaagtgctctacctaagccacagttagttgcccagtgtattgcataatcttagaccctcacattcagcatgaggagagatgagggaaaggcaaatatatggaacccaagagaagcaaagtgcaattcccgtaaaggtagagaaggaatgtatgagccatgccctcacagtattttccgccatgacagctgttgccccaggatcacatggcctgtaaatcacaagacagagccaataacaaatgttgatgctataagacttctgcttaagtatgtatgaaagagaagtggagaacagtatcctaaaccacacaccctgacacttgagcaaaccatgatcatcattaaactcatataccatcataattcatatgctcatgtcacagtccttaatcctcctgtgaagaatactgaggagttcattgtgcctggagctgggtgatactatcaagcttgtgatgctatccagttactctgtatccaatgtcctaacaggtaatgttgccatcatagaatcctaaatgatgtatcacgaaacagtttgaataatacagttccacagccgagctacttcatacatcacatgggctcaaaacactgaccttagaacttaacaaccattttacaacgttcctatgaaaaatatgttccaggctccaaatggcattctttcaggcaaactttgagaacacaatctgcttaggaactgtctctactagtctgtgatatgtttgttttgcatataaagcttgtttcatgctctttttacaaagagttatcctgttcctggaagaggacttcaaataataaattgtcaccaaaaatggacatgaaattaaaaaaaaaaaaaaaaaaacaggcagggggtggaaaagatgagcaagctgaaaacaagtccattttgggaaggttttagacttcccgtttaagggagttttcatattaaaggaaaaagccctcatgtgttgtgcatttctttgttcatggcacttagcagagatttctacaatgtgaaaataggaagttggatttatatggcttttactttaatgatgctaaactgcctggaaatagcagtgcatgctattgcaagtttcagatttttttatgctgtattaccaaacacctttctaaattttagatgagatccccagtattgtggatattcaagagcaaagcaaggcaaatacaggaaattcagatactttaacggctcagggttcccaattatattataaagcgaaaagacactccagcagagtagttccttacaatcatctaatacc

SEQ ID NO: 38738 - DNA, 900 bp, Bovine  19866880689712
atgcttttgaactgtggtgttggagaagactcttgagagtcccttggaatgcaaggggatccaaccagtccatcataaaggagattagtcctgagtgttcattggaacgactgatgttgaggctgaaactccaatactttggccacctgatgcaaagaactgactcattagaaaagaccctgatgctgggaaagattgaaggtaggagaaggggaggacagaggatgaattggttggatggcatcactgactcaatagacatgagtttgggtatactctgggagctggtgatggtcagggaggcctggtgtgctacagtccatggggacacaattagtcagacacaactgagtgactgaactgaactgaactgagtcataacttgagtatagcttgctgtttcagtgcagtaatgtgacaaagttgttgttttttaagtcccatctataataaggtgataaactgcagaaaatacaaatattttaaggaaaaattgtgagcagatgcaactgacagcaaattggatgtgagtaaaaaattgtttgatagtttactatctggattaaaaatagaatctaaccaatatatatgtgattatatgtttttattctagttaagtttgtcaaatgacggcatcaaaattttaattcctaagtaaaattagtaattctactccataattgcaactcataaaatatatggtgttattaccatcataaaggataaaataaatacaaataaaatgacgtaatgtattctccagaaatgaaaaattttaattatgccgtattacacatttagctctgattcttccttcactatatgtcacatctccacctacaagtaaagaaaataacatgagaactcaaataaaaactgtctaaaattgttccaccaagt

SEQ ID NO: 38739 - DNA, 5356 bp, Bovine  19866880744420
tctgacttaaccagagtgttaaagaactaaggtttggggagtatttttaatatgaggaattctgttattttcactaaaattccagcaaagaaagcttataattcattttcattttatacttctctgttatttcaacaactgaatatcaacattgctacatgatgaaaaatattgtctatttcccatcatttttagcattattcagaaatactgataggttctctgtgccagatattctgtttttcgttaatattttggcagtagcaccaagtttgacacgagaacattttaacttggaatcataattgtgtttatgtattcatgggcttaaaattatgcagaatactttagataaaacacatcccaacacagtttcattaaatttgtttctgaaagcataattcacatgattttttctctaaattactagcagggagccactttccctgactactcttttttcatataaactttttcataaacctgtatttaattagttttttaatctttgctgaatgaaaattatataaaacatatgagaacatgtatcttctttccaaaaagctgtgagcagtgtttaaaacagactgaaatcaatgaatttagtaaaacaggggaagaacattgaagttagtccaataattatgtccataatgccaaattactctttctaacagttttaatgttatatgagtatcaagtggaatttcagttaagtgaactcagaagaaggaaaataaatacataatttatttgaaaaaatattaaaatatttataatatgcaaagagaggactatgatttagtaaaataaacatcattctaaatacgcaaatataattccaggtacccatgctcaaactctgttgtacaagaaataattcagtatttttcataaacaaatttgtatttgaaatcctatttacccgttagtttggaaagaaagtcaattttaccattactgtgatttctttcacatacactagaagttgagcaaggtctcaagtttggggtgcagagtgcaaaagctccaactcaaagaagggcattcagggaggcttgatcttccacccaggtgggtaaccgcaagtacccatgttatcctaaccctgtagctccataaaggcaggaaaagccaaggcatccattcaatggtcaggttttctgtcctctttgcagactgaaagccttggtacccaagagtctgtctttatatttgacaatataatcattctctttgaaaccttaactcaaattccaggattcaggaggtggggtgtagatcatcgtcactcttaaacttcaaaataaactgcctgctggccttgcgcaaatctctaccattatctcaacctcagcaatcccaataacctaccttcttctcttcccccagcaaactctgctccataaatccaaggtttctaataagaaaaccagaagggaaattgtcctttggcaacttctgtcagtcaagttaatagggttgtaaaaaatattaagaaaatagatcacaaatacaaaattaatagcatgggatattatctgataaagccttttgatttggttctttcaatcaaggtaactttctactactttattacatatgtatatttttatttatatacttgtttggttcctaagttgtgttggactcttttgtgaccccatggactgtagcccgtcaggctcctctgtccatggcattatccaggcaagaatactggagtgggttgtcatttccttctccagggcatcttcccaacccagagattgaacctggatctcttacattgacaggcagattcttcactgcttagccgccagagaagcctacatttatatactgctgctgctgctgctgctaagtcgcttcagtcgtgtccgactctatgcgaccccatagatggcagcccaacaggctcccccgtccctgggattctccaggcaagaacactggagtgggttgccatttccttctccaatgcatgaaagtgaaaagtgaaagtgaagtcgctcagtcgtgttcgactcttagcgaccccatagattggagcccaccaggctcctcagtccatgggattctccaggcaagagtactggagcggggtgccattgccttctctgacatttatatacatttatatactaccttcttctaaaaggaattgaaaaatcattcatcttttccaaaagaagttcctaaactaacacatagtctagaaagcttccacatttttaaatatgagaactaatgaataagcataacggagaatttaaacacataggaatgaaataatatccataatttaaaccccaatcatgttttattatattagattattcctgtgataaaataggaataataattggaaagaaagccttacaaaagacatagaaatatagtacagaaaatacagaaataaatgttatgataaaagaacaaagcactgtggcctggcctggttctgccacaaaacaaagcaaaacagaagatgttgaacaagtgttttccataatctgactctaatcatgttattcattttttaaagatctctcatggggaagatgagatttctcaatgtcagacttagttttgctcagtatcaaattataaatttatctttgagagttagtattcccatctcatagaactagctggggctagttgtcactttctttgtggcagtaatagatgaacatactagggacatttatttcattagcaatgaataccagactggtgtaaagcttttttccaattatggtttgtattagagtatatgaaaaatgtaaagcaaaaaaattaataatcaggatacaagctgtaacttaattttgactcttgtaaatttaaatctctggttactgctttttaagctgtttatacattagaacaaaacaacttgattgatttttaaaaacaaaatttttttctaaaatatttctgacaaaaaggagtatatagcactcatacagagctttaataatagtaataaaaattataaagtaaacatcggtgaacccaccactgagcttgacaaatataacttggaatgttttatataatttcttgaatttctgtctagatttactaaaaatattccttcaaaatatttatgctttgtgtcgactggcttctttcacaaaatactatcatttaagaatttaccagatagtttgtttctaactgtagatctttcaaagtgattgatgttaagatagtctaatatttgaatatgccataaatttttcatctattgtgtagttttgactctttcaaacaaggatactgtttaaaaatattgtaaatatctcctgtacacagatgtatgagttattgttttctatatttttgtctactggattatagagtagaataagtgtgtatgtactaagttgcttcagccttgtccaactctgcgatcctatggaccgtagcctgccaagctcctctgtccacagcattttcaggcaagaatgctggagtgggttgccatgccctacttcagggaatcttcctgacccaggagatgaacctggcaggcaggttctttaccacaagagtagaatacacaaatacacaaatgtaaacacacactctgaacatgaaccctttttgtattgctcatattaatcttttttctcatatctaatgttttcaatatctttttgccctttcttactgttcatggggttctcaagtcaagaatactgaagtttgccattcccttctccagtggaccatgttttgtcagaactctccaccatgacccgtccattttgggagaacctagcctgcatatctcataatttcattgagttaaacaaggctgtggcccatgtgattagcttaattagttttctgtgatttggttttcattctgtccatcctctgatggataaggacaagaggcttatggaagcttcctgatggatgagactgactgtgggggaaactgggtcttgttccaatgggtggggccatgctcagtaaatctttaatccaattttctgttgatgggtagggctgagtaccctcccctgttgtttggccaaactatggtggagataatgaagataatggtgacctccttcaaaaagtcccaccgtgcactgctgcatgtgaccctacaagcttggcctgctgcagtccatggggtcgaaaagagtcagacatgactgagcaattgaactgaactgaatgttttcagtttcttaatagagtctttttaatgaacagatggtttttaatttaatgtgttgcatatgttaatgttttcatttatgatttttcattttgtgtattagttaagaaaactatgcctaccatgtgtccattaatagtgccaccaattttaaagtctgcatcattgattgctttcccttttgcatttaaatctattgtctatctgtaaggaatttttgtgtgtgatttgaggtagtggaatagactaatttttttccctttatatggacaaccattttgtcttaacagcatttattgaaaatacatccttattcccatagtctgcattgatagcttttaatctttttttctgtcccattgtgttggtttatttctgcatctattcaaactgtcttaattactgcagatatttaataatattcactttcagtatatgtaaattttccaatactattcttctgctttaagtctgtgagcaattcttggagggttatatagggcttccctgatggctctgtcacgcgagtgtatgttcctcggttctttgtcttgtcacaacaaagatttggagcaacggacattaaagccctcggcgcatcacagctcttgggtcttggacaaaccatgttacagctcttaggcaaatcagtgttacagctctattttatttagaagatagcagaagaatccaagactcgaagagaagagactggaggagtgcgtgggagggagggagggagtgtgggggagagacagagagagagagagagagagagagagagagagaacgcgcgtgtgcgcgcacgcacgtgggagatagagtccgtgagaaagcgctttggctcctccttttatatgttttttcctccacctgggcctgccctatgcaaattgggcttagccgggagtgctgtttgttctgtttgttctgcctgaagtcttcactctggtcctcggaccttcctttgaccttccttgtcttttagccaccgccattttggactccttttccctattctacctacctaacagctcagacagtaaagaatttgcctgcaatgcaggaaacttgggtggggaagatctcctggggaaggaaatggcaacccactccagtactcttgcccggatgagcccatggacagagcaa

SEQ ID NO: 38740 - DNA, 966 bp, Bovine  19866880747174
atatttacactctgatgagtttggatacatgcatacaccccatgagaccatcaccacaaccaaggtactaaatctttctatcacctccaaaaatgcccttgtggttttttgtgtatttttaggaggggaaattggttttgttttctttttttggtaagaatattcaacattaagaaatcttaacatatttgaatatatatgtccctgatcttgaaactctacctaattctctcctttccactttcttcctctgctctctccacctctctttccttctctctttttcttctcatctcctaacgcttcctctgataggcacacataaatatacaagcttcctgtttattgttaggacattttagagactggcatgataattactgacattgtgattactgatatagcaatcatttaattctcttaatgtaaatactttaaaatatatttttgcatacgctgaaaaagagtaagatgtaaagaaccaaaaatagtgaattatctagatgataagaaaggtattaattttatatatgagaatacatttaatgacatttaatgatgtctatacacacacacacacacttttttaaaaaaagtattctttctctctaaagtctgtgtactccaattcttcatgcatgggaaataaagcacacattctagaatttctttttttgtttatgttgagttctccatggaaaaactaagccaagaacataatgttctccgtttttgatgaatagctgattccgctttaaaaggaaaagccttcctttcaaaaagctgtaaaatagaattattttaaaaataactccatctggctcattgtggaatatcatttaaaaatgtatgctgagtctaaagtgttttccttggtcatgaaataaatatgtgtacgtagtctacatatctcattaatttaagtctgtgtctgctatgacctgagaatcaacggtcacataaata

SEQ ID NO: 38741 - DNA, 1000 bp, Bovine  19866880807764
tagaaagaacaatacttgaagtcgtctctgcactggcctattggaagtttaaattttccagtcttcccttaagccataagacatgtggagaaaaaactacaaggatgcttcttaaccagtttcaatggcatttacctatgggatattagcatacaaaatcaccaaaaagagcagctggatgtcagccagctaccagtttagaggcaatgctgagaggtattcacttttgttagtttcaacatgtggagttgatggatgatagcagtacacttgagcagctggccatgtaggaaactgaaataagtttggtcaaaaaaccagaatatctgccttaagaatacccagaagcatagtttgcagcctaactccagacttctggaaaacagaaagagcaaaacaaattaattttaggaaaaataatcacaaagaagtctgtgcaagccaagttctatgtagctaaatatcaaacatgggagattattaacttaaaacagagcaaaggcatgccatccatgccaaaccaatgaagtcaatgaagactcatcatacaggcggataaatttgtcaaagtgttttagattcttcctggtagcagacaagactgactgactcttacatatggaagcataaagctaatagctttactgggaaatataataccctatttctttttggttttgtatttatttagggatcaacctttgttatatttaagatactagattgcatttaataagttaaacttgtcatgtaaatgttagagtccagatttcaaaagtaagtgctatttttctgaacaaagccaaggaaggtgtttgaggtatgaaccatgtttggaagctatattcttaataatgatattttaaaagtcgaatgttctttagaacatcaagagaaatatgccggtactatacaagaagttgtaaaaataaactctatagaatatgctgaaagttgctttggaaactggggttataagaaagaaaaactaaatttcaaa

SEQ ID NO: 38742 - DNA, 1496 bp, Bovine  19866880894607
aatgcagtcaagaatttgctatcccaccctttcttttgccaattcatcttagacacttgatccagattgctggaaaatgtttggcatagactttttcttttactgaagtaattctacaaactgatatgatcgaaagatactatcatttgaaaaattgctgtgcaaaacacttgctatttccttttgttattcccacccagtggagccaaatttagaaataatttatatccagaatatgttttaccactaagaatcacggtaaagtagagaagtaattatttaaatatctttaaataaataaaacaaattacaatattctgaataaacaatgactatacaataactatgtcagcttagacttccctggtggctcagaaggtaatgcctacaatgtgggagccccaggttcaatccttgggtcaggaagataccctggagaagaaaatggcaactcacttcagtattcgtgcctaagaaatcccatgaacagagtaagcctggcaagctacagtccactggggtcacaaaagagttggagacgacttaacaactaaacaacaattagcaatgacaagcatcttttcctatgcctcttggccatctgtatgtcttctttggagaaatgtctgtttaggtcttatgcccattttttgactgggttgttaagagttgtctgtatatttcggaaattaagcccttgctggtcatatcacttgcaaatattttctcccattccaacaggctgtctttttgttttgtttgtggcttcctttgctgtgcaaggctttatgtttgattaggtcccatttgtatatttttgttttcatttctattgccttgagactgaccaaagaaaatattggtatgatttatgtcaaagaatgctctgcctatcatctcttctaggagttttatagtgttttatcttacactcaagtatttaagccattttgagtttatttttctgtgtggtgtgagggtgtgttctaacttcactaatttaaatgcagctgtccaactttcccagtaccacttgctgaaaagactgcctttcccccccatcttacagtcttgcctcctttgttgaagattaattgaacgtaagtgtgtgagtttacttctgggctctctatcttgttccactggtccatatgtctgtttttgtaccagtagcacactattttgattactgtagcactgtctgaagtctggaagggggaggcctcctgtttattctttttcctcaggattgcttccacaattctggttcttttacagttccctatttaggcttatttgttccagttctgtgaaaaatgtcatgggtaactgaaagagattgtgttaaatctgcatgttgctttgggcagtataggcattttaacaatattaattcttctagtccaaaagcatgggatatcattccatttctttgaatcatcttcaatttcctttattaatgttctataggtctcatcataaaattttgtctttca

SEQ ID NO: 38743 - DNA, 1113 bp, Bovine  19866880949903
ttatttaaaaaaatagtttttagtaaattactgggtgaaattttaaaagaagccttgataagtacatttttttctgaaatatatacagatggataatgaaatttctttcttactcatcatctgatgtctgctcagtttttctttaagtggaattataaaatgttttccaaatataagactgtttactgagctaataaagtaattagtctgattaaactgatggtcagctcaggcaaacaaagtctgtcaacacaatctgtgtgttaacacagaagatatttataatttaaaacaaatgtgttcaaataaaatattttatgtagatagatctctggccaaccatggagagctaaataactttttgaaacatgtttggaaaccaattaaaagataaatttgatgacagcaaaagacaattaatcaaggataagcatcaaattcatatacaacaatttcttttacagaaagtgtgcagtttgacctgaatctgaaaacacaaatgacagaggaaacagaataggcagaataatggcccacccaagatgtccacattctaattcccaactcgaaattcactttggacctatgaatacattaccttatattacaaaaggactttgcagatgtgatcagtttaagaatcttaattaacataatatttgaatgcatccaatctaaataccaggaatgcttgacagttgaaaagcaagtgataggaagaaaatcagagtgatccagtgtgagaaaaacttgacctaccattgctggctttaaagataggtaagaggccacaagccaaggaatgtgaatgccctctggaagctggcaaaatcaaagaaaaataaactcccttagaaacttcagaaagaagtggagcaatgctgatactttgattttagcttagtgaaacccatgttaaacttatgacctacagaattgtaagaatatatttaatttgtttaagcctctaaagttgtaataatttgttacagaagcagaagattaatataccagaaatgagtgacggtgacatgtgagtataaattctaagttacgcctcctttgaggcattgtattcattactcaattgcattagtttcattatgacaccag

SEQ ID NO: 38744 - DNA, 3053 bp, Bovine  19866880959308
ctatttgagttggcttgatggctatagatgagattttggttaaaagactaacagactaaacgtgtgaatctacatttatacacatttacacacctaaaggtatgcagaactaaagggatgttgcccacaagcttaaactgtggataacggcccacctctgggaaccctgcctcccatgtaatgagcattaacataaaatacctttcttcatctcacaggaaacatcgtgaccaaacacacctgtgaacagcagcaggaagaaattaacatatcccttcagagtctgactacagccaggactttcccctctccccttttagtataaaagaagtctgaattataactcagagaatacggttctttgggacactattccaccatcttcttagtctgctagctttctaaaaagttgttatcacttgtcccaacaacttctctctcaatttattggcctgttttgttgcaagtccgggcttgggctcagtaacatgtctgacaccaacagacacatctttagtatttctcctggtttctggtggatactcagtaatttaatgtgcagatctatcttaccaaatgtttgcccatttgctgtccactgagacattgataaaagcctttcataaccttacaagcagtgttttcataacgttctccttaagctttcttgtggcgttcgaccattcttaaaagaatcctataattttgttcaatcccattttaaagtccttatacatgtatctaaacttctgaaaatatttgtaatatttgatactacatcatatctagcatgagatttaggaattatacaattgtctctctggaagaatttattgttacttttggatatttcatgtagagatctgggcaaatggataaaacattttaactaccccaccaaatctgtcataggtgtccctccaagtgtgagaaagacctctttggcctcaaggttttttgtttgtttgtttgtttgtgtaaattgtatttatttatttttaaactggtttctgtaagtagatgctaactccatctttaaagccaaagaacatttcctgaagaaattacagcttatctagttgttaacaaatcatataaaattgggtaagtctcaacttttaggtgctgtacggaatacatctgccctccaaaacctctatgccactaggaatatatttttgttaaattttatctgactttatttcactcaattcacctggcaaattagccataggaagggtccttctttggagcagagagaactgagcccatgggaagaccatactaataaacatgaatgtttacaatttatagaatataggcgtcttcttctctgctctgactgtatatatacacagcctgcatagacaaccatagtagataatgagaacttattacttcctgaacataacagctcgtcccttcttgggtctggaccccggcggggttgcaccacctgcttctgagtatacgcatgcaaacaaaactgttaaaaggcactaccttcctggagtgccttctttggagccacttgcttcctgaaaaagtatacttccttatcagcatcagagttcttttttttagtagtagatcctctctggatctcagcccctgccaaggtccagagggaagatacttcactactcggctgctggggctatgactctgtaccagactacctttcatagacttccccatttttacttatgttcctcaaatgtggatatcaggaaaggattttcctagaagccattcttaccaccctttctatctcccagagaccaatcctcctcatctccttaacattttcttgtcagccacttccatccagattttccaaatcagatttaagtctgtgttccctaatgaaacttttgaaatacgaagaaaagaactgaacccagcagtgggtcaagctgaagaattcaattctttttaattggttctgatgttcatttgaggtagctgtaactcagtgattgaaaagccaagctttattttgaatatgccttttgtttaacgctacagaattgcgttttcagtgacagtgagaggtttatagtgaaaagaaccatgtctaatgggtattgaaatgtaatttcacagacattcttggaacagctcttctaataatattactttgcacttaactaatcatttgcctaatgtgaagttagcaagaaaactaaaatcagagaaataaaaaatgccaggtccattttcatatgtaaaacatcaacagaaaataaatgcacttaggcactcaaaaagtgacttgcgtgttttgactaaaatagatgtttatcaacatgactgccttacaaagaacatcagggctgttatttgatagattacttttgaaaggtgggtctgcatcacaatattttctgtaaggttttgcttcattatgtcagtgattgcaagagagactaaaccataagagactacttccagctataaataggtcacatattcatatacataaacttttcctcacaattgggaacataagcaaataagttggcatatttttatcacaagggaaatattcaagtagaagcagagggaaataaatatcctctagaattccaatcctaaattggaaaaaccacccagtaagttttctatgagtatataagtaaaatcttcttaatattgcccactaggtgcttgttgtcattaaattactttgagtcaaggaaaatactgggatgatatctagacctggagaataatagaaccttcctttttttcttctctaaagacatcacgtaactacactggatcagcagaagaataatatcttgaaaaacaagtcggacaagtatagctactcccacttcagctaaatgtgttccacaaaaatatgttagagaggactcgaaaaaccaggccacttattagtaggggttcagtgagtatatggtgttttatctcagtccctatccccaagtgtcctgaatacaaaataaaaaaaaagaacgttttgcaccacaaaatagtcataggaagggcaattctatttttattatcttagattttataagcattca

SEQ ID NO: 38745 - DNA, 886 bp, Bovine  19866880979527
cagtaaatggtccctggggtacaatggtttaacttacgattttttgactttacagtggtgcaaaagtgatacacactcagtaaaaaacatacttcagatttttatcttttcctgagctagcgatatgccgtctacactctcacctgatgctgggcagtggcagcagccacaggtcccagtcagtccacaatcacacggatacagtgaaacaaccaatacacttacaaccatcctgtacccgtacaacattctattttacactttcagtatggaattcaataaattacatgatatattcaatactttattaaaaataggctttgtgttaaattattttgcccaactgtaggctaatgtaagtgttctgagcacgtttgaggtgggttcagctaaactatgatgtttggtggattgtgtggtgtgtgctcaggtgctcagtcatatttgactctttggcaccccatgaactgtagcctgctaggctcctctgtcaggggaattttccaggcaagaatactggctgtgctaagttgcttcagtggtgtctgactctttgcaactccatggactgtaacctgccagtctcctctgtccatgggattctccaggcaagaatactggagcaggttgctatttcctactccaggggattttcccaacccaggactcgaacccacacctcctgcattggcagaaggattctttaccactagcaccacctggggatgatcactcgatggattaaggtgtgttatatgcattttcgacttacagtattttcaactcatgatgagtttatcaggatataattatatcgtaagtcaaggaagatcaatatcacattttctttatccaattcatctactatatccattatatattatta

SEQ ID NO: 38746 - DNA, 970 bp, Bovine  19866881004893
tccccaccctcttatcttccttaactaagccaatgcactatttgagttcaatcttcaatcagaagaatatcgaaacacccaagaggtgctctctttgcttacacactgaacatgaacatgtattctgctactcccacacaaggggatatagagggactctgttacttaatctatgaaggcatcctgacataaatgtcctctcttttcagattcaaagtacaaatgaagatctactgaaaacttccagaacttagagatctatttctaatccgaggggaagatagaatctgctttggctcatcacatttttctatatcctttgagtgctaaccacaggaaatatttttaaactaacaagtcaagatgtaactctttctttcattccagaatctgactctcctctgaggcaacatgtgacactgactatgaaagaaataggaagcaaaaagaaaaaatgtgatttcagccacgaatagaagactgaaaaaactatccttaaattagtagagctttgtatatagatgttggttccctagggttaggctcttaatgatttaacactactacaatcgatgatttcaaagctattatattgtcccatctattgtctgtgcctattattatcctggcaatgggaagtaagaggtcaaagtttaggaagagaaataatgtctttccttgtaaaaccttcagaaaacactcctaagcaacagcacctcattctctcaattccaaataactgaagaaaataatggcattgatgtaaaaattcttattatggcacagtttgatcaggtatcttgactggtgatcacaggcattagtaaagagaccattgattattagtcaagggctttgtaatagattattaacatcaagtcttcccttcctgtcttctcatatttatattgggacctttcagatcttcccatgatatggaatccatttctccacttcttgattctgggtt

SEQ ID NO: 38747 - DNA, 1244 bp, Bovine  19866881072225
ttacctatttacctgaattataagggctttgtggtagtgttttccgtggagaaaggaaacgcctttctccactgagagcagagtgtgtctcactcttctctttttttttttaaaccacaaataagatcttttgtttgtcaccattaaaagtcttcattttaaacaggttcttggactgttggcttgtatccattagtttgttcagctttagcacctgtctcatcccagcaacttttccagaactactgccttcgccatgtagctccgtgagttttccctcttcaaactggggcttcttcagcatttttacttttctaacgaagacatcatggagtggaaaaataggttggcgagctttttctctgtcttttccagtgctgtctggaatcagtttgttgacatcctccttcaagtcatttttctgcacctctcaggtcatgatttccatcatcttcttgtgaatctggcgcacctgctggtgctgggcataagaggtcttcctaatctgattgttgcgttttttagtaaaacacacacgagaacagatgaagcacgttgatatcaacgtgacttcagtcatggtctgccattttttgaccatcgagcacattttgtcacaggtaagatccataccatggaaatctcaggcaggttttgccctgaacatcctccgtaattagcttgaattgtctaaaggcagcttcatcattctgcagatcagcaagattcatttcaaaaacacaacccttgaggccatcagatgtgattttgtttccttgagttcttgtggtcagtgctttcctactgttccttgtattgaacgtagctggtgctttcacatcataccaatctttcttagaaaatgggtcaaccactttcttcttggctccctttctacctcctttcgtaaggtgcttattcttgccgaccgtcttggtgacgttcagaaagccaaaagggcagacgcatagcttacttgagaacttcagtgagcggggcagaatgcactgtctgtatgaccccaagtttcttctcttaatcattcctatttcctacaggtcttcaaaagagtaagactcctgtttattcctgtagccataaattaaaatagaaataccagcatggaagcaaaatagataacatataagaaattatgaaatttacatgtggcagtgtttatcatactacagaaaagagttttttttttttaacatttggagtacagctatgtcctgggtgatctc

SEQ ID NO: 38748 - DNA, 692 bp, Bovine  19866881129240
aaaaagaaagcaggtttaggatggggaacacatgtatacctgtggcggatttatttcgatatatggcaaaatcaatacaatattgtaaagttaaaaaataaaatttaaaaaaaagatgtatttctcaatataagaatataatttggtctgttttatgaccactaggtgaaatatttgattggttttcaggataattgagatctgatgataaatttgatgataaatattttgttcaataatgatctccacatagttcactggttttttccccatatgatactcttttgaggcaaagggaagctctgagtttagaggaggaattatatgagcaaagaaagataaaaataagccttttcaaatgtatgtttctcctaaattccatatttcaccttttgtataacagtcctatttcttttggttctcccatgatagctcggagagaaatcacacagagtggatattcagtgtctatgactcagtttcttgggtgattggctgatcggctgatctatttctttctctttccttctaatggctgttcaaaaagtcatagaacagctactatagctgctgtattgatgtaatcaagtgaaaaagactactgcttctttctcaaatattattttctgctaacacagcacacttgtcaaagtccctgaatattccagaaataggcatcacataaacatata

SEQ ID NO: 38749 - DNA, 1377 bp, Bovine  19866881152664
tttaatagcagatagggcactttggtgaaagctcatgttagtgagattttatttcacccaacatacaggcatagtatgcacttaagtcatcgatgggttgttgtaagtaaagcaaatagcatatatttacagaactgagcaaacagcattttatgatgctatcctcgaaacattcacactctaatcagcaatagctctccctttcattagtgagcatcagtgagacactcttctaattagctataaacttactgctgaagagcagtcatttcaaatactgtttgttactaaaacaaatacctggaaattacactattagtacaaaaaatcaatccagttctaaagcctaacactgaaagcaaacttaaaactctcactcccacatgcaacttgctaccagcaggtttttctttgtagtatttgaagacttctaacaagccaggatccaccaacaacatacatggaggcaagaaagggataaaggcatgtgcccaaattttataattactttggaagagaggcatattgacaacaattcgggagagagtggaagtgcttaatctcagtacccctacttggattctgttttgtcagaatgtttggggacacttgttcgcatcattaaagccatactgatgatgaagatattttcttgactttcaaaaaatatactatatcacaggaagtgggttgaagaaagaggcagatgtgtgtgtgtgtgtgtgtgtgtgtgtgtgtatcaagtatagcatcgtggtgggggcgacgaaggaggtgtccacagaaccctgaaagcattgatggatcttgtttaagaggaaaggcttgagaggatgtctagatttatttggatttggagtaagagaatatatgacattttaaaggtggcatatacctgtgacagattcatattgatgtatggcaaaaccaatacaatattgtaagtaattaacctccaattaaaataaataaatttatattaaaaaaataaagatcatcaggggaaatcctctgcttgaatctcatctcaatcatttgttaactacaaaggcttttttgccgtttaaaagctgggtgactaagtgtcttggttttattttaaatgtggagatgtgagtactgaaaggatgtaggtaaaacatatagcacagtacctggcaagaataagttttcattgacttctgctccttccctttccctttcctcccttgcatttccaccccttcctctccatgccaaatatcttgatctagaattccaagtcttttcactgacttcactgacctccaatcttctcagtgtccatcttcccagttcaagtcatttcttctttcaggaagccctccctttgcttacccttgcttggcatgccaaaat

SEQ ID NO: 38750 - DNA, 1531 bp, Bovine  19866881227579
tgagtttttctacagagactgttaatgtacctatttgccctatacaaaagtaggttaattcctcagggtcctggttagtatagcattacatcagaaatacaataataaggcaataaaggtaccagcatttttattctaaaatatggtagtttaaacattgaagcatgaatagaaatggaataatactcaaactttttatcaattttcacaagttataatggatattccaattattttgtataaattacattaccaattctaaaagttgcataaatttttaaatctctggaaggaaaaagtgttataatctgacttgcaaatatttttagcaaacaaaacaagctttagaaagcgacaaaaatgagaataggatgtatacaaatataaagtgttactgaacagactgggatagctaaatcttctgtgaagctgagagatgtgtgcattcaagaaaataccaatttagctagtattgtttgcaaactttgtagttatacacataaatgtgtctcttctctcccttttgtattggcaccagcttagagagccttcattttatccatccttcatcaggacaatcaacttatctctgatactcaaactcaatctcttaaaatactctcctgtttttttttaaattttattttatttttaaactttacaaaattgtattagttttgccaaaacatgacaaaagtgcagtacacaccaatggcttattgtaggccctaagcattcgccattcagatactggattttctgagtttctgtatggttctgaaaaacctttttattatcattgtacctgaaacttgactggatatgcaattcatgtagtacatttgctacagaacctggtaggcttttcctgataatctttcaggcttaaatgatgctgtgtgccagtccaggttcgatgcatgatgctggatgcttggggctggtgcactgggacggcccagagggatggtatggggagggaggagggaggagggttccggatggggaacacatgtatacctgtggcggattcattttgatatttggcaaaacaaatacaattatgtaaagtttaaaaataaaataaaattagaaaaaaaaaaataaatgatgctgtggaaaatccgggactcctaattttatcttctggtgtgtggcttgggttatctggaggtagcctggagaaatctttctttatctttgaaatttaatagtgaaccaggttatgttttagctttgattgttctgaattacttttgcctggattagagaacattctctttatacttacgtatttttaccccattatcttagggaaattttgttttatagcccttaatatgtttctggttttatggttgagcttttattcttcaaagatgccagctgtcttatggaagcacatctttatatgtccttaatgttgtctcccttccttcccttcttcctccctttccaccttcctctcttcttcctctttcctttcttcctttgtttcatccttctttatccctttctttcttcccctctc

SEQ ID NO: 38751 - DNA, 1158 bp, Bovine  19866881338284
tcttgtgtgtttgcatactaagtacttagtctgtgtgactctttgtgttcctatggactgtagcttgcctggagaatcctacagacaggggagcctggtgggaatactggagtgggttgccattccctcctccaggggatcttcccctctcagggattaaacctgcttctcttatgtcccctgcagtggcaagtgggttctttactagtgctgcttgggaaacacttgagaataaattgtaaaacaaaaagaggtaaaaactcaatgtgcatattcactcttttcttactcttccaataattacataatatttcacattcctaaataagaagcatatctgaaatgtaacatattgcttggagaaatgtatatgcaaaatatatctatcatggtcacattaaaatctccagcctgaaatcatagggaactttttatacacaacatataaagagtatagttctttctaatatatcttttgcctttattcatctatccctacatgttgataatataaactactctttgtcatttttatctaattcaccctgaatatacaccattgtttgtgaggctaaatgactaaacttggtgacatattcatttggtgtagctccttgcactttaaagtttggtttaaaatataatgctgatatatttttcatgctattttaataactgaaagcctggaagctgtgacaaattaagctccctcagaagtcaagaataaccatggttcaaatgatgtccttccattcctagcagaatcatgacctgactaaacttttcaaattataagatatattgaataattcctttgtacaagcttaatgaatatgaatattaaaggatgtttcttagaattagagtgagtttgaatcacttatcactaacattattaattgaatggctttaggttacatatttgagaatttaattcctcatttataaaatatagataccaaaaagtattcatagtagggtagttttataaaatacataatctttagtaaatatttattaaatattttaaatgtgtaatcttcctaaagagatgctttttaaagtaagagtgtattgagtttctaattttattctaataaactgtaatatatatatgtggataaagtatgcctagaagtgtgctgctgttccattcaa

SEQ ID NO: 38752 - DNA, 803 bp, Bovine  19866881391555
gaaaaaaaaattagtcctttaatatgtttacttgctttgattttgttgcctatttaaaataaattgtaaatgcatatgaataaaggtaaggaaatataattctctaatttatacaatttaaattctttaatttttaaaatatgaaatgtcagagttttaacattatttctgaaagcaattttttgagtgaagaatgcaaaatgcagctagaaaattattacactgaaatgtttgaatatctttgagagacaaaaataaagtaaatgtgctaacaaggaaatagtgctagctacaattccaagaacaaggaatgtgatatgcagaaacgcatgataattaggaatgtaagtcattttaatgttaaaattgaaaattgaatcatattacagttattaaagtcaaaagttacggttccttagtaacactttccaattcacattgcccatatgtactattttctcttcctgtttggctgattttggctcctgtttggtttattttggctttggtcttcggcccttaaggcaatatgaattaacattgtattgttctggttttcaaagattgctttttgtttattcattaaaaatgaaattataaaaatgtttatcagacagtttatttcataaatacgtgtgttctgaaaatactgtgtagatgaattttagtttgaaagcaatttttttttcaataggtacttcaattttttatttgtatttagaaagtgcaaaattccaggaatcatgggcaagagataaaagtggctgaactaaaatgggcctggatcctcttttccacattag

SEQ ID NO: 38753 - DNA, 1348 bp, Bovine  19866881399814
ccgactctttgcactcccagactttagcccccaggctactctgtccatcggattgtcctggcaagaatactgaaataggttttcatttcctctgccaggggatctccctgattcagggatcaaacctgtatcttactgctgagccaccagggaagcccatatctaaggtataaggcagaaactcagttccaggtgtattgggaatgaggcaactatccaagacctggagatcagagcaggatgagcagttaactactttaacatctaatgaaagaataagggaccctgacacatattttgttgggctgcaaagagagacaatccttagggttcaagatagcactgaatttctaggaaaaaataattcagatgacttcaaaatataaacaccacacagacaagagcccaatctgtccattacatgcgtagtcctatctaagataaaagaagtttaaatatctctgctatccccgtgctcagttgttcacagattcatgttgaaataatgcaactatactgaggtattcacacagactctggtcttacataaaattatcttgatcaatctagacactcagaagttcaatatttgaaattatattggcatgtcacatctctaaggatcacattgctcatacaaacagaaatctccatgagagatgcctgcattttataagataattaaataatgaaaagaaatagatgacaacctaggctaggacatttccattttaggtaataaaatcatatctgaaaggctttcagattttttttctcattggaatactcaagaaagagaaaaatggattcagaggccaatgtttattgtatgcattttatgagccatatagttcagagaagcctggcgtgctgcagtccgtgggtccccgaagacatgatttggcgactgagcaaaacaacaatatagttcaatatgcaattacctcatttgtttctcacaaaacccacagtaaatttaccaccattttacataggaatagacggaaaacaatattaaatatctcatcacctaggtaacaaaagatatagttcaattttaaactacatctgtacctttccaaaatttgccatctttatatcagattccttgcctaattataaaattgaatttaataggatcatttggtcatcatatcatttaaataataggacatagaataatgactttgaatatgtctctgaataatcagatagagcatgtggttctatatttagctaatatgtttatgcatctttcatttagtgctaatagtttccttactactcaattctttgcttggtttcttatttagaggtttaaatatgatctaatttcctttgattaaat

SEQ ID NO: 38754 - DNA, 741 bp, Bovine  19866881466167
atttcctacctaacttgtcctttaatatagcatcccttgaacacacaagcatacaccatgtgctttatgcttcttcaaagttgtttccataatagctaaaagattattctctagctgaatcatacaaaaaattattttcatttacctaggctttactatgtgtcaggcacagttctaagctcttcacatgtattaaaccggttgatcttcataataaccttgatgacatgccaaacacagagcaggaggaaaacagccatctcacctctcattggtaaatttctttatctataagcatatttcatattcattcatgtgctgactgagcaattcaaagaaaaacacacccacagaaaatatgtaattccttatttgcagggaaatctgcagctggagatattttctaccattgccaaagaaaggctgtgaaatgtagaaatgaaatgaatgtctcaatatgatcaaaggctctgtattgttttctctaacaaagtgtaatgaacatgcaatgaactgagtatctgcatatctgaattttgacactaagtctctctagttataagacttctgctttattgactatgccaaagcctttgactgtgtggatcacaataaactgtggaaaattctgaaagagatgggaatactaccacctgacatgcctcctgagaaagctatgtgcaggtcaggaagcaacagttagaactgaacatggaacaacagaactggttccaaatagga

SEQ ID NO: 38755 - DNA, 776 bp, Bovine  19866881528886
tgggagctgagaggtatagggaattcagagcccttaagcctgtttagtagaaaccctgtgggcaatctcatttctagataaagctgaactaatatcacaggtcaaaacttgccagctaagacatctaagaaaaatatataagtatcacttcatatcttattatataataggaatctacacaatattttacaaccaagaaaaccatgaaaggctaaccttgcatctattttgaacaaatgaatgatatatgtatataatatagttgcatatattctaaacccaaaatcacatcagcaaatttatagtttcagggcatatcagaagaaaaccaattgtcaatttgctagaaatatcagttgtttcagactatcctatgttgtaatcagttttaaaaggcacattactgttaccataaaccattaaaggtggtttataaccaggggaaaaaatcctttaaaatctctcactgctacaattcacaagccattgctacaattcgcaactcatttgttagtcttaaccgccctcagctttgccttgggccattaactaacaaaccaatcattaactgttagtaatgaccatttttcccagggattattgcttaattgaactcttgtacaggacccattattttctgagatgtcaaaataactatgctttactacatttttctataatattaacacctcccaaaataagcaatagcagtgtcggagaattaaattgtttcaatgtacacactattttaaaatacattactttaatgaacaatt

SEQ ID NO: 38756 - DNA, 1449 bp, Bovine  19866880438002
tgacaaacaaaacatttcgtgttcaacttcagaaattacatcttaaaacaagattctcattaaaacacacacacccctcccacacacgcacaatgacaatgacaaaatgaaaacactgtatgaatactgcaggaagggttccaggtcatccacatcgaccctgggagcgggttcttgagcccagcccatggtgaagtgcgaacacactgtggattagtgtctcaggcacgggggccccgactcgagcaaccttgaggttaaactgttatgtacattatatctacatgcgacacagtattttaaattaggaggcaagcacacgtgtgaaggtgttactctactgaatatcaggagatggtggcgggtacggagaacagttaacagaagaagaggagctgtatcacctgttgggagagaatataacctggcatatagttctttaaattaaaagaaattggtacagaaaggaagtataatccaaaaaaatatcaatcaatccagagaaatgtttccattgtccaacatgttcctaatacaagtcagaattcatcatgcacttggacggtcaaaaggagaatgctaacttctgaaaagggaagccctggacattcctgggtaggtgtttggcacccaaatttcaccgaagaatgctgtttcttaatatcagaccaaagtgcaaagcaatataaattagaggccaagtcttctcttgacggtcgatttacttctgcaaaacagactttacgttcctctcatatgaacaatttacatttgaagcgttagatttgttttcactggtagggggaggaagtgggcttctgtactactgaaagtcggtgaggctaaggtatccttctcaaagcagaggccggaatcggaggtgagaaatatcggtacttgaagagttaggctgctttgcatctacccagcgtctagaaccaattccagcttcttaactcagctgtgaagaactcccttaggcatttggtagccgcgtagccagtagttcaagactaggaaaccctgggaaaaaaaaacacaaacaaacaaaaaaaaccaaagggagcatggatggatattctggttggatgtgaagatatatatcacagcccatacatctccacaaagacacatacattgctgtgcacacgttaacactgactgtcaaataaccagcatcaaaacagacgctgcaaactgttttgagcatactacgtaccaggcgtcacatttatttaaacctcacaacaaacttatgagggagcagctattatactcacttaaaagagagaactgaggctcagaaacattatttagtttaaagcattagcccttatatcctgggataaaccataatggaaaagaatatataaaaaagaatatatttatgtgtataactcagtcactttgctgtacagcacaaattatcacaacatgcaaataaactag

SEQ ID NO: 38757 - DNA, 1949 bp, Bovine  19866880443826
catcagatatgacccaataagatgctaaaaaaacagtcaacattgacacatggcagtgctttaatccacaattatccttgtaacttgcaccattccttttatcatccattagctttgattcccattatcccatctagaactgtgtcaacgcttttgtccctagggatttctctccactactaggatctgacagtcaagcttgagtactaaacaggatcattacctcttaaatccacttatctgatctactgaatagtaaattgaaaagctcattaagagcaacaatctgatttgttttcacgtgtgacagggtcatttaaaatcaatgtatgattactgcatttctgttaaaagaccatctcacattttccaaggtaccttatcatgaattcagagagcatgcagataatatgaaaatgtctttaaacatttgaaatgcagttataccatacatacacataatttgggggtgaggactaatttgtccagtgagcaaatatctgtaaaattgtttatcataaagcacaattcaatgaaagttttctactgaaaaaattctaacacagtatttaggggttttcaacattttctaaaacttctatcacttcacccaaaataatttttataacagcaagaagaaactatatcacaatacatactcattataaggaaaaatacaggagttggcataggaatgaaagaaaagggaaaaaagctcactttcagttcatagagtcctaatcttttctttcattatcaattaagataatttgatcctagtgaaaactaagcaaatatctaagaaacaaaagactaatgagcccatttgtgttgctatctctctctgaaggacacggtgaagccgcataaaccgtggtgcctttggctgcatgtttcgcagagtcagaggcgcacacactgtcctctagttttgccgtccatcgtgcctgccttcctctcttctttaaacatgcaggttttcctattagactacaaactccctgaggacagagatgatactctttcatcttgcatccctattactcaataactgttgaatgtataacaaaaatgcacattttggctgattccatttcattcataattattttgacaaaaggaaaaaacaaaaaaaaaaagtgtctttttatacaaagaacttttttgtgtgtaaaaataaaatattccaaattccactcactcaggtgaccacttgcaaaatttcattattttaaaagatgtagtttttaaaaatcattatcatttttcaattgaggtatacttgatttacaatgctgtgttagtttcaggtatacagcaatgtgatccagttatacacacacacacacatatatatatatattctttttcagattcttttatagataattacaagatattgaacatggttccctatgctatatagaaggtccttgttgtttactatagaaagaagtaatttcagtgcttacataatacttcaggaagaagccctccttgtagattcactaagaagagctctctcccctcctctggatgctcagagcatccactgttgcaggccggttagcggcacttttcacataacagaacatcatcctgctgtactaataattttccatgttaatatgtatttcctccattacttcatgctgcctgaggccagggaaaatgtctgtttctttttatagctccagatgtacttagtacactgtcttgataaacttagcaacacagaaaggcacaggttttggtcccaaagataactggatttgagttctgccactaattaggtgttaaagtctctgaaccttggtttcctgtttttctgagaaaacaagaatgataaaaagacctaccttatgggctttggggaagattaaatgatggtacctaacagagcctggcattgagtactatccaacaaatgcggcttccctccccaaccc

SEQ ID NO: 38758 - DNA, 2232 bp, Bovine  19866880475528
ttcaaaagttacctttctcctatagctagtcatacttgactagtctgaaaaatgagaggtccttataaagtgaggctgctttggggagtgggcaggtctggggtgcctaatcctcaggatcctttctgggatacttcaaggagaaactgcttggcgtttcagcctcctgcatggtgaacggttgtctgtgtgccaagtgtgagatggatgggctgggaaacagctgaaatgcgactccttccaccctgacccccaaaacagggtttctaatggaaagtctgacagaccctttactgtagtggcactactgggggcagctataatattatcctcataattctactatataataacaacaaagaaaaagaaggtgaagggtcattgtgctttgtctttagaattaagatggctgtcttcatccttacagcatactcttaattctggagacacatcttaataacctctaaatagttccaacaaaagagccgtgtcagaggaatgagcaggccccaaggtgtttcaactggagtgttttcatctgcctttattgctctatccctctccagaattaaggcaataacctgtgataaattattcaggaactgctacagggatcaaagcaaaatcattctgttaaagtgctgtttgcaacatttggcacttagtgcgaaaacttttaatgtgcgcatgctgaaaatctaggattttaaataatttaacattgtggagtttttacgaagggactaaagatagcaggttcctatttaactgctcctttatcctcctagaagttttcattcattttccttaaaaccgatgacgtcatggccaaatcaaaaatgatgcatgggaagtcagggtattggactgtattttactaagggtacaattatagggggaaacatttactgtgaactaatgctttagagccagggttgtcatggcagtttcttccttttcccctttacttggaaaagaaaaacccaagacaaaaattcaatgttctcttcaattttattaggactaagtaagaaaataaagctataaatttaggagttttacagcatttcctcctctcacaaccatatttcaatttggcaatgtaggtccttaatgtttgtgctcatcctgaaatctgcatttgaaaaatatctataaacagggagttagaaaatcctggtaaggattgcaaattaaatgaatttggcagtcctgcggcattttcatagagatattttaacagcatcacctcctgtggactggaatactaaatactttattgaagaacaaaacagtactgtttttatctttagtacttgcaaaatgaagtacctgaaagcacttttgcatgtattatttattcatcatgatagaaaaatagccttaacctaataaattacatttaaaagcatttagtgcaaaagttttgtttatgataaagcaacagatttacttctttatcggtagcttaaagcaccaagttttctttatacaaattagacagatggtgcttacagtagaatttactaaaggtctgtcacaacaaatgcagccaagctgcatatttaatcactgcagaatcttgtctacctgcagctgccaactgctaatccaatttccctgataaatgtggcaagagacacgatcagcaataaagagcatctaactccattttcctgcagggcgtcttttgatgaacatttaggacggaagcgcggagtgcactgtgtggccttggttcgtggcagctgcatgcattctgaggcacagttctcaggttactcacttaattctgccactatcattacgttgctattgatctcagtagctgttgcctacacagcattactctagatgaagctgaatcaggcagttatcatgcatcaaacttgctcaaaagcctggagatttccccttaattacttgtgattttatttgcaaataccgttaaagtgtaatcaagcagtcactttccagggtcgttaagaacttgctggtttagggatatatcactggaactccattaaaaatgactctgggaagatggtttctatcaaactagatgggattacatcaaaatgggcttggagtataatgaaatcttcaaatgagacaaatgtaatttttaaaaagatactctttttcaatcttactgcttcttttctgatataaagggcagcaatagccaccttaaagttgccaagatttactttcggtcattaaaaatatttg

SEQ ID NO: 38759 - DNA, 1310 bp, Bovine  19866880483518
ctcataatcctccccaacactgaagcgatacctgcatttttttttatttttacacacagtgaaatcttaccagagaaaggttaacttttttcaggtcacacagccagcaagtgagagttatgatacaaactcaggtgtttcaccctagagcccatgccctttatgttaaatcatgtgtctctaaggtcacaggtccttagaacttatcaccatttggcaagttcacatcaacagatataaaaggaatttggtttcctcaatattctgctatcacccacgctctgggatgtatataattcaatttgtatatgtttaagagtctgtaaataatggttaaaatgtccatgaacagaagtttgtgcaacacataccacccttcttttccctttagcagtctttctcccctatctatccccacttgtcttaagaattatcaaacagaaatgttaaaaaggtttcatagcatgaaaaaaaaatctaacattaatttaaatcaatatctattgcacacccaagcgctaaacatagtgaaggattcaaaggacaatcagctttagacatgatcaaacttccatgatacacaggaaggtctggtaagtcccatatgcattaggaacaagtcattatgagaattagtgatataggtgagaatttccagaaaagaggatggctaagatacaggcagacagcaataacccaagtaagcaaccaacaggaaagctcaactcaacatttactgaacaccttctacaagaaggcgctgttgaggagtttatcatttaacaggggacacaaacaggaaactctaatacaagcgcagaagatgccaagtgccacaggataaatccaaagtgccagcactcattcatttaacgatgattatcatgtaggcattgctatcgatacaaaaacaaaattatatctgccaccataatataaattgacatctagaagaggtatctaagttgtgttctgagaggagagaagaggacgttatcaacatgggtggaagagaggattgctgagatctcacctaaatcaatttggctggagagctattaggtccttcccattaatatcagtagcctgagacacgggcttaggtcagttcatatcagtgctgacaaaggaaatctgaagaacaatggtcctccacactttggctggaatatagaataagtgaggaatgtgagaagaaaaagctggaagggaggcaggaatctgaatagtgaggacttcaaatgctttctttccctttaactgtaaatatcaccaggtggaagccaagatcccaggctcctcacagcgca

SEQ ID NO: 38760 - DNA, 1940 bp, Bovine  19866880498259
cattccttaccattgcaaaaccctctgtgttcttgcccagtctccctttttgctgctgtctctgcttagaacacatttatgatgaactccataactgtggccttctctgtggagtcttccctgattctcaaggacccagaagtgtccatcttcccgccgctgacccacagcatctttgcccagccctggttcctgttacctctaaggagtagtctgtcccaggcagcttttagctcctcaagaacagaggttgtggtagatgtctgtgttctcttacctcctcccaggcatcttgcagacttggaatttaagaaaatggatgagtatgacatacaggagtaggacgttcttggtggttcagtggttaagacttcgccttccaatatagagggtgtaggttcaatccctggtcggggagctaaatccctcgtgccttgtggcctaaaaccaaaacagcaaacaaataatattttaacaaattcaataaagattttaaaaaaataagcgatgtaggagtgaagtgagtaaatgagtaagtttagtgtatgaggaacgaatgaaaagatttttaacagcctgagccagcaggaaccgtgactcccagggtgacatgggttgggttccctttctccgtctgcatgaaggggtcatggagagatgtggcccctctataatttgaccatgtctttggtgaaataggagcctcaacagtgagctgagcttcttgctcggtgacccagtagagaggaaagcacgtctgggttgagaggcaggaactgatccccttgggcctgtggcctctgacttctcccacccagaaggttctcaccacatgtttcagtaggggcagctcttcctcagggagctgagagtctttgccaagagttcccataggcagcagtataggcttccagagtcaaagctgtttgtccagcaagtgccctcatggctggtggccggatgtggtgggcagcacacagaaggcctggggttggggcgatctcaagccagggcgccagtgtcatcatgtgactctgtcttatagatgatgtccgtcctcatgaacaccattgtctttgaagactgtcggaaccagtggtcagtgtccaggcctctcctggggctcatcctgctcaatgagaaggtgagtgtggctgctgggaggtccccaggaggcaaccgcaggaggagggtgcagccagacaccaggccaggctgtgagagagacgggggccagctgagcgtgagcgggcaccttgagcgcccaggacaaggccgtattcccccagaaggcccttccccaggggcctcagatctccttcagctaagtggacacctcaggctagcttttctggaacccagagcccccacactgggcaggtggttagctcagcagtgcttccagctcaccctcactcccttccctgctccaggagatgctgggcaacaatctcttttgccctttcctgggcctccttcctgatgcccattgaccactgccctcaatggtagcagtcccccgaatacagaggcagcaccctctatccaggacgtgtgtctctagcccttgagtgcacacaccactctgggctgcctcccaggttctccagcttccccttgaacccacccctggctccccagcagtcagtaggaacagtgcattactgctcgggagaatgaattgtctatacaataagagagtactggggaaaagacagtgagattagagacagccgcatacattaaaattcaaactgaaatcccagccttggaaggaaactaatagaagaagaaaatatatcaaaaagagaagagctgtctcatcattcacctgtgctaagtatccaattttagccacattcaatagcactgtcattcatcttccctcggtgttattgtgatttaaatccaagctctataaaagagagcagttcttttaa

SEQ ID NO: 38761 - DNA, 1472 bp, Bovine  19866880517815
ctcctgagccccagcagctcctgagaatcacctcactctggcctcccacaaaaggcacagccacggacgtcccctcctgaaaaaccgagcctgaagctgttaagatctcttctgttagaactttttaacggtgtcataaatcttttattaacattcagtattatactaattaaaactgtactctgtatgtattattaatttccctagcacttcttgctggggtgacatttttagccagctaagcagaatgcagcacagtaaataagaagaaactcatttccagacaattagccttgcagaaaaataagttggttaatggaaggcatgatgattacaaattttacctaaataaacagggtatcttaatggtaactcttcaagctaagtaaacagattggggtgataatgtcctaagcaatacttaaatgtaactgtttaataaattggtaaattactcatttcatcttagaacaaaatggtaatactgtagtaataacctagtatatattccgtaaatatgaagcattatcactttagctctgtagaaatcaccacagtgatatgtcagcattgatctaaaactgcagcattttatctcaagtttattacccatttttgagaatcgctgagattttcagagcataatggcaataaaagaagaatttaaaaagcgctttaatgtgcataagttaatcagaggtatcctccggggaaaaaggaaatttggtaaaacatgaattataagcatcatttaaacttactttggacactagagataataaatggcaccataatttagaaatagcttttaacatcaatgacggtaagtaccactttactgttcataagaattgcagagcaatggtgctgaggccaattttattagccatttttttctttataaaagcaatccagccctttccacaactgaggagacaggaacaagagttacgtgctaatatgcaaaatgcatttaagttttttgaaatagagaataataaattgtgccaaaagatagagtctggagacaaatgaatgatcatttaaaaagaataaggcgctctcagactttacatatttggggaaacttgataaaaaaaaaaaaagaagccaacaaatcgttcatacattttctcatttgccagagcatgcggatgcgctttcaaatccgagagatgaagccataaatcccagcgattggaagatgccgcaacagaaatatgtttttgtaaactgtcaccattgacaaatcatttataaactatacagagcacaggttcaatctgctcttcagggtgtccaagcaacctgcctacagagaagcctcagactctgacctctactcggcgagcacagcccgacaggcagggcggctggcagctgcactgttcaagcggagcagcccaagctgtaggtaggaccatcgccaggactcactgagccacctactaagcacccagcgtgctgagcat

SEQ ID NO: 38762 - DNA, 1529 bp, Bovine  19866880560539
ctgaagctaactgatgtacctcccacatagctgcacaaaaggatttttcaacaaaacgatttcagtctcagttttagctgagttctcaagacaactggtatcaaccgctcccatttcacaaaatgtgttaccaggtcacctatgcaaggctgtgacggctcctgaccattagctgacctcctgtgtccgatctttaaaagaggtttgagaggttgagggaggtacttgattataagagcttcttcttcttttttttttttttttattctctctctctctcctggtgattttatgaggacccctgcctagggcttccaagggggcgttggtggtaaagaactcgcctgccaaagctggagacacagagaaaggagggctccatccctgggtggggaaaatccaaaaaacagaagcaatattgtaacagattcaataaaaactttttaaaatggttcgcatccaaaggaaaaaaaaaaaacaactaaaaaaaaaaaatagacaagaatgatcttcctaacattggtgtcctctgtacttaaaaacttcccagctggcccagtggtaaagagtccacctgacaatgcaggagacactagagatgcaggtttgatccctgggtcaggagaatccccctgaaggagaaaatggcaacccactccagtattcttgcctggacaatccgatggacaaaggagcctggcgggctacagtccatggggtcacaaagagctggacacaacagagctactaagcacatgatgttagagtcgcagtctcaccactaatcttgttttgccctcagactttacagttccctttaatgggtttccactgaaacatctttctctccctcttgattctgctcactgtaccctgaggagttagtggttggcagcagaaacctcctttccgtaggacagaaagtgggccctctcccaggtttccgtaagttttgctggactaccacccctgacctccaaagctgccatgggtgcaccccctgcccgactaacattcaagttgcctgtgtgaaggagtgatttgttgcggcctctaactgcttcttctcttccttcctttttgtcatcctgcagtgttctgtgccaaggtctttgtggctaggctgcgccaacctggtagagagcatgtgcgcactgagttgcctgcagagcatgcccagtgtcagatgtctccaggtgcctctcttctttcttgttgtaaatgtgttttttacgtataccatgaacatttgttgaaacttgcagtagtgtgtttaatccaatgttaagtctgctaaatgttctgtgtaaccctctgctttcctccagcctgggtgccctacatggaggagttcatacctagaggggcccttctgagcaaatgggtctttggctgggccctattctgctcctctttttccgctcctgctttttatcctcccaacccctaccttgaatctgtgattctcatgtttaatagttgtgcatgtacccccaaaaccttgacattttccatttggctacctttaa

SEQ ID NO: 38763 - DNA, 1717 bp, Bovine  19866880579526
aaaatatttagagatgtggtattttagcatgtgtacatttgcgcattcctccatataaatatgttgaaacatacagtgcggggtggatgagggaatagggacgtttatttaaagtggtgtactcatgagaaatgttcttttaaaagatactgtcatgggagacaaatatgtcatctaatcataagctgactatctgcaatcatttgataacctcaaagtccatttgtataagaaactagaaaagcacttatatgaaaagtacacctcgaagacacatgtaagtgggaaattaagactgatggggcacgaagcacacacaaatatgcagacctttttctgaatttatacctagattttgtcctagaatgaacaaaatcaccttttctcatgtttggaaacaaacccacctttacatcttcttgtttaaagttgttattgaatatctgtaatactgtttcgaaagagactgtaagaggcagcatgaaattttcaaattcatcctcatcttcgcctatcagaaaaacaaaaggtcatcatggtttaaaatgcatgctactgtccattagccttcacagtgagcgctttattcaggctcagaaacgttctcgagaaggggtcagcctgcattcacatccgtatcacattctgtgctttggctcattgaatattctggtgttttgccttctcttttgcaccaaatgaaatagcaaaattacttaccagccatttttttctctggctctttattggatcaaacagactcatgccccaggcacctcagcctttcagctcttagggcccccagagcttccctaatgcctcaaggaaagcccctttcaaagcctcagagaacacggtctgttttccttttctctttaggtgccaaggccctaaaggactcacagactcaggtgcccagatagtgctaagttattattctcttttatttatgttcttttttattaatttgttaaatagatgtcagggaaacaggatggggtcctgccaaaacaggatgaggtccctcatgggtcattatgattttaaggacattctccgtgagtacacttctttttgcaataagcttctttttctttttataaaagtgggaagagacatcttctactgtttttcactatgaaggtagaatcttcacttaacatatggatacgcacaattgacaatttatattctatccttcacaagagtgggttccttcaaatgagaaagtttactcattcatcctatgccacagggaattgtgagccccactttacagatgaagaaacaagcagagaaatgttaagtgacttgctcaaggtagcatacttagctggaggtggaactatactgtctagatcttgtgatttctgtgctatcattttttaaatagagaattagagaggaaacaagatctcagagaagaagccagtggttctcaaagtttggtccctgccctagcagcatcagcatcacctgggaattcgttagatataaaatttcaggttccgtcccagatccagcaatttttgttttaagcagccctccaggaaatttcaggttcagttcagttcagttgctcagtcatgtccgactctttgtgaccccatgaaccacagcacaccaggcctcactgtccatcaccaactcccggagtacacccaaaactatgtccattgagtcggtgatgccatccaaacatctcatcttctgtcgt

SEQ ID NO: 38764 - DNA, 1417 bp, Bovine  19866880588688
ttatgctcaggctttcccacctgcccaagactacaagatccgggggcctgcattagtcagcctgtacaagaaatgcttcttgacattctaatggactagtggtaccctcttccacctttctaagctagtcttcataaaaccacatcttgggaattccctagcagttcagtgattaagactctgcagttttactgccaaggacccaggttcagtccctagtcagggaactaagatcctgtaagtaacacagcatggcccaaaaaacccaaaaaccaaacaaaaaaatgcatcttgagccaaaggtgtccagcctctttgcagtagaatggaatgctcattgaaggctgcctgtgcaacagaaattgtggaatagagacttgagtcagatcagccatgtgctacagcctcattgagggaactcttcatttagcacttgaagcccaccaaaaaaaaaaaaaagaagaagcagcaaacctgatatggctccaggattttctctgatcttttttctagtagacaagcaaacctttatctcagtaatttcaaaattgaggatgcagaggactcccttagaatatacttcttaaatgcccttttcaggacctcattccagaggttttcattttgttaagtctgatctggggatcagaaaactgtgtttttaacaagcacccctatgtgatttttatggaggtagtcttaatctcactttaataaatattgctatggtttatttctcttatgagtgttgtgcttctttgatactggtttgagtttcatttgaggttttccaggtgtatttctcatgcacttatcttttgcctgttgtgtatggtaaatattaagccatttacccagttatgatttagttatatgggttgacattgtgtgaatatagcagatgatgataccaaatcctattataacagcagatttctttgtgttaaaaaaaaggttccctagcccctgttaagcactgttctgtgttatattattccagcccagaaaaataattcagtcttctaaattccatactacaacagtgttgcttgcgcttaaccgttaaccatataaggcaaattgaaattacgtactatgctatactatagcttcaaattaggacttctagagatcaagatatttttattagaattcctttaaatactgaattgagaatcattacgtcatttgttccatgttaggttggtgcaaaagaaattgtggttttgcactgttgaactttgccatttgcactttgaatttgccatacattcttaaataaatgtggttatgttatacatcgttttaatacacatttatcactttatattttttgctaatgacttattacttgctgtttatttcatatttattttagactagggaaattatattaaaaagcaaattcgagtatttt

SEQ ID NO: 38765 - DNA, 955 bp, Bovine  19866880619511
tctacgatgttttaaagcatttatgaaaatgtgtcacaaaatataatttcctaaaaacaaattctcttagtacatttgaaagtttgttggaactatcattttgtaaatgagttgtaaagagttaggaataatttttgcaaattattatattaaaatgcatgaatctggcatatactgtctctaattacaaacaaaggatcagttggcttggcattatctacagaaactttaaaagctggtaggattaataacttatgataatcagtgttatgaacactatacagctccttacagtaaatattgtcagatataaacaattaatatataactgtatattgtctttcaaaatacatatgtaactccacattatagcttaaatttattaaaaggcaaaatctgattaatcccctgagttatttaatgaacaatttagttgagccattttcttctaaaatcattatggataattagagtttagacaatcagagtatgagagaagagctgaaaaactgtcagaatcgtgtgatttaaagaacttcatatatattacattaaaacaaacttcagtcttgcccctgcatatatctcaaacaaaggaaaagttagaaacaacttgctttgtaacaaagttaaatttaagcctgttttcttctctcttctttgtttttttttggaataaagaaagaatttcagtaaaagtaaactccgtacaacaatgaaggtatcttttccttttctagttgtatcttgcatgctgatttaaagcaagttcacatgtaacaatttactatttatatatgaatatacacttactgcttggctccactgagaaactataaatttcatctattgaacattagcaaaaaattacatgtgtttatcatctgggttattctcagattaatagagataaagacaaaacataatcagtagcagctctgcaacttaatcattg

SEQ ID NO: 38766 - DNA, 1803 bp, Bovine  19866880672186
gctgaaatcaagaaaggttatgtaatttatttttaaaagtttaagtaccgttcttaaagataactggtgctcattttcatcattatccaccttgaagtgataatctctgtcagcctttagttcacaacctgtaaatgaagaacaaaaccaactgtaacaaggagaaaaataacactgaaacttcagtgtgtgtaagtaaagaattaactcataaaggaatttttactattctagctaccaaaagggaagaggtaccactccctggatttcttgaacacaagtttatcaacatcaaataaaatccatacagagcgttataaatttcactttccccccacactatttaattctcaactacatagtctcagaaataggatcaaaaatttagtaaagctggaattgaaacccatcctaacaatgctgataaaatcccactatttaaaaaagttgattacctaccaaaattcccaagaaaagtgccaaccaaatttagaagtgccaagagttacacaaacacctacatccacagcttgtatttgtagcataaaaactacaaatgtagaattaaactccttataggggtcaacattccacttttgaggtgtcagaaattatgtacattaaattctgcttagcagttaaaacatggaaatatgttaaggatatttccaatagagttaacataaaaattttgatagaaatagatccgaaaagctagtttttcaaaatgctaggaataaaagccttaacgtatatagtgcatgttactactaccattcatgaataggcagttatttgatataccatcagaattaaataattaccatctaatagttactggaagagatgcctcaaagcctgacacaaggaaatggcttcaacaattaagtttagtgagactgaaaaaccaagacccttagtatgctacactgtgcatgagagggaaatacccaaaaccttacagaaggctgccttcgctggtctccctctaccgccccaaatcatttgtaatgcaatagttctggaagcaagcgtcgtctaattttccttaagccgcttctaagttcagtaccacatctgtaaagtgggcgcggtgaaattagaaaaatgattctctaaacgagtactaccaacatagatgttaagcactgaacaaagacctccagagtcctggctgtaccaaccacttcacctaacatttcccgcccaccagcctcaattaagccctgagtcgccgggctcgggggcgacaagacaccagaaagccccggatgtagctcccacaccccctcctcccaaccacgtggcaaccacgtgctccccgcggtcgcggcctcctcaagaccggccgggccgcgcctcccctccccgtgcaaccggccgaggcaacgggaccgagtcttggccccacagctcctgaccctgaggcccgatgacaacgccatgctcaatccatcttctcgttaggaaaggaggctcaggcctcacaccccgaaaccatacaacctcctgcaccacaaacccggagaccagcatcaggcacccgcccggaatcagaagcctatcaactcacaaagcccccagaataactgtagccggagttctaccatgccagctaacgccaaactctcaaccggtcgctcccaagttacttcaggccctaggccccgaccgctcatgccccagccttcaggccgctcctccttcccaccctctccgtgctgccggctcgactctcctggatccccatccctcaggctgaaggatcctggcagctcgcttccgactccctcagacctccag

SEQ ID NO: 38767 - DNA, 978 bp, Bovine  19866880682783
ctaaatacattttagttatctcctaagcaatattggtaaagttccaaatgtgatgtgccagctttattatttttttctaattcacatcaaaataaatatataatgataaaattacgaaaactttgtgccatttaatattttagccactcgaaaaaatactactgtataggaaaaaaaaagttttaacttcgaatggcactgatgatatactacaatctgatcccagttatgagtatattctcacatgcaacactttccttccaatatgctctattccaaatactgtccctcaaatatgaattttcatcacaactattgctcccaccaccacaaatgttttcaccatcacctcaccttcttttttcatttcagggccagatcattccttcaagaccttcccctacaacactgcttcttttgtttttcaactgatccatagactagccttctttttttttttaggcagataaaggcttgtcttttattgaatgagtgatctatgcaattgccgaggccactatgtacagagaagagggggagaactttatttcttggtctcttcctccttggacagagtcttgatgatttcctctttcttggcctggagccgctcttcacggcgcttgcaggcttccttggtcttagacctgcgggcctcagcctggtccgccagaaggttcttgcgagccttgtctgccttcagcttgtggatatgttctatgaggatccgcttgtttttgaacacattacccttcaccttcaggtacaattcagtctgaaccactgaaatgcagctgcttctgtagcgctgcatttaaaggcatctttcttaagtgcaaactcagtttcttttcccagaaaagcatccaaggagatctgcttgtattgtcaagtatctgtaagctcttaaaagttaactaagactgtattatcaaatgattttaaatagtgaattttcagtgatatcagtttatttaa

SEQ ID NO: 38768 - DNA, 2845 bp, Bovine  19866880710330
tttgtgggcatgctggagattactaacctgtgcagctggcctccagctgatggccaggacacacatgtgtgagtgcatgcacacacacacacacacatttagaggatgcctgctgccaatttcttgcctggcaaaccagaaatatttcagtggtttataaataagatcccaatcatctcgggacacttctcaggttcaggcccatctgggtcaggtgcccacagggctctgagctcctctccattcacacccatactccatcccggcacgccttccacttcccataatgcacagagaatgcctcagcgccagagaaacatctgaactggacaatttcacaggctgcatcagtgctgtcttgatttgttctttttttctctcatgttattgaaatgttatttttttccactcacatactaccacctctcaccccttccaaatcaacctattggaaaagatgtttattttgctttttccttggcataatttaatatcagacaagtgcatctctgatgcagacagtatattcctggggcatacatttgagattctggttaattagaattacaaatttgtcatgcaatcctggccagtttggaattggcaccctgacatcatgtctatgcccttttggccttgccagcagttgctaggattgttggaggggcagggggagtcgcttttctcagctataagttaggatttcataaataattggcagcgccttaaaagaagcctgctctttaccatgagataatgtatgttttctttctacttacttggagtgggtcgtattgggagccacccaagttcacttttaaatcatttctctgcatgccagacacagcttttgaagtcgtctgccccagcccccagggaagccagggccagggcctgggcctctacccgtggccccactatgtgccccgccgcccataacaggaagtgtgtcagagcagggtgggcacggggtgggtggggcgggtccacagggctcagttcccccagacggaaaatcctctgacgtgtcctcagtgtgcgcgtctggagctccagcaggtcagatgtcaccgctgcctccaagcctcaacacccctttgtgtctgccccgctggccttcagatgtagcacatggcataacagcaggctttttcaaagtgcaggccacaggaaatcacatctgaagtgcctggcatggagggtgtttttatactgttcactttttcctttttcttttcatctgttttctgcatttttttttcagtttgctttttctccttgatttattgttgtattattctatttttaaaccaagacatactttcccatcagactctttaatgtaactcatatgaaaattagtgatgggtggacctcaagacggtgcaggggctgaatccagtaggaactgccttcccaaagcgcagatgcttatctgaatccacactagctgctgtggtccaggagagcagagtgaccaacccctcactaaccgatctgaggctccctcgtgtgggctcctgccccttctgctcgaacttgtagcaaacagtgtccttgtcccagtttgtcccccttccgtgggaaaacatggatattccagaaaggattatggaatccccaacatcgggaggaagaaaaccagtgtgatccaacctagcgtgttcatttggggatcagtccatgagggctggctttcagagcaagatgggatgatggtttaagggtcacactcaggcctctttgaagctcctccatgtctcaaggagaccacctcagcaccaaagccagagagccctcagctgagattcctgctagcattgtggtgaggggtgaacctctaacgatctgtgcctcagctagaatctgaatgcttttcttctagggttgtaaaaaatagagcaatggtttgtcaaggaaatggcaggggctcagtaaagtggtagctggtcttacgattcacaggtttgttcccatctcctcatttagtctgaattcatctccctttcccccgaattcctgctgagaatttgtcagtctcccttttatttattttttctgtgtcttatgggtctctccttcctctgcccaaatcggagaggttagaagggtaaggactgtattccatgtggcctggcagttaaaagcatgaactttagagaccagtagtctgtcttcactgctcatgagtgagcccactcatccattcagcacagatgcctgagttcttgcaagtgctgaggattctgcaaagagcagtaaaagcctggttcccacagcaggcacccctggttctccctattctatttcagccccagctggagcagacatttcaagagcaaaatggcctcacaccggcagcatcccacctaacaggtgtgctgcctaacgctctacttcctgttctaagaaattttctcacatccaaatggcctgtttggacgttatgcaaatgctgcctaggaggatgaggttaacatgccaggatgaggtaagcagtgccagtggaggccccttgcagcctcctgtcctccaagcagacaatgctgggaggtctccgcatattgtccgcagtgctagagggatggagctcccgtggcccacagcgtaaccttcaaagtgctcccacccccttgttgacttctcttccctctcctactcttctgctccctcccttctgcttcctcccaaacccttgacctgaatccttgacccagactctgctttcaggagaacaaaagctaagacaatttctgctctcataatctttgaaatttaatgagtgtagagagacaatagggagaaggcattggcaccccactccagtactcttgcctggagaatc

SEQ ID NO: 38769 - DNA, 1045 bp, Bovine  19866880753737
atgagggactcctgcttctctaccaattagagttttagactcattctagcattccttctttctaggtaaggtttattgggatacccagagaatttccccacttcctgacagcatcttatccagaataaagccccacttccttaaaccctcttccaaaccacctgacaactccttctgagatgttctacagttcttcacggtatgtgtcctcccttcctgcacccagtagtaaactcaacttgctcagctatcggtgtgccctcgctcccctttggttagaggtactgacagacttgacaaagttcacacagagctgaaggcagaattcactggaaggcgtctccagctgtattccttcttagcacctgtcactcctgcgattaatgcctgtcttcccctcactggaattaagctccttgagcagagaggccttgtctgtaaggttcagagttgaatttccagtgcccacactggtacccagcagaggctggaagtttaaaaacgtattttctgaacaaatgaattaaaggggctcaatatacacagatttcctttcatttctcagttcctcccggtacgtggtgcatatagaccataaaccttctcttcccctactaactttcctaacactcacttctaggacgcctctactgtcacagcctacccgtctgcctgagatcctcccgttcgttggccgctctcccacgcctgagccccacgaccaccccctccttgtcgcacgtcgaaacccacctgtcgcccacacctcaccctatcctaaacgctagcggatcagcagcgccgctacttcagcgtccagtgggcgctgcagacatcgaacgcgcatgtacggaaatcggtcgcagtatctctgacaagtgaagagttgcctcggagtttcggtgccggtccgggtagcctcgggctgccaggaagtcgggggaaggtagccggaaggagaacccgagagcagggctttctgggacatgtagttggggcgctgcccaggccctactttgagagagcccttaagtcttcaggtttg

SEQ ID NO: 38770 - DNA, 1739 bp, Bovine  19866880807794
cgatgactgatggaggcggaaatgaaaagccgataggtgaactgtcttgctcaagatcacacagcccgtaagggagggtttggagatttcaacccaggcccttgtggtcctaaagcccttacttttcagccacccagtcagaaaggccaaagcttggagccggtggcccatgaggtcaactcagcatgcagacatgttttgcttggacccaagtctgctttaaaaagtgggaaatttcacataaaagacgaggtttccggcttctggttagaaatcagatctggcaaccctaggcccacctttccatgggaccacaactggctgagctgaggagtggctgcccctcagtccaggcttgtggttgccacaccccgccccagcccacattcctcatagatgtcccctgcctggcccctgagagtacctgcctttgcatcctggcaggcctgcaggcaccctctcaggagagagacccagaccatagtgtgaaggttctgagccccttcctcagcatccatctctgtgtgttaagtgcatattctttaaagtcaggcctggggcccatgggatttctctttctgagcttcagttttctcatctttaaaacaaggatgttagtacttatctaggactatggagagaatgacttgcattttcaatccctgggtttgggccactcataactcctccttccccctttcgtggaacaggataagttcagggggtctagcaatcactcaggcccaggcaacacccatcagagtggaatgagaacaggccaggtttgtgggtgttccatgggctagatgaggcactgcctctaggctgtcacagaccttgggccctttcctaaaccaaattgagtggacccgctgattccttctgtgtctgttgccctctttagaatgcacactctgcaaggcctataaccacattttattcccatctgtatcctgcaagctcaccatgtactaataaaatctcttagtaatggaggccccaaggctcagtccttggtccttttctctcctctgtctcttctctttgctttgtgatctttccaatcttaaggctttaaacatcattcatacaccaatgactcccagatctatacctctacccagacctgctcctgacccagaggtgtacctaactgcctattcaacatcgaacacttagataactactgctcatctcagactcagcatgtccaggcatgaactcctgatctccccgcaagtgactccacctgtcacctctcaggtgatggcaactccatccttccagctgttcagccataaagccacaatgccatccatcctctcttgcctggattattacaatagcttcctagctcgtcatcaccctgcttggactcttacctttgccagggtattctgtacacaagagtcacagcagtccttttaaaactgaaattaactgtgtctctaccttggtcaaaaccctgcaatgatgccctcttccttgcagtagatgctagagttcttaacaatggcctacaaaaccttgcataacctggagccctctctgacctcacttactgctctcctctgcactcagagtttcagttacttgcacaaaatcaagttctagcagggcaaagaggactagaactcaagtctgctttgtcttcaaggttctcaagcttctgctgcaaagcacaagttcctggcaagtctcattgttttcccggactgcggtttcctcatctataaaat

SEQ ID NO: 38771 - DNA, 1332 bp, Bovine  19866880853315
ttggggtaggatctaagaaaaatccctcatgaattttagcatagttagagaaatgtgctggataggtgagcaaatcggattcctttgtctcattccatattagggaaaggaactcgcaacagtggtggggtgtatttactttgtgccagacactgtactgagcccatatatgcacatatatatatatatatatgcatatatatgtgtgtgtgtatatatatatatatatatatatatatatatatatatatatacacacgttagttcactcacttcttataacatacctgagaaataaatattatttgccctgttttatggagcagaaaactgtgattctgagacattaagtaatttaccccaaaccccacaggttgttaagtggtaaaatcaggactggaactgttctaagttgttttctgccccccttacaaatctcatggtcttgacttatctttgtataatacgttatgcatattaatcaatagcactgattgcatgattgaaaacagtgtaatcaaagatcagaattatgacaattaaaagaatgagtgtgaggaaatcacatcatacacattccttcattttttttttcaatttcctgctggatttttgacacttcggtctgtgtatgatctgggaaaagttgaaacaaggcgactaagtacactgcaaggtgagatgcttttcactgctacgctctcactacaggggtaaagaagcagcagcgactcgtcttcggtcctctagtagtggcacagtctaccaacatggttgctgtgtagttccaggcgagctaggcttggaaggacacagtgataagcaatgcagtttgtgtaccagttaatgcagtcagtgtttatagaaatgcttttaaattaaacagctaaccactaaaataccattttatcaaataatcaccataaataaaatgcatttgactctaagatgacatgtgctcttacaggatgtttcttctgcatgctaaggactattcagaaaattaaagaacacacattttttttgtggataaaaggcaaataaactttccccagcagtaatgtgagaaccatcactgacggtttgacatatcaatatttcaggaagaataaatgactttcatatctatgtttttttaaaatcatatacttactcatttttatattactagaatactttggaaagaatctgtactttatcacctgaaactgcttaaagtatttcaaaatattttaataaagctctttgaattatcaaataatgtaacttttaaacaaattttactattattataaatatttgctcttcatcccttgcccaaaggaaaactat

SEQ ID NO: 38772 - DNA, 1507 bp, Bovine  19866880888619
tgaaaagaatgcagtacaaacaaacaaaatagttataccatcattaaaaagaaactctgacagtgcaggtgacagcacaggcaggataaatcaccataatgttccaaatgctgagctgtcagcatgctaatgctgtgatcagacaccctgggaatctcagcactacagttgtcagaaacaggtatcataaatcacctctctctactgtactgctcattatcacagctatggtatacatgcttttcagcatacttcggtataaatttgaaggcaacacttataggtctgcttactcttgcacacactgtagacaattcttgcctaataaatggatgctttattttgcaataattagagaatgtgagaacataacagacctctgtttttgattcataaaccatctgaatgaacagactgcaaaaccagcacattttcccaaggtgtacatgtacaatatatttaatagtagcaatgagctagataaattaacatcattccacttaaaggagtattgtttgaaagccattcctggatctaaaatacaaaagcatgagagacaaatcagaatcacttcaaatgcctagcgacattgaaggaagccatctacaaaatgcaaaggcaacatacagaatgggagaaaatatttccaaatcatatatctgatgaggggttaatatgcaatatacataaagaatttagacaaatcagtagaaaataaaatgaaaaatggcagaggatctaaatagacatttttcctatatgaagacataaaagtgctcaacaggtacaggaaaaggtactcaacatcactaatcaacaggcaagcgcaaactaaaactacactgaggtatcacttcatacttgttagaattactattatcaataagactagaaacaagcagccgtggtgaggatgcgggaaaaagctgcactgcggtgttcgttgtgcactatgtggaaacgtaaactggcgcagccagcgtggaaagcagtacagaggttcctcaaaaatcaggaacagcaccaccgcgtgacccagaaacccaggtatctctctgaaggaaaaaaactactatatatgttcactgtagcattattcacaatagctaagacatggaatggggaaggcaatggcaccccactccagtactcttgcctggaaaatcccatggatggaggagcctggtaggctgcagtccatggcgtcgctaagagtcagacatgactgagcgacttcacttttcactttcatgcactggagaaggaaatggcaacccactccagtgttcttgcctggagaatcccagggacgggggagcctggtgggctgccgtctatgcggtcacacagagtcggacactactgaagcgacttagcagcagtagcagcagcaagacatagaaacaagctaaatgttcatacacatgaatggataaagaaaatgtggtatatacacacagtgaaatattcagtcataaagagaatgaaattttgccatttgcagcaa

SEQ ID NO: 38773 - DNA, 888 bp, Bovine  19866880913193
acaccgctggcctatgtagcagccattcccccaccacttcccttccgtcctagggatgtctctaacaacaaaagtttgaaatagcagatattttcttagattcccttgcatatatagttctcaccaatgaaatgtaagaagaagtctctaaggaacaccttgataataagaaacagatataggagaagaagccttgtgcttcctgctgtggatattaccccgtgaagatgtgaagctggagctgccacagccattttggaaccatgaagtcacaaagaccctgatgctaggaaagactgaaggcaaaggagaagggggaggcagggaatgaggtggttagatagcatcactgactcaatggacatgaatttgagcaaattcagggagacggtggaggacagaggagcctggtgtgctgcagtccatgggggtcacaactcagtgactgaacaacaacaaaagataaaaaccaacaggctaaagatggcagagctgaaggatagaaagatgctggcttcttgatgacaaagttgaactgtaaaccaagatcctgggatgttggtgcttgagctggagtagagctcccatctccagacttgctgctataccctgctgcctccacaaaccaaaactaatgttaactgagcatttactaagtaccagacattcttctgaagcacttcacatgtgttacatctaaatcttacagcaatcctatgagatagatcctaactaaccccattctccagaagaggaaattgaggcttagaggttttaagcatcttgcctaaaaccacacagccagtgtgtgactgagccaggatttaaactccagagctcaaacctgtaccactttgctttactgtctcaccctcctattccttctct

SEQ ID NO: 38774 - DNA, 1027 bp, Bovine  19866880918483
tcaggattcaccgaatcctggtgtacaggaactacgggagatagtcttagaaagttagtctgaagccaaatggaaggaattctttttacagcagataacctgagccagattcatggtttctcagtttagactatgcacttgcacagagttctgtggttataaaggcctctgcttggttcagtgtgctgctgctgaagactttaaattcttaatcatttatgaacaagtgcacaccacattttcattttgtactgggcccagtggatgatgtatgcggtcttgcaataacatgaagaagttattaattctaagaattgttgaagttcacattatcaatagggtaaaataagtttggataaattcatgaattaatgtagaattcttaatgaggtctgtttttaagaagctgaagactatcttttgggttttctcaaacctttgaggatgatgtaataagggcagctaccaacagagggcctaacagaaaatgaaatttcctttctcattacgatctatctgaaactcagagacatgcatgcaactgctataaatctgagtaaacaatgaattacaatagaaatgttgatcaactacttttcaaaggaagaaaaacttgaaataatgattaaaaaccaaacagaattatgaatgaaatgtgacacttccctctctctcagcatttaaaaaagtaagtttctttgatggctctctatgacccttattctcactccagtttccccggcagcttccttgtcctaatcacttaaacaatcttacatcttccccaattagacagaaaccagaatttacgactggaaaacatatcaaagcaggaaaaggatacccaagtattaaaactaactgtgaagggctgccccaggacagagtcatttcaatcctgtgtctgttagaaaaagctatttagaatctggaattattgaaatttaaccttagaaaattaaaaagtacattaaaaagttactagatatgtttgctaaatttgccgtatatgccacatataatgaat

SEQ ID NO: 38775 - DNA, 1451 bp, Bovine  19866880963776
tgaagacagagggcacaattcacctgccaaactgtgacctgtatcaggcggacccagcagggtggtaaggtgaagaggaatgggttttaaagactcctagagcaggcagttactagttgtatgaccttaggcaagttgttttacctctctgggcagcagcttactcatctgtatagtgaatacaatattacctaattaattcattcaatatatacttattgagcacttactatatgttagtaactgggaaaaaagtagtgatcaacacagtcaaggaggaagcttacaacaaataggaaataaggacaaacaatactattaacatctctgatctagttttagtatgcagagtgcttctaagaatgaaatgaatgaagaacacatatgaaaatacttatgactgcatcgtgtacagagtccacgtctatgctcagtacattcgtaagtggcagcgctggaacttaaattcaagttcagtattccctccattatgccactttgtcaagattcctttgagagacttgttaaaatgcagatttcaggctgaagatcacagtttgtgagtacaacatagccatctgcaagtaattcaaaaccttcaagtactgctatgagatgagataaaagaatgttaagacaaactgtaataaaaaaagacaagacttcagtttctgtccatgaaggattaactgctatgagaattttttccttctgccataaacaactagaaaacaggacaaaatatatgaaacaacatttttcaattactgcacaagaagcagtataggactattaaaccagagaggagggagacaaatgaggtaatacctacacaactgctcaagcctattgcccaaagcagcttccaggctgctggccaggaaaggggaacccaaacaaagccaagtggtctcagtgagttgaatctggggaggctgaggcagctggaacttctgcgactgagtatcagagagtgggaactatgtgagaagagagctctgaagatctgtagaggagttctctccagtctttgaacaatgtaacagagacacataacacgtgtaattggagttccagaaggagagacagagagagaggtagactgtaattatttgaatgcaaactgattacatcatttgatggtgtagattataaaccttagagtaccactaaaaattaagaagtatggctaataagctcataggggatatagaatggagtcataaaaaacatttaattaatccaaactaaaagaagggaggaaaaagagacaaagcaagaaaaaacaaatagcagtattgtagatttaaactcaaatatactgggtagttatattacatgttaatggctgaaacactttattaataggaggcagagatagtcagatttcgtataaaaatgtgacccaactatatgctatatgttaggcaaatatgtccatatcctaatcc

SEQ ID NO: 38776 - DNA, 772 bp, Bovine  19866881003555
tgtgggctggggcggcctgaggggggcgcggcagggccgcctagccggggtgcgtggggcggatccgccgggaccgcttggtcaccgtggtgtacttgaagggcttctgcagttcggcctgtcccttggggtagcgtttcatgaagtgcacatcctgctggttctcgcgggtcttggggcccttccgcggccgccccttcttggtgaagcccacgtaccagccggagtacttggccgacatcagggctgtgtagttgttctccaggaccttctcaatgaacacacactctttgctggtgccatcaggctgcaggaagagagggaaggagcaggtgagagaggaagggcagatgcaaggggcagagctgtgttgagaaggcagggacgggggccaaggcttgagacggcaaagtagaaagggcctggccccaggcattggcctcagcagtttcactccccggatccctagagtggacttgacttggcggcccctgcatccttccctgctcaccaattaggtaccagcctcccattaccattcagggatccctttcttttccactcccacgatggagccaggggcttccacctcagctctactagaacaaaagattcagatctgaccaatcaaaatataatttcctgtgattggtgcagagcacagcacgtggcctgagtcatccaatcagcagccctcaagatcctgttataaataatccccccaaacataggccagtttaaacttgggaaaataggtaaggctgaagcaaag

SEQ ID NO: 38777 - DNA, 975 bp, Bovine  19866881012792
attggccaatggagttgggttaattggcctgttgttttggcatcgggtacagacacagttacagtcaaatcatgggccaattcagtggggaaaacatctgtcaagcttgttgttcctctagctgatctggaagccccatggagacacaactgtagtgaagatcagacgagaaatgtacgcccaaggaatggtggttagatgcactgtttccctttttacacgctgtgtcgtgtttgtggcctgacacccactcttcctgcatgacgcctcagttttgctaatccattccggatgactaactggttggttacgtggttgataggagaggccttgctaagggttgggaagtgctctagaatcagagggatgttggcttgtaccttggctcctctgctcattacttgtgtgacctttgccagccgatttccctttctgagcctcagttgcctcatctgtaacatgggagcaatacctgccctggaggtcattgtcacgaggtgtgaggaccacctaaccctcctgggttgtccatgaatgaaggagttcctgagatgtagggcttttagtttttttattaaaaaatgttttttggctgtgctgggtcttcgttgcattgtgggggctttctctagttgctgtgagcaggggctacttgttgctgctgtgtgtgggcttcttactgcagggacgtctcttgttgcggagcttgggctctaggcacgcaggctttagtagttgcggctcctgggctctggcggatgggctcagtggctgtggcccatagccttagttgccctgtggcatgtgggatcttcctggatcaaacccgtgttccctgcactggcaggcaaatttttaactgctggatcactagggaactaccaggactttcagttttaaacctgggacattcttggcaaaaccatgagctggtcacctaaggtggtgaggactaaatgggacagggcctgcagg

SEQ ID NO: 38778 - DNA, 772 bp, Bovine  19866881035857
ttgaagattattgtattgttcagaagataattttattgtttactaggaaagcaaagctattaactttctctcttatttggttcaatataatgtgttaaaacttctggagcaaccaataagaaagttaaaaacaaatttctaaataactcattgatttaacaaccagtagtacattaaaacatttaaattgaacaatacagctaccactgagttttttcaggaaatatatagggtcaaatgtttacattttaaaaagaatagaagctcaacattagtaacataagtgttcaatgacacaatcccccacacacaaaataagagaagggatagtataataagtaaagaaattatttaaaaacagaagatcagcaaggtcaaaagttttctttttgaaaaaataacgatataggcaaatttctagttgcattagtcaataaaaaaagaaagaaaagaatggctgatattagtaagataagttgtgagaatctttgccaatatatctgaaaacctagattaaggggcaaattcctcagatacatgactcattaaaagtgactcaagaaaaaaatagaaaatttaagtaatctaatgaccatagcataaattaaatcagtagtttaaaatcttcctacaatgaaatcacaggaccaaaatcctttacatcttcataagtatgctatcatcagataattcaatcttaaacttttttcatagacttttttataagcctaaacttttcttgattagaaagtcaggaaatgatggcacaatg

SEQ ID NO: 38779 - DNA, 999 bp, Bovine  19866881047931
aacagggatgcagaagcacatccttgagagccttgttgggagtagtaactgaagacatgagtaaagcctactcttgctggtcaatgccccatagatatgagctgtcatgggtgactgtggcttgcctggggctggcgtctaacaggttgctgctgctccccaagtgtcatttcacctgtccacgttcagatgcttgggtgggagcctctggggaatgctttttggaggtttgtggtggtgatggacatcggcctggtgcaagcgtgtgtgtgcatgagtgcatatgtgtgtgagagtgtacgtatttgcgtggagaggtatgtgcgtgtgtgctctgtgggctcaagtttgctctcttatgaaacatggatgctcataccacctggggctgcccttgacctgcctttgaccctggaacgacccagctcccctgaggtgttcagaaaccgtcacctgccccaggctgcctctgcagggggccggaaggagtgaagcacccccactcccttccgtccacaggcccctagcccgcagagatcctcagccgtgagggaggcacccaagactcctcccacccggcccctgagcgagtgccgaccgcgccctcaccgcttcctaccttcccgggcccgggttctggaaggtgtcccaggtcccagccacgggcccgggggctgtgggcggccgcgcctgccagcctgggctgttctgagacgaggctctgcctgcccgccggtccctgcccattgcagtcaagacaggacaacaagacaaataatttcttggatctctttatcttggacaccatttattctccctgtgccccggggcaggactgacctcatggtgggcccgagtctggcagctgcgctgtcactgggggctgggctggccggccgggctgggccgtgctgggctccggctcctccaggccagctgcctcctccctctcctgccccatcgctcgttactgcctcgtctccctcctctctcttcccc

SEQ ID NO: 38780 - DNA, 1517 bp, Bovine  19866881166023
atatgtgaaaacttaagattatttgaagagtagcctgtaacctgtaataaaaatagaacccaaaaaggccactttgataggaagactgcaaagagaattagaatagagttgctcaaagaagacttcttagaagacatattttgttctggaagctgcaagaaacatggaaagctgagaaagagaagaaaggttccaggtgatgaaaatgggttccataagaggcaaagtatgttttgttttgtttttaaagtagcaatcatatgagacagctacagagagactagccgattatagaaaaataagtactggtaagcttatgaaaggaaaaggaataagttatttaaagaagcagaaacaaacattcagggtttacagattcagaaattcagattaccatcattctataaactgttacgcagtatagaaactgaatattcctattaaaaaaacttccaagttatattgagtcaccttttaggtatggggcatgggagggcagggaatcaaaaattacagatctttgtgacagataaactatttctgattttgaaattttttagccattaaatgatggtcaggatttaatggcttccagatccttaatgctaatttaaatgccctcctgtagagattttcatttattaccaaagtatgagggaaaagaaaatctgactaaaaaaaagttcagagaccattttctagcagagtatttccactgaaaacagtatcttcagaagtcacagttacatatctcagttatcacacccccttgttttgcagttatgtttatttgtactctttgttctgacattctagcatctgttcatgggttttctttctctctgcccaaccatcatcctaatgacagcttaattaagagtccagagtaaaatcaaatctcttttgtttaagagtcaaatttttgttttgttttctctaaagctaaatatttatggaacacttatgtatgtatcagtctcttgttaggcatttttatataaatttattcctgactctacttctgtaagaaagacattattagccccttttaaagatgagaaaactgagactgataaattgccttgctttaaagtcttacagttaagaagtaaagctgggtttaaatgcaagtcttctgatattgaagaactcttttccttgcttggggaatgtgagttccattctgggtatgtcacagtaccagtaggtcatctggccagttttatgttgtccgaagttactgagagtattccttagggatctttaaatgccagtgtgctttcaggttagactccatactgcatagtgggacggatttcttacaagccactgtggttaagaattgtttttataatgtctggatcctttacatttctgttttgtggaattatcagtcctctttttttttctaatttggcattattcaggaaaaaatatgttaatctaaatgtttctatgccactggaattatgacttagctcaatttataagaagcagagttggtcagcagatctgat

SEQ ID NO: 38781 - DNA, 1802 bp, Bovine  19866881199599
atgcttctagaggagaaccaggaaagggtcttggcaagaccagttgctctaaggtattcagagactaaactggcttcgggaaaactcttatctcttaagctcggtgaacaaccaccatttacctgctgcaggacctctggattttgctgcataaaatgtaatagtctctgaccagcctgggtagcctctcggcatcgaagtgatttcttgccctcttttgctatgtgcttgaagaggtaggtgacgatgtagtctaaactggtacagcagctggaggagacgactgtatctgtgtgaacaaccaatgagaattcacttggtgactaacgtgtttgtttcatctcactctaatgcctaaattaaaaaaaaaaaaaaacaatttctggtttcaaagcacttttatcaaactataaattctttgaggatttttgctttgcttatctctttaaaccaaatatcaactacaggacttcacagagagacacattagtaagtaaatgattcctggattgcattggacagaattttccatatgtgaccttaatgaccttctgttcaatttaagtgtctttattaaatatctacatggcgcaaagtgctctgcttcaggggaaactgtaaacttggcacaaagtactttgcttcagggaaaccctcgcccttgtgtcaaagagaccatgattagacataagcactggagcacagtgctgtgtagaaatgaggagcacactgctgtgaatattttgagagagatattgcgtttggatgaggatcaaggagggtttggtggaggcagcacctgagatggactggggaaagttatttcagttaaacataaggaaggacatttttcagatggagagattagcacagtatacataatatggtgagaaggtatggattttcaagacagaatttcaacctagtttcaaattccatcttttccagctacttgctgtgtgttattgtgaaggagccaattaagctttctcatcatttgtaaaatatgttgcagagctgaatgaggagaaaaataactagaaattctcacagtaaaaataactgatatttattgagagcttactatgtttaattaacaacatgagtacctagagggtattatgctaagtgaaataagtcagacagagaaagctaaataccatgagttcacttatatgtgaaacctaaagggaaagaaaccaaatgaacaaacatgacgaaagagatacagagagccagcaggcggctgccagaggagagggcgcgggaggaacgagagaaacaggcgagggagagtaaggggcacaaactttgagtaaaaaaatgaggctcgggtacaaactgtacagtgtggggaacacagccaataatatctgggtagactgacagatggtaactagactcctcagcattttaccaccatgtaatgtttagaaatattgaatgactatgttgggcaccagacactctttacaaacaaaaacaaactcacagaagaagaaatcagatctgtggttctcagaggtggctgggcagcaggagggggaactggatgaaggtggtcaagcggtataaatgacactgctgtgtattatatataaaagttagagtatatcctatgaatacccatcacaaggatgagcattcttatatttttaactatatgtgatgataaatgtgataaatgatagatgataaatatcaaacttattcgtggtaatcattttgggatgtatataagtcaaatcattatgttatacaccttaaatgtgtacagtgtcaactatatctcaaaaaaactg

SEQ ID NO: 38782 - DNA, 923 bp, Bovine  19866881224768
atgctgttcggaataacaaatggatgcttgtctgattctgaaagccttttctaagtgtgctcccgtgctgtattattgagctgatggagactgcttttgtcatctggagtaagtcgtcttggcagtctgaccgttagtttacctgtcttttgaatgagcgtaagaattatttcttggtgggaaactgatgctgagcagatgtttacaaagccccttaggatcgcgggatagggccctcagtagaattgaggttgctgttatgtaataatttttccttctagttttgattaaaaaatgatacatgtgtatcatgtacacaagtgtgtcaggtgctaatgggacacgcaaacccaggttcccttcacactgatcagaatgcagggggctgtcccccagccaggctccctcatagcaccaggtttcacagaaaaaatgggaacaaaaatctcttaaaaaataaaaaaaaattttttttttcttaactagatttctcaccttcaggatggtgagacaggctgacttggccttgtggtagactctggtgccctctgctgtcgttcgggaaacgaaggtttcttcagggagccatctgtgcctaccacaaggaaggaagaccagctgctcttgcctggtcaaaagtttcctcctgaatttgactctaagagttgtttgcgttggaggcgaggccccccatggagcccggggtgtcttattccgtcagcctcgggtgttcactccaaagctggaactcggaaagcaaaattggacctgaaaagcaaactgaccaaacacaaggattcccagggagtaaaacagagagctaaagagttttggagggatcagtaaggggccaatatgcaccggatgacgcggccccaggctggtgtgttctgaggggttgtttattcatttaaaagttccct

SEQ ID NO: 38783 - DNA, 977 bp, Bovine  19866881390709
ggaaaaatagtgttttgtgcattcccaatcttgttcggaagacattgtggtttaagtataatgcttctgatatatagtatttaagtattagtctgactacatattaattatgtgtgtttttgatgtgagctgttttaatgtatgatgaaaattaaatatcatgctgtttgggcctggaaggataaacacatgactagcaaaatgtcgtctttgtgctgaaattaggctgtttccgatgattaggggctgctgttagtgtgagagcgtgtgtgtaaaagcccacagtcgtcagcggagagaaaagggctgtgcggttctttgtggccaggcgtgacgggtttttcttggtggcagacagctctcccagaactaagtgagcgcctgaggtgcccttcctcagccgaacagacccgccctgacccaggagtacagaagcttgggtgcacagagcctgaggcggtttgagaggcagctcactgaagccttggggggcggagaagcaggagacaggacgcggggcctggcctcagctacccaggtgctccctggctaagttctttcctcaccctaagaggccgttcctctttcagcctttctgagtgttgagaagaggaaggcctttatgtgcttgatcccccacccaggaggcgaggactccatcagcctaaattgttctgtaacaataaaacaattatagcaagagattttatgagaggggataatacagtttatagtcaggagcatctctattgctctggttttctctcgaggcttaatgttcacagtggacccagaccaaagcccgtttgagagttaggagccctgagcccttcagagctggtctggcccctcccccacagctttcttcaggcccagtttggagccagacctctgacacttgttctgtctcccaacagtatttcggtgaactgagggcaggtctgataaacagccagcctctccccaagcaggaggtc

SEQ ID NO: 38784 - DNA, 1629 bp, Bovine  19866881472071
attcttgccggaaaaatcccatggacagaggagcctggtgggctgcagtccatggggtttcaaaagagactgacatgacttggtgaaaaaaagaaaaaacagagagagaatgagggcaaagggcttaattcgacaactgatggtaaagttgcaacaaaagggagcaattaccataatcgccaaggattgagagtttcagggactcccctggtggtccagagaatcagagttcaccttccagggcagggggcgagcgttcagggatacctggtctgggagctaagatcccacatgcctcagggcccaaaagccaaaacaaaacagaagcaatactgtaacaaattcagtaaaggctttaaaaatggtccacatcagaaaatctttttgaaagaagagttttacagggattatcttatgttcctttcaagaaacctgtgaggcagttatttttgtccccacttgacagatgaggacactgaggtagcgtgtacagcccaaggtctcccagtgcatgaatgacgaaggtaagatctattctcagggccccttggctctacagcctgggaccccaaccacttccccatcacagtttctttaagggaagcccaaggtaagcgtagatcccccttcacaatcacatgtggtcatcatcttatgcaattttttttggccagagcagagctaaacccatcctcctctttccggtatcttcagaagcccctctgtctgccaaaaaccccagttcaaccaggacttccaggaagagcgaagtcacagattttacactgacacccaccagcatcgctggtggcaaaggagatgctcacccttccggccctagaaagaccacttacagggttcggggatgcctctagatcatctctacacctgtccccagggcccttctcatatccagcatcctactgcttctgaaacaaatggcttagctgtcacatcccagaattctatctctcggtccatttttgtggactcaggagcatgcagtctcaggaattcaacacccccaccccagaatttctccctcatcctccaaaccaagtcccaatttaacacacaactaatggaggtgtgccctccacactggggatctgtcccagctctgttccctgcaggtggcagctgaagtcatgtgcagaaggacccaggtgtctgagcagttttcagagcccagtcgttaattcatttgtctgcagacattatctagactccacgtctcccagacaggccacgacagagtgcattacgaggtgagcctgccttagttttccctccagcttcccctccacctttttttttttttcttcttggactcagggcccaacgtcttctggacatatttttcatttttccaaatatcaattgctcttttattccctcttcgaagcagtgagtaataagagttgtgtctggtcctgaaattccgactgaaataaattagcccaatgaccaacaggaggtgcctagaacaataactgcggaatatttggcatattacaaaagagcccctggatgttgaagtacagtaagtctagaagcacattacagagcgaagttgccaaaacgggtatgcaatgagccatccaggcagcagaacgcctcataaattaa

SEQ ID NO: 38785 - DNA, 1984 bp, Bovine  19866881533502
agagatttaaaaaaaaaacgtctgataacgacacagctcagtggaggagcctggaaatttgaattccagcaagcaccccaggtgattctgatgggcttcaaagtttgaaaactactgacataaatcactaaaactagacagtagggtagaaaagggacctagagatcactttgtttaatttactcgttttagaggtgaggaaattgaagcctggagaaatagagaaggtgatttattcgaggtaaatggccagtgagtggcagagttgagactatataccaggttgctcaacttctagttcagcactctgtccaccatatcagagtgttaagggaaaggaaagccaaacagcatgggaagcagacagagcagaaatgcaggaaggagaagatcctgaagtcatcctgcatttctgccccaggaaacagaccttttctgaattgtgagcacagttgtaagcagttagttgaaattgctaattacactttctgtagacacagaactcggaacactctggatgaccaatttgttagaagatgcagttttcaaagctacacatttaattatataaagacagccactaaagttgttctaattctgtaagctaaattaaatgctgtcctaaaacataaaatgatctagtgctgttctaacttctcgggcttcactgtaacaattctaagcctgtggtggtgtgacttcacatttcatacaaagactcccatgatataggattgcttacgagcaagtcactgtgggacaccgacagcagcattttgacaaaggcttggagtacattgtcaaagtggttgtccccatacaacttgaagacgccaaagctgacataatttccacacaaggcagatttgagagctgaatagcagatggagatgcccttgagtttcattggataaatctgatcttttgagaggctcccaagggacaggatctgagtccctgtttcagggtaaaagcagaatgagaaagtggcataagcagatgtaattcaaagcagttacgaggcacatgatcgacattttcactttattgctattgttcattttcccctactgttgttccaagagtcacaccatcatataatgaaaaatataaatacacaaggcagtttatatgggaagtacaaatggcccagtgaaaatcaatcaaaggtactggagaagtttggtatttttgtctggatggtgattacacgaatatatatgtagatacatgaaaactcattgagttgtactaaagattagtttatatactttaatatttgcattatctcttcttcaataagaagtgaaaaaaagtaggaataaataaccaactaagtcaagaaaagataacttagatacataagttactctaaattgtggggtgaattttcgcattttcacctttttcacatgaacttgatactgagctactttactttttggaggatcacaggtttggtacatgaagtaaatgaaataagacacacaagttcttggcatagtacacaataaatgttacttcccttttctccttagatcctttttcagaagacctaaagaggtggtcatttaaaaactgtacttaaattctatgtttgaccatcaaaaacaaagtaatgtttatataatcaccttacagtttttttctagttagcatttacaaccacaatttctctttctgaaatgtgtgctagtaaggcatattactagacaatatccaagaatgctttgtaaaaaattataaagtcatatatgtttcttagctctgctttttcctgttcaagtaagtaacacttctaaaattgaaactaaattcaatttacaaaatttagaggcatactgttgtggttctgtactgtgtctattgggctaaataagaattaagtttcccagaactcatttccctgtacagttgtggcctagaattgagcaaaagagaaatctatatgagattggaagggaaagtgaggtagcagctagga

SEQ ID NO: 38786 - DNA, 1019 bp, Bovine  19866881657836
acagggctggtgggttagccctttccccacatggaaggggagaggggcaccctgccagccttcctgcagcccaggagtgtcacctgctctgaggcaaggaggtggatttttaaaatttcctgtggttggcaccgccagggtccagcaagctctgggtagcatgtcagggccacagcattgcctcttccctgccctggagactgtgagggcacagtggggccccagaaggaggtgggaggggacagggaggagactttctgccctcagctggccctgatcagagatgttcttggtgtgggaaagcagggtgcaggcacgtcaggctgacacctgactgggagctacggactcgttatgtgaaggacggtttctcacagcacctaggctgtacctcacaggcagcctgagattaggaattctcagatgaagggagtgaggctcaggggcatgaagtaacctgccctcggttgcatggtaggagagtgaggcagagtgggattcacctctagcttggccactctaggacccaggcttatgaaacagcactttagaggctccgagtctgccaggttcagagagtcgctctgccttgtctttgctgtgtgctcttgggcaagttacttaaccttaacctctctgggtctcagcttttgcgtggataaaatgggaaggaaacaaccagtaaaacagttcctcctccctaaggatgtggagcagggggtagtgcagagcccagggctctgaaatcttacctgcatttcacaactttgctctggaggactccctccaccaccctgtgagtggcgtaagctccacttgcccacgtcactctagctcctggtgactggggagaaggaaggggttgattgttttctttctgagggcaggagttgtgtgatggacatctgtgtgctccctatcttgtgctgggttgcacttgcccctcactcacaggaacccgtggccaagcacttagaggagggtaatgccacgggccctgccagtgaggctgaggagag

SEQ ID NO: 38787 - DNA, 873 bp, Bovine  19866881876708
attaccattatctgattccagaatatgttcatcaccctagaaagaaaccctgtacctgtaaaatagcatcccctcattatccctggctcctgggagccactcatctactgtctatctctatggatttgcctattctagacatttaatatgagtggagtcatatatgtggcctttgtatctggcttctttcatgtaccgtgatgtttttgaggctcatctatgtttagcatatatagcactttagtcctttttttggctaatattccactgtgcggatataccacattttgtttatccatttatcagttgataagcagtaaggttgtttccaccttttggctattttgataatgctgctctgaacattcatatgttaagttttggtagggacatatgctttcagttctctagggcatatgcctaggaataaaattgctgggtcatataacaactctgtttttaactttttcagtacttaccaaactgttttccacagtcactaaatcatattatatttgcttcaccattttacattcccaccaatctagattttaaattatacaaaataataaatgaaatatcctataaataaaatatctaagagccaacatactaaaatagttactatttgtattttaatgtgacttcgccaaaggaaaaaaaattgaaattcaaaaatgagtaactttccgttgaatcaggtcgttggaaatccagtagagggaatttagctttgggtatctccctaaaacctgaagaatattgtttttatctatgcatgactgagaacttagagtgttatgttaatatttacttttcctgatgccaggaaaatagtagcctataaattgacacttcaacctctcacagtat

SEQ ID NO: 38788 - DNA, 2501 bp, Bovine  19866880152634
tcacagtaattcaagtctatgccccaaccagtaacgctgaagaagctgaagttgaacggttctatgaagacctacaagaccttttagaactaacaccccaaaaagatgtccttttcattataggggactggaatgcaaaagtagaagtcaagaaacacctggagtaacaggcaaatttggccttggaatatggaatgaagcaggacaaagactgatagagttttgccaagaaaatgcactggtcataacaaacaccctcttccaacaacacaagagaagactctatacatggacatcgccagatggtcaataccgaaatcagattgattatattctttgcaaccaaagatggggaagctctatacagtcagcaaaaacaagaccaggagctgactgtggctcagaccatgaactccttattgccaaattcagacttaaattgaagaaagtagggaaaaccactagaccattcaggtatgacctaaatcaaatcccttatgattatacagaggaagtgaggaagcattaaagcctcgaggcagacctgtgcctgataagaaactgagaattagctaggaggctgcctggttagaggaaggtacaagaaagatggtaggaaatgtggtcagagctggggtggggagggactgcagttttttgtttcatttgtaacaaatgagaagccatttgagctctgagtagaagagtgatgtgagtcaaccttttagcagggtccctatggctgtttaatgggttgaggaagtcaagagaacagagactgctgtaattaatccaacatagtaagagatgatggtggcttggatgacctggtaagcaccattaagggtagaatgtgtggttcctgaatgaatgaataattgtcccctggattttaagagcccaagcccaaatcagacaagtgtgcacgtaattctacaacttctttgacttaaatgcgccttgggtcaatctcactgaaaaactgacaacaatctctaaggtctatttccccgagtttacatttcaagtgcctatttatggatacgtgaactgaaaatctaagtatcttgctactatggagatgcagtattttaaaaccaacgtcagaaacttccaggatgtatttggcccctaagtttaacacccacaattgaagaaccgttctggaaatctgtgacaaccgcctcaaggagggtgagaacccacagatattgtggtttaaaaaaaagagaacttgaaagttctatttctgaggcatttactatggtttcagtttatctatcaagactacagaccctattcttgaattgtgaagggaggaatttactcacaaattaatcagatagctggagcaataataaaatagccagcatttactgagcatgtcctttgtgccaggtgatgtcctaagccctttcacgtgtactaacttatttcttatcaaaaaccttaatgtttggtgctgtaagtaaacacccattttacagataaggaaacagattataaaccagatgtatttttctaaagtaagtttgatataacgttcattaatataagccattaaaaaaaagaaaacatgtaggaaattttacatgtcaaaactaattccctgacgtatcaagagaaaaggtaactttgtgataaagatgaaaaagaacatttggccccaagacccagattcttaatcactggatttctttcagtatggtgggtacactgttctcaaagtggttctgtcacttgcattagagtatcacacccaaccattccctaggaacatgtatttcaacaagctcttcaggaggttaaaaatcactggcatagtataaaaacaatgaatctggaggaaaaaaaccatggcaccaagtcaaggttttaatatcctaagcagccctgagctaatcactttaaaagctttagatttctcatttgtcacatgaagagtctggactagatagtgctatgaaactctctagatccacaacagttaaactgtgaataaagaagaggtgtgaacattaagtttattattagctgaattagatacaaaaccctgaaattcctacttaccctgtgcaccgtggatgcaagtgcttgaagaacagccactttatccctaagaatgagaatcacaagttaaccctcatcagggcttctcatacttacaacgttaacaagtgactctactctcagaatggactggccattaacaaagatcacgtcttaagtaaagccagttctgatctctagaataatatcactagaatagtaagttagaaaatgagaaaactgttcagttatttttaccaaaggtgcttagtacatgttcctactatgctttgctaccctccctggcctggtctctataaccatcaccccaggctagcaatttccatcctcagcctcataaaactttcttaaccctgaatctttcatcctatccattttcctctgcattcttactgcagctttctgtaatattcctgccttattatctaaat

SEQ ID NO: 38789 - DNA, 1572 bp, Bovine  19866880511254
ccagccttggacctccctgtctggtccccaaggggcccccaggggacttgctcacccgattcctctcggactcgccagcattgtctagatcccgctgggtggctttccgcgtgttcacatttctgaaagctgatgctttgctgttcttcttcctgatggcttccatcagaattttaaagaatctaaaattagaagaaagccccgcagccccgttcagtaccagcatctccactcttccttcactgcggggataaggtgctctaaggacttcgcccacttgaggtgatgctggggactgattcaggagacagagaccttgcctctccagtcggctcacttttttcccctcttgctacttttgggctgagggggcacatacggtgcatcagaaaggcagggctgaaagtgtgctccaccattcgcagggggcacagcctggatcaccaccaatggtctcctgggccattcccagggggcatggcctcaatcaccaccgatgatctcctgaactttacttctcttgtctggaaagtgtgggtgtcatgcaatcttgctttagggatcagaaacacccccacgtccaccaaaacctgtcatggggcctggcaggctggctgctcaataagtgacagttgttggtgccgtgcggggccagctaaccagtacagcagggccttcagtaggaggggcacccaggctggggccagggctgcccccagcccacctaccgcatctccaggaagtgcttggggctgacaacttctgtctccttggtgtgggagccctggcaatttgatgagagagctaagatgtggaagagcttatcagagtctccaaggcagtgataacgtactttgtgggagtaaagcacgtcgacagactgtggtggtggttgtttagttgctcagtcctgcccaactcgtttgagaccccatggactgtagtgcaccaggctcctctgtcgatagccaggcaagaatactggagtgggttgccatttccttcaccagaggatcttcccgacccatgggttcgattggcagctaaagtctttaccattgagccagcagggaagcccattgacaggttagaaccaaaggaagttaaaaggactaacgcgaggcagaaagagcccagcaggccttccccggcccctcctcctgggttatctattcgtcgcccaccttgtctcctgtcccctgctcctgtcttcatatatcctcttgctggtcttctgagtcaggctataacagcacaccaaatggactgcttttaattatacaaactatcagttcctcatctgcccagccagccagcctgtgttctctgagcatctgtgaggtgccggccacgtgccagcccagggggcaaagccaggatgaaacgacaggcactcagcaccttaactggcggagtgagacggtcacgtgtttactattttgttcagtaaaagcaacagactgctacttctccctcccaatttccaactccccccccaccgcctcaagtttttaaagctgtacatggttttggctgaggtttctgcctttggaaggctccttacccactgat

SEQ ID NO: 38790 - DNA, 2061 bp, Bovine  19866880522033
ccacctagctctgattttggctcttgaagatctctagcatcagggtcaggaaggcagtgttggcatttggaagagttccccgcaataggagtgtcagatttggggcttaattttctccccaataaatggtggagctgaattccattttcctgttacagcaaacgtttcctgaatcccttttagtgtgctaggtctgcggtgggtataaggatgagtcaggcactcaggaagtttgttgagattgctgacatctttctcagctttaagattctttctagatgcaaataggaaggactgtctcagccttgagtagaccagacaggctcccaggctcccttccctgggtgggaccggcctgtcaccaggtggcgccacagtctgtcagggacacccgtgcttggttactcagcctttttgcttgggtttctttggttttgcttaagttttctgatctgcctgtgtaaatgtgctttaaaaaaaaatgctcaatatattagagatatctgccatctgcaggtcctggtctactttcaaagagatggccataggattgccacctccagtgaccaaagctaaagatttcatgttgatgtctcttgaaagtagggtagcctttgtccaagaaaaaagctaaatcttggcagaaatgagcagcatcctctcagattcctgaggtcattgctgcctgaagtcacagtgccctcttttccatctgatcaatagcaagagttctttcttcccatacttgctccacggcggccctctcatgaatcatgaatgcctgggtgtgaataggcatgcgccattccaggcactgaggatgtgccagtgagactggtctcacccatttcacaagtaggcgtgtggccctacttgtcagctgatgccttcacaagtgagttagtctgacaggggtgctgtcatcacacaggggaccctgggaggctccttcagccagaatagaaaccacacctgtcttctctataactgagaagtcttctgttcctcaggattgaggacaggcccactttatcaccagtgctttccatgacattctcacttactggatcccccttccatcagcgctgaccggtttcttctctcttctaacccactgggtcgagggaccatttgtctctctcctgtgtcatacgtacccagcccaagggggccagtccaggtgaccagacagtcggtcaataggtgatgctctagggcagcttaccgcctcatatgttgtcgatgcacacggacaacatcgatttatgagcacttgggccacaaatctgtcaagttcaaaagacataaaggccaacttcagagttcgtcatttgtcagagctcaagtgaaaaagaaaagtggaaccaggcctgaccttcttgagggctttccatcacgcccgtttttcttggttgtgtcttggcaggaaaaagactcctggatggctatggaccgatcttttttgagtcagcttccaggccagtccctcacagacagactttacaacatttggattcgccttcagagccacgttaatattgtgtttgatagcgagatggacaaattaatgatggaaaagtaccccggcattagacaggtgagcagttggatccctattgctagccgaaggggtgtttgtcttaaggaagaaaatagtaaccatacttgtttttttcccttgacaatgactttttattttaaccaattggcactactgtagttttggtttactttttattttattattttttagtgtaaaatatgaaagatttatttcaactgtataaaatgaaagaggagtaaaagaagatattaataaaagatggtcctcactgaagaagtgattgaaactaaaattgcagaccaaaaaacccaaacgtaataaagatgtgcatagtattgggttggccaaaaagtttgggtttatccatcctttttcgccaacccgttaccattatacaggcttgtgaataatagaagtgtcatctttcatgctcatgctcagtcgctaagttgtgctcacaattaaataaggcatatatatgttctagagcttccctg

SEQ ID NO: 38791 - DNA, 981 bp, Bovine  19866880642749
cgcctggacagcctgcgcaaggacaaggagcagcagaaagactcgcctgtgttctgccgcttctttcacttcaggaggtgaggcctgtgggggaaacctgaggtactctgagccctttaatgtgcttttctccttcctcttctatcaacagtaagtctaaaactgggaaaagctagagatgatacttccgatctgtagatttaggagtctcgatcttattacatggtatttcctactcatactccttttcagttttttttttaaagcaagaagcttgaaaatacaaacttctgattttagaaataacaaatacagaaaaattctgaaggttctaaaaaaccaccacacaaatgactactgttaacttttcagccatcttagtgtttatgtggttatagaatatattcaagcatacctacttgttgtgtaaatactttgaatcttactttccccaatatgtactttcccagtacgtaataggaaccacttgatcgtgttgacttgttaaaaaaattatttatttttatttttggttctactaggtcttcattgctgcatgcgggctttctctagtcacagcgagcaggagctactctttgttgtggtgcacgggcttctccttgcgctggcctcttgttgcagagcacaggctctaaggcttaagactcagtagttgcagcaagtgggctcagcagttgtgactcatggactttagttgttccgaggcacctggaatcttcccagatgagagatcacacctgcatcccttgcattggcaggcaggttcctatctgctgtgccactagggaaatccggtcatacttttttcagcaaatacttttgaataactatgaaagaacccagaataatgatgtttgaaaatggacttaacctattcccttgttggtattcagattattgggtattttttgccactaaatacagagatgatcatctgttgtccatctctctgattattta

SEQ ID NO: 38792 - DNA, 1093 bp, Bovine  19866880707006
aaatgacagctgtgggtgggcacttgcttagtacagtttgacatgtgtcttgaaggcgcagtgtaactcaccttatttttttaatgtattttatttgcttatttattttcattattgttttttaatattgcatttttatttgtttatttttttcactgcaccatgtggcatgtgggattttggttccctgaccagggatggaacctgcaccccttgcagtgaaagtgcagagtcttaaccactggatcaccaggcaatttccttcattagtttttatgaagacacatgtgatcttactctccctattgtcctatattctgggttttttgtaaaaatttttgtggtcacccttccatgctcttaatgtataggtttaaatgatcttttgatttatttcaaacacagggttctttctgaattacctttttttgggactggaagatgttggcatggagtccaggttcaaccccagtatgttctttctggatttcttggtggtaccaccctcaaggtaataccctttcattggctttatttcacctgaaaaaggtttatggaataattgaataatgacctctgggagagaaaggaagggtcaaaggttctgaaaaatagagcagcagttccactcccaggtggcaggtggtgggactattttcctcttcatttttcctgagtgcaggaggaatgtgggtttcttttggagcttggggcgtgtgaatagggatgggtaagcggctgagggaaatgtgcactgattccacatgtcctcctgcaggtatcgccctgtcaaccgccttggggaccagatgttcaccaacgggcagacggtgaacttgcaggctgtcatgaaggacgtggttctgatccgaaagcttctggcactgatggcccaagaacaggagctgccaagtgaggtggcagcacccactacagaagaggtcaggatctgatgccttagttctagcttcctatgctgtgggtgcagaatgctatgggaatgctatgggtcctgggagatactggttggcaattctgcatggttgtgtgtgagccatgggtttgggaggaccgggcaatgtctgggggaaag

SEQ ID NO: 38793 - DNA, 1216 bp, Bovine  19866880758440
ttctatacatcagtgtctcttttgctgtctcgtatacagggttattgttaccatctttctaaattccatatatatgcgttagtatactatattggtgtttttctttctggctcacttcactctgtataataggctccagtttcatccacctcattagaactgactcaaatgcattctttttaatggctgagtaatactccattgtgtatatgtaccacagctttcatatccattcatctgatgatggacatctaggttgcttccatgtcctggctattataaacagtgctgtgatgaacattggggtacctgtgtctctttcaattctggtttccttggtgtgtatgcccagcagtgggattactgaatcataaggcagttctattcccagttttttaaggaatctccatataatggtttttaaaagttgaatttgttgctaatgttttagtcaggctatttcacatgaaaatgaggacttctggcctatcttgggtaaccaaaagactgggcgatctcagggtcatgttcctggctgattaacaagaagctgcaggccagtggcaacacccgcctcggacagggcattctcgctgcctttgtctctcctgcacgtccctggccctgagccatggcgttgctgttctgtgagtcgtgggatctgagtcagaaggtatgatccttccttttcaaagcttgctagttaatttgagagcaaggggtgtgtgtagcaggtaagcaaagacacgaaatgctgtatgaacacagaggactatgatgtcattttgggagctgaacctaaggaccagcctcagagaaaaaaatcagcagctgtttgaggaggggcggccttgggagaggggacagggctgggggagttcaaaccgaagtcttcattctcctctcctagccagtgatggtgtcaggggtgcaccacaagctgaacactgaactctggaaacccgagtccttcaggagggagtttggaaaccaggaagttgacctcgttaactgcagaaccaatgaaatcatcacaggagcaacagtaggagacttctgggatggctttgaagatgttccgagtacgtattacagaccctttaaggggctgagggtgtgaagtggggttgggggtgcacacatgagcagcaggagccgactgtccttcagtgggagcagcagtattttctgtgagtctggagtttaaaattcctat

SEQ ID NO: 38794 - DNA, 1552 bp, Bovine  19866880809833
aataggaacacacacacacacttgactcatactgtttgcaatagttaggtcaccacacacactgaatttgttaatactgaaccattcttaggggaaagatggggttaggtttcttgaagcctctggtcacaagagacatcaaccaatcacaatacataaccttgtttttatgtgtttctgttggaaaaaaccccacttcacagtttttaatatatataactgcatttatttgcatgcaaagtcgctttagtcatgtccaactttgtgcaaccctatagactgcagcccatcaggctcctctgcctcccattctccaggcaagaatactggagtgagttgccatgccctcctccaggggatcttcctgacccagggatcgaacccaagactcctgaggctcttgcactgcagatggaatctttacccctgagccagcggggaaactgtattactgcattactaactttgaactcacagctaccatacctcatagctgaatgaagcttacataacacatgttctaagactcacgtagaaacagaacagaccacttcagcactaccccagggggccattttaaacattgaattaaccaacaacgtagtactaaacagactttgaaaaggacacttgtttacagtagaagagatgaaacaagaaggcagaatggcaccttaatcaaacctcagctgggaacaggtgtcagacaactcaaaattttcaccactctgcacatgtctgtgaatgaccataaaagcaccaaaatactaattggggggttacaaatatatttcagcaagtaagcaagtccccaaacatagaatccttaaataatgaggactgatatatatgcatacagatacatgtatatatgagtaacagttaatcttttaaaaaccattttcgtatcacctattttaaaaattatttcgtattacacacaaaagccgtcaacagtagtacctttgtccttccaaccccaataaacagtaccgacccaatggctaacattgagcattaatgtctactatctgctcataagatgggtccttttttctgctagatatctgatctggaacaatcaacgtcaatatgttagttctcacattaaaggagtttatacttctatttttagggcttaatattggttctaaagttttacctgtataggctttaaaaggtctttagaaagaaatactctttgttgatctcctaaaaagcgaacagatgttatggaccccaaaccagctttgtccagtagagatttgtacatctgaaacaaaagaaaatgttttggcatcataactgctattagtatcattgtgaaaatggggactggcaatgttccatacaaagattaaaccattcatttgttttacttactactagtatctcaataataactatttatgcgaccaaaacaagagcacacaatttttatccagaatcaatcatataaacccgatacacatttgagagtcatgttaacatataggtctgggtttacagatgtatggcttggcccaaatttatacagaattctgttttaagt

SEQ ID NO: 38795 - DNA, 714 bp, Bovine  19866880827060
tgaacaacaaaaaaggtgtgtgtacatatacacatgcacacatttttaaaaattgtatacaactgtgaaaagcagtaatggtgagagtgaatggtgttgggggaaatttagttttattgcacacttttgtgtattgtttcttattttccttttaatttttttaacatatgaatgcttctttaccaactccattaattgaagaattttgtttatcttgctcatcattataagaacaatacctgctctgataagggcattcaataaatatttacttgaagaacaactttagaagaagttgacttgaaatgtcccagtgaatatccttgcacctgcttctctgctgataaggtttaagactgtggtcagaccttttccatctctcccttgagactaggcaacttacctggaaaagtcccaattcctggagtacttaccaacaaaggaagatgtcggtgaatgtctctgctgtggtgaatagtgcaaatataatccagtacatcatccatttgacctgttgaaagagaaagcaataaagctagcagaaaaggtcaaggatgaatggttgccagcttcaagagaacaggctccaacagcagatgttgagatgggtccaggcagcctggcctaccactggtcaccccttctcctattcttccccaggttggtcccgttccactccagaccctggggatgcaagcaaataggccatttcca

SEQ ID NO: 38796 - DNA, 1473 bp, Bovine  19866880916831
cagttgcagcacgtggtttcagtagttgtggcttgcaggctccagagcgtaggtttggtagttgtggcacatgggcttcattgctctgtggcatgtggaatcttcctaggctggggtcgaactcctgtcacgtgcatcaccaggcggattcttaatccctggactaccagggaagcctcatatctggttattttattgtgggttgagaagggaagtaagagagcaggagtgggagcagcatatttcacagatacagatttgaatagactgatcagggtctaatttcaccttaggcgtttttcatgttcttgttaatcaagtctgctttccttcaattctgtttgtctaggtatgtgtggagtttgatggagaatcttggaggaagagaagatggatagacgtctacagcctcctaaggagagctttcttagtggaacataacttggttttggctgaacgaaagtctcctgaaatttctgagcgaattgttcagtggcctgcaatagtaagtaaaacttgggcttattgaacccctgagaagttctttcatccattatgaacaaaacagggaaaatctatatgtaatatctatagttggccttctggaaaataatagtacagagatatgatgttgcagaagattcagaaaaagccccaggatctcctgtcagccctgttaggaggcctgcaattctggacccttgactttcatgggttttcagtttcctcacttgaagagtagggagtgagggtaatatggggaacttctaggtcaaggattggaaaccagccgataaataccgacatacagatctttttagtttgccccttacagtgttttaaaaaaatctaaattagctgtctacctaaaaaaatgtagagaatattcttaaaaatctagattcccagtgcttactgaaagaacagtaagatatggccacactaaagcctgtagcaacaggcttttagcaacagtaggctgaagctgaatagtaggtgttgcctggctcctgtcagggtttccacttttggtctcatgatctttaaggttcccccagctcatatttctttgactttaaagacactagcagtcagtatatgatagtgccatttccgcaccagaagtctggtgcagttaaaggcaaagagtgagctctgtatctggtgaggacagttaatgctgtttgagaggtgaactgggacagatttgggtagttgaaaggccaagaggatgattaaaaggctggccagcttgtgaaggacctgcatggtgtgtgaaccaaattgagattttgcccatggatgagacgagccccggaagggttttgagtgatgtagggttttgtttaaagttgtattttgcttttcgtattttttcctccatctattaagaatttgctaaaaacatggcccatttccccagaaaaataaacttaaaacagaattctgcataaattgggccaagccatacat

SEQ ID NO: 38797 - DNA, 821 bp, Bovine  19866880986778
cccattaggttaaagtacaccgagcgtaagcgagggattcctccgccagggccattctttccatttgttgcctcacggatgcaaaaaagtcccgagaaatcggttatcaactttaggacccagaggaaaattactgtggtgcacagataagactagatggcgaaccctagggctgtaagtgcctattggattgcttgtcaactgcgtagggtgtcgaccgaagataggttttccacttggcggaagaatctcacaggaaaggggtgagggcggtgcagagtcagcgggggagggaagggactggaacgtgcggtttgaagcgtactcagctagagggaggagcgacagtgttcgagaggctcgtgcgcaggcgcttcgcggagcagaggctggagcttgggctgctgggcgaaatggccgcgggaggcgcaggcgcacgtggtgatgatcatggaacgtctgaagtccgccattttgaaggaaaaatgaagaaaggcatggagtcactgggaaatgatattaattatatctaaagcaaaagaggccattcgtacaatacaagaagggctattttctttattttttttttaatgtaaagggagaatgagaagatattctgagtcttacaaagaaaataaagactagatcaaggtcataatgatacaagatatgaacaggaagtgactttgaaggacaaaggagttgaaaggtgattgtgtctgttccacctgaagatttttggttgaatgaagaaaaaaatgcaatgaaggaattgaagatctgttattttataaaggctggtgcttgatgtggtatcacat

SEQ ID NO: 38798 - DNA, 595 bp, Bovine  19866881014429
ggcagtcccaagtagtgcttgtgtgaattaaacgtttattgtggtaaggatggaccgggttatgctgcagcaataacccttaaatcccagtggctagagacagcaaagatttatttcttgttttatgctgcctgtttgctgtgggttggcagaggcactctgctcatggtcatcaccagaggctcaggctgactgagtattttttgtctccaggtgctattattacaacataaggcaccaggattcgctggagtatggaaagaaaatggagagtcatgtaccagctcttaagtacctctaactagaagtaacatgtgtcatttctgctcacatttcattggccaaagaagatcatatgaccaagcctgaattcaactgggtggagattttcaatctcacgaaatatctgtagtcagccccagtgaccaccatatatgttgaatgaatgaatccttaccagctttgcaaacctctacatggcctttttttgttaaagttggggtgagatgggattttttttcctattgctatcaggacagtgctaacatactcctttacctcttcacagtagaaaaatctttctctctccttctga

SEQ ID NO: 38799 - DNA, 1784 bp, Bovine  19866881032003
atgtgggttcaattcttggattgtgaagatcccctggagaaggaaatggggacccactccagtgttctggcctgagaaattctacggacagagcctggtgggctacagtctttggggttacaaagagttggacatgactttgcgactaaacgacaacgacgacaagtttggtataatcaatcacgggacagcctgacattctgtccgcttgacagaaggtagtgggaagtgcatctcaccatctatacaatgtctgacttaagtctaaccatgaggacaagtctgacaagtccagaacatctatatcacagtcaagagtttccataaagttgatgggatttccaggtggcgctagtggtaaagaacccacctgccaatgaaggaagtataagagatgcgagttcaatccctgggtcaggaaaacccctggagaagggcatggcaacccactccaatattcttgcctggagaatcccatggacagaggagcctggcaggctatagtccacagtgtctcaaagagttggacacgactgaagtgacttaacacgcacacgtgggggggactgttctaggttagtcaaagatgcaatagccagataacacgtgtgagctttaactggatccaaatagaaacaagaaaaaaataaagagtttcttaaaaactgggggttaatttgagtatggaccacatgttgggtgaaaccgtggagagacagttgattttcttaagtatggaaaagattgttgattgtatagaacagtgaatggttctcaagcaggctccacagacttctggcagacccccaaaccctttccaggggtttctgggaccctgtcagagggttcatgaggtcaaaacaattttaatgacaatacgaagacatctgcctttttcactgtgttgaatttgcactgatggtgcaaaaacaatagagggtaaaaccacagcctttgcatgaatcaaggcaatggcactaaaccttggcagtagtgattgtattcctcaccacgacccagtagggaaaaaaaaaaaaagcctgtttcatttaagaatgtcattatgatgaagcagaaatcatcaattttattaaatcttgaccttggagtagagttgttttttatattttgtgatgaaatgggaagtaagcattaagcactgttgcataccaatgtatgatccctgtcatgaggaaaagcccttgggtcattgagttatgtgctgattatccactatttttcagggaacactatcgctacttgattgactaacaaaccatggctattcatctggcaagaatgttttaggaaatgagcccatttcttcaagaaaaacaaataaggtttgttgtcaatggtaaaatttgatatttcaagcaaagactagaatttttgaaaaatttcctctcctaccatgaacttgacagtgtcctaacacttaaaaaacttttctgatgagattgatgatgaaattaatgaaagtgctttttgacactgtgtatttgtcaacatttagaagatctgcatttaacttggtgagtcaatagtttctaaatgattcatgtgtgacattacaaataatgcatggataaaagatccatgaatttaaaatatgtggaagggggcttccctggtggctcagtggcaaagaatctgcctgccaaagcaggagacatgggtgtgatcccacatgtagcagagcaactaagcccatgcaccacaactatcgagcctgtgctctagagctcggaagccacaaacaccgggcccatgcgctgccacta

SEQ ID NO: 38800 - DNA, 719 bp, Bovine  19866881059302
agagataaaccacccaattttcatgtgatgttttgatacagaccactaattccttagccctaccaaactacagtaaacatagaaaaggaaaccacaatcctggaaacagagactgtaatacaaggcccctcatataaaccctatctggaggttgcagttttcctttttagactagagggtagctgtaactgatatttttgaaatctgtcataagaattcttcccacacaaacaaaagacatccagatattaatggccagttctacatttgaaatacagattaatacgcaacaactttttctatagttaactaaaaatattatataggaatcatgcattaaggttaaaatatatcacacacaaaaatacagtaaatttgacatgaaagtagcattatttctcagtaaattcatattctagatctaggagaaaaagggctcttcagttatgataaagaaatggcagatattcatcagtatggcagaagcaggaaggtgacatttccctagtttcctctgcatctatgtgtggatatacattacctatacattctcaatcatgtactctaagtcacaatgtaaaatgtatttcaaaatggtttgaaagcaactgatctagagaaataaaaatgaataaaaaaagattctaatatccatagaagtaaacaggctgcatcatatattaaactcctttctaccatgtacacctcgctacctacat

SEQ ID NO: 38801 - DNA, 1429 bp, Bovine  19866881116674
tgaaggaagaaagcatggactcacatccttctttctactttctgttttagtttctctactctcttctactctgactctgttcatctttattgaggggggcagggagtggaggagagtataaacagtaagacaaatacatacctttcctgtagaggaattcaagagatttcggaggaaacccgaactgttgttgcttacaggtgtcaaaattgtgctgttaaaggtgtggaggactgtgctggatttgcacaagggggggaggggtggaaggcatttgatttcattctttaaaattggcatcgctggttgcttttctaaaaaggaaaccaaaaacatccagatggaaaagcattctgaaaggcagagcccttactagtcttctattaacagaattactatggaaccaggaaacttaagaggataaatactaatgatattattgattttggtaaggatttccaactgctatttacatatattatacatagtatatatatataaacattcaatacccaaagtgatactatggtaaactgtactttttatttgttcctggtatggaaaatacaactgatttttgtaaataacattgtaactatcaaccttgatagtatttataaatacagattctcttagaatttcacatgcgtaattagattgtccacaaatatcaacagttttctctctttatttccaatcctaacatctttttgttcacttcactgcaatagccaggacttccagtacaatgtttaatgaaagtctgaagacaggaatcctcgtctcatgcctgaacacagagggaacagcttaaaaattattcaactgattaaaaaattcagtaataatttgacatgtttgctgtcaatttatcgtagaaactcattacattaaggatattcccttctgttcctaagtttttttgttttaaatataagcagattttgaattttactctttttctgtatctcctcacatgacttttccccactttttaaatgttaaaactgcagctgcacttctcaagccctattgggtcaccccgtgttaagtcctttatttactgtactgaattctattcagtgagatgtttaatatctctgcgtgaaagaaactgatctgcaatttttctttcttgtaaaacagccagaaagcagaatcacctaaattctaaatacctgatttccaaacccatgcgctttatactacaatcaagcatcctgagacaacagcatggatgagaaaaataaagttgaagacagagtgttcccatttagacagaacaggaaatatatacaaggtagagatagaaaggcaaaaattactattgaaactaataattctcagcccaccctattcttgccaaacagaagctcaacaatgacttctatcaccagcaaaagttctctctgggcttgcaactgtgtca

SEQ ID NO: 38802 - DNA, 1425 bp, Bovine  19866881150631
gaggaggcactggactcaacaggggagtcacgctcatactcgtggctaacatttgttacagcaaaaaggtacaagacaaacagccagggagaaaagcacacggggcattgtctagaggaaaccaagagaaagctgcagagagttctctcccagtggagtcacacagggcatacttaattcctctggcatcaaacactaacaagtatgaagtgttgtggcattccccgactcagtggtagagaatccacatgccaatacagaagacacaagttcaatctcagggtcaggaagatcccctggagaaggaagtggcaactcactccagtattcttgcctgggaaatcctgtggacagaggagcctggccagatacagcccatggggtcgcaaagagtcggatacagtgactaaacaacaacagcgtgaagtgtttatctccgagggaagctcgtttggagacatagtcttctggtgtttactgggtactgtcatgtaggcaccctctgtctagcagataccaaaatccagactcccagaagaaaagcagttcagcacaaaccacattttacagtttaggcacagcaagccattcttaaccagttagagtggtaggaaccctcctgaagtccagattcccagatgcccaccagagaccaaccttgcaagccagcctgaggctgctaatgcttagaaagacctgcttgcagggtgggcccttggctggcatctgggaactcgaagttccagagagttcctcccaccctgactggtagggatggctcactgaggcttacaggtggggatatgtaaactgttttctgccatgttcaccgtttcttcatattatccaaaaaagtttgtttttcttctttatgtagaacataaagcaattagacttctcttcttatgaaatttagtaatagaatattgtgagaatgatttggacactttaagtgaattgaataagtgagtttattcacttagacatattttcttaaaaatgccttggcagtattattcaatttagttattacataagtgatttatgtcatagtaaaattttaaaatgtattccaaatgatgcaaaaattaagctagctttcttactgttcatttgaaaaatatcccctctggctgttactgatttttcttcacatctaccttttcatcttctagagggccagtgtgataacttgccatctttgggtttgcttttgtgaatagccagtcttctttctttctttttttataggtcaagatgctgagttatcagggacactttcacttgtcttgacacagtgctgtaagagaataaaggatactgttcagaagttggcctctgaccacaaagacatccacagcagcgtttctcgggttggaaaagccattgataaggtatggagttgtctggagtgtttggtgtgtt

SEQ ID NO: 38803 - DNA, 1248 bp, Bovine  19866881234182
ggggtttgggatcacaagcatttcatttactaaatgcacttgtctaaagttggtcatcgcctcttcactcccaatgcaagggccctggtttcaatccctgctcagtaaactagatcctatatgctgcatctaggagttcatgtgctgcaactaaagaccccatgtgccacaaccaagacccaacagagccaaagaaataaaagtaaataaaaataaagttggtcctcaaggacagagaggtcagagtgtataggacatttgatttggcgtgtggcagcctatggaaatacgccacccatagctactgacagagccttaaaaatacatcaatacggttgctactcagtgactggaagggcactgtgtaccctccacacattttcaggactccactcttacagcaacatatactctctattcgtctcctgatactgccttggcattggacaaccctgttagctcagatggtaaagaatctgcctgcaatgcagaaaacctgggttcgatccctaggtcgggaagatttcctggagaagggaatggctaccccctccagtattcttgcctggagaattctatggacagaccgtggagttgcaaagagttggacatgattgagtgactaacacttcaaacagtgctgtggctgtggctgtaatttatccttcctacacaggcctcaggaagcttgcaccggatcctcccacctgctgagactcacatctgagggggtgggaagaactaagtgagcaggcattctggctctttactcctgccaagcaccgcaagtgtttaacaggattgcactcccttccatatgttcacacagacatttattcacacacatttttaaggttttatatgcactctcctcctgatccctgaaaaatattataaacagatgttctgaaaggtgtctcaatgcccagtgctttaaaatttccctaaatttgaaatgacaaatagaaagtactgtttccttccttcccccagtttgtccttgcttatttcggtaagatttcctaccttagagagcttcctggcttacaactgttcctcatacaccaggtagacagtttgatgaaatgctttgggcaagaaagtcacaatccaattcctaggaggaatgttgacctaataaaaacaagatataccttgttttatacaacagatggactctcaaaattttagctataaactgacctttgggaaactgaattccttcccataccttatataataaatttt

SEQ ID NO: 38804 - DNA, 776 bp, Bovine  19866881303366
gggctgaagaccccacccggaagaatctaagaccctctgctccaaatgctcctgcttaacagaccatgctgactccaggagctgcctggggccctgacctgaactgccaagttggaagccggtgaagatcatggaacagcctcaaggtcagacctaccttgggaacaaggtactgctgatcggtgcaggccaggacgtaggcctcggcccggcccagttcactctggggaaagtgggcgttcatctcatctccatcgaagtcggcgttgtaggccttgcagttggcatagtggagccgcaggactttctcctcggggaggacgcgggcgcgatgcgcctggatggagggcctgtgcagggtgggctgccggttcaggaggagaatgtccccgttcttcacatgccggcacacctgcgggcagagcagaggacgggctgagcagtggccactctggcatcactgctataatgccaagggctcacctcgccctgggcttctgtctctctcatgttttactcaataaaaggggaactttcagtccagagtgaaaccctagaaatctatgagaaataactactaagcccctcggggactcagagtgtgtgtgcgtgctcagttactatgtcgtgtccaacccttttgtgaccccatagactgcagccctccagactcctctgtccattggattttctaggcaaggatactggagtgggttgcatttccttctgcgggggatcttcccagggaccaaacccaggtctcttggcaatggccg

SEQ ID NO: 38805 - DNA, 1106 bp, Bovine  19866881313827
gatttgcgcttgaaccttgaatgctctgaactaaggaattatatatcccttagtgttacttcatatcaggaagtttttgctcagatcttttgtctgcagtgttctagatttttttttttctagattattttgatatatatgtgtgctgtaggagagaaagaatactttgttcataagcactgcaattctaaccttaaatgtttttttcatttatattgaagtatagttgaattacaatgttgcgttattctactatacagaaaagtgattcagtttatatatatacacccattctttttcatattctttttcattgtggtttatcataggatattaaatatagttccctgtgctacacagaaggaccttggtatttatcagttctgtatttaccagtttatatctgctaatcccagactcccagttcagctgtctcccacccatctctgccttggcaaccaccagtctctctgtgtctctgattctgtttccacagacaggttcatttgtgtcatatagagatcccacatataagtgattagaaatgcaagcttattttgcaaattcattgtcttcttctaggtttgatgatctgatggccaacattccactgcctgagtacacaaggagagacggcaaactaaacttggcctcacggctgccaaactactttgttaggccagatctgggtcccaagatgtataatgcttatggtaagaaagaaatggttaacttgaaaagattattacagaagtaaaacacattaaaatatttgtaacattggttttgggggagggagagaagatgtctgtaatcctaccctttaacgtagcagtggtcttcattattgcatatttcctttcatcccttggccacgtgtatgtatatttccctttcttaattgcagttgtagggcgtaggccattttttaataaaaattttctcttatacttaatattatacaagaaaagttttacatgttgctcagtggtttttatgatgattgcatcatcatttttgatggttgcatggtacctcatttaatgaaggtcagtttattcattgttttaatgttgctggacatttaggtcagtctgctggaattt

SEQ ID NO: 38806 - DNA, 748 bp, Bovine  19866881815538
tcaaaaacaaaagccccattcccatatcccactcaacacctaaatgagggccaagaagacacatgagaatattccttcccagggtgagggaagactccttcgtggggacagaccccctcacctttgaccatgggtacaaatacattaaacaattcatttacccacaattttaaaagaaggattctaaatataggtacctgttgttgaagctgaagtatctcccttttgtttttgaggttgtgaggcaggctgcttagattctttcattacctctgatacactagagattttcagtggaccagactgaatcttggaaatgaaaaacatttaacgtttcagacataaatagtgttttttaaaaaggcagcatacagtaacttgtattatttaaaaagtagtaaaaagcttgggagttatcaataattcataacaatgtattttattaaccacagtaagagaacccatcatactaggaaaatgcagtccaaaagtagtccatattttaatagtaacaaaaacttctcctaaggtaactaatgtacttgatatatgaccttccttttaaataaccattacttttatgtgtacaacactgagaaggctatttccattcactttctaaatccaattatggtgtcttctaaatacattcagttagaaacaaacattttttaaaaagctctcagtaaaaataaaaattcatttttcctttctttaatctccaagattcacgcacctgcacttccaa

SEQ ID NO: 38807 - DNA, 2428 bp, Bovine  19866880099397
attttatttttaaactttacataattgtattagttttgccaatatcaaaatgaatccgccacaggtatacatgtgttccccgtcccgaaccctcctccctcctccctccccataccatccctctgggccgtcccagtgcaccagccccaagcatccagcatcgtgcatcaaacctggactggcaactcgtttcctacatgatattttacatgtttcattgccattctcccaaatcttcccaccctctccctctcccacagagtccataagactgttccatacatcagcgtcacttttgctgtctcatacacagggttattgttaccatctttctaaattccatatatatgcgttagtatactgtatttatgtttttccttctggcttacttcactctgtataataggctccagtttcatccacctcattagaactgattcaaatgtattctttttaatggctgagtaatactccattgtgtatatgtaccacagctttcttatccattcatctgctgatgaatttgtcttttttattttaattaacccttagtactggagtctggacaaatattaaccagtattcctagctgtggtattatagacaatatatccttgtgctttaatgagaactctaagcattagtaagaaattatgtaataaaaatctgttaaatgtttattgtatatgcaacagatatataaaatgaattggcataatgaaaatttttcttgttgacatgagacacattgctgtaaataatcatctttgtcttggattgcaatacagaaatacacacacacacacacacatatataggacctatctgtgcttaggtgtgctttctctattttgttttcctggccttcttgtcaagatgtcattgattacatcacaccactgagaatataactgactttagcagttctttccctgattctaatctgctctgaagcagaagcagagtattagtttggctgagattcagagccaaactgagtattgtattaagtgagggtcaaaagtctttgaaaatgggctagaggccttatttacggagaaaagaataaaagccttaatttcatcaattttctatacttttatacttaccactgtagtttagactcttcaagtttggtagttagataaaatactactacagaccagacttacaggcttccctggtagctcagctggtaaagaatctgcctgcaatgcaggagacctgggttcgattcttgggtcaggaagatcccttagagaagggataggctacccactccagtattcttgggcttccttggtgactcagctggtaaagaatctgcccacaatgtaggagacctgggtttgatccctgggttgggaagatccactggagaagaaaatggctatccactccaatatactggcctggagtggagtcgcaaagagtcagacatgactgagcgacttttcacaaacttaaacatgtagcccagatctctgtgttccacactaatggaaggaactgtattttatttagccttctctttctagctcctagcaaagttcatggcatatgatagggattcattgaatattaacttgaacaaaagtactgattatctattcccttttcatatcccacatgcatttgaaactcaggaggtgcaatggcaccccactccagtactcttgtctggaaaatcccatggatggaggagcctggtaggctgcagtccatggggtcatgaagagtcacacccgactgagcgacttctctttcacttttcactttcatgcattggagaaggaaatggcaacccactccggtgttcttgtctggagaatcccagggatggcagagcctggtgggcttccatctatggggttgcacagagtcagacacgactaaagcgacttagcagcagcagcagcagcagtgagaaatttagtcacacttctcaggtcacacaacttgttgcaacagagcaaggactctcctgtgttcctgacttcagggcccaggaggggtgacctggagccaaacctgtgtccatcatttacctgggtggatctgtggcatttggctggtgcaagagtgttccctctctcgcgtttcttgtgcatgttgagttctggttggagagacaggagttccttctgcagtgagggtatagacaggtgggggcttcccaggtggcactcgtggtggagaacctacctgctgatgcaggagaggtaagagatgcaggttctatccctgggtcaggaagatcccctggaagaggccatggaaacccgctcgagaatcccatggaccgaggagcctggtgggctatagttcaaagggtcacaaagagtaggacaacactgaagcaacttagcatgaacgcacataaacagatggagttccttgatgtccccttcaagttgactcccaaggg

SEQ ID NO: 38808 - DNA, 1147 bp, Bovine  19866880339597
ctgcaaaataataataaaaaatcccatatgaattgaaatgggatacaagagctcaacagatgtagctgtatctctcatatgaaaataaacggaatgttttccttaatcaatcagaatgaataatgttgatgggcctggcagtgactaaatcagggctgccagctcccgctacccagcgtgattttgtctttccaaccagactaaaaaatgctctccctccttcatactggacgacttcatttccactcattcaatttaacaaaactcacccggaattctgaaagcttcgcctgtctcataaaatgtttaccagatatctcttacagggtggcagatgtgctaccatgtttcataagaagaagaactcaagtggccaagtccactggactgaggagcataaacaatcacactggtgggaggttgtttattgttggtcatgctacaaggtcacgtttttcagcacttttgtttaaaactccatctaaacaactgcctgctgtagaacattgtggacaactggaaggctgccttttgtttaaatcagctttgagagtatgattgagttggtgacaccccttaactttctatttttagcaggagttcaaatacatttgttttttcgttttgatgtatatttctacaattattaccataacaacccagtgtaagcacattaccaaaaaaggaggcactgaccttctttaccaatcttcctgtttgccacatagttaacttggtaaaaccttcagagaataagaggtaagtgaataataaatctaatttgttaagcatttgtttgtgtctttgttattatatggatttaaatatattctagtttgaaataatttacatatattagattatttattactctagtggtattctatgaacaataacattatgaattatatattttatataattgttattatataaatatctattattattcacaattccattttcaagatgaagaaaactaaggcacagagatttcacttccttaaccaaagtcacactgcttgtaagtggtggagagagattccatcctcacccaaacctgtttacaggactcatgtacctgatctctaccctagttttgtgcagattcactttttccttgatcttcttaagtattcttttctcc

SEQ ID NO: 38809 - DNA, 1357 bp, Bovine  19866880410026
acctccagcaaaagcaaatgaattgattccactaatttgtgccctctatttttacttaagatggaaactttgattaagaaagatttccatttctcatattcccacctggatggataagaggggatctgaataatatgtcttattcagaatttgataatagctaattgcttgggatattaagttcctgcttatatattatttaaaagaacatatatctttgataggttttattttgtttaatctctgaaacactgctgacttttaactgtctttgccccaatagacagtaaagaacacaaagaatgttgctgatggatactatatcatatttaaagtctatatataagaccattacttgctgacaaaggtccgtctagtcaaagctatggtttttccagtagtcatgtatggatatgagagttggactataaagaaagctgagcgcctaagaattgatgcttttgaactgtggtgttggagaagactcttgagagtcccttggactgcaaggagatccatccagtgaatcctaaaggaaatcagtcctgaatattaatgggaaggactgatgctgaagctgaagctccaatactttggccacctgatgcgaagaactgactcatttgaaaagaccctgatgctgggaaagattgaaggcaggaggaaaaggggatgacagaggaatgttggatggcatcactgactcaatggacatgagtgagtaaactctgggagttgatgttggacagggaagcctggcatgctacagtccatggggttgcaaagagtcagacatgactgagcaactgaactgataagaccattgttagtttttcccttcactctggaagaattcaattcataaatacaagaacccattttggactttacagtttatccagacactgtttcgtttttctgaaatatctgtatattgtcatggtgttgggtacatggggttagcttgagaatgatctatttgaatttataatttgggttctcaattttttattcttaaaatttttattttatattggagcatagtggattaacaatgttgtattagtttcaggtataacagcaaagtgattcatttatatatatatatacatgtatctattctttttcaaatgcttttcctatttaggttaatacagaatattgagcacagtttcctgtgctacacactaggtccttgttggttatctattttaaatacagtactgtgactatgtcatccccaaactccaaatttatctccgtttcccacctttcccctttggtaaccatacatttattttctaacgctgtgaatctatttctgtttttttttttttaagttttttttaaattttat

SEQ ID NO: 38810 - DNA, 1250 bp, Bovine  19866880498708
gatatggatgacttggtcatcccctctttgggccaggaaaagaactccactgacttccagccatgattctagtaataatcctagtatctctttgccctgtacccccactccttcacatggaaaaagaacagattgccctgatcactaagttgggatgaagaaccaaaatgtttaacttttaaatttctcatcctcttttgaattgagaaatgtgagaatgcatattaccctgctgttcaccatgagttgaaactaactctttctgcagaaaggacctatgattttctagctatgcttctgacctgaaagtaattcttggataaaataataagtatcatatgtcagtacattctctagtccagtttttaacagtaaaatagctgatatttttatttttatctgtctgacgtgtagtacttatatttcaattggttctaacctcagaagaaggagtataacttactacaccagacccaaatacaagctttcacaagtggtctaataaatgaataaatatagctagctagcaaaattagatagcctaatgtagttaatgactagtggatatactatgtaaatattgttttaaagtatacctaagacgttaacaaaagggatcacatagcagggcacaaagcaaataacaaggaattttaaacaaaaaatttgaaatttttggtaacacaataaaattaaatgtcaatactaaaggaaaaccatgatccctacagcaaaccttatctaaggacataaaacaagacctaaataaacagatgtatcaagttcatagatgagaaaatttgtttatattgtgtctctttcactatattctgacattccattatgatgtcctttggtgtgggtctattggatattggatgcactgtgttgggctgtcagtgaaacctacaaactcatgtccatcttgggaaatgtttttgaattctttattgatgatttcctgtttaccatattctcaatgtctgggtgtcccattatttaagtgttggatttctggaaagtgtcctctggttttctcttctagtttctatcattttactcttctaggggattacttaagcttaattttttttcttgaggttttcattcttgtattcagagtttagatttactaaacttgatatttttcctctatatctcccctttgtttttgtttgagacttctcagactttattaagacactaattacagtattttttcaaagtacctgtagtctctaatacaaatt

SEQ ID NO: 38811 - DNA, 1709 bp, Bovine  19866880517698
tactgtcatttaacacagtacaattaaactgaggtcctctgacatatttttagatatatcacttttgaagttttaagtgatctataaaataacgtaaacataccgtgtgccccagcctcctgtctaaagactgcaagattatttcatttgtgtgtttatcattcattgcaagttattttagtgaactgatgagagaagaatccaggtggacttaagaggtaaatgacggaagcacgtggagggcatgaatgttttggaacattctgaatgtagagacgtttgggaggattacatcacctcacaatacagggcattatttatagtcctgccataatactgtgttccacgagatgatgtaacctacccaacacttttcttagggttgtcagtttacaaaatgtagcaattattccaatattcgtgtagtgggtggattttttattttcattcatcataatcacttgaattatattagcttcatgattttgttagtattagttgactatttgatttcatagttacagagggtctgtgaggaggaggctttatacacgggctaataacagtactaatttacattacactataatgaaaatctcttaggtcaaccttggtgatctatagggtgtgcttgcttttaaaatggattcttgcattcttaaagaaggagaaagagtgatttaaattgttctgcagaagacttggctaatgccatcagaggtttagggagtttatagtagatggattacagctgggagagggtggaccaggcaggcatgttagatcatcagagcagccagggctccggtgatgagaatatgaattatgagcagcagagggaagacagtgggaagggtgccgaaggactcccactggtcagtttcgggaactggtaaataacagaaatgaaggagtggctaggggaaaatgggggaaatattttgttttataaaataaggtaaatcaagcaagaggaacaataaaaacatccttcttccacccagaaaatttaagtgaaattagtattgtgcaaagaaaacagttcaaagataaaactgaattacataaattttgcaaaggagcacagaacagattagaggacaaaatgacataaatggaaatccaaacaatatataacagccaccagaggaaagggaattaatgaaccctcaaaaattaggctcgtgaagtgtggagtaaagtagatgaaaattataaattttcttaaagcaaagccattcatcatgatggactcctaggcaagttttaaattctacatggtatcaataatcagtaaaatatgcaaaacctacagttcatttttaatttacattttagatcagccattatatctatactttgaattctatgtgagaaaactgcaattatgttagataacaagagaaacatcattttgttattttttttggctaatgcattttgttaacattaatccatctggaagggaaggtttcacgtattctctagggagatgaatgacctggatttataaattgcggaccccagattgtggctggtttctttatatattacttaagaatatatctagtaagtggcaataattttgagcaaaaagacaccacagaagactatgattgcataaatttctgtcctatggtgatataagtcatggttgtgtttacctttggggttggtattgcttggctacagtgtggacaatattcgct

SEQ ID NO: 38812 - DNA, 1319 bp, Bovine  19866880559956
cttcagttctagttgttatgcacttgtgaaacactagaaaccaaatataaatcaaatgttataaagcagctccaagctccatgacagcacaagaagctacagaaaaaaacggcagggaagttctgcttctcctcccctcaaacataagcaagcatttctttgcttactacttgttatgcttatcgtgttaaagctataagtttaggaaaggaaatatgtgactataaatactaggcacattgtaaagcctcaataggtatttttattagatatattgtatcttacattttatgtaatatttgatcatatgctgttttccttttcaagtgtattcacaattgcatttgattgactagagggattttccatttaattgctgttttcctcttccaaattccccaactgaatcactgacttgactgtatcctataaaaagggtgacacaagtactgctttgactgccatactcttttcatcttctttcaccaatgactaagttttctaattacattttctattttgattaaaaggagacatatagaaagcaaccatagaaagaaaacttccagttgaagtaataaggaacccatttcccaatttgggaggaaataaaacttttttaaatttaagaaatcaagtagaaatacagaaaatattataaagtattataatcatttctcaaaattccataaattctcttatggtttattcattcacttattagcaatcattgatttatatcatccattcatttaaaattacttttcatagtttttcacatttcctaatcatttggaattggtagttttatactttcactaagttgtataaagttcccttttgctcttttacaaaaatttactaaaacagtaagttaaatagcttcagaaagaagccaacatttgagcaatttatacactcaaaaatgcaggattagaaaagcttgaagtttttcctctggaaaccatttagtcttataaaactgtgggtgtgctaagttccgaagcatctttctgcacaatgatttgatacatattagaaatgcatattcactaatgcaaaggcacaggacatagtcttaagttcaaataattttcttttacttgctaaatcaaattaatacccaagttttgtttttcaaaaatgcttggggctagagcactgggatgacccagagggatggtatggggagggaggagggaggtgggttcaggatggggaacacatgtatacctgtggcggattcattttgatatttggcaaaactaatacaattatgtaaagtttaaaaataaaataaaatttaaaaaaaaagagca

SEQ ID NO: 38813 - DNA, 1597 bp, Bovine  19866880581892
tggatacttcccgtgtactcccatcaggacacacaatgccagcctttcctaatttagactcactactttaataataacctaatttgttattttttccatcccttgtgacaacaatacaaatgacaattgtacctacttgatggaattgttgtgaagatctgaaacatctaagtgcttagaacattggcaaatagaatatgcgagaactgtgggataattcccatgggcagaataccatgagtgaccattgctctgaacgtaagagtggctgttctttgaccattgcaaccatttggccacgagatggggtgttatcacctctgtttgtacttattttcaggaatattacacattatattgatcttatttctcttttctataatttgagtaatgattttctctttacctataacaattaataagccaaaaatacaatgagaataaattgttcaattttatgtggaaaggattcaagacttaaaatttacatcattacaatggataaagtaatttcactctcccatttccaagcaaaagccatacaaaatttaatttaacatgtcatgaccaaggccacacactttgtggaatttaattgcaaaaatcactctctaatgctgacaaaatgaccaagctcttcccttagatttttttcagagatttttttttcccccagacttctttatagcatttattttggggataataaaggacattgagaataagaagccatgggcaggttgctgattttgttgacatcagtatggagcagtctcattagattaataagctgccatgtaaaactcaccgcataggtattttccccatagtcttcttattgattctgagccagacgcatgttgcttacagcctgatgaatttaagaatagatctaatgactgcttaatgtagccttgcaaacagctttcaaaagtcattaggcctgcaaaccaatagggtttgcacccttgagacatcattccacagacaaatagttttcagtttgacttttctctcttaattcattgctgatctgtatgtaattcattaggcctgtacaagtttggttctgatgaaaggaactctaaacttgagactgaaatctctatttgccatatggttctgccaccttagagctctgacctggacgggtgatttaatttcttgggcctcagtttcctctagtatagaaactgatctaaatcagttgttttcaacacgtaatgtcagggctcacagcatcagtaccacctgggaacttgttagaaattcagattcttggtccccataccagacacagtggatcagtactctgggaatgtgaccaggatagctgtgatttaacaggcactccaactgattctgattcataataaagtttgagaaccacaattgtaggtcagggatcagcaaatattttctctacaggtttagatggtaatattttaagctctgtgggaagcaaaatcaaggatattattcaggtatctattttaaaagagaaaaaataaatttttcttgacgtaatttaaaacagtaatagtaatagctaagacaattttttgttgtatgtgtctactaagaaaataatagaacc

SEQ ID NO: 38814 - DNA, 2034 bp, Bovine  19866880662447
tttggggagatctttcagaggccagagttctcttcaattctagagacttctggaggcaggaggccttgcagtagctctgcagggcttgaaacaatgctggtaagatttggttgaaaagaatatgctccactttatgtcccatttctccatgatccttggagagggcaaattaaaccttcctcgccttcttcacatggatttacagttctagtgacagtgtgttaggaggagcactgggttagtagagaggcagtggttgtgagttttcaggatgttaaaccctaagaagaagctggggtgtatattcatgatagggctagttcctgcactctaggagagtgaggtatttacttgtgtcatactttgggtgaaggtggtattcacatcaccagtagagagactatctcagcattagcacacacaaagccccatagatcctgctccactagcataaaaatatcttaattttccctctccctcctgcctgatcccaaacacagaaggcatcagtagctgagggaggagggtagagagaccactttcctctcctctactgcaagcaataagaagcacagctcaagaggaataagatgtacaattggaattaagttcatatagaagtctttaacattaacaggattttgtcttaaatttagaacagaaaatgtactctaaaccaaattatcaatggaaatttatggaagttggcaaagatgtcatcgagattcctactacaaagagtgaaaaggatgcatgacaatgtacaaatgaaagggaggattaatgaaaaatatcaagtgaattcatgttcatatacaacatttggaaacttctcactaaattggttccattatatttgtggttaattacttgcaatttagcaataaagacatgaaaactatgtcaatcagtcaatcaaaattttccaacaaaatagtcttatgatacatcacttaggagaatagttgaaacagtactacctgtgtttagtttgatactgaatatattttggcttgaaatgaatcaatccaaaatcattttgttctacacaatgaagtcttcaccagaaaacaatatttttatgtataatgtgttcttatagagcatctctctagaaaatgatccaagagttcagccaacagaaatttgaccccgtacctttgactggactggaggaaatatgtcaataaaggtcacagatctggggactaggggtaaatcagaaatgatcctgaattaatagaaaggaacttaatgaagaaaggtgtgtgagaactattaagagagtttgagctttagtagcaggtcaaaaataaggcttcatcccaattcatccatccttttcagagaggtatctaagcaccaaaatgccttagaaaatccttcctgaagtgcaaactatccagaccatcccaagacaggagaataagagttaagatgatgatcaactagtgggatcttctggcattttttgagaaatacaagttaatccttacctttgagttctttttgtaaacaatgtttataaatgataaaccatgctggcagggtagggataaatttcaggatgctagtccagaaaccacttttagtaattgtccaatagtgccaaagaatcaaatgactatttcttgattataggatagtatacatgtatcaatgaaataaaatgacagaatctaacattattatacaccacctgtgggtcaaaaagtctatgtgcctaatctgaaatgtcaagagaaacatgaatttgatagtactgaattcattcttctttaaggagactaaagtttagcattgacattgaatagcacttaatgctatttcacttagagtgggacattagaagcgggattcaatctgaaatgcttattctagtgattcacctctttgcagtgtataaagtattttagcaaggagtcactgtttcagagagagtgatgtgttatgaaaagaagaaaaagtcacttattactgccaaaataagcaataacaatgcttaagagaatacagcttggtcttgcatgtggt

SEQ ID NO: 38815 - DNA, 1627 bp, Bovine  19866880706787
caaataagagtaaataagtgatgtaagacactatggaaagtgacttataagaagcacgggtatacctgtggcggattcatttcgatgttgggtaaaactaatacaatattgtaaagtttaaaaataaaataaaattaaaaaaaataaaaaataaaatcaatacacctaaaaaaaaataaaaaaaagaaacagcatatgtcagagggagaaataacaatatagttgtttctcttggtctttgaaaaaaagtttatataaggcatagatatttcgtgttgccatcttgactgactagttacataagtgaatataaagttatatagataaattctgtgaagaattcccttgccagaaagcctgactccatacagtacttgagtctttgtgtcttgtgggacacaggagttgaccaagttagagtagaattttgtagtttgttttttcttttttttttttttcgctttctcaaagagccctggtttggatcattgatttttagtacttttttgttatctgcatttctcctaagtgttcttacccaaacgtagcttcactcaagtaacttatagttacatcccctgaatgtttgtttgccacctgcagacctttgtgcttttctgactgcatgtcagacccacttggtaattgtgtttcaggtaagggtgaggtgaggaaggaggaagctcttctgtgtccacagtcatacattccagtgacaggaaaagagaccctgaagagaaagtgataaaaccatttgactacagttacagaagtctgttgataataccataaaatatattttaaatacttgatgaggttaatggatattcccatatttctaaaaaatgtggacatttgtcaaatactcattagacactaaccagtgatgtaaactgtacatcacatgaagatgtgaaatatctttggtattatacattgattttcttattgagcaaatctcgcatgaaaattctgaactcagttctttaaatattctgagcaaatcacaaaactaaattcctttaaaaatgtacataatatatattttctaaaatgttaacatttgtgtagctaacattcctggacctgtattatgcatacttgtaattcatagtcttgtgttctttatttgatttaagaaagagctattttagctccattggcttatgggtcatttgtacatattactgctgcatgtttaaatgtaccgccttcaaaagtgtttatgtttgctgtggtctccccagggaacttgggagctgacctctcattttgatgtacactgtagtttccagggcacccatagaaactatttagaacccaattccctggagccccaggactttgagacaaatgcttgacccctgctttgtctgtgaacaatattgaagcccctttctgtacagtgaaatgccagggtgactgcatctaccgtggttcaccaaaagtgacattttggagagaaataaaacatgttgtgcgggcatgtttggcttcacatttaaaccaagtttagaatgggagcaacttgtcactttgagcaaaaatattttcccagggatcatgatagatggacagtctgtttctaaccttactcttttatgattgtaccttacttgttacctcc

SEQ ID NO: 38816 - DNA, 1984 bp, Bovine  19866880716098
atttttatggtttatgtaaataaagctagattgagggaatttcattgcaaaggtgaaaaccagaatgacatttatgaagatataactctcataaccatctggcatacacaagggtgtcatactaaatgggatcagaatgagctccttttggaagtaaacctttaataactgtggaaactttaggggaatctatcctagaatgttttaatggagtacttgagaatgagttgtgcacagctggccaatgaagagactctagattggttaccaaagccaggttttaaatggatttgcaatcctccacagttctttgaaaaaggcaatgaaaatggtgatgaattaacaaacaaaaatcttttctaatcagaaagccctttcattagcaatgcattatgattgacattgtcctttttccttccttcctttcctttcttttttattttgtgttgtctttctatgacatcagtcttatgcagataaatgattaaaggacaatgattaaaacacaaaacatttgaatgctacaagccttgtaggcctgccagaaacgcactgaagctatataaaaaaaaatggtagggaaaaatctaagctaatgatgcaaattgctaattttttgtatatcatataaaaatgacccggtcttcctgtcagagcagataactaaggcactggtacttacagttcttttccttatgattgaaccaggtgagggaacattttggtagaataaggggggaaaaaacactcacttgctgaccctgtaaaatgaatccctatctatatcattaactagaaagtgcctgtaaaactaccttatgatatggtagagtgtggtgagcagaagccagatttaccagatgatattgatttgtcttgaatttatctaaatcagtccatctatgcttgggaatgctttcacttattttccccagaagcagtagatattcagttttggtctgtccttgattttggaagttcagttgctgggctctggaatgtcaagaagatgatatgggataactaggcaactagctaagcatgttctcaacagtaaatcacttgcacctttacttgccgtgaacctctacatggaagaggcagttttctgaagtaattcaggacacaagtaactgcacatttggggcaaatttgcttatatgtctgggcttctttggtagctcagtaggtaaataacctgcctcagtacagaacataggagaccctatgttcgatccctgggtctggaagatcccctggaaaaggaaatggcaacccacttcagtattcttgcctggaaaatcccatggacagaggagcctggagggctacagtccgtgggattgcaaaagtcggacacaacttagctactaaaccaccaccaccactgtattactttggtgaatatataaatactccccatgcatataaagacctagttaaagggatgcaggcttccaacctacaaagaaaatgacttcacaatgataaaccataccactaacaatataaatttattctgaacctcatgaatataaaataatacaattatttatctgataattcttatttagaatgcatttaatgcattcatagatgaacctgaatcagccagaaactgagatgatattttctgtcctataatattggtgggtgacaatatgtccatgtgacttgtgtgtgcatatgtgtgttggtgaacatgcagtgattaaggaaattaataaattagctttgaagtaagaggtggcatcaagaaagtaatttccatatgtttaaaaatttttagtagttgccgtacattatgtctccacaatgaaatgtttgacttgagaattttgcatttgcacatctagttattccattggaacgtgttatgggcttttaatctacttataacctccaattctcttctccctttcttctcctgcttcagggtccttttatgttactcacccttcaagtatgcttggttcttctccta

SEQ ID NO: 38817 - DNA, 1462 bp, Bovine  19866880746460
ttaaattgcctaagatgattttaaaatgatgggagcaatgaaagttaattataatttaagtgaccctaaattctaaggatagaaaagaacttcctgctgtttttatttagaatcaatcaactttgaaaacaaaaatgatgaattatattattattactgttaaggaaaggatgctgaacctgcacaggatgctgaagctgaaagtccaatactctggccatctgatgcgaactgactcactgcaaaagaccctgaggctgggcaagacttgcaggcaggaggagaaggggacgagagaggatgagatggtcagagggcatctctgacttgatggacatgagtttgagcaagctccaggagttggtgatagacagggaagcctggcgtgctgcagtccgtagggtcacaaagagtcagacatgactgactgcctgagctgaactgaaggagggaaggagcaagggcttcttggtgggtcactgttgaccaaggagtgtaacagcagttctccccgaaggctcggctgtgtctcacccccaaattaggagctgtgtcttctatacaagaatggccaaggataccctttcctaggagacatggtctctcttcctctggcttcttctctgggaaaatagggaatatatctaacaaatagaattactttaaaataaaaagttaaatacttggttactgaaatcaaacattttagagggagtttaaatgaaaagtccttcaccttctgatttctactctctctgggccaggaaaacaacactaaaaatattttagtgtttctgataattttcataaaaatgaactcacacacatctttttaaaaatttgcatacaaaggattaaaatatacacggaaactgcttgtttgatggatgaatgaactgaatagtgaatgaagagtcagtcttctgcaaaaaattatttcacttctgacttacatcaggacctggtgtttgtatatcctcagtaagaattgagtttcaggaacttggagagatacatggagctaattcctccatccctggcagtctcctttagtcaacaaggaaaggagacataactgggacaaaagttactgtgaaatttcccttggagcaggaacttgcaccatctcagcatacccacccattgcattgctcaacacatctcttatttccaaatggtgatttatgtttttgctgagctgctaagtactcaatcagccttccaacaactccattagttttccatctgactaattaggaaaaattggcttgaggcatggatgtgtgagaaaaaggaaagagctttttttctacaacttaatagtctcataactggttctcttttgtaaatagggaaattaataacatcaaagcctcttctactccagaacaattattcaggaggcaatttgtctagctggagtgaaggcccctcactgaggcatctccacaatttatatcct

SEQ ID NO: 38818 - DNA, 2797 bp, Bovine  19866880816815
tgtttttcctctttttcttaattctctaatttctttctttgcctcaaatcacattacttgcttattattttgttaaaagtgaaatgggaataataaccatcgtacaattgcatcgtgtattaatttgttaattttgctgagcaattgagggaccaaagcactaactgttatggttgtctgccgaatgaagttgtctccaacaaagcatagagaaggagatgccgagttacagtaaattcaacatgatgctgctattagcttaaatgccttagctaaatggtagcaactgagatcattaactttgctttcatagctattttcttaatgttacttagcaacttcactttgaaaatacccatttcacatccctgtagcctaaggagtatcattagtagtgaaattgcatgtttgattgcatagccagagaagagttaatggtatatcctgaagatctatcaccagctacactgagacagctcagacagcatgcatcgaatgcataggccccagaaacagagcccaataaaaggataaaatttatccaccatgaattcagaatatgaaaggaatcatttctatgtgtattatgttgcagaataccaatatccatgtattattgtataatgaatccatatatcaacaagttttgtataagatcaagatgatctgaaatatgaaaatctaaaatgtaccaaatattcctgctctgaaaaaaatgtatgaatatttcttactataacctagggataatgttgcctttaacaaatgtaaatgcatttggtaatatgaatacttgtctagggtgatgacttcttaagaaatcagcacaatataacaactatagaaatgcaaaagtaatcaaaaggttacagttaaaccaattatttattctttcttccaattttatgtattttttcaattgtttataattagtatgtatagttttttttttttttgagagataagcaatcatattttctcccagaaaagtattttaatccaattagtactcagtagctacagacaagcactcaatatgacaagcactaataattattcaattacaaagacagagttttaactagccttatcatctataaatatgatgcttttatattttgaggtacaaaggcattttctgttcaatctctcttaccagagtcattcgtttttcctaagagaagtaaaaaagcaaaactacttaactactgttaataagttaactcttcttccatgacttcatccagtaatctctggttttctgttaattgtgtggcacctctcccactggtctccttttttgctcacttttctttaaatatagatattctctaagatttacttcctgtcttttgcttacacactatttgctttcactgtcacatttgtatagctgatacttaaatcagtattcatcttttcacccacccatccatctatccaaatatttattcattcaacatgtattgagtgctactgtgtgtcagataagtaaagcaagtggtgggaattcaaaatgatgaagaaacagcccctgatttgagggataaacgaatgttggaaatttttatctgtatgtagactgacatccggcaaagttcaacatctaaaattaagcctttgcttgctgctgctgctgctgctaagtcgcttcagtgtgtccgactctgtgcgaccccatagacagcagcccaccaggctcccccggtcctggaattctccaggcaagaacactggagtgggttgccatttccttctccattgcatgaaagtgaaaagtgaaagtgaagtcgctcagtcgtgtctgactcttagcgcttaacccaaactgtatctccagccaccattatctgtttctgttcatgattattttcagtttctggtctcctgaccctgtcctccccatgatgcccaccaaaatcaatctccactgctgcctacagttctctgttacttcacatcaggggcactttggtttgctaaatatccttatttgtgaaagattttaaaactttattttggtaaaatcacgatgagacaaacatttaaatatatacagtgtcttctatatctaatgcacacctctcaagtaatagtattagctggcatttctgaaatttaatggtgagtttctatatgtcacgcactagactaagagctgttcattcttatttccaaaacaaaaacacaatagccttatgacaaggattctctttttatcacctgtttagaggcaagaaaacagttgattaaggtcataaagctaaggaatagctgctgctgctgctaaatcgctcagttgtgtctgactctgtgcgaccccatagatggcagctcaccaggctcccctgtccctgggattctccaggcaagaacactggaatgggtaaggaatagctatccaggtttaaaaacaggaggttagatttcaaagtctattttcttaacttatctcctatagtccctataagactaaattatctttgtttttcttctgttagttatgcccctgattctaaaaaatatacttttcttttttttaaactgtagacaatggctattggctcctctgtaggaaagaagacagttcaactcattttccttaaattccagtatttttcctttccaaatagatatttttagataatttgtattttatttagatctttattttagtttctcaaaaaaagcatattattcagtaatattctatacattgccttttcacctgaaaaacatcttgctaacatactacgtctgcacatttcatttcagttcagtgctcagtcatgtccag

SEQ ID NO: 38819 - DNA, 1471 bp, Bovine  19866880936591
aagatttccaatcacccttactcatgcttctctctgggcctattagataccattatcagttgattatacagggtttttcattagctacactagactagtgaacattttgatctcatataggagggcatgaatattgatttagtaaaatgttcattgatgttgggaagaaatgtcctataggagaccttccctgttctgatctctgatggtcagtcacaatgatgtgagaatcactaaactgaaaatcctgtattttttaattcttcagattaaatagagggactttttaaatagcctagattggattgttcaagctccaagagctaaaccagttgtagagagaggtaccacaagtgaggagttggatgacttaatgacaccttcccaacaaaagagcaaaatctatcaatattttctggtgccatttagcaaagaagttaggaaggctaggccaaagacaataataaaactgggagattttctcaaacctcgggctgctttattttgtgtttgattttgcccctatgcctagtttcctattggggttaaagttgatgctgtatggcatcttaaaagaaactgagaagaagctggaatattggctcttcaaagaaagaaaagagtgaatgcagaattcagcttagaaagaatgtgtcatacaagaaaataattataagaaagaaaaggtgctagaagcatacttcatttctgcttaaatgtaactggaaaagatcattccttttaggagttaaagccagttttttaaaatatgcttggaataataccaaccaatggtagacgagttatttttaaaacaacagagaatttaggacaaaactaatatcaaattcctcttacctaaaagcaatgcacacgggcatttcatgggaaacatcgactattccgacagcaaagaatcactgacaatttggtttggaatgtttggtccatttaataacagtgagctcccttcactcaaaagaaaaacaagtgtgttggtttacatttaaagacagagctaatgtcaccataattttgagtgaattaatttgctctgctatagttataattaatgggtatgtcctgcttgtgtattttaagtgagtatctattatatgggggtaaagtttataaagaaagttgttctgccacaagagtggtgtttagccatgatgaaaagtctcaaagagagcatgactaattattaaattcatagatgcgagaagagtcactgcattcacaagtgtcatcttttcataatattaatgaatgggttgatagtaccagtctatctaaaaggtcactccagctgtgacattcctttggtaatccttccatcaatattaagacaagagtaaatgtcatgcttgtgtgtggtttacttttaaaaccatttagcaaaggccaagccattgtaattcttctagccactcaatgtagaaggaagccagggattatttttatctccctt

SEQ ID NO: 38820 - DNA, 1948 bp, Bovine  19866880993525
aatttgaatctgagacatagagagactaagtcaactatctgtggaagctggacttgtaaattcacatatttcagggatttaggtacttggtgaagtcaggtcagattttgtctcattagagaagaataacgactgggcttccctggcagcccagttggtaaagaatcctcctgcaatgtggaagaccctggttggattcctgggttgggaagatcccatggagaagggataagatatccactccagtattcttggacttccctggtggctcagatggtaatgaatctgccaggagacctggcttggatccctgggttggggagatcctctagaggagggcatggcaattacttcagtattcttgcctggaaaatccccatggacagaggagcctggcgggcggcagttcacggggtcacggagtccaacagggctgagcaactgagcacacgtgcacacaaagactaacagccttccatttcctgtttctctcaggagacctggaagcacttcctgcccttgagctttgcaagataccctgaccctttcaacacattctctttctgctcaagctagttgcagagagtttctggtttttgaaatcaaaccattcctaagttatagaactataaatttaagtgaaaagcaacccggaagaaagaaagccagtactacgcagaacagctgcaaaagatttagtggtccttactgatgacacaggtcaagttcaatgtagctaaatcttctttcccaaactagtagctttcctgccagagaaccagtgaatctctaaatcttaatgttagttttactcttttctctattcctcctgttcagtcaacaagctttattattttaatttatagttggtgaaatatatatgccaagggagggaagtcatgtagctcacagccatgggtctagtttccaggacatgcagggttagatggcttaggtccaggacctgccctatagcccttcctatcacctcttcatttctatgtctataatcctatagcagaataaaacagaatgaaaaattctgtataacagacacattgagaaaatctgtccttaaatagtagcagtttggatacatttcagggttcagtctttggccttttctgtaaacatgcattaactacttgacctgatccagtcatattggctttaaatatcttctatatgctcatgactctcaaattatatttctagctctcatctttcacttggactctagagttttatttcccactgtttatttgacatttccccctggatgtttattagttatctcaaacttgacaggtaaacagccaaacctaaaaagagtttattttctcttaaactattctttcctgatgttcccatttctgaaatatggcacctccattcatcagttattcagactccaaacctgggaattatccttaactttcacattccacattcagactacaggcacagcatgtcagttctaccttcaaagtatcctctgaacctgaccactgtcccccactcggtcacttccgctgcagtccaagccactgcctctggcttctactgcccttgtattgtccatgagcaagactttgacaaaatatgtttctatactcacgaatatgatgcctgtgactttcctccatacagtatcccagtggttgccaatcacacatggaaaacaatcccgaagtctacaggccttcataatgaagctctgattacttctctgccctgatttcttgtcccaaatcatctctgattccttgcccatccacatgagcctctttgctcttcctctaacataataaaattttcttttccttgggcttttgtattgggggattcttctgcctgaatggctctcctctgtgttcaaatgtcccatctccagatagcctttgatctcctttcctaacatagtagtcccatgcccttcatctgatct

SEQ ID NO: 38821 - DNA, 2958 bp, Bovine  19866881016233
ggaagccctatcctaatggttgagcacagacaataaacacaaaacataagtttaaaaagataatgacttcatgaataaaataacataattctctacagaaacataaatatttagtagttatcagtataacatatcttaaattttggactagactagaaaagaatgtcaagaattataattttgagaaatgtcctatgtcaaacaagtcaggtggcagttgaagaataaatcaaaggataatgttttaagatgggtaatactaagacatgtttgtatgctgatgataatgaaccacatagtgggaagaatgtatgatgcaggagaaaaataggatattcacaaaagtggagatactcaaggtgataaattgcagatatgaaggccaccagattgatgactttggtggataaaatgagaggatgttttatatgattacatggattttctctaagaattagggggtacgattgtcatctgagagtggaacagaaagtagtgttagttgatggcaagttttcatgagatagtagagctggatgaataggaatactttaataagtgcaaattcaacaatgggaaatacttgactgagggtggaatgcttgagatcatgatggcagagttagttacattttggaggatgacatttcatgaatgatgatgtatggagaagaaagcagtggaagctgacaggatcaagaactaggagatcaagatgctagatggattctctctatgaatgttgatgtcttcaataattaatacagagttaaagtggaaaaacagaagctatcaattaatggattataaataaataaatgagagtttaatagatggcatcaaaaaggaaaaaatgcctgagatcaaatatttttagaggagcagggagtttggaaagggtaaaggaaatgaatggtttagaatcagcaaagaatgacaaccgcctctaggtagtaataaacataagctgtgtctcccaaaataagccacccatggacagaattctcaaagatcagctaagtagacttttgagaagagaggtgaaattataaagtacacatcttagaaaattagaaagtaaaaatgaaaatggatactagtctctagctgtgagaggaacagttttgaaaattgtgatttaaaaaattaaaatgagtagtccctgcagttgtgagattttgtccagggatcttcaagaactgggatgatgatgttgaataagatattttaaatgcgtcttgtgattaccttcaactgaccggcggtggtggtttagtcgctaagtcgtgtttgactccttgcatccccatggacttcagcccaccaggctcctctgtccatgagatttcccaggcaagaatactggagtgagtagccattcctttctctagggagtcttcccgactcagagattgaactgggtctcctgcattgccggtggattctttactgctgagccaccagggaagccctcaactgacaatatattgtctaaatactggctagatagtaagcactgtacatgagtgactaaatgtatacctaaaacacacactcttcatctttcaaacactcatgcatgcttaaataagaaatatagtagaagttgttattttctcaaacagtagcatactgtatcatacaatattatcaataaaaatcagattgatccaattcttacatctttggttaggcttatagcatgtcttgataaatgttctaggaattatcctggcaaagcagaagacaagttcctttaacagtggctggtgatgttgaaagaagaaagaaatgagattgtttctgtgactaccctagctggtaaaggggatattaacttgaggtgacaaaagcaataactctgagttacatacaaatgaatataccagtcttttaatcttaaattgctatataacatttttagacctcagttttcttatctggaaaattaggatttttggtatctactttgcagcatttttgtaagcattaaaaacagtaagagatagtatcttaatcacatttctacagtgttgcaagtcctaataaataatgcctgttgatggctttctgttgttttctgatacaggcaggagttacgtcagtgaacatttgaatgccaaagctaaaatctctatttttatcatgagtgatcagtctgtttatttcactcttctaacctatcttaatgatattagcaggttgtattctacttctaaaataaatcctgctgactcttaaaactctattttatctactgttattctttagtatttcagcagagaaagaaaacattttgtattttgctgattcatttctactcttcaagatcatagagacattgttaatattttttattcctctcaatgaaccatgaattttcaactcacagaggagaagaaaagaaacataaatgggacaggagagcagtgggatagagaggctcacttggactaacacaaagataaagagaaattggttctgtcatctcaagtagagagacttgggagactttagggacagaaatttcaagataaggcacaaagaaaaataccaggggcataatataataaccttaaagtatttttttccctgcgagttttgagggacagtggcattttaaatggattttaagtagacaaagttaaggaaagtatgaaggaatctttactgtgtattgctgatgttggcagataacaggattaagttttaaaaaatcaaatcaatatactattatcaatacattatgagttttgaagaattaatttatctaaaaaagtgttttaatgaatataatttgtatttcagtgaataggcagaaaagcattaatcatgttgaaaagtgatcagtataacttcacctttctttaacatgagaaagctgttgattattaatcctctggagtagagggaccacagttttatattccacttggtagccaaaggagaaagaaaaat

SEQ ID NO: 38822 - DNA, 1192 bp, Bovine  19866881071889
attcttttccaatgagtcaactctttgcatgaggtggccaaagtactggagtttcagctttagcatcattccttccaaagaacacccagggctgatctcctttagaatggtgtataggttaattttatttaaacgtcagagttagaattgaatttaggttgtggtaattttgcttcaaaatatagagacataattttaaaatcatataagaaattaatgtctgcttaactttcgctggtgtacttttctggcttttttatttcctctctataagcaagattagtgacctgcttgtattgcttgagaagcatcacaaatttcatttagaaagatctcctcattaatagaattcttgatgtatttattaaacacagggaacagatcatgttttatattaatgtcattaattctccaatccatatttttagttgctatttttgcaactgtaaacattaatttgcaggtacaagggctacatcactgttctattagttttgaatttttagcagaaatgagatacgattgtccattaagatacagtccaactgtgaacacaaattattctattgtgtttaataaactaccatgatgaatttttcacagtgatttgttatttgtttaaaatgccagataattaaaaaatttttcatctgaaggaaacatagctttgtatatgtcatttgctcagaatcttagatgcagaataaaattgtgtctatattactgaatgctttatatgcttattgaggacttgcatactttgttatgatcttcaagtataacagaatactccaaaggctctattttattgttgaaatgttgcaatatagatccattcatttgctactggaatgataatatccatcttttgtgttactactctttccatgagtaatacgtattctaatttttaccttaatctctgatactgtatttatcatgattttttaaattttattttatttttaaactttacataattagttttgccaaatatcaaactgaatctgatactgtatttatcatgatttttgtaaagactttcactgtgaatactggccagttttcttcaggctaccttatttaagaaaccaaatcctttaggctgtcatgatatacaatccaaggcatatggactatgactttcggaaggtcatgtctagcaagatgtaggtcctattcctcaagctaa

SEQ ID NO: 38823 - DNA, 1176 bp, Bovine  19866881077308
ttgaatataaattaatttggtttcttatcaagaggagaaaagatgtatttaatagaattcccaaagtctctttgttacttgataacacacaaaaagaaatatatgtatccaaatagtttgctcacgtggctaggaaggagttgtctaggatggcagatttatacagatctagtgtgaatcatggagaaggcaatggcaccccactccagtactcttgcctggagaatcccatggacggaggagcctggtgggctgcaatccatggggtcgaggggagtcagacatgactgagcgacttcactttcacttttcacttttcactttcatgcattggagaaggaaatggcaacccactccagtgttcttgcctggagaatcccagggcggtggagcctagtgggctgccgtctgtggggtcacacagagtcggactcaactgaagcaacttagcagcagtagcagcagcagtgtgaatcatggagaagacaatggcaccccactccagtacttttgcctggaaaatcccatggacagaggagcctagtaggctgcagtccatggggtcgcatagagttggacatgactgaatcgacttagcagcagtgtgaatcaacagaaggcacagcacatcagctcataaaaagcaatgagtaattacatacaacgcatgtcaatttgccattgtcaatttttaaaaatgaattacatttgagaacagaaattattaaagaaagcagaaaaactattatatcattgtctccatagagtctaaattatcaccaaccctacttaattattcagtatgttttaaaaatctttaaaaggaagtcaatcatgtttagctcattcactgtaattatttgtaagcagtagaaacaaagcacagactctcagttaattctgtttaaattctaagacattgttcagacctactgcaaagcataaaagacatatcagtttctcagggcttggactagggtgaaattgtataggcccctctctgtaaccacgctactcttcagataatgcatagtgctttcatcaatagaaaatggcagacccatggctttgggaatgtgatttctcttggaaatggatgataaatcacaattatgtaaactaaggaaagacataacctacctatagccttcataataatgatcatggcaagaggaa

SEQ ID NO: 38824 - DNA, 981 bp, Bovine  19866881206226
tgtagtacaaggatgtttataaatgggcttgctttcatcctaaaatttctacttttaacctttggcttgatatcttgatttctcaattccctaatatcttatcatgaattattttagaattttctggaaactctcatcacctctaattgtttgattcttaaaagctctgacctcttacctttgcagcttcttgctcaactctgccctcttcaattgccatgttgtccattgcttgtaactctaattttctatttttattttatattctgtagcttggtgttcccacccatgtttaattaatcatcagttcctattgattgctcatcagtaactgattctcccctggaacattgcaatagcctcctaactagtttctctgtacccactattggtaaatattactaataacgatgccaaatgatgccttacctatgtgagtatactgctgaagactctgccatttcttctcattgcttttatgtgaaatttctaagtcctaacaaatggaaagtttgtcaccactttgttactccagcttagttaagtattcagacatcatcttcagggaatttttttaagccaatgagtgggtttttgttatcatattgctttacacacattttttgtacttcactttcatatattacaacaattagtatatcattttctcattccatctagaacacaatatttatatattgaatattttaattaaaaatttaatagctaatatatgaaagagtatcatgttgagatatgaagttcacaacagctatttgttttctgtttcgtttaacaaggagccagtatttgtctgatttcttagttatgagataggtctgggtgggtgtctgtttctcagattgtcagaaagtagtgggggtgttgaaacaccacttagacacttactgcaaagtgatactttaccatcagttagatcaatatggtctgtgcctacatcccaggagccaaggagagcag

SEQ ID NO: 38825 - DNA, 1567 bp, Bovine  19866881232862
gaattatagccagatagacttagaaactcccacttaagtttggatttcttttctctgtcttcctttttgttttgtttactttggttatctgaataaagctgccaacaattgtgggaagacagcaccctagatccatgtgaagtttcacccttgactgagctcttccatcttcagtatccatttaaacaaaatagtactctctctaggtgtttatcattcccattgtataaatgaagaaggagggccttgggaaaatgaagtgatatatataaagttactccagttgtaattgacagaggcatctcttaaatgtgaattttctttccataccccatataacaatgtttccctaaaaagaccttagtcaagcaacataataaaatgagttggtcaaacaacataataaaaagacttggtcaagcaacacaataattccattccttccactgttgaatgctcaaatattatgtctatgcattccataataaaaaaataaaatgaagaactattctcaaaagagttgcatggagttaccagggcatgttgctgggaaataaaagatctgtcttttcaatgacagtatgtgcagcatgtttcttgttcaaatgtgaccctggaagtatagattgtgagattggaaaactcttatattttgagcatttcttaataagcaattcctcaaggctatttatgtatcagggtttgctatttcttccttttgctgcttgagctctaaattcaggaaacatatagcttaaaggaggcttaggaagggataagcaattcgaaatgattaactaaacaagataatttaatcagtatgtctctggtctcctgatagcaaataatacagagaattaacaattaacaagaaaatatagtgacctcattcatgatcagtaataatgctatctggaccacatgaggtccttgacttgactgtttacagttgctttggaattttgtctctcataaatttttttcaactctggagaatttcatttaactcttattatactgtactaagaattaaccactgtaaacggtaacgaaattacagacatcttgaaccattgctgaccctggagttgacataggaaacaagaagcaaagaataagattacagaaaacttatgttacagtgaagggcagggatttgcaaaatagataccagttctatcaagatatcagttcctcagctataattggatcttgcatatgtgtgtacatacgtagaatgcttaaatcattagttattctagtgagtgaggattctgatccaacagatgttatgcaaaatgtgactcttttagcaggtatctcacttgaaaatgtttttctaaaattcaccacacacttctgcttgtagagttttcctcctttgtcattgtaaaagataaggggtataagatgtgagggtataagggtataagatgtaatgactgaagacttcgcctttggccagtgaattcaatgaatatgccaagagcaaatcattccatccctgtctggaaacccgttgtctaaagctttattcctcatatcatctgtcactgataataaaagt

SEQ ID NO: 38826 - DNA, 2062 bp, Bovine  19866881263380
tgaggtttttctcctgtcttggatattatatataatattggtatgaacatgggggtgaagatatctccttaacacggagtttttacttcccagaaatagaatgactggatcatatgatagttttatttttaatttcttgaggaatctccatacatttttccatagcggcttcaccaatttacaaacccatacatgggtttccttttctccatacccttgccagtatttagcaatttttgcctttcagataatagccattactaacaggtgtgagatgatagttcatggtggttttgattctttatttctctagtatttagtgagtatgtttgagtatgttttcatgtacctgtgagagtaatttgaaaatatagtttaaaaaaaaataaaactggaagtctttggtttgacacttcccaaactattagaaatggaatatttttttgcccccaaacaaaacaaaattaaaactacaagaatgatggttagttttaacattagtcagcatagagaataattttttcagtgtcgaattataacaaatatcattctagcttgttctgtttaaattatatttgtgttaacaggatatttagctcattatcatatccttaagtttctaaatttttaaaatatttatatgacaattttaaagttctaccaaaaatactccattttttagataaatatatactaatgataaacttacacttgtgtgtttatggctatgtcatttagttagcaaacagtaagtgctggccatgtaataagtgctttacaaacagttcatttaatcctcacaacaaatctatgaatgaggtattattttgttaatcccatgttataattgaagaattcaaagaacagagtggttagatcatttgcccaaggtcccacagcaagtaatggagccagaatttggactcagaatatgtgtactcctaactgttctgctctaaatcacgaatattctatgaatctcatttgcttttttgtgtcaatggctcctcataatgtcttcctttaggtgctactattaaccccatttgcatatatcgcaaggaattaagacttaaaaaggcttacatgatttgctctaatctctgccctgcaatatttttaatttaaccaagtgagccttctatcttatgagacagtagaatctacttttactggctgtatagttagtatgtaatatagttatacaagtaagagatcatgaccaaccccgatcttgagtcatcttagaaggttttgtttgcactacagaaaaatgcctgccactacttttgggagcttgagaaccacaggaagttttacaaacatctaaacacctagctagaatgggcagaagacaggctaaaatcattatctgcccctgcacttccaacaaagcaaaactgaattctgtttggcaagtctagtacaccatggttctagacgtcaagaaagagaatgttaatgccattgacatctgcaagaaattggactctcctaaaatataaaaaaaaaaaaaaaaaatcaaacacattagtgttttaaaagtggatttatattgcttactgagattatgaactgataaaacagaactatcagaagcctggctctttttaaaatacagcctgtttcactgtgttctttccttcctataatctctttatgatcaaatgtagaatatttcagcctgcaatttccaatttaattcttgtcctgatttgagctattaaattggactccatttcagcaacaactgagcccctcactgtatctttggttaccaacgactgtggatagccatctgcttggatgattttcaccatatgtgtttaaagtaagacagtgttttatacatgcttgatgtaggtaatacttgaaaatcataaaagaagaggaagatcagagtaagctgtaaaattgtaagcaaaattgaaattataaaaacatatttgaaatcccaagactgagtagagtttacagcatgtattttctatcattcccaagaaaagtcaggtacaatcgaaaatagttcccaaacggaaaaaatttaatcctttatcaatta

SEQ ID NO: 38827 - DNA, 742 bp, Bovine  19866881366686
gttgacttatttgtggtgaaaattaagctgcggaattgtgccacttggcttttcttcaacaccgagtacttacttattggtcactattttatgcttcttttgccatttacctgtttgttacttgaggaaaattacactttatgcttttttactctcttctgtgaaatgccattatttcctgaaatggcttagttccacttaatagtgaagcttaataaagagctctgttttctttgtttcaaactgtcttatataaaacacaacagctgcaggacaagaacataaatgaatggtattactcagttcacagccttcaaatactgtgactcgttaaaaagcctgatgggtaaattgcctggtatctcattttcagtataaatggaagacaaaggaggtatatggcaatgtcctttcagcctagacaaaacttccacgtcacataaataagttatttttgtctttgtcaatgccgacgaggggcaactttattttaaattattatttttattatatttgaacctcccatatcaatataaattctgcctaactgaagataaggattctcctttaaaagaaatgattcaaaatttttcattatcaaattaacaaattttaagtcttttaccttaggaaaagcaaaaatgttctgatggtaatcagatctttcattatgtctctcttttgtagtctcaaacttgtaaacattgggccaaattcaagaataaaatagattaagagaagg

SEQ ID NO: 38828 - DNA, 1622 bp, Bovine  19866881424134
atcaaggtgcaggtgtattcagtgtctgaggacctatttcctagacagtcatctttttactgtgacctgacatggcataagggggaagattgtgctttgagaactctttttataaaaaccctaatctcattcatggggggtcaactctcatatgtattttcactttcagggttaggatttcataatttgaattttaggggaacacaaacattcaaaccatagctgaatcaaatgaaaagattgacctaaagtactgaccatttgcctgtaaaagaaaaactgtcaaaaagagacacctgtgatgtttctaacaattacagagtagatcagagcagcatttcccatgtagattccatggattgttgtctggaaagcatatagcacatgacttcttcaggtgtctggatctttaccatggctgaaccttttaagatattttcataagtgtctgttttcagttattaccagtgtctcagtattattcaaatgtagacatgatgttactggcaaatgaccataagtaagagacagacttttaagttttgtgtttcaagagtgatggttgtaatgctgtatttacattttcttaccctatgtctctccaactttgtgatttatatctttggcagaggtacacatcatcccagccacaaaacagactagtattaaacctgtgtctctggactaatggcctggtgctgaatgagctttccaaagcaaatgacctgccgcagtattattacatgttctcttaaacaaattagaggatcttatttcaaataggaaatggctgatttattttaaacgaaaatattttataatactttcaaatttcaaacatgatattaggtaaatgaaagtgaatatttcagtattacaatatagcagggggaaagtgattatgtaaattatgtacatactgataggatagaaatctgcatattggaatatctacttcccttgtattttttatagtatcatcataatacaataaaattagtgccctattgcattaaaagcacatacttattagtgaaatggccagaaaaaaataatctctcactcagggaagtattagcatgagatattttgtctaagtgtgtatatcacttgaacttcctttgaactctctgcacttcttgctatttatgacaaagaaagtcattgctcacaaactattgggtttgcctttgaagcagcaccaggagatcagtgacaaaaggcagagctgagattagatgccgagggttattgtcttgctttggtcccaaagctatgtgaaatgtcagctaattgaaaatggtaattatcctacacaacaacctaaatggtttcattctaagctatgtgttgcctttaaattaatagtcattgatcttctggtttttcacaattctttcctgtccttttgtcaaattatccagctatcagtccttggaacaaaacctatctcaccatttttattgaccatggtttaatgagtgacctgaccttcctgtttggatagactgtaataggtccatccatctgaggatctgtcagccagtgccgtgtaaccttttactgtatatttggtttcttggtagaaaggttttaaaatgaaaacttcaaataattgtttt

SEQ ID NO: 38829 - DNA, 755 bp, Bovine  19866881426582
ttattttcatgaataatattggtatttttatcagggatgatagcactggctgctgctgctgctaagtggcttcagtcgtgtccgactgtgtgcgaccccatgacggcagcccaccaggctcccccatccctgggattctccaggcaagaacactggagtgggttgccatttccttctccaatgcatgaaagtgaaaagtgaaagtgaagtcgctcagtcgtgtccgaccctcagcgaccccatggactgcagcctgccaggctcctccatccatgggattttccaggcaagagtactggagtggggtgccatgccttctccaataacactggctagttccctataattttgttgagctgtcccttgggctaatagaatttcttcttaaaaaataacgtacaaaacatttaaagtttgaaatactaaattaaatatattaatttataaaaatacacatgatgactcagatatgcaagccaagctaatccattcccatttaataaacataataagttttacagtctctcttgcacaacattctcagatattctgacaatattttaggctctaaacattagctacttaatattcttcagttactgaagtaaaacaggcaaattttgtctgaagttaattttcacatttcattgggagaaaaactacctccttctccgtgttcacattttatttgatgcagctaatttttagcaaatactagtaaggaacggagaaggcaatggcaccccactccagta

SEQ ID NO: 38830 - DNA, 1508 bp, Bovine  19866881518698
ccctttcaactttcatatcctgtgattaggtaatattgtaatgtgctgtgccatgcaataacagcattaaaaatggtataaaagtttagggaggacagaaatcttatgataacctatttgaatgtttaaatgatgtaataaacattttttttaacaaaactagcaacatctgttcacagagactacaaatatatgttgccaagttctgtacagcttggcctgtatcacacactggaaaatcaagaatgagtaaagaaacagttaaataaacagtgtgaaggcagagtgttgattcatgtaatagagacaggacgctatgaacacatttctgaaccacaaggtgaagtcactgaaactggctctctgggggaagtgagctgaatcaaacactgaaggaacagcaaggcgggtgaaggcagcaggtggcttttccgggtagacagggcatggatacaggatggtactctggtttccagggcactgtgaggagttcggaatgtctggagcacgactgcaaagacggtgaaggcgctcagccaattctgctgtatcgttccattaaaccacaaacaggctgtttgtgtgtctcatgaatcctttgtatggacagacatcgtataagaaatccaactaatcacccttcctgtaaaagtacggaaggctttattttgtaaacaaacatactttccaaataattatgtttatcaccaattccagtttattgacagccctgtctctgctcagaattgaggaggtccccagctcatgtctctttgctgtgtttcagatcagatattctgcttgcctaatacagattagcagaaattgaaaaaggccagtggctctctctctccccaacctaacaaggctctttagatctgcatttcaaacacccaacactctgtcctaaagtgagacagaccttttgtatatccccatgcacttatcatagatctttatttaaacatttctcttgtgaagttgtaatttgctatatgcaggtttgtttcccttgaagggaagcaatagctctgtattctcaagtttatagtgcctggaatcttgtttagatgaatccataactgaagcaaccaatttatttcctacccctccacctggcagtacattatttctgccttgaaaacctggatttcacaatattgtctctgaaacacttaaactctttttattttaataacctatagagacaaaaaagttagagaattaagctagtaacattagttttaatttatgacagaagaataaacactgagctctcaagcccatgagtttatttcttcgtatttttactggatgcctcatattccaacatatgtgtgcctctcaccaacatactttaaggctgtttaaatattctgcttctgagagctgttcaaattgcatatactttcttcattgaagaaatatattttggagagagatttagtgtctagaattttctatatgttttcaaaactaagtctgtgtgcatgctaagtcactttaat

SEQ ID NO: 38831 - DNA, 1853 bp, Bovine  19866880817583
acaactaactataacttctggttcaaatttccctttgatgtttctatatacacacctacaaaaataaaaagctaaataaattccaagaatgtttctaattctaaaaatgtttgattcaatagcaataaatatttataccccactgtatcgccccttgtactaattgttgaagatagtgtagatactgattactctcagtaaattcagtttactggaggaatcagtaagcgaatcattttaatacaatatgttttctgcaactatagacatcagtgcccggtgctttaggaacacaaaggaaacaatgattattctggggtgcaaaggactcttgttagttattttcccattatccactgcctcttttccactttccagaatgtctcattacaaattttccttgatttatgatggggttacatactaatatacccactgtaaaaagaaaaatatcttgaattgaaaatgcatttaataaacctaagctaccaaacataactttgcctagcctaatgttaaacatgccaagaaaatttacattagcctgcttttgggaaaaaacacctaacacaaagtctgtttataataaagtggtgaatgtctcatttaacttattgaatgctctactgaaatgaaaattgggatggttgtgagtgtatcagttgtttgcccttgtgaacacttggctgactgggatctgaagctctctcctactgcccaggagtattatgagaaagtattatagcacatatttatagcctgggagaagataaaaattcagaattcaaagtatggtttcttctgaatgtaaattgcttctgcaccatcataaagatgaaaaatcataagttgaaccattgttaaattgggaatcatttctatacccagatagccttgtcattctagagaggttgattccatgacacttccaaaatacagcctgagtttgtccagtcaaaaatctcagaatttgtgttgagaattttgaaatacacacgtaatgaataaaggataggaatcatgttatttacattctaattttctctctgaacaatactctaccaataatgcagacatatcctatatacatctccatggttaatttctttcaatatttatcatgaaacatttgattctgatcctcatttttcttaactggatagcatattcatcttaaactgtacacagttctctcactggctctgatggagtccttagcccactaacatcaccttcctgggatgggccccttctacttgactatatgaagtgaaaatgaaaatgagatggtccttaattagactggaataccattaacaacagttggacatgtgcggcttacaagcaatagatgtcaattatatagactaaaatgagttaccaaatctaacacctgaagattgtgcctgttacctgagattgtgcctagtacatatattgaacttaattttagagtctcttttaaaaacaaataacttgtaaatgatgaagttattttattcatggatttgaagaaagaattagaagattaaataaaaatataatgttctcagagaaaagaaaatattaagagtgttaagtttggggaatttcctcatcggggagtggttagaactcaatggtttcacttctggggcctggatttaatccctgattgaggaactaagatcccacaagctgtgcatcttggcaaaaaaaaaaaaaagtaaatttgtgtaactcacagagttaattatttgatcccttactctctaaaggaatatttattttctacaactgatctcatgaggaataaagtatcactttctagtagttcaaggaaattcttattaaagctttcttatttccattta

SEQ ID NO: 38832 - DNA, 1139 bp, Bovine  19866881395289
cccaaacacgaggagatggtgcaaaacacagaagcctggcatactgtagtccatggggttgcaaagagtcaaacataacttgcagactgaacaacagtaattattgtatatagtagtactctgctgctgctgctgctgctgctgctgctaagtcgcttcagtcgtgtctgactctgtgcgaccccatagacagcagccgaccaggctcccccgtccctgggattctccaggcaagcacactggagtgggttgccatttccttctccaatgcatgaaagtgaaaaaataaagtgaagtcgctcagtcgtgtccgactctcagcgaccccatggactgcagcccaccaccaggtcccttcgtccatgggattttccaggcaagagtactggagtgggttgccattgccttctactctactgtatgctatattctatatactgtaatatataatgctatgtataagacagtatactattgtgtatatagatatatgtatgtgtttatagatataggtatgaagtatagatacactgcaatgccatgtatcagtgacagattaatttcagctctttttttgtccaaatttatatattattaattagcatgattcaaatcatttctggtattataattttggtatctattgcatattataaaactggtccacctattcagaattttagtattttaaatgcattacatgtattcccattatttaatagcccaaaaaggggggaaaataaatgaactattagagtcatttagtcatttttattcatggagcaatgctgttaatgttcaaatcagaaataaatttcatatgtttttcttccaaaggatatgcctcaaattttagtatgcaaattgcccccaagtacagctttctagctgtttgcttttcaaaagcatattgtataaatagttaaaatatactggcatttataattaaattatttttctattgatcatttttattgctctgtttcacattttattctattatttataggacacagtaatgaacttccattgctttattgcattatttggtaaacaatgtaacaaactcgagaaagagagcaataaaattaaggtatttagcaataaagcaattcccggattttaattaaattagggac

SEQ ID NO: 38833 - DNA, 925 bp, Bovine  19866881717502
ataatctgcaaatgctaatttaaacctggagttgcttctgagcaagctgcatgtaattatgaacaagcagcagattatcctcagaagggcaatatgctgtaccacaaatcacaagttgcatttcctcctctttttttctttttttgagtgcaaaatgtgattccaaaaagatgttattaagctataacaccttagtcattttcaagctcttggcacttaaagtgctgaaatttagattactttttttatattctgcctgtgcctagtttccttactgtatgtaaagttattaaagctgtctgttccaatttcttctctacttaggaagatatgacaaaaagatgaaagagactacctttaatctcaaaaggctaaactcaacacagaaatgaaaacagtagaatacataaagacaataagaggacttttccaaagatagtttacattcttcgagtggtcagtaaaaaggcactaaactagaagtatgtgacgacataatagttctgaggctcaatttcctctctagatagttgatactgttttttattatgctacataattgaaatgccacttgccatgtaatgatttgctttacctggggtggcgggggtgaagacatttgttctgtaaattgcattaaggaaaggaaaaaaaaaacacatattaaagcacaagtggcaattagactcagcaatacattttcagaaagtaccctcaaagtctttctcaaaaccaaaagggaatgttgtggtatgatttttctctattataaaagttaaaatagaaatggggctcagggatctaatggagtgactatcttcctaggttccttgacattctgatagcgggcatagactttcattaaatttatggggtgttttgttgcatttataattctcaagatttataactattagattttgtt

SEQ ID NO: 38834 - DNA, 2052 bp, Bovine  19866880342972
cctgggtgttcattggaaggactgatgctaaagctaaaactccaatactatggccacctcatgcgtagagttgactcactggaaaagaccctgaggctgggagggattgggggtgggaggagaagggcatgacagaggatgagatggctggatgacatcactgactcaatggacatgagtttgagtaaactctggaagttggtgatggacagggaggcctggtgtgctgcaattcatggggtcataaagagtcagacacgactgagcactggactgaactgaactgaagtagcttagcatgcacacacgcatctatgaatatatatgttatgtaattttaaaggtatgcatatataacaaaggtttaatgtatcaatctgtctgcacaggatcatctaaaactttattttttcattaatttatggttgtcaaattaacttattgcttgaatgtatcattagaaactctggtacttcattctatatttcaaaacgtatcatagagtaaatgctgtaacttgaacctggttcctgacttgtgaaaacatcatgtgtctctgctaccaaagccaagagaactgtgccaattacatgcctgaacctgtttcagtttaattacatggattactgaagcagaaacaacctttgtgcttaattgacccttataattgtcttagttctctgctttgcccttcttgggggtataattccatgtcctactattattaggaagaaaaattcacttccttttttggtaactccaaaaaaaagaaagattaaaatatactttagtgctcagagaattaacattttatcagcctctgtagctagagagtaatatactgagcaaaggggaaagagatgacccagagtcacctcattatcctcatgtgagagttgagttacctcttacacttgtttttttttttatttttatttttcacaaccaacctcagtaactcggttctatcaatagtgacctttgagcatctcccaatttaagatatccaaagcccacatagattcttgaactctgcatatatttgaatctgtgttgtaaaggttaggtctctagtcaattcatgcacctgcagggaaactcaaaatggattagtcaacaggaaaagaatgcttactcttcagtctctcaaccacaaattcaacttttccatatagcagtccaaaacctaagaacttcaactaaatggagacattaaaagcacagacgtcattatatccctaatatttcactcataatacctactcagtaattttttcaaccagttaatggaaaagccagaatggtaatgtcatgcatgaataaattatgattctctcaaattacctttttggattatcttttatgaaagaggtagacaaaatttatgtaatgccactcctttttctcctggacacagtctgtgagaatgtgtgttaagcttttagtaatcaattttaactacgttaaatatatagaatatacaaatataatatacatacaaaaaatatacaaatataagttgagagttttaaaactcagaaatatttcacagtttcacagtcccaattcataaagccccgcatcatttattttcatccattccagtgtttgtccatttgtggatttttgtcagggagtattgagcacatgctctctaccagcactgtattaggctttgcagactcacaggtataaattagattgtctgtcctcagacaggtgcacacagatgcaggagcacagacgacagcttttagccataatctgtcctgaaatcctctggtatggattcccagtcttcttaggcagcctgaaaagatggatcagggagttccagctaccttaaacaaatactgatgacaggaaaagcacacttgagaaatgaagaatgtgatgttgagaatgctgagggtaagtgggggaggagcaggagaagtagacatgtgccaaactggacatgttaatgattttgaattaaattctgaagatgataaaaaacaaatgaataaatgcaagaatggacatgagtttaccagacttactttttagagt

SEQ ID NO: 38835 - DNA, 1658 bp, Bovine  19866880442925
tctatgagagttactgtgtttatctctgcagacctttccactcccttcccagaaactttcggacatacacttttcctcttttcacaatgggtttctgactgacttacaggggaaagggtgacagggtggagcatcttgacgattccagaaaggcatctctttcttccctattaatttctgcacaatgcagtttgaagtggagagacactgggctgagcaaaattgccagctcgccagcgggggaggtgctcctggaatgtgttgaatgtgcattctttagatgcttgggaggggtgactgcccccttattggcatctacccatcttcactggtttggctgcttcagtaggaaacaggtattattttgaaacagtgaattctctagctcttaatcactgacagtagactgctcttaggtttctgaaattaggcttttaatgcaaagtgacattttctgtacattttctttggtctcttcaatttttgtttattctgttttaaagaatgaagttgaaagtgtcatctcatcttggtagaagattttcagtcatgagtaagacaccatacatagcaaaggaaacagatagattagtaaggccaggcccttttcctccagattagtaagcattgcaaatagactcatgctatttattgacaattacctatttttcattcctttagcaagatattttgtcattattaaatgtcaccattttccatggttgtttcctttttctgaagaataatttaaaaactatgaaaggaaaaataaatatttttctccactcaactagtttttctttaaaagatttttttaaaacagcagatgaacttctgatcaaaactcaggcacacagctgccttctagaacagtcttgcaagttcctgactcacgctaagccatcgtcatgccatactgcactcctaccccagttcttcactcacctattattgttaatgtgcttgtgataactgtctcttgaggattctcttaggatcccaagttacataaatgacagtgagagtgattttactaagcaagccgtttaaaactatcatgggtgaggctttatatagacttttgtttgatattcaaattcatgtgtaatatgaacaataatgaaaactaattagtttagaaatagtattgcaatatttaaacttccattaatttgcataggcttctgcctacctttttctgaaagagtggttatgtactaaacattcagacataaaagggtaataaaagaacattaaaaataaaatgaaatagagcgaatgaacatgcacactttttattccttctttggaaatgccacagcacaagagcacattgttccgtcaaaacccttatcacattgtattataattactgtttatagtctagttctctgactaggcagagagcttcaagagatcttaacctattaatctttggatcccaggttctgacataatgtctggcaagtacaggatgctcagcataaatccataaatgaaacagaggagaaaatgtgtgagatttcctcaatctgccattaacggtacacgaccacctagctcttagcccccgtgaatctcaccttcttaatttgtactgtgggtgaaataaggagttgtgaagagcctcagaagagatcctgtgtaaattctaaaga

SEQ ID NO: 38836 - DNA, 2863 bp, Bovine  19866880499038
caggctcctctgtccatggggttctccaggcaagaagactggagtgggttgccatgccctcctccaggggatcttctcaacccagggactgaaactgtctcctgaagctcctgcactgacagctggatactttaccaatgtgccaccattgtactaaatattgggcattaaatcaagattgtgtgtgtgtgtgaatcataattgcacaaagttctttatagtgccatccaaagacctagttctttatatctcttgtcccctggagttttgtgcaagatcttctctggtggctcagatggtaaagaatctgtctgcaatgcaggagactcaggtttgacctctggatcaggaaggtcctctggagaagggaatagccacccaccccattattcttgccaggagaattccatggacagaggaacctatgggctacagcccaggggatcacaaacagttggacacagctgagtgcctcactctttttcacacttgcttctctgtggctaagcacacatcccttctgccaatctcccttggcatatggtagtgatctccctttacgatatcttaaagatggattaagtgaggctggatttgtggattctgcctttagtcctgtcagagaccagtgctctctctctctcctttgggaacctacagtgaggaaaagccctgagccatcctgcttccttgaccccatatcatattcctgagtgatcagaatatggggtttcaattatatattgtcttatcattccaaggagagataaaatccctgtttctcaattcccaaacctcttacttctgtataatatttatatgattatggacttggaaagagccaattttgtaatgctatcatacgtgatagtaggcttttgcttttaattttgacagtctgaaagcttattctgagagctgcttccagagaaatctaattattcttggttaggaatgttcttctggtgataccaccagcctcctgggtactaagcatgtctgatgataggtgattcataagccctctgtgacatttcccaatgagctgttttgtcacaggtgatccattttgtcagatgtgttatttcagcctgagctttaatgtgactatcatgttgctgggcaagcagctgagagtgttgcatagcttgtcacacgctatacacccctttgaatcagaatacataattttcaaatcccagcatgtgaaatttaaatgagaatcccgccaagtcacagctaatttcttcccttccttacttgatacccgggggtccaaagtgcaagcattaaactatcataatcagtccttgaaaataagttaaatcagtgcaagggcatagattctcactggggcaggttcttttacctcttcttgcattagattactgatgggtgagtttaagaaagcagtctgttcagatgacaagctgcttgaatcaactatgacaaatgcaggagactctgcacgtgtgtgtgtgcacatgcgcaattctaatgctcatgtctccagtcttactttctttatgttcccaccttgcaagttagtatatctattaaaatgtgaatttgtaatttcagtacagctcattttaatacagtaacttatttgcatgagttctgtaaattcagaggagttgaagattagtgaccaagttccagcatcaatacagtataagtattcagatcattcttaaaaatggctcacttccctaactaatttttaaataagcattggaaattaaacttagaattgcctcatcagtgtgaaagtgaagttgctcagtcgtgtccaactctttgcaactccatggactgtagcctaccacgctcctctgtccatgggattttccaggcaagagtactggagtggggtgccattgccttctccagaggatcttcatcagtgtagaattccctttaattagattattatgaaattagctaaagggcatttatagaatttgaatccatttaaagaacaattttatacattcccttgtgttagtattttgacttttcttttaaaagtattttcttttagtcatcttacttgttttaatttttaattaaacttacttttaacttttaattcttaaaaatgattatgtatttatatttttatagataggtaacaatgtgtgtgtgcaaactcaaaccatcctgacaataaaatcaagccaattcatgtttgaattaaagtaaagaatgcagaaagcaaagaccacaggggaaaaataatggtaagcttcacatctatttaagtataaagctaaaacttagcaactaaaagtaatattttatcagaaatgacaaaagtctagagaaggtgaattgaagcatattcacatttaaaaatttggaagtaagagatgatattggtacatttgaaactattaatatcattatatatcactggaaaagtcatgctgaataatgtatttttaaatcattgaacatgtagttttaaaaaagataatgaccttcttataatgtcttaagctaaaaggaaatttaaagatataatgtcttttttgatatctaaatattccaaatttatcactgtcttcagcttcattcttttgttatattctactgaagttaaatttaataacttaaaatattatttgtaatgattcaatattcataaagatatcatttttcactcatctatccatccatatatgtactttgaaagatgcctgaagtaaagctctcctgataccaattctagttattactgcttaaggattttgggtgttttaacatgtttctctgtaccttttatttctttacaaataaatttttgagttcacagtggacatgaaccctataaatataataaaacaattttatttaaaag

SEQ ID NO: 38837 - DNA, 3114 bp, Bovine  19866880503583
cctggagaatcccatgaacagaggaacctggcaggctatagtccatagtgtcacaaaagaatagactgaagtgacttagcatacacgtagtgatttatacttagaaactatgacacagatctaagtcaaaggcaatatttgggctgcaataaattaatgttaatatgaagattccaataaatccagacccataacactgaccattgtccgtagtacatgaactatgcattgatatgacagaacactgtgaaggagcccaagaccctggagaaaaggagcaggatttaaacatttttcctgaaaaagtagttgtaagattaaatactcaacagagatcatgataaactatagaagctctttttattatgagcaggtatgattctaaaatattgttgctaattctattcattatgtctaaattaacagtgtaagactgactttagcacacagctaggaatgcttgtcaaaccactgaaaatagaaacttgtcagactccagcagaggaaaaaaagcacaagtaccaaatgatagagactgactatacgtaacttgggaagagaaggcataattgcttgatgtcatcaaatttgcatgttagatatcagttaaaccagaggttggtaaattatgatttacaaacatagccttaagcctgtttttagtaaatgaaattttattgggacaaagctatggccatttatttacatgttctttacagttcctgttgctatatgatggcacagttgagtaaatgtgccacaaagcccaaaacattcactgacctttttcaaaaaaagtttacgatcccctgagctacattaaagcatcatcatacacatacaaataatagtcatcaccaccaccatttacagagtgccagtacatcaagctttatcatgaatcttcatcataatctgaaagtcaaagcaattgtgtgtatgtgtgtgtgtgtgtattcctcacaataccatatgagttggatattatttcctcactttccattgtggaaactgagccaccaagagttaactaatttgccaaaggtaacacagaaaaatggcagagccaagcttcaaactaggcaacacagattcagagtttgtgcttttgatctctatcctatattgaatattatgctccttttatgcaaagggaaaatgcagttcagggaaattaaatatgttcagtatcacatgggaaccaaatattaaagctagattccagacccaaagccaatatgctttccatttttccacatatttccactgtatatccctaaggagataaagaattgcaaaaattagtaggaaattataatcatattaaggttagaaaaatatgcctatgagaagatatcatttggtcccagggaaaaaaatgatgtggtttcttaaaatgaaagtgaagagtggcacggcctcaatagccaaaaatagcaatgcatagaatacagttatttaaaaaacgtaagcttcagtttttaacataaggcaaatatacaatctaatgactatctctgagacacttgataggttcatgcctagaacacaatagtgactaggtaaaaccttaatcagcatcacaaaaacaaaccaaaaattagattttatagaagtaatgcagaaggaaggattggaattaagattcaactctgaaacagagaagcagaatggtaagatttttagtaaatgatgagaacataagtgataattgtttgagcaaattacaatctacacagtgatagaacttatatggtgctctcctaatagagaaaaccaaaatctcccagaagcaatatatagtaatgatggaagcttttaaacacttgaatacctactgaagtcctaattagactacaagggaactcatttttatctgcctttctttagtacttatacaacaaacaaacattcagtatgctgcactacttttctttgagatgcctagagaagtacacaccgtagccactgggaaaaatacttcaaaaaggccaaagaaaagaggtgattctctgacaaaattcttgcacagattattaaataactgaattagtagtttaaattaaaaaaaaaaaaatgctgctccgttggagtgaaataaccttagcccacagtcttggctcaagtcactcctaccctgtgggaaatgaatgtcagaacttgtaggctaccacattcaacactgctacatctactgtaactaatggtggtggtggtttagtcactcagtcatgtccgactctttgagatgccatggactgtcgtttgtcagactcctctgtccatgggatcctcccaggcaagaatgctggagtgtgttgccatttccttctccaggggatcttcccaaccaagggactgaacctgggtctcctgcattgcagtcagattctttaccgactgagccaccaaggaagcccactactactaatcgaaagagtaatattggcgagactgtgaacttcctaggaagagccttatttgctgtgtaaccttgggtaagctgaagctccaatactttggccaccttatgccaagaatcaactcattggaaaagaccctgacactggagaaggttgaaggcaaaagagtggcagagcatgagatgactggatagtatcatcaaatcaatggacatgaacctgggcaaactcaaggagatagtgagggacagggaagcctggtgtgctgcagtccacagggtggcaaaatatcagacacggacttagcaactgaacaaccaccatcaccaccttgaataaacttcttaacatctccaagcctgttttttcacctatgattgggatgataaagggtcctgaataaaaagatagtaccacacaatactgtttatttaacttatatgcagagtacatcatgagaaacgctggactggaagaaacacaagctggaatcaagatttccgggagaaacatcaataacctcagatatgcagatgacaccacccttatggcagaaagtgaagaggaactcaaaagcctcttgatgaaagtgaaagtggggagtggaaaaagttggcttaaagctcaacattcagaaatgaagatcatggcatccagtcccatcacttcatgggaaatagatgaagaaaca

SEQ ID NO: 38838 - DNA, 918 bp, Bovine  19866880510463
atttgaatgtgacatggtcatttgtataactgtatttcttatctccctaacaagattatttaaattttaaaaacaaggactatagatgttagcatatattattttatgctgcatagtgctatagtaagtatttgacaaatagttgaagaatgaatgagaaatctaattgattgttactcttattggtaagttgatgggcaagttatcagaaagtgttataaactgattaatagctaattattcactctacataagaatgaactattttgttgccaatgtaatctatctaaaaatgaaaaatagattttttccctagatgtaatgaatatatatcttttcaccaagaaatatacatttggttcattaatatatcacacaggaaattttattaaatgaaattaagcttttattaaaatttctgcatggattgaatggttgacaatataaatatagctgagccctctgcaaaaaattttcaattggagaaaacatgatttcttcttattaaatacatctatgatttatttttctcatatcagcatattataactccttcaataccccaagcaatcaaataactatggataaattacaaatgtctgccaaagcatggcacaatgctttgcatatctaaatgctttaacactcaaaccctacaactgtaaagcagtatagtcaacataagctgattcatctttattttattctctaaaagggttaatgctcaaagaatcctttgttttatggcaagtgtaatgtgaggaccctccagtcctgatttatcattgctccttttttttctctctctttctttccttgggttattttttaagtgcttgcgatccacattggataaaaaagacatttgaggctgagagctctgaaggctcaaggtgggaagggagagggctattttga

SEQ ID NO: 38839 - DNA, 700 bp, Bovine  19866880525083
aatattaatattccttatatgaccattgcttccagcatttcattttccaaatgcactttttacaaacatgtaatattatggtccattaccaaccactaatggagaattttatgactaacttttgcaccaaaaacaattatttgctgtgtgaggatagatttgcaaaacaagatttggtagcatttaaatggacacttatttttagaggaagactgccctgaccgtgtcctaacacttagattgccgtctcatggcatcattatctccaggcccagacgggcttctcttgcacttaaggagcataaggaagccaatttgattacataggctgtttcttatcactaggaaatttggggatggaaaaataataacttgtaataaatactatagggtttgaagtcatgtctatcttccaagataattaacaatttcagttgcttcaggaaccaggaaggcacaaaacttttctactgtatgctctttttaggaagaatagtgggtataattcttgataagtcaaaatgaacaaagtgaactgttgcactagggtgtgaatatgattagaattattcgatcagcccataaaatgttctcttaagcatatagactttttaaacatacaggcttccctggtgactcagatggtaaagagtctgcctgcaatgagggagagccaagtttgatccttggggtagggaag

SEQ ID NO: 38840 - DNA, 1360 bp, Bovine  19866880569829
aatatatttatggaaaagtaaatactaggcttcccaggtggctcaatggtaaagaatctgcctgccaatgcaggagacacaagagatgtgggttcgatccctgggttgagaagattccctgaaggaggaaatggcaacccactccagtattcttgcctggagaatttcatggacagacgagcatggtgggccacagtccatggagtcacaaagaatcagacatgactgaacaacagaacacaagaaggatgatcttgctcggagacgagtaaacaacaacaatacctcaaaaaagctaaattaggtatatcttggattaatctgtgaactagaaaattaacagaaactatgaatagttttataaaaataaatttaaaggcttgaaagaaaatgccacaatgtcataatgtcaaggtattaccttcaaaaggcaaaaatcctcataggcttggccatgatttctctatatttggtgtcatttttgataaaaagatggagtgtaggtaggcatatgaaaatatccagacaaaaaggacaaaacatggaaaaacagaatcaacttgccaagaaaaacacacctgccaagaagggctgtctactgtatgatttaatctatggattaatggaatatagatgatgacacataagatgctaaacatttagaaaattaataagtagcttataaactacatgtttttcctagtagtttctatttccttagttgttccataaaataaaaacagtatttctaccagggtccagcatattagttaaagaaaaaccaaatgccaactcaataggtgttcacttaatggttttaatttcttaatagttttatgacttgtcttcatgatttcataacttggacagtgaatttacaattctatataacacacaaacacataaaaaatgaggaagtcagctaaattaaaaatttggaattctgaacatcaagttaatataaaagaaagctgttaatataaaaatataaaacctgttaatataaaaaataacctgaaatacatttctcagtcactctacaacctcaggattgatctcgaactgcatgtggttatctagttcttctctcctgaaggaaacggttccttttgtcattggaatagacattatgcttcatcacttaaattagtagtccccaacttttttggcaccagggacctttttcatggaacacaactttcccatggactggggtagggggatggtttcaggatgattacagtacgttacattcactgtacactttattcctattattattatatcacctctatctaagatcatcaggtattagatcccagagttggggccccctatttaaaccactctcgttagacct

SEQ ID NO: 38841 - DNA, 2341 bp, Bovine  19866880575235
tgcaaataacagaagtttaaaaataaaaataaagttaaaaaaagaaaaagaaaactgcaggtgctgttggatataaaatgtcaagtttaggagtgacagagaacaccatcaaggagatggtttagatagtggaaacacatcagtgggcaattaaggatttatggaaattatgcaacattagtaagggcattattcatatctctggagcctaggaggagtggccagcaatttgcagggggaaggaaatgagatttatgtttggtgaggacttttatattcctctagtagaattttatgaggggcttactttctggcctggaatcaaccttctccagtagaaatacttccagccttattttcagcacccacccttgttaaataccctcacccacccaattgctcaagcccaaaacccagaagtcaccctgtgcttctctttttataattccctaagtctgattcatcaaggagtgctattacttctgcctcataaatgtgtctttaaaccatctcattctgttcatctcaactgctaccaccccagaatgtggctctgtcctctcataccagaactattgcaatagcaccccgactgttcttggaatttatccttatccctctctaacctcttctccataatcaagctggatttgtatttttaaatcataaatctcattatgtcactctttccttaagattttcaaagtctttccattgcacacagattgaaagacctaaaacacatccagaaatggaatactattcaatgctaaaatgaaacgagctatcaagtcatgaaaagatatggaggaaccttaaatgtatattactaagtgaaagaagcgaatctacaaacgttatatgctgtatgatttccacttcatggtgttctggagaatattaagataaagaaacaggaaaaaaaaaaaaaaaaaaaaggttgccagaggctaggtgtaaacagatggagcacagaggattttgtagtagtaaaacttctgtattttgatattatggtatatataataatatgttgttgttttttagtcactaagccgtgtccaattcttttgtgaccccatggaatgtaacccagcagtgtcctctgtccataatatttcacaggcaagaatactggagtgggttggcattttcttctccaggggattttctcaactcaaggatcaaacccacatctcttgcattggcaggtggattctttactactgaaccacctttatgttacatattgtagtatcacacagtgtcaggccttctctggtggctcagtccgtaaagaatctgcctgcagtgtgggagactgggatcgaactctggattgggaagatcccctggagaagggaatgacaacccactccagtattcttgcctggagaatccccatggacagagaagcttggtgggctacagtccatggggtcacagagatttggacatggctaagcgactaagcacagcacagtattacacatatactatatatgatatatatatcatatatcatataatttcagtggtggataaatattgttatatgtttgtacgaagccacagaatgctcaacacaaagagtgaattttaacgaacttccagtataataatctgtcaatgtaggtccatcagttgtaaaaagtgtaccactctggtgagtgaggttgataatgagggaagtatgactgtgggggcagacatattgagaaacctctgtaccctccactcaagtttgctgtgaatctataactgctctagtagtaactattttttttttaatgtcctaaaggcattgcatcaattgtctgctgcctatccatctaaactcatccctccttttgcccagaagagatctgctgtaagtaagatgtccatggcccaggaagcaaaagggagaaccttctcttcttccccacctagggcttacattgctccttcagcatctttctaaaggcagtttctaaaagacagtggcggattcatttcgatatttggcaaaactaatacaatattgcaaagtttaaaaataaaataaaattaaaaaataataaataaaagacagtaacaaagttgcagtcgggaaaaaagcaagtatcagaaagttctcatttgactgctattgtcttaaagtgacttcctactctctaagatgggtggttgtcttaagctcttagggtgcttttagttgcacatagaggtctccactgtggccattcaattgcacttcctgtgcatggactaatatatttttctctcttagctgtgccaatatcagcttgcattttggggggatcttttccacacaaactgtatcagggcttccaacatc

SEQ ID NO: 38842 - DNA, 913 bp, Bovine  19866880631706
cctgagaacaggctcccttgaaaagcaaggttctcatagttggcctgtaaccatggaagcagatgccgttttcttcttacccctgcttacctctttgcagcctcgagctgctccctattgttaaaaggggtacgccttgatttttcttcatcatgaccgaacttgcctcttcttcaaagggcatgatgctgcaggtcattggtctagactgtttgcacggtccagagaacagccttgatgtaacccttgctccgtctgagccacaccaccagccgtgcatctgtagactgtagggggacattggagatctgtatttgaaaagaagtctgtctgattttgccattgtgccttttcactcatcgatcgaatgaatatcgaaccttctgtcgttgcatgtgtgaaatagatagcttagcaagcacttttgtgcccaacctgtgcagtgggccaaaaaaggttttccttttagtctcaagaattttttttttcagactatgaatttcgtgttagcttaaattgtgtgtttttatttcatccagctgttaggatgactgaattacttcatcagcagtgactttcttttgaaggaatattttttgtcaactatattttggtttttggtttttgtcttttgtagctttttatgatctagtttaactcatttgtaactagaagtggtataattgtatcctgttaaaccagaaagttgaggtttcttaagaagatggttagatgatgtctatcatttaacagatttaatttcagaaaggtgaacttgaactgcctcaaggtaatttcagtgatttgtaagagtaagtaagtcaaataatcatattgattttgagttaaacaaaatgtttgataaactatgtgaagggaaaattttttctttgtttttccccttttaaaaaat

SEQ ID NO: 38843 - DNA, 1585 bp, Bovine  19866880669475
tagaaaatccacctggaatgcaagtgatgtgggttcagtctgtggatcagaaagatctcccagaaaaggaaatggcaaccccctccagaattcttgcctgggaaatcacatggactgaggagcctggttggctacagtacattgggtcacaaaagagttggatacaacatagcaactaaacaacaacaactgtaatatatactagcacttaatttttgtgatatctgtcataaaacgccccttaaaaactagtactagtaaataagggttattaacttgattatactatcaataatcaagtatgtgactatgggccaccctcttgtcatctcttctttaaaatgaagggaacaagtctccccaggcttcctctgatgggtctattctacaatttgatttttttttttttttttttttgaatgaagtgattcactaattcagtatgctgctgttgctaagtcatgtcagtcttgtccgaccctgtgcgaccccatagacggcagcccaccaagttccagtccctgggattctccaggcaagaacactggagtgggttgccatttcctctccattgcatgaaagtgaaaagtgaaagtggagtcgctcagtcatgtccgactcttcgagactccttggactgtagcctactgaatgtcatattaagggagtctacagggaatgggagcattaactggtaaagcagaagcattgctaatggacctgagacagtagccacagtcagagactgggctgcctatatcaagggaacctaaccaataatcattttatatttactaaacattctgtatgtctctgtatcattttaatttatagaactgtagtttcaggctgaacttgagctcatgttttgtatgttatttggggttctttgtttacatttctaaagtcagcaagataaaacaactacacagaaaagtgttaatagttacataatatcttattggtaggaggtatgaaaataaaggcatgagaaaggtgctttagtagtctaaaaattcagtcttttatgtttaaactatgtcatcctattttgcaaatgcctgctctaagcataacactgaactcatccctaaatatgaaacagtagttaagaaattatttgcaaaacagatctcaaggtctttattttgttcttccatgtggaatctatttactcatttgcacatgtggaacttctcatctctgcagcatgcttgaaagcttcacactgagtctgaaagttgagacagatttggatcagtaagcaaattaaagattcgcttcaaaacattcaatagaaaaaaaatgtgttcctttcagtttttgaggatttatctttgcacaaaatatctatctacacatcagagacatttagatgtttagctaagtattttgtgggctgaaaaaggaatattcattggaaagcaagcttgcctcacaatagaattgtattctaaaatcttgtttgtatttacattctgtattttatatggatggaataatttcacaaaggcatgtcctttacctgtcttgttcatatccagtgctccattcagttcctggtatatatcagagtcttaataaa

SEQ ID NO: 38844 - DNA, 3687 bp, Bovine  19866880675838
ttcttgcctggagaatcccagggcacaggggagcctggtgggctgccatctatggggtcgcacagagtcagacatgactgaagtgacttagcagcagcagcagtttcttataataagagatgatagaatcagagtgggaaaaatcccattacaggtcataaatcagactttactaaatatgtgtgtgtgctcagttgtgcctgactctttatgatcctatgaactgtagctggccagattcctctgtccatagaattcctcaggcaagaatactggaatgggttgccatttccttctccaagggattttcctgacccagagatcaaatccatgtctcttgcattgcaggtgtattctttaccactgagcgacttgggaagtccttactagctataggatacttgctatttcactgtttagggttgctgggaagtgtgatatttctcccccccccacctgagttaatgtgtgtattatgtgtaagggctttgtaaactgcattttaatgtactacattgatgttatttattatatttaaagcagttgcttattagtgtgtaaatattactaaatggcattcctatattatttaccaaaatagccaaatatagtcagtgttgtgtgaggtactcaacagaagctagtaaataactcaatagataagtgggataataacatctaaacaaaaatttaatcttatttcattcttcaataaagaacttttcaattttttatgtgatgtttgtgttttccaagtagagtaaatcatcttaatttgaatatagaagcacaggtatggaggaaaaacaataataaaaataacagaaaatgataccaaaaatctctataaaactattcccattactttcaaacaaatatttattcatattgtcaaaatactggattttattttgttcatatatgaaatgaagagattaaatacatgcagaatcattccaaataattctttgtcaaagataatagctcagtttatgttgctttacacgataaaatttcagccatccataaggacttgaaataactgacaactaagtttaaaaagatgcatatgtggagttagctataattatagttacatgtatatatgcacaagatcaccttacctacctcctaagaaacctgtatgcagggcaagaagtaacagaactggatgtggaaaacggactggttcaaaatgagtaaaggagtatgccaaggctgcatattgtcaccctgcttattcaacttacatgcaaagtacatcatgtgacatgcccagctggatgaagctcaagctggaatcaagattgccagatgaaatatcaataacctcagatatgcagatgacaccaccttaaatgcagaaagtgaagaggaactaaggagcctcttgatgaaggtgaaagaggagagtgaaaagctggcttaaaactcaacattcagaaaaggaagatcatggcatccagtcccatcacttcatggcatgtagatgagaaatagtggaaacagtgacagactttattttcttgggctccaaaattagtgtggacactgactgcagtcatgaaattaaaagatgcttgctccttggaagaaaagctataacaaacctagacagcgtattaaaaatcagagccatcactttactgacaaaggtccatctagtcaaaccgttggtttttctagtagtcatgtacagacgtgagggttgaaacataaagaaggctgagagccaaagaattgctgcttttgaactgtagtgctagagaagactcttgagagtcccttggacagcgaggaaatcaaaccagtcaatccaaaaagaaatcaacgctgaatattcattggaaggactgatgttgaagctgaaactccaatactttggccaactgatgcgaagagccagctcattggaaatgatcctgatgctgggaaaggctgaatgcaggaggacaaggggatgacagaggatgaaatggttggatggcatcactgattcaatgaacatgagtttgagcaaactccaggagacagtgaagtacagggaagcctggtgtgctgcagtgcatggggtctcaaagagtctcaaagagtttgacacgactgagcaactgaacaacaacaaatatgtaataagcaataaaaacaaatggatactgattaaaactttaagtattttaggaatacttagcatctacttgaaataatacatagtaattctcattttcagaaaacatttccattaatataagtgatgttgcgtcctggtttcatgtggttcaaacagcgcaagtccattatataaagagaacactgacttaaacggtttaattaaagtgactctatttcctattttatctactagaaagaagaactgccttctacatttttaacaccagatctacattttaaaaatcatgtaaaaacaactggaaacaaccaatacgtatataattaataaattaattgtaatatagtcacataaaaatactataacataataaaaagaacctatgatatgtacaaggggagaaatcacatggacagaatgatgagtaacacaagccagacaaaaatgtatatgtgctttgtgattcgatttatatgaaataaaaaactggtaaacctaatcaatggtatttgtttaatagtgatagacaccaataaggcatgagataatcttctagggtgctggaaatttctatgtcctgatctgagacattcatatatatgcatgtgattatgtatatttacacatatgtaaaacactcacccacctgtatagttagggagcacatatgttaaatatctccattaaaaaaaatcttatagtttcataaagaaacaaaaaagtcaaaggaccatcttcaatttttcagaaagcatgctaaatggacatttcaacaaaactcatgaaaggatcaaaatgcccgaggatacaaatcaaagatgaaattataaactagaaacttttaataatgtgacttttacagaaacaataattcatggtcaagtttatgttcaatatatatatttttattagcccttttcatgttgaggaatgaagctaaatacctcttctattttgtttccatatcactagtattttaaaaagagaaaaacagaacatttggtaactggatataaatgactttacagcattaagaggcccttgtgaggagaaaggaatacaaaacttgaaggaagatttatattcaaagccaactttccaggcagtggtattattaacatgagcagaaagatcatttttttccctctctatattaccattttattctacaatgaggaagttaaaggaagagcattgattatgatcacagctcaaaaagtgaatgaatcaaatatcttagagttggaaaagtgattttgggacaatttttttaatgttcatcaagagagtttgaaaaatcatatccaacaattttataaaatgcattttttgcccatatcctcatttcttttaagttttagtcttaacagaagttagaaatctaatttttaaacatttatcaacaattgctccgtaatatagttcaagtttctttctacacagcctgtgatatggacaaactgaattttgaaaagacaccatcatctagagggaacactgacttcagagccgcaaaaccctgggaaagagttctgaacctcgcttccaggcaatgc

SEQ ID NO: 38845 - DNA, 764 bp, Bovine  19866880823093
attcctaggtcaggaagatcccctggagaagggatagggctacccactccagtattcttgggcttcctctgtggctcagctggtaaaagaaactgcctgcaatgcgggagacctgagttcgagcactgggttgggaagatcccctggagaagggaaaggctacccactccagtattctggtctggagaatttcatggactgtatagtccatagggtcacaaagagtctgacacgactgagcgactttcacttcatttcactctttaccactagcgccacctgggcagccctaacactgaccaaagggggaagcctggataataggtaacataccaaaaccaggaaaacctcattaccttaaataggatgagattgtgaaaggaggaacaagctgaataaaacagcttgtttggtaggacctttttagactgcgttacctttcctctggaaagatgttgcaggtaaataaaatcaggtcttactggataataagtgtaatatatgcaatttattttcattacaaagggtttttattgtatctgaagaattccacagagggccattaaaaatccattatagtgtttttagttagtgatctgctctgcttcccaaaacatggtcattttatgcagtattagacttatgtgcatttctgcttcttgcctggtcctcattctgaatacttacaagtaattacttgagagggtttttcttgccttgttggccatttcttaaaggtacaatataatttattgagcaaaata

SEQ ID NO: 38846 - DNA, 2181 bp, Bovine  19866880828454
gaaggggaaattaagggagacaaactgaactgtgaggctcagggactctgttggttctgcctgtcactgttttaagctggctcaaagcctccggggagtctggctgttccagccttcctcagccagccagacggtaacggcccactgcttttattcattaccctgagtgtaatgcactaaatttaacaagtaacacactcagcgggaatttattggccttttgcagtatgattgcaaggtaggatatggatatggattccaattactgttgacacccagataagaagaacaaagcctgtatatgattattaatcaaagttaatattttaggaaaaggacaataaataaataatttctatactatttgaagcagatgttcccaggttgaaagaactcttctcagttacacaattacataaaaggagcattccagtgaaagagaatagcaataatacaatagcaacatcgaggcaaagtgatcctagacagcaacaattttcatataaaaatagctaggtggagcagatgtacaggtgagagaagactaacgaattccaaatatagactcctgtgtgttatagaaagcaatggccaaataaacggtcatctttaaataaggatttagtattttaaggagaaaaaataacaaaaaaattgttatttcagatggtaactatgatctattaaaatgtggcaggaggagtgatggtaaaaaacatactgtatcacattttcacatcaacaaccctggagttacctgatgatgaaaattcaatattgttcacatatagatatttattatgtcaaagtctttgggctgcaatataaaatggaagaagctagaagttttactaactttgggcaagggcttattgttatttttttatattatttatagaggcaatgggaacacaataaatacaaaggcatagaagagagagaacctgcttttattttaccagactatatgtgaatgaaatatgttgaaacatataaggcaaatgaaaacaaagggagcatcaccttttccatgatttactcaaatgactaacttaaattattgaaataagaagcagcatgcatcactggtgaaggcttgaaccttcacattacacagaatcatatcctagctttcataataacactctgactttgaaccacgaatttaatctctcttagactgtgtccccaagtgtaaaatagaatgattatagtaactacctctgtatttatactgcaatactgtattatatgcttcaaagctgctaagaagctagatcttcaatgttcttaccacaaaacattgaaatggtgattatgggacacattggcaagtgttaaccaatgatatggtggaaagcacactgcaatgtataaatgtatgaaatgaaagtgttgcacaccttaaactttaacaccataggggaaaagtgaataaagggaacacaagattcctctgtattgcttcttacaactgcagacttatttcaaaataaaaatgttaatttaaagaaaagagacatatgattttattttatttaaccgaaaatgttttatttatccaacatactttcatcttagtctattaaatgagataaaaattagtgagatacattacttttttttcatactgtccatttgaactggccgcattccaagttctcagtagtgatgtgatagatgctactgtactggacaacacagatgtagggagtacaaagacaagaagtcaagacaaggcttaagaggtagtcatgggccaaattgggcttcccaggtagagctagtggtgaagaatccacctgccaatgcaggagatgcagagatgcaagtttgatccctggattgggaagatcccctggagggagaaatggcaacccactctagtactcttgcctggagaattccatggaccaaggagtctgatggactagagtccatgcggttgcaaaaagttggatatgactgagggactaaacagcaacaagtcagatcatgaatgtaatgcttgtaataaaatccagactctgcaatggctgacagagcccaatgtcatagccacctctgcttctttctgtcgttctcatgctcagtcacactggattccttgctattcctgggaaattccacatgtgctccagacttggaaacctcactcttgctgttttctctgtctggaat

SEQ ID NO: 38847 - DNA, 3124 bp, Bovine  19866880835157
tgaaagatttagtttctttaccaactagggctaaatgttcacttttcttgacagcaaaaagtaatactgtacacaaaaagcacagataacatataaatgcttttccaaaacttctatgtctaacaaaaattaaaacaggtaccgtctttttcatagagatttctctagttttgctaaagtttctattctactcaggattagagcaagagagcaaaaggaaaaagttaataagaataaagtgggagatgagttataaaagagtaaactgaaagtgcaaggatccccttttatataacagtagacttaaaaagaaacaacaaaaaaaagttatacctgatacgaaaggtgcgatttcaccaagtgcaataaattgcttattatgccatatttttgcaataatacaaatacagaaggctcatttgcttatgctgccttacaaagctgctttacaaagcgcgatgtctctgtagttaaatacaagccaatgtttgccttttttttagtttgttttggtttggatttttgtttgtttgtttttgtttttgagcaggagcatctctctctctctctctttttttttttttcagcactgttgtatggagtaggacaaactcagattttttcttcatgcctcctgatatttcttgggaaaaaaagaggaccagggtgcttgtcttctttttcttccttctcggtattgcaagcacaaagcactgcgcagaagctgcaccaatccttgccgtccctggcagcagaatggtagaaggtgggagagaccaggaatccttccaggctctgctgactttagaaatgaggattgcacacgtttgtctcctgaaccaaaagggtgagaaggcagggtgccagtttgctacactgctgcaatgatctcacgctcactgctgctgccgtcctgtttgcccagttcaaatgcctgttcagtacaaatcaaaaaaaaaaaaaaactacttggatttttcagcaagcaaaacgggtattaacattaaaaaaaaaaaaaaaaagaatcagcagtaagaaaaggcaaaaaacaaaaagcacatacaattttaggattcacttgttatgcctcaatattctgtttatatgttctttctttctcccccccccccacccccatttagagataagcagcagaatttatcaggcgtgaaagggacagcctcctggtggcctgccaaaaacccagaataaaggcgaagttgtgcttcaaagctcagtcgcttgctgagtctggctaaagtcaagtattaagatccaccattttctgagccatgctaaaaaagaagaaaaaagtcaggacggttcctgctttccaagtctccgttggcaccatcacaaaatctcagtcgtaaggtcacatgatcctctgccaaatgtagagtgcattcccatcaaccattctgctgatactgcgaaggcagctattgtctcgtttagacccaaagttcagcccactcttcattgaattagctgaaaaacgcatcacctttgggggctgggagtcatggaaacgtctacctggcaagctgcccactttttctgcccatcaaccagagatggaattgtgctgcctaatgcaatgatgacttggaatgtgaagagtcgtccaaagtgaatctgattcttgcaacgcctgctccagtttgcacggaaaactctggcttcttgtagttaggagggagggggggaatctttcctactaaatgtagcaaataaaggtctgaacatgcctactctgcaactttatttcacaacacacccaagtggttctcaaatgaaaagactgaagtctctgcaagtttttcgagttaaaggcatcccttcctcaggctcctttttccttaagagtgcatgcaacaagcccaggacattcgtttcagtccctcacgtgaagacttacaatctctgagtttcgtcttgctttttattactttctgattttatctggcaccagttttatactacatggtcacaaaatccactagcaacagtgggaatgcattattgccgcagtctccatcaaagtggtcccctgagggagccagttgtctcttcgaccacacagaccactgcaactgggtcctgtgataatccttcacagcacctagcacagctgctgtgcaagtttgccgagtctgactcatgtaaggagtgctctttctgttccttcaccagctacagttttcctgtatggtatgaaagatgcctttgaaagatgcaggaaatatatcaacagctcttaggcaataaaatgaaatggttccctctccctggtgaatttccaatctagcgggcgacgaaagttcccgtggacaaacatttccatactttctaacaaaagtacagtgaattaaatctttctccatttccttaagcagaatcttaaagccaaacaaagcaagtcttattagtatttaaaccaaacatactcagtagtactgaaaagaatcatgttctacccgcatttaaaagtgtttcaatttttcaattaatgagaggatctttagaactctgttaccaacattttcaaattatattcagtgccttacaaaactacagaccaatgttatgcctcctccatgtaggcacccctaccccgatgcacacacacacttcacaatacctgaaaaatattttaaaaaattatcaaaccacgacttgcctaataaaagaaaatcatccaaaaaaaaaaaaaagcacaagtgatctaggaaataccctgaaaaaggtatgcatttttttgagtcatggtctttgggtcaccttcttaaggaatcgtagcaatgaatatgtacacacacatgcatgggaaccattctggtgtcctcctcatttgtaattcagaacacaaacaattgtaaaccataaaacaaaagcttacacatgctgaatttaaaaatgctttttttctagattgcaaaattctggacaaattttgctaatgtcctaagtacatgctttagagtgccggatggagaattgagcatggcagacacatgtgccccatgcttcagcatagtaagaagaaagtagacaagccctcatagaaagaaaacagttaaattttgagttctcattcatttattcaatagatattattaag

SEQ ID NO: 38848 - DNA, 1772 bp, Bovine  19866880864855
aattattggcctcattttaatgatgataaatctaggcttagagaagttaacaaacttgcttagaaatagcaagtcaccatttcagagctggaatttgaattcacctttgttcactctaaattaacagtctttttaccacatgactgtaactcttaaaaccatatataaaactatcataagaatgaacatgattactttgcattcatagttttagttggcacttattggtcaacagaaatactcccattagctattttaaagacagcttttataaaacagataatgattaccacttaataaacccagcagtataaagttattagatatatcacactcttcccacatgatgggaaggtgcaggaggctctgaaatgagtgctgtattgttttttctgttactgttgggttgctcttttaaagagaaattctctgtaattaaatagcaatcaggcacttaaaagacaggctgatctcagtactgtatttaagtaaagcagacaaagattgcattttccattctgtggtctggacacctggtgcacaagctcagccttgagcagggtcagcctaattgaaaccatccttcatgtgcctgtcacataaacaagactctgcgttctgaaaactccatataacaaaaatatacaggatttctttttttttaattttcatcactgttatgagtgccaacatttctgtccttagttcaactgatcttgtagatatttccatcctttttaaacatcaattttcacttaatgaaagtaccctgcattagcaagacttaattatattatgcaaaagccacagggataattataatttatccaggcactcttaatctgtattaggggaaatgtgttacagacctgatgagaaaactcacataccattatccaatctcaacagctgcttagctaaatcttgctatagtaaaatctcagttatcatcccatcatttctagcctgccatgtttttttttaatttctacaaatttaaaagaaacattttaagttgtcatttctagaactttgtaatgtgactaaatctgtttcactaaaccaaacatgttcttatcctaacatgatttaagattgcactagctacatatttacaattctatttaactaatcacatgcatttgctgaacatctcctatgtcctcagtgtttctggaacaaaggacctctaggtattctgctacattgtcataagcaactaaatcctagcagggagaaaatactttactgtatatgtccaattcccataccttgatttgcccaacttataactgacagcaaaatgtcaaagtttcagcttggaaatctactcattagataagtataagtgccaagagaggcattccttcttagagcaatattaaattcttactaattgtaattcagtcctttgtccagcagaattttcacttatccaaagtccttgtatgccagtacttccaccatttccgttggaaatttcctccataactgcacaaatttgaccactagattgtatttcctgcctttcagttcatctcctttctcatacttattaagctgcagacaggtaccttagatctgtaagacctaaaattaattttgctttgttttagcagtctgggggaatgaacagtcatttgtaaatttcccctgaataatgcacttgttcttaaaagcttgtgaattgtcaacattattgtagccactgaatgatggcaatattactgcttttgacaagcaaggtaaaaattacaagaattgctaaaatt

SEQ ID NO: 38849 - DNA, 1753 bp, Bovine  19866881057684
ctgagaaagggccctacactgcactagtacctaaatactagcagaagctgcctgggaagacagccaatggaaggactttgtttgacccagctgccaatctcccctgaagccgtgcgccagactaaacactcacactattttaactgaaatcaggctacagcagctgtttgctttccggctctgagctctgcacccaccatggcctgtgcagttcacccagcgagttctgctagctgcgtggctaaaaatctgttctgggttgggatctgtcattggagagcaaaatttaaccctattcctcgtggtaaatctgaactgtgtgttgctcagcctttgcatctggtaattcggaataattttacgatctatttaaagaagagtgacattttctttcacagaagaaaagatttgaaggttacaaagattcatatattctttgaaattctaacctaaattcttcagatgttttcaaataatactaagataacacttgtgcatggcaagaacaagacccctaccaagctcttctaagaacaaagatggtacctattcaacccgacccaaacttcttcagccctaccaagatggaaagttggtagaatgggtacagagactcaaatcattctgaaagttagttcttactacttaagactcctccagaagcagtgtccgagcacaaaagtaatttgtgttccttatatgaaaaagtaccaagtgatcccatttatctttcctaaatttctaaccttatttagctattaggctgaatgtgaaaattaattatgaattgtaaaagattaaaatatgcccatggtagcctaaagtgaaaaggaaactaaagagaagttagtcaggagaagcacagtttaaataataagaagaattatctgatgtaacaggaagaaaagatctgataaccaagagttattgcacacaagatggcagccaaacattacatatacacagaaaataagtcaggaagtcattcaacatgtggaagagagaaagacgttgacaggagtctgataacatggactataatcaagttattcttattcctgaccaaattcctaattatggaaagccatggtgagagaggacagcatcttttcatttagggatcttagcttctgttgttgctccggggtagaagaatgtctgtttacaggcaaatagccagtaaaacttttatttttttaaggtaactaattcggttcacagtgtagtcagaagatgaccaaaaaagaaacatttctgatatactgcaaaagtactaccaaggatagttttgcaaagttgttctcatactttaatagaaagtatactttgttgctatttctgaccacaaattaatatttctgttttattttagaaatgagagattgaagttacaaaaagtagtgaagatggttctagagagggtgaactattaggtttgatgagtacaggttacctgaaagacccaattcattaaaaatgcatgttgagataatattgcataacaaatgagttactatctcattctgaaaggactacatgcattaacctggaagatttgctttggatctagcttcctacatagcggagtaaaattggttgctcagaattctcatggaatcagataaaatgtaggaaaatgtttgtgtgtgtgtgcctctctttcaatccacaaaaatattcatgtttctctgaatggtctattacaatctaccaagaaaatatcatacaaattacacaactatatgttcttctg

SEQ ID NO: 38850 - DNA, 661 bp, Bovine  19866881211640
tggcaagtttctaagaatatgggaaaatattaataataaatattgcctccagtttttatatcctcattaactggaaggtgtgccagccttagctcccatttatttttgtttttttcttttgaaacatttcaaagaactgtaagcatgttaattaaaccagaataaaacttcaaagtatccactttccttctcatagtctaggctcacataagaaaatgcaattaagttgaaaaaaagttttatttgccccaggtttacattgggaagtgatgaaatatgcattctcaactcttatttctttctggaatcaattgtcactttctcttggccttcttttctaaagtaactggttattttggttactgtcaaaggctaaatggtgtttgcagccatcttttttctccttctgatgctaattctattgtttaataaactaagggaaaggaataccagaagaaatgaaacctggacttttaagttttggaaaagaaatcagtatattgcttaattgttgtcttttatgtacaggtttaaatatataaatttggactaaccttgagcttaattcatctatttagatatgaaatatagttccaagtcaagctagccaatttttctttaaaatgtattgatatcagtttatcttgccctgcttaaaaat

SEQ ID NO: 38851 - DNA, 819 bp, Bovine  19866881222337
actgataaaatctgacaaattgatctgtttaatatatggaatttaaggcatagctttttaatttttttctttttaaaacagttaaaggatgtatttgttggaaaattgcaattttatatgaaaagtaacagtttataaaacatgtgcataaaacactttcctttgggaatttatatatttcgtgagtcagaatattcaaggttatggcgcagtaataaagcatcccacatttcactggtttactgcaacaaagatttactcttttacttatactacagaactcaaataacttttaacatcagtccaggctcatggagggaccaccttgattgttataactgagaaaaggatataagcgaatggcatgctaactcttgaagttttatatctgctcacactcattgactgacacaggttataaagtcatagctaagtcaaaaagatatgaaaatacattcctactaaatgaacatgagaggaaaattggagtatttgtaaccaagttctagtgagtatcacaatcattttctgctggatgacataattttagggatagcttttttatgattgtggatgactggatatctttacttctcaatataagtctatattgttaaggaaggtagaatattattgttgctccttctcagagaagctgagaatcagaaggcctggatagtgttactatacacccacagttagtgagaaggagactggggcttattttatctttataaagtaattgcttttccatatggttcattaatgaaaatcctgtactgtgttcttctactttatattctatgggccttttgtgta

SEQ ID NO: 38852 - DNA, 1078 bp, Bovine  19866881224996
agcagagtcatcagaaatgaccaaaggagattgtagattgggcaagacctgagtctccagtgccatctcacctgagttcaggtcttcctttgaatgtatgagttactacagtaactctccccaactcaggggtccagtaactcacctttctttaacttaagctactttaaatgagatttctctcacaaaagatgaaagagttctgattggtatatcaaataattgcaattcagaatcttaaggctgattgatactaaataacaaccaggcttccttgttggctcagcagtaaagaatccacatgccagttcaggagacacaggtttgatccacgggccgggaagattccctagagaaggaaatggaaacccactccagtattcttgcctggagaatcccatgaacagaggaacttggtaggctacagtccatgggctcacagtcagtcaggactgagtgactaaacaacagcaagcaacaatcaacagttatttattggtgtccaacaaaataatacaacaaatccaaaacacttttcaggtgcttagttatttaatcatcacaacaaccctgcaaagaaaatgcttatattaaagcacttttaaataattaaagtgagacagacagagattttgtaattccccaagagcccataactagtaaaaggaaaattctgaatctgaactcagagcttctgattgcagtgtccagactcttaaacttgactgactctctcttgacatgaattgagttctgattcagtcatctaaaattaagtgctttcatctctctgaaacttaatttttttcatctctaaaagagggatactatttcctactgcagacatttttgtagaaattgaaagatattaagcttacgaaagcattttggaaaatgcctagcactagaaaactgtcagttcatattataaaattataaactacattaaaactttatcagctatgaattgtgtaattgaattactacaaaatttaatgaacatgttatagtcaataatgtctcagaaaaatagatacaagagtcaattcatatgtcaggaagcagtttttaatctaaa

SEQ ID NO: 38853 - DNA, 1533 bp, Bovine  19866881268105
ctggaattttgccaaatctaaatatgattatatttctttctgggttcatggggtcagtatctttctgagtataaaagtccttaacactttagtgtgccagtaaagctgcagtagaggtgcagagattaagctacattgataatgtctagaagaggtataggtgtctcaggggaattataatgcaggttaattagtaatgaaattacaagtggtatatactgccttgaattccttaaactcaaatggacatactagtacatgtgcccagatttagtctaattcacctgatgaatatttaaaaggttttgcaagttgttatgtttggatgagtttcgagcaaagcagtacataaagggttagctaatgcccaaatattcttgccatttacacacgcagtgcagcctacatttcggtaggcagcaagtgcaggcatcattttgattacttggattcttttgtttaatttctcactagacatttaacttagcacagaaatcccactgatcccttagtgactgtatttagaaaaggaaaacaaagttcctaatatagagaagttttcaaaaatcctgaacatttgtaagcttttgaaaaataggctttttactacaacgctgcaaatacatagtatgtggaaacttaggtgctaacattatctgtcatctccatatttagtttcttatctctaagtgaccaactacactctgagacattatatgcatgtatattaatacacattagcatatgtacttaatacacactttaatatatacattaatatgtgttaatatacatatttatatattcaaagatatcttaatttttttaatctttggtaaaaatagtatgaaaatggagaatttttcatataattatccacaatatttcttcaatgtgttagctttgattttcattgaatgttgcttttttcccagctttatcagatagagtgcattactagccaataatattaagttgtatgtaatgtcttacttgtagcagtttgaaagcaggtggaacttgaaggtaattgagattaagtgaatttaagatgaaatagttttatataatcagctaatgccatgcatattttataaagaatttcaaagtgaaaatttttcatatggtgaaataaatttttcattgtatctgatgtaagaaatatggttttaagtgtgttaccttcataattattcctaaacaaaactagagtgcaaaataatcttggactatatctgttaggtcaactaaatgagagtaataattcctagatttcatcttggccttttgggtttctggggcattttaggtctttgatgtaaagtggacttaaccatttcacttttctaagaaatttcttcctctctcctggtaggtatctgatgatttgtgaaccctagatgactattctgtggagtcatctttccttgcctttgaattaactttccctaggccctgagtcaacatcaatattttatacatccaaattggagggtctttcttgaaattctcctatgtgtttttctggacata

SEQ ID NO: 38854 - DNA, 1720 bp, Bovine  19866881289184
aaaatgctgaaactcttcttcctacttagctacaataacaaactaggtctaaaataaatatacaactcccaaagctatggttttttttttttaatttttttcccctctgttacgattcagctgacttcaccgggtttatccccctccttccctttcacatccctgagtctgtgggtgagtagggaatagagggcagagacactagaatgaccagaactattcacagtaggtatatgatggacagtctcattcaaaaaccattccagctttcccccaaactttcactgaatttcttatttaaatatgtaaaatgcaaaaataatatcctatatatttagtatcactctaggtaatagcccttaaagtataaattctgcataatatttctcaagaactgttttaaaaatgtgtatcagcactgtagatgctggggaggtgcttagtaaagctggctttggtgggatacaattgtttcaaacacttgcctcttacttcattctttaatgaacatctctggaataagtaattactgtgggaacacaactttagagccattctcaaagagcaaaattggcagaggttggttttataaagttcacaaaatgaatggtgccttattgccataaacaaagggatttttaacaaccagatttaaaatacccagcgaattactgataagtgaatcagtgaataaagataagtctttaattgacaagaaaatgaaggattaggctaatagcgtactacagcaatatgccttgaattcaaatttaggccttcttccctgtttggattaagtaattactaacagctttttcttttttaacagaaagtctatttcttgtgcaacatttctgcttaacatcttctaaaatgtgtgctactggtattaagttttatcatgaatccttcaagtgacttatcatatcctcttaactgtgtatttgaagtgacatatgattattttctaatttgaaatctgaaatttccttataaaatatatttgtctggtaaatacaatggagtaaaaatagttgtaattttaactagaaataaattgtatgattctttaaacttttaatgtcaagattaaaatatttaacaagaaaaattgtaagacaagataagaaaaatccaggtaccaataccaaaattatgaataaataaaacgaattcctagagaaccaatggaataccacattcaacttcggaagtgagcatatattttttttttttcttagagaataatcgaattgaactaatccataaactctgattatgatttgagagttgaccattcttatttagtaatgtaattaagtactatttcttattaccacagaaaaacaataacgtttttcaaagctttgagttttcatatgtattttctatctcctggtctgtcaaagatctgatatatcttccaacaaaattctcatttgaaaatatatgtctctggtaaagagctaagatgtccccaggaaacagatggagtgatggatgcttttcttaaagaggaaagacttcagaatacaaaaccccaaaggaacggtccataagtttaaacagtgtggggaatttccagtgacaggtgggcaactggatgttgtgaggctaatggggaacttgctgttatataccagcctggatggcctaggaggggagtcagggggggaatggacacatgtatatgtatggctgagtcctttcactcttccca

SEQ ID NO: 38855 - DNA, 797 bp, Bovine  19866881291919
actctatatatactgaaacaagctgaacaaaatctttacttataagccatagattgtgctgtgaagtaagctaacagaagaaggtgggggggagggagtggaatgtaaggacaggatccagtaacaaaaagtgagttttttcccaacacttcagctgtttaaatccctaaaccggccctggtggtactcaccaccattaatttgggaaaatgtccccatcctcttgctaagagcgagtgctggggagatttctgttattccattgcactgttgccaagccaacctgaaagtgtgtgggttctcagagaaacatctcagtatgcagtgttaagtttcatagcattcttgacacagtattctacatttggtatacaatgtgattggtgagctggccttggaactgaaactccgactgtaatatgattcccaccgttttggaacacaacctgttcatgaaatagaaattgcatttattttcaggaaagaaaagtacggaggtttctctaatccagaacagtttaagtataggaaatgttccagaggatagcaatcaaaatgatgaatgagctagattgttttattcatgtggaaatataaatgaagcataaattacgcaagagaaatttgctgagggaaaaaaaataattggggaaaattgtgtgatggtctacagaatgtgaaaggcacagacctcaaagctagagaaataacttgtagtcacaataatagaatgtccacagagtaaagcagaagctgccttcactaccaaaaaagtagatgggaaactacagtgattt

SEQ ID NO: 38856 - DNA, 1011 bp, Bovine  19866881381913
ctgtgaggtgtctgggactctttcagttcaaaagtgcctaaacattcatacaggttatgaagctttagttcagactcttatttttctttcccatcaagctattcattgagacttccctgagctttttattttatgcctttctttgaatattttcaagaagacactactactttctaggtaattagattgtaccacatatgaatataaattacacttatctccccaagcaataattgaatttcatgcacacaagtacctgctttttctgaaatctttcctctgactactgaatggcaggtaggctcagaacctaccagtggtaaaaaagagtaataaaaaattcagtggatgctacaatcttagaatttctgattttcagtatattcaatttctttatatttcaacacctgtagttcttcagttcttccattattattagaactttgtcccatagttagaggcaggagaatcctcaaaataaagtcatcctaggttgcatcttattttttttttttaattttttttagaaaaagaactcagatatcctagctgagtatgttatcttcacaatatagatattaaaggcttaatactacaactgaatttcacaaacattttattaacctttattgcttgtattgtactttaacataataattcacacctatccagagcatagaatattttctatttcttggagtcaagaatatcacagatttactacacacttagaaaaatgtttctttcttttattaactctatttccttcaaacagaagagtgacatctaagttcaacattgtaagacttaacttttactcagtccatattctccaagtatttagctgtatttttcaagtgtactcacattttccaataaagttatctaaaattttcatccttaaatataaataagctcatcatttattcatggtgaatgcctttctaggaacatgcctaacttggttcactttttcctgagctatcaatttaggaacgtcagagtcaagga

SEQ ID NO: 38857 - DNA, 1328 bp, Bovine  19866881519955
ccactttaagtttttccctaaaacaacccccaaaaggagaaatgtcagacaactgctgtttaggagaagcatctgggtgtatggtgggaatgaaggtagtcgatcgagaagaaaacacaataccaaaatgggcaaaaccttttaaagttttttttttttttaaaggcttggaagactcatggagccccacccaaggctactcatatgacatataatgtggtttcatagtttgcatttatgcattcattttggttggtgttgttttcacagtaacagttttgaaagtgaaaggaggcatggctgttaaagaagcgactaggttttgcacaatgaactagtgaaagctgaaaagagatttggatttggcatggagcttaataagataattaagagtgtagagattaatggctcctaaaaataacatttaaaataatgtttttcaactaaaggatcttgaaacatgaaaacaggtttataaatgttaattaagcctgtgaaagttgatgtttcattagctgaggcagcataaaggaacaagagctattttttaaataattagtgaacaataaccaataaacttaataaaacattttatttgaatgttatcactatatagggtatttgtaatttcccacaattctttgtataatgacaaaacagaaggtagaattcatcacctctgtagtatttttcattgtttaccctatatatttctattataataaaatacgattttaaaagcacaacagtttgcttgaagtttattcttttcacggaaaatattatagcatcaattcttcacgtgcaaattatagtctttataaacgctctatatttcaaaagcattcttttttttaacaatttaaaaacatgtttagaaacagttttaataaaacttaaaaataggtgcaatacatcgggctaatcctttcccactgaattaggcaaaactaggtttttgttacaaaatgcttaaattgctcagcaatttactaatacaaacacacaaaataattagaatgcaatgcattatatgctgagccaatacattgctttaaacgtaaaacaagtttgtgtgtactttttccgctaaagtacctaattgatatttctaacagctctaagacaaatgcttcttttaaatatattttaaaggtcagtattattgtggaacaagctctttttctacttagcaactgagaacatgatcttttcatccttatttttgtcacatgaaatcttggtaagtaaattaaatataacttccctcaaactaaatttcacttattagagaattttaacacacattctaatacaaccctgtttta

SEQ ID NO: 38858 - DNA, 715 bp, Bovine  19866881896539
tttaactatttcttacttgctattgggttctatacatcatgcaacttttgatgctacttaaagctaagctaatactctgaatctgttggtaaatgcatttatttctgaaaagtgattgatcattgagtaaaatcacattagcagcattaatgttacaattcagagatgataagttgttatagaactatggtgaggatatatgttacgtaatgctatacaattgtggaaatgtacttatactgagtaggcacagttttagtcattttggtccatttttagcagcttcaatttaaagaatcatacctcattttttttcttatatcatcttataatcatgtcattttctagagtttcacttggagtaagtaacttcaatgttatataatgtagaaatatggatataaagtagaataaaattttatatttttgtttaactttatatacatttcacatataacatagtttcttagttaaatgagaatagagggctatatttaaattaatagcaagggctggccacactgataaaatctttactgtgacctctaagtgttgctcagttgtatctgactctatgagactgcatggactgcggccctccaggctcctctgtccatgggattctccaagcaagaatactggagtgggtagccattctcttttccgggggatttcagagcaatgtatagtaatagaaatgacagaaatagggcta

SEQ ID NO: 38859 - DNA, 4637 bp, Bovine  19866880450872
gggtttatgtagcatcgtggcattggagggtacataatcttgccctctgtataaatcccccctagctttcatgagctactaaccatgacagagaccaccacttatctacagaattgatgtttttgaactgtggtgttggagaagattcttgagagtcccttggactgccaggagatccaaccagtccatcctaaaggagatcagtcctgaatattcattggaaagactgatactgaagctgaaactccagtactttggccacctgatgtgaagaactgactctttgaaaagaccctgatgctgggaaagattgagggcaggaggagaaggggacgacagaggatgagatggttggatggcatcactgactcgatggacatgagtttgagtaagctccgggagttggtgatggacagggaggcctggtgtgctgcagtccatggggttgcaaagagttggacatgattgagtaactgaaatgaactgaacctggctcacataggtctctgtgtgctgctaacatgcaaatgcttccttacctgctatattatgagaagctctgtttctcggcttgtcttacatttatgcattcattctactgcggcaacaccactttgtggctttgggaactcagcgggactctgaggggaccatgagctaagacatagcgtgcagcttttccacctactcctatacgtgctgaacacagctctcaggtttcatctgcagaaggggcagagtcttctgctctagaattcttaagcaaagttaggcattttatttgtcctccttctgacctcaagcagtgggctcagattaggatgggagtagatcagacttgggctttccaggtggtgctggtggtaaagaacccccctgccaatgtgggaaacgtaagagacacaggttcgatccctagcttgggaagatcctctggaggagggcatggtaacccactccagtatgcttgtctgggaaatcccatagacatggtgagctacaatccatagagttgcaaagagttgggcaccattgaagctacgtgacacacacacaggatcagatgcagggctcatctcaggggcacactagtgtcttggtttttctttcaaatctccatactcttccccatcagacaaatctttttgagaactggcaacacaggaggctttgtcctaacatgtcaggtttcttaagcttataaaattttctggattctgctgtgtcattctctgagacaatgaaggcagaacatctcatgaaatggagaatggtgataattacaatagtgtagatggatgaaagtatctgttaatatttcagaatttcatctgtcattttgctggcagtcaatattgccaaatacttgtcttttaggagtttcttcagtccataaataagagttatttgtcatcatgctgtgaaaagttcattggctcaagatttagaaggtttatgttctaagtcctagttttttccatttctttggaagcataacttctatgtcaacagtaagtgcaattccaactgtttgtctagtttatctgtggactttgattctgttgattgtgtagcattgggaaattgacctagatagacttcatgttccagtttttactatatattcccatagcactttgtacctcagatacagggacttatgtggtttaataataatagttaatatttaagtagcatttctaatcaccaagtattatttctagtgctttgcatgtactagttcatttgttatttatttatgagatagatactgagaaacaatccaaaatagagtaaatttaaacctacacagtctagttccaaggggtagtgctcttaattactgtggtgcccagtctcttaaaatagagagtaatttgaaggaaagaaatgggaaatgtattattgtgttcattactggagtactttccctagtttgatttataagcaccagtctttcaaaagtaaactatgattccattctgcctaaattctgcatatattatccaaaatttcaggtatgctgaggaagagctgaatgaatgctaatattaccattattagtattattaagctattatttttctaaggtgaataataaatacatttatttaaactcctcctttcaaaaatgggtttaggccagaaatcaacacaagtaactcttttcattcccacttggaaataataattcaaaaatagaactaactggataataattaagaaataatttccctttttttgggttctgcacattaaaagtttaccctggttgaacagtgtaattgcagtataacggcatgataagaccttattgccatctagtgtcaggaaggagcactgcagcaatgatgccttttcattcctcttccgctggcagctttcttcattgatggatctacatcgctattaacctgcactcccaggtggcactgtttgattgatggtaaagaccatcagccattgattctgtggcctattttaataatttgatttcagagtaactcatttcatttcttacttccaaagcatggtttattttatgaggatgctctccggggaccgtaagaattttcatccaagttagtaactgtgtctaaatagtttgaatgtgctcagccctaaaagatttctttactttagcttcaagatgctaaacatgggaaaaatcttcatgacttatatttaaattgttatgaaatgtttcagacactcagaaggacataaagaatacaaatttacgaacccagtgtattaaaaggtctattgctatgtaacaagttgcctcaaaatgcagcagcttaaacagcaaacatctgttttcttacagagtttatgtgggtcgggagtcagggactggcttaactggatagctcaggctcagggtctcttagaagtacaggtaagctgtgtgctggggttgcagtaatctcaaaccacttgagatttccaggctcacttggggctggaaaatctgcttcaagatcactcactcacgttggcggtttctgtttctggctggctgtttgctagagtctcagttctacaactagaactttttttttttactgcccacgggcttagttgctctgagacatatgggatcttcccagactagagatcaaacccgtgtctcctgcattagtaggcagattctttaccactgagcccaccaggaatgccctacaagtggaaccctcataggacttgcttctcctggactcagaagtgggatggtggcagggaggggatgggagggtgggagtgagggaagagtgagggaagccacagtcttcctaatctcagaagtaactttaacttgtaccagatgttactggccacacaatccagcctcagttcccagtggcaggggactccaagaaggtgtgaataatgggaggtagtcaccagtgatcactggagtcatcttgattgatggctgcttactagacccgtcatcaagcttttttagtttttctaattagagtataattgctttacattattgcgttagtttctgctgtacaatgaagtcaatcacttatatgtgtacatatatccccttcctcttggaccccaaaccctacccctttaggtcatcacagagcaccagagttgagctctgcctacctaaatggtaatcatcattatgaagtttatgtttttcaacaccataggtgtttaatacttgtcttagtccattcaggatgctattaatataacaaaatactacagactgtgtgactttttaaaacagaaatttgttactggaagctggaagactgagatcaaagtgccaagcatggtcaagtgaaggctggcttcagggtcgcagacttcttatcttcatatagcagaaagggacaaaggagctctcttgtccccttttacaaggctaagctcattcatgagggctctgccttcatgatcgaatcacctctcaaaggccccacctcttaatagcattgcattgaccgttaagatttcaacatttattaccatatatgtatgaatccataaaggatatacagtaggtattttttcaagctttgtagaagtggtattttaacataaacatcattctgtcacactgctcaacatgttttctgagatttatccatgttgatacctgaaattctaattttccctttaacccctttacaatatttcttgcatgcatataatatattttattttaaaattccctttactggacatttaagtgattttctttccttttgttattcctgcaattataatctttctacttgcctcctatatactataattgtttgttgtttagtcacagagtcatgtcctactcttttgcgaccccatggactgtagcccgccaggctcctctgtctatggaatttctcaggcaacactcctggagtgagctgccatttgcttctgcaggggatcttcctgacccagggatcgaccctgtgtctcctgcttggcaggcagatcctttaccacctgggagccacctgggaagcccgaatactatagtatttatacttaaaagtagtatacaggtcttgccagcttgaagcatgtgcaccatttacctagttactggatgctgccagatttctcactcctgggttttttcttctgcttctcttaaatta

SEQ ID NO: 38860 - DNA, 602 bp, Bovine  19866880481239
cgcagaaggagcacaaccccaccacttcctcctccggcgccgcgtcgcgggcccgcctcctacgccacggccacgcacgcgtcaagacgtcacacgcagctggttcaaggtgggagtgaggacagggagtgggtggggctcaaggaaggcggggcacggacagactttctcgcggtccgtctttactctcgcgagaagcatagcttctgctgcttgaagcctcaaacgtcacctgcagaggtacagccgtgtaggattttaagtggcccacttctgctatcggtctctcctacgtccttccagcgtaacttctcacaaatttattcagtattgccagatcctcccttgctctcaggctccgggctttgttgttgcacctgatttttttccccccacagaaatgagatttgagcaatggtggctcagcggtaaagtatttgcctgcactgcaggagccaccagaccagggacagaacacgggtttgatccctgggtcgtgaagatctcctggagaaaggcatgcaacccactccagtattcttgcctggaaagtcccatggacagaggagccctgtgggctacagtccatggggtcgcaagag

SEQ ID NO: 38861 - DNA, 1647 bp, Bovine  19866880504863
tgttaactcggtatttgaaaaatgatgtcccattatagctttctcttgcaggagaacctttttaaaaagccagcaagttgtatgttatcttcacagacagctaagactggagaaaaagtgaaaagcaatctacacaacatattataactgcatgtttactctttcttcatgatttagcagagtagaaaacagtgctgtgtccaaataaagcagtcaacaagaacctgttatctgactttattgagccaaaaattacaaaggttctatttattattagattatattataaaatattctgattttttactgagactttttctgatatcaacaaaacactttcagagggaagagctaggatacctctgagaagccactttctcttataactgataaaacaatacattcttatggcataaattttactctatcttgaattatagtaattaccgtgcttgtcaggtttcccttctggctcagctggtaaagaatccgcctgctatgtgggagacctggtttcgatcccagggttaggaagatcccctggggaagggaaaggctacccaatccagtattctggcctggagaatcccatgaaccatgtacagtccatggggtcaccaagagtcggacacgactgagcgactttcactttctttcagtgtgcttgtcagagcaagaaatttgcctttctcatctttgtattcctagcagcgtctgttagaatagccttcatatgaaagtgaaagtcagtcagtcgtgtccgactctttgcaaccccatgaactattcagttattatcaggaatgcaatcaaaataactcatattggatatccgaaggagttcataacagaagtttgggcataaggctgtctcttttcagacacaggcatccccagattgctgggctacctctgagggaatgaggacttaggattcagagccaggaatttaaaacacaaaaacaaccacccagctgcctgttaaacttcaaaaggaaaagtactcaagtataaataaaagtatcatgctttacgcgaacatccatgttaacaagtaaactctttttaggttggcaggaataattctaagattgttttgtctacactgcaaaagcaacatttattattggtagcatctgccataagaataccaactatgataaagtctgtatagtaaaaacactgagccctagactgggttaaattagaaaaactcagatcacagacatcagttcttttattcacttttcatctgtataaaaggttgattggcagaggctcttcaaacagacttgacagtgtactccattgtgaaatatatataataggtaaatagaaataacattttattttcaaattgatgtcttttaagacttaaaaaaaatttaccttttggttgcaacacagggcacatggcatcttaattcccagaccagggatggaaccctattccctacacttggaggcacagtatcttaatcactggaccaccagggaagcccccttttaaaacatttttatattgacctatggagaaggcaatggcaccccactccagtactcttgcccaggagcctggtaggctgcagtccatggggtcgctaagagtcggacacgactgaggacttcactttcacttttcatttt

SEQ ID NO: 38862 - DNA, 3954 bp, Bovine  19866880566306
tggtgaaccctcctggggaactcagatgtacttcgtcattttctgacatctgctctgggggggccttctccgattctgccggagtcctcttggcctgcatgcaattgcctagaaatgcaggggagtcattgttttctctcactcaaggggcactgggaacagccatccctccttcaggaggacggctttggagacatcctctatgattgaaccagaccctgtttctcacattggtgacctgaatagcttatccttgaactatcttttcttccttccatctcacccttgcattctttcactctcgattccaggaacacctccaagataaatcacctgcacccaaatccttgcctcaggctctgcttctgggggaacatccccccctccccccgcacccgcccaagatgacctgctatgcgtactgttcagcagaacattgtcagcttggttgcctcccaccagccttgactgagggaagagactgtggtgcccagcagaaacagcagggtgcctaatggatggagtaacacccagccaagagggtagaggatcaggaggtgacagtggaaattaagatagaaattaagatagaaactatgggctgggtgtgtctgtgaacatgtgagtcaccctggggaactccaaaagtacttggtgacacttttgctggaggcttcaaatatgcattttcaggaatgggtaagagccagtgggacactggttatgggaagatttggaacttcacaatgtgtgtgattctagagtcggcaaccaatgatgatgagtgacattttctgggagcaatgcagtatttctcaacttttggtgcacatcagaatcacacgaggaacttaaaaaacacagttgtccctaaaggagaatctgtaggggtctggccgtatttagttttgaaaattctcctgttgatgctatgtccaagaaagtttgaggacctctgtttagaagtgggacaaaacaaacataaaaaaaaacagggacagaagtcagaggatgcattaacacataagacgcaggcagagaaagatgagccctgaaaggaaggtaagaagcagcagtcagaaagttaggggaggaagtctcacgcaggtgtataggcccgttaagggaaggttgaacaagaacatggggtgggggcactggtaggatcagtttcagggaaataatgggggtgggtgtcaggacacagtggataaaagtgtggattgaagaggaagaagcacagagtgcattctgtcactttcaaatggctcacatatcaaaccctgcctccctccacatcatacccaccatgggagagcatctgtgatggtaagcctctatataacgctgggtttagcacagcccttcagcaccagggagactgtggctgagcctcccttagagaaggatctgtgagaatctctggtagaaaaatctccaagaaactaagaggggaaaaaaacttggaaaaagaaaaaaaaaaaaaaaaaaaacccaagcatttcaaaacagtggatgcaaagattgggatggtattttgctttttaaagtgaaagttgtctacataatacctctttcctccttggatggctcacaggcttcctgccccatgggaggctgtggtgtcctagagggaaaaacccttcagaacatctcctgggtcacactcgtcttgcactgtgacgctgtgtcctctagatggcaataaacctccacctttgagttcccctcctggcttcaggtcctttgaaaattgctttctggtagaaaaaaaatgagaggcatttcttcagaattgactggaagctgctgagaaagctcttccttgcctcttagttcttaaaaggcctttgcaacactggcaagagtccagtgtttggaatattgatatcttagcgaggaaggagctgctgcatttatgactaccctggagctaggatttgttgttagggaataaagagctcccagggcagcaaccttgctccttgggaaaccgtctttccccttgtgccccgtgcctgaatagctcttacccttcgtaacagggtcatggcattcattccacctcatgagccaacctttctgttttcggcacttacctgccatatgccatcaaattcaagtgttttagaagtctcattcaactctcccagctaggttctgttattctgttatttaaatagtgaactacttgaccagtatcagtcagattagagcttgaattattttttaaattaattttttattggagtatagttgatttacaatgtcgtgttattttcggctgtaccagaaagtgattcagttatatgtatacatataccactctgttttatttatttttttcttattatttttttttccactctgttttagattcctttcccatataggccattacaaagtattgagccgagttccctgtattatgcaataggtctttattagttatctatttaatatatggtagtgtatatgcgtcaatcccaatctcccaatttatccctttctccctgggtaaccgtaagtttgttttcaacatctgtgactttatttctattacgtaaataagttcgttcgtaccattttttaagattccacacgtaagcaatatcatatgatatttgtatttctctgtctgacttacttcactcagtgtgacaatctccaggtccatccatgtcatcgcaaatgacattatttcattctttttatggctgagtaatattccattgtataaatgtaccatatcttctttatccattcctctgtcagtggacatttaggttgcttccatgtcctagctattgtaaatagtcttactatgaagtgcagagcttgaatttttaatattgcctcaaggactaggttgaaaaacacctgcaaaactctctggtaggagccctgaggtgggtcagagaatctgtgtctctggggagtgttgctaaggccatgagccttaggctgtctgaagggtttctaaggctctccagctgtcctggagagggtcaaaaagttctgaagagaatcaaggtgtgtgtgggaagcaagcacagtggcccctgactactgctattaggggccagctccacctgtgacttgggactcggtttaacagtgggtatatgacaccatggagaaggcaatggcaccccactccagtactcttgcctggaaaatcccatggatggaggagcctggtaggctgcagtccatggcgtcgctgagagtcggacacgactgagcgatttccctttcacttttcactttcatgcattggaggaggaaatggcaacccactccagtgttcttgcctggagaatcccagggacgggggagcctggtgggctgctgtctatggggttgcacagagttagacacgactaaaggacttagcagcagcagcagcagcagcatatgacaccatcagggttcccaggtggcactagtggtaaagaaccaacctctcaatgcaggagataaaggagacatagatttgattcctgggttgggaagatcccttggaggagggcaaggacacccagcccagtattctagcctggagaatccgtggacaaaggagcctggcgggctgtggtccatggagtcagcaaagagttggacacggcagaagtgacttagcacgcatgcatacacgtacctatgacaccactgcatgcattcagacttttttgtttaatagtaactttcttggaaagcagtcaacctagtggtctgttcaaagcagtaagcacatgcagatcggctctagggatagaattggcaattgctggcctattgtgtctttgagtgagggcagctttggtttccagctgacgtcagaggaaggtcatacatgacacatgagctgggagaccttggagtcaggcttggtggagatgtctctactgtgaatttcttacagggagtcaccagggtgaaggctcaagtttt

SEQ ID NO: 38863 - DNA, 786 bp, Bovine  19866880591967
ctctattttaaaagtgcatttaggtaagattcccccagtgaattttactggggaattcctattaaactcctattttaagaaaatgatattagaaaagatgcagaaattgtggtattactctcccacaacaaaacaccatccttaattttttccctagggaagatcataagctctacttgctgctaatagatacttttaatttcaaaaaatatgaagtgatattcagaaagttaaagagttctttttctttgcttgactgtgaacaaacatttgtgaccaacattgacctaatcaaactaatctctggctaatggattttagtctcagggataagaagcattcaacctaaatctaggtttatctcaaaagagagaaaactagtaaaccaggcaataccagatgcaaatcaaaattatacaaaatgggaataacaggactgtttgaattagtttcagttattctgagcgctttctattctttatttttctatatcagtttctgaattatattttgacagaattgagcatgttctccattaggccataagtttgtgtatgcatttcccttttccatttcactttgccttcatattatcatttggttgaaatttagaggtgcctgacattgttgccataatgtcagtaaaatgagaactgtgagattgtaggatatacagtgtgccgagactataaaaaatacagggtcatagccataactgtggactgattgcgggtgtaataatggcttggtagaatcagcatctgtgggcaggcgttggcctggggg

SEQ ID NO: 38864 - DNA, 817 bp, Bovine  19866880626042
aatttatgattttaaatgtatgaattctgtgaggagaaaggggatagactttgctacaagttattaattacaaagctaaggttctgtttctcttcttatgtaaaatagtgttctttgtttagcttcttacagtgctaggagaattgcgtagttctattgattggttccatgcattagaaatctgacctttaacagatgtttgagaaattgccagcacagacagcattagccaactagacatgttccccttgttacttgacaggcctttagtggtttagtaacgtaccaaagaaatttaaacattttttttaataataccaaaatctttctaaaatattaaaagcactttggaaaatattgataaaatgagatatgtcatttttcccaaatcaaggattacagttaaggtagttttaaaatgtgattgtttattttataaaacaacaataaaacaagaaaatcctgtatgttgaatgaatagtattttactttattgaaaaatttgcttatgaaattgtcattcaggattaaagcgtgttttttattgccttggtcttttttttctcttgtgcagtgtaaacaattttagtgttcttatttgattgtaaatactgttcaaaagtatagaatttttacatagagattatgtatcactgaacactaaccatatctggaactcataactaggagcaggatgctgcataaatgtatgttaaagcttgttttctgaaggacagtctctctttagaggatgtaagagattcagctgtgtagttgagggtgttcagcatgaacactctaagctctgtttccttta

SEQ ID NO: 38865 - DNA, 1155 bp, Bovine  19866880628257
actaactggaaatatgaaatgcatttccaagttgaatttcttgaagcacgacagacaatgctgtaataaaatccagatattcccgccactgcattcctttcctctaatacttctgtaactcaatctgaaaagaccagctttggaaagattacttctttataagccactaatgttgcttattgcttagctgcagatattttctaggtactcagattgtcaaaatcatcaaaccattgaaaactaaactaaggatattttacaatttttgtttccttgttctaaaatggcaatggtattccagtagctcaattctgtgtttcctgacactatttctcaaaaaaaatcacaattaggttttctatctcataacctctactataatggtttttgaacctggctgcacattccaatcacttagggagctttaagaaaataaggatatccaaccccaccccagatccattattacagtgtttgtgactgggctctgggaaaggtgttttaaaactactatagtgcttggtgagctcttattttaactgaggaatctaaatcatctctatgaaaacagatactcagtttatcatgtgttcagttacagtgaaaataaatttttaaatattttagttttaatgaagtatagttgatttaaaatgttgttagtttcaggtgcacagcaaagtgattcacttatacatatattcatcttctatgtcaacaggttcttttctcatatcttattacatcatatctcatatcatttgacagaatattgggtagggttccctgtgctacacagtatgtccttgttggttatctgtcttacatatagtagtatgcgtgtattagcgaaaatcattttattaagattttaaaaggtgagttatcactatcaaccatgtttctcaattttaatgatgtcatcaattctcaacatttgtaaatctgttgagttgcttttccggttcaaagctgtaattttaaaataccccatcatgcaaaactcctttttaaagagtgagtcatgttaggaaattttgtccctttattgaaggattaaatgctagcaaaacttaagactctgactaacaaaataataatagaacaagagtctggttaggagtaaaggaataaatgggcacttaccttacgagc

SEQ ID NO: 38866 - DNA, 2207 bp, Bovine  19866880644172
aaattgagatatagttgttattgatggagtcttatcaattaatgtcagtctggatggaagtcaagtttttctagaaaggatttgagtttgtctttgctagtcatatgggtcgatacaaaactgagaccactttaaattctctccttgaaatttttgacccatattggtagagtaaatttagaccacaaatcaaaataagaacctgtttgtggttcccattttcaggggaaatttagttttcctccttccacccagcaccaggtttaaatatttaaggtttctgcctgatctcttcttgcatgcctacgtgctcagtcactccatcatgtccgactctttgtgaccccatggactatagcccaccaagttcctctgtccatggaatttcccaggcaagaatactggagtgggttgccatacccttctccaggggatcttcccaacccagggatcaaacccatgtctcctttgtctcctgcattggcaggcagatcctttatccctgagccacctaggaagcccttttccatgagaatgtagccttttggattttctgacttttgctcctgaaggggctgaactccttcccttacagattctccatcttgggttttttctctttcttgagagtacataaatcagtgcctttcacaacagaggggattccctggtaataaaacagggcacttactctgttctccattttatccagtgctgccttatgctgtgtacattacattaccaacctgtaacttacctgtcccaaccactagcctctaagcctgtgaaggtgaaaatgaaactgaaaacatctgactcggctctgtacacccagattctagcaatgttcttagaacaaactggcaacttaaaatgtgcactgaagaaatgaatcagtatatgaataacacatagatcaatcctctccataagtcttcaatgcaactgagaaaatgctgctatttttaaatctatagatattaaaatttgcatttaaaaatgtgttttataaacatactttgttgatatattaaatattcacaatgtacttctagatcaaaacagtagatattatattactttaaaatgatttctatataaataatatatcaaaatattaatagttaattgtaaaacagatttctagatacgtttcatcttctactttcccagacgttctaaaattccttcagtgactatgtaataacacacattacacgtaatacatgttcgttttctaaaaaaataagtctgaaaatttgagataggaattgtgtgttgtttccaacctctaaaaggaaaattgttactttccttaatacaatagaacttggatcccccaacactggcaatggaaagagaccctcaatgtgggaagaaacagctagactgtgttcccagatagtcattctcaagtaagaagaagcgaaaatgtgtctgaatctccagactggggagtataatttgaaagtttatttcatatcatagtgtaatattatattaagcaggggagggcagtgtgggagaacacacaatctgttttcataatagaaacaacagaaaataaagatcaaccacatcttatctgatggagctataattttatttattttatttttttgagctataattttaaaaggttaagaaagacaacactagtttcccaagattcaccttccccttggagttgttgttgttcagttgctaagtcatgtccaacttgttgtgaccccatggactgtagcccgccagggctcctctgtccatgggatttcccaggcaagaattctggagtaggttgccatttccttctccaggggaccttcctggatcagggatcaaacccgtgtcttttgcattggcaggaagatactgtaccaatgagccaccagggaagtccactccccttggatatcttcagtaattattgcagttactaccaacctgtcctgagctactccttaaacactttagcccaaacatggacgcatgtcactttcgtgagtatcaacaagcctggcccactgaaacaaaactttactaatgacgaaagggtgaaaaaatggaattctccatggagcttaattaaagctttatagtcagcttataaaataagctttactttctataaatcacagatcccatctcatcctcatgagagtagaaagagagtagatgttttattcagaagtatagccgtgcctcaa

SEQ ID NO: 38867 - DNA, 1482 bp, Bovine  19866880665868
caggtgagctaacagttaagtaggacacaaagaactccagggccctctctcctgctctgggcctgtttctgcccatctcaactcaagggcagaggctcattcttgaaggcggggatgtgagtgcacgccactcccttatcctaatagctgtttcttacgaatatctatttctcaataaaaagttcagttatcactataaaaacaataacaaaactcccactattttctatcataaaaataaaacaatagtttgctaggcagtttctgaaagtctgtttttttttttttttttcttttagtaaaattatgagggagcagtaatttgacaccagaaagaataaatctgagaggaattctgggactaggaataaagcgtgtactaggtcaaattctcatttcctctacaggaatgttagtttaaaaatgctctgaagtaatatatttatacaacaaattgaaatgagagtaaagaaaagtgtgaaaagttaagacttttctccacccaccaaagcaatattaacaataaatttctgtttacttccttctctaaactattagcaatatcatcatagtaccctgggaaataaatctgcatataagtcaaattagcaccaccaagattttcaaagttgtcagtggctcacttatgtcaaatacttaacaaaatataacatttggttggtgacaaccaaagaactagcttattgttcccctaggctgtctggaggctaaatttcacttccctcaaattcatctcaattccaaataacaaaaatattaagaaggaaaaatacatgtgtctggtacactccactctttaaactactggtaacttgtcctgggcaatcattcaagctatttttagtaaaccagatgtgttgagcaacaactaacttagggacattctgaaactgtggacaatgaatttatatatcaataacggaaaaattgtggttcaaaacagactgtgacgaaaaataactttctcactgaaggactacagtaatgataaacagagctgacacagttcagacactttcattaacagaatattttaaaactttgctcaagtctttaatcaatctttagtctaagaacgaagaaaatacttaggtttgctccacgcattcccttcaaccagcaattcacagcccaatagtaccatatcaaatacttaataaagtgttcaatgcctgtgttttgtgataatagaaaataaagtattaggagtcttatctctgaacttttagcagattagaatgaccaagtacttcaaataggattattccttcaggtctaggatgattctactttattctagggaaaatacctcattactacaatgaattttaatatataaagatagacgtaggggttaattaaaagcaagcacattctgcttcaaatcttgaatgccctttgtattattattcctttattgcaggtgtgtgcatggccagaagctaaaatccaggacaagat

SEQ ID NO: 38868 - DNA, 1646 bp, Bovine  19866880721538
tcatattaagcacctattatgtagtaataaatctgaagaaaagtggctttacgattggctaagcagcttcacagtgttagagtaccagttggcatctctgattctgtttacattaagaccctcaaggtcttaaattggcttcaggcataccttcacagaatatttccaaaagctgaaagcaagggataggagtgaaacaagagggctttcctcaagttgcaatcttttttgatcagggagaaaagtcattcccagaaacaccctagcagacttccttttatgttgctttggccagaactgggtccagttatgaaggagactgagaaagcaagcatctggcaaagcgaaacagggttccctcaatccctgggattgaacacatgcataccctttaaaaaaagaggggagtttatcttggcaacaaataagagaaaaaaagtggtttcagagacagcaatcaaaattgatttccacgaaaacagacatggagcttgcattttaattaaggagaaattttaaacataaatataaaaacaaggtaatttcatatgctataaatgctacaaaatcaggcgatgtgataaaaagtaatgtgcatattttgatggtaaagctgatagaatttgctagtggaactgaacatgacagcatgttaaaaagatgatttcaactgtgagtctcttctcgtagcagaagcacagagtactaatcacaatgggggctgctcaaggcatcacagggatttagaaagtttcttcctctctttggccaattttagttgaaataagcacaactgaaactgtaaccaaaggaggcattatgcttccagaaaaacctcaaggaaaagtatttcaagcaatagtagtagctgttggatggggctctaaagaaaaccagctcctgtgaaagttggagataaagttaagagttaattcttcctctagaatatggaggcattaaagtggttctagacagtaagaattatttcttattagagatgatgacattcttggaaaataagtaaacggaaataaattactattgagatggcaccacgtgaagctgccaatcccagggaagttttgaaatctttcatgtaaataatttctatgctttccttttataataaactaatgatatccaaattaatgacatccagtgtctctaaaattcagtttcattgcactgatttaaacatttccaaaacaaacagacaacaactccaaacaaaaaatgactccaaaggtaatactcatttccattcataaatgaagcttgagaaagataataatgagtgtaaagtcataccactattaactgatagtcagaattgaaattagtactatctgaaatcaaagtcaattttctctcccctatacatctatctgtggggggaaaaaatacacaaaatgccatatataaatttataacattgtaacacaaagaataaaaagtcaagtgtttgaaaatagttgatgcttagaaacttgtttctatttattatttttgtctttcattataggattggtaaaatgaacaaaatactttgtaaagttttgtgtctaaaccaaatatggaactatcaaaaatgttactgacttaaaaaaacaaaaaaacacccattaccgactgttagaaagtagcaa

SEQ ID NO: 38869 - DNA, 1834 bp, Bovine  19866880779802
tggtaacagtggactcatctccagcagagagagagagtggaatttagataacagagcaggcagacaataagttaccagctgtcaccccaagaccaaccacagtgatagccggaggttgttgcacagacctccctttctcagtcccttaggacctggtgagctaccctagcttctcctcttccccattcagcagctggattcttaaagcaattcatgctacttgcctacttaaaatcatccaagtttcacgtcgatcacaaaataaaaatccagacttcttccccttcatctgaccaggcacacctcccaccgatgttatccagaagcagccacacagatctcctttttgtttttcaaatgcaccagcctctttcctgcctcaagaccttgccctttcccattccttcagcctaaaaaagcactctagttctcttagaatctttttttcaaatgtcagctctcctgagaactctttactggccaatccatctgaagaagcaccctttccaatggacctgccccatcatatccctcaaatagagcaacgattagcacagtctcattacttgccttgtttactgtgttattatctctctccctgagtagaacataacccccacagggacagggtcttgactgttcactgttatctccctgacactctgaacgcaaagtaaaggcaaaagttgttcatataatgaatgactgaataaaatggtacctaacccacgcacacctctgccaaattcatccccaccatttactttcatcgtaataatattaatgtattttgacggctccttacagtttttaaatagtatattcttgtttgctatttatagcttttacatacattgttcatttattttgatcttaagaattaaccctgtgaggaaagtagggcagaaatgacccccagatgaaggattaaaaaaaaaaattaaagctgaggggcttcctcagtggtccagggcttaaggctcagccttccaatgcagggggcatgggttcaatccctggttggggaactaaggtcccacatgccatgggcacagccaaaaatttaaaaacataataaagttaaaaaataaatgtttgaaaaatttgaagctgagagaagcaaccaacctggaaagtgccaaaatctaaatctaaaatcgggttttgggaaatgcaatgatgtccgacaccaactgccagtgttaggccaccgaacttcacaggttatggacgcggtcctccacaaggctgccctcacttcagacacgagcctcaaaggcaggggtcctgctactccgtcaagtttgagagtttgctcgaactactcaaaggactcaggaacacacggtacacactattaaagtattatcactacaaacggacacaaatctgaagcagccgagggaagagacagatggggtgaaatgtcagggagctccaaacatgaagtttctggtcatctcctgtggagttctggatgatatcacctcctcccggatccaatgtgtgccagctctcaagagcactgccaagcagagacactcacccaagtctcccgtgtccagagtttttactgaggctcagtcacacactgcccacatctctgacctgtagtctactgctcctctggaagccagaactgatatggatggcatgttttgaagcccccatcataaatcacattgttagactggccagtagccaaaccccccaggcagacaaagacactcctatcaggtaggacatctgaagggcctagatattacctcccagcagctgagggcaaaggccagacatctcttttgggtaaagataattcttcattatactgggg

SEQ ID NO: 38870 - DNA, 1145 bp, Bovine  19866880818626
cccctgcaatggaagcatagataaccactgggaccaccagggaatcccctggaccaaaccgttttaatgctgattaactttcatcatcatatgaaaaaatccatataactatggtagttgtctcaatatttctcataaaatatatttactgaaagtcacatacttcatgaatatactataaaggcctactgtgatattgtgtttagctttttctagtaactgaaggattttttttttttaatagaattctcccagtccttggttacatcagcctacccctgtgacctcagcagatggtattggattacttagtcacattcctgtcagaccttccagtgcagaacctcatcggcctcttaaaatcgcagcacattccagtccgccactgacaaaatgtttagtagatcaccataaagagtaagttaccagtgcttaaaacatatcttttatagtttttcttaattgtttataaataggtatttttaacgaatgtcttaaaactaggcttaataattattattattctggttttatatcccttctaattttcttaatattacagcacttgcaaagtcatgtttcactcttacgatacaatagtaatgcatagaagctatacttgtatcatacaagaaaaagtgtttacagaaaccttcatgtattttctttacagagaattggagaggaaagctttcattgaaccactgcgttctgttgcatccacatcagccaaaaatgacctggatctaaacaggtcacagactggaaaagatggtcacttgcataggcattttgtggatcctgtattgaatcaattacagagaccaccccaggaaactggagagagattaaacaaatataaggaggaacaccgtcgaattcttcaagaaagtattgatgttgctccctttacgactaaaatcaagggtcttgagtgtgatagagataattattccagagtagcatcgtcatcttctagccctaagagccatgtcatcaaacaagacaaggatatagaaacagatctttataaaatgaagcactcagtgcctcacagtttgcctcaaagtaactatttcactacattgtctaatagtgtagtcaatgaaccaccaaggtcatacccatccaaagagatttcaaat

SEQ ID NO: 38871 - DNA, 1183 bp, Bovine  19866880835400
ttttcttgtaatcccatccaaatttgttttttatctggtagtttcttaataaaagtaactttcttaaaatttccctgttatattcttaatagccttttatactatctgtactatattttttgtatatatttgtgtttatttcccccaccagataagctccaaagagagttttgttgttttgttaattgctatatttctatacctagaacagtacatgttacatagtaggtactcaatattttttaatgagtaaagaaggaagaagagttgacttctaagtatataacaaatattaaatggtacttacaagaacatgtccctttcttcagtggatgggtctagtttctcagctttgattctgcttgttaaggagtacacagaccagtctgacttatccctaagtccagttattctgtgatgtttggttaatacctaaattctactgatatctacttcaaaattattctcagaaagcaaacatttttggttaatttacttcttcccaccctaactgctaccattgtctttaagcctgcaaacattgtagattgcacctgatcaaacagatgctgtattcaaatcaaaacaaatggaaagtgctgtgtattttggcaaccttcctttcttcctttgcctatttttaaaacggagctttcctaggatataatttcctgcatagtgtggcagctatggcctacttaaagtcttgcagtcttgcagtaattgaaatgtaaacttactgaagaattagtatggttttgcaattttttttaagcctagaccgtctcacgacttgaaaatagagtgtttacttccaagttgtgtataattgctgtagcttttctaggaaaccagtgttcttattctaagaatgttggggaaagtggcaatgaaaagactgggtagcagtagttagaaatcacagacatttggtcctgagatttactgtgagcaagaacaaagaacagggaagactctgggagattactttctgaaaggccctccaaaaccttgttgacttagtttttgaaagtgacctaatttttgactgaatatttgggtgatatgaagctgaacaaatatgccacatgcttgtcatttggtaaaatcttaaattgtctactagttttgtctgttagaaatttgtctaccagttataaaggggaaaaatgtaataaagaaa

SEQ ID NO: 38872 - DNA, 1590 bp, Bovine  19866880951316
aacttaccccagaagaaaacataggaaattgcttttcagtacatattaacttattttcctgataaaagaaaatcaaaataaaaatttagcccattccaattaaaaatacaaattactaatatttaagatagtgttgtattatttttaataacacaaaagttcaagcattccagagtacaaactgtgttattccaaaaaaaagagaaaaactctttatctaaccaatgtttacagaaatttggaatatttacataccttataacactgtagaaatctttggtggtgacatatggattaagttccctgaaaacactttaataattttattccatcaatctgtatagtcaagtatttaaaactggtaatgctggcaacatcattttctatccaaatccacatacatatagtgaagtgtgtggagggaatcttatgcagggattatgtgggtttatataattacttagcaataaggcttatttctggctcatttttacaccagaaaaaaaaaatatagtaaactaaagaacagatcaattcttccttctaaacaaaccctggaaatagttaatattcatgaacaagttgaatgacaataaactgagacaccaggtacagtttctggataaacttttatagctaccaaaatagtgccctaaaggcttgtgcagcatctaatgcccatttaccaaatggtggtggtggggtgcaaggcactgtggtctagggataaacacacctcttttataagcattagatttaaaagcagagaaacaaaaaaatgacctgttccaccttaaaagaaaaaaaaagtacaagtttattatacaaaattcaaatgaaagcatgctaaaacacacagaagagaaaagaagcaaaatataagaaatgaaaggacagaaaggaaatgacagaacagtgaaacgacattgactgtatgtaaggttataacaaacgtatgagaggaagccttgagatatgattaaatagaaggatttgcatcatctctttgaaactagtgttgctcttggttaaacgttttgactctagaagtgtagagggataaataattcctccaatttaggacagtatttgtgagtttacgataattaaagcataggtgtaatactgcaaagtgaaagtgaaagtgaagtcgcttagttgtgtctgacgccgtggactgtatcccaccaggctcctccgtccatgggattttccaggcaagagtactggagtgggttgccattcccttctccaggggatcttcccaacccagggatcgaacccgggtctcctgcactgcagacagactgaaattagacttaaataaaataaagtggtgcaaatcggcccccaaaagtaatgtttttgatacaaagtcacttacatgaccttgttaggcaatttgagatgacactgccctagtgtaggaaaggtaagcaaggcacacgtagcatttatattgggaagtcaagtgttctaggcaatctacgttaaactctcttccagagtttataaccagaattcataggaattttgaattagtcaaggttaaaatagatgaagatactcagaattaaactttgggggaaa

SEQ ID NO: 38873 - DNA, 2767 bp, Bovine  19866880964990
atgcttgagaaagaacaacaagatgagaaaaatggcattcaacatatctcatagtcactccttccaaagaagacattttaatactcaaactccacagaaaacgtcaagtagaacagaacaatcactcagtgtttgaaagaaacacaccccgaatgtttctcctttacccccacaatactaccaaacacaacacttctgaccccacaggtgtgggttttccacacatcaagcaattccataacatcagctgggtaccctacaattcaattctgaccttaatcagggttagcacagacccgcatgtcaaggactcagtctcataagattgtcctccacatcaaatacggatcacaagtactaagtctcaaggccacccacaacttctatctggcttggcttcaaatcagaagctcccatgacctccctgcttggatctgatcatttgctggaataactcacaaaaatcaaggtaacacttacgtttaccaatttactatgtaataaaggatgtcataaaaaataaacagctgggtaagaggtacatggtggctcagtaataaagaacctgcctgccaacaccagagataagagagacacagattcaattgctgggttgggaaaattccctggaggaagaaatggcaacccaatccagtattcttgctgagaaaatcccatggacagaggagccttgcagactacagtctgtgggtcacaaagagttggacacgactgagcacacacatacgcgagaggtatataggctgaggactgaaagggtactgagcacaggagcttcttcctttgtgaagttgaggtgccccacattcccagttcatgaaagtgttccacaacctgaaagctagccaaaccccatactattgggatattttttttttggtcatgccacacagcattcaggatcttagttcccccatcaggcatcaaacccatgcctcctacagtggaagcccagagtcttaccaccagggaagtccaccactggaatttttatagaggattcatcacattaggcatgatcaattattagctccacttccagccacactcccctttcttgcaaattgaggttgggtcaaagattcagagcttctaatcatggcttcatctttctggtaaccagtccccatacaggagccaacaagagtgagttcattagaacaaaagacactactatctcctaggaaatttcaagggattttggagctccgtgtcagtaactaaggtcaaagactaaatgttagaataaaagagtctcctagcacctctatttgcaagggttttaggaggtctgtcagtcctaaaggaaatcaatcctgaagctgaggctgaagttcccatactttggccacctgatgcgaagagccaactcactgggaaagaccctgatgctgggaaggattgagggcaagaggagaagtgggtgagagaagatgagatgtttggatggcatcaccaactcaatgaacatgagtgccagcaagctccaggagatggtaaaggacagggaagcctggcatgctgcagtccaaggggccacaaagagtcagatactactgagcgactgaacaactaggaggtctgtgtcagaaatttggaaatacatatatttcttatgattgcatacatgtgcaattataaaccattttaaaggatgctgttattttggttttcccttacttctcccccctgaaaagaaggagctacacttttcaaaagagggttctgtggagagaacattcaccttctctgtgtccagtcctgggaaaggagagagattctaactactaatccatccacccccatttactcaaaatgttgggagagggagaagagaatataacatagaaatgaaaactctacccacccccaagcatcaccaacaatgcctcaggcacatatgaatctactgagtagtacatatctgatgacaagatttgtaggaggcatttatctttgaaatagatttgaagagatttgttttttaatctactttaaaattcctactgggtaaatcttaagtggcaaaatttcagagtagaaagagaggtcatttacattcaaagagaaagatttggtttattagaactaaaaaattatagctctactgggtacgaattttaatttggccttctgtctagggcattgttattctatacaattacggaatgaacctgaataaaggaagtcatcatccatggagggttttcctgtaggttgaaagtccgttatgaaaaatcttccttttcaccctgtgactgtcttaacagcaaaacaagttaaagagaaaggtttttttggtacttaggaagcatcatgtgagtttggcaatggtgaaatccacagtaattgggtaaaatagttggatctgccagtagagggagtgcaagtcaaattagcaatagaaatcttcagaaataggaggttatgggaggattctaggaagttgcttgctaattagggctataacaaaacacagagttaaggcagatttttcatgataaggcttctgctggtgcaaatgcctgggcccaaatgcctggaataaaacattagtagcctatgggagtggcttagaagccaatgggagtggcaattgactgtggggcacaacagatttcatgtgtaacataatttatttaaccctatatttgcatctcctccccacttcttgtttagttttctgtacatatggttgtttgttttgttagcacacattatgccaggatgtctgtccaaaataagg

SEQ ID NO: 38874 - DNA, 1139 bp, Bovine  19866881087352
ttaagggaaatgttgaatatgtaacagatgggacatagaaacttaagtgagcttcatctgaagtacaaagactaataaactctgtttagttttctgcctcttgcagatgccttgcaagaaaagagctgggctacagtgagagatggaccaagatttaggggaacgtatgcagagctgagcctgattttgaatgtgtttagtttcctgcaacttgttttgctaactccatgcctcaagttgactgatagagctcattgcataaagtttcatagatgtctttttttttctgcagcagaatgtcctcaaggaagttcaactcaattgcctttctctgaaaaagacgctgaactacgtgattgttcgatggtcctggaaagaaatatctgtttcatttgaagtttccattttacccttgaaacctaggtttgatggtgtgagaaatgcttgccttcctttctttctccctggttgagttacagagaatcattaggtactcattagactaatgtgaaggcagataacaccggttatggagcccatgactcatttttaaattttaccagttctctttcacttactgcctaaattgcaggctttcttgtgacaggtagctctgaaatagtagatatcaaaatttatgacttaaaaaagttaaggtgcttatctttagaaaattcctggtatgagccaattaccaacctctttactttcgtgtgtgtttgtgtgtgtgctcagcctcttagttgtgtctgactctttgtgaccccatgaactgtagcgtgccaggttcctctgtccatggaattttccaggctaggatactggagcgggttgccctttccttcttgagggggtcttttgaacccatggatcgaactcatgtcttttgcatctcctgcattggcaggtggcttcttatcactttgccacctgggaattttgttttttgtgtgttaattgctcagttgtgtccgcctttttgtgtccccatggacttcggctgcaaggctcctccgtccgtgggattctccaggcaagaatactggagtgggttgccatttccttctcaagaattttgtcttggggcatgccatatgccagctgacttactgaatccttgcttttaaaaaaaatttttt

SEQ ID NO: 38875 - DNA, 1460 bp, Bovine  19866881161180
aaatactgaaaatagtatgaaatataaatttaccaaatacaggaagtatctaccttctcatgtaaattaaaaattattgataaaggagaggtgaatttaaggaaagaatcaggacttttataatcaggtcctcaactgacatatgtgaatgcaggttgagtttgagtcttgaagaatttacaggaaatccatacgcaatgattatgaaaggttagatgttctcagcattggacattcctccagcatcattgtgtttgtcctctttccttctttcagccagagctatttttggctttactttctctggcttgcttctatagccagtactgggcttcctcttcctttggctgccgtcttggcatgcacattattgatatttcttctaaagaagtaagtagttcttgctttgaccacacgcaatgtaagctcactctctctgtcttgctttcacacacacacacacacacacacacacaatgacgaaagccaaccctacagttagtggcttaggagtgaaatttaatacaagggttaaagaggtggtaaacatgacgaggtgaacaaaaatgttccagagacttccaataagttatttgtttcataaagaaagggatgactaagaccaaaacttttttcttattctgtatcttatctctattctcatagcctaaatttaagtatttaagttaattcttgtagctcagctggtaaagactccacccgtaatgtgagagacctaggttccgtccctggcttgggaagatcccctggagaagggaaaggctacccactccagtattctggcctggagacttccatggaccgtatagtccatgggattgcttacttgatatgtttcctctttataatgtactgagaagtttaattggtatctatttgctattcccagagtggggaaagccttggaaggggataaataaattagcccttgagtttggggtctactttaggatgcagtggggagaaatttctaaaggaaaaaagtggaagtctaaggctagtgaaagaggaaaggtcctggctgcatttttacctcagtgaattctttctgaataagactgtagagtttgttcacatctatcacaccaagcacagtatttttagtaacagtaatacagagcagcagcttgtcacttggaggctgaactaataagcatactgttcctcttacacacgacaagccacgcatcttatttccactcatccttacagacgctcttaagctttccgtgtttctttacggagatggcaaggagtactggttaataagctcttagggttattcagaatccctcttcagtgctccttttctgaagttggaaacactcatgcatgtgcacacatgctcactaacctttgtcagaggtgaagcacttccaaacgccactgaatggattaaaagaatcctgggcttgatagaactcataccaagagccagg

SEQ ID NO: 38876 - DNA, 875 bp, Bovine  19866881212230
acctgtgttccttgcattggcaaacagattcctaaccactgaacccagggaagtcctagaaaatgtttttaaaggaagctagaggcaaatttctcctagaaaacttaaggaaaaacaatctttgaacttctgcctatgacttcattcatttctttcctaccactcagtttctaagtcttatcaacatttatttaaaaagtaatcaaactccatcttctaatagctcacgattcttttgactctttctcagtatgtggctattctgtttgaaacaaaatccagatagaccaggattttgcatctgagcatcaaagcaagggggtagagctggaaatttgaggtctctgtaattggagatggtgaatataatgtctcaagagctttgattatagaggccttggtgttctgacaaatctgagaataaaatatatatgaaaactgtttcttttgtgtctgacccagcacagatcaacaggtgaattattttttacagatagaattaaggcagtcctactggtgtaccagcagatgcatggttcaaggacattgggcattctggagaattctcttctgctcccttatttgagaaacgtctaatgcagaactggttaaatcattgcttttctgcctttattcgacagacttttccctagtatcagcttactggtaagaaacctgcactgaaattctactttctttggccttccctctgtcaaactttgttgaatagaatgcctgactcctgcctaacttggctctcttcatcttggctcaggctgaagcaactggacagcttggctcagagtccagggggttagaaactgcaatctcgtggccaccctgcctctccctcacatgggctattcctgcccagt

SEQ ID NO: 38877 - DNA, 1949 bp, Bovine  19866881277289
acagtttttgtgggtttcaaaaaaaatttttatttacttgtgtccgtgctgggtcttcgttgctgcataggcttttctctggttgtggagactagggccgactctctagtttcagtgcatgggcttctcatttcagtggcttctcttgtcatgaacgtgggctctagggtgtgcgggctttggtagctgtggcttccaggctctagagcacaggctcagtagctgtggcacacaggctagttgctgtgcggcacgtgggatcttcccggatcagggatagaacatgtgtctcctgcattggcaggtagattcctcactaccgagccaccagggaagccctgtgtttgttgtttttgaagggggttgttgggagatggaaggcatctcttgcttcatattatgttggaagatactagaaactaaagttgttttcaaggttgaaaacaactcatttaattcatcataagtcaaattaatattgactgagtgcagtggaaagaaaaacctcactggaaagcactctataacctcttaattaatatcagctcattaactaatagtctgaggtgaattccagttccaaagaccataacctcaatcagtcccttgaaatttttttcttctttaatatattgctgttttttttatattattccttaaaattgagaacaaattcaatattccctttcttaaattgtctctaccttttgcatacatctaatttatttatctttccatgtgcttagtcactcagtcgtgctcaactctttgcaaccccatggactgtagccagccaaggttcctctgaccatgggattctccaggcaagaatactggagtgggttgccatgccctcctctgggaatattcccaacccagggatcgaacccaggtcttctgcattgtgggtggattctttaccagctgagctaccagggaagccctattttcccatagaccatcgaaatacctagaaactttgaatgtttgagcatttggaatatttgagttcaaagtacattcttcagactgcctcattcatcactctgaaattgcacaaaaattatttgtctgactatgtgttctagtttttcacttgggaattatgatcctgtagctaaatttgccattctatagaacttgaacaattctaacctccaccaagctctgacttgtcacttcagccagttttggggacagaactggagtcactagttaatgctggttttaaaacaccttttagttacatggcccttgaacagctctggtgcagacagacttatcagagaggtttacatgatcattttccttgccacccctttcttctttttattttctaactcccagcttccttacatgtatctagagagctttccaacttctcaggatactctgcactggagaacttctccctatacactgccttttactctgcaaacattctggcccccaccttggacaaaacatttctattctatgtcaagaatgactgaaaatatcttgaatattataatgctagaaaaccaatacacttttaacaaggaactttagagtattaaaggaatgacttgtgatgggaatttctgatgacagaatagccaacgcaatggacaaagtaatggacttgtccctcgggtctgtgaccctctctttccctgtgaactgacctttctcccaaacgtcccgccctgtgtcctgggaatgggcctggctgctgagctctgctggatttgtctgcttccttggttacacagattatactaggtgagcaactgagttcagctggtccaaccaagttttctctccagaaatttggagccggaatcaagagaaagtttgcaatgttataatgtgaacttgaagatggaaattcagccatatttgccttgtgaccaacagataagacagccagcctgaagatagatgatgcagtgccgggcagaataagg

SEQ ID NO: 38878 - DNA, 1071 bp, Bovine  19866881532387
tggcttgaaaaaataaactttctcggtgaagttctggtcagatgagttggagtagaactgaatttgatggtgtttagatcaagacagtggttgtcttgtcaaataatgacttgtttgaacctaatgttttaggtatagtggggagaggacaactcatctatgtatgtatgtattgcttcccaaaatactcagtttgatttgtttgctaccaaccttagatgacctgaacctatttggtttgtatattgcttctaacagtgaaacccttaaaaaggtgacttatataaggcttacagttagagaacacattagtacgtttcaaatttttccttaagacattcttgtcaaagatcaaatcttaccatggatttatttcttaggctctgttgttatgttactgctaatgaactataacttatgaatttgcatttttgcatacatttagataaaggaattttcttcagtccttagaacacataggagggaaggttggtaacattaatgttaggacagcgtaacatggacctttctcttaatctataattctaggacgacatagacagcctaaacccagttctcagggacaacccgcaacttcaggaagaagtgaaagtctgggtaaaggaacaaaaggttcaggagatttttatgcaaggtaactgttttgagttatgcattaatttttttgttttttgaactgggcaatttcttgtttgcttttggttgtttagttacatgcagtataaatagaagacccagtctaatattttcaattatatacaggccccagaaaataatagcaaaatcagaataatttcaataggaagttgataactttgctagtttactaatttgagctaaatgcctggaataaaattctgaccacacaggtgttttgttgataggaaaatttccgtattacggacgctgtaggtgtgtccttcctggagaaggaagcattgttttctgtggaggattgcccagagccacagttgatttcctttgaagaatgctgttggtatctgataaaaatggcttatttcagtttgccttcctcagcaatgaccacaa

SEQ ID NO: 38879 - DNA, 1989 bp, Bovine  19866881604032
atgttcattgtgatgcaaagtaacatacatggggagatgagaggttaagaacaaaaataaccacgtgtcaaaggaaatatatggcatatagtacatagtacaaagggatgatcgatatgctgctcagatagcataagatggcttccacaaattacattcccactttcaaaatgctgccaatccccttagaagcctgagataagaatctctgaactctctgcactagcatctcaaagcagctgccaaagcaataccaatgcttatacacccagaatgcaccaagcactgactccagcattttacatgaactataccatttaatctctcaaaagtcccatggggtaggtactctgcattcctgcttttccagataaggagttgagacacaccaaggtcaggtgacttgtctggggtcacacagcaagtaagcgacagagcgggaaatccaactcaagcgtgcatcctcttcctgtgccagtgtcatgcctcccacactccttgctctgagccaaattcacatcacaacgtctttcagttctgcacatacactcccacccacatccaacttccatgtgtcttacactcatttgtttgatacttcttgaccccacaagccctttcattccctctgccagcttctgcctttccatatcctgtcacagtcaagcaagcccagtcaggaatattttccctcctgcctggatcaaattgttatcattatgaagatgactgtttactcattgacatcatcacactaatgcttattaaactcatattactgctgaaaggcaagtgtgacttgatcttcacagtgagtcattaagtgcaaccaacactcaaagaaatggtaaattgatggttgtgataagcctcctaatcatcagattctttttgatgacctccttgttatcagcaagtatgctgataggaccttaatagtccctttaccggcaagtcaccactagcctccttgagaatccaaaatgcaccatgtatgtgaatgtgtatacgcaagtgggtttacatgtatacacataattatttacgttattgacatcctgccttgtttccgattatggtcacgtaaattacaagatgccacaaaataaaagcaggtaaaaaaatagaaaaacaaagaggatcataaagtggggacaggagtaaagctaaaaatgcatagcacttatcctccccagtgaccacagatttggccctgaaaccttcaaggaacctgaagtgaaaagaaaatcttgatccatttctttgtcacagagcacttatcctccccaatgaccatagatttggccctgaaaccttcaaggaacctaaagtgaaaagaaaatcttgatccatttctttgtcacagagtctatgaaaaatcaaaatgactgctataggaattacaactaatatcaataagcccacaagagaattttagctgaggaatcctcaaagtagggatattatagaatataaataagcaatggtgtcaacagtatccttacaacactcataagtttcaactattttcacctaccttcattgtgattgatagtaacatagccaagcacaactcagaaaaggtaattcttggaggcaggtgggtaggaagtaagatgcacaaaggatcaaatgtatattaatatatgtaagtacatcatatatatatatatatatatatatatatatatagtatgtgtgttaatatattattcttaaatttcttaccaaaatatgctgatcaaaaaaaaaaaaaaaactatattcagtatctgcaaatgtagtgaaaatcctagtcagcgaccaggagtcctgcaactggtatatacatcacaactgataagtctgttttctgactctgttaaaattatggttaatgtaaaatcactactagtaataacctaaaatcattatcagctgcagtgtgtatgcactgactcttatctccctagagctcacaattttcactggaatagacagtggggatta

SEQ ID NO: 38880 - DNA, 2844 bp, Bovine  19866880426676
tctgggtccctctccccgcctcggtttcctcatctgcatggggatgaggttccagctctggctgttgagggtacttagatccactagggggcacccgagtcctgatggtgctgaggctgcgggagcaggaaggtgccaagtgaaccctgcctggtccaggaggaggagctctggccttagcccttggatggaccagactctgggcctggggccggtggcgtgcccgatgctctgcccagggggcaagggactccagtgcctccccactttgatttcacagcgtgcggtctccacccttccctgctgaccccccagcccctagtctgaccttcagacaagtctagaatggaacagtgagtgactcaagggtggtctgttcagttgccctaactggtttacaggctgaggaaaggccaggcggggtgaggtggctggggcaagttaggtcactgaggagctggcagcaaagctgacaagttaggaccaggggtgtgttccctcttggtcggatgcccagtgtggcacggttgcccctggggaaagcctcagtactccctgacctgaacagagagaagggtcggggtggggcggggaacaaaaggattcctctcgcttgtcctctgcaccggctcgagggagggcgctgctcggggcctaagcagcccccaggtgattctgtgtggcccaagcccccagggcctgctgggcacacaccctggctccccgtgtcactcctgccctgatccccttctgggaaaaggacaagaggcccctgctgccttctctactaggtcctggagaggaagctgtgaccgcaggcatcctagaggcccaggccctatgtggccaggaaggagacctcagtgggggtgacagaggccagagggaaggcaggggcagcgtcagccccgaggacccggtacagcagctcctccttctcctgctggagctgccgccgtgattgcgactccttctccagggcctcacgggcaagaagcaggtcctccgagagctgcctgtggacacaaagccggcgctgcctgaggggaccacctctcagggcctccagcaactgcaaagaccagcccattcctccagaaagcctgcccggtggccccacttgaaaaggcaactccagctgttgaccaaggtggccctcagctttgggttcagatctgctccacctctaagaagtgtaattctgccccaggtattcactctgggcaaacttgcaaaatgggaatgctaacaggaccggctctcagagtcagtataatgatcaggattagatgagataatatgttgtcaacaaattacatctgacacatgatctcagctgtcattgaccgaccccttaccactgattcagtcattcttttggcctcttgaaccctaagcttcctgttccttcttcctgaactgggctttcccatggagcccactcagctgggatggggataaacagatattaatcagtcctgctacttctgtttccgggcagagctggtcccttgggactcctgacccccaagcaaagaggagccaacctcctcccccagacaggcttgggcctcctgcagactctcccaactggaaattcacaaaaaataagcggtggggtgggaggagcagggcatgggagcagctaccttgacacaaccatctggttgcgtcctctggcgtggaggtcctcgttctcctgctgtagggtggtgatcttctcctccaacagcagatttttttctttctataacaaatcagagtgagctcagaaagcccccggcacaacgtgtactatcacctccctcttatccgtggccaccaaaaacactgattcactttagaccaaatgttacatttcacgaggcactaagattacttggaacaatgcaactaaggcgtgaacgcaggactgccaacttttcacttcgccagatgagtattaaaaaaagaagacagccactaccatctaaaatctccatcagttcccaagagaaaaaaaaatagtttggttctccaaaagacagaaataaataatgtatataaatgtaagtgtatctgttatgctaatccacaaaaaatggttgaacaaaatggataagggtccactgaaatggtctaactttatgttgtgcggcacacaagaggccagggaacttcttccaggacaatgtaacataatctgtttggattcaatcctaaatcccccaaggccttccttctggagacaaagccaccgtgtccctgacgcccaccactgcccaggcccgtccttgctgactctgatttcccatatctgtctgattttttttttttttccggcattgactccttcctcaacccttgccagacctgtgacatcttccaggccctcctggttagccaggctacttgctctggtgtcacccaagtgatagcgtcgcgcatagtcaaaaagtacaagaccaggatgagaaggagccactgctgggcccagaccagccccagggactcaagggccagcatgggcggcaagtcaaagctggtgtggaccaggctgggccttcctcagagtataatcagtacctaccctctgcacacatgacagaggaaatacccagaaagtggaagcgtaaggctgccttcccctagcccccttccccatccctcatcccagctgctgccagccacggaccactgtctccatgaggatcagccgcttgtccagctcatggattcgctcattcttcatctcgatgacaaagtgtaagctctccagctcctgctcccagaactggctgaggctcccgtgctcctagacaggaacacagagtaaccttagaccagccagcatggggaggggag

SEQ ID NO: 38881 - DNA, 881 bp, Bovine  19866880474264
cagctccctcctaatgacgtggtgccagatttcaaacccagcacccagtgtgctggcgggcaaccccaggagccagccgtggaggtgagatccagcacgctcctaattgataaggtatcagctccacctaccgccaccagcaccttctctagagaagttactcccatctccagctccaggcccctgggcccagatttcatgtccagctccctgctcattgatgtccagcttggagccccagtggtgtccacagagcaagagatgtccgggcggacaactgccaccacgcccaccaaactgtacagcgaggtccacctcacgctggccaagcctccatccgtggtcaataggacggccaggccctttgggatccaggcgccgggcagcactggtcagatggagcgaagccccatggtagagagacgacatcgtggggagaagacccccgtcccccagccccccagtgtggcagacaggagcccccggccacagagacacgtaatatcccacagccccatgctggagaggaggcccgtggcacagcgaagccccgccttggagagacgccccctgggaaacttcacccccacccacccacctatgctgagaccttgtccacagcccctctgacttccggggttaggtctcccccatcttattctgccctgtaccccagctccgactccaagccttctcatctaaagggccaggcagtccctgccagcaagacgggcattttggaggagtcgatggcccgcaggggcagccggaaatccatgttcaccttcgtggagaagcccaaggtgaccccgaatccagacctgctggacctggtacagacggctgatgagaagcgcaggcagagggaccagggggaggca

SEQ ID NO: 38882 - DNA, 765 bp, Bovine  19866880538761
gccccagctggacccttgtccttgttgtcgggaggacagagacgatgtggcagctaatactgagtggacgccctacaggggcacggagtgatggatggagagagagcacggtgggtagacacagtgagggccagagaacagagtcttgtagactccttcctaccagcctgtggtcctccaccaacaggaagtggcctctccatgaaagactgtaagcggaatggacctcaggtggcaagggaggtccgagaggccaccgactgcatgctggatgctctgaggcacgtgggcacctgcttgggctctcctcctggctggcccgggccacggcggagtattgcttgtgagtgcttggccagccgggccccactccccactctgcaggtcagtctggctcagcgtatggcgggatgtccctgccgtcacattcagtccggcggtgggggccgcagctacctggtgttctgcagctcctcccggagccaggtcggcagtgtctggcccatcttgtacagcagcttggaaagctcgacgttgtggtcccggtaatagtccttcaggaaggcgcgggactgcaacaggaagggaagctcagacgttggtcatgtgctggttcgagtgacccccgcccccgcctctggaaaaccagcaccccgctgccattatcccccactcccattatttattcacagccttcttcaaaatggtaaccttcaaaagaaaacatatagtagaagcagcaaactatagtgcacaaggtcgaaa

SEQ ID NO: 38883 - DNA, 1923 bp, Bovine  19866880592289
tctgtgtgtcagggaccatgctgagcaataggaatatatgacctttcctctcacagagtttaagactgatgggaaaacaaaatcagttaatccccaggtaaaggaaaaactcaaagtaatgtgaaggagagagaagctgtgcgtgtgagcatttattgtagggaatttgaattagataagtctacatctgaggattgcactaggatctgaggacaacaggcagagaagggaaagaatttagggtggaggaacacccaaggcaaagagcttgtaagtggaaggagcaagttgtagaccagtgggcaagtgtgccatagtggagcgttgcggtaggtgaatagagaaaaggatttggagtcaaactgtgcagaactatgtggaccaagttaaggcatttgagaagcctttaaagcagaagagctgacaggatcagataagtgtttctaaaagataattactgttgacttgatagaacaagagtgggtatcaggagaccatttaagtgctctcagaggaaatggttaaatacctttaggacacctgtaccatttaataagatgcaacctttaaaaagaatgaggtgaatctattaatatatgtactgagtggaaaattcacacataaagtaaaaaagttttaaaagagcaagtttttttccccttatatgaaaaatataaagatctatatttattttgcacatataaaaattctatgtctatgcctgcattttttaatgtatacagaatatatcatacctgtgcctgtgtgtaagaaagatttctaacctgtagtagtggatacctgtggtgaggagaagaatgaacatgggcatgagacataaaagagaaattttcttttctattctttatatttctatactgcttgaacttttcacagttgtatgtcttttatgattaaactatatttttgaaatgaaaatatatgttggagtcgagaaaatagagtatgaaatgtcacacttggaaatagatggtcccgtggccatgccaggaaaataggattggttgtgaggggaattaagcagtgaagtaaaagagcagtgaaaagagaacatggaattttcaagccttttcattgctcatttcttctgttgttgaacttgaaagttccatttcaattctgaaaatagatcatgtaaggaagaccgattcttttctgggaggagacacttgcccactttaatgtgtcttttctattcattatatctctagtcagtttacttgatgtatttcctaagcttcttgttagctgtttcaaatactttgatttcttacagatgaacaaactgattgaatattaccagcagcttgctcagaaggagaaggttgagcgagatcgcaagaaactggcacggcgtagaaactatatgcctttggctttttcggtgagaacttggtataaagaggagtttccaattcactgatcaagaccagtatggcataagagtggtgaacatttaagaaagtggccattgtccctggattcctgaatgatggctagcaaaaaaaggtcccttaggtgataggtgtctaagtccaacgggtatgcttttgccatatcattaggtctgtgagttctttgagttttaagtacatttgtgtttctttctccatcactcccctctatatcttcttatttcctaaagaggttactattagttttgtaggcacccacatttacagcttttgcatattacagaaagtcagaagaatatgaacaaatggtagattttactcatgttacacatgtagtccacccacctctggcatcctggtagtagtgatttctggacttcagttatcataattttttggcaccttccagtatttttccaatgtgaaaaatactgacttttatactgagcttttttatggttaaataagtagtaatatatacaggtgt

SEQ ID NO: 38884 - DNA, 1983 bp, Bovine  19866880598786
tctgcccagaacgtgggggcatgtgtgggggagtatgagtgagctcagctccttcatgccaagcccctcccaggacagagtgaaggccgtgctccggacccctgctcccttcgacccccgagggccagcaatggaagagcccaccctccatcctgcagttccttcggccaggctgtctgagctctgccctcaactttgttctctctcctgttctcaatacactctgcctcaaatctgtctcgcttcttcttttcttccatgctcactggctggtggtctgggccctctccctcctccccgattctggcctgggaagtggggtgggactgtccagttactgtgtgtgagcctgtggtgagagtccgcatgctgcctgcatctgctgagtgtctggatctgctgtgggtacagatgtgtgctggcttggaagtaagggctcccttctctcttccccaggtcaagcactcagggaaccaaaaatcccttggaagacatgttctgtttcctccttcctttggagtttggccaaaaagtctgtagatgggaaaaaccccacactccttatggtccagatttatttgaaatctttataagtgcctttagccagagcatgtacacttttttttccccccttagtttccctcagcatcccactctcccattatctaaatctgggagcttcccagtcatcactgcatacaataagtttcttccccttatggagccaaacaaactgccatcgagagccagaaaaaatgggttccagcctcatatctgcacctgactccttgtgtgaccttagacaacccctaggccccagtctccccttccacgcaaagagaggattacagaagctgtgggctagctggctgtctttggtctctgatattcctctttgctctattcatggccacctcacacacatgccctgctttggggctggtgctgggttaagtgggtgctcatttctgaattttcacccatgtgcatttccaggaagctctgaggtagatgatgaattgagatctttttcagaaagtgagtaattctgattgcctgcagcatttttgtattatgtactccccccacccaggtgcacatgcacacggacacacacacagtcagtacccagccagggcagtcctgatgaggtcaggccttgacccaaaaccaaaagctgaggccttgctcgccactgcccccaacttccaacccacacattctgagaagtaagttctgttactccttccacttactggccctagccttcccttgaagccaccaaaggcaaaggcagtccttagagatgtcagacagttatcatagctcctcctgcctcagcctgctcttttcctggctgaaagccctggttcctctgccttagtgcttgttgataggcttggatcatgaactcttggccccacttcccacagcccagctgattgaaagattcctgagatggctcacagacagcagctcgcactgtctctggctcatatacacaactgtgaccctggaataaaaggggtggagcccatgctgagctttaactttcctacttgatgattggagccttggatgtccccaggaggtccctaatattaccaatcccatgaaaactctttagactgtgatacattcctctttaggttaaaagtctccatttctgagtctgggcccatctagtagctgctgccttgtttggagaagacaaataatttaccgtttctttttaattgagagaaatgagattctgactagctgagaggttgactggttaggctgtgaaagtttactgattggatgagagaatggagcttatgagtggttctagattttgactgggtaggagacactgaacagaccagctagttctggactcagagatgactgctggttaatttggattggattgcagactgattggactgacttttgctggaatctgattggctaaacagatggatggtttagtatagtagt

SEQ ID NO: 38885 - DNA, 1889 bp, Bovine  19866880631664
cctttgagagacttccctgacccccagatctgagggggacctccccattttatgtctcttgttactgtttactatctttgtggctttctcccgatgtggagttatcccatttactggtttggtaccttgtttaatattcatcctcttttatgaccatgagcaccaagaaggtggggctgggtctcattcctttgggtgtgcccagcacccaggacagcacctggcatatctgggtgctcaatcagcgtcccatgaacaccaggtgtgctgtgcctcgaccgcgccagtccaccttctggttcctaaatactcccttggacagtggcttcccagcctggaatcccctggagagcttcagacattcctcatgcctggatcccacatcccaagggtgtaatttaattagtctgggctgtgacttgggtttttggaaatgatccccaggtaattctaatttggacgtggttctaaacccgcagcatcagcatcattaggagattgttaggaatgcaaattcataattccagatgtaagggatcagaatctgcattttgacaagacaccggtaatttgtatggactttaaactttggagtgtctgctctgaagctatgttcttgcccttagcatgtggttagggtggtgatggtggtgactacagttggggaagattgtcttcaaagatctccactctgaacagtgggtctgagctgccttagggacccccaggatatgggggggcattctggtgggtgaggcaggtacaggagggggctgtgcagccatggcttgcgcagcgtggaagggggttggcagagtgtccaggtgtttgtctggcatagcggcaactgtctgggccagggcccagcaggtgtgggtttcacagaggccggtacaggatgttcacattggccctcacgggcctcccagcaggctccgtgttgcaccgtgcgctgctgcctttcatgtctctggctcagcgttgctgggagcccagcactttctagttactgaactcccccgtagacagatcaacatcctgcagggaaaagaggctggggtggcggcggtcctccgaagaccggggcccaccatggcacacagcccgtgtgaatgttcgtgcggaagggagagccctgccgaaggtccagggccagagcctggggcaggaagtcagggcaggcaacaaggccagcagggccactgcctcacacgcagatgctggggctcgcccggccgtggctgtgtgactagtggctgtccggtgccctctctgtgctttatatcacagttggtcaagggagatgtcccaatccctgagatacagcaggggcagggcttgagccatggcttggggtgacaggttgggttgccaccccctgcagtgagggagaatcaggaaccagggtcctccctggatgctgaggaatcttgggcctgttcaccacagtctcagagcctcatccacacacgcacgagacagaaagaaacacgtataggggaatggaaggagcatcgcctcttttcgggaaggtaactaaggctttgggggagtgtagactctggtctgtgcagtaactgccaagccccctctctggtgacttaagaaagctctgacctcctgggaggaaggtgcccaggcctaggtgagtgtgaggggctagggggagggtctcagaaccttcccaaagaagtctgccaactgcgatgcttttctcccagcttcctttagcacgtttctttgttcattcctcctggggcctgtggtggggagcgttttaatgctggatgtttggcaacacacgccaagcttctcctgctggcactcctgggtgactctggcagttcccagcaggggccatgcccccccggggtgtcctccatccccct

SEQ ID NO: 38886 - DNA, 1308 bp, Bovine  19866880666538
gcccgggatgagactgcccaggaaaaaaccggttaaggtgggaactcacatcagaccaacttattacccgacccttccaaactgcggtgtgctgccggttaaggtagttgtggtcgtggcgcggggcctacgccttcaaggctagatccgaactcaccccacacttaacaggttttttcctaaaccaagaccgccgcctcccgagacagggcgcgaaacagagtctgggtcagcccgccgtgctcctctcgcccggcactaggtttgtctcccgcagaaagacctcagccccaagccctaggccccgatgagcccccgggccgcaggatgccagccgattttccttgtccagggatcctacctgcgcgtcttctccagactccgccaccggaaagagagggtggaagggggcggggcgacgggtcacgctcttgtcccggaagtgcacgtctgaggtcacggggcgaggacagctcccggaagacgccgattttagcgtttccaaggacattaaaacgcctggagaacacggcttactgaagggagcgcctgaggaggtaagggcctgggtatcttgacgagcggtctgcttctaagactgaaggaagcagccacacgccgtgggtgtggaaggcctgtgttctaagatggcggtgaccgcggctagaccaacttccaccacgctgaccccggagcctgcttagcctgagggcggcagctcccctcgcggtgcggaggtaaatgacaatttgtcattcgtctgtcgtctctgactctgcaatcccttcgactgtagccctccaggtttctctgtccatggaatcctccaggcacggatactggagtgggttgcctgccattctcttctccaggggatcttcctgatccagggatcgaacgtttgtctcctgcattgcaggcagattctttacagtctgagccaccaggaaagcccttctaactactgaatacttggcaaaataagaataaattattcaatatttgtcattttatgccagcctatattcatatgcattgcttcatttgatcctcaccacaataacagatcagatcagatcacatcagtcgctcagtcgtgtccaactctttgcgacccccatgaattgcagcacaccaggcctccctgtccatcaccaacttctggagttcactgagactcacgtccatcgagtcagtgatgccatccagccatctcatcctctgtcgtccccttctcctcttgcccccaatccctcccagcatcagagtcttttccaatgagtcaactcttcgcatgaagggccaaag

SEQ ID NO: 38887 - DNA, 1657 bp, Bovine  19866880718648
aattgagctcgcctcaggaaatggaaactctcccagcgggtagggagcccacatctaccccgaggttcaaccaggagccagctctgggtttccctaggccagggggacagtgtgggcaaatgtgagggagcaccaaggtcagcagaggaaagggaccacaggaggggcaggaagtcacctgcatctccagcttcaaagcattttcctttggccttgttgctggaaactttagcagctggcggcagcccaggcccatctggatggctcagaggaggggcctccaagtcttggggaaaatgctctgggttttgagagcagtttgtgtgtgcctctagcgagcgcatgtcttgtgtatacatagaaagcaaacatcgtccagaactgcatgttctgagtgcagttcaagggagctgagcttcgacagcccctcctctgagggctgggggaagctctggagctaatcacagaggcgccatggaggctttacaaggggctctgatcccttccagggtgacccagaccacacttctcaagttgcctgaataaatgttttacatccagtgtttcagaatcccagatctaacaacccactgcttcaagtccctcactttctagacaaagataaacgcatgtcaggcccagacaatggcccacctctccgcctcccatattcaggtcatcacaagcctccacatagcagtgagccctcgctgtaataggacgtgaggaagaggccaaaggaaaagacccaggttcggttcccagcctgcccctctgttcagacaagctcagacaagccaggttgcctctctcaacctcagtttcttcatcagcaaaatgcggacaatgttgctccatctttgggaaaaccggaagtgtgggtgtgagagatttttgcagataccatccagggattctcacagcagaatctcagaacatcagtcctaggagagttctcccccaaggccacaggactcctctctatccccatcctaccctcaatatgcaagtttcatcatcttggttgaaatagcttatcaagactggcaggtatggccactctacactggtgcctctctcctcccagaagctctgaatctcttcaaacatggatttccaggaaggttcatcaggacagatcattccagaaacccattcaaggcagagtggcctcctggctttgtgcttctgtgactacctcctgccttagtccttcaggctgccagcaaacaggactgactccaggaggaacactccggggtacaaaataccagggctggctcgaccaccaatgcccaactatagcattgcagaaaccgagaaccagacagaaagtctcgtccaagtcctgcaataggcatgggcttggaggtcagactcagtcacagctttaccccctagcaatttataactttgtaagttacctaaacatgaatctcaatttccacatctacaaaataaaatcccaaacatttacaaaggacacagcatggcattttgtaattaagactgcaggcttttgcagtcacagcctacattcaaattctaactgctcatggccatggggtgaattgcatcatttctctcttactcagtttcttcgtctctaaatgataatctcataaagggttttggggaatattcaataaagtaaggg

SEQ ID NO: 38888 - DNA, 1216 bp, Bovine  19866880749612
aagagagcagctgcccccttccctcaacaaacacccaccagggcaggcaggggagctgggccaggccccacccacacccctcgcccatcccccatgctcaccgatgttggggtgcttcagcaggcggcagatgcgggcttcacgctccagcttctggtggtctgaaacacacagatgcccagatgagtccaggggagggaggcatctccacccaccccatctctccctcctcatagcctctaatgacctctccctcccagggcctgggcaagctcagctggcagagcctctgggttctccaagaaggcagtgggatgcagcggaagagagacccaggctgcaatgaggcagaagtcccttccccgctctgggtctcggttttcagggttcttaaccgaggggcatctcctgcctgtatcagagccaaagtccaggcagcctgggaacacccccacccccacatcaggctccgactgccctcccccagccctgcccctcccactgcatctcctcctgtggaactgctgaacctcagctctccaggcacgccctgccctgcccagccctctcactctgggaccttcgcacacgcggttctctcagcttggaaagctccctctcagcctcccacctgctcttcactggccatcactcactcttaggcatccttggatgtcactctctctggcagcccaccctgattaccagctgctgggggctcctcctctgcattcccagggcccctagacagcacatgccactctgtctcagggatgtcgctgtccctgagggcgaggacttggtctctgttgtacccctggcatctacctaaatccctggcctatggaaggtgctcaagaaataaatgaaggcttccctggtggctcagtggtaaagaatccgcctgcccatgcatgaggcacgggttcgatccctgaagcaggaagatcccacatgcctcagagcaactaagcccctgcgccacaactattgagcctgtgctctggagcctgggagccacaaccagtgaagcccaagcgccctaagcccatgctccatgacaagaaaagccactgcaatgagaagccctcacaccacaattagagaacagcccccgctttctgaagctagagaaagcccatgcagcgatgaagacccagcacagccaaaagtaagtaaataaatacaattttttaaatacataaataaaaagata

SEQ ID NO: 38889 - DNA, 1576 bp, Bovine  19866880755815
cctgtctggctggccccagagctggagtttcttgcaccacattgcattgcccctactatcttcatcatctgttcacctctgtgtaagagctggaacaagaatgcagagcattcccttgtttaaactcagctgggaatgtgtgcatggggcaactcaaaatttttggtactctggggcatgtctgcctatgactgaaaaaacactgaatttgatttttgaggttacaaatacattttagcaagtaggtgaatttgtagatacagaatctgtgaataataaagatcaactgtatatgtgtttaccttaaaaagcaaatgatggaaaaataaatcaccaaataaaatataatctacaaaaggtattattagttatcttttgaaatagagcaacttaccccaaaacttaatggttttaaacaacacacatctattgtttcaaagcttctgtgggtcaggaatctggacatggattatctgaatcgtctgctttgaggtcttctacaaatctataatcaaggtattgatccaggctggggtctctcatctgaagactcaaatgactcatttccaagctcaattacatgattgttggtagaatttaatgcctcaaagattgctggactaagggcattcacgtccttgctgattgttgtgaggaagccaccctcagtatcttgccatacaggactctccaacttgcaacttgcttatctagggagtcaagagaggagtctgtaagcaagatggaagtcacaatcttttataaccttattatatatgtgacatcccctcaatgttgccatatgccgttggttagaagctacttacttatgcggagtattttatcaggaggtgggactcattggtggctatcttagatacttcctaccacgagaggaaggaaataagatagaagggacacagattggatcttatattctttgaatataccatagttctgttgatttgactatgtaaccataaaaaaaatttacatatttatataaaacaaaattaaatttgataaaccaattccaaattcctgcttctgaccaaagtgaagtaatatggaatgggtggcaacatccacctgaaccaatggaaaaaccagacaaatgcatgaaataatgattttaaaggtattagacatcaggctgcgaaggacagtgatccttgagagatgggaaacaaattgaggtgacccttctgattgcccagtttactgccttgagaacatttccaggtatgacatgaaaagtgagtccaggcaggggccaatagacttccagagtggtagagaaagaactaacagtacagagagaccaaggcagctatagtcacagagcagagatcaaagaggagaaagctgcacataatgagagctccagagatttgcagagggtccacttcaagtattcaggagagtactggtcagtgcatgtatataaggaaaattagtgtctgggaaaagagacactggagaggaaggaggaaacagtaacctggagttcaagattaagccaagattaatgcctgttcccatcagccagactggaaaatttcacaattcactggga

SEQ ID NO: 38890 - DNA, 2023 bp, Bovine  19866880775361
tacctgctaaaaaccaaaaatggcaccagtaacaatgagcatatctactactcagatcttgatttttaataccaatctctagtaaaaggcacaagggctccttggagaaatggctctgggacagaaaaatataggtaagcctggggtaagtaggaaatttctcaaacaactgaataacgcttcactccccctcaatgccataaaatgatgggggtacgccaaagggagacagaagtctactaaaagagggttataatggccaaagctggaacaacctgagttaaaaaaaaacagtagtattggagtataacctgaagtatacaaaaatattcacaagtccacactgctttaagtaaatgattaaataaataaaaaagaaaaaagagaaaaatcttccatgtaaaagaattccaaataattcatggagatagctcttatggaagggaagcatagctcgctactagttaaatgtgggctgtattagtacatttccttcccgagtatggtatggaaaacgaaaaggggatttaaaaaaaggtaactttacatcagaataatctgacaaacaatagctcaagccaagtaatcaaggttaacatctacagtgaaaagtcatattggtggtatacacccctgatatgatgtggtgagagatacactttacctatgtgatcctcgtccccataacacattctctcagatgatgacaaaagcatcagacaacttccaatcaagggacattctacaaaatatcttaccagtactcctcaaaaccaaggaaagtctaacagaacttcacagcaagaggggcctaaagagatatgactattaaatacaatgtgggtatcctgaataggatcctagaacaaaaaaatgagattaggagaaaaattgaggaaatctaaatttaataataatgctaccaataatattcatcaattgagacaaataataccatactaatatatgacatttacaacaggggagacacggtgaggattaaagggaattctctgtatcatcttcacaatactcttaagtccaaaactgttataaaatacaatttacttttttttaaatgcaagagtcacctttggcaaaaaaaatgatgctgaaaaaagaaaaacagctaatttcatgtgttttcttaccagctattaaaacatagctgtggaaaataggaaaaatggatcccagtcttacctgttcttttttagtttggcttcagccgatggcatattttctaaacaactgggacaataatgggagtccacctagaatgaaacaagaaatcaaaaaatcatcttggcttgtgtatatacctgtaacaaatagtgaaatttaaaataaattattctgcagcagcaggtagagaccatcgttgtggcaaagaacttggactgtttccagcatagggtttattcttataaaaatcacctgtttttttcttaacctctgaatttcctgaaatccttttatttttcttttctgaattttcctattccctttcaccagggttttatgtattagacatgttaaactatgtttatgttaaagaagactctatgataatctaaatagattaacacataatccaatttatgaagctgtgatcaaatatccttttatctaatctagctttatgggactgcaataactggactgcactttaatagttaagagagattttaaaagttctctagttactgatatatttattacatgttcactgaagaaaagcataaactaacagttacaaagtcacctatagccaaccaactagagatttttaaatggcaaattaaactactacgttaacaagatagtcttattgtatttagctcgaaaacatagtataaaaattaaattcactgatgaagttgctgctcaaatagtcaccaggaacacaaatacagtactgttaacttatatttgcacttacttatcataaaaggcaaaatgtaattcatttctttttggtcctttctgaattatgctcctcccttcaagtgcagctccaatt

SEQ ID NO: 38891 - DNA, 5316 bp, Bovine  19866880783243
tctcacattatacccaggttttggataaatgaccccaaatcactgagtcttagatatgtagactaagaggcttttacaattctgggcttttgtatagcaagagtgaagagcttttgcactataagctttggagggacctcagagatcccaggtcaccttttggccctcccacaaaatgcaagaaggcctctgtgagcatcctcaacagcatttggggctggaggctctcaacactgtttagttcaatgcatccatttagtagatctggaaactgaggtccagagaagcaactggacttgtccaaagctgggccagtctctgaaagaaatgcagtagaacctaaagaagtcagtctccaggtgggactgaattaggacaatctagaacgatccccaaagagatagaatttagcaccgttgagggcactgggccttactgctgtctgccagggttggggtcctgagagtcatttgtaaagcaatggtcaccctaacgtggcatctcttgaatggatcctaggctcccaacatctaccctcatggatagcatgggagaaagggccaggtcctccagcaggaaaaagcaggcaggagggtgagacttgcaccggggcaggcagttaccttgtgtcttgctcttttcaatcctttgatgtgatcaggtgttcaagcccagagtccagggagccagtgttatgatgggactcactgccagagtttaggccaagggcttacacagccttccgcatctcctcctccttttgcatccctgagtcttaaaagccagctcagcctgatctctgctctgtggggattgtggtgttcattgtggggaaccagcacccccccagaggacagaccagtagagaggtgcccctggtgatcagctggggagctccggggtgagcgggactgactgtggggtccagccacctctcttcacactctacctctgttgctagccttggaaaagcagagtctgatttgtcaaagaaaatgtaacttccttctttccttcttcacagctttttggggatgctcttaagcccttgtactctgcaagattccatcagtctgtgtgcagacaggagaggagcgcccagctctggtgcccaggtgaggggatagcacggggaagggaggaggcgctggaggcagtcgggaccgggttctgtcaccaacattctgggtcctttggacaagtcgcttcctctctctgaacctcagtttcccctctgtacaatgaagagttggactagagccaacttcagttgcttaagtactacctttatttttaccatctacctatacttactttatggcaccccactctagtattcttgcctggagaatcccataaacagaggggcctggtgggcttcagtccgaggggtcgcggagagtcggacacgactgaagcgacttagcgtgtgcacatacttactttatgaaatatttccttaaatcaattcactttattaatgtagatacagttattttaagatgactttctaaaacaatcattaatgaataaccagtcttacagaatacacttttaataagcccaatggaaatgaaatcaaattatataatcctagctccacgctctttcctgcaaggcacctgggcctgagaccgctctcttttcgataaagaggtgagttagaaagtcggtagagagactgacattacactgagcctttcctcttggcagagccagatgtgttgaaagagaatttagaaagggaccaacttgcccactgtgtgaaccagtgctgtttcagtgggtgcccacaagcacagggaatcccagagcgttgcctcagtgcctcccctctgggggaccttggccgtgcctcttctcagggcctccctctgggtcctaagctgcacgagtctaacctgcgagtgcattggtttatccctgtctgacccctggccaaggcgagacagacgcaggcagaaagcgccctaggtcaggcccagcctcagccccctgacagccctggggtgcaaagctgccagggtctctcctgcaaagagaggcccgggaaggacagacatgcggacagagacctagacagacaggcaggcacagcagtgtgagcttggtccccttttctcccccaagagtacatttccatgcccactcattggggcacctgcaggacagcaacctacatgccagtttgcaaccagctggtcagctggggtggccgcaggcattcaggtgactgtaacttggggggtgtgcccctggggggctcccttatctgtagaaagggaataaaggtcttccccaggctctcccagggtcatgggcaggcgagggctgggagggcttgtcacactgatccaaggtccccatccgcagccacagcagttggacggaccaggcttaggagagagaaccaaggcggtaccaagccctgtccacacgggcccttcctcttcactggctccggagccgccccgggagccctgcccgtcaccctgctgtgccatctggcaggacaccgaacagagcagacaacaggcagcccagagggaagggattgctcacggttttcaaaatagaatcgatggaagtccaggccctcgaccaggttccccagggcctcgggttcgaaggccgtcatcccagggtcacacattttcctggggggaaggaagtcagaggaaagatgggctggggcggcctctcaggtgccccctctaattccaggggcctggaccccaggaaggtgagcctgtgaaatcaaaagtgactgcacccacctcataggatcagtgaggctgcggaggggacagggctgggacagggacagtgtggacgctgctgactggcaggtgctactgggtccaaaccatggctctgccgcttacatgtcatgagaccaccatgcccccctgccccccagcagtggctttacgtctctgagcaagagggccataccaagatgccagcgggggtaactcagtctgtacacaactctccaaattacatcacaccccccacctcaggcagcagatctgtccagagggggctttcctaatctgtcttccttgggcagggggaccttttccttcactttgaattggcttctgttaaccagcagttgtggccccggaggggtgtgttttgctgcattaaacggaggtgtcctattgtaggcagcagcgtcctctgggagccgcagctccctcttctgtgagatgaggaaggtagcagcccaagaaccggcgcctgggaggaaggagcccgggcgtggctgagcaggtcctctgctgtgtatttttagctcagtgctcccactcaggtctgcattctgggagcccctaatagccagatggaggaaggaaaaaactgtctcccccatccctaggtctctgagatcttctatgacacaacggggacccctgtggcaatgacagtgaagccagggacaggaagtaccccaggacaaacaaagaccccaacctggggaggggctgaagacaatggcggagggcccagcctcgtgtgagctggagctgtggtgagtgcagggcgccctgcccttgttccgccctaaccgctctgtctgtgtgactccagacaactcgcttctcctctcagaacctcaggttctcctgacggattggccagcagggttgttctcagatcacgtgggattcccaggatccttccagatccagagtcctttaagccggggctctgaggcctgaccatctggaagactaagcaccacctcgctctctccaaggaacccttctgcaggaggtctctgggcctctgaagggactcagaaaccatctgctccggttccattgtacatgtagggaaacaggctcagtgagacgaaggggcttatccagggtgacacagggtcagactcagcaccacaggccccagaggtcatagcaaggggtcaaaacctaggctacagaagaagtgatatcgcagaggtggaagacttggggggtttggggtcaacaggagatacctctccttccctccctccctatagctgtgtccccagagccgctctcaggctctctcatcactgacttaattctttccagggccagatgcaaaatctgttcaagagagcatttccatgtttttatgcaaccctcaggggcacacatgcacacacacccatgcacaccccttatgcacgcagtcacaaacgtgcacgttacgtgtgcataggtacatcacactcacgtgtacatgcggcctccgtctcacacctgcaccttccaaggtccttgtttctccagaaataatcagcagattgccggggctttgtcacccgctgctgctgaaaccctcccatgatcaggatgcacctggcctgcccagcctttgagaaacaaacttcaactcctgggcatatagcaggaaccaggatcaagctgcccaagaagcaaagcccacccaggtcattcctacttcacctaacagacaagggtcattcttcccttagttgatagatagcttttgtccaccaaaaagcataggttgggtcttcagacccgggccttgtcagccctggccaagacgttgaggcctcagcccagaatcctggctcttctgggggcccactgaggtccgctcctggcctagaccagcaaggctgaagatggccaccagggggcgctccagcccagtctttgtacactggtcgcttctccaagggctggcctaggtgtgtagggaatgtctcataccacttgtttccgatcatgccatttttgtgcactctgccttatccctggatggctcagaattgctttttgcggttctttttctcccgcttgttcactgaagtttggtttcctgcctgctcctgcccatctgaggtcagaggaagtccagtgtagcccaggcctacatggtcggactgaggaagggcctgcctccctcccctccttcccagcttatctcctgaggaggctcgtgttgcagtggaagccaccccctctttccttggggaaggaaaagagttttgttggagttcttcctagacaacaaaataggagcaggaagaggagcaggactgagatatagacaagtactgtgagcaaaaagcttaatgagaccacaaagtctgaaggcacaccagactgaatgagttcagcctgattcacggcacatgcagtgtgagtgaatgagggtcagagacaaagaccccccaacgttagccatcagcgccccctgattcaggcaggacatgcaggatgcacccagccaactcacgtgtaggactcaaaatctccattgcttaggcttcaatcagctgctccgtca

SEQ ID NO: 38892 - DNA, 1571 bp, Bovine  19866880801833
actaattgcaccattaccaccttcagaaaaaggaaaaaccactcagttttgtttctgtgcacaatatgcttcccgctttgccgccaacgttgcaattcagaggcagagaagagaggcctttgctcaggggctgcacagctggtgggtagcgggcagggcacagaacatacatctaaaggctagaatcgatcgcaggtgagctgaagaaaggctgcaccaccacccctgtatcccagacctgctagcctgtccccaggaggagactgcttccacacgtgaaagcactggaaccatccttagcgaccaccgagggcacctgagtcattgcccagaggagaggagaggcagcgttgggcagtggttagagtgactccatgacctacaggctgtgactggggatgagtagcctagcttctctgtgccttgatttcttaatctgcaaaatagagctaacattccccagctccaaggctgttctaaggattaaatgagatgagcacagtgtctgacatgctgtaaatgctcaaaagatgggaaatgattcttaggaagaaattcaaaagtcactccctcttcatactgctccctctgaatcatggaagaacacatcacatatcactccaggtgccattctctgagttcccactggagctgagctcaggtttggacatcaccttgcctgtcctggtttgcagcattcctgcagaacaaaggactggggcaggagaacaggcccagcatgtcaggtactaactaacaatgctgctttagaaattaacaaacaggacaaaagggaattgtgccctgaggttgtattaatgagggtctaatgttctgaataaaggaggtgatagtccagcttggcttcgagctgacctgagcctctcccttctcctcactccttccttgctccccttgagcccttccttctcaggtatccctgtctttcctcttcctttttatcccttttccaagtttctgtctcccttcctctctttctgtcagtttcattcggtttcttcctccctgtgctggcctggaccctgtgcacacggtcctaggggatgggcaggacccaggctgtagggtcctgatgctgcagagatgactggagaggatggagagggaggaagaaaatggagaagaggaaaaggtctccttggcaactccttgttatacacacacacacaaacacacctccgaactttcaaaggcctcgaacatgggtgtgggcactgcctcagacaggcaacccccatcttgactgtaacaaccaccctgctgaggaggcacgactgctaattcactgcttcccctgtgcccgagaggctggtagccgtgcccagtggtggcggacagcgaggagccagccctgcctgcgtggtgctgagcgcacaagattgattgcatcagggggactgtttctgccagactccccattccccagagaagcggcaggcaggagagcccgcatgtgcgcccccccagctgcaacttgcatgcagtacacaagagcaggcctgcttgccacagcctggtggccaggggtggatgctctggagggtgctgag

SEQ ID NO: 38893 - DNA, 1159 bp, Bovine  19866880835431
ctctatagtcttgataagcctttttttttttttttttttgctatattaatacatctggctggcctgtggcttctatattttatttatgagggcttccttttaagtcctagtgacatcctgggtagggtaagagttacaaactttaaacagtcacttagataatgtatatttctcagaatttctggatcgagtaactggccctttttatggaatctgattcatttcctcagtgaaatagcaactctagagagtatatagtctagtgtataagtaatataggagttgatgagcatttaagaatgcagtgatgcagaggtacaggtggggtgctcaagagtgatggtgggaggcgggggcacacggggtgatgattttgtggtataatcatgagagaaggtggacctaggtggcagcaggggagcatgtttgaaagatacctttccttttccccaggagagccaggtcctcctgactctcacgaatccagtggagaaccttacccacgtgactcttttggagtgcgaggagggggaccctgataatatcaacagcactgctaaggtaggagtgttttgcttcattctgagtgactctgacttccctagagtggcctcatttgacctgctttaaaggattccacactcattattttcacatccagtcttcaggttcccttgatttcacctctagggttttctacttcatccgcaggcacactgccactgccctttttgagggtttcatcatttctcacatggactaggacagtaactttctaactcccttttttagttcacccccacttccactccagcccatcttctctcttgctattaggatgatctttctaagatttagctttgatcatggcaggctgcttgtttggtgtctctctgacattggaataaactaaattccttggcaaagcttgctgctgctgctgctaagttgcttcagtcgtgtctgactctgtgcgaccccatagacagcagcccaccgggtcccgccgtccctgggattctccaggcaagaacactggagtgggttgccatttccttctccaatgcatgaaagtgaaaagtgaaagtgaagtcgctcagttgtgtccgactcttagcgaccccatggactgcagcctaccaggctcctccatccatgg

SEQ ID NO: 38894 - DNA, 1182 bp, Bovine  19866880866292
gtaacagactgactctacccccaacaccacacagtccaaaacacccccatccaccccttcttccaagctcccaacctccaagctgaagctgacagagctttgtgacagccccgcaggcagaagaaagtaccttggctggtgagccctgagactgggagactctactttaacctctaatgaggggaaggaggcagatacccctggccccctcaacacacatcccaccccatccattcctcactttcaaaccaacccctaactgagtcagcctgattcatgattcagccttatttcctcatatttgaggaaagacagactgaacccatttcacagactgagaaaggaaggcagaaggttccaggtctatgtgaaaccacaggccctggcaattcaggctttggtggctgatctagatagaaatcctgaggggcctccgaaagggcagctgggctgagggtttccatggggcaaaggctctcccaggcagagcgccgcagaggaacttctagaaacgcacagaaggggcagttctgaaaagcaatgagaaaaatgaagtggaagtgggtcaagcacaccctaaacgctgagattctcgggtgaaaagggaactgagagaagtcacccaggcctgaccggcctggcacatgctttctgcaccctctccagattctctgcgtgctgtcagcaacgggaccttgctgtcttcccaggcagtttatgcccgttagtgtcactgtcaccctcggtgctgtctctgcctttgagagccacacaggacaagattatgccctctgcccagagacagccctgtagggaattgaaagcagtgacacggccacttatgggtccttccccaaaccttaggccacctgtgatgacgccatccccaaggcacctacaaagtcctgtagcctccccctccttccctctcagtccatcctgtggcctgagtcagactccggtcaactttctgttggaccacaattagcatcatctctgagctggtctcaaccctgccagtcttgccaccatctccagccaaatgacccccaagagaagcagcacaagagggcagaaacagttcaaacctgggctcaatcacaggtctgcaagtgactcaacccctctgagcctccatttcctcatctgaagatggggtggggttgggggtagcagcaagca

SEQ ID NO: 38895 - DNA, 1057 bp, Bovine  19866880866777
tggcacacaggtacaggagatcacttccctggaacccagcacatccctgcccgtcccacctttccctggcagcagttaatgcacctctgacacaatctttatcttcagcagaaacctctcctgagcggtgtccccatgcctactggtgactctggtgcccagacacctcaaaccaatttcattccaaacttaactaagtatctgccccccaaccaccgttgttttccttgaacgactcaagccagaagtggaagtggctctttcctcatctcctgcagccagtctatcaccacgacctgataattccccgaacccctcaagcccctctcctcctctccatgccctctgtcaccgccctggtccagctacccactggctctcgcttgaccacagtgaaatcctcctgcctccagtctcgctcccgccaacccactttccacagggcagccagagatatctttggaaaatgccatctgactgctccattccactgctttaaactccaacagccctttataaaactttgcttttgaaaagcctgctgtgatctagcccctgcccacctgtctggcctcatctctcagcaccaccccagcccccagtcctagctggcccctaatatccttatacatgatgcagcctcggcctgcaattacccgtgcccctctctgccccgtgaactcccactcatgcctcgaggcccagctcaaatgtctccttctctgggaggccttccccacccccaggctgagcgagtggcaccctcccctggggccctcccagagcatttcccatgatgcgctgcagaagctgtttacggggctgacacgggcctggctgagctccttgaggacagagccctgccttatttattttcagtccatagagagaagctcagagaatgtgagaaggtagagggagagagagaagaagggaagaaggcagcagaaggaagaaaggaaggcaggaaagaaggaaaggaaagaacgagtcaagcaaagacattgggggataattcattcaatcacctacccacccattccatcactcattcaac

SEQ ID NO: 38896 - DNA, 789 bp, Bovine  19866880886633
gagcccagctgagggcgagcgcaaagatgacacaggataaatgtttgctgatgtttattagtggctgagtggtagacacagcctgtgccactgcccaggggccccacccagctcacctggtaccaggagtaggctcggtccgctgggttgatgaggatggtcaggaccttcgccttgggtaacagggcagctgcccgccggggagccacttccgaatcaaagtagttggcgcttttctcaaagtagaagtcggaggtggtgttggaggggatagggaagaattccatgtacctgcaggaagcccacagaagagggctcacaggcaagattcaggaggggcctgaggaatgcagccaggagggccgggctcactgggcgtggaacgtgagaaagcaagcaggcacactgctctcagtctgacaaggacttacttgccaggatccgagacagagtggccacttggcagactccatcttatgaatcagctcctttttcggggagacttgggatcaagaggatctgaagatgtatgtggcgggtggggcgggggtgggggtggggggcaggtgtgtacgcatgggaaggggttgtgtcttctcttcttaaatgggatgctcccggagtgaaactgacagggccctaacccttactgccactagggggcgagcggggacgcttctgacccgggaaccccagcactgaggggaagaacgccctctgctgcctccaggctgcagggtttccttcctgacctgatagtactttctaagctgttactgtagaccagca

SEQ ID NO: 38897 - DNA, 876 bp, Bovine  19866880889807
ttaattttctgtttagttgatctatccatagtgtgagtggggtattaaagtctcccaccattattgtgttattgttaatttctcctttcatacttgttagcatttgtcttacatattgcggtgcttccgtattgggtgcatatatatttataattgttatatcttcttcttggattgatcctttgatcattatgtagagaccatctttgtctcttttcacagcctttgttttaaagtctattttatctgataaaaactcttaagaagggcgcacgctcggcccgggggacccaggcgtccggcggttcgccgggagcgccccctccccctgggtggcgccctagccgaggcaggttctcgggagcaaggacacccccgctttgaacgctgccctttaacaacctgggacgagccttggccccgggggccccactgagcgagcggtatgtggcccccccaggcctgcccagcattaaaaaaaaaaaaaaaaaactcttaagaaagcaggaatagaaggaacatacctcaacataataaaagctatgtatgacaaacccacagcaaacattatcctcaatggtgaaaaattgaaagcatttcctctaaagtcaggaacaagacaagggtgcccactttcaccattactattcaacatagttttggaagttttggccacagcaatcagagcagaaaaaaaaataaaaggaatccaaattggaaaagaagaagtaaaactctcactatttgcagatgacatgatcctctacatagaaaaccctaaagactccaccagaaaattactagaactaatcaatgattatagtaaagttgcaggatataaaatcaacacacagaaatcccttgtattcctataca

SEQ ID NO: 38898 - DNA, 1429 bp, Bovine  19866881020992
tgattttgaagcatgcccattgggaactgctgaactttgtgactttgaggccatttgcagtaaggttttgtgtgcgatggccctttgtaaactgaagtgctggccacaaatcttggctccaggtgttattcgaactctgagatgagggaagtgaaggtgctggagctacagctcctcagactctgggaggttgcggacccagccctgggccactctgttgaagctgggcctgaggcgaaggagttccaaaccactggtgagctccggaacgaagggagtgcctgccctcggaagggtttctcccaccaggggtcctccaaagggcatcggggtcctggggagagaagagcggcaggagaggctgagtgggagcggggtggcagaacagacatgggggtcaccgcgtgtggccccctccccgcctctctgggcctccgtttctctgttactcagcaaaagattttatactatctttaacaggtttctccagctttgcccagtcccaaatctgcccctagtcaggatggctcgttgtttgtaaatattaataagaatgatgttttcagagtgaaaattggcctgtcctagcaaaactctcagctccccttaagtaaagtccagaagggggaaaaattggaatctggtttttccttccttttgacatctccccttacaaaaatatatcacaaactggagagagaaaggagagttagaaagaacattcagaatcagagaatgcagattacaaccaggacatgccatttctcacccacaatactgacaagaataagtgatttggtaacgggccaaagttagtgaatggtggagagattctcactcatatactgctggctggagggtgaactggtgcagctaccttgcagggcaatttggcaggatcctttaaacctgagaatgtgcaaattctgtcaaccagcaactctacctgtaagcatatggcttaggaagtgcatgcacatatgcacaaggaagcagatatgagcagtgattagtgacaaaccagagacaagccatatgcccactggcagaacaatggataagatcgatatattcatggcagagtactatgtaacagcttaaaaggaatgaacagagctatagatactaagagatttcaaaagcataatgttgagtgaaaaaagcaagttataggatgagattcaaaatatcaaaagacacacatacacatgcaaaccaaacaacgctacatccccataggtatgtagatgctctgagaacacacacgacctgacaacagtgctacttttgggaagagactcgggattggaggatggggaacaaagggccctactttcatttgtagttgcctagggttgtacgtgagaaggcgatggcaccccactccagtactcttgcctggaaaatcccatggacggaggagcctggt

SEQ ID NO: 38899 - DNA, 978 bp, Bovine  19866881032116
aacttctcacagccttcactgtagtttgttcactatgaggccccaggagggatgtagaatatgccgtgtctatcaaacatacatttgtttggttttggcatttcccagtgtttttgctcagtccattttatggactatttaacataggagggctgggctagggttatctggtggcaggggtgtgctggggccagctcacactggcttgggaagcatctcttcttctttttctaatttttaaaaacatgtatttatttggctgcaccaggtctggctgcagcactccaggtctttgctgtggtgtgtgggatctttagttgaggcgtgtaggatctagttccctgaccagggacagaacccaggccccctgcattggaagtgcagagtcttagccactggactaccaatgaagtcccaaaagcatcttttcttaattccacgtgtagcgaagtcatactggtagcttggaattgtccattagaggaaattagcaaacactacaaatcaggactttttctctttttcccaaagagccagttggtaagtgcttaccatcacaccgctatttggtctcagtcacctccagacaggctgagagtgagggctgctgtaaatacatggtcagcctgtccctgtttggggctatgcaggacctccccttcttgtctgagaggatcccagggctgggtgagaggtgacctttccctctgtctttctccccagaacgatacctctggcgaatacaagaagactctgctgaagctgtgtgggggagatgatgagtaagtggcctcctggccccaggctggagggtgtgacctcgggtgtggctggtcaggattctcttggcctcttcataatggatggatggatagatggatggattagatggacttgggaattccttgaaggtcagaacactgcacaggtgaaagtctgagcgtcccatgtacacgcaaatgagtgtggtctcccata

SEQ ID NO: 38900 - DNA, 1628 bp, Bovine  19866881037200
ctgctttagttcccctggctgacccccaggagcagaactgctgggtcatttggtaattctatgcttaactttttgagaatccaccaaactgttttccatagtagctgtaccatttttcagttccaacagcaatgcacaagagttccagttgtaccacatccttgccaatgctcgtcattgttgtccttcttattattgccatcctagtgagtgcaaagtggtatctcactgtggttttgacttgtatttccctaatgactaattttgctgagcatcttctcatgtgcatgttgattatttgtatagcttctttggggaaggttatctagatttttgatgctattgaaatttacctcaaaaaagtgataccaattttttttcatcatcagtatttttatgactttcccccagaattttttatcttttaaaaacacagttaagattatttttatatgtaaaatgtatataccgttctttttatttaacattgtgacaaacatctttgcaagtacttcgtctgctgctaaaatgtgtgtaaagtctagaccactgcacacatggttttccttatttcctgtgagtctagacataaagattttaactactgtttaagtaatactgcactaaatgtgttttgcctaaagatgtgcccatattttacattatatccttagatttccagaaatggaataactagaacagaggtctgaacaattttaggaatcttgaaacatattgcaacattagcataaaacgttttgaaatagaactgaagcctttgccctgggaatttgaagggtactaatgtaccctgtgaaactgggcctgtcagttgaccctcagttcactttctacagtatctctgaaacttactttgaatctcatttcagtatctatatctctaaagtccttccctccttctcaaagctattatgggaaaacagctttcttctccaagcagagcattgacttgatactagttttagtgttataaagatattaataagacaattttcctattgtaaaaacccagaggggaagggactgcctgtcttgtgttcttcccaacagtcagaattctttcatagttatttttcagttgcttggcacctgttaggtgctgcttaaggcctgcctggtggctcagtggtagagaattcacctgccaatgcaggagatgcggttcgatccctgggttagaaggattcccctggagaaggaaatggcaacccactctaatattcttgcctgggaaatcccgcagacacaggagcctggtgggctatagtccatggggttacaaaagagtcagacacaacttagtgactaaatgacaacaacaaagtgaaaattaaataaatgactagaaatataccatgggggaagtgtaactgggaaaggctagtggtggtttttttaacacttgatgacactttattgtcttttattttctatttttgttttttaattattatacattcaaatggactttctgatgtagtttcataaactttaacacatatatagattaatgcagccaccaccataatccaatataaaacagtcccatcacccccaaaatactctcaggctgcccatttgtattcacatcctctcccaccctaacc

SEQ ID NO: 38901 - DNA, 1951 bp, Bovine  19866881057748
ttcccctgccttgtctggcccaaagggatcaacacagttttcctccaattttaagtacttggtacatctcagagtggggctgcacctttggaggaactggaacatgggaatccaggtctgccacccctgggttcctgggccatgctcagcagctctggaggcagggacatgagtgagtggcattcctggttctggcaggagaggagggagcacgcacaccacagtggccaaaagcggcccattcagcgtgacggcagacttgggagagcatctgatggttccaagggaaatatttgttggggaaagaaaggggcacacaggccgggtgactttcagtcacatgtgaccacatgacgcccacacaaacgggtctcttgaggccagagcagacaggttacccctgttacctccatcctgggtacagcaccccgtgggggtgggatcaagctgggagtgggtgggcagagccctctcaggtcagcagcctcttggatgaggccacagagctgtagtctgttaacaaggccagaagatgcctatttattcatcctacttactgaccccgaagcactaccactgacaccattaccaccatggacggaggtttcagcctgctcagatgaccagagcactggggtggcagtcgggaacactttttacactgaaactgatttctggagtaagcagtacatactcatgcaaaattgtaaagatgcaaaaaggatgcagagaaaagtaagtctcccagcttcccacccctcccttagattcctaggaggaagcaacattactgctgagtatatccatatatgtatttatgtgacattgatagtggcacattatacacacagtggtaaaccttctttttgttttcctaccttatcttgtctctccaaaattcaggacctggaatataacaggcaggagtgaacattcaaagaatggtggattagtgaatggggggtggtgggatgagtgaatgacatccatccaggtttaggcctctcgtactcggtattttgagacatatccctaacctcgggaggtttcctcttcccttggcatgttgcttcaggtggaaaattcaggccttcttgaccctggcacagagccatagtgggggaactaagtgaacaaggctgctgaacagcttaattgtcatttccaccagcggatggttaccagggagactcaaagaatgctagaactgggagggctttttcagagacatggaggcagcctgacaaaatctcagaattggggtgggtcattccaccagttctgtatgactttttaaatgttcattccagtgataatccaaaagaattaaaatttatatttttggaccatctgattgtctgtccagtaatgttgcatggccatgtgactatacccgtgttggtgtttgtgtttatgattatatgagcactgggagaatcaaggatttcacagcccactgaataaaacaaggatttcatgtagatcaaactgagcaggttcttatattctgtgtctgcagagccccacagtcaagatcccttgacatagtcttaggatctttaaaggcatctggacgttactctagtaccagaaacttggtgaagaaaagaggacgccaggcaagggttgggagcctggatgtgagtcttgtctctgcctctgattgaccgggtcacctggactctcctgtctcttctgttttcatttctccatcaataaaacagggatcaaaacgccttcctcacaggatattacgaaggcaaaatgagagagtaaatgtgaaatttcagtatttatgaatgtgttcagccctctcatttcatgaaggagggagatgaggcgggaggaggtgaaatgactttttcaacatcaattactggcggagctaggccgggaacccaggctcctaacctcacctggttctcctccactgccccgggcaccgaggcca

SEQ ID NO: 38902 - DNA, 1027 bp, Bovine  19866881074527
cagggcgggcagcgtgggcaggtagagcagggcgtaggcttctgctgcagagctgcttttaatatcccagacgctattgtttgcctcagtgggttcgctgcctctcttcgtccccgacaatctgttcctctgtcttctcacatatatatagatcccccccctccctcaactgaaagccttctcccacttccatccttctctctttcatcacgtgggaaggaagtctctggaagtggcagatcagagcggctgtgggggaggctgtttggcaggggtaggcagggcccgggcccggcagagcttccccctcgggcgggcccctttctgctccattttgtgttgcctttcccgcagcaccctggaggacgcgaaagtcaggcccagtggggtgggcagagacctgggttccagaccatggccatgggcagctcccttctgttcttctgcactctgtctccctgtggggtcagggggtgggggcagaactcagaccaggtcagctttctggggagtggaacatagggctccctgggtgtccttctatgtggtgggcatgttcactggagctgtggttcccagacgtccgccaagagtccacagggagtgttacttttttctcttttttttcagtgtcttactggaaaatgcagagcatgccccaagctagaacagtgtagagtcgccagtcaccatcccagctttggtagttctggacttgtgaccagtcttggttcatccacatcttcactctcttccccaacaccactagattcctcctttttttctttctttaaagcacagtcattaaaaagttggcccacctagtcagcgtccccatttccccagttgcctcatgacgttttctgtatctggtcaaataggaatctagacaagggccaccggctacattggtccctttggtcttagttggttttccctgagcagtttacttgttgaagatcctgggcccgtgtagtttgggccacattcctgtgtcctgggaggaggcggcatcagagtcttgggc

SEQ ID NO: 38903 - DNA, 2241 bp, Bovine  19866881077041
ggggtctgcttcttccaggagagagaggatcgttgctcaccggtctcagttgtgcttcctctctgctaacgaacgcccccttgcccaccatgttcttgtcccctcagaaagagggtagctccaaaactgccacaagcaagaccctggccccagcgtccctggagaagaaagcagaggagtcctcaaccagcagtgatgaggacctgccatccagccaggtaggccgggcctgtccctaagggcacttaggctaagagctgagcagatgcgcctgggagatggcgggggctggggcacggggagggcaggtctatcccacttacagcacttccccatttcctgagctctctttttttttaacactttcatctccacaataaccctgggaggcaggtagcagagcctgccaatggagggtcagagttggctcccacagccccgaggcgcaggtacacagcatgccgcctgacagggagagccttttactgcgggaggcacgtgctgtgtcaggaatcgaggcccaacaagctgggagtgatctcccaaactcctatgacccgtaagaagcccaggaagaggcaggcactggtccctggttccatgtgtaccccacttcctgttaggacccaggagccttctctgcagggtctgtcagagccccgggggcctggtcccagacctcgctcaggaagctacggcccatcttcacacgctgccagccatcctcccctggctccacccctgagggcggaaccaagtcccccatctccccagctccagaggcttgctggcgttcacctggcaggaatctgggtttctgtgtgagccccaggcctttcccacagccggcactgccctctgtcctcccctagccccaaggtactagaagctgccgccaggtccttcagagatgccggagttcccaaccgccagatgagtggggtctccctatccagctccccttaaatgtcatatcacacactgatgagtccatcagcagggtcaggtgtcatgcacacccgtggtgctggggtgttcactgtctttctctccttaatagcccagattagaagagtaactgtgaacaactccatctaccgttggccccttcctgagggccaaggacagtgctggtccccatattttcatttttctgtttaatccccagaccagccctatgaggacaggtgcttcttttatgaccattttgaggaggaaggaacaagtccagagaggttggacaagctgccctggcatcacattgctgtcataagggcacagacctggtgtcagaacccaggctgtccgtatttgctcgctccctggccctgccctgacattcccctccctgtggcagcggggctcgggccctgccctcgggctctccgtggagcctttcagagcctgccttctctgtgcagaatctaaacagctgggagggagggggccgcttctcccttctctgcgggggcggactaacacaattaaaatgaacatcatgcttaaactgaaccatttaattggtacgttagtcctcaaggttttggagtccctgttagaaaagaaaaaggaaaaaaattcagcgctttgagcattccccagaaggattcagggaagccggcacagcccaggggagctgcagcctcctcccaactttggggggtttttagctccttaatccccagctctctaattatgattattatcgttattatgcatttatcaagtacttctctactggtgagtttcactgtttttattattagcccatcactgagagtaagaaattgataccagggtggtgggcagagccccaggctgggaggcagagaggggctgtgggtccattcccaggtcccctcactgccttagtctcccccgctgcaggggttgggcttatgtctttgctctgaaagacagatcaggggatggtccctgcatggcttagccctgttgtgtaggcattaatcccaggccagagtctgtgccagggcctagggtaggtaccaaattttaacagacaaggccttgcctttagagttccagggtgagttggaaagaaagaagagacctctaagaagctgaaattaaggtgttaaatcaaagatctaaagtctagcatggttggtcctaggagttcctgtctggtgcttggaggaccagcttccagccctggctctgacaccagtttgctggttgccctgggtgaggccactggccctctcaacccctggggtgaga

SEQ ID NO: 38904 - DNA, 4250 bp, Bovine  19866881085280
ggggaaggctatccccttcccttgtccacttgccccccaacttcccatccttagccgctggcccctgaacatcacctggccccctaccctggctaccattgccacaggctcttcctgcggccttgggcaaactgcgtctctctgggcattggctccaccactgatgctgtgaggagacaatgtccatggtcctcccagctctggtgttcgggaagcctgaaatttcccacaggtgcctttcacagaggctaaagagggtagcaactctaaccgtgctttccagcatctgcagaagtgctctgatccccaattcacagatggtaaagctgaggcacaccagggacaagggatctggcacagtcaattagaggcagaatcatgatgggaggatacgtgacggttcagagttccctcacccgcaagggcacacccttcttccctgcaagtgttccccaggcagggcaccacgaggggcaccccttattagtcttctctccatatgcgcggtgctggggacctacacgcaagcctgagtgctgccaccagtcccctgagccaggtcatttcaccttctcagacctcagtctgctcatctgtaagatgggtgagtaagtcctttccctccctcagagatgagctagtgggtggagaagtgccacactggccccaaagcgctataaaggtgacaggttgtcagaagcaaaataaaagcacagtcctgtctttgcgggggatagtgcctcatggcacaggtattttctcttctccggtattacacctaggatcctcctaacagccctgccaggaagagagtgggattgagaaacgcaacctgcaggcgtcagagcttgtgtccaagagcgaaggaacctaagcacccaggaccctgggcttccccacctccaccccaccccagaacagggagctgcttctggtctccagtgtcccccactgatcaagcccagcctgagccttgttcatgatacaaagccatgggggctccagagccagctcttccctctccttcgggcaatcttgctggcccctgcaaccctttccccagctccaacaccacccttgagtcaatttcagatccttttctaaagagaaaagactgggttgtgtgttctctccagcctccctcctttctccctccccctctcaagtaaaatctccttcccaggctctctctgtacagcccagtgattacacaggctgcagggtaattctgcctccctaactaacctctcctgggactgggattcaaagcccggagaatgtcaagggctagaggaggcatcctccttctctatctcctggaattcaccccttcctctccccgctgccccacccaccccgggtcctggtcttccagaaggttgggtctgcagggagctctgaccctagcgcccaggcccactctgaccctggagctgggggtgctgcaacctgcctcctgcctccaaacaagcctctgtgctcctaaggtctgtgcttctgtttgcctctcccatgggaggaaggaggactggatgggtcaaggaaggaggaagtgagctagtctctgggttcccagagacagccccaccccaaccctctagggaaactggaatcaagttcctggcttatgtgaatcatatactgcagtgggacctccatccaggagcatcaagaggccctagagcattaattctgaccccaacccctcaaccccctcagctggctgccccctaggcggggcaggagcccctcctctgacatcctcagccagccctaccctagggtcctcgaaggcctgcagtcaggaccctgggcagggcgccaggaatccctcaagaggctcgtgtcctcctcctgtccttctctgcagctgggaggccagggccctgcaaaaggaggtcaaaggcccccatggccccttggagggccagcctagctgcctctggcagtcatcatgctggtgatctgaagtgggttcctagaaatgggagctcagcttccaggtggtaacagcagtgtcctggctggccagggccttgggtcaccccttgaaggatggtccctgtaggcatctgcgctgctcatcctgacagaagaggagcctgtcccatcccagccagcccggtgggttaggggcagggctcagtcaaccccttctgccaagctgggcaaactcctgtcaaaaagcaaagccctggcaggtgccagcccccatttgagggcagtggtgatctcagggtgccacaggcatcactgtgtcttcatgagaaccatctcactccatcctcccagtccctctttatctccaggttacaggttgtgggaaacaggtgccatggccagcccagtgtcatagcactatgggtggtaaggtccgggccttgtgccctgtgctgggtgctgccactacctggtcatttggattggagcttcgagtgaatcaggaaagccctgcctccccagtgatgcagcctggccttttaaacccaggcatcagaggggtagcacctcatctcctttttttccaatacaagcatcctcaggccccatccttaggcttcctgacatctggcgagtcctgaccttgcccgcattgtttcgtaggttcaagcatttttctagggaagatagactttcatcagattcctggaggaatatgtgaccttaaaaaggttaagagcactggtaattgtggaaggaaattgatcagattaggcctggccatgcctgccaccctcagtctttctgccatggtcacaaaagggctccagaaattctgcccatgccctgatccctgcaagagccctggcagactgtggagccaagaaggctcaagaaggcgctccctgccaagtcaccaccagaccacccagtcttatgatatccatctcctcttagggcaaaacagcagttttataagcgcctgagtcacatctcaactccatttcactgcactctgtgacgcagtcctcccagaactgagccttggtcgcaccctgaaaggcagcgcccagctgatcagggaatccttggctcccgtggatgccggaacccagctgagaaggggtccctgcacaagtgcggcagacagcctgggtcctccagagcagctccaaacatttcattcctgctgtccacaccccacccccaggacaaaaacacactcagaaagacaggaagtctgcagacaggagtgagtacacgtctgcacatgggtatgtttctgtacaagggtctggtgtatgcctataggtatcaggatagcctggtgtgcaagtgtgtgtgtgcatgtgtgtgtgcgggcagccttcttgtacacagtcatgggcccacctcccacacatatgcagacaccagcctgagctcgcacatgccttcagcagccacactcccacccgagcccatgggcccaggcctcaaacacacacacataaaccttcccatgggtatggaccccggtccacacagatgtccatatccagacctcacagggacatcagccagcccaagtcccacctgcgcatccttacacagacatatttacatacagctgatgtgcacacagctccaaccatgtgtacataagtgacgcatgtatgcaccttcgttctcatgcaaatcagccaacggacctccttgtgccgcttgcatccatccacccctgcagggcacacttgcattttcaggacttccacataaagcacacagcagtaccttcccccagggcacatacacatgaacacttgcacacattttcagtgcacgcaagtgtaccacagagtcagtgcttacacaacaacacacatcaaaatgcacctttgcgtgtgcatactcagaccttacagcagcacacacctgcttacagggtgcctctcccctgcactcctgctactatgtcaggggccacccagggcactggagctgcattgcccatagggcaaactctgcctccgaactgtacccctactatggatctatctccagttgcttcacaaacctagcttgcggcacctgggagtgctccctggacactccacaatccatggggctatcccaaggggctctcctctccctcccccacctcctcccatctttctctccacaccagtcatcaaaggcaggaaatgagctctgaggctggacaactttgccgagggacaagagctggtgcaccctcacatcactagcccctgccttagcagaatcccccctcccacagctcactgactgtctctcccctcctcccaaca

SEQ ID NO: 38905 - DNA, 799 bp, Bovine  19866881109869
ttcttccttctgccgatgtttacttcccaacatgagctgcccattccacccatccatccggcctggagaattccagcttcatcatatccgaaggggagaatctgattgctttttgagggcaaaagaaaacaaccgttaggtatcgcttctacttggaccgcatgcctttttatagccaaacttctgtgtgtttcgtaagtggattttgcgttaatggatatttatgtaataactagacctctcaaattattatgagaaggtttgggttgggaagggaggtgggaagaggggtgaggggtagtttttttttttttcctgttctaggtcttttttttttttggtcatctctgagatggactttgtcacttgtgggttatctggggctgaggtggactcagcctgacagggaaggatctctgacatttcagtccccaggttcccttggggactggagaagcatcggatgttagtgctgatgaagaaatagcaaatctgggcagagagagtgggggaggttgtcaggctggcagtatctggactttatcttgcttgcctcccaaactgagatcctttctgccatgctgcccaggatttcattacatctgtgcaccaccctcagcgcgcccccatccatctctggggggttcacgagcatgtgtcttcatgcgggtccaaaaagaacactgggagttctcctcttcacacctcctcctgcggctgtggtttgcatctctcttttcctttctctttccctcttcccttgggattgactctgatgtggaatgccttggcacatcca

SEQ ID NO: 38906 - DNA, 1660 bp, Bovine  19866881116196
ttggtacatttctaagatggatcgtttctcgttatccttcagtaagtacccaacaacaccttgtattgttttgtcactaagtcatgtctgactctttttcgaccctatggactgtagcctgccaggctcctgtccatgggatttcccaggcaagaatactggagtggcttggcatttccttctccagagaaaaacaacagctacccttgaccaaataatacctgttctagaagtttatttgcagatacttgtatacatgaaaagtcaaagtgaagtcattcagtcatgtccaactctttgcaactccatggactggagcctaccactctcctccgtccatgggattttccaggcaagagtattggagtgggttgccatttccttctccagaggatcttcccaacccagggatggaacctgggtctcctgcattataagcagatggtttaccatctgagccgccagggaagtcgtgggaaatgtaattctaaggcacacatatgaggttaggcattgcagaactgtctgtcacagctgtagactggagctatagactgggactaacctgattgcctgtcgataggggactggctaggtaaattataggacagcccacatgattaggtgaaaactctttatgtgataatataggaggatctctaaaaaaatttctgaagaagagggtacagagcagcatgcagtgtccagtatttgcatgggggaggggggagctatctatggacagatgctctggtaacactggccacctctgggcaggggaccttggagtctgggatatagggatgggaaggagtcactttaactatccacacttttgtatcttttgaactttgaaccatgtcactgtgttaactacccaaagaagaaaaaactgaaaacttccagggacctactgctgctgctgctgctaagtcgcttcagtcgtgtccgactctgtgcgaccccatagacagcagcctaccaggctcctccgtctctgggattctccaggcaagaacactggagtgggttcaccttccagggacctagattctgtgattctaacattgcatgattttagtgctttagaatttgtcaagcctaacttaatatgactggacaaagctcatctctcacgaggccaatttcctaacaatttactaccagtggttcccatgggtctccaggcctgctctgtctccgaggtgcgccactagcatcccctacgagctcgagcagccctgagggaaggctccctcccagcacagagcagctgcatgaactgtggtgtctcctgggaacatagcccttgggcccccgctcaccctctttgcctcctttgtcctaggggagccttctcagtggtgcgcaggtgtgtgaaggtgctggccggccaggaatatgctgccaagattatcaacacaaagaagctctcggccagaggtaggtgctggatccatgcctggcccgccctcctcccttcatccttccctctatcccttgggttagaaccgggacctgggtctctccttctgggtgatgctgcggtcagaggtgggggctcttcttcctgcgggtactatgagaatagactcctccatatttcttccttagggggtctagactggatgccatagcctctcacaggccaggctctctg

SEQ ID NO: 38907 - DNA, 1298 bp, Bovine  19866881124429
aatgaaaaggagagctctatggtacggaggtggaaaggagaaaacccagaatgtcagtttgccagccagacgttccaagagtcactgtgtctgagcctggggtaggttgcatgagtgtgtttcttgggaacgagttaaggcccagcactcatcctcttgcccagagctgtcccccaccagccctatctcaggtaatcaggttgtggccccgctcggcagcaagatccagaggctgggccagtaatgttctatcatagcagactctaaagaaccaccttgcctagccccacctcaggtcctccccaccccagcccagttccttcaaacaccaaaggaccagaaaggtgaagggggtctttgcactcccgacattacagcaggcccatgttgtgatttctctgtcccctgggataaaagtggtgggcctggggtcctcagggatttcagacgatcaggaagcaggattcttctcagatttgaacttggtggctcccaaggaatggaaataaagaaggggtcagaccgccccatcacccttccaaggcagccaaaataactacctcttccttcctcttctcagtgaagtgtatccggagcaccgcagagtattttgctgagaggctattcaaggccatgaaggtgcgtggtggggttgatgcgcccgaggttggggagaggggctctttgcacccccaaaagattgtcaggactctggcaaatccttgggagtccattggccaaagagagcattcaaggcattggccataaaaccaagtgatggcacttggtcccaggtcatacaccttcccacccagatacctaccctattctcatgattgttcagggggtgcatcatgcccccagtccagccagccaactgggttggaagcccatgctttatttctaaacgctaattaactagaatgtttatatataatgtacataggaagtgaaagacattttggcattgcctgccaagacttgtgatgttcatcccagggactcggggattctgctcctggcgagtactgagaacagattttcccaggactttacacacacaacacagaaggtggtgatgtcttcatagtgcaccagggtgaatgaacacggtcatttgttgtcagaggccacaggcccaaagttcctgcaagtggcccattctctgtcttccagcgccagactggacccagctgggtccagagaccagcatttttatgatgtgttcataaaaacattcatagcagtatggtccatgtcatgaaaaaactagaaacagcccagtgccgtcaggagta

SEQ ID NO: 38908 - DNA, 1275 bp, Bovine  19866881125904
acagtaggcgtggtctccaccatcatggaacttacattctaatggagaaaagtgacatcataagtaggcaaacataataaataagaaagtgatagatatggttgagggtgatttagggaggccacttagatggagtgagcaggggcgacctctctaagcgggtgatgtttacttggatgagagggttgaactgtgaggggccagctttctcaagaggcaggagggagagtgcttccgccagggcgaaggcaagggtaagccccagcagccggggaaggtctgctggggcaggaagggtgaggaggtggatgaggcttccagcgtggcagtacctttcacgttgtattaaaacatgttcttttctttctaaacgcaattcgatgactgtgggctagggttccagggcaagactcccaaatgcctgaatcagaactcagctgggagggcttcaccattttccccaggggacagcctgtcctgtcctgtccaggatgctgtgaccctcagccctcccagcaccagccggggcctccctggagcagggagaccacagcaaagctgcccagcgctggctatttctggcaggggagggggccgcctgggccctgcagctgcattcctggagcagatctgcccgaatggttgggcctgaggaatgcagaaccacccctaccccagacacaaggagccttttctcgcacaggcccctggaatgaggctttccgggggctggaggtcactggatttctgctgtttatggttaagacctttgctgagcagagaaaacacagctgtcagccagaggcccagcacaacacctgcagggagggagccaggctagagaagggagggggctgccagactcacctactgagttgagccccactgacatctatgtgactgtcctcagcagggatgacagcctgccatagacaatcccctgaacccactttagagacagggaagctgaggccactcagctggatcataattgctcatgtcgagaacttattatgggcccgcattgtgataagagcttgatgaacatttcccaacagtcctgtgacgtgtctcctattgctgacattttacagatggggaaaccgaggcttagagggatcccattacatgcctgatgtcaaggaactgttaagtgaaggaatctggatctgaatctaggccttctgactctaaagctccctctgggattttttttttctttttttcctggtcttgttttatttacttatctttttttctccaaggaaacgtctt

SEQ ID NO: 38909 - DNA, 677 bp, Bovine  19866881131132
tttggagatagagacagagagaggcgggggcctgccaaaggtagctagcaagtgagcaatggagtccaaggttccaaatatttttgtaggggccaagtgctacctcggggctggtttgccctgaggacttctgtgaaactttttatttttgccctgtgtagaccctgggtctgaggatgctcaggacaaccaagaatcctctagtacacccctggatgcccatctgttctcagcttccatgcctccaaaacccaactattggacccaggatgggacaggcccctccaaagaaccaaccaagtctccatcagcaagatctgtacgtagttagtgggccagaaggctccccagcgtgttagaggtgaatgcaggagtcagatgccaacaccagagtgcccgcccaccaatccatcactgcagaaaacaggaagcttcaagacgtgagactcagtgtctctggttggccaccagggggcagctgggtgccaaccagagcagcaggaaggtgcgagcagaagagtggaagctgtggtcaagaggtcaagcaggaggtgggggagggtctgacctctactcgggccactgcactaagttcccacatctgataggccacctgcgctgcctccgggaagaactggccagcagcactggaatggaagggtgttagggagaggaca

SEQ ID NO: 38910 - DNA, 1103 bp, Bovine  19866881135358
attctatatgttgagaatagaggtggctaatgaggtgcccataaggcgtatctgactacacatgtttcatatagtctgcatgatgttttaaatttgaaagcaataattaaaactgaggcattgacatagaaatccagatttctagattctcttgaaaagtgaggtatggcaacacaagtcccacttacatagcaaacgccaaggaagctgcgcacagggcgcctcctcagaagggacatggcgcactgttcaccactcactactccctgttgtcccctcacccagagacacagggtccgcagtcatcagcatctcgtacccagttcagccccctcgtgtactctcctggcctctctggggatctgggttgagactctggtctaagctcacctgacactacattcacctgtatgtctgagataccgtgattctcaaattccattcccctgcgtttgaagaattcaccttgtcgtgaagtccactgtacctccgctggggtctgatctagtcatctacgagctgtgccctgactcccaggtagctgagccctgtcgcagagacccactgctctggaaatgaggcaggcagaggtgctctgctgaggcggttgctgagaagcggggaagggaaggaagtgagacgaggcccccaggtgcaactcctccgcccctcccgtccccacctgcagtgtggtcccggaacagcaagcctgtgcacaccaccatcctgaacccccacatccacctgatgggtgacgagtcggcctgcatcgcctacatccgcatcacgcagtacctggacgccggcggcatcccccgcacggcccagtcggaagagacccgcgtctggcaccgccgggatggcaaatggcagatcgtccacttccacagatccggggcgccttccgtcctgccgcagtaagagcccctccttccgacgatctaaaagaacggggtggtgtcggtctggagttggtacacgctggacgggccctgagccaggggtgggaagaccactgggagaacaggcctgtgggtcccagggggtggggggaggagacgcaggtgggacccactggaggcaacttaactccatccaaggag

SEQ ID NO: 38911 - DNA, 1892 bp, Bovine  19866881137810
attctcttccttgtgtactgccgctatgacccaggccccttgcatccctgggctttcggctgtattacactttcctgttctctgtcctgtttcccatcccacccagtgactggtcatttccctcttgtcttctttcaattgagacaaggttggaattttccgaaaggaactttgtagaggaggcaggatgcaagatcttcccaggatctcatttgtttccctttccatgagcttctattaaatatctgctatagttctagttcagccccaagcccatgagatagaaagatgaatacaagcactctcagactcgtgacccctatggtcccaaggggtcacctgggctctctggccctgtggggtgaagtgtcagggctctgagctcactgcgtctccttttcctccagtcctccaggcctcctatgagcaggacaaggaagcccttacccactccttccaggaggccaaggcggccctgcaggtgagaagggttgggccatgtgagtctctgtgatgtggccaccctgctgtcagctcaggaggtcttggtctgagatgagggttggcctctttttcagggatggttgggagcatcttggagacgtcgtgggcctggggccacggtatgattagagccgagggtggctgctcagtgagctgtggaagaatgaaggaaggcctctgacccagattgactggtcagggattttctagagagggtgaggtctaagctggaatctgagggtgggttggaatttttcagatgagaaagggtaggaagagtgccttagcagaaaacaaacatacaaaaaacacgtgtttaaacacatggaggaaaggggaaaaagtacagagtagctgtggaactgaaacaagtccaggagacctgggtatagagcatgagggggaaacagtggaggccagagaggaaggcagggaccaaacgatgggagtctgtgagccccagtaagggggtgccctatcctagaggcgacggacaaagtttaggtggaggaaaatccttgacaggggagcagtatggaggcaggcatgtacctggcagctgcaagagtgatgtgatgttggctgcaggagaaggcatgtagagggagcagtgagagaagagacagagcaaggatgctgagcctggcttgcatgtacttttgaatgccagtctgccaccagccgtgaataccgacatcatccccaagggtatggagagctggggctgtatgttttgagcagtggttgaagtagcttaagcctgcagtgctgggtagagcaaagacagactgaagaggccaacactgacccctccccaaggggtggggaagtccacctccagccttatgagccaggcttgcctcatctcctgtctgctccccctccaggagaccattgacagactgaccgcacagatagaggccttccaggccaagatgaagagggcagaggagtccatcctgagccgagactacaagaagcacatccaggtaggaggcagtccccacagcctgtcctccttcagtctccagaaaggtccaggtctgggcaacaggaaaggccagtccctcttccaggttggggctagaactgatgctgttaccttaatgagggtctggaagaaacagtgtccccatgtcactaagggggaacgtaaagatcagagagaagcacgtgggtggtcaagtgctcatgctctggactcagaatgaagtgccaagagcagacctaccacgtagcagaagcaacttaacctctgtgaaccacggtttcctcgtccgtgatggtgcgggcgcagcaggcactgttggaatagagtaagatacagcacgttaagcacttgccacaggccaagaagggggaggtgacttgtcaaacaccgttggggg

SEQ ID NO: 38912 - DNA, 1326 bp, Bovine  19866881185281
catcttgttaaaaggtagattctagttgagtgggtccgggtggggcctgagggtctgcattcctaacacactgtgaagtgatgccaaagctgctggctcaccagtcacacttaagcggcaagatctaggtgctctgtaaggaacattctaactctgacagctaccacgccttctcccttaggagggaagcatctctctgtgtccagggccccaacagttaactcctctgcagaagagtagcatctccatctgctatttatacccataaggcacctccccttccccgtgcctggggaaaggaacagagctgcacagacagcagctggaggcttggggctagagtcagagaaggggcagcaaggaggctggcggggagccaccctggttggcccctgacctgcttatgaccatgggcagttcctgcccaatctgggccggcctccagctccccaacagtacaatggagggagtcatgagtggtctttgattgtagaattccacggttcttagaaagcccattaatcctggaagagggagatggggtgtgtgtatgcacgcgcgtgccactgcacagttgcagttgtctccggtcaacacttcctcatccttcagtcgctcattcccagctctagcagggagcagtaagttatgggctctggggctgacattctacagtcagattctggatttgctgcttaattgctgtgtaacccaggacatgttgcttaactgctctgaagttccgttttctcatctggaaaatgggaatgatagataccttgtaggcttatgatgatcaaacaaatcatagcacaatgacaggccctggggaagggctatggatcatttagctgctccatcctttctcaatctacaccctccaatagaacaaccttaccgaaagacttaccttttgcctgaatcttcgtgtgattctcattcctccgagccatcaagattttgagtcattggtttggggcactatatataatattctggttaagaaaatggaattttcagtcagacacacctgggttcaaatccaaattctacctttcatttcgtatctgagcttgggcaggctacaaacttctcagacttagtaccttcctctgtgaaataaggataatcatggtacccactttctagagctgttgtgagggttaagtgagatgttgcaagtaaagtacttagcacaagcctggcaggtggtagaatctcagaaatggcagccatagtcttcattatcatcatcacttgagttatgactccttcattcattgacctgatgtcaaggacatccgagaccccaccatgtgccaaggc

SEQ ID NO: 38913 - DNA, 1808 bp, Bovine  19866881229870
tcccatcctggggtccacgttaatgggagtgcaatatttgcatagacatgagacctcacaccggggaaattcccctggtgaccaggcttcctttctgaggtcaggccacatcatcagaccccgctccttcctctctggctctccccagcctcctgatggctttggtcccttctatctggctgctgtagatccaggctcacagatttagtcccatcctttcattctgggtggtgtccaagagggtgtgagggcagagggtgggctgggtatctggaatgaaaacaagttacaagggatacaggaaaaggcaaaaggcaggaggtattctggaaacctggactgtaatgctaacgtgactttgggcataagccttcccctatctggggcttagtttctccttctctccggccagggggttggtctgaataatctcaaagcttcgttccagagctgataggctaagaagccacttcctttagcagcacagtcttgcaacatttgtccttggatcttcctcctttgacttgaatcttgcaacactctgccctgtatctgtttccttgggaaacacaattttgcaaaacacacccctacattccatttttcagacatttacagaattctatgcacctccttcccccgacttggcttgagttttaatgtttcctttcacattcaccatgtatgatgtcctgagacccacaaaagtggaatagagcttccagatccgtcctccttgtggtctctccccctggcactgaaaagacaccttccctgatacatgaaaggggaatagtgaggtcctgcgaccacctgcatcagaaccaaccattagaaaagaactttgagggacttccctgggggtcctgtggctaagactccatgctcccaatgcagggggccttgggtttgatccctggtgaagggaactagatctcacatgctgcaacaaagatggaagatcctgcctgctgcagctaagacctggtgcagccaaataaatgaatgtttaaaaaaacacagccacagccaaataaatgaatattaaaaaaaaaaaaaaaaaaagacccttgaaagcagtgggcaagcttgtgactttgattaacctggggagctattaaaataccaatcccaggccataccctgccccctgagattctattattactgtagagtggggcctggacatctgtattccacaaagctcctaaggtgattctgatgtactgcctggattgagagtcactgatctgaagcccccatccaagaccaaatgggccaaataattctgacggacactcaagttgacgaacccctgacctatgatattctttatgaaatcctcctaatggacaccccttctatacacacagctcttcccagggttacaggtggacaaagagaattgattccttttcccagatgaggaaggtgagagacagagagaggaaatgtctgctgcagtcacacagcgagtcagcagcagcaatgggctcagtacctagtgggtgcctagcgcccctggcatactaggcccatgccgagcacccctggactcaaagtatttttgcagaagtcatggatttgacatctgggtgacccagagaagtgctcccacactcggtacctcccactagtttgtgacagtgagttctccttggctgcctgtatttgagcaggcaattctcatttcagagttggaagatccagtttagggaacttgggcttctcaaactccactaagttccaagatcacccctgaaagcttatttaaagtgccatctctagggccctagcccccagagagg

SEQ ID NO: 38914 - DNA, 1195 bp, Bovine  19866881239766
agcacagactcggcagttgtagcacatgagctcagttgctcctcggcatgtgggatcttcccagatcagggatcaaacctgtgtctcctacactggcaggcagattctttaccactgagccaccagggaagcccctatgattcactttttagtgacgagaaaaccaaggctcagagataatgcccaaggtcacagagccggaaagcaggggcgggctgggctcacccctggctctcaggactctagggagcaccaggctttccagccagcagtttccacagtgccaagctcctagacagggcctcagtgtgtgtataattcagaccttccaaagcctctgtgcttctgttttgtttttctcttcgcttctctgtttcagtcctatcccaaggctggttctcagggtcacagggctagaaaatgctccagtgtcagagcatgaagggccctcagggagaagctggcctgggaggctttagagagggagagggtcagagagaaggccatgggccaggacctggtctgctgacctccagccagcctggaacccttccccccgctactgttcccagaccagaggaacccagcagaaaaggccagggggtgagacagccctgcctccgagggagctcccgtacccccatccaagcccgcagtgactccatggaaaaggaatttggcaggaggcttggaccaggcccagccagcaatccagacgacttttgccaccctgcacaaacaaagctgagagaatggggggctgggccaactacaggcacctcaggtccccccactgcagggcatcaggggcggcagctccaccccaaattccccagactagggaactgccacccctggtgatgccccagccagctgggttcaagattgtggtccccagtgtcagagacacaagagatggctgtggcccacagcgggtagtccccttgttgagcccccagtcttcttgcacccgtaaaagccgtaacacccccctcttctcccagcctcttcagtggtgatccttgaaagaccgacccttctggagatgcagggatgagggcagagctgccccagggtcaggagacctgggtctgacagggttgaatccctaagtggggaaggggaataagaagccctgagtacacccctagagtaagctcgcagggctgctgcaagactagccctcagcagccca

SEQ ID NO: 38915 - DNA, 1138 bp, Bovine  19866881251055
tatttacataggtacctatgatgccttgcccaagctcagtggcctcactatcctcccagccttacctatttcctcctgtggcccggagtttgatgtggagggcagtgatgcccagctccttgcatctctgggctacatcctgggcagccaacatggcagcatatggagaggactcatctcggtcagccttcaccttcatcccaccagttacacggcagatggtttccctgggaacaaaagcacaggatcctttctttcttacccatcaaggattcagagtgcatatcacaccctaaagataaagagcactactgcccaggaagggcagaggatgaaggtcaatctgaacaaacatcctgatcccacaagaccgccctaggttctgcagtgatggtgttcacagatcccagcttaacactgcatcaacactttactcttagctttaatcttattacttgagtaataggagtaattcctcctcattttacataagaagtccacagactgtaaaggcaaaaaatgtagctccttttctcttaaaaccccagcacctagattacagtatctgtgcactaatcaaccaagcacatatccttatctgaacatctttaataaaaattatttctagagatccccttaaagtgctactcagttccctggtcatttctaaccccagcccttgctatctgggtcctgtgcctccccacgggggttaactcacttgccagaaagatcggtgacgtgcacaaaagtgtcattgaaggacgcaaagatgtggcagacaccaaatacattttctccttcagccacctgagggccgaggctgatgacctgttcttccttcttttccttccccttgcgaggtgccatttcttaaggagaagaaaaaaaattccaaccttaacaacaaaaccccaggtgtttacaactctgggaatacttcttccccgagaaaggtgagcaggacactgaagagctctggctctcccactccaggccgccaggagcaggaatcagggctcccaggtgactcccaacccaccctgccaagagcagagtgctcctcatctctggcttcagggcacaggcgcgtgataggtgttcagcaaacaacgatgtgcaatccctagcctcattt

SEQ ID NO: 38916 - DNA, 1137 bp, Bovine  19866881288976
aaagctgaaactccatactttgacccctgaatggaagagctgactcattggaaaagactctgaggctgggagggattgggggcaggaggagaaggggacaacagaggatgagatggctggatggtatcactgactcgatacacatgaatttgggtgaactccaggagttggtgatggacagggaggcctggcgtgctgcagttcatggggtcacaaagagtcagacacgactaagcaactgaactgaactaaactgaagcatagagctgtcgtcattgtggggaagaaacatgggtatttaaatattctcctatttgtctaggttttccaactttcctataatgaatacagattgtttcttaaaatggaaaggaaaaacacctctcaactaaggtaaaacaaagcatggggtcaaatactgtaagcctgaaaggacaagtcttaggactctgcagactccagtcctgaagtgacaattgcttagggaccagaggtgggtgggaggggaaaatgggagtcccacgtgagctcggcaggtggaacagaaggagtctggtccacagccttccaagtgcatcttgtccttacctcgcagggcctccgcatgctctccctctaggacttttcgctgttcattcagtttctctccaagttctagctccctctccttctccacctggaggcagagggtcccgagcagaatgagattcagtaggttcagggcagcctgacttatccacttaccacccctggagccttttggagattggtgatcagagtccccccagccccagtgatctgagtgatggaaataatgcgtacattcctatgagggcgcagagagggcgcaaggcctccaagacatagctgatgtgactgacttctccctctttagggcttaagagggggcttccagagatttaccatgtggaaagagattttggagtcttctaatcctgatgccattgaaggcagaaggacctttgctatgttggggggttccccacttttattgcatagaataaataaaacaaattatatgcccacagttacaaatattttgttcaacagatataggactcttttctgggcaaaaggagtaagagataccttgcaacaatgataaaaccaaaagtt

SEQ ID NO: 38917 - DNA, 1047 bp, Bovine  19866881300117
ctccccgctgaggggttccctggccagatgaaatcctgtctgagaaccccttccccacagagcgggtgctgccttgggactgtgaggaagaaagcctaagggaactgggcgtagtgcaggggctggcacaaccggaattcctatcctgcctttggaaggattaccataagcatctctcctcacactcacctccgaccttcatcctcactgttatctcatttcttccagaggcgccaaagaccagatcagcctcccaaaccagagcctcaggaactgggtcccctcaatggtgacacaggtgagtagtcagccctataaatgtcctctctgacatctgtgaggcttcctactttataatcaacaaacacgatatggctatttaattatctcctgggattttacttcggttgctttaataggagtatcatttctaagatcagggaggtgatagttcttccctgatcctggctattgctaccacacctggagtgctgagtttatttctgaaaagtacattttcagaaaaatctggaaaaggagagactacagtgaagaagaatcaggttgatgaggaatctggaaaccatgtcctttaaggaacaggtaaagaaacagaagatgttgcgataaaacacaacagttctctccaagtgactcacagagaagaaagatgagccttgttcagtgtgacccagaggtcagtaccacggcccgaatgtagccaaacacactggcagaattcagttcagtctcaaaggaattttttttgtctggttgatggtttaaagtcatcagagctactgatagaatgcgctctccatctctgaaagtgtttaattaccacctggagactatcaggatattgcagatgaagttaaagtaccagataagcaactgggtcagaatttagatgttctccaatctgactatacataagaattacctggagtggattttcaaaaataccaattctgaggccccaccacagaccaactaaattaggatctctaggagtggggctgaagactctgcattgttagttagctg

SEQ ID NO: 38918 - DNA, 1411 bp, Bovine  19866881323235
tttcccatgttactcacttacagacagactagtgactcttagctggcccacccactttatcaagcagggttctatggtgtccagcctctgcgaaaaagaggcctgctaccactcggggcccttgggtacttcttgtatcaaatctaatcgttcattagcttaacccagggtctgcagaggccacatcactgatagattttgagtgtgagacctgggctcaaagctcagcgctcctgcttgccagccgtcttgaacttgggcctgttgctgcactcttgggagcctcagttttatcatcagtggaatggaggtaataacagtcttcactgtaggttacttaggcaaagtaagtgaaatagtgtgtgcagcctatagtgttaaaaatggcagtagtagctaataatagctgacaaccaaaacagctttacgataaggaaaccaaaacagaaaaatgcaccccagtgaccagcttaaaggtatcaggaatttaggtcatgactggcttaacttggatgcctgggagtgagaaaaaggtgtggggttctaatacacttgtgaagttccaggcttctcacttagtctggggcttgtaagcttgagtgaaggcgacactctaagcagataacatggacaccttgaccacagaagaagaaatgggatagaaatgaataaatggggaatgaagagttctgctcaccgtttgctcctgcctcagggtgttagcctgtgagtgacctggatctcagggccacataaacttgcaggcaggcacctgagaactggtctcataacatttgggagctggaaggtttttacatgtgtcccattccaaccagctcactcctcacatgagctaactggggcctccatgggggaaagaagtggcggcctaatttaccagaaaagggtctgtgtttggggactctgattgactttatgttcaaatcctggctctgctcctgaccactgagtgaacttaaacgaagtcttcccttcctctgaaccttaatttctttttaagttgagatgaataaactagaaaatgatttgagtccctctggttctaaaatcctttgagtgtcattcttcattcatccatttcataagtaattaagtgtccttgaaacatctccagagcactaggaatacaaagaggaataaggggcagtctcattaaatatcactgggcccaagaacatgtatgtacagccaagtagaatcctatggctaagctgaaccagtgaaggtttgtacttaatgctgtaagaacccaacagcaaaagtggcccattctttgagtgagaatgtttatagtgatggtaacatttgggctggacttttaagagtgaataggagttttcttaggagagtaggagttgctctagaccccataacaagttagggggcttaa

SEQ ID NO: 38919 - DNA, 1090 bp, Bovine  19866881366370
actatttaaacaagtcacaagaccagtttaaattcaagaggaggggactaaatgaggcaaactttaggagttgttcattagtggctatcagtgtaagagacaaccacagccaaccagtctttctctttcaaaattggaaatgttcactgtggctggtctgtctctgttctttcattgaatgctggatttgggaggcaggtaagttgtaatttttagttcacaggtctctgaattaagagaaggtatatctgaaacttacatagaaactatgatgaaatcttgaaccttcagccttaggccaaaatgatggaaattttggttgcctccttttgggaaggggtgaggatattttgcatgctaagttaaaggaggtaatacttgtggccatacaagtggaccaggcaaatttaattatttttcaaaaatattttctatcttatcagagcctttgaacattgctatgactattattacattaaaaattacccaaaactcatgattaaaaaaaaatacaggtttgctatttcatagattttgtagctcagaagtccaggaacaatttaactggatcctttgcttcagtgtttctcatagattgtaatgaagttgtcagtcaaggctggggttcattgaatgttcaattagacaaggatgtacttccaagcttacttgtacttccaattcattttttcaccagttttcttccttgttggctgtcaggtagaccctcactcagttccctgtcatgtggcacactctccacagtgcagctctcaacatgagcagagtacttcatcaaaattaacaaggaagaacttctactagtacgagattttcatctttgttacataataacagcagcgacaccctgtcacctttgccatggtctctgttagaggcaagtcacagatcctgtgaccacactccagggaattgcacaaaggatgaccgtataggtgttggtataaacggggacggtcttcaagtctgtctgccacacgaagtccctcactgagggataattagagttttgtaccatttaagacctgaacatatgcttatttcagctaatggatgtgaattatgtgct

SEQ ID NO: 38920 - DNA, 1204 bp, Bovine  19866881685151
aggccagagcaaggaaatacatgtactgatcacacatgcacacgtgtttttacttgtatattttttaataaaacattttaaaaataaacactttataaagtatttttaaaaatagttaactcttgccttcagaggacttttggctgatgcgtggaggaggggagggcagctggcagtgccatagagatagagcctgaacagggaaagaagtgtctatggggaggagggtgggggtaaaaagggcctcggagccactgaggattggggaaggggaataatggtctgtgtggatgtaagaggctcagttatggttgggactggtgggtgagagggtagaggggcaggagacaggaggctgggtctcaggggtgagtagccttggaggcgcactgagtgggcgagagaattgctgtgtgaggctctgctgtaggcccctctgtgttcctcctcaggctggtgtgacgacaagtaaaatcccagaggtggggtccctgggtgcggctgagaagaaggtgaggatgctggagcagcagcgcacagaggtaagtggctggagggggtggtgggggtcagggaagatcctttcccccttccggggccagcaggacaaaggcccttcctggcccctggctctgactggtctctgtgatgagctgtcatggtgaccactgaaccatctgcccaaggatgagacatgctgccttgctctgggctcttgtctcgtaatcagtccccctgcccataggagtcgctctgagcacatggcattcagggcatggcctatcattgttgaagggggcttagtttagaaaggctcccatggtgaaccttgagtggtggcgagaggttgtgataggaggcaagtgcagcatcaggaatggggagcctgtcacctgtcaccatgcagctggttcaggaagggtctgtcacagaaggagagaccccttacctgcttgtagcactgctcccaatcagccgagagtctccagaaatggaggctcttccttgtgtctcatgcgtgttccgccctgatgtctctggaccagaggtgggagcctgatcttctccgttgactgagcctctcctttccacgcagttcaggcccttgtctcaatccctgggcctctctgccctcccttgtcctccagcacattgaaagttaggctccactggtcttttgtttaggcgcaattcatttagtttt

SEQ ID NO: 38921 - DNA, 734 bp, Bovine  19866881985192
cagctagtcagtggcagaaatgaaatctgaacccaaaccccatgaaatggtgatggctccagagcctataggggaatcttggcagggacaggggagagcatgaggggacctcagctaccaagccctcaaccaagcctccaactgtgctctttcagccctaggcccagctttccctgccaaggtgctggggataatgaatgagatgctctggttgtcatggagatgccatggcaacgctgcactttcgggaaataccacggtaactgtggccactgctctgttgaaagtcactcatgaccccaccccccactccaaaatgctcaggtgcccccagaatcctctctaggacgcaaagagaaaagaggcagaagctacaaggaacttctcagaaaccaagttgtctagagaggaggactggggaggaggttgagctctgccctggatggacaggtgggctctgaagtgagaccaagagccccctgagcctttgacggtgaagtgcacctaacaacccagctcccgtgcacttgctgcctccatgtgcagcagcctaccatgaagagctgcatgcatcatgctgtgtcatcccaaacatctgcggggcagtgatgcagtagctgctagcatccttgttaaaggtctttgtgcaaatctctccacctctctgagtctcagtttccccagcgtaaaatggggtttatactacttatctatcttgcagggctattgccaag

SEQ ID NO: 38922 - DNA, 1542 bp, Bovine  19866880371264
cgtgtgtatgggcatttagatttctaggaatatgttgatttcaaggtatctaagaacatctcttttggcttctcctttaaaattttttggttagcccactgtttttgttaacttattcatcacccaagagagctgtgacgttaaaattcttgcctgtaacagttttagacaaacacttccgagggatgctcccctgttagtgatgggcatattccgagtcaggtcaaaaaaaggcaatactttctattggtagcttgtaggggagcatcaaagatggcaaataatgacaacagttctttggcatgagggtcttaaagagctccaggtccattctactccctctgatactgacaatgcagggctgatatttctcaaggttaccgttgagctggagagcaggagatgagagtagggcaaggtgaaaccacaaagtttgctcttcttacagagatttggccatttttctcgactaggtaagtctttggttagtttctagagttctggaaaagctgtaataatttttccagttttcatggaagggtacattttcaaaggtccttactccaccattttcactgtcatctgggcatttgtttctaagaaaaacctcttaagtacttataagatttactttccaaaccttttactgtgagaattaatttttactacaattgattttatctcttctcactttaattcaattagcatgatgaaatataaatatttcctacagggattattgagaaataaaagataatacatagctatatctacatggacatatgggttatagctattacccgcagaaaaactgtttcaaaataagccattataaacttagagacaagcctgattgttataatttgggtgctatagccatgctattaagaacaaaatcctattaaaatcaatttgtgaaactcataatcctttaatctgttctgcaataatatgatagtcaaatcctgggaagtacctcattaccaaaaagcacattttaaaaacaataatctcattgaggaaagaggatttctggtcagtcaagttaaagcctaaaaattctctagatttagtgataagaaaattactgccatttactacctacatatttaaatttcttgaatcggtgggtttacagttttaatcaaatttgaaaaaaatttagcttttatttcctcagatacttctctgaactgaaacatccctaccatgcccccatccccaatatacactccttctgggactccaattacacatatattagggtcactgaagttgtcttatgtttcacagatgctattttcattaaaaatttttcttttcctctgagtttcattttggatcatattcattgccatagtctttaaatacactaatcctgcaagtttaatctgctattaatccaatccagtgcattcttcttttcagacactgtagtgttcatttccagaagtttgacttggatcttttttatgtcttcaatgcttctacttaccttttgaacatatagaatacatttagaatccgcctgcaatgcaggag

SEQ ID NO: 38923 - DNA, 2171 bp, Bovine  19866880483659
gggtttgcaaagagctggacacaactgagtgactgagcacacacatactttagtgcgcttcctcttagtgtttttcagggcatgcagtttattcgtgagtttgtagacagaaagatgcattttcattttggatctgagaatttttcatccttaaaaccatataatgatttcctttgttttttctcctgtaaattcattgagcatttgaattgctttgcagggtctttgctgtaaattttactcaccacataaaatttaagtcaagcaggagaaatgtaatggtataacagttaccttttggtaagtttatggagaatgtagggtagtatactaattttgcttccaagggacccacattttcatctgaaaaaaattatgaaactgagtcccatttgtagaagtttctggaaactcaaattaagctgcctctatacttctgtaagaaacaagtctttggtgggcttttgtatagtttattgcattgtatgtagatggattgagctagttacaatagtctcttataaatcacagagaggaccatcactctagttacaagtcctacatacgagtcaaatcttatcaaaacatcgaacatcatagaaaccttgaaaaaagcctgacattttgttaaaacaactggcaaatagatttttccttcctctcttctgcattcctttccttatccacaacagtatgcaatttgtataatactatatccagtcttcctcatttttccttacccaagtaccatctatgcaacccaaaattaatttttcaggcatgaaactgggcactttgctgcccaatgcagaaagcctttacaaatccagctggaatagagtggaagggcataccagattgatgtcaaggcctgctcacatggaagtaaaattaaacttatggactggagaggcaagcttaatttttatgtgcctcctccctaaaagccaactaaaatctaggaagatggaaactatctgagctggtttgagtggaccaaacccatttcatttttaagtgctacttttggttcattccttatgaagtgaaggcagagactagttcctgtgggattaagaacaaccaagagagcctctaatactagactattattgtattagcattttttagttccttgcccagatagcctagcctgtgtctttctaaaaaaaatattttttaaaagaaagagataaaatacattttctgttcacccaaattttaattctctgaatttcattcactgctaagcacttgcaattcctggaaaactcattagattttttcccctagcttcctccacgacaaagctatgcttccccagtggaccacctcatctttgagtttctagtccttggaatttcacttctcagttccaaagctaaggagccagcaggcattccttccttgtctcaaagtccttttccttattttgaatgccccagtttgtctaaatttaccaagggggaaaaggaatgtatcacttgggcctgaaaaatttcttgctgagtccatattccatgaaaataacataatgatagttggaagaagttgccaatcccaatttaaaaaccaaaaacctaaacagaccagataatttcagagagaatcttcctgtgattgttcttgctcatacagtgattgaaacaattcaggcttaactatacagttagttttacagaaggtagagctagtgatcatgttgaactgaattttccccatcctaatctatttcagataatagagtctgtgtagaggatgagttcttagacagtgtttttcaactgctagccaaggtgtgtttttttatctgaatacctgagaaatcacagtttcctctttaatccatataggtttggccacagtttttatgtatattctgtgattggagtctatgccatagtcattgaattttggaattaggagcaaccttagagatatctagttaagtgccctcctccacattctacaagtgagacaatgcagtttgtatgagatctcacagctgaatacatttgagatatttttagtttaacttccctcccaaggaatcagtgtttaattctttttatatccaaataatatttcattgaatggatatgccatactttgtttattcatttgatttatttccacctgttggctattatatataatgctgctatgaacat

SEQ ID NO: 38924 - DNA, 2286 bp, Bovine  19866880547495
atatgatgaagggttttatttataggctcaaaagtgattttatttaattcttaatttctggttttgtttatatgtataatatagtttgttttggtaaaatagtgttagaattttagaagctgtccctctggcacgttcactatagaagcgtttatacctaagctattttaatcaaagctgtaatgaaagtgaaactgatgttcaaaatcattttctaaatatttcatctctgtgtgtatgtgtatttttttgaaattgttttcccgtgcatgtacctgggtaggggtagggatagatgtgggtctatttgtatttatctatctaacgctgcatgtctgtctcaatggctcgtgtatgtgtgtgtgtgtgtcagtgtaagtgtaaactgcagagaattctgaagagagtcatttttagggaattcttttcaaagtagttcgaattttctcagaaaaagttcccctcatatgtgttatggagtcagttcaaagtagactatttataggtgttatttaaatttgaaggttttctgcttaatgaatttgtaagttgggttgctttcaggaagacttaaagatggcttcggaagctaagatttgtcagtgcttggtaagataggagtgtccgaagctgtggtgttgcaaaattgaatactaacactggccgacacttgtcatttgcacagttctctcttttggaaatgtttttttgtcaattgggccttttttctttttttctttttctaatggctctcttaacggaccaagaccttgaataatgcatcattagtaaaaccagatataactgagttgttataagctgccagacctccagggtttgactcggggctccgttcttcccgcctctctatcctgtttcttcatccgcagaatggggttaatagtggtgcttatctcaggattttgtgccgattaagtgccttgaacttagtgagtgcttaatacaggtttcctattattgtggcagtattctcatctgacccctatatttggtcactggagagtgtggaacagctttcctgctttgaaggggctgagccagtgcagataactgagcagtagtatgtgcctagcaattgcatagtggctcagactgttgcaagagtctgcctgcagtacaggagacccgggttcaatccctgggtcaggaagatcccctggagaagggaatggcaacccactccagtattcttgcctggagaattccatggacagaggagcgtggcaggttacagtccatggggttgaagagtcagacacaactgagcaactcacatttattatgtgcccagcaattgcataggtaagttatattattcatatctttttgttatatactcttattttgtaaaatattttggtctaaggacattaaaacttagatcaagttgatctatcttgttgataacaagaagggagaagaaaacatgttattttacagttagatttacagaattttccctctcctctgattgtgctttatccaggctttcaccatgccaactcccaagcaaatgcttttgtcaaatattttattgtcaagaagtagttgcgtgtgtgcaagacactgctgtgtgccccttcttactcttcctccaagatcagaaacttctgggattccctgtgaaccatttgacctattctgggcctgaggccttttgtgatctgaccttgtccatggccttgctcgttcctccaggacactcgtctgccccttggctagccaggcccaacacgggtctgttgaatggaaccatgaattctgttgccttgccgtttatccaagaccagtccttcctgacccctaccttggcattggcactgtctacatttctcttacctctttgagttctttgagggtatggatttgttttctttctcttgtgtatgccttgttgccctaattgggtttcccttaagagagtttgggcgtctacgcttggtggccccattgtggggcattcaggggttcttcctgctgaaagaggagcagtggtcagtgtcttttctagttccctgtttaggaggttagtctttctcaaagatggccgatggactatcttagacattgagttcttattattaataatcacatttctattagttctaggcacaagaagggcaatctagaatttattaatttagtctcttcagcctttgctggggtgagaagcctcactcctaagggtctgagccttgaacatggctgctgaggaggagcagctgttacctggtccagaagcgtgttggtttgggatggggtggg

SEQ ID NO: 38925 - DNA, 927 bp, Bovine  19866880636022
gatgcaaatttggcatcataaaaatttaaaacatgctcattcaagggcactataactgaaaagaccagaagaaaatattcacaaaacataccagacaaaagaacagtaccccagaaatacaacccccgcaaaaaaagatgaactgacagatggataaaggaatggatagatgaatatatatgataaagcaagtagagtataaaatgttaatggtggaatctagagtgggcatacaggtattcactgtgaaattctttcatcttcaattataaaatgctggaaaaagtaacttcatctcagtacacttaagatttagtaaattcaagaaaatactaagtcactggtcctattaatagattgtgaaacaaaattttgcacacctgggatcaactatttaaagaaagttctgtagagtctcagagaacatgcaataacttactaactttaggccttttatgcattaaaaaaatcaattaattaaacctatttgcaaataccttagattctctggaaaaagaacatgaatgcattgagacatctgcctacatgtggtcatcaaggaatagccccagacataccaactgccccactggtgttgctgtgtaaagaaataggcttgcaaagaactagcctcagaactgaagtgtggtcatttaagagaacaaagaaaatggtcccaagtaaatattggttctcccctacattacagagataataaagaaaagaacacaatggttctaactttcaaaatcaaaactatgaataaagataccactgaagacacacagttataatactaaattaacttctaattaagcacttatgacctgggcatcataatgtttcacagatgatttcccatttaatccctataccaactctgtgaagcaggtacaagttattattagccttttgcttcttcagtca

SEQ ID NO: 38926 - DNA, 1584 bp, Bovine  19866880684061
agaagcctttgctctctccttgttactttcaatttttttaattgcctgtgattttggagaaaaataaaagaatggaggaggattgactatcaaagacaatcgatgagctctagaaagctaacttttctttttccttattaattatatatttattaaaatatatcattattgaatggttatatatgtatatatatatataatatttcacactgcagtatggtctaggcatgcactggtggataaaaatgtgcatggccatgatcctcacagagcttgttgcctaccaactgggacagattttgaacaagtaaagagacaagacaaaatactaatgggtgggttatatgatctttgaattatatctccataagactgtcaccaaaaaagtaaagactatggagaagggtctttgtcagtagagtgtcaggaccatgtctccactctgtgttgctgggggagggtctcatgtaccatcccatcctctgtgggccctcagtgatagctggcccatgctgggtgctgctcacaacatctgtgcaatgatgatgtttgcagagccagaatcaaacctttcctctcaaagactatggagactgagacaaaacgttcagtggccacctcctatcaccagagttctggccacattccagacttggcaaatcggatcggctattcctgaggtcactcctctccccctctcctggagggtaacttccatctctaactgcttccacagcttcattttccactttggtgagccaccaggcagacaatggagaatgtgtcatttcggtcctcatctgtgcagataatctgataccatacacaatcctttagcatatttcttctgtatttgtatcttggcaaaggcaagctacattgtttgcagttctattccagctttttctggaaaaatcacagaaaagatgagaatacctcaagccacaagcacttggctccctggtgtagggttttgcacattcccctgccctcctctttggtttccagctcactctctactccctttctgtctctctctgtctctctttcagctgatactcttgacaacaacctctatagactcttctggggctcccaggtgtactctggagctgcctgagaacacactaatccctttcctctttcacaccgtgaaaatcaaacattccagaagaactcttcttccaggtgaaacagactggcttcatctctgacaggttttctacttgtcctgacatgagaggcaacgaaaaattaggtgttctccaataggctctctaagaatacaatgaaaggaagcccctcatctaaaacagcccagaattccagtgttttggacatgtcctaccatctacaaatcattagagctagctcctctaataacagcagggacttgttggacttccgaaagataaattactgtttgctccagcaccacatttagggacgctttccctacagggccaagccacggttacaggcatgagagtgttcatttggtgaaccagagttgcatattggaagttatttaccaaccttcatcactaacaatattaaaatataagccttggcttgtgagtcaaa

SEQ ID NO: 38927 - DNA, 1786 bp, Bovine  19866880835442
ttgagtagtggccaggcgaagcaggccgttatacgttgctgatgagatggcagcatgtttggcaatgtgtattaggtaccttgaaaactcttctaggaattgactcttaaggaaaatagtaaaaaaaaaaaaaaaattcatgcacaaaaatcaggtatcagttttctgttgttgctttaaaaagttcccacaaacttagtggcttaaaagaatacgaatgtatcatatgacagctttgtaggtcagaaatccaacacaagttctgctgggccaaaatcaaggtgttggcaaggcggaattcctttaggaattaccacctagagcaaggtgatgctctggggaagaatctgctcctttctcgacttccccagcttttagaagcagcttacatttcttggcttgcggcccccgtctgccgtcttcaaatccagcaacatggcctccctctgactctgataccgttgtcacatctttttttttttctgaccacagttgggaaaggttctcttctttcaaagacccgtgtgattagattgggcccacccagagaatctccccatctcaaggttcctaactgaatcatgccttcagagtcacacgttttcgccgtgcagtcacacgttcagagcctccagagttaggacgcgggcatctctgggacaggggcattgttctgcctctgatgtgttagtatattcgtcccagtgttcagaacagtgctgagctacaaacgctctacaacaggaatatgtttaaattacagtacatacagatgttggagtatgaggaagcctctaaaaatcattggaagaggatgacacgggcagtgaaaggcaggatgcagtttctgagcagcaggagcccatctggacttgggggaggagggggcgcaccatctggtgggcggcattgtgagtggttttcattttcttttctttttttggtatttcctattataagtatgtataactattattcccccttctctaaaaacttttaattaaatcttaagggaatgtatgttttatttaacaatggtgaaagtaagtatgctaaaaacaaacgctaaagtcaataaaatttacattatgctgtaaaagaacataatttaaaggcaaaggcaaagtgaaactttcactaagcattccctaataaaaaccctataaaatgaggcatgtagtaattacttgggctaggattaaaggcacataagaatgtctttaaacattctatagccaacatacaaaatgtaatgcagtctaattataattagttaaaatacaacttaaaatatatatatgtttatgcaaactcaaattaacatttcaaaataattatttctgtgtgacccatacatttgcataatttaatactcacactggagtgcagagaagatgtcagtaaaacaatgtatttattatttgtgtatgcataatattggagaaggaatggcaactcactgcagtactcttgcttggaaagtcccatggacagaggagcctggtgggctgcagtccatggggtctcgaagagtcggacacgactgagcgacttccctttcacttttcactttcatgcattggagaaggaaatggcaacccactccagtgttcttgcctggagaatcccagggacgggggagcctggtgggctgccatctctggggtcgcacagagttggacacgactgaagcgacttagcagcagcatgcataatatatgtagtaattcaaaggaaaactcttaatttagaagctaaaacaaaacttcacccagtgtcatctcat

SEQ ID NO: 38928 - DNA, 1166 bp, Bovine  19866880897092
gaccgctgcgctccagtcatgtccgccttcggcttcccgtggcccgacatgctcgactgcgaccgcttcccccaggacaacgacctttgcatccccctcgctagcagcgaccacctcctgccggctaccgaggaaggtaggccctcctccttattacacccccaccaccagctccacgaagaccccgcatcccgttgcgttgacagggggccagtcccaggcggggcagacgctctccttgccctgatttgtcagcgtgacaaaactgagataatcacccctacacacacaccaaaaaaaaatatatatacacacacccaagtctctcattcccttcccctgttataccaattgctctttcataggaacagttgaaaagggaggcgccgggcggggtgggggtgcggagaaaatgtagaactgaaagaggtcttttctttgtagacacatgcaccattctttcaaaagatgctagcacgggggccgcaattgagatagttggaagtggccctccgcggaggagttggcgggtgagcacgctgggcagagcaccctggcctgaatctcacgcagcacgtttttaccactgggcaggattctagacgcagggacattccctacagccacgatcgccaaaatgtgcaaacagatagtcttttaaggcactctctgtttgccattcaggctttgaaaataaaaagtaggactggctcatgtgtgctgaaaattcagctttggttgtaagtgcccaggtgtccaagaaagaagcacaaagggaatctccagaactcatttttctatcactaatcagcttttatcttaggagtggttttaattaactggagaaaatcgtgcaaaagagaatttcccaagtttttttagaaaacagagggggagttcctgcgcagaaaccatcaaagcaatgaaaacctcatgggctcttgatattcttcctgaaaggaaaacatatacaatgtgtctgagctgatttaggtcccccgggacagaaagggggcttcctaatccctttcagggctccagcagcatctccctttcaatctctaattgttttcctacagccatcgttagttaaagaaaatgcaaagttgcttagcaatctttcctggcaggcaccatgagtctgcaatcatcttatggttagattt

SEQ ID NO: 38929 - DNA, 1078 bp, Bovine  19866880900773
ccatctattcatggcaaatagatgcagaaccaatggaaacactgacagactttattttgaggggctccaaaatcactgcagatggtgactgcagtcatgaaattaaaagacacttgctccttggaagaaaagttatgaccaacctagacagcatattaaaaagcagagacattactttgccaagaaagttctgtctagtcaaagctatggtttttccagtgggtatgcatggatgtgagagttggactataaagaaagctgagtgctagagaattgatgcttttgaactgtggtgttggagaagactcttgagagtcccttggacagcaaagagatccaacccagtccatcctaaaggaaatcagtcctgaatattcattgcaaggactgatgctgaagctgaaactccaatattttggccacccaatgcgaagaactgactcatttaaaaagacactgatgctgggaaagattgaaggtgggaagaaaaggggatgacagaggataagatggttggatggcatcaccaactcaatggacatgggtttgagtaggctccgggaattggtgatggacaggtaagcccggcatgctgcagtccatggggttgcaaagagtggaatgtgactgagtgactgaactgatcttaggttattgcgtacaaattattgacgtaagttgttgaaaagtaatgggtcccaacagtttttaatataaattagccagtattatatctgcttcatgatgagatgctttcaagagtatactcacaattttaacacatagaaaagaaatcataaagatttactggagctttaaataaagcttccttattctaggaagaaatccaacatggaagtatttaatacagattatttcacttctttcaaatccagtgactcatcaagcctcttccaggttgctatacgaggtctacagaaattggaaatcaggaaattagtctaaaaaattactctttgctgtcacatattatgttgtatattaaaaaacagattgaccctggtgcttccctggtggctcagtggtaaagaattctgcctgccaatgcaggagacat

SEQ ID NO: 38930 - DNA, 707 bp, Bovine  19866880939231
atttaagaggacaaactgttgatccctatcccgacaggagtttttctcctaggactggtcttatgcagcaccctggccttcagcgaagggtcaggaaatttttcctctaaaaaaattacctctccaccttgaagctgttattcattagcactgtattaaaacgaatattccaaatatctagcagcgctctgaaatgtaaaactgcacagcgtcaccaatttccagctacacatcctgttttctaaacagccacaagagacaacatagaattaagtgctaccaccaatggaggaagtaatgaacatcctcaaaactatggcacacaaactgactattccctgaggattcaaagcactcccccacgtacccaaaacatgcatctcccatgctgtgcatgcatactgtcgctgctcaaagacactcaacaatatcacatttaagtatgtacatctgcagtcaatgaaaatttctcctgaagttaaaaaaccttaaacacaaaggctttgctgtactctatggcagtggtaaatcctggatgatgccaaatgtccaaccaatctttaccaacgacttttccacgtgccatcattatatcgcatggggtgggagtgggggccttaaattcgagttcttaacaagaggctgtattttaacacaaattaaagggactggaaaagatccaagatcaccatcctttaaagtcccat

SEQ ID NO: 38931 - DNA, 1084 bp, Bovine  19866880994039
atttgcacaaatatgctggaggcagttggagttctggaagttgattagccatttaaatcactatatctttgtgggaaatgtttttcaggtttcagaacgtctgctgtttgagcaatgtcttttttggtttcagttgttctaaaccaaagtatctagagaggcataaaatctggccgacctgcttgtccccctctaggctcaggactggcgttttagaactttcattgccgaccttcaaggatgctggttttaaggaccaggaaacaaacaacacgggaaggctctcgggttaagactcctgaaaagagagatctgacagaagaccaaaaatgtgaaagattacacccagttttgttttagaatgttctgtccaatcaggtaggagaaaggaaagctgttttttcaagccccatctgtcaaccaacaggatttgttgaacaaatattatgtttcaaaccccactgctttatgatctaaggggtacaatagtgtaaaaggcggagcaggagccttgaaggaattttcaagctttggtggtgccattagacgtcaatgatcatccttctcccacctgttcactgatttccttacctgggtaaccaggtctagggctgggctaggagccccctctataattcagctcagatgcctgcgagttgattcctttggcagcaaaagttgtgttcttggcccttcaacacgacctggataaagtgacactttctgtcgatccccactccggtacatggctccattcctgtgatattccttccccagccatcaaacagttcattaatatcaaaataacccataataggggcatagcaatccttgagacttgccttaatttagaggacaggatcaggtctctttcatcttgaaaacagcctctcagactaaacaaagacagaatgttctcttttactgaccacatgcaatttatttaaattagtgttaaacattcgaccatggtgtgaagactatattataaacccatctgaaagaatgagttttctgggccttcactgagggattaaaaaaaaaaaggcattagccacattgcaggggatttgcatcttgttag

SEQ ID NO: 38932 - DNA, 1765 bp, Bovine  19866881033834
ctccattttgaaagaaaatattttgacacattccagaaaacaaaaaatgaagcttgcatggaaagcctcaggagcaatttgagtggaagaatccaaggtccttcttcacaagatcggagatagcaaatatttgcccaaagtgattactctcaactgcactacttaccagctcaatctctgtcccaacggtgccattaaatccttgccgtcaatggaaagcagtgccatgacctcaagtcctgcacttgtcaccccataagacattcagcttctatttcctctcttgccatgtaggagggcattccatctgctcctgggacatggatgccttgccttgttctaatcatgtaccctctgtagatatactctgtgaccgtcccagaatcagcatcacctgcaaatttattagaaatgcaaaatctcagctcaactcaggtctactgaatctgaatttgtatttttatttaacaaaattatatttttatttagcagaattacctggtgattcccatgcaccttaaaagctgagaggaaatgttctaaagcagtggtttccaaactttagtgtgcaccagaatcctctaagtgggcaacaaaaattgtgggctcctttcccagggtttctgattcagtgggtcttgagtagagcttgagaatttgccttaaaaagtttccaggtgatgttggttctgttgatctgggaaccctactttgagaaacacttccctagaggtctcccacaccaccaatgactagacctgtagaggaggctttagaatctaaaaggatatgatctgcagctgattataaacagctcataatatgagtggcactgcttccttgtttttctctgctttgccacattctcctgccacctgctggaaatctgttggtctggttttcctctaccatctcccagtttgcatcaccccatcctgccctccctcacctccatgctgtaacacagcaggggtctgccaagttctgtctgacctgatgttgatgggagagacttctttcctgaccttccttgggtcacctcccaatgaatgagccccaagactgtgcactgctgccctcctgtcctggctctgccatttgccactttcctccatgtggagttattttaaaatcctgaggaggaagtcagctcaggctctgcagccatggacctctaaacttcatgcacctcactccccatttttctctttagcatagtcagttgtactattttcaagagatttctatctctggcactgggaaagctctaacacaattttggcaattacgagtttgacagaaaggacccacagctaaagttggacattactgggaatgctgactggcatggctttagactctgggatagagtagggctggagagccagtgtggtctgttccctacaggcaaggagatttggaaagtgtgcctgtttccctgaggaagaacctaacacctcaaatccattggaaaagtggtcttgtcatgtgcatgctttcgggccaatttttcaagccacagcttaaatccatcaaaaatgttttagctaaaaaacgttcaaagtgtggtttataggagtcccatttcagccttgttcagcaatggactaagactgcgatagtctagagggcacttccaaatctattttttagagcaatttcttcttccaaggcaaggaagactattttctttatataaaagcaatacacctttacccttgcccccaaaagcagtttcatgtaaagctctcccatttgcctgaat

SEQ ID NO: 38933 - DNA, 2513 bp, Bovine  19866881037377
cctcccacccccatcactttccctttcactcaggaaatttcaaggttaagagatggtcctgcctcaagaaccaggaacaaagactaaaatacatatttcttattatatcacaagatcacattggtataaaaggggtgatgggagatgaaacagtggaggaaacaggtgtccaaatataaaaggaccttattaaagttacatgtatccagcagtcattagggaaatactgaaatattcaaagggagtgatatagtcatatttgcattttccagagatccctctaggaacagtgtggacagtggatggagacatgcgagactgacagccaacaccagtgagtactgggatagagctatggcgatgccattgaagaggcataggcagatggtagagacagaacaaaggtcgattttgtgggacttcactggatacctgatgagaggagtaaaggggaagaagaaattaaggatcactcttagatttcaagcttaggtgaccaggtggacagtgacccaagtagccaagtacccagtagagatgaagaagaactggctttcaggcagatgtcagtgagaactcttttggatttgctgacatcccagggaatcattctagtagatatgctaaggaggaaactagaaagacataaatggagctcagaagaaataccttacaggagataaagatttgggagttataggcctgtggttagccatggaaatagcaaggctaaggtaaaaagatatgacacagcctctttagagcaagcgtgcatggagacccctcttcacccataagaaggaagcctaattggagggtacatgcctaagggggctccccactcttgacagagctctctggctaggagggcaggagcctggatctgccttaaggagctcttcggcaacatggctcttaggaagcaggtgcgctcaaagaaaggcttctaacgtaaaggcttcctgtgtaatggccaccatcataactgcaccaccagtgtagagtcaaaactgctccatgtgaaacctgaattatagtatgtagtgacatatgcgagtttttgtatacagtcagtcctcatcactccagattctttatttgcaaattcacttactcaaatttataacctcaaagtcaacactcacaatgtttttgcggtcatttgtggacatgcctgaagtgtcaaaaactcgagtccctgacgtacacaatgccaactgaggttgaacagctgatagtctcccttcttgtttctagtctcatgctgtaaatgagtgtccttttcaaggcagttggtatcatatattttacacttttgcacttctggctggtaatttagctgtttaaaaatgctcccagcatagtggtgaagtgtggtctactattctaaacacaaggctataatgtgccttatgaagaaaatataggtgttagataagcttcgttcaggtatgagctatatagtgctgttggctatgagtccaatgttaatgaatcaataatgtatattaaataaattgtctttaaatagaaatatacacaaaacaaggtcatgtattgaccaaactatgaaagtgtgcccagaggcttgcaggaacccaaccctgtattttccctaggattatgtatgctcagttactcagtcatgtccaactctctgtggtcccacaggctgtagcccaccaggctcctctctccactgaattttccaggcaagaatactgaagcaggttgccatttcctcctccaagggacctttttgacccaggagctaaacccgcatctttgattggcaggcaaattctttaccactgcgccaccagcagtggtttgctattcattaatccagtgttcacagtgactgtataggatataattactgcaagtaacaaggattaaccatatttgcagaagtctagaatgagccaagagccacatcagtgctaaacgaagctcctaatttatttaaaacagctcattatacactcacctaaggttcagagtaaggtattgtttttgagtttttatttgggcttctgaggatggggcagggttgagggggagatttactctttgaatcacctgaccagtgattgctgtcatgtgaactgaagaagtaaagcacatcatggagtccagggtcccatcctgccacgtatttactctgtgatcacagacaagggtgtgctctctctgaattttcatgcctcgcccatgaaaccaggcaatgacacctcagatccctatcagttctgacagttcatgatgctgtagccagtcccaaagcaagagacactgccatccactgtgactctaggacggcataaggcttgggaagaaggatttactgcagtgcctttcctatattccccagagcaacctgaggacagactcattagattattgacttaaagattctgcaactcttgtctaattttaacttttatgacagtaataaacccaaaggaaaactgtaaaacaaagcaaaatactctcaattatgttaaacttaa

SEQ ID NO: 38934 - DNA, 1706 bp, Bovine  19866881039103
aattttgggattaacatgtacctactactatatacaaaatagataatcaacaaggatctaatgcagcacagggaatgctactcaatattctgtaataaactaaatgggaaaagaatctgaaaaagaaaagatgtgtatgtataaaagatgtatgtatatgtataactgaataaccttgctgtacacctagacactcatacaatgttgtaaatccaatgttgttgtggtttagccactaagtcacgtccgaactttgtgaccccaccgggctcctctgtccgtgggaccccatggactacagcccaccgggctcctctgtccgtgggatttcccaggcaagattattggagtgggatttcctttttcaggggatcttcctgacccagggatcaaacctgtgtctttggctgggcagggggattctttaccattgggtcctatactccaatacaaaataaaaatgaaaaaaaagaaaagctatacaaataatcattttgtttgcttatctctctaagtcagcatgttttccttgacataattcaaacagtttacatgcttctgctccattctgaaattatgaaggctaatttaatcttgttttgcaatgaggaaaatgtatatcgtgaaggtagctaaagaactaattagcccacttgttacccttgacctatagttcaggtttttatgtttatcaacagagaagtgacttaaatcaagaattcttgttaactgcccacgttatataaagaaaaaaagcccaactatttcataaaagctacatggcaacaactgtcaaagagaagagaaaaataaaaatgactgggttttttccctctaaatgagagaaaagttgagtttaaataactgcctctacagtactgaaaaacctgaaatgttttcacaattttaatgactttaaatttctcatattttctatttttcccacctaaaatgtcatttaattatttataacttattcagatgaaagcatactaagaggcagaagtatgagctgaaatcatttttatagttttcttttttgataaatttttactgtaagtttttatcattttgatgacagtccttttctgatttcaaaattctgttcatctcaataccacctccacttggaagtcttccctgatagtcttaatcatggaaatcttctcttttttttctggatatttagagaactttacgtgtagctattctacctgtctgttttggccgtgcatctcttttggccgttcagtcccgaccagggattgaactcacgcccctgcactggaagcggagtcctaaccactggaccaccaggggagtccctatacgtacccattcttaaaaaaggcatttgttgctctctgccttgcattttggctacttacatatgttttctttcttcctacaatgttaggactggtaaataggaatcctcccactcaccgaggccagctggctcacacagttgcctcgagcaaagggaaaggagaggctctgagccccagctgtgctcagtggaaaagggcagcctggccactgtcacgtcttctgctgggcgtggtggcacctaggccaggcctcgctggccctggcaccactgagacgtatacgggtttccttcttgttcaatgcacaagggttaaatgaagggccgctctataaacagagtggagaggagggagtgtcatgatggcccatgggtc

SEQ ID NO: 38935 - DNA, 1527 bp, Bovine  19866881149416
ctggggtagttcatgccttctgcaaagagcggagacatcagcagagcagaacacggttcaggagagaatggaattctcaccctcaggcaataagctttcaaggacttactgtgttgacaagttaaagacagacataaaataattactccatgaaacacagcacctggtaagccctcagtgaggaagttcttcctctgggcttcattttctgtgtgtgataatctgggggaactctgtaatatacagagtacgctgtaatagtgctatgctttatagtagtaaatactactgtacacttaagagtgtcatggttctttctagtccttaaacttttcttttattgcctgtcatgccaacgttggccatctgcacatacaccacatgcactgataaaggcaggaggagaccaggcatttctcagacggcagtaagaaggcataaacacagcctcacgcacaggaagacagcgaccacagcacccccttgtggttgccatggagcactgcatgtatcagaacccagataggcacaagcatctgcacatcaacacacttgagcacaagcatctgcgattcatcagtttcccctccgtgcgctttcccttccttctgcagcgctatccaggggtgtaagagtcagaacatgctgaggaacaagcacgtgaatcattctacctctcttgggacttgtctgcctgaaaagagtaactaacagggaaagacccagccccccaacagatagtgcccatttcaggttcacgtaggtccaaaaggccctgttccaccgaatctgaaggactaaacagagcagggttatttgtacatgtcccaggacccctgggtctagcaggctttttgaggccatataacattacaaaggcaagcgtgcggcacccaccatgaaggctcggcggacagctggaagatgactcgcaaaggcactttctctgcagctagcgccttaagttggagaaggcaacggcacccccactccagtactcctgcctggaaaatcccatggatggaggagcctggtaggctgcaatccatggggtcgctgaggctcggacacgactgagcgacttcactttcacttttcactttcatacactggagaaggaaatggcaacccactccagtgttcttgcctggagaatcccagggacgggggagcctggtgggctgccgtctatggggtcacacagagtcagacacgactgaagtgacttagcagcagcagcagcagcgccctaagtacacacaccctttcggctttgactttctgagaataaaaggatgtcactgggactgtccaagcagctttaccttctggaaaggcattgtagtcgttcagttccagggggcagtacacactgggaaactggccttcacacgtggcgttccaatcaatgaaactgctacagaaaacaaggggtctagtttcagaaacaggatgtcgacagaccaaggaaagaaagaggaaaaggatcttactgtccagcatcctcatcactgcgagttcttcagt

SEQ ID NO: 38936 - DNA, 1578 bp, Bovine  19866881154266
atttctgtcctgtggctggaagtggaaaattgtgtgtcagggaatggtagcaacactgatcacatgtatgtacacattccgtgtctaatttcatgctttgtactgtgcttaagcctctgttgttgaccagcaaatgtcatggaatgagtactagtaaggtttataaattgatatctgtaaagttggggtgctgcagtccatggggttgcaaagagttggacactactgggcgactgaacaacaacaaaagttggggttagtgaaaaaattgacaattggaaaatgttacatgaacttttttctgcgttatgctttgatatgatttagagcagaatctacatgactgcaagttaggttatcatctgagtactttgcatttgtaactgtcattgttaacttacatgaagaaataaaaataggccactattaggaaggctagggaaatataaacctgctccctgggattgagaggcctgagttgatgggtgctacatttactacatttctaactggcaattttaatgaactcctatgacttccctcggagaaggaaatggcaacccactccagtgctcttgcctggagaatcccagggacgggggagcctagtgggctgccgtctatggggtcgcacagagtcggacacgactgaagcgacttagcaacagcagcatgccatttttctagattccacatatatgtgttaagaaatctgccttaataatatgcttccattatgtagcttagagaatgctttttctgagagaatgtaaccttaaaacattaaaactcttttaaagaaataaaatggcttcctgaattgatttcttttaataaaacaaaatccttgaacaaatcgaaatgtgtcaggactatagccaggaatacataggatgcattttgcatagcgtgcattactggtcttcatgaagtagattcttttggtaacattttgaggtgatccggctaaaacatgttcaatgaaatgtaaattgccaggaaattagataaagatggcagattgagggaagacagagaaaggaaccctccgagctattttgatgctcttgttttccagggactgaggaatgccaaaaagaagaataggctttgagactccccaggggaggggagtaagcgtctttcctgtcacagagagggaatgaggattgcagatgttttcttagagactctagcaacagggttgcaacccaagaaagcaaatcctgaggcttaatttgagctatccgtttggtactgggagagagcaacttctcccagggtgattcctggggcaggctaatggtcaaaaatggagactgcattcaaatctaacctcactgttttctagctgagaggtcctgggcaggttacctgaaagctccgtgcctcagtttcatgggatactaatgctcatttgtatcaacgtgcaccagttgaatgggatactaacgctcctggtgaaaggaataaagcacttagccatgcaattaagtactttacgtaagtcctatttattatttttgttctacttggtagtcattagtgcatgatgtcagccagctctagccacagagg

SEQ ID NO: 38937 - DNA, 1022 bp, Bovine  19866881187951
gggaagctcagatgcagccttaccacactagccacctcgcccagcccagacttgaaactccctcaagatgactccatccccccgccccctcccagaagcagcttggctgaagagccagcagaggccaggctgcactggtggcctgcagctgagaaagatgatcttttggccatccttggtggttgctagttttccaaaatccttcaagggtcttttagtgctttctcctcagagaggccttggggctaactttttcagagactgtgtttgtcccaggagtgggaggaagagcgaaaaactacagcctgtctcagttacctgcagccgcgccccgacaccccaccactgggaatactgtacacagtatgtaggcatttttgcctgtcaaaaaaaaagggaggcatgggacactttcttaggcatgagtggtccctctttataaatgagacagagttaggggtcttacaggacaattgttcctcttgcctgaagaagcccctaccagtgagttgtttacaaatgccatctgctgtttcctttcaagcaaagttactaatttttcacgtttctagctccaaaggtatgtgaagcctgcaaaactaaaaacgaagatgacaacgacataatggaaacactttgtaaaaatgattttggtaagtaaacaccaccagcaaaagttttattttccagaacagcttaaagataacaattcattaagatgttactattactagataaagtaaaagtgaaagtcactcagtcgtgtctgactctttgcaacccaatggactatacagtccctgtaattctctaggccagaatactggagtgggtagcctttcgcttctccaggggatcttcccaacccagggatagaaaccagatatcctgcattgcaggaggattttttaccagctgagccacaagggaagccctttactagataaagtttgggtaaaatagcatcacagctcatctttccttgagctaatcatctaacaggttatcttagtttcctctct

SEQ ID NO: 38938 - DNA, 892 bp, Bovine  19866881273406
tgtgtgactgctgtgttgcggttagaggctcattctcgcccttacggttgtctggatacacgggactgatgtcatgactgtcctgtgttcacaggtattttcgaatggacccttctgcaacccagtttcacatagagaatcacgagaatacttcagggctttggtcattgtggtacctcaaccattttgaccatggtgttgtattaaatgatgtgtttgtttccaaggagaccaagcacgttttaaaggtacatacggtatttttatttaagttttagcctattttaagctttgtttaaggtcaaatactatgaaattaattatttataaaatctttcacttacaaattttaaagcaagtatgtttctttaaaaattttcagaattacttttaggctctctttattttttcaaactattgttcaaggagctcaaagggaccagggtatatcccattagagatatttattactaccattatttaaaaatattgtaaattacaatttatcctaagaagattacatttagtaaaaataagcctcgttcatgataaaatagtaggttttggtaaaatactggctatgaacatatcaagattattttgtgaaatttaaaaacaagtgcatgttaaatattaaatgaaacctattatttatagaaaaatatgtcagtatttgacttggaaataattaagtaacattttatttctcaaagtatagaagaactttagtatcacacagtatgatgattttaatcataattagcattagttaggaaagtaatttctcttacttcttttctttttagattctgaatttcactggccctttatttctacctccaggctgttggaaaatattttcttgaaacttgctgttaaagacattgccata

SEQ ID NO: 38939 - DNA, 1414 bp, Bovine  19866881294575
catctggtatgcacacagctgttaaatatattcccaaagaacagaaacattatccatttccataatttttgaattatagaaatatttagtaaaactgaaaatacagcaagcttttataggctgttagagtgattgaaaggccctgacaacttctcatagttcacagtcatgggaaacatatgtgcagatctccttatgggagcaaagatgtgagaacttcgtggggatcagaggaagagtctatgagattttggaagacttgagacccagaaaggaccacagagaccgagtgggtagactctcagcttaagccgaatcaccactaggccactgcatggggtaggcagtactgacaagacattctaggtaaactacaacaaatgggccattctaacaggcaaacaaaatgtcttccctgctcaggactggagtgggcagtcttccgggattcacattcaggaatatacttgtttttttcagcagctttctgaattgtgtcaaatttatgaaaagaaacactgctccatcccatgtgtttttcttgtgaaatggaaaggtagaatgacaaagagacagaccacgtggcagagtcaggagccggaagatgtgtttgagaatgaggcccgccactgactggctgtgttgatcttgggcacgttgtcccctagttcttctgagtcttggatcctcgagcacctcacagaattagttagacaaatttaaaaaatgccccatgtaatgtaaagcgatagtcaattatgaggtgttattcataaatgcgaactgggacgtgacatggagcataatttctactagaattcgcgttaagaaaataagcgtgcatagaacatacagtagatcaatatattgatccaaaatcccaaagtaggaaatatggggcatttctaatgaagatggtgggctgggtgtacatttagccttattacctcgtaaaactaataaaaataacgttaaaaggatttgttatgggtgtaaacaccaaaggaaggatgagcaaagaggagacaagagcaatcaaacttaggatgctggaaagcaatcaaacgagtggtaaagatataaagaaaagtgaaagacaatatattaaatggaaatgtctactgcagagttttccagaatcctaggaggcaatggcacctggtcctcctggaactgagggtgtaatgcacctaaaattaggaggactgcttggaagggtgtttaaagagcagttgactcatgagtcctttctcccagtccactcaacctggagaactctcttcctctgcccaaccattaactggtttcctggatcaagtaaattggagagtgtctggcacaagttgaggattaaatgaatgaatgtataatagatagcaagggcccagaaaccttcctccagtgggctcccaaa

SEQ ID NO: 38940 - DNA, 3551 bp, Bovine  19866881325585
agctgggaatttacagtgcacactcctacatggcctccatactgccaacaggagcatctttcttaaataaggctctgatcatttcacttccctactcaaaatccgtcagcttcatacacagagcccttcattatcaggcttccttggtgggtcagtggtaaagaatctgccaatgtaggaggcgcaaatttgatccctaggtcaggaagatcccctggaaaaggaaatagccaacccactccagtattcttgcttgggaaatcacaaggacagtggatcccagcgagcttaagtccatggggtcgcaagagttggacatgacttagcggctgaacaataacaacattcacccctcacattcaactgagcagtacaaaacaactcaagattttctcatatattatgcagttctatacatatctatccagtcctggcatataataacaagttaaagcacttactatggattagtcattgttgtacgcagttatacacaacacatttaattgtcacaagcaacctgtgaagtaggaaatattaggaccacttaacagagaaaacagagacacaagatgtttctagtaaatggaagaagtaggagttgagtctggggtctgggtctagagtccactcttgtaagccactgtgctccactactttaacatacgggtctctgtacccagcatgtccttcaccctcaactcccttctggactcacacatctttccagaacaaacctaaacgtctccttccttaactgtaaagcctttcctcagcagaatgttcaccctctaccatcctcccccatgctgtacactattccaccatgtggcagggggtctgttgaccggggtctctcctcaccaggctggtgaggtcctggaggaccggagctacctcattcaccattacccctctcagtcacaatgcctgccacagcaagcattcagtatacatttactgaactgaacgaatttcaataaaggtaaacgcctatttttattcaaaaccatttcaagttgtccacacagcttgagtggacctattctttaccagctcagttttagcaataaatgatttttatgtactgatggttcccaacttatgacggtttgactgaatgattttacaactttatgatggtgcaaaagcagtccacattcagtagaaaccatatttggaacttggagttcagttctcgtcctggtctagtgacaggcagcacacactccccatgacgctgcacgctggacacaggcagtgagccgcagctcccgctcagctgcgtcaccgccacggtgcgcaaccaacacaccgacaaccactctgtacccagacaacacctccggtttcactttcagtattcaataaactatataagatattcaacactttattatacaagtctttgtgacagatgattttgtccaactgtaggctaatgtttaaatgttctgagcccttataagataggcttggctacactatgatgcttggtgggttaggtgtattaaatgcatttttttgacttaaaacagttttaacttcccatggggttgacagcataaccccactgtaagaagtagaggacgatctgtattcatttctaaaaactggtaaaattaaaaaaaaaaaaaattattctgagaatctcttagtgtctccccaaacccataccctgggtctgaaatccaatttagtgtggatttcaaaatgaaatgctggtgataaatcaaaaacctgacccccaaacgaccttccactagtaataaatgggttgcaaatcagaacttggatgaagaactgaggaaggtctcagcagagcaagaaaacaaaagaaagagcatgatttccacagttctgaccctttaaacaaggaaacatccgtttaaaccccacacagagttgcagcagcaccagggaaactgcggccagcgggctgctctcattcaaacaaccttcacaccttcgtttcttctacctttcattcacttccaagcctctggaactatgagaaacaagtttctgttgtttataagctaccaaatctgtggtattttgttacagcagcctgaatggactaagacaaactcttaaaactccctggctgactgctcagtaaagtctggctatcatcatcaagagcatcagtggctcccgctgtccccctcagtaatctcctccatccatctacactgaggcaactttcagctcaaaaaaccatttctaagaagtctcccttaactatatagacttctttttcataaaagttaattaacaatgtcttttcattacaagttaattaactgtgtatttatcttgccttaccaagtaaatataaattatctcaacacgaaacacacattttatcattttttatatcgctcaaagaactcagtactgcacataaacagaggaggcagacagtttctgttgaagcagttaatgcaatccacacgcagttgatagcttctttgctatcttagaaaatgttaaagagaaacataaattataaccatgaggcttttttagactgtctttaacagtgatcaacatatacaacctaaaggcaagagagaaaaatgtttcctgattttcagacttgcaaaaaaaagcccattctcaagagacaagtacattcctgtacttaattggaatcactggcggaaccaaagcagaacagaatgatgggggtgatggggggaaacaaagagctccctctctctaatctggaagtaattaacaagaaactcaaaagaagttaacattttactatggcaatatgttgaacaaactgatctttcagtgcaaccttgaatttggaatctgcttcaattcaacattaacagtggcttctatatataaatcccatgacctcttgcaacacttttaatctctatcgctcgttcggcagtcagccacttactacttctcctctccaattcactctttcacttgtatgtatcttatcttcagcacaggttacaggttctttcttagtaaagcatgtaaagataccgatttctgcttttttgaattacctccagtgtctggtaaaatgttctgcacacagtagaccctcaaatattttttttgattgaacaaataaacttaatgagtatatactcctggatgagcactaatttagtcaaacctccaaccaccttacacagtgcctatgcacactggcacttgacatagactacttaatccacacaaccctttgaagtaagtataatcttttttttttttttttaacaaatttaggaaactttaaggctttaaaagcttaagaaacttttccaagatccttacaactagcaaaaagttaaaactgtgatttcaatccatcttcgatttctaactacttctcttcccattaagctttactgtttctctaaaatgataagctctcttcagaaccatagttgaggggcatagtatgatactggcattccttctcaaatttcagtgaaaaaataaagtaggtttaagtcagtgaaatggtactgagtgttgtttcttaaaaaaatgatttactgcaaatgcca

SEQ ID NO: 38941 - DNA, 1057 bp, Bovine  19866881346631
ttaaatatgtgtgtgcattaaaaatccagtgataagcataagtatgtctacacgtgtttgtatttctttaggagatgcttcatcttttaattaacctcaagcacagaatgctgtgctgtgctgctcagttgctcagtcatgtccgactctttgggaccccaaggactgtagcccgccaggctcctctgtccatggggattctccaggcaggaatagtggagtgggttgttttgcccttctccaggggatcttccagacctgggatcaaaccagggtctcctgcattgcaggtggattctttaccagctgagctaccagggaaaccccaagcacagaatacccgtaagtaaaatactcggctacagcagggacccacagaaggaatgagtgaaaactcagtttctagtcaagcgacgtcctcgccacgtgacatgcttattactccctctccagagtacttatgcaagacttcatgagggcccagaggtgcaagaatttcagagaaatccttttatataggtaaggtcaatatcacagaaattgggttatctgctaaaaacatgaagccagcttagtaagacttaaaaaaaaaaaaaaaaaagtgtttgcttttactttatcttaccccaaaaagaattgatggggctgaggaattttaagagaattataaattctggggtctcaagttttacagttttctacagaggtctgattcaattgttatttcttcactcacatgaacctaaataattaaattaaaatgatttacaggctcacatgaaccccaggctcctgctgcattagttaactagaaaaagctgctatgtatacttaactgctagaatagaaaaatagagagccacatatattacgaaaagacacttgaaacataaatcagtgaggcccatatgctatgagtctaatttgtcagcattcttttttctgtttaaagatgacatcctaccaggtaagggcaagctttggtaagctggaattcactggttgggagattaatcatttgcatatcggtgccaaacctataaagaaaaaaaaaaaa

SEQ ID NO: 38942 - DNA, 1391 bp, Bovine  19866881549502
aagggaaagaggtttaccacctgctaactaagagcagtacattattcatcagggatcagagagagtctcaataagaaaatggacaggagcataaaggcttggggtttggtgaagggagctaagcaaggcagaaggaagtggggagaaggaggagacaaaggaggaggggggtgacgggacagtcttccctgatattccatctcccggcttgaggaaggccatatggcctcccgtgaaaaggatacacatgcttgcatgaaagctggtaggtgttttcaatgagcccttcctcatcaagttccacaatgatcttctgcccacacacggcgcagatgtcgtccgacagactcctggtgggcatcccactgccgctgtagaactgtgggggacaggcccagagcacacatcattctgtgagcacagggaagccactggcagctggaagacagagaggcttcaccgtttctctgctgctttagaacttgaaacgtgtttcccatagaacaacgctactgtggggtgaaggtttcccaggcaaaaccccactgagccccaaagcacatcgctaattgtaaccacctaacttctccactgaggaatcctttaagaggaacagttttatcgagggctgtagttcagaatgacatgggaagctttttaaattcacccagaacctgacccttctccttattctcctgagactctgattcccagatctcaagtaatcccagacatctatgtatcttttaattaactttaatataattaaaattttaatcaatttaaataaaatcccatctgactatagggagtatgaagactaatcccattagaaagcagcgcatttagaattctaacttgggacattgcatctccccagggctgtggatgaggagcgattcctaacattggcagcacattagaatgtctaagaagcttttttaaaaataaaagatttattttataattgttttagatacaaaagatacaaagatagaatagagtttccacaccaagtttcccctgtgattaacattttacatttagggtggtacatttgttacaattaatgaaccaacactgatgcattattatgaaatcaagtctatactttgttcagattgcttggtttttctcaaatgtccttattttgttctagaatcccatccaggataccattaattgtcttatctctttaggcttctctctttttttaattttttaggcttctcttggctttggcagtttctcagactttttttccctatgattgacagtttgggggtgggggcggtgcttatagaatgtccttcacttggagtttagctaatgtgtttttctcttgattatgctgagcttatgagttttagggaaaaagagaacagagggaa

SEQ ID NO: 38943 - DNA, 677 bp, Bovine  19866882113240
ttttctgtttagtatcacttcttttcctcagtctgtgaaaggaggttgaatggagaattttttccaggtttgcagctttccactgtttaagtctggagaaatactccatgtatttggaagtgtgctgctaggggaataacagttttaagactgcagacttgtccatcgtttatcatcattatatggtgtctgtcaacagaaaaccatttcccagaattccataaggagttgctccatgtagaagcatggagtcttgtgacaaggaaaagcattgcagtgaagagtaataggaaaaggggtgggggataaacagaagcttttagagctaattcatggctggcgtcatctccattagcattgggactgtttgacgttgagttcagagaacatgaccagggctggtttccatctgtcatggtgattaatgggagtattgttaggtaataatagtttaataacatggctggagccaaagaggcacacaaaatgtgtacatgtaattataaaaccaagagcactgtggataaaaccacaagagccagcagattgaggtcctggtctcagctctaccactaagcaagggcagctgggagaaactcttcttaaagttgaggagggttaaaatagtctgctgttggggtgaagagaccagccttagttctgaggcaggagagcgt

SEQ ID NO: 38944 - DNA, 753 bp, Bovine  19866882239218
tcacactaactcttaaaggtaggccagcccagcaaagaagaaggtctctgctcccgtccatctggcttgttcttatgagaaagagccctggtactttctgctggtcagcggccagtggacatgagtcctcactggtcagctgctcgccttcagacccagtagccttcttggaaagataagaagaaaaaggattccttttggcacctttccagagtcaacatttcccctttgaggaaagccatcctctctagatgtgagaatgggggccctcacttcatgtcctccactgaatggacctgctctaaacactgactcatccagctttctccctcagcagttagcagcatgtctgggctgggtgccaggaaaccacagagcaaccagaggtgaggggagcaggggcaggagagtaggagcagccagaccatagcagagggggtgtatgcatgggtcaggtcaggcctggcaagtcgagggcaccctgtatctggtgcggtaggagtcagcttggtgccaggtggaaccatccagggcaagacggccaatgccaggggcatccccactcttcctcgataatgtctttcctcttcctgcctctcttctccccctgttctcctgccctctccccactgcccacccacttcctttactccactagcttttaatttccctctactatgtcctgggtgctgcgcctggggtccacattcagtcaccatccttaagggacttgtgcacttttatgtgatgcaa

SEQ ID NO: 38945 - DNA, 1110 bp, Bovine  19866880340606
tatctgtttttgttccctgtctctgtttttattactgtagctttgtagtatatctgaagtcaggaagcatgattcctccagctctttagcagatattttatcagtgtcattcctcaatatcagacataacaaattaaacattaaatgccataatcactagctctgtattataagcaacttgaggacagacaatatgacttataattcttggcttccactgcctattttagatgcacgtgtaattttctttgctttgcaattaattcgcttattgaaaattaaatttgtggctcttctgggaaagagtgagtcgtaaggtgattttaagaagattagaacttgttcttacatggcttggtgtccactcccatgactgctgcgtttcctgcttccaaagacagtctagacaagaatatcatctaagtgtctgaggtaatgcagtttctgaaatggtcagacttgttttcactcccacagagaagacaaagagtcagtttaaaagtatatttttaatatacatatcttctgggtccaaggtggcataatattatatttgaaagacacatttatgcatttcattagtatttttttcagaagtcagtattctccaggaagtgtatattttctgaaatttcaagaaaaatgttaaaataagctaagaattaatttcttctgatactgtccagtatgtcttaatctattcaataatatgaccaatgaaaaagattctcatgtgtcaacacatttgagatggttcagttgaaaaaaattgagacagcttactgaattcctggaagaaaaaaaacctctttttaaatgtaggtataagcatgttacatttaaatgtttttacttgagatgaaaatttcttggggtgagagtatcagtaacaaatcattcttttgtctctttggatatttggaacatttgggtctatacatcctcacagattaaatgattatctgtttgttaatgctaggagagcttatttcttacaacatttcttaagtttcatctgaagggaaaggcacgtgagttcatctattgtgctaactctagtctattactaagagcagctgccacctccgttaggaaggtcctgggtctcat

SEQ ID NO: 38946 - DNA, 1603 bp, Bovine  19866880514113
acttagtatttcactacagtcctcttctccataaccaagattgcttgcaacttttttgccttagtgacttcagggggtaaaaaacagcatccttccagttctttaaagtcatagagataaatttagtgattaggtaacttatgataacataataatatggaagcttgggaagaccctcctaatatttgtcatcttctacctcttccattttcctgcagttccacttcctatttaggtagctcagagaaagcaattttaatacagacactcctctcctatataaaaaaataggctacacacttttcaaatctattctgcttttccttttgaagtaaagatgacgaggcatggacccaagtaatggttccctgcctcttgtctcttgttgacaacctctacttaagagtttctattactttttgttcagaaaggaatttgcttaagttttcagaaaaataacaatctattagaaaaccatttcagagtaggaaacagacaaatttaaataaacttatatttgttattatttagtctaaaaataaagattcccagtaggtattcataaacagtaattagcaaggcttctttttctaagtgaccacagatctaatccttcctagactttacattgtaataatcctataaatactttgatttttataatgacttgatttggggggacaggcattacataagcctttattacttcaaaaaaggcttggcaaaatttttgtttttctcttttgtctcattctgatgggatttgcagcatttcagctgcttaagtggggacaaagataacccctttgcttccagctgttgaaattctttatcaccttagaaaaaccaggattaagagggtaagatagatttttataggtgtgtttttataggtccttgcagacttgagccaaagtcaagtcaaagagcctatggccaacctcatggaagctcctgtgcttttgaacttagtttatttcttataattttgcatctactcttatcttcatcacccttttatggtgatgagttgccttttctatgagtatttggaaggagtgctcaaacaccaaaataaaacattttaaagactacacatagcatgcttccaaattctattagagagagccccagatacttcaccttagaacatactttttataggtgcaaagttataggatatatgggagaaaacattcatcagaatcttccagagaatatggtcaggaatcttaggcaggcccagtgctgaaacgcttgtccacttagtcacacactatgtggtagatatggaaaaggaatgagatgtccagactctgacaaaggcttttcattatgtcaaaacccgaagcctgggtaaaggttgatgtatagtgtccagtgatttaatatatttgtggttaaggaaagggacaaggaagatgttctaattccgtatcataagaaggtagttgcccatttgcaagttccagttatgagtgtaaaacagaaatataaagtaccaaacctattaggaaataaaaacaaacaaaaaaagtggatttaactttaattactgtgtacttgaagtggctttggtaggattttctaaaaagtgatgttt

SEQ ID NO: 38947 - DNA, 785 bp, Bovine  19866880558096
aattgactgcaactggaaatatggcaacttttcaatccttgcatcatgttactaagataatttttaaatgagtatacatggaacaaaaaatgaaactttattcctttatttattttatgctttttcatcttaatttgaatttgagtcataaactatatatttcaaaattttaattcaacattagcataaaagttcaattttaacttggaaatatcatgaacatatcaaaatatgtataaaaataatttctggaattgtgattattatttctttaagaatctatttcctaaccagtcatttcaataaattaatccttaggcatatttaagttttcttgtctttattatattttttttaatgaaattggtctctttattgttaacttaaatttatctttgatgttaaaaagagctgtggaaaattaaaattgaatagaattctttgaattgaataccaaaggatatcaaaaagtagagggaaaagatagggtgagcctatgcggcatatgtccttagaaagtcttggtttatacctgttacctaaattaaacaattatacaagtataattcctttcactctagaaagtacccaacatcagatgttaaattttatagtcatcctagacaaaagaaaaaaaaaaacaaccctcaaatgtggtatctgaatcacagctctacagtgtggtagctaagtggtgctgtgtaagttagtctctaagagattccatttctacatttataaacagtcaatttaaggtgtttttttgaagttttaatgtgaaaagt

SEQ ID NO: 38948 - DNA, 1417 bp, Bovine  19866880658813
attacaatgatttatgtcatgactttatccccttattcaactaatacagaatactctgtcttatttatcttcatagctccaggacttaactagcttctaagttcctggcacatgatagatgataaaatttttttggaaagagaaaagataaccaagtaaaatatcaattgaattctggcatcatgaattcaatttggaaataattatatggagaaagaatcacccttaacataatttactgtcccactaaatgtagcttggtcagtaatgctgtttgttgtggaaaatcatctgaaatcaaagcttcctgttcaagcaaccatgcttggttgctcctctttgaaatgacctgttgtgaatagttccctatgatttttaaattggttgcagccacttcaaagtggcttagaagtttcaccacagtgtgaactctgatttacctcttcaagcatttcccatctctaaactcctggctttcattagtacttacacttaattcattgcttatacctcacaactcagcaccttgtaatgtgttgttttgtcttttcccctaatctgatgtgaaatttcataaacattagagccattcttaaatgacttcactttcactcccaatctgtggagtgaaagccaatctatcgtttggcttatgtatttattaggcaccaaataaataataattaactgattaatatatttattaattgctacagggctcatggtgttttaactaggactttggcatcattttaaatgtgtcttttagtatttaggaaatcttgactaaaattagatttttccaggatatagcctgctttcattttgagtctagtttatttattattactgttcatatctttaacataggtctcttttattttggaagccataacttcccatttgaaatagatatacaaaatgggttgaaattctggaccccatttcattttaaagtttcctaaggtctaaaaacagttatagattttgatttattttacttgggtttttttttgtattcattaatgttacctgtctgtggttagtataggacaacttagagaaagcaagtagaggattattttaaagcttgaagtttcagacatgttgatgcaactaacttacctgttgagtttcatgttcccttggtctcatccatgggaaggaggaatgtggtgggagaagaccattcatccacaaagaattaaatgatttcccaaagccaaatcttgaatactaaagacatggaggaaaaaaattgtataattatatttcagtgttgtcttggttttcattttctaaaaagatcactgaaagtgcagaaatagaaaaagtaagagagatattcattaatgtggataaagtcttccaatagatttgctttctattctgagccagtctgcaatatttccataaa

SEQ ID NO: 38949 - DNA, 1586 bp, Bovine  19866880698645
ccacgctctctgtccatgggattttccaggcaagaatactggagtggcttgccagtcccttctccaggggatcttccccaactcagggatcaaaagtgcatctcctgctttgcaggtgaattctttaccgtctgaatcaccagggaagcccttgtatgttaatacattcagaatatgttaggctttcacaccttccttttcattacagaaagagtatactgtgcttttgctcaaacttttccaagagttgttaaccactgggaaaattcaagttcctaagggcaagcaccattcctggcctttgagctaatggcccacacttgtaccatctgcatttgtagttgaattttggcagtcttttaaagtgaagattgagataccattaatgttaatcgagatacatgaaatgcacagataccaccacattttatgaataactctattattcaaatgggcataacagattcttattatctatattatgaaaattaaaacttgaagtttctttaaattgctaatctatgcctcaacatgtggttttaagacagaatttgtgtattgaactattctatcttgtctctgtcccacgccatgcagggaattattttgacacacacttgtaaataaggaaagtgaaagtgttagtcattcagtcgtgtccaactctttgtgaccccatggactgcagcctgccagcttcctctgtccatgggtttctccaggcaagaatactggagtgggttgccattctcttctccaggggatctcccaacccagggatggaacctgggtcctgcattgcaggcatattctttaccacctgtactacgagccttcttttcagccttattccccagaggtctgccacaaaactttgctattatcccctgaattgctctttcttttttcaatagttctccaatttcctgttgactgtcaaagcacatggtctctgcggtcccttagtaaattcaagaccgaatgtatgcctccatatgcggttttaagacagaatttgtttattgaactattctgtctcgcctctgtcctatgcaacgcagggaattatttgacacacacttgtaaataaggtacagctcatttgcaagaaaatcatacttcctcattttctcacttcaacaatctgtaatttgtcttgacttgttttccctactgcaattaaggttacttccctctttctcttatcatatagacaggtccagtctgtcatcacttatcgtaaaactagtttttattctagtgtctactgtaccgctgctctttcattttcctctacatcttgctcaacatggcttttaattttgtttcttctaaagtcatcatcatgacaagtaggtacaaacatctgacttcttcattttggcttgttctgtagtcatactcaagcattatatattgaaatgcacactgcttattatatttttccttctcctttaaattatagtaaggatattatatgtatgaatacttaatgtaattcagtttttaaactatgtgttcatgaaggttacagaaagaatttaatttcaggaaatgaaacatttatttaagaagagggcttcagg

SEQ ID NO: 38950 - DNA, 3078 bp, Bovine  19866880741510
gtttttctggcgaagaagatcgtctagacataagaatctaatgacctgaggcttgatgacaatgatcataagtatctatcagaggaaaattccttttatgtcggagaagaaaagagtcccacaacaaaaatacctgccctcatccaaaggctctataaatttggatctcatgctcctttccccatacatgtcactgagagtctatcaaatgaaaattctgtagaactcaaagctaaaaaatatcaactgttgacctccagaaaaggaaaccctgattctgacaaagttggctcctttctcaaagatcataccatcaatttcaaaagtaagttacccagaaccatgactcactccctaacagatggaaatagaattttttttcaagaatccccagatgatttatccctggaaagaggcatccagagtgaaaatgacatcattatcaatctttcagaagacaaacagattgagcctatcaatactccagatgcagaatcagtggaaattgtggaagaaagcagggccttctcagatgtagtcactgatcccaccagcagcacaaatccaataatgagcagactggcttcacaagagacacacagtcccatacactgtgctgtatgaccagagggtacccagtatgtcactcaagttgaaatataatgaagacacagctttcaagccagagagttaccattcacaggatgccactgatccttcagttagtgtcaaccctgatattgaactttcctttgttgttgaaacttctgagaataaaaaaaacagggtttcagcttatttttcacctatgaagacacctcacactatggctgataccactgctatttcccttgagaatagttatgaaggaggtgagtctatacaaactaatgaaaataacgttagatctaaagaattcccaactctacaaacaacagaaagtgtcattctcatgcctcaagtcctaactgaggattctgctctaataagtgatgggtctttgactgactcttcaaagacagtatcattagtaccagagagagtgactaaatacccttgatctcattcatggaactgatatttcagaaaatcaggtaattaaaatccaaacagaccttcagccccattccttggactcagttattccctctgctaattcagtaacttttaccaggaattccatagatggtgggcctgatttgccatccactgtggagagaaagactgttaacatttataaaatgaagacagatgttcaacctttggatacaacaatgaaagtccgttcacctacacaaataagttctttcccttctgaaataaggaaaatggccgcactctctgttgaggaagacaccaaatgctcaatttgatttaagtaatcttacaaatgcaacagttctcattccaactttggagaaaagacttctctcagcccccaagcccagcactctctccaggagcaatagcaacaaggaggaggcgctcattgtttccaaagcagggaatttcatcttaggagactcaagaacattgagagagagccctttcgttggtagatttaatatttctgctagacctcaagctcctcccagtttaaaaagaacactttcagctgattccaccttgtctcatgaaaagactttaaagcctaaggagaaaagttcggctctgtctgatgaagatgcaggtcctataggtttgtttcataatgttcccactggatcctatgagcaactgtggaaatcaactccttttccttttgattttacaactgctgtgagttcatcaagatattctgaacttgatccagttttcaaaatgaaaaaagatactacaacaaaaactaataataatactccatttcaggaaagaaattctccatctaacaaagacatcatttcccctagtaccaatacttcaacaaaagacatgttaaaccttatttttactaacagatctgtgcaaagaaattttgtagggaaagacataaacactgaaaatgaagtagctcttattacagaaaacatctcaaacattacctcagagggtgaaaatgttccagatgatgaggatgtaataagtactgtgtttgatgccacagtttttgaggatgttataaagaaatatgtccttgaaccacgggaggagaataacaatccagttcctaaagaacctactctcatttatgaccccaaaatagttgggtctcacccactctactccagtgctgatgcatacaaacatttatttcaaggagccccaacagaaacaaaaactaaggaaatgctgcaaaatttgatatctagagaagaaaacttcagttctggcctgaataatagtctcaattccactgacaatttgaattataaagttcccagatctatgacttacccaccaactcacacaagtgagaatcttcacaaatttctaggtaaaatacctttaaaaggaggcactttaaaagaagatgacaccagcattatcttccctgaagacaaaagaatggactatacccttgcttcaaatccagaaataacagtaaatatggtgaatgggaggaagttcctagatggacacactgattccttggtgatcacctctccattagaaaataagaatcaattctacagtaaagtcattccatctgctacttataacactgattcccaaggtaaggcagaaaatatttcattaaccaatgttaaagaaaaaactaatatggcagagacgccacactcatgggaaagcattattccttcagctgatttcagtgtcatcgctgatggcaaactttcttctatcaatgaagagatcaaaattttaaacagtgaggcatcaatctcttcctcacctacaaatacaggccacactatgaatgataccactactctctccattgaaaatactgatgacagaggtgattccatgtctccagaggaaaatattaggtctaaagaattcctaactctacaaattccagaaaagcccattttcagttctaatgcctcaactaaaaatcttgaaacctttgacccagtgataaataacacttggctacttcaactgcaggtcaaa

SEQ ID NO: 38951 - DNA, 842 bp, Bovine  19866880781337
ttgcctggaaaatccccatggacggagggcccggtgggctgtagtcatgtccgactctttgagaccccatggactgtagccggccaggctcctctgtccatggaattctccaggcaagaatattggagtggattgccattccctttctcccaggggatcttcctgacccaggaattgaacccaggtcttctgctttgcaggcagactctttatcatctgagccaccaaggaagccctggtatataatataaagccctggtatataatataatatatattatatctattgtgcataatttatgcatgcatttatttatacatatatgtgtgttagttgcacttacataattatgcttatattattatatataaataatgcagaaagcttctgagtagccagtaaattatttagtgaagtattgctctctgagaggtcttaaaatcataatttaacaaaataaatatggatttgaataatctgttatcactacacaattaggtattgattgtctttattattatttcttgctagggtccataaagaaaacatgaatgctcttatcttatctatgattatcttgaaccttactacattcttcttggtaagttttcaatactggtcaacaggtaattttcttttcatttagaaaaatataaagatgttcatatcaattatatgccacaaaaacatctcagagtgagacatcaatgttcttgcaaccaggataattcatactgtattgcctttaaaaaatgtaccatgaactttattatatttctttctatatattcatacaatgaggatatatatatatatatatatatatattacacatacacat

SEQ ID NO: 38952 - DNA, 1586 bp, Bovine  19866880785911
aaaatgtatttatataactctgtaatgggaaatgtctgtaatgggaggtttgctgtgttatagcaaatatgaattgcttattctctttctaccatttaaagatgtttccaatagcccatttgatatctcggggaccaatgccacaaaataaaccatctcaggtaagtttttttaacaccatttctctgtttgtaatttatttaaaaacttctctcttgggaatgcattatgtgatgattattgtatttatatttagctttacccaggaatattttacgtgacctatggagcaaatcaactggtaagtctttatcctattttaattaaatgttaccttaggagataatattataaaatccaggtctccaacaacagatcccatgttttctgactgccgaagttcgcaaccgaaatggcaaggaggcacaattcctatatggatgattctggccaggcatacaaacacacacacacacacaatggcattaaagaaaaggtaaataaattttctatcggaattatccaaattggctacatttattcaataatgattcatctctccactttactccacctctggacacagcattaatattaaggtttgaggaaagaccaattgacttttttcttgagtatctacaaagataataggagtcagctggttcataatatgattcagcgtttctttttgaacagaacgctcctgccagacttggcatcatgagctcagaagaaatgggggtgagtaatgtcttcaaactcttcttaaaacagtggccaagggagaacagtcacagatgactggctgcaagaggcattggccatgagtgtagctgaatatacaacatgggactcaggttgttccactccaaaaccaaaagctggattctgaagcagcatgcaaagaatcatctcatttcccatataactgtttctgagtgatgagcattcttgcacataggattttgccccatttcttaaatgcacaggagcaatatctcttgaaaagccatcactattgaacagcaaatgcttcaaaccaaaaaagaaacacacggttcatgaagttccccttacttctcagaccatttaacccctcaaaacaacaaactcaacaaaataacaaatcgtttagaactcaaaattgagagatcaaaaattaaaaaattaaccaaatttaaattttgattattgtaaaattccaagtacattaatgacttaggtcaagtatattcttactctgttatcattatccatgcatattgcaactttaaaattttgagatcaacagactcacaattggactttttctctcagaaatttctatgttatatctgttagaacacaaaacaaaaccatactaaagtaacaaatcattatcaaatcacatcaaattaataaatacagatcatatcaaattaataaatacacattagcatgctatcactaaaagaaaattcaaatctcaaattattgaatgccttctgtgagtgagacatgtaaaaagaccctctggagataagttaaataaaataaggtttcgatctcaaggagtttacagactaatcagggggaaaatagatacc

SEQ ID NO: 38953 - DNA, 1373 bp, Bovine  19866880835445
cttgaattgctaacccaaagcataagaagagtgcagtatcaatgcttaagacctgaaaaaaattaacaaaaattcaggaaagagattttaaagaaaaaaaataaattaattcatatgtttacatacaatattgtttttgacagatgtatacatttgtgaaatatcattttgccttagtctgcatccagcatgagccaggaaccctgtaatatttcttatatttcttacatgtggatgctaaacaattactaaatagccttattttttctatgagtgtgggtttcaaatatatttttcagtagagaatcattggttgcatactaaaaaagatatctgtttagaataagcatttaaggtcttttaatactacaattgtttttgagatatgttgttaatttgattctctttgtctctaactcacattaaaatatgctattgaggattaactaaaatgatgtatatgattagacgcagtggggagtgagtttgctttattgctctctcttaatatccctgaaggctgggattaaagatcttatattaaaataagtaattattggataactcaattaaactttgtgatagtaggggaactcttgtattactgactttttaaagtttcccaaaatatattctgctgcatgaccactatttttaaacccatgcattttctaaattttgtacttgccttaaatgctcacattctttcgtttattaagatttattgcttgctggacaaacttcttagatgttaaaactagctgcctaggctactgcacaatactttgtggcatttctgttgttgctttcaaatcagaaactcatctggttcttctttcagtagtttaaagacaccagtttcagttgtgaaattgtcttctttatggctgaatgcatctagatcaggagtagttcctgacaattcgtcagtattcttagttacagattccattctattattttcaggcaaatcttcttctgtaagcaaatcttctgtgaggttcatagttactgatgcagggatgacgaagtcatatctggattctacggcagtaagcagaacagaatgactctcttcttcatttgccatatccctttccatccaaacactgacttcatctgtagactcttcatcagttagcagagcatcttctgggttatctttgtctctttcagcagtggtagtgagctcaaacacagtgatgaacttttcctcatcagaatcagttagtttaggcacaacattggggtcattttctggaagaattaagtcaatttctgttattttctcttctgtaagggcagttatgtctggaatagtggtgaggtttctttcagtagttggaggatttcagcctcagggacagaggagt

SEQ ID NO: 38954 - DNA, 2024 bp, Bovine  19866880876958
aatttcttaatatcacaattagctccaggccagatttccagatttccagtcattcatttctgggctcaaattgtatccatctgtgccaaaagtatttttatctgaaagtacatctaatctttaaatctaaatcagttctctgaagcacctatgaaatatacagaactaggaattttttctaccatccaacataaagaaattctatatttcctgacaattttttttcaaaattctacttagaatagagatatcacatgtttattctagctttcagtgatttcctagatctagactttgtgtgaaggccctgaacaaatgtaagttgcttgtttcaataagcctgcttcacttcactaggcaaatacttaacatgactgctcagtgaatattaactcccagagaaaccaggatgagtaattactgaagaaggagtgtccaggtaattagtctttctgtccttgcaagcagaagctatgctgcctcaaaattattttccacaagtcgtttcattcacactggtttttaggagagtcatttcaacccagactaacacttattcaaagtccaggcttagacaggtaacccatcctcagacattttgcacattattacataatgtttattcatggactgctttagtcttcttatagagattagttgacacttttataaatgtttcttggtaacaccttttcaccctttcataccttcaggtttaaaatttattttgtagcatttttaaagtttatttatttttaattggaagataattgctttacaatattgtgttggtttctgccatatatcaacatgaatcagccataggtatacatatggcccctccctcttgagcctacccctcacctcccactccatgccaaccatttttaatgaaaatgtcttaaagacactattttttcatctttgcctagtaagtgacagtctaagaaactgatatttttcaccataatgtaaaataggcatcaccacagaaagtgaagtcgctcagttgtgtctgactctttgtgacccatggactgtagctaccaggctcctctgcccatgggattttccaggcaagagtactggaatgggttgccatttccttctccaggggatcttcccaaccctggaattgaacccgggtctcctgcattgcaagcagactcgttaccatctgagccaccagggaagtctccacagcagaaaggaacatattaataaataatcaatgaaggttgtgtgtgtgtgtgtgtgtgtgtgctcagtcatgtccaactctttgtgatcccatcaatgaaggttaaatttcttcaactcctactcatgcatggatacaaaagaagaaaaatgcatttgtggaaatgtagattcataaccatcagacccacgacaaaacactattcaattcactaagtgagatttttttaaatgtgtaggtatatgaaactgtaaacattaagattctggaataagtctttaataaactatgtgctttagtgtagtacagttgttaagaagagtatttgggagctatatagatctcagttcagatttggccctggaactcatcaatcacatacccttgggaagatttcagaatctcaatgatcaatattttatccaactttaaaatgagactatcaatatctacagctcaagactgtaggatgattaatacaattgagttgatgtatgtaaataatgtatatgcatacgcactatgtatcagaccagatcagatcagatcagtcgctcagtcatgtccgactctttgcgaccccgtgaatcacagcacgccaggcctccctgtccgtcaccgactcccggagttcactgagactcacgtccatcgagtcaaacaccgcacaatttacctgttagtaatatttttgttctaattaacatcatcattcagaaataggggctgactgtgatgctttacagaagtttgcaaataaatgtttgcctgcatgatatacttttatatatggaaaaagaggagatataagaggaagcatatg

SEQ ID NO: 38955 - DNA, 1697 bp, Bovine  19866880889859
ctcaaacaaaaggaaatttatgtagcaatccaaacccacttcatattatgtctataaaatattggaggatagtggaatacacgtttgaatactaggttctctttttgttaagcctgttatatgtgaacttattttgtgatgaaatgttctaagtaaaaaatattatttgccttctaatatcctcttgttattgcacaatttggtagactttttagagtttttataatttagatgttttgtgtttccaattagaaaactcagaaaatgtagtttacatctttaatcatgaaaaaataattagttggcaagaaaatcttaacttctttttggaagtaaaataattagccatttgagcagacataatccaccgcgtccctttttctcttaatttctgccctattgctctgtcaaaaataatcaaaattctaccatgataaagtggatacaatgtaagtacgttggaatatacattaatacttcattagcttatcatctttcagcttgggaaataaaaacaggaaactaagggaatgggtcacaaacagagaagttttggcagagagggagagagaggtctaccgttagagatgcagttaaggctgggtggtgcataaaataaacagggtgtacttaccggtaatgacagcgttgatcctagaagacaaaacagtagaatcgcagccttcatgttcaaattgctacctgaatcaacaaagcaatgttattctttcactccgtttttttcttttttgagacaaagtggtacgtgaaaaaaatgagtggtctctttgaaacgtggtcagttctgttacctttctcttcactaggcaaaatgtacaggtgaggtgatttctctagtctgtatgctgaaaatttttacctttaggtgagctatgagtgtgtaggaagaatttaaatttgactccaggaggctggcaactgaggagccaatcaggacttagcctgtctgtgaagtcatttggtttctttcatttcccaacacttcattaggtgcgttattagctgcagacatcatattacccaatgtctgccatttgaatagagggtattttcaggaagacatgccttgtataattaaaagtgcagacaataaaaagttacagtctttcttcacttccatctccttcccaaatgacttcccagagtacctgttttatcatgtgtacatgggcacataaatcaaacatcaaaatatagctgcctatgttaaaaaatgagaactattatgtatatttctctgcaatttactttgttttgctttataaataatcagcaacctatttgtcagtaggtgtagatttatttcatttatttaatggctgtattatattccatttccttttggtgcacagttaatccattttcattttagtttgtaattataaaagtggcacagtcagcatccttataaatttttttcacacaagtgggagtattttttgtaaatatttttcttataagtactgtactaaaggatatgtatgtttaaaatttcaataatgggggaaatggccagattgcctccagaagcattgaatggtgtactttattttaaatgggggaaaagctacagtaatctaggcaaaatgcaggggtccactgaggtttctttcacaaacagaacaatgaaatgctcaccataggctttcagggccctgggctttactgggagtttt

SEQ ID NO: 38956 - DNA, 1788 bp, Bovine  19866880913760
accctgatttcacttgactctctgatttcacctgtgaagaaagtgggttaatgagaaatccttcagtgagcattttactcattagtcttcatatgaccccaatttcttaaccaaaaccaaatggaagattttctttctctctcttcactgaattatgttttaaaaagaggaggataattcatcatgaataacaattataactggattatggactcaaagatttgttttccttctttccaggatgaactccaggataaaatccacccctttgcccagacacagtctctagtctatcccttccctgggcccatccctaacagcctcccacaaaacatccctcctcttactcaaacccctgtggtggtgccgcctttccttcagcctgaagtaatgggagtctccaaagtgaaggaggctatggctcctaagcacaaagaaatgcccttccctaaatatccagttgagccctttactgaaagccagagcctgactctcactgatgttgaaaatctgcaccttcctctgcctctgctccagtcttggatgcaccagcctcaccagcctcttcctccaactgtcatgtttcctcctcagtccgtgctgtccctttctcagtccaaagtcctgcctgttccccagaaagcagtgccctatccccagagagatatgcccattcaggcctttctgctgtaccaggagcctgtactcggtcctgtccggggacccttccctattattgtaagtctaaatttactaactgtgctgtttaacttctgatgtttgtatgatattcgagtaattaagagtcctataaaaaaatgaataatgaatggttccaaaataagcatagctgagattaatgattgtcagcattagttataaatagaataagctggagaactttcacctccccctcaccaccagatctcaatgtctaggcttacccgtggagattctgatgtaattgttctttctatgtagaagaaacttattgggaagaaataatataatggactatgatttaattggtctgttgagaccaattaaattagatgaaggcgattaaggtacaataaagccagaattgaatttgataatctcatttggctaagaataacaaacctaagaaggtttgctattttctacaattttgaagttctccttatgcacaattatttcaccacatgactcatttcacatcttgtttttgatatatgagcatatgagggaaaaatactgagatgcttatttcaatcctcagggaaaattttcttgccaaaaggcaagaattgtataaatcattcacttattttattttattattttttttatttttaaggtctaagaggatttcaaagtgaatgccccctcctcacttttggtaagctttaggatattggaggcagacatgatcatttttatagttaatatcttttacatttcattttcctggataagccccaatagtagcaatttccatcagtgtaccagcttaaagattaattataaatttattttcaatgattgactgttatttactggcctgaaattatgtatctgttatatttcaaataatgcaaaactgtatatatatggtgtttacagatttgattggttttctttcaatagcctatatccttattattgattgtcatcatttatagaaaaaactgaaaataatttcttatacttttatgtaaacctgttagagcttattttaaaggtcaactgcattcacatttctaatctagtcattatgagcttcaatagttttatctcacttaaaat

SEQ ID NO: 38957 - DNA, 816 bp, Bovine  19866880939202
gtctctaacagccaaagcagcagcagaagtctctgaaactgattttggcttggccttcatggattttgcttttaaattcagttctttctttccagcaccatctttaagtgtgagcatataacgaatttcagaggacagcttctgatccacaaccgacaacttgttgatcaaatttcggtaggtaacaagtctttcaatgacaggatgtccatgtgcagggactctcctagctttcaggatcagataaaaactaatgttggagcagtagttcaaatagagattgtatttggtcctcaggtattggcttccttttccaggggggatgatcttttgctccactaactgtagcaatggctccagctcatccttcatctctgtcaacttaactttcaagtcgtctatcagctccaagagctctggagattcctttcgcagcattttcagcttctctttcacggaaactttcgccaaatccttcacgacacgtgtctcagcctcatttacctgaggtactggttttgcaaaagcctccacccaggtaactccaaaatcgtcctcttgcagggcttgggctaagcgccgctgaatgagctgtgcctccgcctcctcctctctttcctcttcctctacttcttgttgactctgccggcctcgggacttggagccatagtccgtgtcgtagtaaagttttttcctctgaccccacgacaaactgggatccacagaagcctcagtctcactctgcacggagctcccaccatcattcatcgtcaccctcctcactctctccatcttcatcgtcctcatcggcaacat

SEQ ID NO: 38958 - DNA, 1126 bp, Bovine  19866880987935
ttacgctacaataacataagctactgagtaggctttcagtcaaggtaattccagggctagagaattctggttacctccactccagactttccttggaatagttatcatcaggaagtgtatattaaattaatctgttaaaacttattttgcattcctactggcaatgcagatttagaaaatgggaaaccatgatcttatatgcttcttcaatcacatttatttttctttgattaacaggaatattgattcttcaaggaagtggctcatgttcaattttgcagtgacctgaaataaatcacagatataaagttattaaactcagtgagtcatgtgcttgtgaatgtgtaagactttttgctttttaattacaaatattggctcaaaagtatatctagttcaagggctgggaaactttctgctcaagacagagtagatgaaagaaagaaagcagagacttttagtggttggaattagataaaagatctaccccctcgccccccaccagctgggtcctaatgtaatctttagtcccatttacattgcctcaattcattggtaattaacaaactatcaatttgtttttgagatgatgagataaaagggacctttatttcaggtggagcattcagtctttagaatgttatttcattgtgataaataaaagttaaatgagttttgatactaattagaacaatggatgattttctaaggaataggctgaagtctactttagaccctagatccacaagttcatcaattatgatctttactttgattaaaactttaccttctttgggtgctctgattcagcccttaaatgcaccattgttgatgatagtagaaaatgttaaaaatatttttcaaaaatattttcataagaaagattatttctattgcatcacagcaagtgagggattcaaactgccgtgtaggttggatcatacaagagcacacatatgtacctgtgagttgtgtttagtcactaagttgtgtgtgtctttttggctaccccatggactgtagcctgcaaggctcctgtgtccatgggatttcccaggcatgaatactggagtgggttgccatttcctttaccaggagatcttcgacccaggaatcaaaaccgcgt

SEQ ID NO: 38959 - DNA, 961 bp, Bovine  19866881071060
agctggatgcaagaaggttatatggtcaactgaaagctccaggcatttaggataagtagattcatgtctattagataattacaatgtgagaaaagctctgagtctttttttaaactcaaaaattaactgaactaatttagagaaaaccaagcttttttactttgaatactaaacctataccatataattctgcatctgtaaaatcgttttatgccattatagatgacttgaaaatgtaataaaacccacacttctcagctaacaaaaataaaacaagcttccagagtcatggagatgccatcttgctctaccttccccaaatagaagttcaaaacttcagaactattattcaaagctattgagattggatatcttactgccacacacatttataatgtcttgggcattggcttggaaaggcaatcctctcatatggacaaaatgtagtgaagacgtagttccaaaatcaacagcctctggtatcttttctgacatctccttaggcaattctgagaagtggaacaaaaagcactgtcaggaacatcaaagcttcagagttattcgcagactgcaattatgaatgattttaatttcttttttttttttgattttaatttcaaaatcctcaattcctcttcaaatagtaaggaagagggcttccatttaaaagccaatcatctgaaatttcccccacctaacagatatcacctgaacacttataaggatttagtgtctcaaaccattaccagattataaagaatgtatctttttctaacaacaaagagaaggaaaaacaattatgaatgaaaaataaaggcaagaaatttcctgggttacaatcacttaaaaaaaattaatatggtaatgggatatttctagggcacaaacttagaacgtatttatcaaactttcaagattctaaacactgttttaggattaagaatcaaagggaataattaaa

SEQ ID NO: 38960 - DNA, 968 bp, Bovine  19866881419926
tgatcagacataacacaatgcacgattctcatcaattccccttgctgtaggataaaagggctgggaaacaggaggacaattaatactgggtaacgctgcacagcaaaaatggtaaaagaggtagttggattaatttaacaagcacataattcacttcttttatccttatatacttagctatcaaaattctttgctctgctaaaggtggtgttttaagaaaaactaaagcaaatttttgatttaaatacactttcaggcattcataatttccttctccaaaatacaaagacttaatttttcagattggacaaaagtgcaggaaaaaataaaacaacctagaagttaaatccttcctgatttatggcagtccctccttcacttctgacactgctgtattcaccaagtttctacattagcttgtttctaataagaggataaaactacgctacatcttaaaatttctcccaccctggaatatcctaagtgcacattatcatattctctctattttgcatattttatttttctatcttttggccacaccacaaggcatgtagggtcttatttccctgatcagggattgatcctgtgccccatgcactgggagtgtggagttctaaccactggaccactagggaagtcctatcatattatcttaaaccaatcaaccagtttacccctctacatatctatattatccaatgaggcctttgtgctttggaagtgaaaactcaggtacttgttttctgagctacaaaaataacaaagagataagggatgacagagattttctttgaaaatgctttggatagttgcaaacaattttttttttcttttgctgaagggtctggttttaaagaggaacataaaacttcaagaaatatgtcccaagatgatttattctattttaggatttcttatgattattctgttctaggatttcttatgagagggatatctaacaactg

SEQ ID NO: 38961 - DNA, 1001 bp, Bovine  19866881551826
ctatggctgtaactgatactactgctgctgccattgatgaaaccatttctggcattgaaaccactactgctaaaactggcacaactattcaagaaactgctgtaactgtgactggccccacaatccctatagtgagcaccaagagtgcaagtgaccaaccctgcaaccactgcagaggttcttaaaaccacaacagctgctccagaagcggacactgctaccctcggcactactctgcctgttatcattctcactcctgctctccccagtgccatcaccaccaccagtacaactttgcctgaaaaggatgtcaccactcctgaagagtatttttattacactgaagatgagattgaagcctctgactatgcatatggctcagagtctgctgaagattccactgcaattccagaaactaatgccatgggccctgtaactccttcaactccaggggccaccccctcctgaacctataattgataacactactcagaaacttgaggtaatagctactacacatagcccttgaatattgatcaagtaccccaaccaataatcaaaactatgtgataaaatactgaaaatcctagccatgaaaatatagcaattatttaagcatactgtattttagtttttagtctttcttctttatctatcacgaacacatcaggccacatatttgaagcaccataagaaaaactgtcactgcactttattatgattaatttcacttgacatagaaatggaatttgtccttctcacttcactctaaaaagtccttaatgtcctaagagtaagattcctgaaatcctcttaattccttaagtactgaaggataactaaaaggataaaaagataacattttttagtgtattttattcttatgagaggaaataaacactggaaggtgtttacctatggaataataagaatattttatataagatagattatttctggaaaactgtgaaaactagaagcagagatattattcacagaat

SEQ ID NO: 38962 - DNA, 1305 bp, Bovine  19866881572667
caattactcagggtcctgggtttcttatttggaaaagatgagcaataatgctagagatggaaggtaggagcagaccttttcaggtagacacaccaagaatgcagcggggttggggtcattatcagacctcttgccctttgaggtgggaaaacatggtcagcatccccactgctgagcatccatgaggaatagacgttgttcatcacggctttctggatgtggccagggaagaaagaaggaaggatgagtctagctctgtgcagtctccagctcacagtgtaccaggaccaatttcctgtcttctgaaactctttttccttccttcgcaacccagcgaaggcaggggattcaagtccagatttcacagaccaatatctaaattctctggtgggatgaacttggtgctgatgggagtggtgtgctatgtggatgatccaggaaggtctgggaaacaccctttagtgcttgtccaggggagcattgccggtgagactttagccctggcccgggggcaggcagtgaaaggatccctgggggtcattgatcactatctaccaggccctgtggttactcctgggtttggtcttccctgctgcactatgatctcctagatgtctggagagctgtgtttgcacttcgtatctccactagttccccggaaatagtgagggtcctttgagttgtgggttttttgttttgttttgttggtcctaccacagcacgggggtttcccagagccatcagccaaaaagaacctgcctgccaatgcaggagacaccggagacacaggttcgattcctggatcgggaagatcccctggagaaggaaatggcaacccactccagttttcttgcctaggaaatcccatggacagatgggagctgggtgggctacagtcccggggtcacaaagaatcggacacaactgagcgactgaacacaacaaaagagcggttgtgcacagcggggctctcaggagatccatgaaacccctgaagttggtggatacacattgtgttcatgggcatctgtgcatttttcctgaggagacagtgtccataaatcaaagaaacgtacactaaagccaataagaaataccaagaaatgtctagaactacagggctaggtgttgcctgtagttcacaaaatactgtgatgaatcctgatagcctaagccatttaagaaaaataaattacctctctgtttttgctgatgtctctcagttttcaaaagatttaagaattttccccttttatattacatatttcttgactcccacctccataattatattattgcaagtat

SEQ ID NO: 38963 - DNA, 730 bp, Bovine  19866881813587
ttttgttatatatgtgaaaactggcttttgacacagaatctacaaaaaaataagtaaagtttttaaaaacctgtatcttcggcctgtacagtcaacccttcataccctggaaactctggatacagagggctgactatcagacttgagcattcatggattctggcatctatgacgagtcctggacccaatcccctgtgaatactgagggaagactgtgtattcacagtacacactatactcaaagacatgttaaatatttacctcaataccctttatcctatactattacaatgtcatacaacatggtcataaaaagtttttttttaaacaaatatcaaaacatacaacgcagacccaatgaatttcaataagaggcaagtccttacctatttccttctcactttcaaaagctgtcatgggtcggatatcctcatttacttcatgctcttcaaagaccatttctggctcagttatatatttagcagtgggagaagatgctattttttttcccttatgagaaccaacatgtgttcgaacttcattccttctgcttggaaatatctctatatatctatgtcaaaacaaaagtgaatatgtgcaaatggtacaaattaacttcacagtgaactcttttaaaataaaatatgcatatatatttccaaaggtcaacaaacatgggtgtccaaagataacaggtggggagaaaagtaagaaggacatagacatcagc

SEQ ID NO: 38964 - DNA, 1201 bp, Bovine  19866881824708
tgcattggtaggcagattctttaccactgagcacctggtaagcctctatagagtattcatatcaaaatgttaacctgaataaatccaagattttaacatctagttaccaggaaataacacaggatacaaaggagtaagttaaaggacaccatgaggaagcaaaaatataaatacagaatgtgagacactatacagaaccactgattcaatttcttcaaaagccaactggatattaaaagcggggggcggtgaattccctggtggtcaagtggctaggactcagtgttttattgctgtaggcgtgggttcaatccctaattggggactgtagatcccacaagctacgtggcatggcctaatgggggaaaaaaataataaaaaggagaagggaataaaaagggaaaggggatttgctcaaacttaacagaactgcaagcataataatcaaatgtaacatgtggaccatgtctagattttggtggggaaaaagaaggcaactagaaaaggtataaataggtataacctattggcttatacctttgggtataaacaggaaaatgtgattatggactggcattagataataaatattgagatgttaaaaaaaaagacataaactgaaaaaacagatgcagcagatgtaacaaatgttaacaatttattcatctaagtgatggacatctgacaactcatgtctgtactgaaataatttaacagtcatgttacactgtgtttatgaaaatgacccaatgtttgatctttctacatcattactatctgcttcactcaccggttgccaatttcttccctgtgtttcaaaagggcttggctggccatttctggttcttcaaactgcacataggcttctcctgtttttcttctccctctataatccatgacaaaagtaatgtctactatattcagtcctaggtgtccaaaaattattacaaattagtgctgctaacaagagctgttttagtcttacaacttaatacattcaatcacattctaaaaatttcttttttattagtaaaactgtgcagctagtttgccagtctcaaagcctatacccacctaatgggaagaaaattattatgcagtaaaaagccaataacactcacctattcccaggatgtttagggtccaagcagtccatctaaaacacacaactctctctgttttttgccattaattacacatt

SEQ ID NO: 38965 - DNA, 901 bp, Bovine  19866880584152
atattgtaaattctataaaatgtggtgattatatggaaatggaaaccaagtaaaacccaccggttagagagactcctacattatgcttctccagatgaataagggaaggaattggtaagggaaagaattttttttctatatttaacagtatttattttgcctaattacaaatgtaatgtgttttcactgcagaatatttgtaaccggtgtgcagcaaaacaatctggcacactccttatgcagttttagtatattcatccttcacgatctataaatgtgtgtgtgtggctcacacaagttcattagtgggagtgttcaatggagcacactcatttttggctggggagggcaaggtggaaggtagcctgagtatccacaccttgaatcaataaatgaaatatgcatacaatgaatgtttagcctacaagtaaaaacagaatattgtgtttcttttttttttagtatgcctcatattgtgtcctggtattctttattcttatcacaaaactgaccagatatgactgaactgtctgatccattcttttcattcatgtggagtcaccgtgttctgaaatctcattactacagagcttccttgccatttgatgttgggcgtagcatggatgtaatttgtctggaagcttccgtgactactatagtgggtcctggcctcacactcacactctttttttaaaaataaccccaacagttcacaggcaacaatctgcctttttctctgtgcccatcggttgtctggttctcataaacttaccctgacactcacaaagcaaatgtccttcgagtttttactgcacggtgaggtgacccaccagatgtggtattctggtcagtctgaaggaagcacacaatgtttacattaaccttttcaggcccttttcca

SEQ ID NO: 38966 - DNA, 1217 bp, Bovine  19866880681893
tattttgaaaatgtgtaaatattattatgaacatgataattaaatgaaataattgctataaactaacttgcacatagtaagtgttcaattaatgtgagctttcaacaatttttttttaatattctagtactgaaactgtggatcactgtgtctgtatgaatttttatggaaatatattttgaagtgtacatacaacaacagtgatacctataattaaattacacgcttcaattttatggggcagttctaatacatgaatttgtatttgtcaaaggcaattacttaaaagcttaagtagcagaatttaatttgtaaaactgcaaaaattatttcagaataataaattgcacataaaaggaaaaaataacttattttgtctaatgatctggtcatcaattcagagaatagtttcactgaatcatatgcaatagtactgataatcaacgaaatgaattgtatgttgataagataaggctagagagtggccacgatggggaagtagaaagaccctgagctcacactctcccacgactccaccaaaatcacaactatctgcagagcaaccgctgatgaaaaagacaaagaaaccagaaaagatctcagacaatgaaaaccacaaagaaggaaccacaacaaggtgggtaggaggagccaagaaatggagctaacctgtcacatacacaaaaataaaaagagcaacttagataaaatgaagtagcaaaggaatgtgttccggacaaagaaaaagttaaaatcccagaagaactaagtgaagtggagatagggttcacagttatgattaaaatgatgatcaaagaactgaggaggtgaatggatgctcagagtgagatgactgagatgtgaagttgtgttttttttttttttttttaataagagttagaaaatataaggagctgccaaacataggtgaataataaaataagtgaaatgaaaaatacactagaaggaatcaatagtagactaaatgatacagaagactggatcagtgaagtggaaggcagagtagcggaaatccctgccattgaatagagaccagcaaaaaaaaaaaaaaagaatgaaaagaagaaacaagagacctctggtagaacaagtgcatcactaatattcatgttatagaggtctcaaaagacccttataagagggagataaagggccagagaaaatatatgaagagataaggcttcaaactttcctaa

SEQ ID NO: 38967 - DNA, 2704 bp, Bovine  19866880683395
tagatattttcctaattttgtgtctctctttttttccccaaaatattgtaaagtaaggtgaaggtgagtagagaactggttgatctacttctccaaggattacctaatttattaataaccacactctgttttgttctctgtttgagctggggaaccctgtctgagcaaagaaacctgaacctcacaggaatggattcacactcaatcaatgcttctgaggccttggatagtgatttaggacccctaacgatagccttgaccgttacatgtgcattagaaaaggagatgcctgtcagcaaagtagatattaaagaaggatgctttttaaaatttatttatcatgctttggtatgtcttttctaacttagtgatggataaacagaatctaaacaaacatagtccaaggtgggttattgaaataagtaaagattaataatgaaaaattgagctatggaagttaggattctaggttgaaaatgccctaataaatttcacaagtatctaatggttgttgttcaatcgctaagccatgtccgactctgcaaccccatgaactgcagcacaccaggcttccctgtccttcaccaactcctagagttctaatggatcacgatgcaaatattcctgattattgaacatcccattagatgtgcggttgccttttccaaagagcttacagacagggctggcagctctccttcctttctggcaggccatatttttactgggccaagtccacacaaacctctttgcatactcattaacaatcctaggaaatactgaattggttttaacttctttatttaataggcagcctagttggttgaataaacaggcaagagaatgtgttttatgttggatttttcttttactatttctgaaaacattctacattttagttgattttgtgtctccaattagtgaaggtgctagatatctgacttcccagtaaagtcagtgggtattaactttattgcctctttaggtcctgattatgctaaattcattttagagtatggaattcaacatgattacaatataatcgcgtggttaattgcaagtaaaacctcctctaaaattaatatttaaagtggaattgcagtcaaacgcagaatgagtgaggatgtattgtttaatagagtgccctgagggaggttagtgcatttcagagaaatgtgggttgtgaatcagaaaataatccttaataaatctccagagaaggccacctctacttctagaaactgtattgctggtgggttagatactctttcttttgttttatttcctttgcatttggctggataatctctattaaagagagagaagaagaaaaatgagtcttctttcaagttcttcctttttcttttttacgggctccccgtaacaactttttcttctaccgtgaacattttatgtctaacaagacatctttccacatgtttgctagatgcaagagctaagctctatccttttcttattcctttacagtattattaatagtaagtattttagttactcttctacctcagaggataattgaatatgtagaaacataaatgacagtttttgtgtctgtatcttttgtaccttattgtacttgttgatttaatgcaacctaaattagaatcaacctaggataggattttatgtaggtgaagaaatgatgttttactgtacttgacttttgaatattttaagcattctttttgtactaacctgcaatcacttgatttctaatgctgtttagactgcatataattttaacataaaattaaacttataaaactttgagtgtagagatgactttttggaaatatttatttcactttctctcttataaaagaggatacataaagccataactataaaagctttgctttacaatctataagaagtataccgaaaggattcaaaataaaaaggcactcatgaactagtttcaatatgattttacatttcagaaactcaaatgtcttattttcataaggggtgattttatatacacacttttcaatgggcatttgtcacaaaacatgtcctcgcatagcattcatttgcactcaatatcataaagttctttcaatggtttccccttataaatataaaaccatattttaccatataaaatgggtttcctttgtagctattttgacttttcattggctgatgatagagacttaccaattttcttctttatgttcttatttctgaaaattgctgaataaaatagatgataaaagatgatgtattattaccatatatattagccaatggaaatttgctgtatcactcaaggtaatcaaatctgagctttgcaacaacctagaggggtaggaagggatgggaggtgggagggaggttcaagagggaggggatgtatgtatacctatggctgattcatgttgacatatagcagaaaataaaacaatattgtaaagcaattatctttaaattaaaatttaacagattaaaaaaagatgtatttatgctgtatacacaaaactagaagctcacttgttctctcttatactcagattggagaaggcaatggcaccccactccagcactcttgcctggaaaatcccatggacgcaggagtttggtgggctgcagtccatggggtcgctaagagtcggacacgactgagtgacttcctttcacttttcactttcatgcatggagaaggaaaaggcaacccacttca

SEQ ID NO: 38968 - DNA, 1475 bp, Bovine  19866880762426
aactgaatatgcattttgagtgaaagagaaacagatatgcaagaactaaatataatataaattaaaaatatgagttaagtagatattcagactatagatgggaaggaacttgattaaaatttgaaaaaaaaaaatggcttcaaagaataggcactgggactactcattaaacacttaaaggcattgcaaaattgaatccaaatagggctcagcaaactgcatcaacaaaagtgtggacatgctcaaatggtgagattaggaaaaagcaaggattatgatttgattgaggttatttcatggattatataagaaagttcctggtctgtttgttctttatggatacttcttacacttctactacctgtgaaacaaataatatgacttgttgtcaatatttttaaaatatggacttttttcaaattttcagtatttggtttagggattccaacagtcataatctatgttttccataacttctggagcagccttctttatagtgtatctaaaacaaggagcagtctggaagacaagagttgagacatgttgaaagaattctgtactataaaatgtataaggttatctgtccatgaaatgataaacatcagtattgaaatatactttagtgttagaaccagaatttaactcactgaagaaactggaaggcagtattttacccacaattacactgatagttctatttattttttaagcgattgtttccctagaattctcctgttttaaaattgtaaaacccaagagtctcattttataaacaaacacattgcacatacacatttttctttttcttctttttttggagcccaggtcactgaattgcatcaatcatgttttgttatttatagcttactcaaattttaatccacacatgactctctgattatatttgtttacatatttattagtaataaaattaacacatctaaagtatcgtgcatatcaacaactcaaatatttctaaaaatgcatatttgcctaggcatcttcccccacatcttatctttgacttctcacccggaagtatcatatatcctgaagttcatgcttcttatccccttgtttttctttaatattttctattaccaaaacataaaaatgcttagcaaatacgttgcacagttttattttttaacgtattaaagggggtataattttatatgaacatcttaatgcaggattattttgtcagatacttaagtataatttgaaaagaggagacaggagcctgagggaataataataaaagcccattcagtaaacatttgtgggacagttgacatcttcagacactggggatacaaatataaataaaattaattccttctttgaggaactcgtgatttgtaagaaaaggatattggtagataattacaataaaatgtaaaaagtattatatgaaagatgtttgcaaactgatttgtgtttatggaagagatggtatttccctcaagtcttta

SEQ ID NO: 38969 - DNA, 911 bp, Bovine  19866880763982
ttcttgtttaaatacctgttggtcagattttgtgggtttttttttttttttttattcctgcttttggttcattttagaccttgacaaattgaacacttttactttttcctctcagacattctatgcctgatgcttcttttactgcaccaacaggaaggatggattaatgattttactaggaagacagagacatccatttacaaagtcctcacgggcatcacaggcctgtatagtgctctagataattacaagaacaaatgctcaaagaaaactccataaaatgtcagaatgggaggaaggaaatagaatcagattgtattattttaaacaaaatatttttgtaactcataagatatatgtgtttacaaagcatttcagcaaaaaaaaggaaagaaatgaaattagtcagacaattcaaacaaacaaaaaaccccggtcttttcttttcttttctttttcatttttgattctttgcttctaagtgcttcatttactaaactttcagcacacagtaaacctctcccgcccatgctcagtcgctgcactcctcgccaactctttgagacccccatggactatagcccgccaggctcctctgtccatgggattttcccaggcgaaaatactggcatggattgccatgctcccctccaggggatcttcccaacccagggattgaagctgcatctcctgcatctcctgcatctcctgcactgcaggctgcttctttaccacgtagccactggagaagcccagtaaatgtgtaagtcttcctaaactgcagtgaattaaagccttccttccttgctacttttaaactctgaaaatttgaagtatattataagttatctttactgtaatgaccacctatcagaatagagtaggtactcaaccagtattttttaaaataa

SEQ ID NO: 38970 - DNA, 2063 bp, Bovine  19866880836016
ggttgccatttccttctccaacgcatgaaagtgaaaagtgaaactgaagtcgctcatttgtgtccaaccctcagcgaccccatggactgcagccttctaggctcctccatccatgggattttacacacacacgtacagatacatgtagatacatacatacattggaattgatattttatttgttcattcatgtattgatatttagtcattctaagtcatatgttgtatatttttgaataatgaagccatcaaagacaacgcaaaatgactcaacatctccaaagtttaacatatatgaattatatatgaatatatatgcaaatatatgtatgtatgggtgctaaatcacttcatttgtgtctgactttttgcgacccagtggactatagacctccaggctcctctgtccatgggattctctaggtaagaacactggagtgggttgccatgccctcctccaggggatcttcccaaggcaggaaatgaacctatgcctcttatatctttagtattgaaaggtgggttctttatcactagcaccacctgggcaaccctcagcccctccccccaaataataccggaatattaatactgaatattgtgtgtatcagataaaatgtaaaatgaaacttgtaaactattttgctagattagggtagtgtgacctgattggatagggatagggtagaattagggggaaagaaataagcaaaaacgtaatgcagatatttaataaaataatgatgtattacagcagcagtaatgcaagtatacaacttttcttttaagtgccccaaatagttccattaccactgtgaataaaccattcgcattgtggttagaaaagtttgttttagcaatttccatgcttaagggctttcactaaacaataattctatggtggtgacttttgggtgtgtctaattgtctacaaagtaagcttgaaactggcatttcatgtcattaagaattaagaattcaaaatataataataataaaataaaagatttacaaggctggtcattcaagaaaaataggaactttaaaatgtcaaagagctttatatacatacacacacacattaaaataacatgattaaaaatacaaaaaaataaataaaaataccataaaacatattgatttaaaattacctttgctgttatagagttcttttttagcaatcagttttcatcaagtttattattttaacattcctaacgcaaatggcactagcaaatatttgggaagtgaaagtgaggtctctcagtcgtgtctgagtctctgcgcccatggactatagcccaccaggctcctccatccgccggattttcgaggcaagaatgctggagtgggttgccatttccttctccaagggatcttcccgatccagggatcgaagccagctctcccgtattgtaggcagaccctttaccgtttgggccaccagcaattgtttagaatttgtctaatattttgtaaagtatttacatatttgttctcattgccaagaaatttccctctatacatatgttatagatgtgcaacattatcaatgaactctggctttgaaaacctatttatatgtttgtgaggcagaaaggaaagattcccgttgtaagcccatctggaaactagtgcaaccctcaggatagcctgagttttagctggcctctgagaatatttacaaaaactgatgagatttcatcattacagctctcagtgattgaagccaacatatccaataaacagctattgaactttgtgctgaggttatgagcatgatgcagagataatttggaatagagtaggcgtattttgttttggtcataatgagtttttggtcaaaagaatgtgtgcttttaaaataatggaactgatttttctttctagtctcataaaacttataaagctgcttataaaattaagaaaaaaatgttccagtattttaaggatactcaacctgatgaggtaaacatgcatctattggttgacgtctttgaagggggtgatatgtaattggtttttgatatacgaattggaaaattagctttaataatgtataa

SEQ ID NO: 38971 - DNA, 1409 bp, Bovine  19866880875304
aaaatgtaattttctattttcagctaaatgcttctacaaaaaaggattttttaaatcaggaactatattatgtttaatcaattgttttattttaagaataatgaggtttgttattagtcttctctggggaaataagcttactttgtaggatttcaagcaaataagagaattatctgtaaaagtgtcattgacaaaaaagctatatctctgcacataagtaatgaagaaataaaaataaaattgataaagatctcatgtaagattcttttaaaagtctgtgcttggtcattgtttattccgacacccttatagtgcaatcacaaatactaaaattgtcatttaattaatattttcacatttatttgatgatgttgttagctctatctacccactaaacaataagactgttttttacaaaacagctgcaggacacccaaatcttcttcaaccttcagtagtaccaagtaatctacatttggcattcataatatttgttagagaaaatcatttacatgtccaactttctaagtcagatgcatctttcttattccaaatttcaagcatatttcatattgcttattctaacatcttttcctcacttcctgtcataggcatgactcttagtaatctagctaatcagtgttgtttatgatcccaatcccaattgtcccaaatcttatcagggtccataatgttttaaagtaaatttctcatttatatctgataaactacttgttcagtgttttcaaataattttatcagcacctaactggagaagcgtattggtgaaagaaagcaaatcagcactttgacaacagaaagcaaagagaaaaagtctttgaaatgcctcgaactcaaaggcataagagaattctaaagaatgtatttaaagaaacataaagagtcaaaggaagtgagttaatattttctgtttacttggaaatgttaacagagagaaaagtaaaaatactgtttaagattcaggaattgggagtggaatataatagggtataaacaggtaacaaagttcttgatgggtaagattaaaataagaataaaaagccaaaaagaaaaactccacacacatggtagaaaaagaataagggtttcagtaacttatgatgatggtgacatgagggtgatgcattctaacatggatagctctctaccacaaaatagaaaataaaacaactaatgtttattgaacttatttaagacatagttctgagggtttttctttcactaattcacttagtagtcataaaaaatctgtgaggtaaaagataatagtgttctattttatagacaataaaactgataacatttccaaggtcaacaaatcagttagtgacagacccagaaccaaaaatgacatgcatcattatgcagccctgtttcccttcaattga

SEQ ID NO: 38972 - DNA, 2455 bp, Bovine  19866880903525
ttgcaataattaatcactgaataaaatgtgtcctcagcactttaactagtgcccagacttgtttgtgtttgacatggttcatgtaagaattgaaaattagaggcacagtataccacttaggaaagctgaggagttgcctatctttgagtgcttgaatgaaaaagaaaaaaaaaaattaacaataaattagtaacccaaacctataacctgaattaactataagaaaataccaaatttcataaattatatcttttttattacttagaatttattgaaaatgaaatttgcactgcaagagatgaatgcaaaatttaaaactgttacgaaaaacaggaaaaacataaataaggataaaattaatgaaggacccattgaatgaaaaatattgaaacaatttgaaaaacctgtaagtacatttgaaaattaaagagaaaaagttaaaatgaaagaaacaggattataggcttatatgtaaaacaaaagataactgaagtcaattaatattcttaaaattaaaaacaaagcatctataccatgacagtgtttgttttattgtcagtattatttctccatttttctttcaaatagaaaccctagtttattgttttcaaatattcactattctcctacctggttaaatgcctcagaagatcctgattaagcccaatttctaagaataggtctttctgggtataaggaaaatcatactacaaagctaatgatttagttctggaatgggaatattctacaatttgcctgatgggagattttttttttttttaatttcacttccctaataagaaaaaaatgtttatcttcctcaactgaattatgttgtatgtggatattctaccaataacacattaagatatgttaatgataatacaatataaatatactatcttatatattagtatctattatgtataattttatatataggctaccagtagaagacttccctggtggctcagacagtaaagcgtctgcctacaaagctggagacctgtcttcaatccttgggtccggaagatctcctggagaagggaatggcaactcactccagtattctagcctggagaatcccatggacagaggagtctggcgggctatagtccacggggtcgcaaagagtcggacacgactgagcaacttcagtttcaccagtagaattcaacagtaacaatgtttataacatttgttttattttatatgaccagcttgcctgttttggtttactaattgtttttcattttgctgatgtttgaataccatcaacaaaatgctcatcaaatatgagcagctttatatctgctcatatttattctggaaattatacctttatttaaattgtatttaactttttcataagttgcatatctactgttaaaactgataatttaaaaaagtaaacaagtttataaaaaatgagtacgtttgttatgacaaacttttttctctctgaaatattgaagttagggtattactgaatgtcagtaatatttaataaggcaaactgtctttgaaagtacctttacctttgagaatttgtcctttttcagtctggagtttttgactgatatttagtaatatgttgccatggtagaagataagaggtagaatgtatgtaagacgtggaattcaatattgcatattaaggtactttcattcttatagatcaatttttatttatggtttgatataaaactgtcacatcacatatctttcaaaagaggtaatattttgacaaggctggaaattgcacaccaaaatatattttacctacataaacacttaatacacacactttctctctcttcagaatctgaaaattgatcacttagagaaggatgcataatttcaaatatctctattaggtgccatctaatgaacagaaacataaatataaaatatacattgcatatgggaaatgtaggattgtgaatccacttcctaatgttgttaacactcgcagtagcctgtatcccatggctttctaataattgtaatctactttgccccctatgttagggatataattatgttaacagctttcctacgcaggcaccatacattgctattatgaagctaacttcatttaattagcatcgtgtagtaaattagcagttataaggactgctgggtacaaggggatctccattttctcaccatttacttaatcctcagtcaatgttaagattatttctcactgaatttccatagcaaaatcaccatcaccctcctcagatactgtgattcagcatttgtagggatttggaacaaacagttttctccagatgcccagaagttaggattattgaaagccctgtcctgccccttgttggaaagacacaggaatgcagagagacaaagcccatgtgaatgcattctttttctttcaagcaactatttttttttttttaatgacttgataaaaacagtagtattagctaag

SEQ ID NO: 38973 - DNA, 1471 bp, Bovine  19866880986420
aatatttgaaagattctagcatagatgcatgtaaatcacatatttgtttctcagaaatttgaaaatgctttgctaaattatcaagatgcttatagtatggaaatatatattggaggaaggaataaaccttggtaaaatcttgaaactaagtattcaaatgttagtatttccaagattactacaaaaatggctcatataaatacagtatctgcatcctaccatattccttacagtgtgactgtgaactttatatatatatatatatatatatatatataaaagcataataaaaacagatattactttattgacaaaggtccgtctagtcaaagctatggcttttccagtggtcatgtatggatgtgagagttggactataaagaaagctgagtgcctaagaactgattcttttgaactgtggtgttggagaagactcttgagagtcccttggactgcaaggagatccaaccagtccatcctaaaggaaatcagtcctgaatattcattggaagaactgatgctgaagctgaagctccaatactttggctgctgctgctgctgctgttgctaagtcccgtcagtcgtgtccgactctgtgtgaccccatagacggcagctcaccaggctcccccgtccctgggattctccaggcaagaacactggagtaggttgccatttccttctccaatgcatgaaagttaaaaaataaagtgaagtctctcagtcgtgtccaactcctagcgactcaatggactgcagcccaccaggcccctctgtccatgggattttccaggcaagagtactggagtgggttgccattgccttctccaatgctttggctacctgatgtgaagaactgcctcattggaaaagaccctgatgctgggaaacattgaaggtgggaggagaaggggacaagagaggatgagatgcttggatggcatcactgactcagtggacatgagtttggataaactctgggagttggtgatatacagggaagcctggcatgttgcagtccatggggtagcaaatagagataactgagcgactgaactgaacctgatatatatgtacttctgtatacaatattatgtgtgtattttccctcactccacttcctgatagggaaactgagtctcaataatgatcaataaatgactaaaaaagatgtcaatgacaggcctgagtagacacttctggtctcctggcactcaattaaagctgtttgcatttttttatatcaataaatctgtagacccaggtgagtttcttaatgcagagaagaacctcagggcatgtcagtttcagataggagcaataaattgcacgtgtgcatttgaaatgaggacatgtctaccattttctaaagctgaaagactatccttttaaaattcacattttagcagatgcttcacatacctaattattattggttagaatacttaggtagtaaacaagttcgtcagat

SEQ ID NO: 38974 - DNA, 1543 bp, Bovine  19866881072206
aagaataaaattagagaacccccgttaaaaacataatgaagagaaaatgagcgtaactgaaagggcttaagactagatactatgaagacgtttgaacaaaattcttcatacaattaaaacgagttgacgtgtggtatactttccattgttaaccttcataaaggagagtatacagtaatccttctattcaggcctctttcatttggaattcaagataattccaagacagtggtgcaatgttggaaaaaaaaaaggcttaaattcctaaattaatagtttagacaataataaaggaggaatttgaattgcctgcttatgtgtaccaaaataattgaagaacttagaaagacatacatacagccacacagtcttatattttactctgtttttataagattcatatccttctattacatctcatatagtttagtcagaaataaggcttcctaggtggctttgtggtaaagaatccccctgccaagcaggagacatgagtttgagccctgggttggaaagataccttggagaaagagatgacaacccactccagtaatcttgcctgggaagtcccaggatgagcctggtgggctacaatctatggggtctcaaagagtcagacatgacttagcagctaaacaacagcatctgtttgtatgaccataagattggtttatgaaacacttactagatatcggacactatacttagttcttgatgttcatcattttgtgtaatgtttacagcaatctagtgaaataaatatgctcttgttaactgatagtgttcaaatgtactagtttttctaggattgcactgctagtacaaattggaatttgaactcatcaggctacctccagacaaccattttatacgacttccccatcatcttccgactgtatgatcaactgcatattttactgttttatgcaaaaatgaaaagaaatctgttaaaagtttgtctgtgttgctaatcacagataaaatgatctggtttcacagggctctcatgacaaataacctggatagactccttacctctttagtttgagagactatcaatggcatcccactgcagtagggctaaatcccataaaaaggcaacacagaggcctgttttatgtctcctttaaggattccacgatatgagactatctccatgagagaaatgataaaagtaacgcaatattaccaagtaaactgccaggacacccttcatcacaaaacaaagactaaggctgttccaagctctggaggggaatgaggggcagttcaaagagaggaaattggaaggtgaggaaggaaggtgaggtggaggtagttatttccaggatataactggggtggccgggtgatccgtactattgcttgcaactttttctcccaagcataagtagcacaaacattggtggtgcctacagaaagaaaagccatccatatgtaatttgcatttgctcccttttcaattttcagatattcttaaatatgatagaaattataccatacttgtaacatggacttggaacttagaaatacacatatatac

SEQ ID NO: 38975 - DNA, 981 bp, Bovine  19866881105597
tattatcccatggaatttcctatttcttagaagttaataggtcttctttaaatactgatttctaattcaaaacataaaaatcaggcctacactgccttagttaaaggcatgtgacgtaacacagttgcctgctgaaatcaagatctgtctttatagctcagttggaaaaaagggcaatttaatgacttttaggaagattcctagacaaaaatggtcaataattgtaaagaaaagaacaatactaaaacattagtatttctctaagaattaaacctaaaaatagtgtattaaagctgaaaaatcaaaactgtataggcaaatatagattcaattattaaatgtatattatataaaaatttcatcagtcaccacttaccttatttcagagtgcctgaatatagagcagatatggaatcttgagtcacttaacaaataacttgaagctgtatatgttttatctgaatatttgtatccagcatgaagcatgctgttgttcagtcactcagtcgtgtctgagtctttgcgaccccatggactacagcacacccgtcttcccagtctttcgccaggattagagcttgctcaaactcattaccattgagtcaaagatatctaatagctgttgaatgaatacgtgtaactaaatgcgaaaatagattgtgatttgttgttgagactacaattcgaagttctgttttcttgagaagcataccggagaagaaaaatgtctttagcctaatgtcgtagtatgtcagttcagttcagttcagtcactcaatcgtgtccaactctttgcgaccccatgaatcgcagcacgccaggcctccctgtccatcaccaactcccggagttcactcagactcatgtccatcgagttggtgatgccatccagccatctcatcctctgtcgtccccttctcctcctgcccccaatccctcccagcatcagagtcttttccaatgagtcaactcttcgcatga

SEQ ID NO: 38976 - DNA, 1187 bp, Bovine  19866881113845
ctaagttgtatctgactctttgtgatcccatggactggggcatgccaggttcttctctcctcgactctctcccagagtatgctcaaattcatgtccatcagggtgatctagcagcttcatttatgatgtttaaaaactgtaaactacccagtttcttatcaactgtagaataaatgaattatctgtgacatattaatagaagtaaatattctagagcaatgaaaatgaaaaatctactgctaaatgcaataagatgcattctcacaaaattcactaacatacttcatataaagtatatataaaaaagaactcctataaaatttatattaagttcaaaactggacaaaacttttatggaaaaaaaattctttatagagcatcagaaatcaggggagtaactaatttgggaagaagtattaaaactgggagatatctcaaggaggaattatggtgtgctagtaatatttaatttgttaaagttttctatatgcatgttctactttcataaaaagtgtttataatacatgataatacatagcacttagtgtaatttcaagaacatagcaagtctaaacaagaattttacttgtatagcagagccacagagatgatgtctctaacctataatagcactaaacataaattgatcttatagcaaactttgtcataaggcactggtatagacatttatattttataaaaaatgttttagatgtaaaggtcattattaggcaatttagataaaattggattttgagattgagggaaaaagatccattacttttgtttcttatatgaagatttgatatctcattcacaacttaaatcattatctcacaaggaattactagactgcctagtggaattaccagttaaagagatataaagaatatgtatgttacattattcttagcatttcatttatgagttttcacagatgtcttgaaatgtacattagggaaaatcactttgccagacatataattaatacttttcaaatcaagaacctattgaaagttatatcatacctgaactattttgagcttttctaattaggtatatgctattatttgttttaaccaattttatttttttccaagaaaactcaaacctaaattttctgggtaaaaatccttgaattttcttcaaggacagaggataagggaatagtaacaatgtattataat

SEQ ID NO: 38977 - DNA, 1738 bp, Bovine  19866881126703
atcacggagcatacgtaacctagtacttaactgcagctgccccctcagcccagccaaaagcagcacagcccccccagtagagtcataaatatgatgaagtaagtacacggttttctatgccactgaggcttcctggttttgagaagcagaagttaactgatagaggatattggtgatttcagaaaaatcattgattacgtgctgatgggttaataaatcaggtattaatggctcaaaggatgagttagaaataacaactaaaatcgatgagaagttgatcattaaagggttgtgaataattaaggtagtaactttatgaatactaaatagtagaaggtaatgaggaaagcttacaaggttaaattcccttattttgaatacataattcaggaactgggactccacatacatgtaggcatttaaattactagtaattaatgggagaagatttccgggaatcttgaatgacggaactgattttggttaggtaagtttttaacagtagtgcttaaatcatgttgtatagaaaaggtaatccttattgtgcaatgggaaattatcagataagtatagatttcctttcaacagaagaaaaacttccagaatcttaccttaggaatagcagctttataaattggaaacagcacctaaatagatgaaacaagatgattcacatgaatgcaggaaagaacaactaaatgttgccaatttggcaaattggcctatatgcaaattagtcatgttttaaataaagaaaacacatcaaagggcatgtctgttcatttattttgacattttataatttagtctaattatttgtgaaactgttacccaataagctgccctttggtatagtttgtgaaaaataatgacattttactcaacgttcttacttttactttctatggtacatgcaggcaagatatttagtggactaattaattaaaaattgaaatgtcaagtcttacccgtatttctgtgcattagccaaagatacatacggactagaaatcagaaaattcaaagtgagtttaatatgaatttccagagataaatctgtgaaattaattctctgagcattgtatgaactacatattctgctgaattatttgctttacatatcaaatatacctcccttcagactaaggtgtctgattttgccattttacaaagtttgagataaactttgtataatcttacatctcagtgttctacatcttttgttgatgacttctggccctggaaagcccaaaaggagatttttattttttaagagggaatttttagctctgtcttagacaagtcttcttttaatatcatactttgcagatgattgttttaagaataagtgattatggttttgtcttaaaattgagctggcttcatttttatataacttgctttataggaaatatataatttctagtttgtcaaggctgtaaacatattttgctcagtgcaaattatcaagaccacagacaagtacaaagcagcattggctccaatttgcttttctaagtaaacaaagcctgcagcacagtgtttcattaatgagggatgaatctgagtcttttcctgataaatcaaggggctgtgcttattaaacaaagatgatgttattgattcaaagggcatgctctttaagtagttttttttctaattgtttgtgctgatccatctacattttatattttacttcccattttagccacacacattttataaaatgcccagccaa

SEQ ID NO: 38978 - DNA, 1602 bp, Bovine  19866881132414
ttggtgttctttggaaggaatgatgctgaagtggaaactccgtaactttggcccctcatgtgaatccttgactctttggaaaagactctgatactgggagggattgggggcgggaggagaggggatgaaagaggatgagatgggtggatggcatcactgacttgatggacgtgagcctcagtgaactccaggagttggtgatggacagggaggcctggcgtgctgcaattcatggggtggcaaagagttggacacgactgagcgactgaactgaactgactgaatctatagtaatcactaaaagaataggaagagaagctatagaaaattaaccggtgaaaaataaaatagctaaagcagcacacatgcacacacatacacacacaaacagattaacccaaaagaaagctttacaagagcaaaaagcaggttagccaaatgttgatagaaaagaagtattagacggcaaatatgaagtaaagtctatctttataaatacatttgataaaaatgaacaaaatacttcaaattaagaataagattgttagattagacatttaaaaacttaacaaatgctactcctaagagaaacatcttaatacgagactatagagtgattgaaatccaaaagactggataccatcaatagataaaccatgcaaatataaagtaaaagaagcaaattatagggctatataaatattatagacaatatatattaaggccagagtattcctggagatacaagagtaaaattacatagtgataaagaaggaaatcatttggaaaatatgaccattctacatttttatgcaatcagtatgcagattcaaaatatgtatgaaattaccattcacaatacttcataagttgataatacctgcagttaaaacatatcagtaaggacaaagaaaatacgaataacacagttaacaaacctgacctaattaacagacctacttgtcatatagtgtgcttgtatataatgaacataattagcaggcctaattgtcacacagtgtgccctacatttaacaatgacagaaactcaaactgttgtcaggcacacgtactgcacttaccaaaatgagaggagatgatctttgtaaagtaaaacgttgccgtcttacctgggcattgcttcatgctcaatctaccaggtatcctagcagaactcctattaacttacgagtatatcttgcataaggaaaatgagcaaaattctatggcacttttctgtcttataacattgctcctgcaattaaagaaagctgcaacctcatgatgaatgtctcaagggctgttgtttttgtcatggaagatcagttatttcttttattaaaaaaaaatattatatgtacagaaagaggaaggaaaaaatgttttcctctaactgaaaaaaaggtttacttccaagtatttatgttgctgatttcttctttcagctgtgcatatataatttatatttcctaaatagaaagtctccttgatgttgacattaggatgaatgtgcctatcaggccattggcccaaattgccgttaataatgtgaaggtcatagggtctactattcattggccagtgagtattgtatcatattat

SEQ ID NO: 38979 - DNA, 1180 bp, Bovine  19866881135064
ttaaaattgaaatgaatgtattgtttatattaccacttagaaacatttttactgtaaaatcatttatcaaaggagtggtccattgagataaattcagatttcacagagaggtgatgctacaactgaagaaaggaaaaaaacaaaaaaagttggggggggggatcaaatatcaatttaggtggatttctatttagaaaattataatgattaacctagtttagctcataactgccatgtattaaaacctaaaatacttggtgctgacaaactaaagtaaaaaaaaaagtgaaattaatttttaaattaatttttaaaaacttaaagcattcggataaagcttattttcaacttctatattaacttctaatgtgaaacttcatacttttgctgtatgttgtttgaattcaagctaattatataattttaaatgtttattgatttcaatatgaaaatatttataggatcaagagaaagtccataacattatttttttaagctggcacaaataattatttttatatattgagagttataatagtatacaatgttaatgaagcatatatgaaagcatctattgttcttttcttcaagaaatagttaaaagggtgtaaatcaaaatatgatttgatttctttcattccctgttatcccctagtctctttaacatattgatctagaaagtctcagattctttttatttacatgtttattgaggacaacatagaaaataacaatctattaaggtatttatgaaatcatctttacgtgtattgaaagactctaatctaaatctatttttatcaaggagccgcatagagattaatattaggctctggtgccagaggctagcatatacattcttccttcaccacgtacaatctgagagaccttaagccaactaactagactctctatgcctgttttctcaactgaaaaatgctgcaaagtgggaatgagcctagaccctatctccttggctttatttttttaacattaaacctggcataattgtgcatatagtgtgttgcgcagtacagacatatagtaaacaccccaaaatagcttataagttgagttccagttctatttttaagagggagtcccctttgaaaatgggcagtctttattttattcatctgcattttaataatagcataatctccattggaagggaaaaaaa

SEQ ID NO: 38980 - DNA, 838 bp, Bovine  19866881297083
ctttaaaaaatatatagtttgaaggaagtgatatgcatttattaagtagattcagtactactcattggcattttaccagactgatttcatataacttaaataaagttttctaagccaagcagatagaaaacaattctcatgtcttaccactttattaagttcttctttttgtcttaagactttgcttaaccatgtatttcactgtgaggttttattcagcatgtatagacaaaatcagttacactcagtatgaacttgaaactctctcttttatttataagttctttgaaaatattttcgatatcctggattccaaaataacgatgatattgacagaagtaccaacaaatagaaaacactgtatcaatatcaactggatttatttgtacccttggagattatgaacactattctcactcatatttttaatatgatttgatacagtgaatggaagaatggaactcaaaagacatcagtttgaattcagatactaacacttacaatcttgggaaattggacaatgcattattactttacacatatttccttatcagtaaaatagaagaatatcctgattcttttagtgtactcacagtgttatttgggggatgatatataccagaatatagtgtacgggcaccatacccaggaatcacttggctcccttctaaacaaatagattctgggaccccagaggtgactaatatcatgacatctacgggtatacaccaagaacctgatttttaactaatccccctgctaaagcttgattgacaatttcaatgtcacttgaattcaatgtcaattcaattcctcctaaggaatactatgctaagaa

SEQ ID NO: 38981 - DNA, 2891 bp, Bovine  19866881325079
ttgtttgctcgatggcaagaaacattgaagaaataaatatataatgattaaaaaaattttcaaatataatcacacgaaaaaatataacagtacattgcagtagtgatcaaaaacgctataagatataaacatttgaatgttatagcaaacataacattctcaaacctatagagactgtatagcaaacagtctctataacaaagagttatagagactgttgaaaagaaggaaaatgactgagaattttagaaaagtaaaccactgtgagggtcttcaaatacaagtatctgatgcaaataatcaactaagtgtaacatatttgaaagaatacaacttaacaaacaaaattcacaactattagcacgtgaatattgatcttatacttttgactttcttttccacctaaaatgaatatgcctctcacattatgctaatgttgaaagaacgactaacatttcaatttctatcacatacagctagacaaaatatcctagaatggggaggcctcttactaatcctaaatcacactgaattgttgaacacctattgggcttctaaaataatctgtaatcacacttcttatattttacagaaaataatatttatgttatgatgtattcctgttttttgaagtggaagtatttactaacccacccttaacaaggaccgattaacagaaatcgctggaaaatataacacattttcattttgttccaactcctcccatgccatgagtgtctttccaaaagggaaaaaatgacaactttcagtaaaaatgtactttgacttgcataagaccactctgtagtccaccacaatgattaaagcgaagttatatggaagggatcaacacagtataagaaagagcaaagtgtgaaaaatgcagttacttactctgctgccacatacatctggatgagaaagtaccaaaacctaaaattctacatgattcttgaaagtatcacagctttcattaggcaagtgattcatgcagagtaaatctttaaaaacaaaattctgaaccagcaataggcaatagtcatgacaaatatggttttggattgaagctctcttttatctacttcatcatttttctgattgctggaggtgaccagaagtttagggagtatttaatcactgacaatgaggaaaggaaacaaccaaataagtacaaagagataactgatacaatgtacgaaatatgccactttcctccatgtggctaattcactaattatgaaagttccttaagattttcaagaccaaagattcaattttttcatttttcaggacatatttaacaaggctgatttgctgtctgttatagggtgtacctcgttatcttttaaatttgcataatcacagaatgcttgattaaggaatggaagctttgagtgtaatggatatgcatgcatgattagctgtaggaggggatctgtaattatgtggtgtataaatatacatctatatactttaaaccttcataataaacacaacaaaatcttgacatttattttaaaattattttagtcataacttagaaaaataatagtaggtttaaaagagccactggaattttcaaccacactcttccagaggaaaaattcacagtatgatataaaattaatatttaaagtatacaatattggtgatttttttgaaaagttagatggaatctttgtttccccaggtatttttgtgctgtgagactaatgcaaatgaatatcccaattcattaggcatgcagagtgaatactgataggatgtgtgtcttaaatttctatagttctcatccatctaactgaatccagaattggtacataatacacttttccgctccatcacttcccaccccccttatacatacagatatccataagtacacaccacaccacgattgttcccaaatatcagtgtgaacttcaaactcaccaattggtaagaaataagttgccaactggcatatgtttatgaaagaagaatgataaactgctactgaatatgtttcattgtagatgtaaacaggcaattaactaaagtcatatttcagccagactctaaatattctaataatcattttataaaatttatctttctgagttgaaatttttttgtgtactatattactgtgtgtgcacacatgctaagtcactttagtcgtgtccgactctttgtgaccccatggactgtagcccgccaggctcctctgtccatggtattctccaggcaagaatactggattgggttgacatgccctcctccaggggctcttcctgatccgggttgaaactgtgcctcggaagtctccttcattggcaggcgtgttctttacccactagcgccccctgggaagctcctaaaggactagtatttatctgtttatctgggtgcggtccataaatatactttatatgtatgaatatttacttcccaacaaaacatgcagtgtagcatttatctctatttttttttctatactatatatccagaacaaaaactgacaactgctaataatgtctttttccccccataattccttgaggcatttcacctgtgagagtttaaaaaatatattttaaacaaattcatcattttaagggggaatgtaaaaatatttcacaaaattatttcttatatttcttttatggatttctttctgaagaaagaaaaatcactctacacatttaattaactcacttgctgccctctctattatcatgctccacatatggcttattttccagcagtccggtgttttactgaagaaaacctaataggaaatcagccttaaatgtcatcttaatttcccacctcactaaagggctcttgtaatttgcaaaagtgatagtgaatttcttgccaggtcgttaacggatttttctggagtgagt

SEQ ID NO: 38982 - DNA, 1213 bp, Bovine  19866881350087
cctgtcaatgtatggcaaaaccactaccagtactataaagtaattagcctccaattaaaataaataagttaaaaaaaaaagagtatctcacaaactgtactaacattgactaacataaactctactctgaagatgtagaggagtcaccacaatttatagcattacaaaaataaaataataaacatggattaactattggattagatgtttatattgtccgttggaagttggcaaccatggccagactttatcattctacttttttcctcttgaggggcattctacctgatcaccacattgaataccaaattcactttaaaatttgaagtacgtattggtgcactcacatcctaattctgaattgaggcatggtaatttataaatatcctcaaagcaagagaaaatacatcatacggaaatcatatctaagttgggaaaaacaggaaaggaagtaacatttctttttgacatctagaaacaggatttaatcctaacaaaagctgtgctttaagccttttctagctaaacttagcaaataagaaactgttaatgaattatcttactgttctctcacaaaccaatcaatagtaactccttccctctaaagataattaaagttgatctaattagattgctttcacttacaaacatcttgtaaataaagttaatttattatcacagctagttcacctatggggattattgtaccataataatggaattattgctgtaaatcttacaacaaactatgtacagatatctgatattttctcttaaaacttgatttttctttgctatgagatataaatcataaataaatctcattatctgtggcactagggcacttgggcaaagacatccaattaatgttaggcaactatgtatgaatattttagtgtattacttaataatatatacaatgttttatattcatataatgaactgtaaagaattactgtacacataatcttactgttataatcaaagtgaaagataaagaaacttaaaattgaaatatttatgtgtgtttttctttgatgctttcaactatttaataaagactcgatattttatggagaagacaatggcaacccactccagtactcttgcctggaaaatcccctggatggaagagcctggtaggctgcagttcttggggtcgagaagagttggacaagactgagcgacttcactttcacttttcactttcatg

SEQ ID NO: 38983 - DNA, 961 bp, Bovine  19866881387048
attttcattttaagaggcccatgttctaaaaggaagcttttctcttgtcctcccaattaagcaaaattatttcttgcatcagaattaccatgaattactaatcatcctaaaattgcaaaataaaggtggtgatatttgaactgagggaatataaaaaatggtgctcaaaaatgaaaatgatccatatattagttcattatttacttaaatacacaaaagtggatagaattctgttttggatagttaattttaattccaataatttaaaggagtgaaaattagaagatttatttttgtcgtataagtctattatcttagaatccttaattggcattttattcatttcatttttatcattatgcccaagtcatgcaatgtatttccttcataattattacctgtatcaaaactggtttggaagatctttgaactcctgttttcattttcttttgaactctacttgtctctttgatcagcgtattgctcttgcagcttccgcctgatgtaaagcagtttgtatggctgcataccttgtttctgtggcccaaatataaaaagccaaatgacagaaattaaggaaagaaagtctttggtgcggagtggacagcattcaccgagcatttcgattaatgctagctctgaagcctcctgatgaacaatagaggtttctcaccatgatcttcattagcatatctttgtgacttgcaagaaataatttgcacagtctcagatttaatggtaacccgaagctcccttattctgtaatagctttctaaccacaatcaactcatttgctttttttttctttttgattgacacacagggtgcagaggtgccgcccatttccctcctttcttccgcttccacttgctagacaattaactagaaatagattatagtaacttgactcattctttatatggtactgacaatgtattttcttagatggcttataaccaga

SEQ ID NO: 38984 - DNA, 1457 bp, Bovine  19866881396576
cttattattggcaccaccggttttggtgacaaaaaatactgcagtttatgacgttcctcccagtagaatgtatgtacatatacacatacatatatatttatttctccccctcaaaataagcccttctagcaatatcacattaatttaagaatgactgttctttgagtatgagccactatcaaatgatcaaataagtttttaaatagtaattgcacataataaaaagaaagacgagtttattcttggacccagctggctagcaggcatttattatctgtgatacttatatatgtcagtgtgagttcatcaaatctaaaagattttttgctttcacctgaaataatcatagaaattttgagttggagctgacctaagacataaccttgcttaaccacccacctaaagtagaaattatcagtgtcagtatctctgacaagtggtcattcattatatgcttcaaagtactacaagtgataagaaaccccgtgctctgtgattcagataattttattgttgaataaaccagttttctaacaatattctcctgtatggtgaggcatctgcatcttcttaatatatatccattgaatatctgtttcgtcttagagctctaagactgtggtagctgttaacatattcctctccctttgtctcaacttctgttactcttaatcctatctttgctctttagacatgtcctccaaagctgttgtgtacactgctcgccatgttttggatacacgctgatttttcaatggacttttagaactttggtttgaaaacgttattggatttttccaaagtagacagacttcaggcttagatactgtctgtcagtctttcaaattctgttattccattgaagaccacgctttgtatgtattattatttaaatcatcttgttttcttaggcctcaagttagactttgggtttatttcattttattcagtgtgaatttagtattcaacagactgccctttaattccagaatcgcccccgcccgagccccatattatttgcagttgacttttttttaaacatgaatgcaacatttcacagtttgcaatgtcagggcatattattgcactaattttaaaattgtcttatgcaatgcagaggtagttattcctttgacatagtataatcttttaaaggttgtattctgagtcttcatccatgtcatctatttaaaaaaaaaaagttctccaacaatgagcccagtgactggtttctgtggcatattttaagaagcctctttccattaatcatcatacataatgtagtatttccttgacttgatatgaagtctttttgttacttgaataaatgtttcctgaaacaacacagaatatcattacaatttctaggcattttctcattatacctgttccaactcaagcatattcatacacgttcagttttcttttaacacacccattttagtttgaaggacatg

SEQ ID NO: 38985 - DNA, 1040 bp, Bovine  19866881430905
tgatatcagatctcaatcactaacttaaaaactgaaggctactatcagtgcaactggttgtgactgagataaacagaaacttaactatgtttctgacagcttattgctatctcaggggaacataaaaatcaataattcagtatgtattctatagtcctttagaatttttatttgatgaaaaagtgcagatctgagacatgggcaaattaaggtagattcatattctgacatgcaaatataatgctaaaatgcgtgattaatagaccaatgccaacgagaaggaggtctccagggaagaactataggaatttgcaatattttccaatagtgcctgggctcatgacatagaagccactcttttcatatttgtggatgacagatttaggaggattatctaacagtggcagagttcaaaaattttgataggctagaatgatgaactgaaaccaataaagaagaatttgacagaaataaatataagattctccattcagattaaaaacagtttacataaacccatattcagagagttctatcctgaaagcaactcagtaaaaaagactggatttttaaattggtgacagtcaatgtgacacagaaatttagaaaaaataaataaatcccaggctgctttttacaaggctaactggcattagtggtgaagaatacccctgccagtgcaggagacttaagagacatgggttcaatcgctgggtcgggaagatcccatttgcaaatcactccagtattcttgcctgggaaatcctagaggagcctggtgggctaccgtccatggggtcgcaaagaattggatatggctgagcacccacacacacacacacaggctgctttaacagctctgttaaatgtatgaaattccaatatggcaatgtttttcaaagtgggagtcaagatccattattgagtcttaaatcaattaatgggtcctaatgaccctgatcagagaaggtaatggcaccccactctagtactcttgcctggaaaatcccatggacggaggcgcctggtagggctgcagt

SEQ ID NO: 38986 - DNA, 748 bp, Bovine  19866881479668
ttgtccttgagagaaaatatcatttggccttggtaatgcaattaatctatattgaagtaaagatcatttattttttaatggactgcatacataaaacccctttttagcacacatcttttatgtttgtagcttgttcaattgtttactataaacaatggttggaaaatagaatttctttaaaatgaatgtaaagctaaagttattaccactttaaatatgtcagtggtattgcctgctagaatgctatggaatcattttattagtttatggaactattgttagaaacttttcaaatttaggtaagcattttactgacagtacaattgcattaatatataaggatgcattcaaaataaatttcatattgccagttcaaaggcaaactttgaactgtgaaatatatattttgaacatgtgaaatatatatttttatcagacaattatactgtaaagaaatgaagtaaggaataaataaacttagcatctgttagagcttaaacctatcaacattcttttcagtatcctttctatgcattaatgtcatatgaaaagtctttagttaaagagtgaaataggtggattttttggactcatatctagtttaaattttgagaaaaatgtagactattaatgatgaaaacttaaatgctagagtagcttgctagcaaagaatatgtccacaaaggaaacgtacaataactgaatcacacttcgtattatttttaaggaagaacttagatttacttta

SEQ ID NO: 38987 - DNA, 737 bp, Bovine  19866881661452
aaattattttctgtaaagtaaatagataaatttaaaatcataccattaaaataagatgtaaaatatctcataatttatgtttacaggtcaaacagaagtataagtctaattaagtgaactgaatatacagaagattaattggtgaagcagctcaagactacagagtttgttagtaaatgtgataaatattacatattttgagaaaactagtttggtgatggaaataaaaaaggaaatataataactcataacagcatattccataatactgttaattcagtgaagagtggaaaacttgaaagcaactgacaaaggtgacttttaaaaagagggagcatggataaaattggaagaaagtaatgtggagtccagctgctaacacaaaggaggaaacagacttagaaacatttcatacttcttggcatgctcctactataaggttttcagtattttagttgttgatgttccgaatccattagggttttactttttggcaaggtaagaacagaaaagacttcactgtgccactataaacaaagtttaagtaattatacctcaaaagctttccaaaaaggatttctcttctccggactttgaaacagggtgttggagaaggcttcctggtgtggtatttctcagttttcattttcactttggctaaaaggcctatttttgcactgcctttttcttattttgatagatccaagttggtttcatttcttgagtagcagattact

SEQ ID NO: 38988 - DNA, 833 bp, Bovine  19866881915798
ataacacattttttcttggtacgcaaatctagaacacaagcacagctcaccagccttgagggcaaggactttgcatttgatctttaatggcaccacatagtccctgacacagaagagatgccaccagcgtttgtggaatgaattgggcaaagttggccaaggtttcaaagttcacacatctgaattagttttatgaaactaatggagtttgataaaattcttcagtattactacataactgaaagtgatgacaaggacttccctggtggtccattggttaaaactctgcccttcaaatgcagggggcatgggttcaatcccttgtttgggaactaagattccacatgccctgtggtatggccaaaaaaaatgacttaaaaaaattgattacagatccctgtcctggagtaatgtccaactggtaatgtccaatccatcatagattgataatattgtaagtcgaaaaatgcatttactacacctaacctaccaaacatcacagcttagctcagcctaatttaaacatgattagaacacttactttagccaacaggtgggcaaaatcatctaatgtacagcctattttgtaacagggttgattgactatctcatttaatttcctgagtactgtatttaaggtgaaaagcagaatgttgcctagatctagaatggttctaagtatatggctgactgggacctgcccagcatcaagagagagggtcatacgacatgttgctagcccaggaaaagatcaaaaatccaagtatagtttctatggaatgcatacagttaccataccttcataagtacaaaaatcacaagtcaggaaccat

SEQ ID NO: 38989 - DNA, 1117 bp, Bovine  19866882016064
ctgtggttccatgtccctctagaaattcctgataatctcttattctaattaaactataccagcaaagttccttttgacaagtagatgacacatttctcaaattctggaaactatgatgctgataacaaaacccttataggtttttaatatagaatcaaaagctatgtaggtagcattttttcaactttattgtgttaagtataagattatatccatgaaaacagaatgatctgatcatgaaaatagcagagattttaaaagacattgccagtgaaaacacaaactctttatgtataggatatatttgggcatatgcatgtctatgtggcatatatttagccatggataattatttgaacatcacagagcagcacagcatctttctcaagtccttctgtttctatagtcttacctctattgctgccaccctttgaaaaccatagaaactttttgctgttaagtattatttggtagctatagctaactttgttttaatcaggaataagtggtaatggcattagctgcttgtgcttatagtatattgtgatacttaaaaaaaattaaaatattccaacttaatatttccactgtagttattttaagtattaccttaaagtccattttctgaaatacatatgtgatacttcatttgtacaattcttttgtgcaaatgtataccagtgtttcaattaaaataattataagccaacagataaaatatatgtgtacttaaagatggacatttcaatttgtgattctgaaacactgatacatctatactagaaaacagaaattttttgcatctaatttagtgatatgcatgaattatatttattctgggaaatcagacaattttcaaaacttatctgtcttataaaatttcaattaaagtaccctcagttataaattcaaattcctctgaaaaatgaatgaaattaccaccaggaagatgaagcggaaaacctcatcttcttgcaacagtgacccaatacataggaaatgactcttctcgatattttaggcatagggcacatttataagtcacagtatcttgttcattattctgaagtacagctctcgtttcattttgttacatctcctaaacattttcagaact

SEQ ID NO: 38990 - DNA, 1855 bp, Bovine  19866880201760
atacaggaaagtgatgaactggaaagaaactctggtatttcctccagaggtgcctatatctgagaaagccaaggacttaattcttaggttagtagttaaatctcttaaagaggttatggtatcttaaggcctcacagggacctaaaagattaaattgcctatttcagttttgtgggaagaaaaagactatcactgatctatacagtttaagaactcagtaaagaaaaggcattttggttttttttaatgcagattcttaaaaggtaatattcaggggaaaaaaaaagagttaagagggaagaagtcttatattatttcagaggtcactcctgttggattacaatgactttatcccctaaagagaaagggaaaataaattcttagtagcagttcatatcacaaaagtctatgtaagaaaaacaccaatacagtatattaatgcatatatatgaaatttagaaagatggtaatgatgaccctctatgtgagatagcaaaagagacacagatgtaaagaacagactttcggactcagtgggaggaggtgagggtgggatgatttgagaaaatagcattgaaacatgtatattatcatatgtgaaatagatcgccagtccaggttcgatgaatgagacagggtgctcagggctggtgcactgggatgaccctgagggatgtgatggggagggaggtgggagggggcttcaggatggggacacatgtacacccatggctgattcatgtgaatgtatggcaaaagccaccacaatattgtaaagtaattagcccccaattaaaaaaaaagtctatgtatgaaaccttttctaagcaaaagattcattctttttctcaactaagatgaagcatttaggttctattgtggattcctagaaggaatatgaattgggacaatcttataaaaaaaaaaatcttcaaactgtctttgacctttgacccagcaattctacttctaggaattttgcatatgcagataatcagatgtgtgtaaagatttaggatatattatgttatcttgatactgtttttagtgatgaaaggttgaaaatcatctaactggcaatggtgaagtagctaagtaaattgtagtgtttccatgtgtaaactttagaaaacaaatgtatagaaaaatagttaaatgactttgggaaatgttctcagtatattaagtgaaaaaaaaaataatggaaactccttatcaacaccatatttttgaaattatagtaaaagactggaaggaagtagcctccaactgtttgcaatagttatgtctgaatagtgcagttatagatgatttctgtttttcctcacatttctcacaatagagttaacttcagtaaacagaaaaaaagatgaaatgttggaaataatgcagagtacttgagatgtagtctgcatattataatttctgtgttcccattttctaggttttgtattgattctgaaaatagaattgggaatagtggagtagaagaaataaaaagtcatcctttttttgaaggcgtcgactgggggcacatcaggtatgtttacaggctttgagtgggataaggccgtgtgagtgaaaactttctactagatttggtgattaatttacctctgattctgattgattaaatacaagaggtaacattgtggtcatgtgataagttagtgttttctggattatataaatgagtgagactctagtggccatagctaaatgactcattttatgtaacatccactttaagaaacaagcacatactgtgccagtttagattttgatatgcaaagttacatgatgaaggctgttagcacaacaaagatgtattacatttaatactggataactattt

SEQ ID NO: 38991 - DNA, 2549 bp, Bovine  19866880628355
caagaatactggagtgggttgccattcccttctccaggggatcttccccactcagggattgaacccaggtctcctgaattgcaggccagattctttaccatttgagccacagggaagcccaatgaagtggtttggttcagttcagttcagtttagtccctcagttgtgttcgactctctgcgaccccatggattgcagcatgccagacttccctgtccatcaccaactcccagaatttactcaaactcatgtccattgagtcagtgatgtcatccaaccatctcatcctctattgtccccttctcccgccttcaatctttcccagcatcagggtcttttcaaatgagtcaggccttcaccatcaggtgatcagagtatcagagtttcagcttcagcatcagtcctttcaacacatattcgggactgatttcctttaggatggactggctggatctccttgctgtccaagggactctcaagagttttcttcagcaccacagttcaaaagcatcacttcttttggcacttagctttctttatagtccaactctcacatccatacacgaatattgaaaaaaccatagctttgactagatggacctttgttagcaaagtaatatctctgctttctaatatgctgtctaggttggtcataacttttcttccaaggagaaagcgtcttttaatttcatggcttcagttaccaactgcagtgattttggaccccccaaaataaagtctctcatgtttccccatctatttgccatgaaatgatgggaccagatgcccatgatcttagtttttggaatgttgagttttaagccaactttttcactctcctgtttcactttcatcaagaggctcttgatgaaatgaagtggtaaattgctgtaaatagacatactaaggagtttagattttatcccacataatgggaaaccactgaaggattttataaagggatatgatataacagatttgatttttagaacaattacttagtagcaatatggaagatagataagacaggaaaatcaataaggctattatagttattctgacaaagacccatacaggacaatagcagtaggaataaagaagagaaaatagttttaacagatgtttaaaagctagaacttaaaagatctggtgacttatcaggggagatagggagggaagaaaaaagtgtcattttcaaggttcatgacttcagccactgaatggaaattttcttaatggcctttaagtatatgataggctcctgagcatcagatataaaatgacgtattgcctgaaggcaaagagatatgagacgtatcactttactgtatcatcatcctactcaagaacagctgcatactgcctaccacattaagtgaaaaaaaaacattctatgtatgtatgatacacaaatccttcttttttcttgcccctttcattttaatgcccatatcacacccccagggctaacactagatacatgtacaaaaactgtctttttttcttgtttaaagatttttttttttaatgtggaccactttaaaaatctctattgagtttgttacaatattgcttctatttcttgttttggttttttggcaacaaggcacctgtgagcttagcttcctgaccagggactgaaccatacctcctccactggaaggcaaagtcttaaccactggaccacctggaagtccccaaaaactgtcttggaagagatatatcaaaccttctaataagtttctttactaacaaaattcagactggggaagttattcccaatcaagagctcagcaacagagcctttagaataaaatacatctgggtgtctcctctggagattttgactctgcaagatctaagttatctgtaacttagaaaagcttgacaggtgagtttgatgaaagccccagctgaaaatcagttatggagacagataaattttcaattaaaagttaagttttaagaactagcagctaaagttcaggtttgatttcatctctttgtttcctaatattttaccatggaagttgaataaaactaagtaatatgataccatgaaaagaatgtgaaactctgaagctgcagttcaagtctgagtttcttgggttcacaaactctgtgaccttgggcaaaatacttgatctctcctttaagtcttaatttctcaggggaatgaagaaagtataaaggttatataatgaagaggttgtaatagataaattttgtagataacttctaaaataatatagaattacaacacattttctttaaatatttggaaaaagaccacatagtcaaatgaaaaacaaacctgatcaacatatagcccaaatcatacatccatgaaaattaagtacctcaaactgtttcaaacacatttcttaaactttgggcataattattgattgttgattattaataatcttattaataatcattaaaaagctataccagtaaaaaattattgctaacatttaacaagtatgctacattttatattactgaaaaatgaatttgtttgtaactctgtcacttacttttttaag

SEQ ID NO: 38992 - DNA, 1528 bp, Bovine  19866880628356
ggactaaactgaactgaactgaaccaaaccacttcattgggcttccctgtggctcaaatggtaaagaatctggcctgcaattcaggagacctgggttcaatccctgagtggggaagatcccctggagaagggaatggcaacccactccagtattcttgcctgaagaattccatggacagaggtgcctagtaggctacagtccttggggttacagagagtcagaaacagactaagcgactaacccaccccccttcattaccagctgctcaggaaatgtaggttatataccctgtaacttaatgaacagaatatgttcttccataactttgcatgcatgtactgttctctttgcttataataccttttcaaattgatcagccttgcaacttcatatgaatcctctaataaacctcacatgtgacctctcttagacatctcctcgcttccttttcccttcctccttccaccaggttaaccttcctctcattgtgtttatggttattgcctgtatgcatgtctgccaagctcgattagactgtgtggtcactgaggacaggacagtgtatttcattcatctttatattcccagcatctaatacagtgtctgtctggcatattagctttcagtacatttttaaaaaactgatctgatttgaattgaattctttgacataactcagttaaaagtttaggtttggtaactaaattggttgtcagtaactctttaatccattacagatatttaacctattcctattttttataatttttgagtaacttggattttttttaatagtaaaactgttttccgttctctagcacaatgccttacttgtaatcatgagaagtggaatattacagtgattcatgtcctaggcaaagggagttataaataagatggtagaaggtgacatatttgtgtgtttagtgaaacagatgcttcattgccttctgttacattggaattcactgaccagtgcatgaagtagctattgtgtttttctttgtattgaattcatgcttacaatgagaagaaacatcatagattgaaataaattattattttgtgggttttttttttaccatgtttctatgttccttgcaacatgttctaccactgagaagcggtatgatttgagacagattatttaattgctctgggtttcaatttcccattctgtaaaacagatatgaatagtactacctcatagggttgctgtggaagttaaatgaaccaatatatgtaaggtgctttctcatccccatgccactttcctcaccttggccttcattccagccctgaacgtactaagcttgttcctgcctccagcctttatggatactctttcctgtgctgggatcacagccttcatctgacagctcccactcagctcaacattccatatactaggctggcagttccaggagagcacagtgcctgggacagtagttgtataacaaatatgtactgagtgagtgaataatagagctgatatgggacaagagaacaggatcacgggaatagaag

SEQ ID NO: 38993 - DNA, 755 bp, Bovine  19866880635620
atcaaaccagtcaatcttaaaggaaatcaactctgaatattcattggaaggtctgacgctgaagctgaagctccagtactctggccatctgatgtgaagaactgacacattggaaaagaccctgatgctgagaaagattgagggcaggaggagaagcaggcaacagagggtgagacggttggatggcatcactgactcaatggacatgggtttgggaaaactcaaggagatagtgatggacaaagaagcctggcgtgctgtagttcatgggctcgcaaagagtcagacacaacttagcaactgaacaacagcaaacaacaatgacatcagaagagaaggcagtgtaatgaaagaccagggctttgggataaggtctagttttgagtccctgttcttccatctgcggcctgagtggacatagacaagttccttaatttttttcagctggaaatcatagtatatttttgagctatagtgagaactggaaacaaactatgaaaactgtctggcaagtgataggcagttaattcctggaagttattcctattattctagtcatgcccagtaatctacataatctcttggatctatttatggttgcttctgacatttctacttttgccttttttatatcggttatgaatgtacttgtaaaaataaacctggtgtcttccaaatgcaaggggggaaaacccaattaagattacattacataaaattgagtacggaattcaagctgtgagataaagtttaaa

SEQ ID NO: 38994 - DNA, 916 bp, Bovine  19866880666549
ttatacaatttaagaaaaaatcagagcatgctttagtccatgcaggaactgtagttattacaacagcagcaaggcactttcctctataaatcaccagtatcaaatcaaaagtgtcacaaagctcaaaggctgaaaatatatgcagaaatataactttccaaactaagtaaaactttctgtgattcagatgcgacattaagaccctgttgtgtaggccctgttattttggaccagcatatatagatttttaataatgtcaaattattcttcagcagaaacttcccagcttagataataatcctctagaaggcaaccaatcaatgtccttctcattatcatgatcgtcactgtcatcatcacagccgatctgaagtgccaggtggtactgtgcgcctcctctcaggtaacctcacgacaaccaggggcggggatactatttctattttcctgcgaaactgaggctcggagagatgaagtcatttgccagaggcctcttaactagtgagtagcagagttggggtttcaaccctgtctgactccagagctattattctgttgttccaaaatcatgtctaccttttatgaccagactcaagcgattaaacaaagctaaagccaaaaaataaatctgtaacttccaaaaggcaactccagagaaggactggccttttcttacatgatcaccttacttattcttgacaaatcttaaattgctgtataatccctagttttaaagaaacttcaaaggatcaactctctcatccttctatcaggaacaaggctgtgctaaccttcctccactgtgctaacctgacctctggtccacatagctatagaagctgtttaaaaagtttcataatcttgctgggaacctttggtgtcctcatttactgtctaaatagggaaaaagtatcag

SEQ ID NO: 38995 - DNA, 1378 bp, Bovine  19866880675201
atggtaaaaactcattcataaataaatgatgaattgaattgttaatctcattaattctttccagattaacataaacctttatgagagcttatagttaaggctctaagataggtgtggtccacattcatcctgtgtgcattagcaggataatttggctttaagatgctttcttccccgtgaccacaaatatgacccagaagcagggactttcaagctggaattctaatgctcttcctgattatggaatgggcttaggtgggggaaaaaatttatagatcctaaataaaggcaaagaactatctggagaaatttagactttgatcagatctttccaattcatttcctttcagctttgcccatcagctggatcttccttactaaaactagtggttgaaaatccctgaggagggaatatcaaaacttcaacaagttcagacagatttaagttcaaacaaaattctctacaccatttgagatttttccctttttctccttaccatccggttccctcatttaaaataaataaatttatattaaaaaaataaaataaaaggtttgggttttcccccttttcttgttcagttcagtttagtcactcaatcatatctgacactttgcgaccccatgaaccgcagcatgccaggcttccttgtccattaccaactcccagagcctactcaaactcacgtccattgagttggtgatgccgtccaaccatctcatcctctgtcgtccccttctcctcccaccttcaatctttcccagcatcagggtcttttcaaatgagtcagctcttcgcactaggtggccaaagcgttgggagtttcagcttcagcatcagtccttccaatgaatattcaggactgatttcctttaagatggactgataggatcttcttgcagtcgaagagactctcaagagtcttctccagcaccacagttcaaaagcatcaattctttggcactcagtttttttatagtccaactttcatatccatacatgaccactggaaaaaccatagctttgacttggtgacctttgttggcaaagtccttttcttgtagaacggtgtatttgctgaatacactgatttctgccctttggtttctattccttgacttccaattcttatctctctattctaaccccaacctcaaggtttgttgttatgtctgagcagtccttagataccatggttacccaaagggtcaaactgactccccaaaactgaacattgctgattcatgggatgccatggggattacactgcagctgaaatagctgtcctaacaaagatcctcagataacagcaactgtgaaaaagaccagctcctgttacaaatcaattagctaccctttatttaaaagatattcagt

SEQ ID NO: 38996 - DNA, 820 bp, Bovine  19866880724317
ctacctctgaatgtcaggccacttctctataccactaagaagcaagacataaaacctaactgatatggctggttcatgctgatatatgatagaaaccaatataatattgtaaaacaattatcattcaattaaaaataaattaaaaaaaaaaaaactaattgatactgacaccttccaatgctttgaaactaggataaggagagagagaggatatctgccatttgcttttctttgtattttgacctaatttagaaacaaccaaagtataattctagaaataaaataatcatttagcaaaaacataccaacagccttgctttacctcaaatgatctaatttataaattcatatacaataaatactgcttttacaaacttctatgctagcactgaaattgtgcttatttacaaaaatgccctgatacattaaatttctacatttaataatcttgattttaaaatataagatttctatactttgattttgcagaaagctatttaagcattaatcactggcaaattatactttgtttccttctaacatcttccctgagttttacatgcacaaatatattaaaaataacaataatttaactcagctacacaagcctctccttgaacacaaagatcacatcaataggaggctagtgtgaggatattaaaaaatgaatgagacagcttctctgaccttaagaggttaatatcaggcctgccaggggacttggaggacaataaagcaacacatgtgatgatacactgaactattctttaccttgtctgtcttgatggtaagcacatctgtgctcttgcagtatcgatct

SEQ ID NO: 38997 - DNA, 1683 bp, Bovine  19866880743247
tttcagaattttccactgtttattgtgatccacacatagttagcatgttaactagacttattgtggtgatcatttcacaatatatacacagcaaaccactccagatattcttggagaatcacatggacagaggagcctgacaggctaacatgccatacagttacaaagagtcagacacaactgaagtgacttagcactcatgcacacacaaatattaaatcatgttgtccatcgtaaaataatgtcaatttaatgtcaataggacttctctcatggctcatatggtaaagaatctgcttgccatgtcagaattgttgttcatttgctaagttgtgtctctgactctttgtgacctcatggactgcagcacgccaggcttccctgtccttcactgtctctgggagtttgctcaaactcaagtccattgagtcggtgatgcaatatggaagacctggattcagtccctgggttgggaagatcctctggagaagggaatggctacccactccagtactcttgcctggagaattccacggagaggagtctggcgggctacagtccatgggcttgcaaagagttgaacacaactgagcgactaatacacactatgaaaagattaaaaatggtcaacattaagaggtacaaactactatgtataaaataaataatctgaaaggatatattgtacagcacaggcaggatagccaatgttttataacaagtttaagtgcagtataatctataaaaatattgaatcactatattgtatgcctgaaatgatataacattgcaaatcacttatcggttcagttcagtcactcagtcgtgtccaactctttgagaccccatgaatcgcagcaggccagttctccctgtccatcaccaactcccggagttcactcagactcacgtccatcgagtcggtgatgccatccagccatctcatcctctgtcgtccccttccacgtttaaggtcgggaggggcggtggtgaggagatacccctcgtccaaggtaaggagcaaatcaactatacttcaattttaaaaaaaaaagaaagttaaaaaaaggtcaacactgtgtttacagcataaaacctatttgatgtaggttttaaaggctctctcttgctgtaatattttttaatcatttctgacattattgcctagacctcatgtgactgcacattttgagaggagaaaagaaaaataacactttcaatatttgcctacttagcctcccattactggtcatcttcacactcatccaaagtgcttcctcagaaagctcctaaagaaaaaaataaagacttcaataaagtataaaatgtatttaaataaactcttaattttaaaatagttttagatttacagaaaagttgcagacagtacagaggatttccttagattctgtgcctagttgccctgttgttgagatcttatatatgattcctttgtcacaactcatgaacagatgctttaactggattttaagacatttttttaaaagaaatttttccactagaaatagcgtattaaactctgggggaaattatttcacactaacatgtatggatttttacctcaattgttcattttatccaatgcattttactactaatttagaatatctcagggacagtgaaccagaggacagaacacgcatctggagaaatgtgttcatg

SEQ ID NO: 38998 - DNA, 1681 bp, Bovine  19866880801883
tttagctggtttagtttcagacttggctgttagcaaatgaatgtaaaatatcatttatcttagtgcaagtcatccatatattcatcctgattttccagaaaaagaagctgaacatgcaagggagagtgagaaaaaagtattgactctaaggaagggataagacagacgctcaaataacttctgtttgttgtttcaatgaacatgcaagtggggccttacaagacagagatggctaaagtgaatgtggcctggaagcagcagactgaatttagcaaagcccaaaagtaagttgatcattggggagatgactcagcaaattttaagcctcacagttataacaaagataagaagtgattttggggggggacttctctggtggtccagtggctaagactctgctctccagtgcaggggccccgggttcaatccctgattggagaagtagatcccacatgccacgactgagagtttgcgtgctgcaactacagatcccacatgccatggcaaagatcgaagaccccatgtgctgcaactaagacccggtgtagccaaataaataaacatgtatttcaaaaagtgatttgtttttttcttgctggacttaaaaagacaatgacattgaaagagggtttggtcaatcttgtcagctaatggcccaaaagagaggagttaatgcctgtgggttataaccagctggaacaaagtaccttgccctgctgctgctgctacgtcactttagtcgtgtccgactctgtgcgaccccatagacggcagcccaccaggcttcccgtccctgggattctccaggcaagaacactggagtgggttgccatttccttctccaatgcatgaaagtggaaagtgaaagtgaagtcgctcagtcgtgtccgactctagcaaccccatggactgcagcctaccaggcttctccgtccatgggattttctaggcaaaagtactggagtggggtgccattgccttgccctaggaactaacaaatacctaagcatggtatttgttcttttctgatggtagcctcaacaattccatgataataggatgaagcctgaaaacttctggattaaaaacaaattcaaatgaaatttcaccccaacagttttgtgtttgtatgtttaacatgccccaactcagttcaatggatattttttgagcacctccagttttttattttttactaaccctagtgtgaatatcaatgcttctagaatatttataagaatgaatttattgtgaaacatagcaagctggtcattaatccctttaaagtacaatttaatgcaatgcctcatgacaggaagtgagaaggataataaaaacctttactacctaaaaccacgtttaatatttttatggcctagttggcctgacaaaatattctctgtgagtcatcacttcaaagtgaggtcctggggacttattaaagatacaacagcatgcttcatgtccattgtataaggcccctcaaatttgaactgcttaggcaagagcatttaagttaagagggaccctgcagaatgtctttgtgtaccccatgaactaggagaccgtgggcccaggtgcccttcttttaaatcttaaattcagattccccccaacttagccttgtatcattttacatttacttaacatgggccaatttcaactactagagcagtcatta

SEQ ID NO: 38999 - DNA, 1467 bp, Bovine  19866880809379
aataggatttctaattcttgaggaattaagaatatctcactctgtcatccgaaggaagaagttctccttaagacaatatgcctgttttctagtttctttcacctatagacagccatgatacaacatttcaatgtactgtttatattctacattgactcaagagttatactaaagctcatagggaataaaagaaagagtattgtgaatacagtattactaaatccaacatggtgcagtttgttattattttgtttttattttgtagaatatggggcagtccaacagaggtgttttgcaggtgtctggcgacaagccagtgagctcaaatggaagatggatgggttagtttgcttttcagaccccaaagcaaggtggacttggcaaagagtaggagtcaccattaaaacaatccattttttcagagatgacgcattgtgtcatttgttagtgtcttccagtttggaggaaaatgtaaagaaattctctggaagatgttttgaagcttaattagaaagcagtttgaaaacatgtcccttgtgctttgccctggtaaacgtgcgtgtatcagaacttacacagagatgtgaatgttttcatcctgacgctgtgtagctctagttgggaactgtgtccattaatcttctgacagcacagcagtgggcctctttgtgcacgactgggccctgtgggtaacttctgtgcagtgtattcatgggacaaatacctgatattttcaattctcctcccttcctctgggaggttgctgcatactcaacacaaacccttgcttcttgtactttcaaggctggaaattttcctattaaggcagaagctgaaaaacaaagcacactctggtaaatagttgataacttggagcagttagtcattctctgagcttcttgctattgaaatgagagaatggcgtggcacaggaacctgaaatactcaaaactttgatttgcctcctgcctccagcagacttttttgcttagctctgctttttagtctatttatcctgaaactgaaagaacttttaaattctgttcaaggaatgtttctttagcacctgctgtgtgctaaggcagtgtactaatgtactatatcattgtatactgactaagacaaggttcctgtcctcaagaagttcacaaaatgattagtgaagtaacactggcaactttgaaggaatagtgcttctcttaaaggattgactcaggacacataataatataattcacagaagtaatattttcagcctttggaatcttcatagctactgatgtttaatacctcctctgagttgttcagttgagtccttacaaggaatttagcacgtggtcatgttttgctaactgtataatagaatctttgatagtagtcttactcttaacaccttctgggttattaaataaaaggaagtggccaacatttgtgctggaatgtcttttaaccttgtttaaggaagaa

SEQ ID NO: 39000 - DNA, 1788 bp, Bovine  19866880829873
ttttgcagtcatgaggcccacagtcacatctgggggagacgtttggattaggttactcatctttcaggggagctcccagtccatgtggagagttcacagtgtggtggcagctctgtgcagcctctgtgtagctctgtgtagccccacagtagagctgcccttcagaacactgaacgccagggcagccccggaccacaatggtgcctaccagctctgtccctggagtccatgtctgacactaagtcactgctttctattttaggactacggatctgtggatcaaataactgcctgcttttcagatgaccaaagaatgacattttaaccccaaactttctggaaaccaaagtattgtgactaaaggcttcttgaaggctattagtacctcattacagaagttagtcaaccactaaacaatacaaaggggcttcccaggtggtgtgagtcgaaaagaacccaccgggcggagacataaagagatgcgggtttgatccccaggttgggaagattccctggagaggggcatggcagcccactccagtgttctttcctggaggatccccccatgggcagaggagcctgatgggttacagtccatggagtcacagtctggacacacacacaagcgatacagatttagtttggggctctacctctacctataattatttccttataaaattatgctccaaagtgagtttctctaaaccatatatactgtaatggggtcctgtatgctccttgtccaagataatttagcatgatggcaaacctaagtgcacaaatattcaggtctctggaatttgccataggtattctataacggatgaaacaaggtttctaaaatataacaatgaacgttttttgaagctaaaaatatctttttttttctatttatgaaagaaatatctgtcttgtaaaaaatgtgaaaatatctaaaagtatatagtgtcaatcaaaagtgacctcatcactctaaaatccagttttcactgtagggtaacggactggagtcagactgcctgcattaaattctggttctgctgcttaagaactggaagacctctcagggtggtgttggtgtccttttctataaacagagaccatgaaagcatgtgagaattataactagtgttgattaagtactttacagagtgtaggtattattccaactacttaaaacatattaacgaattttaataaagtagttgattgatacgagttaaagcacttagaatagtgcctgagatttagtcaagggctcattaaatgctaactgttgttatggccttccaaaactttaatgtccatataaacacacacacacacacagtttcaataaaatgcatttatataaaatgttctgtaactggctttttccctgactaatttgcagacatccttcagtgttaattccaacagatccactttatcctttttaagcaacaaatagtaataatatttactaacatataataacatattatactaacatataatgaattgttttgtactagacactgtgctttgtgtatcatctcacttaatcttctgctgctgcttagtcgctcagtcctgtaggactctttgggactccatggactgtagcccaccaggctcctccgtccgtgggatttcccaggcaagaatactagagtgggttgtcctttccttctctaggggatcttcccaactcagggatcaaacctgcatctcctgcttggcagatggattctttaccactgagccaccgagaagccccactaatcctcacaagacccctaaaat

SEQ ID NO: 39001 - DNA, 725 bp, Bovine  19866880836590
taaaaaaaaaaaccaccagatagaaatccaacagttcttcaagctactcctacaaatgccaaaactgtgcagcaagcaggtaaggcagtaaacggagaaagcggcctcattttaaacttagggttatgaaaacaataggcttcttgatgtgaaaacaaaaacttctcatgtcccatttatcaaaacgtagtttggaaattcactaatcaaaacattttccatcagaggatttaaactcacacaccaaaattatctctagttaagcaagcaggaagtttaccaggaaccccctaaaaattaataattgtttttacagctttgataaatccatgccagctcatgttagtacacggtgtggcacacacaatctccagtgagtctgtcacttctaaacaggaaagcatgaaatccttagcataaggcaagaatcacagatgttctgaagtgaggcgttttagggtttgccccccacccacaaaagctggtttctcagtctttgagatggttttcttagagtgacagttaattatgccaaactcatcatattcatcatcttgtttcatcttcaggaacctacaaggaagggtgtctcatcctcagccctactgatgtttggggccgggtatttctctgttgctgatgcggggagaagcacccgtgcattgcaaggatgtttagcatcatctctggattttacttactaaaagccagtcttgcctccaccc

SEQ ID NO: 39002 - DNA, 954 bp, Bovine  19866880858325
tcagatgtctttctctttcattaccctctctctctctttcttgttcatgtgagttgagtgccagtgagagaagccagatggaaactgaagctctctgtttatgactgaaccaggtacaccacaaacagcagtgtaaatgttccagcccgctgcctcccacacacccagactgcccccaagccccacctggaaggaccagtttcaagcagagagatgatggttccatttctatgcttattgagcctggtaatatttgcttaagaacaacatttgaatagagactcctcagaaaactcacatttccatatttactgggggatttttgtttattaccaatgaggttcagaaaccatattctgtatacttgctaagtgaaaatgagcagcctacaaaaaagcaggccaggaaacataatattagtaatcatttgtgagcatttattatacatctggacctgtgctgggcacatcaggtccataaagatgaatggacatgagatgaattcatcgggcccatttcacagatgagagactgaggtgtaaaaaagtggaggaaccgatcccactgaagacgactgcctctggggaggaagatagaggtgaggtggaaggaatcttgtactctttcctactcctagaaattatctaccacttttattatttgatgcattttaagtgacaatccctgggttgggaagatcccctggaggaggcagtggtaacccaactccagtattcttgcctgggaaatcccatggaaagtggatcctggtaggctatagtccatgcggtcgcaaagagtcagacatgactgagtatgctgggtgcaggggcgggggggttaaaaaaaaaaacaacatttgcttaaactcacagagctgggaggctactcaggaaatccagagccagtttatcaggccccctggcacacaggctcttcgtcactctgctggat

SEQ ID NO: 39003 - DNA, 686 bp, Bovine  19866880862394
ctggggggtccctggttcacggtgcttacctttcctgctgccactggtccttaaaatctgaccgtgatgccctctctgtgtgtgcaaatttggggaaccaaaggaaataaagcttgtaaataagcactaaattttactagcccacaatttgtttttgttccccaaaggtacacagatagtaaattttgtaagatcaaaacagtgtttgatattcctccagcataatcatttgtcctgtgcaatatgtaagggacttctttctgaggctgaatgaacaggcagctaaaagtaaacaactccatctctccagaccccaatatgctcaaattcacttgaaaagagaaacagttttcaatattgaatttatgatgaaattgccacccaaacacaggccacttgatgaagaggcagacggccaaggattatgaacccaggcttgtatggggaagtctcagctcccctgctaaacagctctgtgaccttgaacaaggcattgaatctcagctgatgcgagtctcagtttccccacttgtgaaggggggaaaagaaaagcatgttgttaagagttaagaagggtaatctacagaaagagatcactgcctgcatgtccctgcctatgtttcttaacctcaggaggattagtttctcgtcgggcaactgcagccgtcacggctgcaaagtacaaa

SEQ ID NO: 39004 - DNA, 1055 bp, Bovine  19866880876463
attacttggaaataatttgtattacattttttaaagtttcatatttaggagctacttcccagattttctagcttgagttatcatggaaagatagggcttctttcagattaaaaatttatgttcatacttacagtattacctcaagggataattgggtagttcttttttaatagaaaaatgacctcaatttataattctgttttcttcatttgtttcttctttataaattgccactatttctaaaggaagtggtaaaatacaacaatccaaatagaattcaaagctgaggaattccagcaatcaacaattcaacaacagaatagaaacaatccaaatagaattccaatccaaatagaattccttttaacaataagtgggaaaatatatctgtggaagaccagattgattaaagattactaagaactcatattatgcaagagtgcttaataaatggtagataaatgaataggagaaactggacttttccctcttacttgaattatgaacttacagataaactaaatcacaacttaatcacaattaaaatgttattaaatgatgtcaaacatttatgtcattcataaacagaaaatagcttcttattgaaacactgtattaacagttataatattcaaaagtattatgtaatactaggtaatactttgccccgttgtacaagaaactacaatttaaaaacctgtaggttaagtatatttcactagagcatcctttacctggcctctgtgaggttgaatcattacactttaatatcattgttctgtttgttttttatagcattcttgtgtaattcttttctgttacctgggaatctgtggctcaggaataaatatcttgagaggaacaaaaacacgttaaccattggtggaagcttcataccttgttgttagagaagaggcgtcttcacagactatttgagcccttcttctggatgacttagtattgttttgcattctgatttctttttcctactctctggcctgtggacaaaaatatgtcactattgctcagaatatttagactatgtttacaaacaa

SEQ ID NO: 39005 - DNA, 1124 bp, Bovine  19866880897043
agtgggacacgactgagcgactaagcacagcacagtacagtaggggctagttaagtaattgtggtacatgcatttatggactgctttacagcccttaaaaagaatgatgtagacctcccctgatggaccaatggtttagaatccacctgccaatgcagaggacatggggtcgatccttggtccaggaagatcctgcctgctgcagggcatcacaacgagagagtagcctccatttgctgcaactagagacagttcaagcacactaatgaagacccagggcagctaaaaataaataaataagaatgatgtgaatctatatcaacacagaaagatgacttcaatgattgaatctttaaggaccgtgccattcagtcatatcaactattatccttccttatcagcagagtttttgataaattactccttattaaattgacacttggttcatagctttgcaaatgactatcatccaaggagacttaaatatctgcatgaataacccatcatccaatgagacttaaatatctgcatgaataacccataccctttccagtctcaggaattcttgaatttctcatttacaataaaatacaatagatgttactgtgtcatcaactggtttcttggccacagatgaggcacaaattgcctcatctctaaaattactaaatcaggcgtacttctctctgaccacatcctcttatcctctcaactagcctgctcaattttcatgataacatttgtttttattttgcttcagatcttctagtccacccctctattcattgaagacttaatgatcaacaatttcaagcattctcttgccaatattttaaattccttcacctcattattcactgtgcacctgttgcaaaatcgcttaccctctgtgattaaattatcttttcttgttgtttttttcataccctggctaccaagcaatactagagtgtcacctcctgaaagacaggtaccactattcactattgttcactaatttcaactgggcccttgcttgagttctgttcccacaaaggtagagcctgaatcacagatctggatgcaaatggtttattttgagatattcccaagtagaggaatgaagagaggagaaagaagaggag

SEQ ID NO: 39006 - DNA, 606 bp, Bovine  19866880943693
tgatcggtggtcgcatttggcgatcgcggggagtgtagaccgtgaaacacatggcatctctccagcatgtagaaagcaacctctccagtggctcccgcggagctcgcaagcggctccgcgcaggccgagggaagccagtgagctgtccatggtggttaaggcgccttgacgtgcgtcctgggcggtcccggcgaggcgcagacccccgcgccgggggccgccacttctccggccccagcctgccggccacccagccggtgtgagccgggcaccggctgcacgtgttcctttgcaccgctctgggacgcaaacggggcagaattccagatataggcggaaaataaactctcgagtccaaattgtgggtttccttttagctccttcctgaagatgtctttccccctcagccgacacttcttgggcttaaagaaatgtcggtgcagccagcagtttacctcccttccctacactaaggttctgttctcaaaagagcgagaagcagtcactgctcttatgatgcttctcatatttgttaaaagaatctaggaactggccatcgcttttggatccgtgtggtatctctagggtgacgcacgacgcttctat

SEQ ID NO: 39007 - DNA, 783 bp, Bovine  19866880954876
attataaaatgctatggaaaaatgcacatatttgatgtatgtcgtttcccagttttcagcagtatgataataatttttcattaggaagatatactttttcaaagacttgtccaaaaacatatcaggttgccttttggtgaaataaccaaaaatttattaaacagaaatataaaggcatgtagtactcctgtgcctctgaccaatatatcttactcaggttgggtagagttcagctgtgttgtctaactcaatgaatggacttctttgtgaaaggtcatctgcccaatgcatgcagccatgttaactaaaagcactaaccatcttacttctgtccatttgaagcactctagcatacatagctctaagagtagataagatattccatgctgtaagactctaacaggatagaaacttccttctattcctaactgctttaaaaattctgactttcaaaaaaaaaaaaaaattctgaccttcaaaaaaagaagaaatcctggacaaaagtaaattcaacatcacatcaggcttgaatgttggattcagttcagttcagttcagttcagtcgctcagtcgtgtctgactctttgcgaccccctgaatcgcagcatgccaggcctccctgtccatcaccaactcccgaagttcactcagactcacgtccatcgagtcagtgatgccatccagccatctcatcctctgtcgtccccttctcctcctgcccccaatccctcccagcatcagagtcttttccaatgagtcaactcttcacatgaggtggccaa

SEQ ID NO: 39008 - DNA, 937 bp, Bovine  19866880976513
ggtgcattgggatccttgaacttcttttttgtttcccctttaggaggaatataagttttcatttctctttcataacgggccttgtccgcctttgccatgtcttcaaattttcctttctctttagcagacatggtctgtaaaaaaaaaaaaattgtaaacttaaataagttaacaaaattttaaccaattgtgaagtatggaaatgaataaaatgcagtatcctttgctaaatatttagtaacctgttccgacatcaacacccacatttgcaaattgtaccgaagctttaaaaaaaaaaaaaaaatcgcaatttggaattcagcctttattgcctactcagtaggttttcagccctcttaccttccacctctctgagcacttcttagaaaactctgagaagttgacagaagcatccgggtgcttcttcttgtgctcctcccggcaagtttgcacaaagaatgcatatgatgacattttgcctctcggcttcttaggatctcctttgcccatgtttaattatttttctaaaaaataaaaaaacacaattttaatgttaacaatgacatttatggcaccgaagagcacttgaacttcttggggagtcaatgaacagcatggcactggttattaaacacggccttggcaacaacccctcacaatatcaaagaaaatgtcagggatggacaattcctagaagagtctgcaccaacccaataaatggtccttcagtgggatctcaaagaaagtgtagacacaatggtacactcataccgtatttgtgaattatctccctgcatctgttttgaatgtaatacctaagtggtcattaaaattttttttttcatgtaagaaatcattattaatcaacaaacccaaaggtcagaaaaggaatgctgcagattcatgcagctacgtaaggagtaggtaagagccaaag

SEQ ID NO: 39009 - DNA, 1451 bp, Bovine  19866881092008
tggctagaaatatcatcagctggatgaccgagtccattggtcgcattttctactttctcctatagctccaggtgacggtgttgttaaactctctgccacttcataacaaggatatcctttcctctagtttccagtgtgattttcctcaatttcctttaaatcctcactatcagtttcctcaaagtccaaaattatataaataatgtattcaaggcactttaaaatttcactaatactctcctcaaaatccttacagcttttacactttctactcattacttggttccaaagctgttttcacattttgagtttttgctacaagtactctacttctaggtaacaaaatctttacaagaattattccagatgaacagattattcctaattccagactgggatatgaaaactcatggttatgactagctcaaggtcacacagccagtatgtggatgaattatgactcaaatttaagaataatcaaagtgtatcagccttcctcacccctcacacacaataccacactctctctagaggaaagaaaggcaagcagaatttataaataatttggaattgctgtagtcttgacaggaacttcaaattatacagttctaggtggccctgttttaactgtattctattgttttttactgttcggtacagagaccctgagtccctagatggtcccattttataagtgaggaacctgagaattatttgaattaagatttaaacaagggccagttgacttcaaaatgccatattttctaagtgtccaaccatgcacatcacgccatactcgttcatgtttgaatgatgttgaaggcgttatgttcacaaaggagggacagaatgggactaactatatgctcctacatctatgtacttggggttcccaaccgcaagaaatgggagatagtgggtttcccataggaatattgccgtgattgaatgaggcaatgcatgtaaagcttagcagtacctggcctactgtaagctttcaatgcctgggtgctcagttgtgtccgacttttttgtgaccccatagactgtagcctgccgggctccagtgtccgtgggattcttcaggcaagagtactgcagtgagtctccatttcctcttccagaagctttacatgagcatcctcatatggtcagtactcaagaggttgtgttctagcccttgtatgcctggtcacctcaacttctcaaggccctgcttcaggtctgcttcaaaacaaaggtagaaatgacccattcaggatgctactacaacttgatgaggaaaaatggaatgaattacatgaccagcactgagatccatagcagaaagttattccagaagtctggccttctgtaccaccatctccaagggtgtgaaagaacctcattctgagtccgtaatgccccgtttggctccagcctggagccggcgcttcattaaaaactgtgag

SEQ ID NO: 39010 - DNA, 1718 bp, Bovine  19866881147997
atgagaactgatgagaacagttttcatcagttggaaataaggaatggtggtgctgggagccaggaaacagagaggaaggtgagatagccagtttttgaataaggtactttacttgaagggggtgcacttgaaaagatttcttggagaattttattaaagaaaggtatatctacccagagaacagttttctgcttaataatttatcagggctctggctcctaatcctgtgaacagctactgtcactttgaaccatgtcagtgtttcataaagtcttattttaaaaaaaaaagaataaatggagaaaaagcaaaactgagatctggccatgttgccagaggtagaaaaatatttgttgatgttgaaagaatatgatgaaacaattgacagaatttatgacgatggaatcctaataatcagaagctccttgtaagtaattctcatttgctattggatgaattaggttttctctagtacttcaaggaaataacagttgtttttaataaatagctattctaataaaaatttaaagacacataagccaaaatgtcatccaagtagatagagaaaaaaggtataaggtatatgatgatcactacatctcggagcagaacagatgagaaaaacctaatattcatgaatctattctatcttgacatcactgtttgcttcagctgatggtctgcatatgtgaccttccccacccaccacacaccctctcaatggttcattgtacctgaaggacttaatttttacttgttgttcaccatcttccattcttcaaaaaagcaagataaagtgtcaaactacaagaaacagatcttcagtaattcttgagaaataaatgtgagattaagttcaatcatcctaattcctattaagtctttagttatacatgctacctgagctcctaattgaaatgattagtattgtctgggtgagctgctcttgtaccaaagctgacaggtacctcatctccatcaggtaacaataactatgtgaagcaacagtgaataataattgctgctctgtttagaaatcatgccatgccaatcttgaaaaggagtgcattcatagaaataacattaaataaaatagcaatttttaaaacaatggatggcttagccaaaaatgttgtaatagctctattacatagactgaaaatttattaaaactataagacctttaattttgtctgaaaattcatctagacaataagaaataattttgaaaactggaaactgattacttgccaatcatattaattttcacattaatatatgccttagcagaaaattctaaatgtatatatgtgtgtatataaatatttgtatatatatacttacatacaggtacatatatggcagtgtatttattcattcagaatgtagtcaccagaccactaccaaagtgatggtgataaaatactttccacattaaaaaatcatgcaggctgagtagtttttattcaaatatgtgttttaaaatatatattcccaagtatattaatttttgaaagggcacttaaaaaattcacggtaaagcttccataatctcatctggaaataattacaatcaacattttagtgggtctcccctacacgtctttcgtagtgatgcatctgtgtgcgtgcttagttgctcagtcgtgtctgattctttgtgaccccatggactgtagcctgccaggttcttctgtccatgagattctccaggcaag

SEQ ID NO: 39011 - DNA, 1793 bp, Bovine  19866881150901
ctgcacatgtgcatttatcatcgactttctggaaagttcagaagaggaatctctagctgtggcttttcattgtgactcacatctgcaaaggatgaataaagaagagttttttgaccaagaggtgcagtcctgctgagagagaaataattgctgtttggagagaaactctcaaagaaccagaagtttaaaaaaaaccagaaaagaggacttccctggtggcacagtggataagaatctgcctgtcagtgcagggacacaggttcaatccctggtccgggagaattccacttaccgaggagcaactaagcctgtgtgccacaactgctaagcccaaactctggggctcatgtgccacaaatactgaagctaatgtacctagagcctgtgctctgcaacaagagaagccaccgcagtgagaagcctgcacaccgcaatgaagagtagcccctgctcgccacaactggagaaagctcacatgtagcaacaaagacccagtgcaaccaaaagtaataataaataaaacttagagaaaagaaaaagctagaggaagcctattgaagaaaggaagaaccagaggtgagctgcagggtgctgcttggagctatgggaaataaatctcgaacaagtgaaatggaaaaagtcaaatgtaaaacattgcctgttagggctggctagagtccagggcagaggcagcaccactgggcttggaaacccactgaaactcattccacacagaactgccccacccacatctactccatctgcctccatccacctggagcaggaggtctgacatgttcctgggaagaatactcttgggttgtttggaaagtgagacctttcggagagtcttgcctccttctgcagccaatgttcataatttcctccagagaaggcgtggtggttaaggacacaggcctggggaccaggcagatttcagtcccttattaagttgtgacttaaacactgggcctcagaaagcaggaatgctgatgaagtcagttatgtttcatagagttattgtgaagagttaagtggagcttaatgaagtaagtgctccaaactgtgtaactgttactactgaaagaattataactggatttggaaaaagcaccttcctgaactctgtccctaccatacgaactttgaacctgcccttggcatctgcagggatttaaacactagcagaggccctgttgtggagctggacagtaatccgaggccctgggcgggttgttgaaagcacctgcatgtccttgcacagggctctgggtgtccatccatggcccctcctgagggctcttgttcttaaagcccctgaccttttctgtaggcagttctggcagggacatccaaacacattagtttggaatgggtctgggtcctatttttaaattttcatggataatgggttgttccattaaatatatgtgaatattgattcacctcctaagcatttcctatgtacaggtcactgaacccataaaggtgcagagcaaaatgtatgtcagggctgcctgttgtatgttaggaggttgcatgattgtgttatttgtgccttactgcaaccctaagagaggaaggtaatatcaatagttttacagagattaaatagtttgcttaagattggagataatgcccgctttcactgcatgtaaggcacatttcagtttcagtgaggttaaaatgaggaaaagtatatctttttaattaatgaaatgtagttaatagcagagtctggatgctaccccattcctgtcgatttcacatccttgggatttccccccgccccc

SEQ ID NO: 39012 - DNA, 647 bp, Bovine  19866881226570
tttttttttgtcttttcagaaaactgaagagtgggagaaaaagaagactgaagcagatatggaagagtatgtatggaaagatagcgcctcagaaaaaaacattctggaaacccttttccaaattaaagctgctgagaaaaatacagaattaagtaaagaagagctccttagtactaaagaagttgaagattacaaaaattctgttgttagtcttaagaatgagggggacaatgagaataccatttctcagtacaaagaatcagtgaagagactattacatttgacgtgaattatacagaaaaatttccttgatttactaattttatgatacatatgtaatcattaatttgatataaaattgaaaatgttttttttttaaaaagccattgttttactacattagagttaaaattattcctttcattctaagatacaagggcaatgattattcaaaggttttcttatatactagggcagtcagactaatttgattctgatttcttctggtcctaaagtgtttgaattttatttctaccataaccctttagtgtgtatatgtatatatatacacacacacacacacacaatatattgttcttttgtcacctgctctatttctttctctacaaatcagtacttactggttg

SEQ ID NO: 39013 - DNA, 823 bp, Bovine  19866881229545
taagacaaacattaggccattctttgataaattaatactcctccgctattactgatgaagccaaaacctcagagagtcatttttaaatgaaaatgttgagctggaaaagactatcgcattcttgggggatttgctgctgacatcacctcccccatcctctaatcacaagccccctggcctgcatttatttccttaattccgtttacagtaaccacagtgatggagctaaacatgaacagtagtgcccttgaatgagctagcctccatcaaagatctgaagacagcattcccgcaggacagtaaaatcccccacagttgcgaacatccactctgttcaggatctttggtacatttggagtataagaaaataatggcacaataatacaagtactatcaaaggaaaatttttcatcaaaacaaataaaagttaaccagccatgatatgtaacaactttctagaaaaccaaagtaaatagctctttgttctctacaagttcatttacatgatcagaagtttgacgtttaaaaaaatagtttcataaaaatacactagtagttctacaagcagccttcatggtcatttcttcaattcaactcaccataatcaaattaaaataatgccatgtcctcttattaaaaaagaagtcctcttgtcacaagaaaagcaactttacattttatatgatacagtacatctccctatgagtatacagaatacatgtataaaggtcatcagtatttctgaatgcaaagtaaatatattagtggagtgcttgagtgaagctgttcaacttcctccttattcaaaactcgttactcccta

SEQ ID NO: 39014 - DNA, 1366 bp, Bovine  19866881281579
tagctgaagaacaggaaatgttctaaaaattttttaacagtcacttcccatttttctgaagctctcttctctcttgttttgttttgtttgtaattttatgaactagaaaacattttgagagacatgaaagagtgagtaaaacaaaccactcactctcaaagagccctaggtcatacattaactgattcaggaatttcagctaaccactagtgcacatgttcacctcaaaaatacccaaattagagtggctgctactactaaagagtgctgttttcatttccttttgaagggagtgtctacctcataagactagaaccaattttcatttccttagctatataaggacttgatagaaaaaccagagttagagtacataacttttcagttaattccagtgaaatattgaagttgatttgtttttgccaatgttattttaccattctttgactatcacccttcccccacccacttcctttcacagctgcctatgggcctgcctttttaatctggctctgaaactttctgacctagtccagtcacataatttctttctaaaatactcttccttgactccctgacttgaagctgacaatttactcctgaataatttaactcctttctcggaactgcctcccttaagatttctcctcaccttttcttctgaggatgggaagagagtaaacacgttagaggttcgctgtgtaattggctaagaaataacatggacctgacagcaaggacttttcctcagtcagatgtaatataaccttgtttgatctgtattcatcacagtatccacctttagtgtgaactagtgtggtggtttgactaggatactctcctttgatcaggaggtgatggaggtaggaaaagaagagacacaatcgattcatacagtaattctacctagactgctttatagcaataccaactgtacttcaattcagaattccatattttacaagtatatttggcaatactgtactgggagataacttggaaatatgcatcaaactattagaatacctacattaaccaaaagtcttggttgcctaaggacaaaaaagtgaaatgtgcaagtattagttgctcagtcatgtctgactctttgtgatcgcatggactgtagccctccaggctcctctacccatggaattctccaggcaagaatattggagtccatagccattctcttctccaagggatcttcccaattcagggcctgaacctgggtctcctgcattgcaggcagattctttaccatctgagccaccagggaaacaaaccagctccaattattttaagcaaaaaggagaagttattaggtcaaataacgaaaaaggctatagtttttccagtagtcatg

SEQ ID NO: 39015 - DNA, 814 bp, Bovine  19866881305254
cagcagagagaaatggggcattctttcagtttatcacaagatcttccagatttactgaccatctaatacacatttgtctttcaaatagcagcaacatccttttatgcaagaagtaaaagatcttggcttattgtaatgaacttttgaaatcatctgccttcttgttatcattcctaaatattggtagcaaagagccaaaacattcgtttccttttattttgtcctgttttcgttgctgctttgtttatttgaatacttaaccattttttatggctcttcattttagtgagcacgagagttatttttttctaacacacagtcatgaacatgccctcttttgtgctttgccttacatctctctgtgagaggctattccattttctgagtgtgtgtttgtgtttatgcaggtggttaacataacatgtactttcttatttgatttgtaaatatttggtgagctcttggtgtgcttgaggttatgctagaaaaataaaatatttaagccaattatatcagggtcaagggtgtttgaaaatcctattgtctgaagacatgggtgagaaagtttaaatatttttttatggaaaatctcaaatatatgaaaatgtagataaaatagtatagtgttaccctatatccttatcacccatcttcaacaattatcaaatcatgactaatcttgtgtcatctatatctcgaccctttattcccttctttttattttatttatttattttagttttatcttaatttttggttgtgctgtgcagcatatgggatcttagttccccaacgagggatcaaacccataccc

SEQ ID NO: 39016 - DNA, 1794 bp, Bovine  19866881325101
ctactaaagataaatttttggctcctagatgaaaaaggcatttgaatttaagagaagtactcttcagggtcaatctaacattcccatagaaggccctcaaattccagtttaagaaatacttgtgtgtagtcggtcgctaagtcatgtctgactctttgcgaccccatggactgtagcccaccaggctcctctgtccatgggattttccaggcaagaatactggagtgggttgccatttccttctccataacttcagtttaatttgaagggaatcagaagaaaagcagaatggcaacagttgagaatgggaacagtggggtctggggtgggttgtggactggatgtctctctacatctctttggccattatcatcagccactgcagagttcccaccagtagatactccctgtagcccccacttcctgtctctcttccttctcccacctttaaatgatttaccctttcagtgccttacatttttgtgcaaatcttttcttagcacagataaggctttctctccacttccctgaggctgaatccaattatgctatgggaggttcttcacctctggctcagatctccggcagcatctgtgaatggatgctgttgtgtgtctgcacaatggtctccattcagttacgaaccacttgtgcacatctccttctggaagacggtttgttacccagaatgcatttgtggtggcctactggctttggaactggttaatgaaaaggatattggttaatgaaaattataggaaattatcaggtaagactttttcaaatcttttaatgttaaaagtagttttttttttttttttttttttaagctctaaaaacagcatgagataattatggagaaacacaaaaaggaaacttggcattggccaaaaagttcattctggtttttccattaggtattagggaaaaacatgaataaactttttgaccaaccccattggttttaaaagcaaaactttagggatggaaatcagtcattataggagccaggaaagtagaaatggtatgtgttgtaaggagaccgagggcgttctttggggaacagaaataatctattactgtatcagcattgtccaataaaaatgtgatttgagccacaaatcctagccagttacttttaacttttaattttcttataagtactttaaaaaaggggaaaaaaggtagaattaaactgtactatatttaacccagtatatgaaaaatattataatttcaccatatattaataagatgtatgcatttgcatttttaaaaactgagtctttgaagtcttatattttacatctctgattttgtgccagctgtttcaagggctcactagctacctgtggcaactgtaccgggcaacacagctcaatactgttttggtggtaattacacaactgcatgcatttatcaaaattcattgaattgcaaaaagattcacgcaccccagtgttcatagtagcactatgtacaggagccaaggcatggaaacaacctaaatgtccacggacagatgattggctaaagaagatgtggtatatatgcaatggaatggtatttaaccataaaagagaatgaaaattccatttgcagcaacagaatagacctaaagattatcatatgaagtgaagtaagtcagagaaagacaaataatcatatgatgtcacttatctgtggaatcttaaaaaaaagatacaaaggagcttatttacaaaacagaaatagactcatcaacatagaaaaccaatttacaattaccaaaggggaaagagggtggggggaggg

SEQ ID NO: 39017 - DNA, 1048 bp, Bovine  19866881379846
tgcggctgtcacctgcccatctcctctttctttcagtaattcagaaggcctctctgggcagttgagtctgtgatccctgacctacatcctttcaattaaaaaaaggagatgatgtcatccctagagagtgaggacactagactgggacttgaaaactgtgaaaagccattgtaatagtcatcgaaggaaatggcttaggaagtcgaacaggagatgaataaccaaagagttgttgtctattggtccgctaaagagagcaggaattcatcatgttgcctggcagtgccctacagcctgaaagcagagacctcaggacagttgtggcagaagacaggaggacaaagggtcctggggtgatgggggacctcagtgagaagacctgcccttgatggagagtccaaaggggttggtgtcctgggagagtgaagaggagacattgtgggaacaaagaggggattaggaggagggaggtgggatggaggagacctggaaggtaagataaaaagagtcttcctggaacttttctggcaggaacttgaaagtatcatctgtataaaaatattagaggacagaccacacatcaaaggttaaggggaaaaactgggagactttgggaggaaagtaaaactagtatgattagtacaaaagggaaaagttagttctgcaaaaatttgttagtacatcttctccctgctattcaactcctagaaaaagtgaaaatataaccaagcttggtaaccaatgataaattaagttcaaagaattatatgtttgtgaaatgagccatgtgaatgtcaaaggcttttcaactacacacttgacttcctttcaaatatgattttggagataaaaatacactcattctttgttcttataagaaaaggactgtatacattatctcaagttttcgagaagaaagatcaaaagtttgaagttcagtaagttctcggtgtcccccacagcacatgcacgtatagaggggagggacccagtgctcacgcctgctggcccagtgcctcagcctgggagtctacatattccctaagta

SEQ ID NO: 39018 - DNA, 1309 bp, Bovine  19866881414456
aaaaaaaagactattccaagtgaacaaaactgtcaaataaaaaaaaattgtgcaaaaacagttacttctctctcttttgatattttacttaattttatttagtctaattggaagattaggcaattaatttgggaacacggttccccccacattccttttgcctagggagagactatcggatccttgtcttggctccttgacaacatctttcaaatagcctcaggaacatgactgttgctattctccttgcagccctttgatgaccacctgggacctaggatatacaagccaagttccctctctaacctgatcagcatacttccccggccgaacctccaagttacttcctgcttcacacctcttattttaataatacagaactgctgtggggctccctggcctgtgtcttgctgtttcttgcttctctgggtaaaagattatgtctataaataaatgcagcccactcctgcttttggtggatctacttttctgagtattcatattgcagtgttaggtcataaatgacatacctctcctcaaatggagtctctggcttagaaggcaattttgctttttcagaagtttccaagcctttagatgctggcaataatgaagggattgaaacttgcaagatgctggtgtggaactgtaatgtaataataaaaaaccccaaatcaatccatcaaacaaacagaacataagccacagagtaacaaagagataaataagacaagtggtctattgctaaaatttcatacacctgtgtttagaactctatccttatattgataaaatggttttaggacataaacatccagacgtggtaaccagaggaaacattcagaagaaggtaatttttgaaggcacatttgaagaagacactgaatattgagaagaaggtataataaataccattaagaaagttaatagtaaatcctaaccacgttaagccctgattgacatcttggccctgacacacttgactaagcgaacttgaccttaggcaagtcacttaactgtgcattcattctctcctctgtaaaatgataaagtcagtgcctaccttacagggttgcaataattgtagatgaaatttggttaaagagttttgtaaacaaagcactattttcactttaattattttatatgtgcacaggttaactaacttcagttaacagaactgatgaaaagtgtcattaaaacaaattataatagattttgtggctacactacttaaaacacaaagcttagtagtaacaatattatagcaaaaacaacaaaaagcataatacattttctcccctaaatg

SEQ ID NO: 39019 - DNA, 1648 bp, Bovine  19866881431814
ttttcttataatcttttaaaaaagaactgaccggaaaatgatgaatcaaggatgcagggtatgaatggtaacagaaagaagcaaatgtgttcagtggacactcaggagataggggagagggatacatgtgtgtgtatgtatgtgtatgtgtaggtattaggtgtgtgtgccataaatatggacagaagaagagaccaataaaatatgagaaagtaagaaactgaaacctgcgaatgagcactagactcagccagcacacagtgcgttaacacagctccaaaagcccaagtgacctagaaaaattaccttgaacctgagagaaattattatataggtaatccatcacagcccatagcactgatatacttagggggcctattaatgccccataccctcatattattttccctaaagcgatagtttcattatgtaactcctcacgcagtaactttcaaaggctccgcattgtcagagattaaaaaccacagtccttaatgcagtattcaaggtgctatggaaccaatcttcccaaataaagagtcaactctcttgtccagaaatgccttccttgttcttatatttatctgtgttcctgttacttaagctgttttcttttccctttctgaaaagaccttccttctttcttcacctatacaaatctaattatcattcaagattgcagttaagacttcctttctttttccccaactcttgccaccctctctcattttagaactgcagtaataaactctagtaccacccatccccctgaatcgcatagaccctcagcgctgtagggttattcagcatgttgccatcacattaaggagaaaaaaattgaattgccagattgtgacttcttggttttcccatgtgtcgacaatgttaaaaattagcttaaataaatgacagcattaataccattcttttcataaacatggaaaggagagagaaaattattcacatgggaagatgatttaaatctatatgcaaaacgtcagtaggtatagatcacacactttaggagatgatggaggcttcctgcctgggctgactttccagttctcccagaaggagtttcccagaagcctcagcaaacatcccttcacattacctttgcatctgaacctaaggatggggtcagtatacaggtgagatgataaaggaacaatatttaggtcctatttggaaagaaaaagagggggatggatgctgagtgagtaactaagaatgtctgaaaaccctccccaccccaccaacatgattgattcttttgaacacagtttgagtttctatagattagaatacaaatccaaaatatatacattattttgggacttccctggtggtccagtggctaacactctgagctcccaatgcagggggcccaggtttgatccctggtcatggaactagatcccacatgcagtaactaggagtcttcacgcacaactaaagatctcacatgccacaatgaagacagaagatcctgaggactgcaactaaaacctggacagccaaataaataaataagatttttaaaaagacattatttccattcaaaagtagtctacgttttaaaacattcttaatgtttaatgaaaggcttacaattttttttaaatcagaatttcaaataaaaatctat

SEQ ID NO: 39020 - DNA, 851 bp, Bovine  19866881527773
tgtcctgggactctcagcaaggtaggatatgagggaatctactgagattaagggcagagaggaataggaatagattagggagagtttggtaggaattttgagagacagccactatgagaaatgtgatagggcaggaaatagtgatgaataaaggatccttgggtaacattaagtgccctgccgagattagatagcaggcatttgaagtggagccaacctagcctcctctaacagatcagtagaatgaaatcaagacacagctgggcatttcataaggagaaatacatttttaatgctctatcgctgtttggcagaaggcaggacttgaaggtatcctgagattaagacgttcaatacacatgatttaaacagcaaaaatgtaaaaagtatacttttacgtattaaaaaaatagtttaatacttaatcaaatatacaaacactatatattttgtattatgtaaaaatagtatattttgttgaatacatagtaaaaaagtatattttttgtatttataaaagtatattattcctttgctttgtttttaagctcaggcaatcactatgttaagtagaatgccctagtttgggattgcatcttgaaaataagaccagtgctgtagttggctaaggaaagcgtatgtgtctggcaggtgggctcacctaaccaggtgcgtgagatggactttattggaaagcagaggtagcagttggggatggtcactggaatgaaagttcctcagtgcctagaacaatccctggtacatgatggatgaatgaccagtatcctttgaataagtgtatatatgtgtgtatgaatgaatggatggattagccgtgtcattttaaagca

SEQ ID NO: 39021 - DNA, 1093 bp, Bovine  19866881591776
taaacgcagataatagctataaaaaggggacttttttttttaattttattttatttttaaactttacataattgtattagttttgccaaatatcaaaatgaatccatcacaggtatacatgttttccccatcctgaacccccctccctcctccctccccacaccatccctctgggtcgtcccagtgcactagccccatgcatccagtatcgtgcattgaacctagactggcatctcgtttcatacatgatattttacatgtttcaatgccattctcccacatcttcctctcataatttgtcatggtgaaaactgtccagaatttgctgtttcttgtttgccccaacttattgaaggagcagaagttattaagccttaacagactgatctacccttgttaaaacccacattgtgaagaaaaagaccttccgagaaagagatgattcttacctggaaggtaatttagcagtttccagaaaatgttatataattctaggaaccaaaggctgtctgtaaatctatacagttttctgtatatattttattttctgtatatattatattttaaaactgttgtaaatctcaacagttttaaaagttttaaaatttttgcctcaaggattgcagtgagtgaaaacgcatttgcaattttgctcccacaagctacaaaaagatcattaactattgtacttagtttttccattttgaggggtgaaccagaaattcagaggctaattctctatcattaagttgtaccttttcttccattatttcataacattttggtctagctgtcatcagaagtgccttccaatccagcataggtttaaactcaggcctgtagatgtagttgagatcaaggtatcaagattccacaagtgggcattaatccagtctcgcatttccccctaaaacaaatctagttccagaaatgcccacaagatatgtagcaaattcctgtgtgaccacagatctcctcactaactcttcttgttaatccttgaaaacccttcggatggccagagatagcacagtatacactcccagctggcaaatagatgacagaattgtgatagcctcttatttcttcctgt

SEQ ID NO: 39022 - DNA, 1740 bp, Bovine  19866881952443
agagataaatgtaatcatatgaggtttttaaaattatctttttgatagattgtagagagggagaaaatgacagtgggggcagtgatgagagtgttgtaataattcaggtgacaaatgctggtgacacacaaccaccacagtagttcaggagctggagagagtaggatggactaagagacactttaaaaactgtttagggcttgatgccttgatctgcagggaccaagaggatgaagtttctaactgaatagatggatagtggtgccttagactgagttagaaggacaagaagagaaatgggtctttgggagaagagaattgaaggcatgttgagtttgagatgctcttctccaggtggagatgctcattaaacagctagaagcctggaacaagaattcagcagagccatatagacggtagaagcagacttgggagtcactgctgtagtgtttcccaggtggtgctaatggtaaagaacctgcatgctaatgcaggagacataagagacatgggttcaatccctgggccaggaagatcccctggaggagggcatggcaacctactccagtattcttacctgaagaatcccatggacagaggagcctggcgggctatagtccataggattgcactgagttggacacgactgaagcaactgagcatgcacacacgtttgcagtgttagttgaagccaagtaaatagaggagaatcttaagaagagagaaaaaatatgaacttctaaatgaatttgaaaatcctaaattgataagaaccactttttggttacaggcttcccaggtggcacagtggtttaaaaaaaaaaaaaaatccgcctgctgatgcaggagacacaggaaacatgggcttgatccctgggtcaggaagatcccctggagaaggaaagggcaacctactccagtatcccatggacagaggaacctggtgggctacagtccatgtggttgcaaagggttggacacaagtgaacccatgttcatatcctatatccattttggttacgactttgtacatgatgatgtaagtgcccacagggccttatcacgacttttttggcaatcctagctgcctctgaatgcaccccacccacaagcacccgtgcctctgcctcccagtccataacaaggaggcccagaagcggcagagggttactgtctccaagaacagcctcatgaaggatgaccgttggaagacaaacatcccaggttcctcacaccttctgtggagaaagactgggcggcatattccagcccatgtcccagagttacccagcagggctgacccccagctgcccacagatggtaaacgacttgattatgaactgactattgactttgggcccttccctggcctcttcctattccccacgggtacttttttaggatcacctccaaaataaactacttgccttcaaatccctgtctcaggatctgcttctgggagaatctgaacggagacagctttctgttctttctggtcttctgagcaggaaccattacatttgaaccatataagctgcttctttccttcatctgctgccatatttttcattttatcctccatcttcccccagtgctatactcaaaacacagggagctcaacccagtgctctgtgacaacctagcgggatgggatggggtatggaatggggagggagttcaggagggagaggacatatatatacccatggcgattcatgttgatgtaggcagaggccaaca

SEQ ID NO: 39023 - DNA, 927 bp, Bovine  19866880179460
atgttactgaagcctggcttggagaattttgagcattactttactagcgtgtgagatgagtgcaattgtgcggtagtttgagcattctttggcattgcctttctttgggattggaatgcaaactgaccttttccagtcctgtggccactgctgagttttccaaatttgctggcatattgagtgcagcactttcacagcatcatctaaaggatttgaaatagctcaactggaattccatcacctccactagctttgttcgtagtgatgcttcctaaggcccacttgacttcgcattccagatgtctggctctaggtgagtgatcacaccatggtggttatctgggtcatgaaaatcttttctgtacagctcttctgtgtcttcaccatcttatttcctgtttattcttagatcgtcacggactctgcttctgtggagcgtttgctggggaagaccgacgtccagcggccccaggtggtggagtactgtgtggtgtgcggcgacaaagcctcaggtaagcagcggtggtcacgcgggtgcacctcgggggccggcatcacagaccaggtccgggcagcggggtggggggtcagaatgtgactgtacttttctttattgggatgatgatgtccataagcagatcaggttgtcagattataggaatcaaaaggaaaagtcaggaaactgtctgtgatttgtaaatcatggttgactgtgattatttttgtactagtaagaaggtaatcaagacttccctcatggtccagtgattaaaaacatgcttccactgggtttgatctctggtagagaactaagatcccacatacccttatggccaaaaaaaaaaacgtaatcagtcgtgagcgtagtcagcatttgcgcagcgctttgctcttccacaggacgtctgctgcccgtcccgccccggt

SEQ ID NO: 39024 - DNA, 948 bp, Bovine  19866880344828
aaatgagcatttttaagaatattatgaaatgtatgccctattgtatgatctcgtaagacactgtcttcatttatttatattaaataaaaactttgagatgaaattctttttccattacaggtctattatagacaagtattcttacatttatttttgtaaaattactaagacaatagcatatgtctaaataaaattaatattctgcatagtagtttatattgaatattaacgttggtatttcaccatttctttcccttactaaagcataatttatcctcagaataaggatggtgagccagagtacaatccttgtggaaagtatatggtaaaacttcacctcaatggtgtgcccagaaaggtgaataacgtttctctccatattaaccccttctttcttccctacctttgaatcttaagtagagtcattaagaaatgttatttatgtaaacatttaaaaagtcagtttagttgattttgactctgtgatattatacatattactaccaatagcagtcatcaagtaataattaaaaagtaaaaaatcatggcaagcagtaaagtcttttaaaaatgagtttgggaaaatttatagaaagctccaagaagtagcattgagctaatgtttgcttatccttaaaatgaattttaatctggtggtcatttattacctttttgattaaaaagatatcagacacactaagtccattagaacaatttatgtgtgtaaatcgaggtgtaagacacctttaatattgttttcctttgtgaaatatatacatagttttaaattgcaaatctttctcttaaggattccgaacgatgttgtaagggccttgcattgttaggattctctagctcctgtccgctcattaagtccagggatcaacattagtatcgcttgggaatttgctgggcttcccaggtggtgcggggtaaagaactcgcctg

SEQ ID NO: 39025 - DNA, 1090 bp, Bovine  19866880412476
ctaggagtcggacacgactgagcgacttcagtttcacttttcactttcatgcattagagaaggaaatggcaacccactgcagtgttcttgcctggagaatcccagggacgggggagcctggtgggctgccgtctatggggtcgcacagagttgaacacgactaaagtagttagcagccagcagcagattgtaagagtattccccatgattgttcttatggttccttttatttttaaatattgatgtaaaaacataaggacttccttgatagctcagttggtaaagaatccacctgcaatgcaggagaccctggttcaattcctgggtcgggcagatccgttggagaagggaaaggctaccccctccagtattctggcctggagaatttcatgggctgcatagtccatggattcgcaaagagtctaacacgactgagcaactttcatgacgatgataaaaacatcaagtgctcacctggagatgcacagcttctcagatgagtacactgtgtgactgtctcaccaagcaagaccaaggacatttcatttttgtatttatacttctgcttcggtgagttttagggtaatgtgccatgtgaggtaaggatatagatttcttttccttaaatgacaaatcagggatcccagcattcagacagcatgttaatagactcctgtgacctgcttttcctcactccacctttttggggggctgagtcctctcagaatctgatgagagttctgaatttctctttagaagaatacacaggtgcataaagtttaggttagaaactctcatgggtttaatttcttgtgttgcaggaaattcgtgtttttcaacatacctcagatccagtacaagaacccctgggtgcagatcatgctgtttaagaacatgacgccgacccctttcctgcggttctatctgggtgagtgtcccagctgtctggcgcgggttggaaaagaatttccagacatagagcatttcagaagggagtgagtttattaagagcaaagagcagagataatgaagacactgcaaacccagcgggccagcacctggcagaccagggggagcccccgctttcagg

SEQ ID NO: 39026 - DNA, 1057 bp, Bovine  19866880460150
cacctggggcagcggcagagcagtgtctgtaaccccagcctctcttctgacattcgtttcaaccccgtgtatcaacaccctgtctgtgccaagccttggaagggaccctggagatcagacatgctcagagcacaagcaaaaagccaggcgcagccatgcagctgtggggcccagagcaaaatgaaaatgcagtgcctcctgttcgaaaaccaagtatttcacacggtgaccgtagaacacacaggtttaaaccaagcccgggccctcctggtcgtgggtccctgcatgcctgccaaggccacgtgcccgtgaggctggccccgtgcacgtcacagcttctgcagcagcatctccgagtgcccagcccccagcctggcagggaacagaagccaagtacacacgtactgagcagtaagctcccccagctctgtgacacggacgcaggatcgtgggtttgcagctgggtaaactgaggccggggaaggcttccagcctcgccaggtctcaccagagccgggatctcggcctcctgccttgagtgtaggtccactgttccaggctgaccccagtcccgacctttgttttcctgatcccagaaacaaggagtagtgtttaccgcgggctgaagtctgttttatttttgtgtttcccaataattgattccaacagttcctacagacgtcctgctgagggaaaacatgttttgctcagtcaaccttcgacttcctcgcggcgcctcggtggtgggggcccacggccacaaggaaagcgtggggtgacttttcccttgtttttttttttttttttccatctcactgtcgggggacaacaaaacatgttttcctttttctccaaaggaaatcggaactttcttattgactatttgttgcctaaaattcagcttcctactcttgtgattatcttggactggggggagttatgcgaccaaacttcagaataaaggattatcattttattgaaaggacaaccatcacagccgaaattttcattcatgtggagccatcgacacctctgaaatttgccttggcttcctcat

SEQ ID NO: 39027 - DNA, 1636 bp, Bovine  19866880492357
gtggcttctaaggacgctgtgtgtctactctgcggacaagcccagcccgagcctgtgcccaggagcacttagcacctaggcccacagccccctcgagcgaggacacccccagcccggcagcaccaccaagcccggcgcccccagcctctgtccaggacctgctgctcctgcagagccgcctgcgggccggccccccggttcccagcgccgcacctccgtctggggcaactcctgtccaggcctccttccggggatgtcagccctgccgccctgccctccataaatctcacacctgtaactctgtctggacacctgtcaaaaacccaaatgttcatcacactgctcagcagtaaaaatgagtgagctacggatacgcacaacgtgagtggctctcaaaaccacgagcgaaaaccagacacagaagaatatatactgtgagactcgagatgaagtcctgaaacaaacaaaatgaggcagtcttggacgtccctggcggtgcagaggagaatccgcctgccagtgccggggacacaggttcagtcctggtctgggaagagcccacagcttattcagagcaaccaagcccgggcgccacaactgccgagcccgcgcacctggagcccgggcccggcaacgagaagccccgctcacctcaactcgagaaaagccagtgcaaagcagtgaagcctcagcgcggccaaaaataaacaagcaaataattagcctacagtgaaagaactgctggcagccggaattccctggcggttggtgcttaggatgcagtgctgtccctgctgagggccagggttcgacccctggtcggggaacgaagcccacaggccacgcagttcagccacatacacacacgaaaggaagaaccgcttgcagtgatcgcctctgctgggagtgggagctgacgggaaagcagtcctgggggactccctggagtaggagagatgttgtcttcactggggaagggtgacacaggccccgcagatctaccggagctcatccctctgtgcacaaaagacctgcgcattatgggtaaattatcccacaataaagtcagtttttaaaaacaacagcacaaacacggaactggcaaaagccccgccacgctcctcggctccaccttgctctgcttttcttttttcccaccgcgctcgtcttctaacaacccacgtcactgagtccccgttcattctgtctcctcccgctggaatgtcatctctacacgactaggcgtctttgaccctgtggctccctgataccccaagcacccagaagagtccatgggtcctagcaggagcctgacacatatttgttgaatgaatgaagaacatcatcgatttgtttcctgatgcatttcccaatctacactgcatttgactctcgtaaccgtgtaaggcagatattttgccctcccctagaaatacggaactaggaacaatacttgatcagaatgactgaggagagagccaggctaaaacgttggctctgacttccagggactgagcccaaatgaagggaatcttcacaatttgtgcctcaagaggacaggagcgcatcgtgaaagtctatgatccagaaggggacacacacacacgcagttcaagagaacgtggccagtgctgag

SEQ ID NO: 39028 - DNA, 1465 bp, Bovine  19866880518152
cccttctgacattctgctggtctgcagataaagtggctttctacatctatttgctgaccctctggcagctccattcctcagcttcggagactcagaaaaataggttcgtttttgaactgataagtctacaagacaaagagaccactcagaattgtggtcatctgggcaaccagccagagggatctgaccctagcaggcagggcagatctgttttaaagccaggactcaaaggaagagaagatgaatacaatctgtgaaatgttcactggtttgaggaacctcatcccaccccctaccagtccctttcttgtgacattaatttggaagacatgccttacaaacagatgaactctggcttttaaaagttttattgagatacaattcacataccatacaattcactctttttaaagtgcacaatggtttttagtataggcgcagttgtgcaacaatcaccactaattttagaacattttcatcacccccaaaagaaacccattagcactcactccattcattcctcctccccccaggcaaccactaatgtgctgcctgtgtctacatatctgcctgttccggacatttcacatggatggaatcatacactatgcggtcttttgttaacttgctcctttcatttacaatcacgtttctgaggttgatccatgttatggaagtgtcagtccttcaactcatgtacctcattatatggagagacgacaatttgttgatccattcagtgtttgacgacactttcgttgttcccacttctggctgttacgaacactgctcctgtgaacactcaggtacaaattattgtgcagatggagactttcactctcttgggctgggagccaggaatggaactgctggggtcatatggtaactcaatgtttaacattttcaggaactatcaggctgctttccaaagtggctgcaccattctacagttctttttgcaaaactggtattgtatgagggtttcaatttctccatgtccttgtcaacacttgttattatattgttttgattccaccaacatcctagagggtatgaagtgctatcttattgtggttttcatttgtacatccctagatagcagactggttccaaataggaaaaggaggacatcaaggctgtatattgtcaccctgcttatttaacttatatgcagagtatatcatgagaaacactggactggaggaagcccaagctggaatcaagattgccgggagaaatatcaataacctcagatatgcacatgacaccacccttatggcagaaagcgaagaggaactaaaaagcctcttgatgaaagtgagagagagtgaaaaagttggcttaaagctcaacatttagaaaactaagatcatggcatctggtcccatcacttcatgggaaatagatgggaaacagtgcaaacagtgtcagactttattttttggggctccaaaatcattgcaga

SEQ ID NO: 39029 - DNA, 1181 bp, Bovine  19866880518564
gagcttccctggaggctcagacagtaaagaatctgactgcaatgcaggagatgcaggtttgatccctgggttggaaagatcccctggagaagggaatggcaacccactccagtactgtgcctggaaaattccatggacagaagagtctggcaggctgtagtccatgaggtcgcaaaagagttggacacgaccagcaacccattttcacactattgtcgtgctaataaagtcaggcttcccctccttgacgtcttctcctgctgttaagtctagatctgcactgatacatgacgtaatacgagcgtcacttctcaacatcaggtgtcagacactggcaggcaattattttccagggggtggggactctcatttcttatctttaacaggtggtatttcacacaggcaccaccagagctgccagagggacagatcggccatgaaaaatgcatcactcccaccccgccccatccttcctgcaatcaagctattgatctgcgggcgccgtctcctcggaaaaaggtcacagtgggtgtcttaggcgtgatccagcaagaaaatgccttccccacgggagccccgaggagtgacaagtacccagtgtccacgtcctgctctctgctctggagctcagggcgtttcaccccttcccctctgagatccaaggatggcagtcagaaagaccctgcccgacccctcactgggagaggagactgaggcgcacgcagggcgggggactcagcgagtccagagaagggcctctgcagaatggagtctcttgcttcctggtccagtcccttcaccctttgccatcaagcatttcttctgtgggatccccagtggctcagcggtaaagaatccgcctgccaatgcaggagatgcgggttcaattcccaggtctggaagatcccctggagaagaagatggcaactcactccagtattctttggctggaaaattccatgaacagaggagcctgggtgggcttctcaagtccatggggtcgtgaagagtcagacacaactgaacatctgcacagagcagacttggggctcccagcttctagtgaagcagagaaaggcaaaatgcagagagactgaggccagagaggccagggacagcgaatcaagtgagaaatcccataaggctgagtcagaaggactgagtgaccacaaagtgaatga

SEQ ID NO: 39030 - DNA, 1028 bp, Bovine  19866880559166
tcagcttgcctgggattaactccccagcaatgccactagccagctgtgttaccttgataagctacttaaggcatctgagccgcagttttcctacctgtcaaggagagtgtctcctttcccaagcactgtgaagattccatgagagacacatggactcactcaccttgaatggacgtggacactgagaaaaccatctatgatcgtttaaatgtcaggaagcattaccttaatatacgcgtcacaagaatctctgtcagattgctctgatttacttgctatgtaggtcacatagcaaggaaatgcctgaaaagtacaatttaatggccacttattaagctcttcttcccttggcctggaatgatgctctggaattgtaaatgagaaggacccttgttccctaccagctggaggagacgcaaataaacaaataattgtatggtgtgaaaagggctctaagaggcatctatggtaggcacttgtgggttttggctgctgggtcccctcttggcctgggggcaccctgaactttccctccagaagttgttcctcccaactctagttcctggacttcacagggtgtcatgtgactccagctaggccaatcagagctgttgatcccctggtcactgggattggtccaaggaccagcacatgacccaggactgaccaatgagactcaatcctgggactttcacaagtttgctgggagaggcagccttggactgaacttcaagctgggaggtgaaagctgagcttggaggggtttctgggggctgcctgaggtagaagcccacacaaaggaaggcagagccagtggatgctggaagcagagtccaggtggctcagtttaaccctttgtctcagctgtgttcaaagcagttctaccacatgggtgtttccactaaataaaccaatggtttaaaaggaaaaaaaaaaaaaaaaaaaaaacactttttttcttaagccatctgctaccaagaatcatgcaaaggagtgtgcaagacacgaaggaggcatagttgaacaag

SEQ ID NO: 39031 - DNA, 946 bp, Bovine  19866880643294
ttagcctaacctcactgatataactgtgcggtcagccccttctctcagatgaagcagctggctctcagagacgggaagccacctgcccaaggccactcagccagggtagacattgggctttctccccaccctggggctagggaagaccactctaccacagtatccccaccctggtattacctggagaagccggtcaaagggccggagaccccccacgctgggctggcccgtcaggccgcacggtgtgcacgtagacgcccttctccaggaggccgtctgagacgctgaaaccgaagtcactccgcacggggtccttgtgcagcgtcacctgggagcagcaggaggaggggccctctggagccctgaccttcccccagcgtcccacagttgcccaagtcccttgggctggcatcggatgcctctcggactcagccccagcccacctggatgcccccccgacctctgaggaccctcagtctgcagcactcggtcaccgcggaagccatgggaacagagttcctttccattttttttcagtcttcccgcttccattccagaaccacgtctccgtagggtggccatgtgcactcaccagcctccgacacttcccattgccctgcccaccaaagagctcagaatctcctgaagactattatggggccagaggtctctttgctcctgtgtatcttattttcctagactatagcctacagttgacaaaaatgctggcctttcctttgaaggtagcgacatgcatgcgtacacacacatgggcttccctggtggcggcagcggtaacaaaatccgcctgccaatgcaggagacgccatccctgggtcgggaagatcccctggaataggaagtggcgacccactccagtactcttgcctggagaatgccacggacagaggagcctggcgggctacagtccacggggtcatagaga

SEQ ID NO: 39032 - DNA, 912 bp, Bovine  19866880645520
tgcatgggcaagtgtctggggtgagagtaaggatgaacacgcctgggtgctccccaggcttggctctgggactttatgcatccacgtggattatcacatgatgacactttcatgcaggtgctgctattcccatttgacagatgaaaagacagggccacagagaggttaggtagcccacacaaggtcacacaggaggcctgcgtggctggagcccagagagggcagagggaagcggggatgggagaatggagggggcagaagtgccgggcctcgtgagaggacgctgacctgcagcagccaggagccactgaaggaaggaggaagtcagggcatcagccacgcttcaaaggtgccctacggccagggtacggccaaagttgagcaccagtagacggcggacagatacctctcttgttttgcactgatggagcctcagtgcaccatggtctttcctgcagacagcacggtccataccgactcctgacaaggccatcttggacacaaaagcacaaattttaccatgtgatgaacataaggaagtgcttcctggcacgagcctcgaagaccccacttaaacctttgattaatcctctacaaagcgcagttaagccacttccgcggtttctgttgccgtttttgctttactgaggtcgatttcatcaagacggagtctttcttaattaaaacctgtaatgaagatttgactcatcaatcagttcctttgcccacagcacacaccacttgatcacagcatcttctgccgcctcagattccccgttccggccgtgatttctgtccatttcaattctatcgggtcagaattttgcagatcttaatgttggcatggagatttgattcttctgtcaatttttagaatcaataactactttttttttttttttttttactgtg

SEQ ID NO: 39033 - DNA, 1125 bp, Bovine  19866880646725
atgcacagaagtcgttccgggaaggtgttaggctgaagcagggtcagtcctgcttattttgacaacgagcttaggagctggccgtcataggcctcggcactggttttcccacggcatcagcaagttaaaagcgacttctggttaattaacactcacattttgaaaaggaacgagcattgcattatatgaaagtgacagtgaaagtcgctcagtcgtgtctgattctttgcgacccacggactatactgtccatggaatgcgccaggccagaatactggagtgggtagcctttccctttgccaggggatcttcccaacccagggattgaacccaggtcttccgcattgcaggtggattctttaccagcagagccacatggcgggggagtctaaaatgacttgaagagaattaactatccctctctctgtgaggccttaaacctgtagagtccttttacaccacactctccattcagtgccgtgaaacctagatcaaacatctgcattatttctccctagtgctggagagacaacctacagtctggaacatgccggtgaccttcgagtggaagtgcagaaagtgtatgagctaatagacgcattaaggtaaggtctgttaggtgatgttcctacctgttggcttaagtggaggatgtgctgggtttaccgggtggtgggcggccagcagacctagcttacctggtcctggtgatcgggggtgtgtgtgaggaggaggctgagggggctgccagctccggccctcagtgcgtctcggtaacttgcttgaggagtttaccgttcatgattgttaaaggaacaggagccggttggcgtcagctgtgtgtcggtcacgggctgcttccactcagggtggctcttgtgttctgccacagttaccctgtgacgtagagattaacacccccatttcataggtgcaagagtgcaccccagctagcgaaagtgctggaaccaggatggagtccagactctttcttcagtttgaccactgcttttttttttggctgcactgtgtggcttgtgggattttatttccccaaccagggaccagaaccaggcgtgcggtagtgaaagggccgagtcttactaaccaccagggacttcccag

SEQ ID NO: 39034 - DNA, 1169 bp, Bovine  19866880657892
ccaggcctggacgtgccctggtgttccagactgggctgggacgtcattaaggacgtcccttctgtcctgtcctgtgcacattgtagacagggccgggctcagctcagaaccctggcttccttcgggcctccgcccccgacctgctaggagggccagccgggtcaactctcctttctgggtctctggtggctcacatgtcagataaggcagctgaacagttaccccaagtttaagaccctcctggttttaggaggggcacgtgaataatgacattacacgtcacaacattcccctgaaatctttcaagtaatacccgagggagaggcttaagccctcagctttcggctttcctggacgatcctcgccctaaggggtcggctctggtctccacggccttcctgccatcctcgggtaacggcccccaaatgcttcacagaacctgtagtccgggcttgaccggaggccgggtacttaccagaaacaggtgccgggggcgtctgttcttccctgttactttcatcagcgtcccttccttcagaaactcctgtgagcagagaagcagacctcggtgatcaggctgaccccctactccatccagcgggaaaccaattacgatgcctcccggagctcgagtgagcggctcatggcagaagccccctgcccaggagccatgctccacgcctggtggggcagccctggagacgggcatctggcctttggggagcaccctctttgaaccacaccaacccagatagcgggccagccacagagtggtcccaacaatgactcggcccctggtttgctgccacgggcatccgatgagaacagagcctctgagatgccagtttgctacagtggctgaagacctgcaaacagttgctacagccccctcaattctggaggatacaaacagatgtctgatcgtcttcactaagctgaggcctctggccaaaacgccgggtggggttttacacctaagtaccatctctcactcctgttacttgtcctttgaggaccagaacaggtcaggaatacattttttttttttttactactcttgagctgagttttgtgttttccatttggaagctttaaagtgggtaaatctgtcttttaaaaaacgttggggttcctgagagatggtttcccagccactggactaaactgag

SEQ ID NO: 39035 - DNA, 1206 bp, Bovine  19866880737018
accccatcctgttccaaaccgtaggcaagtctgcgttcccatcttactgtgtacttatggttgccaccatgtctaagtcgatggtgtggtttttgttttttcctggttttatcgagtagcaatgtgacctcttctttgtcttatggaaccttagtaaactaaccactgtcagagactggggacaggtcatgtgcaggggcttgggggcctcggaccccggtgaaaggccacagcgtttcgggatggttggcaaatcgcaacattctggaaatggcccaaaaaaggccccttcttctacgattcccagaccaaattctagaccaaagacacacgcagaccaagtccccaggccccgcctggaaggaaggtcagccactctcccaaaccaggtccggggcacctggccccagcctcgagcctcctgcctgaccgcctagctcttgtgttcccatagaactcagctctgtgagtacctggtgtaatgacgcgtgcctctgacgtctccgcataaaggaaacttgtcatgaggctcacgagtctggttcgcctgtctctgggcagccccccttcacccccagccgtgctctacctgggacggaattctgatgtttgcagccagatctggaagggaggcaagagggaggcttaaaggatgtttctagaggtgcagaaatggggaagggccccaggacagtctcacccggggagatgctccgtggagctgggcctgcctgggccctgttcattgctgtggtccccagtgatggaggggcttcctgggtcccccagtcagcgccctcattggcaaaggggcacgttcgccttgaagaccaaagaccagccttacggcaaagggcatgctccgtccccagagtccggggaccctgtgagcgtcctcaggggccagctggaccccaagctgcagttcagtgggactggcagccccggcctccttggccccccacccagcaggcctctaggagccaggcgttgggagcctgggagatcctgcaggagatggcaggatctagcctgaggccacgtgggacattcatagccatcacagagccttggatagtttctgggccctgggcagctccctctgcaaagcctctggtcccgcattctcaccccaggtccctcagccggtggaggagggcagtgtaaggggagagggggtcttctcagcctgacccagactgcccc

SEQ ID NO: 39036 - DNA, 1729 bp, Bovine  19866880752862
ggaaaccgcagggcctggcccgcctccccacacctgccccttccttctgcagagactcaagtacctgctgaccccgagggaacccaaccgctgggccgtggagcacgagggggccatgccctacagctcccgcatggccgtcaacaacacgctcaggaaacccacgcacatcatcgtggagaccatgatgtgagctctctccgtggacaggctgctctcctgctgtttactaacattagattctcgtaggaccaggtttacagagctttatatttgcactagggttttgtttattttttcaattgtcacagaaaatgttactctgtgtgtgtgtgtgtgtgtgtgtgagcgtgtgcacgtgtgtgtgtgcatgtgcagtgttgggtgtatgggtatttccttttgatttggggatgttttgtacaaaaaaagcaaacccacgggcagctgtccggggcaaggcagaactttcatacggagttagatgtattttatggggacttggtaaaattttctttgtatttttttttatgtagacacatagagattgtcaaacacttttaccacttgaatagatcttgccagcaatagatctcatttttaaaagcagttcttcggtgcttgtgcagctggcagaaagttctgccccccacaccccaccagaacactgggtgggattttaaaggtgtcgtacccacagacctggttcaagtgaaacaaacagctgtctggccagaccccgggggggctggacagaggaaggtgcctagtgacgcttatcgtagccaacaagagaggtgcccaaaccgtaaaccaacccctcaagtaaagggactcagagtccacagaaggggcccagaggcgaacgtctgatgctgagagcgccgggagcccctgcgtcaggagggtcccttttatttcaggattgagggtggacagtcagggcgagagggagaggcatccttccccggggtgtcccctggagcgagtggaggctggccccgcaggaactaggggtctcaaggctccagacctcacacggatgggtctgttgccttagaagggggctcctatcagcttccggctgaccccccagctggcatctctcaaagctgcctgtaggagaagcgtgattggtgaggggtgcggggtgagccagtggaccgaaggatgtgcgcccaggtgcccgggagggggcctggtgtcgggggagggagtgctcctcccctcctctctccaccctcagctcgtcctcgtctcccagaggctcttgttaaagaccccggcctggggccaccctggcgcctagcagggagcaccgggagcaagctgtcatcggggcgaggtgctccccacactctcctgcgagctcaggcacaggtgcagcccacgcggatcacctgtgtgaggaagcgccaacgcagcgctttctcccctcccctgcagaagccggggtcaggcgtgcagtgggtgggaccgcggcagaagctgagtcagggcaggcaccctcaggcgggcagcccactctgaaccaggactaaaggcaccccacctttagaatcccgcccagctcgcatctggacctaagctgtgccatttaaacagacacttccaagcccagagtctaaagtaaaccggaacagcgtcacgcacgagggcagtgatcgcctcgggggccgtggagcgcggtctgggtcagcgttcagagcaggggtctatgagtcctggg

SEQ ID NO: 39037 - DNA, 1335 bp, Bovine  19866880764034
agatgggcctttccagccgggggtgggagccagggtggggaggggggcaaagagtcgggcgagggctcctacctggtgtccactactggcttcagcgggtccggacaccctttgaaagtgtgggtgacttgggcctatgggtacgtgctttgttccggagcatctagggcactcatcagagtcccagaggcacctgagacctcccaaaggttaacaaaccaggctcaagggcaggacctcctgcaaggcggttctgatgcgggcgggcgggcggcacgcacgtgcccggctctgctggctaccagccggatcatgggccgccacgaggagcagggagggagttctcactgctgagctcctactgaccagcaggcctccgggatgtgctgcccagcctgaactcctcttacatcagaggatgctaattcagggcctccagcaagtaaaaaaaacccaacaaactaaaaccgagagagcagaccaaccaactaaccaactgacgaaacagagaacttactttagaaaataccatcgctaagcgaaagggtcaaaaaggcacaaacttccgattagaagataaattcgtcctgggcgtggcgtgcacagcatggttgcacaccagtcacgacgcactggatggtgtgtttgaaagttgctaaggggcttccctggcagtcccgcggcaaaggctctgtactcacaatgcaaggggcataggtttgatgcctggttggtgaactaagatcccacatgcggtgggggggaaaaaaaaagaagttgctaagtgtcaaactttaccagttctgatcacaagaagaaaaaaatacatgtgactatatgaggtgatggatgtcgacaagactcaccgtgatcatttcacagtaaagacatcaatcatctggtatgccttaaactaaaacaatggtatatgtcaattctaactcaataaaactgaaaaaatgaaaattaaaaacatcctcgttgtgctttttttttttggtcctggatacccgtccattaccgcaaaagacactggttttctatttaacgtgggaaacatgagacttgtctttgaactacaactggtttaagttagaaaagcaaaagcaaagggtaaaaacgttctgaagtcaggcagagcggggaggtacggagctacaaggcttcggaggctcgggcctggccctgtggcggccttcagagaggtaaactggaggaccacagagggtgaggaatccgctcgagctcacacaggaaggctctgatagaccaccatcgggttcccggtcatgctcttctcccgcctctgaggatcgcgggtgggagcggaggcgg

SEQ ID NO: 39038 - DNA, 1698 bp, Bovine  19866880837152
aactggagtctcctgcattgcaggcggattctttaccagctgagctaccagggaagcctcccttgccagctctgcagaggttaaatgagaagaggtacctggaggagcactgggctgggagctggagctctgatctccatggctgcctctgccatgagttgaagggacaccttgggcaagacccctcctgtccttgagcctcagtttccacatctgcagggtgaggagacggcaccgagcagtcagtaagtgccatctgctctggcagacgacagtcttttaaactggcttttctgacggcgttccctgacatccccgacgtgggcccctgcgtccactgcaactgcggttcactgttctccctctggaactctcacaaccgtatgttccaagagtaattatcttccgatttcaccttccaactgcatcttaatttacgtttcattcctggatgcctgctggaatgtccaagtcaagcctgatgatttctaatgaggctgcggtcaggtgagtccagcgacccacgacgggtgtgggacccacgtgggaaaggcatggctcagacagacctgactccaaccccagctctgccacacatcagctgtgtgatctcaggcatgtcactgtgcctcctgagcctcagtttctttctaggtcaaatggaagaaataccctgcttttttcataatgctgttgagaagttcaaggcaaaaaaccacataaggtaccgaacaaagtcaactggcaaacatttcctgtgcacccactatgtgttatgcaccaggtaaataaagcaggctctcaagctggacagtctgtttcaaccctgtctcaactccttattaggccagcaaccacaaaatccctgcagctcagttttcccatctataaaatgagaacggcaacagtcctcacgatgaggttactgtgaaaaccgaactgatccaagtgtaaaacactaaagagcagcgtctgggtcaatatgaaccagtaatttgctggtcacgtatgtgatgggggcttcccaggtggctcagtgctatagaatccccctgcaatgcaggagaattgggttccatccctgggtcaggaagatcccttggaggaggaaatggcaacccaccggggtattcttgcctgggaaatcccatggacagaggaacctggcgggctacatacagtccatggggcctcgaagagtcagccggatacgactccgtaactaaataacaacgtaaggtgacagacactgtgcttggcacctacaagctttgtttaattatgagacctcagcaacaaagatcttatcatccccattttcaagatgaagaaatagacactgagaggttaagtaacctgctccaggtcaaataactaagcctacggtggttatggggttcagtcccacggagtctatgaaccactctgctgcatgatcaagaaattcagagccaggcacatacatatcattacgtgaggtctatgattgctatcacacagaaaaagtaaccagatttacgctagatgcaaattacaggatgctggaacccaagggcggtaagtgctgagatttcctgggaccaagcctgccgctaagcgttttctggctcactccaaaccccggagtctcggagaatggagggcttgcccaagtctcgtgcagggaaacgtgggaaaaccgcacggggctctcaccat

SEQ ID NO: 39039 - DNA, 1805 bp, Bovine  19866880837153
catggcagaggcagccatggagatcagagctccagctcccagcccagtgctcctccaggtacctcttctcatttaacctctgcagagctggcaagggaggcttccctggtagctcagctggtaaagaatccgcctgcaatgcaggagactccagttcgattcctgggttgggaagaggagaccccagttcgattcctgggttgggaagatcccctggagaagggatagtctacccactccagtattcttgggcttcccttgtggctcagctggtaaagaatcttccagcaatgcgggagacctgggtttgatccctgggttgggaacatcccctggagaagggaacggctaccagcagcatgaatgtgtgagtggcagatatttaattaaaatagaaaatataaactggtaccaggggcctggctgctatggatgatttctatctccagaggctgtgaaaaatctcttcctcctgtcactgtgactccccacctgccacccccgccctcagttaactcttggcatcttgattgacgaggtattctgcattcgggtcatcctcaggggtagcgcattgccagaaggtcttgggcactggtgcctcagggtggcgagggtgtgcccccaagctgtgtgttttggggagagagagggtccatccgtgcttggttcttgctgtggttgttcagtcgctcagtcgcgtccgactctttgcgaccccgtggactgcaacacaccaggcttccctgtccttcaccatctcctgaaatttgctcggactcgtgtccgttgagttggtgataacatccaaccgggttatactctgtcacccccttctcctcctgccctcaatctttcccagcttcagtcttttccgatgagtcggcttgtcacatcagatggccaaagtgctggagcttcaacttcagcatctgtcctcccaatgaatattcaggactgatttcctttaggatggattggttggatctccttgcagtccacaggactctcaagagtcttctccagcaccacagttcgaaagcatccattctttggccctcagccttgtttatgttccacctctcacatccatacttggctcctgggtcctagagagtcagaaggttacactgaacccagaggaggaagcccctgctctgatttatcctgtttaatccatccctgacatattctacagctcagcaaaaccggactcttggccatacttccaaaggccttgcgtctaactgcctctgggcctttgcacactctgtgcctctgcctggaacacctaacctccttttttttaatttttattttatactggagcagagttgatttacagtgctgtgtaagtttcagatgtacagcaaaatgattctgttttatatatatatatatagggtgggcaaaaaaattcgttcatgttttttcataacatctttgactatatatatggaataggagcttccccatatataaagaatctgcctgagatgtaggagacatggtttgatccctgagttggcaaaatcccatggaggagggcatggcaaggcaacccactccagtattcttgcctggagaatcccatggacagaggagcttggcaggcttcatggggtcgcaaagagtgggacacgatgtaagtgactgcacacgctcgaatatttatatatatgtattatatatatatatatattctttttcagactctcttcccatttaggttattacagaatctttagtagagttccctatgccgtacagtaggtccttgttgattatctttcttatatatagta

SEQ ID NO: 39040 - DNA, 2834 bp, Bovine  19866880867914
acttgtaaaatattgataatgtatattaattaattattaacagggttatgtggagatgtaatgttttaacctatggaagtccacagaccaggccctgtacaaaaacaccatccacgatggaatgctactcaaaaagaatgaaataatgctatttgcagccatgtggatggatctagcaattatcataccaagtgaagtaagtcagacagaaaaagacaaataccatctgatatcactcttatgtgaaatctaaactatgacacaaaatgaacttatctataaaccagaaccagactcacggacataaaggacagacttctggttgcccactggagaggattgggcaaggggtggattgggagtcggggccttgcagatataaaccagtatacagagaatagataaacaaggtcctattatagcatagggaactaattcaatatcctgtggcaaaccataagtggaaaagaatatgaagatatatatatacatatatgtataactaaatcacttttctgtgcagcaaaaattaacacaacattgtaaatcaatactcaataaaataaattagggaaaaaaaaagattccccaggacaaggctataagtattagttttattaagatagccaaccgggtccctgatgcctaccgagggcttgtggatcaattaaaaagccctctgtcactcaccttgcggaatgcaaacctggtaaagaatttccttctccagattttgcagagactcaaatttttcttcatagtacactttgctctggtcgttggtgatctccaaaagctgagagaattcgacttcacccaccccaatggcaaaaataatgatgtttctgtccctcagggccttggctggtaaagctacgttgtcccgggagaccccatcagtgaccacaatcaaatactgatggacactgggcctccctcctcttgaactcccaaaaaaaggcagaataaagttcagagctttcccagtgtatgtgccaccgttgatttgcttaacgtctgagatggctctgtgaacgtccacctttgaggagtaccggttgagcctgaattcttcctgggggtctgagccgaattgcagaaggccaatctgaatctcatcagcaccaatattagactggttgaccattcgcttcatgaattccttcatcttttcaaagtcttttggagagatggattctgaaccatccatcaggaagataatgtcagctttcctattcttacaggctggaggggaaaaggagaaggacagaacatttactcagagtctgaaacaattaattacaagtccccagggagagtctggggtgacacatatacaacgtgaaaatatttgtaaagggggtggaagtggaagtcagggaaataaatttctgtgacccaccataaatcagtctcaaaataagacacggccatatgatagagatctatcatatgaaccagcttggtttattctagctcatccaatacttttagacctatgaatccacagttccagaatgaagcctattcaaatagattacacatatatactcgaagagagagactgagattgaagaaaaaaattcttactctctaaggaacagatgtcttgtaccacttcttgttggatggtcttcaaggactcaaaatcatgcacgaaaaacattctgtcttcagcaatctcttgaagctcagcaatattagcatctctgactccaactgcataaatggtgactccatggcccctcagcgcctctgcagcatcagccaccgggtccatagattggccgtcagtgacaacaaatgagataccaaggcacgttgctgcgagcagagtctgcaaagacctggatcatgctgcccagggcctcacccatcttggtgccccctcccttctgctggatgctgtcaacggctacctccaagccctgccacactggagtgctggctgagggtaaactggggactgacttcatccgagtactgaacgactccaaactggactctgtccggtccaacgtggaacatctttatcacctcattcatgaacaccttcatcgcgagaaagtcgtcttggtgggtactgccagacccgtcaataaggaagtaaatgtctgccttctcgatgtgcacacagcctaggcaagaagaagcagcagcaagccgtcagaatggcatgggagagggcgtgggacaaggctacaggtcccgatcccctggcactccctcattgctgcctgagactctgcctgtgtgtgttccttggccagaagcatgatcagcccataccctgggcaggcaagggagtgagtgagagtggccagcagcccgtgattggaagtgggtaatggataaatattccagctccctcgccctgtgggtgggaccactcagaggacagctcagcagtctccctgagtctctggcagaaccaagccccaggtgcctccatgcctccagcaatagcctgctcactaactcagcccattgctggtgggctctccttcctctctccatccccactcccctaacagtgtcaccagagctccactcccagataaatcacttgcatccatagctcatatcctcatctcagagtctgcttatgaaggcatgagataaacattgcttgacatttctcaaatggggaaactgagaacaagctaaaagtaaaatatcagcatatacatggcaggaaagctatgacaaaactagacagtgtgttaaaaagcaaagacaccactttgctgacaaagatccatatagtcaaggtgatggtctttccagtagtcatgtaccagatgtgagagctggaccataatgaaggcagagca

SEQ ID NO: 39041 - DNA, 1308 bp, Bovine  19866880926082
agaggataaaagtgatgctagaacctccccgatctatgggcaaaaaagggaaactggggagagtgctgggcaggagagaacagcagcggtcgccgtgtttatggggctctggtctgtggacccaggaggaagtgtgtttctagacatgggctttaagaaaggaaacctggagtcacgtctgcggcattctcctttcctccaagacagagggaatacattttgctccaccatgcaaaggtgtaagaaatgtcacattcctatttctgtaactccagttaaatctgctctgagtccctgcatgcctgacaggtggggactttggtctcgtcattatcggggcttcttttcctctgtgagtttacataagaactctgggcttgcacgctgttggaaagtcaggcaggacctaggcccctggaggtcaccactgttgcagccacaactgacccataactttcggaggctgtctgccacaagcagattgtcatatggtcattgtaactgaccacagagtcagtcacaagagaccctccctgtagcaggtctccactgcacatggaaattccaaaaagcctcctgttaatctcagcttcctcactttttcacctgaaaacacaaacgctcctcctaatcaccccaaaccttgatggtaagtcggctaaatccccctccagggcctcagacaccaaagctcttcaccttctctctttggggagacaatgcaatggaatctgagatcttcagaagcacaatggtggcctctctctttggtggagggcacgggccaggggtgggaaggggtgacagtggaaactacaatcgcttgttcaagcgctgtgtatcaccagtagatccccagggtctggcacatagtaggggctaaaaagacagcacttagtaggtactgttagagtctgttgaactgaactcttgaggttaaagctatcagcagaaaccaaccaagcaacaaaatggaaaaccaactattaaaaaatatatacaagtaatcatgactttgagctctgaacacactgggcaccagcccaagtttgggcaattttaatacaaccaccattttgcctccaaacaaactggcatcagctccagaagcctctctcggcctcttaaagagagccagtttctcctcctttaagtggcggcattcctccttgggtggcaaaggagcagtgtccacccccactcgcctccagccaaggacagcagccaggcctcaaaggtttgatagctaagcagtatattttagagagaaacacaaaattatgtctcatcaatctgtaagtaccacca

SEQ ID NO: 39042 - DNA, 776 bp, Bovine  19866881013572
cgggaattggctgctgctttcactcccgttccccaggcactgggcaccttgaacttttgttatctgagggactggggggcaacctgaggctgaggactggtgtttatttttctgatcccacacagagatcagcaggagcctggaggagagaagcgagtgtcctctagaagggtttattgtggcgaagagaagggaatctgttgctgtctatggggccacaaaactcaaggtgatggttcattagaacacaagtttctctctctccgtctcccatcacacacacacacacacaaacacacccctcaaaagcatcatgaagagtcgcagagttccccaattcctgtggccgtgtgtgtttctcttcaagagacatgactactacataaggtgctaagtactgtgcagtgacccagacacacacactgggtaagtgtgtgctgagcacaaccacacttttggccaacctcactgggcaaggctggccgatggatccaagtatccacacagcagacacaatccagactggattcccccaaaccctaggacttccgagcctcaagatgactgctcataatccagaaacccaccctgagtcttgagtgctccactgaccagaacactagatcacttccccaaatctaagcacgcgtgcatgctcactcagctgtgtccgactctttgcaaccccacggactgtagcctgccaggtttctctgtccatgggatttcccaggcaagcatactggagtgggtggccattccttcctccaggggat

SEQ ID NO: 39043 - DNA, 1135 bp, Bovine  19866881035525
aactataagcacttcaaagaataaaattaaacacagagggaagaaaaacaggggaaaaggaatggtaactccagtactctgatataaccataattcccctcaggttgtttttcctaaacacgccataactgtttgtaatcatggtctacttagacctttttccctaaacttgtcttcttctgtgccattttcctccactgatgatgcctccgttgagggcagaggcagagaatctggctaacactgtactgacttgtccctctacagcgccttacaggcccagcacccacggggcaaataaaaactatcactgattttcttatctctgtgctgacaggcaggccttccccgggagctcagctggtaaagaatatgccggcaatgcaggagacaccagtttgatttctgggttaggaagatgctgacatagaaagtcaaatctatttaagtttctccctattctcataattattttaataaacacaaaaaaataccacagagttgtattattacagaaaataaagacgcataaataattatatttacctataaagtctcctttagtcattttttcatataatttggccttttcttccaatttctccctaggagaaaaaaaaaagacaagtataaaaatggtcttatcactgccactcctggtaaaactgccctccccagccttactgctacaacctgcccaaggggcccagcctgctgactagagctgagtctccacccttaggggaccctcagacccagccaggtctgctctgccaactaatcataaagcctggcccatgtttctttcattcaggactgtaccaaagaaccaaaaacaatgcctggtgcatagcagatgttgagtcagtatttgaggaatgaatacatgaaagaatgaagattctaatttaatttaaatgccaaatgcaacaaattaaataccaaaaaaagagaggtatcgaaacaaaaacattttctgttacggatcaccaaattccacagtaactgtctaccactggttttatacaagggtccctggtctccccttggctaattaggtctctctaagggaggtagagaccaacctcttagacgtctgttaaaaatatgataattcctgttttatacagaacat

SEQ ID NO: 39044 - DNA, 862 bp, Bovine  19866881142098
cgaaccaaatttttttccctttttaaaaaaagctgaagtatagttgatttacaatagtttcaggtgtagaatagactgattcagttatatcaaattcttttccattgttattgtaagatattgagtctagttccctgtgctacacagtaggtctttgtcatttatctatctcatatacagtagtgtgtatatgttaatcccaaacttctaattcatccctctcacaggaactttattttaaattcacagattgtgatgaattcttcctgtaataagttaattttagttacaggagtgtaagatggtcaaaaatgctacctgtaatttaaaaaacaattgccaagtgattcaattaacactgtcaaatttttaacaaggtgttaaaaatccattattaattctactcttcattagcttttttttaaaactgatttttgtattggggtatagccaattaacaatgttgtgacagtttcgtgtgaaagtcatgggactcagccacatatatacatatcccattatcttttaatgaggagtaacttaagttacatgtataataacaggatttttttttttaacgaattgttacataaaattcactagtaaggggagaaatttcttaggacaattccaccaaacttaacttgtaagtattattatacatacggttttcagacagagatctacaagcttctgtatacagttctatagcatcttcaacattccctttttcatcttcgtcaaaagcttgtgtcacgaggaaatgggcacgctctaagtccaactgatgttttgatttcaaaggatccgcactctttgactgaactaggatcagaaaaaagccagatacttatatatacat

SEQ ID NO: 39045 - DNA, 1278 bp, Bovine  19866881142712
ggtggtaaagacaaaataacaccaccccctggaatggatcagagggttgaagaagagaaaaatgaaaggaagttactctgagaccgtcacacaaatctggaaaaggcagcctttcctcaagacactttgccaccacctgctgggaatttttcataataaaggcttcccttgtggctcagctggtaaagaatccacctgcaatgcaggagacctgggttcaatccctgggttgggaagatcctctggagaaaggaaaggctacccactccagtattctggcctggagaattccatggactgtatagtccctggggtggcaaagagtcagacacaactgagcacctgttgggaatttatcataataaaattacaagacaaagtgtacaaattcactgtcactcctcaggagagcccttgtgcagtgtgcaacctgcccaaccatcctcagcaacctggtgtaccacatactctatgtaatgccacctccccacacctggccctgccccaaataccccacatgttggcaaatctctctctcaggcatactggcagcccagaggggagagaagagaccacggcttacatgagctcttgtgttcccttctccgcggccgcctccgccccattgtggtccgggggctcatgggctgggatccacgaggcagagtgctggggttggtgcaagaaaaggtgtggttcacggtcggcgaggagaagggagatgaggataaggctggggagatgagagcagacccatgagcccagcagagccctccaccccaccccagggagacacaggggtgcctcctccacccccgaccatgctcgctgtgtgacctcaggcctgtctctccctctctgggcctcaaagcttacaggcttttcacagacctggtgaaactcagctgccagacaggggcccctcacttctctgagtctcagcttccttccctataaaacaggctccagcacctccccagggacagagaagagtgaccgtggggagggcactttacagcggttctggtcctggccggcaggggcggcccaggtgggcgtcctgcagcggccgggccgggggctgtggcaggagggcacgcaggggtcccagcgatgcggctgctcgctcctctgcaccttcactgtggtggaggaagaggagagacaggcgttaggggctgggcgggtctggactccatgcccctgaagggtgagctccgtctgcccagcaaggggaggagagcgggaacagaaggtcggagtttctgagccaggctg

SEQ ID NO: 39046 - DNA, 763 bp, Bovine  19866881243463
agtatgccaaatatgggaaggcatcgctggggctgctcaggacacgagctgaagggtgagctagtggcccccgagccccgcccagggtcccagccctggggccacccaggagtgtgacagctgagcgatacctgccgcccaccccgcctccttcccaccaaccagtcgcccccgcaggtcaggggcgccttgagccagggcaggagttctccaacagcacccgcggggcacacgggcgggacatgccccactggtgcaccccggaggccggagcgctggggcaggacagcccagcagactcgggcccccagggccgggtcagacagacagccctgccacctgcccaccagcggggtgtccggcccccgcccaccctccccgcttggggtctggaagtggccgtcccaggcctggcccctctctgggcagcggtttcagaggactccgtgggttcaggccccctcgcccctcctgccgtccgttactcacccgcctctccaggggtctcccggctgaacccacacagcatgactgctattgtctccccggtgccaccaccggctccctccctcgccctccccagggaggggccgtgggaggggagctcctggctcccactggctgggcacgtgtccacccactgcagcgggcggccctctgcttaaaggggacacggctgtcgtcacggctgattcctggatggggctcaacacccctccccacccctcagccccgtgccacccagtccaagtctgggcagggg

SEQ ID NO: 39047 - DNA, 730 bp, Bovine  19866881406245
cgtttgagattctccggctctgaatggggcaaacttgactctctgctttcttgtccttaggagatctcccccttcccctgtctccagactcccaaacttggagccagcaaacttgaagcaaagtgaaagtgtttgtcgttgagtcgtgtctgagtctttgcgaccccgtggactatagcccgtcaggctcctctgtccatgggattctccaggcaagaagactggagtgggttgccatgccttccttccaggaatcagacccgcatctcttaagtctcctgcattaggcaggcgagttcttttaccatgagcaccccctgggaagcaagcttacctcaggtcttcccggggcagcccaggagagaaggattttccagtgacggaatctaatttgcacggaacaagacattttaattccagaattgcccacattgaaatatcagagacgctcactgtcacgcagttgatagaacccggtctttttaatttgattagctcagaaacgtcttgttgaatctaaatgaagtgcgaatgagggaaccgtaatacgaggcattatacttaatgggggtgttgcctgaatccgtggctgagaatgtgaacacggggcctggggttgcgttgtggtgagcaaagcggctgggggctcactccaggggccctggaaacgactctgggcttaactgcggtttgatttgttacttcccaccttcggcaaagccaaggaagc

SEQ ID NO: 39048 - DNA, 2135 bp, Bovine  19866881527553
ggaaagattgaaggcaggaggaaaaggggatgacagaggatgagatggttggatggcatcccccgactccaatgggcatgaatttgagcaagctcagggagttggtgatggacagggaagcctggtgtccatgaggtcacaaagagtgggacgcgactgagcgactgagctgaactgaggaagaaaaccagttctcagtacttgtttgtgccagcactttatatgcgcattaggaagcaggcactagtaatatccccactttatagataatgcccctgaggctcagaaaatgaagtggatttctccagctcacatagagttcttagtggtagaactgggctcactcagcctggttgactccatggcagttgtctttcccagtatatcagccaattgcctaacctttggcttaatcttggatttactgcagaatgttggggtgcaagggatatgaaggaaatatcccaatatttgagccccttgcccccatctcatactgaaaatcagtactagttaataatgtttgagggcttcccgggtcgcactagtggtaaggaacctgcttgccaatgcaggagacggaagagatggggggttcgacccttggatcgggaagaccccctggaggaggggatgggaacccactccagtactcttgcctggaggatcccatggacagagaagcctggagagctacagtccatggggttgcaaagagtttcacatgactgaagtgacttagcacacacacgtaatgtttgaggattaggaaccaaaaaactataaaattagttattttttcctgatgggttaaaattagtaataataatgtgaatgccatctgggagctgacagtccttttaaaattcaaaagtatagtaggaagatgtgcgactagaaatttgatgtggttaaggcttaaaagaaaaagcttaagttttaaatttgttttttaaaatttagagtattaggttctggggtaaaccagcccttgacgttattaaaatctgtgccaaacttatttttaaatactttcttccaaaatagaaatcactgaatgcagttattttgatttcctttaaaagtaagtctgtagtgcagggctttttaagtattcagtttacaaatgcctttttatataagcagctgtacttcgatctttaaaaaggaaactgccattatacccttttgtgcagagtagatggtgatgatagatccaagccccctgttccttttgccctggcttttcttgttcttaaccacaagctaaacttgtggtttccaaaacttgctgaaacaaaattcattcagtctgttttatttctggctgttgaaatcttgcctgtcctttaaggctcatttcaaagccatctctgatcactctggacaaaaggaaatactcctttatctgaatttttatgccacttaatttcactcttaaagtcacgtattacatctgactggtgttgtaagttacatttcttactagattgtgcgttctttgaggcaggagtatgtctaattcacatttgtattctgctgttcattgttaagtgccagacatatactagggttcagattgttgccaatcaaagacattttcctgtagaaataataaatggttgtgatgtttaagtgaaattaaaaaaatttttttttttacttttactacatgaaaaagccgagtacagtggcagtcagagagaaagtggttaatgatgttagttgaatctgaatctagaagatgcagatttcatttgctttgccttatcatactctcttggcccagagtaaagccttgaagtgttgaaaattaaatatgtttaccacagagctggaatgaaatatgactgggatttattttgtactagactctacatttaaacatttaattttatatccacttttgtccatttataagagcttgtgatcttgttttcagaattgtaaaaacttagaaatccaatcactcattagagttaattgttggtttttttttttttttttgcttatttgctttattctagttggtagaccttaaggctgaactcttccgaaaacaagaagaattcaaacaagaaaaacttctaaaagatgctggagttttgggaaaaccaaaaccaaccaacaaggta

SEQ ID NO: 39049 - DNA, 905 bp, Bovine  19866881583456
atggatgtgagagttggactgtgaagaaagctgagcaccgaagaattgatacttttgaactgtggtgttggagaagactcttgagagtctcttggacagcaaggagatccaaccagtccatcctaaaggagatcagtcctgggtgttctttggaaggaatgatgctaaagctgaaactccagtactctggccaactcatgagtagagctgactcattggaaaagaccctgatgctgggagggattggggacaggaggagaaggggaagacaggatgagatggctggatggcatcactgactcgatggacatgagtttgggtaaactccgggagttggtgatagacagggaggcctggcgtgctgcgattcatggggtcgcaaaacgtcggacatgactgagcaactgaactgaactgaactgactgtggttactctgttgtacatctgaaactaatacagtgttatgtttcaattacaccttaataaaatacacatataaggcataaaaaagttacagcatctttcaacaaaattaaaattctcagcataaggtagagtagtgagaaaaacgtctccgcagtgaacatgtctttgagtaaagcctccagcatgttggggacagggcaaatgctaagaaaataatccccaaatgggctaatattctgccctttactctcagacccagaggagccaagcagtctgagcaaccactattttcaactgccaactttttattatgcaatggatctaaacacacacatggcagtcacgtcagagattaaaagttgggattctgaatccagggtgctagtgcaaacaagggaagagctcttctttacagaagaacgccagctagtaaacagaatgaaaaaataatacacacggaagacagattggaaaaatt

SEQ ID NO: 39050 - DNA, 1680 bp, Bovine  19866881723413
agagaggaatttcctatattccctagaaaaataatacaggattacacactgtcagagttatttctgtatttaggatggtttatgtagggtggatttcctgaaagtagaatcaccagtccacgggacatgaacaaaatttttgatgagaagatcagacctgttgacctcaacagttgagtctgtagctttttacttccttggagtaatctttccttgaatgtgtcgtttattggctatacttagtgaactgagttttttagaactttagttctttgattctcttttaagagaatcatctttcctcttgattgggtgcctagatttgtgctagaatctgaaaaatggatggcatattctttcaaattagattgttttaagttagtacacatagaaacttggggtgtggaaattctttattcatggcggtgtgaacttagtttttccaaagttccttctttcaatcccatgcccccatcctacataaaagtaaacatccatgtgcttcttcctgcccttgccctaggctttcttgtatttggtttggttttggtgatggaccagcattcactctgcttaaaaccggaggcaagtgctcttagctccccaccccaggagctccctttcctctgtggccttggggagaatggagaggcttagattcgaagccattccacagtcactcacctgctctgactacacctccttcctcaccagaatcggaggcgcttcctgtgcctattacatattgggtggatgtaggaagcctagcccagtgcttgttattcctgtgggtgttttcatatgtaatgcagacggttatgttgctgccttttgctttcagggaaggaggaacttgtaaagaccctgtgtctttacttaatctactgcggtgttgaaaatgctgtgtgcagaccttggtatttccgagttcttcaaggattccctttaccccttatagttttaaaactgagttggttgcaccccatggtaacattctcctgagccccctgttcaggaaaggtgggctggggtgtgggttggaggggtggcatgtagcaaaggcagcaatctaggtgaagggagaactttgaaaagcaaaatgcgtcttccctaaaaacaattaatcatattattagacaaacggcttcagcagctggtgaaacagcaggaacatgtcaattttgcttccttagttacccagagtgatcgtgcacttgaccttcagcagagcagggtcatagagagggcatctttaaacagctctgtctggttttggcaaatggaatctgcactggcagtttgaagcacatgcccatgagttccccccatgaacccctggctcttttggttggactgtctggctggggaagttgctgagaaaaaatgtaaataaagctgcagagagccgttggcatggtaagtgcagtgtcctgcagaaaaacaagagtcatttttgcagccttttcttttcgtctgtttctggagggagccttcttgtgatgcggtgtgtttcacaggcacttgtttttcgagcagttggtgaaatagccgtggagttagatgcctgctgtgtatttgaaggaagctgatttagtgtctgttctgtgcttagcgcctagcaagttacttcttcatgggaactggggtgtgggacgtgctgggtagattcaagtggggcaa

SEQ ID NO: 39051 - DNA, 843 bp, Bovine  19866881874047
cctgaccaagagcggaaccccaaagagtgatctcttttctccagcacggtggtccagggagcaagcagaaagtcagagtggcatcagggtgtcatgggaggcagctgggctgggcatcaggggacagcccctcatcccgctcatccgcacagccaggcctggccatctgcctgagccgcctttcccctcctctctgcagccaagctcttccctccacctccaggtctccatttagatgccacctcctgtgggaagccctccttgattccgcaggttggaggtgccccctccaacctgaacctttggctgaacccatctgtctgctgcagggggccagacagggtctgtcaaatccccgtagtgtcttcagggtgtagcaaggcgcctggcacacagtaggccctcagtaaccgtatgtggaatgcgtgtggtaacggacgcccaccagaccctctccccagagagcatggactcgtttctgggggtgaggacggcatctctgggcccaggggaacagggcaggaggggtccaggactgcctgtcagggccctctcctgcccgcaggccgagatgtctccccaggcctggcccgttgtgttctgtcctgcccactctgcctgcgattcattctcagcctctggcacaccgggccgacccagaggccacaggcccccgtgctaagtttagtgactgcaaaatgcgcccgtgaaattccaggcagagccgggggctggcggcacattccaccagctgccttaggcctcccgcttagcgccggggcctgaagggaaaccaagtgtccttccagtgagtggcttggaaggactgggtcacccccccgt

SEQ ID NO: 39052 - DNA, 1483 bp, Bovine  19866881927317
ctggccgggggtgtcccccgtctggaccttcgtccaggggagctgggcgagggtggtgcaggccgaggctgtaagctccccccagctcaggctcacctgtcggcagggccgccgggccgcacgtaggtcaggacaagtgggcgggacttgtgcccgtcttcatgggcacctcctggacagaatttgacaagagactgcagtcatccacccatcgctgcctggtgcccggaggccccgacccagaccttaagcaggcttccttcatcccctctgctccaggactctgtccctgctgttccctgcccctcctatgagacatgggctctaaatcccatccagaagtgggacggaaagtagggaataaaaccaaagtcctctcttgattaaacagcttgctttctctcctgcagtctcatccagtttcccttttctccctggttgctagggagctccgaacttaactttctgttacaacttttccctttcacttcctcaatcatgcacacttggttggccaagttttccatctaatacttgatttaatgatcctggttcttaaagttcagaaaaagattatataaatataaatatatttatataaacatataaatataaatgcaaataaatatataaatataaacattattatatatagttatataaatataagctatatttaaaatataaattatagttgataaatataatatagatatatcataaagatatatcaattacatatttgtaaatatatttaaatataaatctaaatataaattatattaatatataattataaaatgtaaatatattaataaatataaatttatttaagtataaatataaatttaagtataaatataaatttaaatataaaatatatgtatttatttaaatataaaaatgaatttattttaataaacttatgtttattttaatataaacatgtttatttatttaaatttaagtttatttaaatttaaatatatatttatttatctaaatttaaatataaatatattataattcatcagagcaaagcaaaacacacagaattggcattagccttcccgtcccttgaccccaaaggtgactcttacactgacctctgaggacaaagccaaagctattgccctccttgaggagggagacatccactgtctttgaaacgatccctgggttgttctcgggggctggggagaaatggagaccctcctgagtccttgggtcgcatcaccgagctggcagccgtccccagagttcgttccaggacaggcgggtcaccagtcgcagatactacaggaaaggccaacccccccaccccaccccatttgacaggcaggacaagtgaggcttagaggcaccctcccccctgaagcccactcagtcctccacttagagaagggacagggccggcccgggctctcacagagacaacagcaggactcaagcctgagtccagggctggcagtcttaggcccga

SEQ ID NO: 39053 - DNA, 866 bp, Bovine  19866882051395
taagatgggataggaaagaagaaaagaaaatagtgacgtggttagtagtctttacctgctgaatgtaaggcctgcactctttccagatactcatttattttttcttgaatatgttctaggcttgatcctgccatctcagcataaattaaagcttgtgcagcttcctaaaaataaaaaaagaattcaaaagactctaacagatgaattacaatttgaattttctataccactttctaactcatggttggtttctatgaatgataaaacaagaatgtctttaagatactagaaatttttttcataagataaatgaataatagtcctttactaaacttttttcagttctcaatgctctcaattttctcagactgttgaaactttacaaagtcaaatagaaggggttgattttaaacattttcttagaataactgtgatttacgttgttttccttcttctcagtgcagtaggtcagacgaaactacttactgtgaaaaggtgatctgagtcctgagagcattagaacagacaatactcataaatatcaacaaacgattataaacgttaattgtctcactatggcaagaaaagttttttctccaaagaaaccattgtcaaagggggacacattttaaggcaggtttcagttgaatgaaagaaacttattttaatgaagaacacctagatccattttccggttattccatgacctcctcagccagtcaggctgtgctagtgaggaaaagcctccgttctcgccatcaccatttcaggagggtgaccagcgctaccagagagactccccccagcaccaccaccttccctgcagccatctaaatggatgcatttcaaggaaccctaggtctcat

SEQ ID NO: 39054 - DNA, 803 bp, Bovine  19866882194336
tggtggcccgctacccttcgattctgcacattgagctttattaaaagatatactggacacaaagaagagctcttcaagcatgggtacttttaaagatcaacataaagcaatcaccaatgcatcccacctcgggtgagaaataaatcctgccccgccccaaggccacacgactctccaaaactgctgttctgacgtatactccctttggggatttgtgtagttttacagaaaaaaaaaagataaagcagtggttttacttgttcggggtccccaagctaggcaggtagtgactttggttgggcttcaggtctgtctgcccagcaaggtggaagccgaagcccagagcccccggagggaggcaggcagcgggccatgcaggggacccagctgacctagtgacgcgcggagtttcctaatcaggattcctcagggcctggggagttacactggtatctttcgctgggggatgtgcaggagtgggttttagggggctgaatgggaggggcctgccaagagacttctgtgctagaggcacctggctggcggcatagctctgggagctggcagcccagctggggaaccccacggaagggggatgcctttcaaacaatcatttttcaactgaatgaacaaattcttcccctctcccatccggcaagggtgattcatcctagggtgaaaaatgaattctcccaggaggcgctgctgcccgagacactggagccatgaatttactgcctgccttctgtccctgatggaactgggtctcaagatttacgtctggaggtttacgggcagctggg

SEQ ID NO: 39055 - DNA, 762 bp, Bovine  19866880410857
attctgtgaacacacagaatgtaagctctggtatctattcctcttcttacaaggacatcagtcctattggatcagaacttcatttaaccttaattacccacctaaaggtcgtatctccaaatatagtcacacaggaagttagtttcaacaaacaaatttggaggagcataattcagcccatcataagcacttgctatggggcaaactctgtgataggcactaacatgaagtgctgaaagaggcagtcactatcgttcctgagagagcttctagactagctaggtgggaacacaggaaatagataattgcataaataaacatttctatcctagtgagcacatcttgggaaaagaacaggttatatgcaaagccctcaaatagcacttgtccagaagctttggggttaatatcaaggttagcaagaataatgctatgaataagtccctaattcaaagtcttggagcagattatatatagtggacaaagaaagataatgagctgcaaaatggaaatacagcatttttttttttcccccttagaatagcattgtgtttccatcccacatttggaagtgcctcatttaatgtaaaaaatcatgagtgaaggagttcattttataacttttttttttttccccaaagaacagattatggggctttcttcctagttatttcaagccaatcattctgttatccaaattcagtctttgtcatgagaaacaatacaaaaggaaggagcctagtcattttaggctcttaagca

SEQ ID NO: 39056 - DNA, 1258 bp, Bovine  19866880422235
ttcctctggcaactcttgtctctggccagtgttggctgtccttgcctgccctctcttacgagagttgttaaaatgggagcatggctcacagtgattgatggcctgaatgctgatcattccctacctctccgggctcacggtaaatatttactttttgttacacaggaacaatgaggtttcatacaggagatggatgtcgggtgtatatataatattatgcttgtctgactcctttgaacacccaactctcatttcccaggcttactcaggcaagggaagcagacactgcagggtgagctgtttgacttttcagaggacactctgaaagtttgcaagctagatggagtttttggtctttttttttttccttactgaaagactaagaaacatgatctctcttaataatctggtcaggagctactagctatccgtgtatcaagaattctacttgacccaatattgtccgtaatattgattcacatttttaaatgttaattttgttttttattattttattatttttatttttacatttttttggcgtgctgtgtcttcgttgccatgcatgggctttctctagttgcagtgagtggggactactctctagtagctgtgcatgggcttctcattgaggtggcctctcttgtggagcttggcctccagggtgggcaggcttcaatagttttggtgtgtggggttagctgctctgcagcatgtggaatctccctggagcagggatggaacccatgtcccttgcattgacaggcagattcttaaccactggaccaccagggaagtcctttaacatagatacataatttagcttaaccgtaagccatgacgtcccccaaatcatggatgccctgtggttattttcctaatacttattgcaggatgtatgtaagtgtgagaatgcaaaatgctccctcatgtccttgggaccgtgttactaggactagttgacaggtaacttgtatgcagctctcagcgctgccacgtccttgctcagtgaccctaggcaaatcacagctcttttggggaccctttctctccatctgcaaaatgaggcaggctcttaacattccatctttctactcttgtgttttgtctttccagctcaaagtaatgtttataatggagaagagttcatataggtagacaggctaatctaaaatgttttctcacttacataaaggcaatttccaatctttatcttgagattggggagttcttgtcattcatctattattgctactca

SEQ ID NO: 39057 - DNA, 2025 bp, Bovine  19866880466417
ataggtcttttgtttctttaggtagatttattcctaagtattttattctttttatctcagtggtgaatgggattgtttccttaatttctttctgttttctcattgttagtgtataggaatgcaagggatttctgtgtgttaattttatagcctgcaactttactatattcattgattagctctagtaattttctgatggtggatttagggtttgaaagactatttgaaaatatatatatataaaaaatcagaaagaaaggaagaaaacatattggtcagaatggccattatcaaaaagcctacaaacaataaatgctggagagggtatggagaaaaggggactctcctacactgttggtgggaatgtaaattggtacagccactatggaaaacagtatggagatcccttaaaaagctaaaaatagagctgccatatgatcctataatcccactcctgggcatatccaatgaaaaccatactttgaaaggatacatgcaccccaatgttcatagcagcactatttagaatacccaagacatgaaagcaaacataaatgtccatcaacagaggaatggataaagaagtggtacatatatacaatggaatactacccagccataaaaaatgaaataatgccatttgcagcaaaacgggtggacctagagattatcatactatgtgaagtaattcagacaaatacaaatatatatgatatcacttacatgtgcatctgaaaaatgatacaaatgaacttatttacaaaaacagaaacagattcacagacttaaaaaacaaacttatagttaccaaagggaaaagttggaaggagggagggattgggagtttgggcttgacatatatacactactatatttaaaacggattaccaacaaagactcacagtatagtacagggaactctgctcagtattctataataatctaaatggaaaaagaacttgaaaaagaacagatatatgtataactgaatcactttgctgtacatctgaaaactaacacaacattgttaacaactatactccaatataaaataaaaatttaaataaatataaatgacagtgcataagatgtctattactatagtcacagcaatgatttgctagtcatctcactgttcccttaacaatgttctactgaatatatgctttttttcaaataccagtaagctatcctatcttaccttaattttatttcctaattaaagtctctaattgcatgaacacaagtttaacaactgtactataaggtcaagaggaaagaaaaatgctcttttgggcatccctcgatttctcctctagttatcattttcttccctcgagatagatttggaccattctcctggaatgtggcttgactctctgtcctcagcatcactggcaacaattctcaaagctgccaatggcagttgtggacactcattggaaatgacagcagacttcaacatggcattgacttgcatgaagtttttctaatgcttaaggagtttggtcatgtgtcagagctgctcacgttaaatgatccattaggtgtcatgatctccagaaaggtcatctgtcacattgtaggccagaagtgtcacctctgtttaatgtgataggaagccgaactcccaaactaactagagagaaattggcatatgccactgctggctgatcaaaaaactgaggctctcaattcacacccacaattgtgcaaatgaaagttccccactttaaccattgtataagctaaatgtttaatagagtctatgacttaatggccattgaattttaatagttacagtattattagcttaaaatattcttataatgaacataaagtaattcatataatgagttttattatgactaagggtgaaaacctttttttggcagagggtgggggggtggctacaaaatgagaattttggagagtagcaagtgaaagtactaagctgagtttactaaacaagaaagattttttaactgtaaaaaagtccaagaattcattttcaggtaaggactt

SEQ ID NO: 39058 - DNA, 1542 bp, Bovine  19866880499067
atatgcagatgacaccacccttatggcagaaagtgaagaggaactaaaaagcctcctgatgaaagtgaaagtggagagtgaaaaagttggcttaaagctcaacattcagaaaacgaagatcatggcatccggtcccatcacttcatgggaaatagatggggaaacagtggaaacagtgtcagactttatttttcggggctccaaaatgactgcagatggtgactgtagccatgaaattaaaagacgctcactccttggaaggaaagttatgaccaacctagatagcatattcaaaagcagagacattacattgccaacaaaggttcatctagtcaaggctatggtttttccagtggtcatgtatggatgtgagagttggactgtgaagaaggaaactgtggtgttggaggagactcttgagagtcccttggactgcaaggagatccaaccagtccattctgaaggagatcagccctgggtgttctttggaaggaatgatgctaaagctgaaactccagtactttggccacctcatgcgaagagttgactcattggaaaagactctgatgctgggagggattgggggcaggaggagaaggggatgacagaggatgagatggctggatggcatcactgactcgatggacatgagtctgagtgaactccgggagtttgtgatggacagggaggcctggcgtgctgcgattcatggggtcacaaagagacttgactgagcgattgaactgaactgaactgagactctcagagttcttagctctaaacaatttaagaactctctcccctaaaaattgctaatctaagaggcttccatctagaattgcactggcatttactgtttccccaaccttgttttccaccagtgaggactttcagtggcagaggtctgacaagtttaatatagaaaagaaaggagtgaaaagtggtggaatataagacagtgtatcatttggagggttaaaaaggggatagtctggggtgaggcctgttaagtaaatagttgacatagttgactccagtagagcaggcagacagagttgacagacatggctgactccagtagagaaattgggtctgtagtattatatatgtttccttccatctccagggaggtcttcaggaagttgctgatcagctggatttgcagagaattggaaggcagcaccaggcaggctcagactcactgctgacgggaatggcattcttcaggatgaaagaggtaaggcaaaaggctttttggaaatctatagtttctcttggaagttgatggccaccttgaaagcaggggttttttgtgtgtgtgtttgttgtgcatatgttaaacacactatgatttgagaggcaaagaaacattctgaaatggaggttactcagcatactcaagtctagaagtgtactttgtgttccttgcagtgctcatccttgcaattatttgcttttcttctgatttctgtaatatgaacacatttgttaaaccacccactcattttatgctgagttctattatcaaatgtcccaatctga

SEQ ID NO: 39059 - DNA, 3375 bp, Bovine  19866880541732
ctgttgtaataatgaagatgaaagataaaggtggcccccactgatacagttccatggtgatacaaagagtagttcagcatgatcagccactgattaggtgaaggtggagagtgaatgtcaagggtgattgtgaggcttctggcttggacaaaaatttgaatgggagtaccacttaccacaaatggggggattagagtagaagcagtgtagaacgagttgcacgtgaaatacctgtgagtgtttcaaggcatgatgtccaattagttatagttaggtaaataggtctaagttgaagaaaattaaatggacttaagttttcaatttgggtatcatcaccaatagattaatggtaactgaggcactgtaaagagattaaatcaacccagaaaaaatatatagcaagaggcagggaaagcccatgatgaatacaaataattaaaagatacacaggatacgcagggaaaaggtgtcagagagaagacatggaagaagcctaagacgtagaaggaacactcagagttcaagaaaagcctgctgagaagtcaagtaaaacaagggcagacaatcagatcctttggatttaagcacaaagaggtcacagataaccatggagaaggtgtttttcatggattggtggcatcagatcccagttatgctataatgacacctatgatacacatctcagcataagtcagtctgtgggcctgctaacactccttcaagacctcagctctgacctagaagctataggatctccatctgtgaccttatacagcacttcatatgcaacaaggctttcaataaaaacttgtaaataataaaatgctcattggtgtttccactttttaaaacctcatttggaagcacagtgaagtgacttatgaagagatgaaaagatgttcacagctgctcactgaccttgggtggcactggtctgtctccccctcatttccaggcattaaattaatcatgccctctcttcccacctctactcctgggtcaatgactaaggtatttctggtctaattagactcctaaatgagctctagaggctaaaggcagggcctggaccaaggaattcactgtgtcctcccatcttctattaataactagctgtatttcgttgatgctgcaggagaggggtatgggggtggggcagcaggggaactaggggttattttgcttccaattatttctacctggcctcttttgtgacctctgtcagagggtgaccgctcatcactcagaggacacagaggagagccacatcaggaacaggccaagtagccaccagttattaagcactttccacaagccaagtatggtgctgaccttctgtcagaatttcttcaaccacatcacaattccacccaaaatcctcattggctccacattgtccaaagaataaacttaatttgcttctcctttccatttaatgcctttaattcattccaaacaatgcaaaacagaagcccatacaaaaagatgcattaggttaaaaggctattatcagattacaaaaatatttgtgagctggagcatcctattgtttgtacctctaacaaagaccatcctaaaggaatgttctaactaagtaatacagccaacaagttctctttttctggtgtaataagtttattattgtggcactacccatattttgttactatgggggctcattctagtgagggattacacagtctacaatacctattagctcataaagagaagtaattataagcttaaacacaaaagggaaaagcaagtatttagtagggagtgctaagcattagttactaccgtggattactcaaggagacctcatcccagggtgtttttattgcatttcatttgcaaaatcactcctcattacccattctgtgaaaactaagttggagcctttgtgttcatttcctagttggcatgttgtcacactttgtcagcagagggagctgacgagacatttgagcaggaagggggttttctgcttggcatgctcactgggcaggcttctgcagctggggtggcttccccgtgctcagctcctgctccagcctctgacttgcacagcatgcacagattctcccatctccagctgactgccgagcatcagcttccccagctcctgcagtacaggcagcttcctgaattctagccaactgtagcccacagtggtcagcagcacttgagaagtcctgcagcagagtgcctccagggagataccttgctgtgacagctctctccagctccaggaaggggacactgcctacccatgccagaggctgatttctagcaagttttgccagcacagcaccacagcaacacctcgccattcactgagtcacagccgtgtcctcaccagcaggtctggctctgtcaggaggtgcaggggggctcttactcaaacaccagctcagccccagggtagcggttgttcctcgtatctaatgttcctaccttcttcagggttccctttactcctactaagcaatctctcattcccctgaaagtgaaaatgaaagtgaaagtcactcagtcatgtctgactctttgcgaccccagtccatggaattctccaggccagaatactggagaaggtacctttcccttctccaggggatcttcccaaaccagggatcgaatccaggtctcccacatttgcaggcagattctttaccagctgagccacaagggaagccccttaacctcccacaatagctggtaattcctcatgataaactttctttgttcaaattaccatgggaatgctgtcttctgaatcaatatttgactgatacagcactaaataaccacgcacatgcacacaatggttcttaagttgtgaaagtgggtttaaggttctccagaaaaaaaaaaaatcaacaacaaaaaacttttgctaggctagggatgactacatttttatcctcacaatagccccataagacgaatgctctgtccccatcttatagatggggaattgacctgcagaatggtaaaaagccatacacaatgctatcaataattaataatagcatcaagaagacagctgtgacaaaactgggtgagttatttgccaaaattaagattactctttttttccctctgagcttctatcataaaaggcaggagttaaacccatttaaacacatggacatcaccagatgttcagtactgaaacaagtttgattatattctttgcagctgaagatggagaagctctatacagtcagcaaaaacaagaccggaagctgactatggctcagatcatcagctcctcattgcaaaattcaggctcaaattgaagaaagtagggaaaaccactaggcctttcagttagacctaaatcccttagataatacagcagaggtaata

SEQ ID NO: 39060 - DNA, 1051 bp, Bovine  19866880553956
tgatgccatccaaccatctcatcctctgtcgtccccttctcctcctgccttcaatctttcccagcatgaagggtcttttccaatgagtcagttctttgcatcaggtggccaaaatattactttatagcaagtcaggcttgctcttctgaagttacagaaggacagatctttggcctagcgtaagaagcagaaggggtagcatgggtcagtatggcaaagcagtgagcctcgccttagttctattacaggattggtggtactcctttagttagaaaagtccatcatgcctttcctcagagtcagtaaaaagttcatatgtttagtttccaggacatagttagcttaaatgctttgtcctaatgtgtgtctaaagagatgagggtattttaggatgtgtctatctcatagcaactgaggatgaactataccaccatgaagtaggaaattttgtctttcgcatctgttaatttgattcaggaggaaaaatgctgttatctaggtaatttagcttctttatgtaagtttactgatttgcagacctctaccagagaaatgaaacaaaattgttttagttatagcctgtgaggtggcacagtggtaaagatagacaggagatacaagagacgcaggatcaatccctgagtcgggaagatcccctagagtaggaaagggcaacccactccagtattctttctagcctgggaaattctatggacagaggagtttggcaggctacagtccatggggttgcaaagagtcagacagaattgaatgacggagtatgcatacacgccccaatacattctcttgcagtgaaaacctaaaaagataatgggtaattgcaaaggacgttgggatgttgtgtccttcttgccagtctctgtgtgggaaagagaaaattgggagtctatcttgggagcccctgctctcagcctttaggaggattttccaagctggctctgtaacctgacttctgaaattggcatttggaaaaccccagactagtatctaactagttaaactgtattcatttgaattttgctcgctctcc

SEQ ID NO: 39061 - DNA, 1605 bp, Bovine  19866880644031
atgttccatgaggcattttacatcctcatcattattttccctttcctacttaaattagctccaattggaatcactcatttattcagtcctcagccatttgttgaacacctgagctaagccaggtgctgtccttggtgctggagaaatggtggtgaacagtacagacccattcttgatcccatggagcaatcggttctgttactcaccacccagaacacctaggatagaccctacacctaccacaatatagagaaatgcactcacagaaggaaaagttatagagaaatatacgcagtttatccaacatctactatgtgctaggcaccctgttaggtgctttatatgcaccttctctgacaacagccctaggaggcaggaattatcatcatcccctggctcaaggacacagaggattcacacctgagcagtctgaatcttcacagctgctaagagaaaagatagaaagtgacagaacataagtagacactggagaaagacacatactcacaaactcatttacattcacatgtacactcaaacacacacacacacaaatccagaattcaggccacctatagcagcacagacctaggcatatcttgttctttgttaggtgctggcctctctgcttcatctctatcctataaggagacaaaaatcaactcctccctcttcagaaacactcttgaagaggaagcaagcttggtaatactttaattggacaaaagccttccaaatgtggcctcctgagcacagcagggatccatttccacctgccttttagaaaatgtgccctccctggattgcacatgaatgctcttaggcaaatgccagagaatcactctaaaaactttctcccagcaggtcagcacttacccactggacgcctcctcaggagccccactcagctccatcccttggctgctccctgccaggcccaggagagcagggagcagcctctgatccaggtggacacagatgtgactagtccctgccaagagcccttccccccaacctcagctcagggtgggcaagcaaaacacttaaaggctggctgaggcttcaagcctgcagagtccaggaagaatacaataactaagaggcagggtacattccagcaagagaggatggggaaacagggtaagagacaccccttgttagcttccacatctggaaagctggagttctcacatctgccttaacctcaaaacagataccatttattgagcacaggcactgtgccaaccacatttgcatgttattttaaagaactctagtagctagagaggactgtctccaatatacaactgacaaaactgaggttgcagaagataaagctggttcacataactaatcctggttcacataactagtaaataggagaaccatcactttccaaagtccatgctgtcagccactagctttacttgtgtttgagaggatgaaccaacagtgagcagaaaaggacaaagccaccagtatgtcttcataatttgccagtagtcagcctgatctagcggcaactttgattcctcccctccccacctccatccccaagcctgaattattcttctagcccagctgcagacttcttaggacaatttt

SEQ ID NO: 39062 - DNA, 934 bp, Bovine  19866880656493
taggatataaatgccaagtgtgtaaaagtataagctagtaacccaattttaaataattccagagtttagttcctcctaaacacaccaaaaataatgttatccacaactcaaagatatttaaattatattccataagaatagatgcaaaaaaacatctttcattcttgattgggttattttttaagtaagtagaagctttcatttcaattttaaaaacatacttggccttcttaatccattttggcaatttccatgattattaaaaaacaactcaaaaaattcatataatcttacaaatgctaaataattttatgtccaaagtaccttcattgcctgaagccatttttcacttgaatatggaattgaagagggattaattaatatttctttaggacatgagaaatttcttcttgcccaaatatatatgttttccccactccactctcatcaatattatgtttctcttatcttctgcccagtgcccaaatcatttgcctcattgcactatcacaattagaaatcacagattcatttgtgtatttcttaatctgactctcatgaaacagtaagctccacgaggaaagaaattatgtctaattttatcctagcacagtattctctgtaacaagcccaatgactaccatttaataggtaattaataaatatttgctgaataaattaatgaatgttagaggaataattaaagttttatgcttttcactgaactccaagacaaggtaacctttgggttcattttaacatctaaaaccaatccacctaagtcagctacttccaaagggcatttgaaattatttgcacaccctcagaattctacagagaaggcaatggcaccccactccagtactcttgccggaaaatcccatgggcagaggagcctggtaggctgaagcccatggggtcacgaagagtcgga

SEQ ID NO: 39063 - DNA, 1822 bp, Bovine  19866880658241
ctgaggtccagttgcagtgggctgagttgaatggggcgtttgtgtgtgtgtaatgggaacttgatcccagaactgttgccagggtgtcctaaccctgtcctgagtagggtatgagagaggctttaggggacaggaagggacaaagcagcatctggttccctcatcccctggtgccaggagcaaggatggctgcaggctcacagctccctgccaccttgtcattctgtattctgccagggccaccaagggatcatgtggggtgcctgtccccttccattggagaggaccattggactccccaggaaccctctccagtagcttcttccctctggctggcctgcattctgggaagatgtattttttccttccttctgtgaatgcttggacccattgtggataacaggagcagttgggggagccctagtctctgtggctctgcttttccaggaagctgatcttcccctgcccttgtagggtcatcatcagagtgtgtggctgaaggagcaagatgttagatgtgagtaggagtcctcgggcatagcagaggactgtctgctgaggggatgaccagtgtggaactacagctgtttcttagtccatcatcttcggaggatcagggatgctctcagagactggggtgaagcccagcaggatcatgtgtctcttgtaggccttgatctgcttaaacacagtgtcagtcccatggaggtagtccagcatccccagagccgcatagcactggttgaccctggagaagacgagagggtgctgaaggctggtgtgctcatgtccattccacctgtgcccacctgagccttcctgccccacacctgtccccaccgtgcccaccacctgcttctgagttacctgagtgggtgtgcacagattgctgggcccctccagagtgaaaatcgatgcttttcctttgaaaagttctctctctgatttgatgcatacaagtcagaacctccagcagagcctgcttgttgaggtaggttctggaatcccatcagattcccctggaacacttactaaatgcagttgccaggccctgtttccccagaggctttgattctgtgtatctgaagtggaaccccagagcctgcatttgaaaaaagcatctcaggtgatttctgatgcaggagggtcctggaccacactgctgagactggaggctttcagaaagcgcacagctccccttgaattacctgcaggaattgtatgcctacatgcatttttctggtagtgcccatagcttacgccatacactcaaggggtccaggtgtaaatggagcttaaacagtgccaaggaagatccagtgtcagaaccaaaatggcaagatgatctgggtcccacgatggtggttattgtgctgaccccagacgcctctccctccactagacccacatttacactgagacaccagtgtctgctgtcaggagctccagaaataaaggtgagtgttaactgcccagagacccaaagtggggagaggtgccttacttttgatggtggtagtcatggaattcaggtgaaggcaagaaagtaggtggtagccacagtgggagatcatggtgaagatgaaggccaaggaaatccacatggtgatggaggacaagtgggagcccattactattggacccagtattgccagcagcatattgatctgcaaggagagagctgtctgaaggggggcctgaggggaggaagggaaccaaggtagatgtccccttccccccgagtggtaccaggaagacttcctgactcagatctggggaagatgaatgaatttctggaccctaatttactgtagtccttcag

SEQ ID NO: 39064 - DNA, 1521 bp, Bovine  19866880683509
aacacattttgacatcttcctacaatgaactggtgctgcttgaataagctgaaaagatctccccttcaaaagaagttaaaagactcaacacataatagtatttcccatcccttttgataacccagagcctgagagcttcccaatgcccacagagagtggtccccacccctcccactggctgggaggccatgcccagaaaccacaaggtcagcagggctctttccagcaggctgcacgtggcctgacagagctgaagaggaacatctcttgaaggaagaggtgccagggctccccagcagaatcagaagttccagggcctggctcatacccactgagggtggccagggcgggcaaagctgggacctccaggctgggccaccagggcctgcagagattcctgctctctgaagatctgtgtgggtcctctctctcccagaaagtttttttcaggtgaagtacgtatatttctgtggtccaggagaatgcaaacccagatggtaagtaaggcagaagtctggattcagtctgccatgggctggaatcccaccaactacaaagcagccttgagcaaattcctgaacctctctgaaccatggttttctggtctgtaaaacaggatcgggactgtaggaagatcccaagggaatgtgaatattaaccaagatcatgaattagatgtgtgtgaggtctttgttcatcaggagagaagtggaagctctggacaatctggcctggttccctggggcatgtgtcttcaacaaggcaagctacccctgaggtaggtttgaggacccccggctaagcccaagggcaagataaaggcacatcagcaaaggatggacaatgcattcatgagcatgggatccaatccctccatacaagttgttagagttgaaggtccagccaagagaaatgtgagagccaggctgaaatcagaacagggatctctcaactttcagctctgtcagttcactctgaccccaccctgaagttcttacctgaaataaaaaagccactctagtttccgacaagtcaggaacagaaaacagtgacaaagagagaccacatcgagctcattccccatctccaggccttaccatgcctgagcccatgcgactcccccctccccctcaaggatggggcctgggacagggcagggaagttggaaaacactcacactcctcctggctctggggccaagagactcctggacagtatgagaaaagaggaggaagtaagaaatagcaatcagaaaacttcctcttaaactgacctagtctggaggaggcaaggacaggacattaagttagtcaaatggcccaaggcactatgccatcatctcttcctttccatctcttttctggataactgccgcagttcctcccggggtttccctgcttctaacttggcctttctgccccaaccccaatccactctccacagaatggaaaaatcagctcctgccacctccttctttgctttcggaacagcacccaaacttcttaagcggcctccaaaagc

SEQ ID NO: 39065 - DNA, 971 bp, Bovine  19866880706290
cctatcggactgcaaaaactgtgttctttcccatcactgagaaaacagggactggaactgtttcaccaactgaactggatctcacaggactcaacccagcttctttctagtcttctttccactgactgcaagacctctccatccttatttgctgaatgagtgatatgtcagagcctggggaaagctatgcggaatatctttattggtattaccccttcggaatgaaatggaccagtgatgggacaatgtagggctgtgtgtccagtgagaggacccagaaatgggttgttctttgattaggaagggggggtaatgggaatggaagggcgagtgggaagtgatgaccagataaagagaggaggaaagtatagaaaaataacatgaggtcaagagtgggaaactagtatcttgaaacgtgcaggctggttactaacagtgagtcagcatgaattaaggaataagattcagggtgagagaggctaggtcaaacaagtgatttctttcgtggtttcattgggggctaaaataaaaacctcatcattaactaaacacaacactaacatgaaggggtgaaataatttatccttaaataacaggctgacctattcagaattgtaattttaatgtaagactaacctttgaaaatagatcaagtgatataaattattaaggataagacattcatcagatagatggtgtctattagcaattttatgcatgaagagttatctcctggagtacagttggggctgcttctgcgaagaaaaaaatgaagaacccagttaccctttcgtgacatgtgcagctgattttaatctgtatttctcctgtcaagtgaaatgaaaagactgaaatatgatctcttctgtggatgtgcattcgctgcctcccacctccttcctggcagctctaccggcatggagaagatggagatacacttttcaagcagtttttttttttttttttccagt

SEQ ID NO: 39066 - DNA, 852 bp, Bovine  19866880717426
tgaaaagtgaaagtgaagtcacttagtcgtgtctgaccctcagcgacccccatggactgcagccctctaggctcctccatccacaggatctccaggcaagagtactggagtgggttgccattgccttctccgaataaccctctgaagtaggtattattatggagcccattctacatatgagaaaacagaggctaagtggctggtgcaaattcattgataaatgttggagctacactcccgactcacagcagtctgatttcaaagcctgtgttattgacagcctgactgttctgctaggcccgcaggatgtgcttatctgtcgtccagtttataagtgcctttgtcagccacaaacatataatttctgtgttacttaaattgtttaaacaatacctttcccaatggttgtaggatatttctttcgaagataaagcaaaggtcaagctccctacagaaatcctaagcatgtaacattccagctgagtccagacagagtaatgaatgagccagactctggtctggaactctggtatcgtactcaggacattccccttcttcacctataaactgactccactgcccactacgaccaatcaagatacacgctcacttcctgggaccaacttcaaccagaggggagggcactgtgtggacaggaaaggcggccaaatatgatttatctcaaaagaatgattacaattatataattaacaccttgtacccagacattttcatctctaaggatctctgagagtcttacagattatttaaatatatatcacatacattgctggagacaaagtctatagtttcagaagataattaaaattccttccccttggaattaagaga

SEQ ID NO: 39067 - DNA, 3323 bp, Bovine  19866880792018
ccaactttttcactctcctcttttactttcatcaagagactctttagttctttgctttctgccataagggtggtgtcatctgcatatcggaggttattgatatttctccctgcaattttgattccagcttatgcttcatccagcccagcatttctcacgatgcactctgcatataagttaaataagcatggtgacaatatacagccttgacgtactccttttcccatttggaatcagtctggctttcagtcttattcttagagtagccttaacacttctccatccatacagcacagatgataaaacatcgatgttaatggtgaaaaaaattatccacagtgagggacacccagagaggctctcagagttacatggagaagagaagaaggaagagggagatagaggtgaccaagaggagaagaggaggagtcaaaggagagagagcaatctagccagtaatcatttccctatgtgctctccagagtctggaacacccagagagattcacagagttacatagagaagagaagagggaggagggagatagaggtgaccaggaggagaagagggggagtcacaaggagagagacaggtctagccagcaatcagttccttaagtgttctcaacagcccagaacacccagagagattcaccgagttaagtagagaagagaacggggagggaggagatagaagtgacctggggaagaaaagggaaagtcaaaaggtgagagagcaatcaagccagtaatcacacccgtatgtgaaaatggatactgaagatgagattcttaaaggtgcaaaattgataacaaatactgaaaagcaaagattaaaaatctagagtagaggttagactctcaaaaatacaatgttataaatacaaaacaaaatcaaccacaaaaattattaaaaaaatatatatgaaatttgctttaaaaatagggtcttttttggcaatgtaatagtagattataaaaataaaaattaaaggagtaatataaagaacttaaaaattaaaaaatggtaatagtaaaaatatatctaggaatttctctggagttgttgagggcagtgtggagtcagttcagtttcagatagttccttgttccagcttgtacttcttctcaagaatgtaggccccctccaatgcttagtcaatgttaactagagggttttaatctgttgcacctgtcacttccagggtggttccctcttctttattttggcttcctgtttgcaagtctcttcagtgtctaatttccaccctgacacaagggggtgaagatggtcacttatttaggctcacttgttcagttgtgttgtggggagggaggaacactgcaaacaaatatcactggcgtgtgtggggagtgcttgcagtgtatggaccacactgggtttgccccagctcacggcgcgtgtgcttcccggtctacactgctcaggctccatgttgctctgcaggggaactgtccaaagtgggctccaagtttcatgcacttcccaggtctaagctgctcaggttcaggttctcaggtattccacaagggcacagacttggttgggcttgcgttttgtgcccttcccaggtctgaacagctcaggtgaccaggtgcttggcaagtgcactgtccctggtgggccacggtctttttctccaccccgtccgggcacttggttttccgggtgtgccacgagagcactgtctcaggtgtgctgtgggtctcctctggggaactgatctcaggctgcgaccctcctggcagatgtcaaccgtccaggatcccacgaagacgtggttagcaactgggagcctgctcacagtttggtggaggatgcccgtctctggggccgagattgccccttgccttccatatctgactgtagcacgcctgcctctctgcctccggttgggtgcgggaggggcctgtatgcagcaggctagctctcctttggtgttcgttcaatcctttgttctgtgagccggccaggatgtgtgttaggttagagcctttcatggaaaagttctctctctttttttcctctctggctatcctacaatttgggttgctatatcatgtaagcaccctcagattgtcctcagggcattcaggcccagcccttaccctaagcatgcagcgcgtgcctccctgtctagcccccgcttgcgagtggccaacccgagcgtttgggctacttctctgctgggagttgcgttagcttaggcaagtcctctgtgggtttttttttttttcccctcctgcttatgttgccctctaagattccaaaacttcccacagacccgctggtgagagggtttcctgctgtttagaaacttctcctccttcacaactccctccccaggacaggtctccatccttaattcttttgtctctctttttgtcttttacattttgtcctacctcctttcaaagagaacgggctgcctttctgggtgcctggtgtactctgctagtgttcagaagttgttttgtggaagttgttaagcattcaaatgatcttttgatgaatttgtggtagagaaaggggtctccccattctattcctccaccatcttgggactgccccctggaagtgcatcttatccccaggcttagggcatttaagtagctacatatggctagacatacagtcctgtagcatctgaatggtaaggaggcaccaggtttaaaagcccaatttcctgtgtatgtttatgagggtgtgtgtgtgtgtgtgtctgtgtgtgtgtgtgtgtgatacacatgacaggtgttgatctgctggtttgtgtaaactctttgcaaacagtctaactcctgaggaactaattgggaagttcccagggtagaagaagatccaccacaaaccgcagctttgcagtagtaggtagcaggtttgcttgttttctcttggcagtaattgcttccttgcctaaagaaggtgtaggggagacagcggcacttgctagaagctctgggcccacggtttctaagtggtctcaggcagggcctgaggcttccagccaagtagctggttgtcactgaaagccaaacatttagttttgagttcagctcccatttggaattcatttcccagacctcgaagtatgagacgatgcagttgttatttatttattttcctttattcttaggcttgtttgctttctggcaaggagtcaaggttgtttctgtgaaggctggagtccttaggtatttgtaagatgaggaaaatgtcacggatggtgtgtgaaggggatgtacagaaattggacaggagggaattgagccaactctgcctaattatgtggttttctcctg

SEQ ID NO: 39068 - DNA, 2866 bp, Bovine  19866880837502
acatgatcggctgaaggaacttcttgggtgcacggggatgaactggaagaagaagtcaggggagggaccaactgaacgaggctggacagtatgggagctgttaatgatgtctgtgcttaaaaataatgattattccataaagtcaaaaaaactaaagttgaaaaactttctttgccctctaccttaaaatgaagaaacagatggccagctgtagctgtatatttcttgttgttgcaagtaaatgcagccacaggagcttattttatgctaaaagcctccatctgctagatgtaatcttttcgtacctgtggaaaaaatgaataaaataagaaggacccactcgcttttgaccttgactctccgcagattatgcacctaagatagtttcttttgttccttgacaggtcttaattccaaaatgatagtgctgtagtattttgacagtttcatccttttacctaaatggggatgaatttggcttcctaatattcctggttggcatatgttttgctgcaacagagggagaggattttcctttaatgagcaataccctgtgtcccttcacagcgtcttttcttgttgtaaaaatgctcaagcatcctttgcctctctagtctatttgctacacggaattgagaaatcattataaataaaagaggtattaaaacatcctcactgtgtcatggatctgtttatactttggaaagaaggggaagggggcgggtaaacagaatgaattgctgtgaatgtgctgatccattgggccccatcttttccaacccagccccgcagggcttcctacctctcttcccacctgctcgccgtcatcgctgcaacgttattctcccggatgctatgtttctttcccagtggttgtgtgtaatgggagtgctatttaaacagaattcattgtcattcgggctcactttgctttcaggcacgttgctttcactttgactcaactctttagaaagttggagttttaacagggacctaagaggttatgctcttcattcaagaagttaaaaaataacctgaggccagaagactgacactccaaggcagaactaatgctggacacgggctcttgtctctgacacacagactgtgagagtcacatggagaagcaacctgagtctcaaggtttgtatggaaaactgggatgcctgacttcaaaaaagaggctttccacgaactttttgtattgaccttgggtaaagtagagtgcacgagagtgcttattaaatataagagtgaaaaactaaggagcatttaagaatgacttcaagatagtttagtgtagaggcacagcccttctctatttttcaatgtgattactccctaacaccacacgttactctagtgatggacaagcatccagtggttataaacgaaaaacaaacaaattaaagggggaataaaagggagaggaagaataacagtgaccatatgcttgacttctggctgtgtcagtaactggtggtgtgatgctgggcaagtcacttcattttgcttggcctcagtttctccacctttaaacaaagaacttggtctagatctggaagccatggccctggatcagcattattatcttcacctgggagcaccttagacatgaggattctcaaacctcactcagaccccccagtcagaagctgtaggggtgggacccagcaatttgtgttttaacaagctctccaggcaattctggtcacactcaagtttgagaacaagccactgtagaagcttggcggtcagctgccagagctatgctgcagaagagttggaacagctctcctcttggtcctgagaggtcccttcctaacggtgagtctgtgatttcaaggctttgtacattgctccatccatttctatatcaatttcttgtactttccacccatagaaatcaagtatctgtttacctttctgaacgcctttctgaatgcaagggtgtcatgttaaaaatctttctggtattaacaacatgagggacccattaacaacattagacccagaaaagcaagtgtttgtggtcatgagtattcataagtgagtgtctttgctgaaaaatgaatgcttatgttgactgtcaactctgccaagtagtcgtgggtttttctggtctcataatgggggcagtgcatcctgagggtagctgcaggggctctggcttcccgtggcctatgttcaacttgagctctgccacttgcaacctttggtaagttattttctgcctcagtttcagtttctctgtctgtacttagaaaaacatgcaatatctgttttacagtgttttgtaaggattcaaaagatatggttcatgtaaatatgcttaacacactagattgcattcattaagaacttgataaatgtgaagcatctttagtccatttctcagtgttctgtagctttcgaataagaacggtgatgttttcttgtaatagataacatgtgaataatatataaatgaagcaaaatgtaaaatatttggaagattatctgagaaattatcttttgcttggggagtatcctatattgcaaaagtggtccagtggctaatgatctcagagaaaggagtcagataccgtgacaatttcaaaaagagagggtgaagcgattagcacagctcgtcctctgtggaaggacgtctaaatatacctcttaccatcatcaatcctgagtcggttgtttggggtcacttccagagttcactgagctctaactaacaggctttgaagattaggtgggacccctcttatatgctcaagctaccctccttccccctgacttcccttctgtagcatttgttactcttgaaatagtttatctttagttggctataagttccaggagggccagaactatg

SEQ ID NO: 39069 - DNA, 2057 bp, Bovine  19866880837567
ggaagtccatataaatatcagtcattcagttgtgtttgactctttgcaaccctataaactagcccaccatgcttctctgtccaaatactatagtgggtagccattccgttctccaggggatcttcccaattcagggatcaaacctgggtctcctgcattgcaagcagattcgttaccatctgagccaccagggaagcccctatgtataacttaacattcttggatgcctgaaaacttttgtaaaaaaaatgttgagggaaaacaaaagcaaatgttttccgaaaaaaaaaaaaaaacaaaaaaaccaaaaaaaaaacttcagtagtattcacaggtcagatgggctgaaccatcactatcacctgaaaaaatgttttaaaaataaaattctgagttctaagccccagtctcagagtcagaatcttaaagatgcttcccagtcttactatgataaacatctgggtctatgaattcaaaatgaactcactaacattttggtcaatgggttaaataaagatcatctatttcttacttgttggagtaggtgtcgtacaatcccacttttccatcatcagttccaaaagctaagcagccttccttggtcgggtgccagcacagctataaagaaatatgaagaaaggggcactgttaagggattcattaggttatactttatcgttcaactgaaaaaaatttcttgctcttggtgtcttctaattttaaaagtaacaaattctcattatttaaaagagaaatagtattaaaaataaagtcacttgtaatttcactatccaaaacaccccactgtgagctctgtatctttctagaaattttttgtgagtaaacttcatatataattaaaaaacaaaaataggatcaaatgtttaaatgatgtgcgtgatagattgttgggtggggagtaaaagattccagaacaatttagaaaatatggttctattattaattaacaaagcttggaaagatatatcaacagtggttctttggattatggacgcgggagaatagactcaagggtggaaaagaaaacatttttgctttcctcacttctgtactgtgggtttttttagaatcacaaacattattattccccatgtggttatattataatttaatgtacctcctatgaatgcacacacatccaggttattttaaatttcttactattagaaaacaaggtgacttaattttataaaacaaagctaaatttctgaattaggaggtaatgcgtttggttagggagggtccctgtgctttcccagtttcaaattgcatcaaaaatactcttgaagtataaattccctatagagttcatttgtgtgaataggtattctctaagagagaattagttatttgaaaacagtgtatggcaagttcaaagaacgcatccttaccgctgtaaccttggacttgacaccttgccaaaaatgtttcacatcatagttgttctttatggagagtgtattccatacgcggatcatgccatccccgacgcctatcgctaagcagcctgtgtccacaggagagaaagccagactgtaggcaaacccaccgagggaaggcaggctccagcagcactccagagtggccatgtcccaacattttacctgaaaaggttaagggttagggtcttaatgaagatcagagaaacaggaaaacaatcatttcagacagaatgggctcaatgagtgcagcaggagaatgtaacttaactattccagtagaaattagaaaaaaaaaaaaagcagtaaactgtagagctcaaagggatcttggaatacatttattccctaagatgccaagtgaattgaaggcacacaataaactagaactcagccttcctgtttcccagagtccagtggcctttccacagtattatagcatcgataatctcatttggtaaactcaaaaaaaaaaaaaaaaaagaaagaaaaaagatgacgatggtctcaggacagtggaagaatcacagtttatctcaaaaagcaaaatacgttatcatatccattggaagaggagtgctaagtttttaatcttca

SEQ ID NO: 39070 - DNA, 2390 bp, Bovine  19866880859455
ggattctccaggcaagaacactggagtgggttgccatttccttctccaatgcatgtgaaaagcgataagtgaagttgctcagtcgtgtctgactcttcgagaccccatggactgcagcctaccaggctcttccatccatgggattttccaggcaagaatactggagtggggtgccatggccagtacctaagctagtacagctgaaagttggtttttcagctgattgaggattagactgacaaaatttcctctcagatttcacctggctctttttctctctacatgtagcaactcagatcccacagcatcaagaagggtagtttgtccatctttttctaagaaacaggggatcgtatgccacatctgcacataaacaagtggccaagattttcaacgtattattaataggttgctgctgctgctgctaagtcacttcagtcgtgtccgactctgtgcaaccccatagacggcagcccaccaggctcccccgtccctgggattctccaggcaagaacactggagtgggttgccatttccttctctaatattaataggttaacatttgcaaaaagaacagtcgagggggaccttctctgtcactgctcaaagtaagaaactgacctcctggggtatcttaactcagctgtaaaaatagggctttattcaatgtccaaatgctgaaggaaaattgtttatatttggaaaattaaattgccaaaacaaacagaagtatcttctcaatgcacacatggcagttagaaaataattcctctttgcatttttttcatccacaagtaaattatctttgctattagatgatagtggtgatctccttggaagaagagagggagagtaggctagatgacctcccaaactgccttgtattacttgaaacacctgtctaaaaaaataaatcttgatgacttctgatttttcatgcagaagtcagatgaactgtctatcccagcttgttagctgtagaggagcagcattccaaagaaggatttggatttgataaatcctgtattctgatttccagagaaaaaagggaaaaaaagtgtttttgaaaagttttaatatgcattatactgtttgggctacacaaatctcgaattcaataacaacaaaaaaaagtaaggcacactgaaaggaatgacagaaattcctaattttgtggttctcccatgggttctctttaacataaaggtttctcttggtcattcagccatcctacatggactctcatcacttatagcttccacgaagggaaactgaagcgtgtcaaggtgaaggtcttactcagcttgagttacagagcctaacatggaaactaagaggtatggctccttcttgggatgttcttactagcagggaggttaaaacagatttatcaaactaatagattcctgggtcaaaaagcagaggtaagaataactatttcagaatcaacttgataacttagaaaagtggtcacactatcttccattttgtatttagaagtagtttgaaggaaaatcatggaagcataaccccatacctatggtaactcttcattttatacaaaaaaagaaaatccttgggggacttccctggcagtctagtggttaggactccacgcttccactgcaaggggcacaggtttgattcgtagtcagggaattaagatcccacatgtcatgtggtgtggccaaaaaataaggaaataaaattaaaaaataataacccttggtatttttcttgagatttatatttttgaagcaattaacacctaggacatatttgttgttatgtttagttgctaagtaatgtctgactcttcgcaaccccatggactgcagcccgccaggctcctctatctatgggattttccaggcaagaatactggagtgggttgccatttccttctcgaagagatcttcccaaccaagagatcaaacctgtgtctcctgcactggcaggcagattctttaccactgagccaccagggaagccccagaacatatttacctatataataagttataaggttggcagagtatgtaataagatgcccagttttagaagccacgtaaaattatttgttatactaatgagacactgttttgatactatttttccaattctaaaaatagtaattggctaatttgaagagttcagaaacttattatcaagaaaagaaggaacattttggtgcattttccttttctgtggctgtttcatgctgctacaggtgcatatgtgtgtgtgcataaatttttaaccaaattgaggttttactttatattgagatgtttctttcttgcctttattccatattaaaatttgaacagaatcctaggaagatagattaagcaaacatatctctattcctctccataattacaactaaa

SEQ ID NO: 39071 - DNA, 1433 bp, Bovine  19866880876466
ggatctgtaggcttcaccagattgccagaggaatccatggaatcggtaaggttaagaacccctgtcctaggacttctcttccagaacagagggggctggggagctcattgtcaaaagagggcatgtaggacctgtgatcccaggagacaacgtgcactctctgagccagaggaaaatgagacaggaaactggggcaggagcaaggggactctgagaagtggagcagaagccaacaggtcatcaggcagggcccagtctagtggggcagaactgaattccttagccccaaccccagccagacttcttgggggagccgggactccacggtcctcagcttgcttctgtcatcttcccttcctctcatgtttcttctctgagctaatatagtggaagcaacggtggcttccaggccaagaaagatcctgcttctggacctgagtcttgtcttgctgagtgattttgggcaagtcatctccccttcctgggtttccctgttggctcagatggtaaagaatctgcttgcaatgcaagagactgggttcaatccctgggtcgggaagatcccccagagaagcgaatagcaacccatccagtattcttgcctggaaaatctcatggacagaggagcctgggtgggctaccgtccatggtgtcacaaagagtcggatatgactgaatgactaacactttcacactttgatctcctgttcccaacccagttttcatatctgtatgatttttggcataagtactgctacagcccctcaccatgcccacagtagatactgctgacagatctcagtgtatgatcattccatgctcatatgtagcttcagaagccttttcaagtgctctactgattgataggaatttgcaatgaagtaaaatatatttgctattactgggctagatgatctgcacatttccatctctactattccatagctctaaagatctgagctcagaaatccaaacaaggaacgtccctagtggtccagtggcgaagactccacactcccaatgcagggggcccatgttcgatccttggtcagggaactatatcccacatgccacagctaagagttctcatgctgcaactaagacctggtatagccaaatgaatgaatgaatatttttaaaaagataaatctgaacaagacactagatagatgcgaagacctacaaagcatagctatttttgacccttacgtgactgtttgtgtgttgtaacagaaaaagagaatacattctcacttgggctatagatgttctcttgcatatcctatagcaaaaatagggtcagaaaaagatattcagactttgaaatctcaatctggcttcttaaaacagagaaacaggcacatggaagtcagaccctttgatcaaagtattaggaatgggcatcacactggggttggtgccaccaggcccta

SEQ ID NO: 39072 - DNA, 1233 bp, Bovine  19866880897194
ttggtgggaaactccgtgttatcattaagtatgatgatacttgaggcagatacaacaaattcacttagtcaatagctgctcaaatttcctttcagccagtatttgaaaaagaaaagaacagtccctggcattcagaagctggctaggcacttgacacagttattctcctgttgaacagaaaccatctctcagaataccaactcagacaaggtcattctgggaacacgattaaatgaaataaaacaagcacacaacataatttcatctaagcatagacaaaaacaaggttgcgggtgctatccacaaaataccaaacaccttttctttgctaaaataagtgactgttaattcttatcaattatttacacctatttcctcacccaagtttgccctccctatatgtaaaatttattgagataatcaatcatagaattccccccacccacattgtctgatgacatcaaattcagagcaaaccctagcaagtcaaccaaccaaagcccaaatcctataaaatcactccaccaaagcccaaatcctaacatcctcttgctgaggattccccatggtcaccatggtgtgttctcccttgctgcaaaaagtaataaacccaacttgttcaactctgtgttcatgggtggtctctggctgcagaacactgacatgttttaagaggccagaaaattagaaagtacttttctagactactttatagctaaggttcagtcttatgacacttctgccagtcactgatacccactcctgattcagaaaatgaagaaagtacctgcagaccagggggaaacatattatatagtctggggcccacttagaaattctttgagctggctaagatccttaataattcccttctgcttagtctaacaagatgttgaaatgggacacctgctgccctagtgtggtgtcttacactgaggcactactgtgataggtatcgagttgccaaaatgattgtgagagcatcacttctaactcccaattattactcaagttcatttttgatcaattctaatccagaaccatacagagaaatagtatatatagtgtatatatatatatacactatacatacatatatatgtatagaatatatatatacacatatatatatattcttgtatatatactagtgtgtgtatatatatactatatacacatatacatatatatacatatatatactatgaccaacctagatagcacattgaaaag

SEQ ID NO: 39073 - DNA, 1516 bp, Bovine  19866880902335
aacacagcctttggggagatttattggcaacaaattagcttaaatttattgcagattattgatttctacattcaaaggttaatgaggtttgtgccttcattcaacacttctgctctggggaggataatgagattgcctgaagacacaaaccattcaatcaaaataaacagaagactgtaatgtgcatcctggctatatcctgatacttttcccacttgtcttttctttctcaactgtatttctaaggtgattttcatttttgcatgtcagcagatgataaagatgatcccaggcagcactctaccaatcatagatggttccctcatggacccttacgtggagaaggagaactgatctgtacaatctatcaaggtttctttcctctgatatgcctacacccattttggtgtctcagtggtagaaattcaaattgattgatgctcaattagaaacctcagactgacagggagatccaactatcaggctggcaacaagttcattcagtttttccacaagatgttataggaaaacctgaatgagctttttggtcaagccagtacattatttgaagcatgaggtattgtgcccctagatactggctaacagccttttaaccaatacaatgctgggcttaagtaatttcaaagtattgtttctctgaccattacagattttctggcttaatagtttatctgtaagtagttttggttccatctttatctgcatgctagcacacatgttttacaaatcactaacttagttcatttatttaactctagatgagactgtaaactttgcagagagctcagggtctgtattcttttcaagggcttttgtgaagcaggccacagcctgagttaactaggaagaacttctctattgtctgtatctgacccaaagccttaatgaaatgaaaacctggctcccctggagagacacttatgaagaacacaggaaattgttctctcagcagtaactttatgtctatccaaagacgaattacatctttgcatgtgtattcctttgatagtttctctttgatttagttctctgggggcacagacggaaggcaagttactagacctagttcacttttaagtcatgaagtgtaagggctgagaggaagcctaaagttcatttgaatcctttccctcatttgtcactggggaaataaagcccagaagggagcattcaagtccaaggttgtgcaaagccagctctctgattcttcttaaccaccagaaaatccaggcattccggtctcatcctgataagaatggacctcaaaaccctgaggctgtcttcacacctagattgatttcttggggacataagggacataggataccctgtagctccttcttctgtcagtcagacacagttcttgttgtgaaaccactcagaatacattttgattacaaagccatgcactgatttattgacaaaggtcagcttaaacattcttctttaaagtataagtcatgaggaaactaaaatttgtaaaatgttaaagaac

SEQ ID NO: 39074 - DNA, 898 bp, Bovine  19866880945733
catcacaggaagacctgtggagttgggattttgtccctgactcacccacaagtacagttgggccatcacttccaccgtgtgtgacctgtggcacatcattgtctcaagtggctcccttctcctccctgcctggctgccagcaccgggagaccacgtggatgaaggaaggcacttaagaaatatgaagtgctgtacaattttcaggtggtatcattatttgaaaacacgttacccacggttaagggatttggactttggaggcagcagctaccttgttgatcagattttctgaggagagctgcagtcacccccttagggctccaaatgctgtgtcaggtttttcaaagccaattgataacaattaagtagatgccatgttctgcaagctgtcttttgtgggagttgaattctagctttctttccttgtgagcctctgtacataagacttgctatgggcagtcaccttgttggagcttttgaatgcctctgaaactatactggggtcaagtcatttgatgtgtgtgggtgttatctgcattgcaagagaatattctagaaaagtgccttttgctcatgtattttaagcattcccctaccaccagaattgatgtgattcaatcctatacacttgagttgtgaaactggacccaagacagataggaatgacatagtaacagaatgttctttaaagaagagctgattacttcaagcttttggtagtaaagtgtttcctttgaacttattccccggtttctcaccccttccctgtgaaccatgtccccacaattcctacccccaacctcatctgctttatgcttaaacttccatgacttaagcatccttgggtgtgcatggacttcttattactgctcactctgaaggctgccaatgccaaggt

SEQ ID NO: 39075 - DNA, 3081 bp, Bovine  19866880972199
cttactgttagtttgaaggttgagtgggttactatgtaagtcactagcatagcatatggcacatgataggtgctcagtaaacagtagcacctactaatcttatcaaaatagtgataatgttgatgctgtctgtcactcagacacctctgccttagtttaggcatttatttccttctgtccagatgattgcagcagcctcctaagtgtctctatggtcttgctgactttcgctgactcatttctatcagaatgttctttctaaaacacagctctacttatatgagtctactgtttaggaccctcaaatgtcttctcattgcctaaaggataaaggccaaacttagtttcaagtgtccccacagcactgacttataggggtgctcaataaataccttttgaacactaagttgcttttttacctgtaacccactgtgcctcattagcataggagcacgtacagctctccggtaagggtctgagcaggactggacactgcacacctccagggggcacttttcatttatattctatgtgagcagcacttctggaacacagtgatgttccctggattgggacagtgccatggcctggaagcggcctggattcttgtgtggcctccacgcttaggcagataagcggtaagtcatgagccttagctgtaaagtgggatagcagggcctttcctaccttcctatacagttgtcggagccttctgaatctgaaaggtcttataaactgggaagtgctatctcccagaaattgccctgctcttattgtcattgatactgactgtgaacagtaaagactaaaaagaacctaatcgcctgcagtcaatttataagataaaagccccattatgggcagtgactgtgtgataagctcaaggatattatttatttataatttaactaccttgtttttcttacttcaatggcagtactcataatagcataaaataatagtctagctaaaaagagaaaataaaaagacctataatctcacccacacagaagcaagcattattaattccttgatatattttcttctagaatatttcccagacatatacagtgtacataccatttgataacctgctccccccaccccatttaatgtaccacaagcttcttttcatattaatgagcacaccttcactgtataattattaatggatacatagttgtctggtgtgaggacctactttaatttatttaaacaacactcttgctgccatttaggttaattcttccttttccgtgtttcaaatagactgcaagggacatccttgtagctaaatctgtgtgcatatccatgcttatttcctcaggttaaatcacagaagtggaattacagggtcaaagagtaggcatattttttttaaaggcttttgcaaagaactgtcaattgcctctagtaagattgtatgctcaattggattttgaaggtcatttctgtctaatagtggagcgtgcaaaataaataaactttgaactttcaaatggaattagtctctgctgggctgtaatatgggtttagtcagaaatgtggagaatggagctcagtgatggagtagtagaaaaagccatattaataggctttaggctactttcttctctttggaacttcttaaatttaaaaattgggatataatttttatagaatataatcttatcttaactgatttcgatggagacaaccattaatagagctcacatctggttttcctctccttccaggcatatgaaagatgatattctccaattttttttgcagtaggtggggctggtaacttggtctagacaatgtgctgtgagcagaatgatatggtcccttgtggagtgaaggacttagttgtcagtatgagacgccccccacgttgcctctcccccatgaagtctctgctgcgtgttgaccgaggggccctgtgttacagatggtacactgcaagatggtgaagtctctgaatttcttctgaggacagttgccttgaacagtcacctgtactgcgtggactttgtgtgagcgagactcagacctgcactaagtcactaagatttggtggttattttttaaaactgagaagtgaaagtgaaagccactcagttgtgtccagctctttgggaccccatggactatacagtccatggacttctccaggccagaatactggagtgggtagtcttttccttctccagggaatcttcccaactcagggattgaacccaggtctcctgtattgcagacagattctttaccagcggagccacaagggaagcccaagatataagtagggatggtaagaacaagcaaaaccagcaaaaaccactcaacacccagttcacccatgctctctgtcaagactgtctgcagagacgcctgaagctggccccatcccacacccagcagtggctgaacaggtcttgtctcatatcctattttttcttcatggattacactgtccagtgctttgcaatgaggtcctatactattttcatgccctcattccaaaacaaaaatactacttaaaatcctgcatcttgaactggacctcccagaagagttgcatcagatctttttcttgaagcagtggtgcttaaacttcagggggcattagaagagatgtggctagaatcacaggtgagcatggaccctgccccccgagacccccacatacacagagaatcacaggtgagcacggaccctgccccccgagacacccacatacacagagaatcacaggtgagcacggaccctgccccctgagacacccacatacacagagaatcacaggtgagcacggaccgtgccccccgagacccccccagacacaggtatgatgtggtacacatttgcgggaggttcacaagtcctttgaaatctgtggatccatattaaaaaaaaaagattcttgacctattagaatattacaagttgtcttcgaaagcacaggctatatttctagaaagaatccagtaaaatgtaaataatgtaggtgcacaagtttcccataaaatagttttctagtaggatgactgttgctgataaataaaccccaatgttcaattttaatggaaagaatca

SEQ ID NO: 39076 - DNA, 1773 bp, Bovine  19866881025189
ctgtgcgaccccatagacggcagcccaccaggctcccctgtccctgggattctccaggcaagaacactggagtgggttgccatttccttctccagtgcatgaaagtgaaaagtgaagttgctcagtcgtgtccgactcctagcgaccccatggactgcagcccaccagtctcctccgcccatgggattttccaggcaagagtactggagtggggtgccattgcctacctactttagtgttcactatatactctcctacacacagctagagagagaaatagcagtgtactcacaagttataaagaatggagaaaacattccttgagctacacaattggtcactgacctaaaacattatggtttttcagaacacagtggcatcttagccccagagcctacaatgggactaatgaaatacttctttctgtcatgctttacatggcttgaagcaatgaggacactgtcttaggccagaagctctggcaggcttttggtggaaagcatgtggtcccacagatcactgccgttctttttcttgggatctgactggcctcttgggtgacaggaaacacgtgggcaggaaatcagatttctggcagacaaagaaataaacaaccctaaatccttttcttctcttgtaggctgtgaccatctaagagacaaactgggtgatcatcagtctcccaccacaccagctttcaaaagtctgaaggccttttttatttacggatgtctatatgaattctggtggtctctctctgggccttgcccggagtccagtgtctggctaagagctgctcacagaagtaaaacctctactgaacagagccaagaggttgacagtgtcagccctgaagaaactgaccccaaaccttcccagccagagccaagcaggactccagaactagacgtgagactttcagaagaaggtgagcaaatgcagaacgcttgtaaggagcttttgtcagaaaagcatgctggtctccaaagtgcacagagaactgttgctgaagtccaagagaccttggcagaaatgatccgccaacaccagaagagtcaactgtgtaaatccacagcaaatggccctgataagaatgaacctgaacaggaaggacagtccctctctcatcctcagaaccagtggtaagtactgattcagtacaatgtggaactgaaatcccctgctggactctcacatggaacttggtgaggctgatcacgtcacttggaagccccacagtgcagtcattaaggcacaggctttggggtcagatgtggggttccagtcctggtcctgctcagtgacctcaggagtcttaatgtctcttgagctttagttcccttatccataagtggagtaccaaccctatccttgcttgttttgacaaacaaaatcacaaatattgttaataaaatagtacaatgaaacccttttgtgcaagattcccaaaaaatcagtcatgtaaaatagggagttgcaatattacatcattaatgaaaaccagtttttcttcttttggccaccctccctggcttgtggaattttagttccctgaccagggattcagtctacgccctcagcagtgaaaacacagagtcctaaacactggactgccagggaactcccaaaaaccattgttttttaatttttcagtactatcccaaaaaaacacacaaaaagggtagtgtacagaattacgcaccaaactaaaaaatcccaaatgatcagattgctgcagcgtcctaatgacggctattgaaaataagggccagg

SEQ ID NO: 39077 - DNA, 1310 bp, Bovine  19866881051825
gtttaacagaagaggaggtggacgcacagtagagggcccctggtttgcttgggctcacaaagcaaggagattgtggagctgagactgtgcccaggcttcctggctcagagccctagcccttggcacctgtgctatattgcctcctgtttcacggtgctgctgaggaaaaagctttctaaacagagctgttcattgacaagatgcacagctctgagagcagtgaggcccctattctgggcacttccagtggaatcaaggtgatggtgattattactgagcagtgtttacggcaggtagggttgaggcggaggactgctgggttgtcctggaaggtcccttcctaccagagagtgtaggatttgatgaaatctctcacagatcccagtctttcagttcatgacattgacaagtcctcctggctctcgagctcttggattgaacatcctctcccagcctgtcctgcctgccaaccatcccctcctcgtgggcactgggatcagtgagctgtgagaacaggtggctatgcgtggatcatcctggaaatttgacagcatggtcttcagctaaaggactagggaggagggacagcagaacagtaaattacagggttgtccaccgcctgattaaatcagtgcctgtgtctagcactatggagatgctgcatgccaggctccctcctgggcccaaggcccagatgttagtcacagaaccacagtcagagtgccaagcgctctctgcagtccctcatccagcccttgcatttcacatgtggggatactgaagcccagagaggggaagcaacttgccagagaccacacagcattccttcaacaaaatactaagggtctactgtgccacagactgtgcttgggaacactaaggatgaacaaaatagccaccagctccaggctcacagagtttacacattagtggaggaaatgggaaaaagcaggtacagacataaaatcagagattgtgatctgtgtcatgaagaacacgaagtactgcagtcaagctgatcaaaggcagtctctctgggagagggccatttcagctgaggcttgaagtgtaagcgcatgctgtttgtgtgtctgtgcggcggggatgtgttcccggcagtgcccctgggcagtgatgagctccccgtgttggaggtgctggcacagggcaagggcaggggagaggagcagaaaggggaagtctgaggtggatggagtctggagcacatggtgtcttgtgggccgagatgagaggccaggagttcgttttcatcgcactatgaagccatggagagcttatgcatacacgct

SEQ ID NO: 39078 - DNA, 1203 bp, Bovine  19866881090353
ccccaaaggaggaagtccggactaggatggaagagaacggacctatctttttgtcaggacacctgagcagtgctgccactatctcactgactggccatgggctcctgatcatccactgctatagtgatgacaacaagaaccctgcctgcttcactttataaaggtttaaaaaggtcaaagcagtgtctgacacacaataaagtcaaaatttttaagtatgtgaagactattacttacttctgtttgcccttttgctaaaaggtttcaagggagtaagacgactggcatatccctactacattataaacactttgaaggaaaaagttttacttatctctggaatccctgatacactcaggacagaagaggaaccagtagtcgtaactttgactcaccactggatgtcactgttgagtcactgtgccaaggagtgggaggagcagggaagaactagacatactttatcaagttctggggttggaactgacctctcccagaaagaataagaacatttacctagggtactcatcctgatcacctctaaatatggtatagcagcaaagagggatggagataagacagaaagggcattatgatggtttagccacatccactatggaaaagggggtgagaagtgatcgcaaaccctcccatgagccttcactgcccacttctcacaccttctgtttaagaaacttaaggcccaaaagggacaagaaggatccctttgctagtggcccagctgggatcaaaacccaggtatccagatctctggttcagttttctttctaagacaatcagggtgggaaagatgagagacatccactcacatccactcggaagtcttcgagacgtcggaatttgccgaggtattcttgaagtttggggtcaatgtccaaatttttggctttggaatatttcaagaaggcccagaacttttctagcccatacagctgacctgcaggggaagacaggtagaaagaagcttggctgctgagaagttaatagagaggctcgggagaagggtatatgatgtgatacagacaagcccaggggccgagaagacagatgaccagggctcacagagtcccaactctgactcttacctgcttcgtagtccttcacggtttcctcctgaaagtccttaaatatgtccagccggaacttcttttccaggccataactgtagtatcgaaaaaggca

SEQ ID NO: 39079 - DNA, 878 bp, Bovine  19866881107398
ggatgtctaagttcttttttttaagttccttaaacatccactcaagattgcccacaaatttagtactctttgggattaccactgtctttaggtcctctttccttagagtaataaactgagaggtctcagagtagagaacaaaacaaacagaattaagctataacccgtactcaaaccctaagggctggtgtctgggaatcttacctagaatgtagaggagccactccttcccttcaaatgtagacagcagcctctcccactgggcttgccaaaagtagcaggaagcaccccaaaatctctgaagataccttgaaagaaaactcattcatgtttctgcgtgaagactggtgggtggacagctcctgaatccatgctctgcccgcagacctccaccgcaaggcccccagatcctgaattagagccggccgagcagactcaccctatgacgcagttccagtggaccattaacaaggggaggctggagcccaggatgaaagccgtcctcctcatggagccccagatgtgtccctcctaggggacgacaagaaaatgtcaggccctaaccagactcctgccttcccaggcggctcactgctgaagcctggcaggagtgacgggccatcaagttctcagtcatgccagcatggcatatctgctgacctttcccagcttccacaggagactcttccttgtcaagagctctcaggcttgtgtggggaggtgagcatgaaagttagagcttaagggttgagggaaggaagagtgcacacctgccccagagaatctagcaggcagttttgtcacctagacaatgacagatgaaccttccaagagccatgggatttcatgaccagtcctcatgttgaacagagatgcag

SEQ ID NO: 39080 - DNA, 2919 bp, Bovine  19866881136978
tgtccgaccctctacttggtgcttaattaatatttgttgatcagtgaatggctgttggaatgagttgcctccagaagcaatggctgtctgaccatggagctgctgggactaagatttgctggtcatgtggtggtgattcaaccatcacagggcaagggaagacagagtaaacttgaaaatccttttccaccctggaagtctataattccctggcatttctgaaacaaagccctaagttcattttgttctgctgcaaacagattgaacaacctcctcttgtccttcagttctgcagagttctttctttccatttaaaatcctcctccctcagggctgcctctcagggctgtgctgtgttctgttgacaaattagaaaccctattgagtttccagcttgatactgccctgttggccgtttgaaagaactaccaggtaataattcctgtagttttaatgaagctgggtttactcaatcctcttctctcccccacccccttgcaatctccttaacacagccagttgactatgaaaggacactgcatagtaagtataaatctctggacagaggccaataaagcatccaaagtttcatttggagaaatgcgcagcaaaacggcaaagagagctaaggtgtgttgtagacttcgtctccacttgctgctcagatgctgatttatggtggaatttcagggatgtgatttaacctctctggttgcctcatctataaattgaagataacactaatggggtttgcatcataacacagggatagcaacacactatgagggcttacaagcattattctaatgtgaaatgttttattagaatctaatgatacagatttcttatcatcacctgaaagccctgtaaatcctggttcctgactctcccttctccagctaggtatgtattagttccttaaacacacaactcctctcctgacctgggacctctctcgtccaggagtattttccttcccaacatttaccatttgcagatgcgtctttccccttagttctcagttgagcccttgctttcgaagagaaacttttctttttttctcaatcctgcctacaatggatgccgcttccccactcactcactattaagctcactctcatcgctatctgatttatctatagcattggcattggccacctgacatgaagagctaagctgactcattggtaaagaccctgatgctgggaaagaccaggcaaaagaagggggaggcataagatgagatggttagatatgaattggagcaaactctgggagatagtggaggacagaggggcttggcatgctacagtccatggagcacgacttagcaattgaacaatgttttattcacactagtcacttgcttgtctgtttcaccagatcaaagggccatgcctccctcattcacgaaccccactactcaagtggttcaataaatatctgttgagcgcatgaacagattcatttctaacagtggacaactgaaaacaacacaggaagggtgaggctaaggaactccaggtatgtgcatgagttagaaagaacctagtcttcctcctgagtctctcctttactctcacaacacttgtgacaccagatgtgtggagttttccccacctagccattgtcgatgacaccagctggatgaccctacaattgaacacgattcagacactgtcttcctgaagatggcatcagatcccacaggttaaaggctcagcaccatgagactacccctacttcagatgccaatggcaagaagcaagtccccaggctacccacaacttctgtctggctacaaatcagagattctcatgacctcttcccctttggattcattatttgctaaagcagatctcagaactgagggaaacactcactcacatttaccagcttattaagtaaaaaggatatgataaatgatacagatgaacagccagatgaagagatacacagggagaggtctgcaggaatttctagcacaggagcttctgtttccatggaggtggcatgcatcaccctcaaagtatgtagatgcattcacccacctggaaattctctgaatcccatcctattggaagtttgtgaaggctgtctcacataggcatgatcaattattagagaggtagtgtatgtggctgaaaattctaagcttctaatcatgggcttggtctttctggtgaccagcccccatccatgagccatctaggagtccattcagagttgcctcattagagcaaaagacactgctaacacccgaaatgccaagggatttaggaatcctgagtcaggtaagtgaaagtgttagttgcttagttgtatccgactctttgtgaccatatggacagtagtcagccaggcatctctgtccatgggattcttcaggccagaatactggagtgggttgccataccctcctccagggaatcgtcctgaccctgggatctaacctgatcaactgccagaacaaaagatactcctagtgctcttagcacttgggaatttagaagggtttcggaagttctgcatcaggagtggaggacaaagaccaatgtatatattttctattgtctcacaatacacttaacaaaactctgtagagccattcaaaatcatcaccgagaagattatgtagcgctgtttgttcagcgattacagtttgttttagatcacaaaactaggcacactgttggatggtccgcagacggaaggcaaatatttgctcacggtgtatgtggaattaacttctttttcatacatttctagagtcagccgggccatggtgaagtggggagagggatgtggcacaactttctgagcccctataaactcacctgtggagttaagcataaggagtggggctgcaccccacatacctgcgaggaggtgatgccccagagagcaggggaaagtcag

SEQ ID NO: 39081 - DNA, 785 bp, Bovine  19866881157226
ttgaagtgacttagcgtgcactgtcggatagcacagacacatgttttcctaagaacctgtagaaatcatcctgaatcttacccttgggatcctgaaatggaaaaaacataggtttcacttatcaaaattatcaaggaaggtcgaaccagatgatacaatttaagcccacttaaaatataaaacactgtcttaaataatgagataatttgaatttttggacatatcttgagaaagttctgaaaattttgacagttgtattcagttgaaagtttcttgaatattttgacttgactattaaaacaaatagaaaataaactttagtgctaactcctgtgatattttaagtttacagctctgtttcaaatgcttttggcaatgagtcactgaacaggttgttcttaggacatttctaacatcctttaattaaaattcacaagagtttgtatgataaaataccaagggaaccagttattcccaggtattcttttgccaaaaaaggtacattgtagacatacagtcctgtcctgagtaccatctgccttccttcccatttgaaatgttatctatctgttactaacactgaagtttggccacctgatgagaagtgctgactcattggtaaagaccctgatgctgggaaagattgagggcaggaggagaaggaggccacagaggatgagatggttggatggcatcactgactcaatgaacatcagtttgagcagactctgggagatagtgaaggacaaggaagcctgttgtgctgcagtccatgggggtcacaa

SEQ ID NO: 39082 - DNA, 2028 bp, Bovine  19866881163969
ttgacaagcttcctttgggctctgagtcagaaactgattctctttccagcgatgtcacttactaccctgggtatgtcaccaactcattcaatttatttaagcttcattttccttgtttataaaatgaagaaactaatccctgccctgcattcattctaaagttgttatgagaatccaaattagataggggacctaattagattaaggtagcattcctctttgggctcctactaacataggaactgcaaggctgcatagcattttgaagagacaggatgtataattagacactgctagctttgcaaagcgctcaaaatgatgacagctatacctacccctggagttgtggtgaggtttaaatgagatgatgccaggaaagtcctgggctcataggaagaccttaatggcttttctcccctgcattcatattttgttgaaatactaaatcttttttcatcatattaccagagggttgtttgcatatacaagacattgactaagatcagcacttctgtttttttcattgtaatcactgatttttaccaaaaactgaaaaatttttgtttaaaaaaatcaaagagtgcacaaaaagtttcatggattttagaaaacaaagcaaagaagctaaatacagaactcttgatcttgaaagtgtctgttttactgtcttccccaaagcacatcagaagatgcatgaagagggcatgtaagttagaaaaaatttatctccaaaaatccttggtagcagggagggatatttctctcctcatttttctaattcatgccttttatgaaattaatgtttaaatttttatcaaagtagtattcggtatggtttagaaagtaaaacatactacaaggcttatacataaaaagagctgtctcaagttctacccttctctcctccagttccagctcctaacaagtagccactttcaaatacccaagatgtttcttatgttatttacttccttatttatgaggaacatgcttgtactgccattcttgatttatttcccatttttactgttatttattgatttcctaaaagagaagacaatgatttcattctctgagatcctctttcatcccataccaatttcccttcctgccatccacctcttagctaagctaagctaagtcacttcagtcgtgtccgactctgtgcgaccccatagacggcagcccactaggcttccccgtccctgggattctccaggcaagaacactggagtgggttgccatttccttctccaatgcatgtaagtgaaaagtgaaagtgaagtcgcccagtcatgtccgactcttagcgaccccatggacagcagcctaccaggctcctctgcccatgggattttccaggcaagagtactggagtggggtgccattgccttctctattagtagcatataatacctcttaggctcatcaatagcagtgttcacaccactatgattctggttatttcttaacagttgtaccacacagattttgtagttacaattcttctctgatccaaaattagtgtttctaagagttaataattgctgctgtgtcttctcagctttccacatattcccccaaatttctgatcttccatagagtcaaacataacaatttatccaattcattgtttctttctcttggagagaaatcctccattcctcagttttccctcagccagtcactctccaaccttgccctagagatgttgcactgatatttctttctctgtcacctgggaattcctgttttgttggatcctccgctttgttttgtctttttccttgatttactgtgtcatttgaggagcacattctccaacaacttcctgacaaatgacgcttggtatacacatttttgagaccttgcttcactaaaaatattgttagtttacactcacttgcagtctcattgtatatgcaattctaggttttcagctactatcgatgatttaaaaagtatcatccactgtcatctaacttccagtttcatgggtgagcaacttcaacccaaatcattcccgat

SEQ ID NO: 39083 - DNA, 2662 bp, Bovine  19866881210366
attatataaaaaggttaaaattatatatttatatattatgtaaaaaccaagttgtatttatttgaagaatgtcaagttgtgttaaagattagtgattaatcctccattaattttagtagatgcaggaaaatgcgtttggtagaagttcagcatccatatataattaaacttttaccaaataaaaattaaggatatttttaatttaataaagtatttctataaaagacttaaagaaaacattatatataatggtgaaatattgaaactttccctttgatattggattctcttatgagagtgtctactataaacacttaatagaactgtgatatagtccagctatcatacttctggatatatattcaaagaaatgaaaacagggtattgaagcaatatctgcaccccatgttcattgcagcattattcacaatatggtaaagctgaggtatggaaacaacttaaatgtccactaacagatgattggataaaaagatgttctgtatctatatctgtacttatatctaccaacagaaacagacagaaatatatgtagataccaatggagggtgttaatccacatggaacttgtagcgggccctccatatctgctgctcttctatagccacagatttaaccacctatgaaccatgtagcactatagtatttactcttgaaaaatatttgcagataaatgcaactgtgtagttcaaaccaatgtagttcaactgttaaatctgtgtgtggtgtgtgtgtgtacacacaatggaatttattcagctctgagaaagaagaaaaccctgtgattcacaatagattgagagcattatgctaagtacaataagccagacaaaaacaaatactgtatgatctccctgaagtatggaatcttgaaaacaaagaagaacttaaggaaaaaggagagtggaaaagtgattggtggggactgagaagaggggacatagagattttaaaagggtacaggctctgagctgtaggatggaaaaggtttgaggatctaatgtgtaacatggtgactgtagttgataacattataattgaaatctgctaatagtgtagaatttaaatgtcctcactaaaaaaaaaaaaaaagaaagaaaagaaaaatatgtggggtgataggataattaactaaattgaggaactcattcacaatgtataaatatcaaaatcatcatgatgtacacttcgaacattttgtttgtcaagtaattttatctaaatagagctgaaagaaaagatagatcacatttcattatttacctcaaaagccagttttgtgtattgatgtctccttgtcaccatagtactgagaactgatactcaaaacacattaagctaaatgtatacatttaagggaaaaaaagtgtatttcctgaagtcttcttttcctaagccatcatttaatgcacactaattatataatttgtttatggtacctgtcatcattggtttattcaaaaatagaacatgttttttctcttttttgtttttaataaaaatggtctttggcctactggtaatatattgtaaatgtatgactttaaagaaaaatataagtaatataagagtgaaaaaagtataaggaaaggagaaaacaaaattttattacttataggtagcatagaaaaattttaaagaatctatagaaaactattagaggcaataaatttagcaagattgttggtaataaaatcagtatgcttcaatatcccatcataatgttatgtgtgatcgaaaaattcactcagtaaaacatgagttcatttttggtgaggttaatatagagcaaaatattttagctcgtctgtgctgacacacaaaatgaaaatgatgaaacttactctctactcaattgactatatactgacccaaggaaatcccacacgaccaggaagctgaagcagtcacttcctaattatgtccctcctgccccacgaaaaacacaaacttcaggccacatacctatgagaatggaggccagtcaaagaatgcaataccaatttctttatatccaaatttgcattattattgagccttttattgcagggttttcctgtagaaatctagttatagtttcataaaccagaaacaaacagaaaaaggaatctaaaaactagatttcattataggagcaggcataaaaccaagtctctaggagtaaatctaatgagaaatgtgcaaaatctctatggggatgactgtactgttgggtttaggggcaaggttctgaataatgagcttaaggcaagtctgctaattaagagggttggatgtgcaggaccacacagagacagctgtaataggggtgcttttacagtctgccaaaatactagtacccaggatgtgtccagcctggaggacagatgtgagctaaaaggccgcatttggtcaatgaaacccagccagaaggaaagatcgggatgtcagccaggctctgacacctacagatgcttaatcagatggcacccacaccggaggacccagccagtgcctggctccagatctttacaggctggagtcaaggagagagccaggtcagaactctcggccatgcacttgcttctgagaagagtttttgaagcattaccctgaggctaagactgtgggaggaaataactgatactcagtcccagctatattg

SEQ ID NO: 39084 - DNA, 1059 bp, Bovine  19866881239738
attttcacagtgccatgcactataagacactttacgtattaagtctcttaattctcacaacccatccttgaagttaaatattatcctcattctttgatatgaggaaaaactgaaactgaatctcagagaagttaagcaaatgacccgaggctatagcacttgtgcctgacagaacctgatatccagttctatcgcctgaagtccagtgtttctcaaatctgtcacaatgctcatcattcttccaccaaattgctgattcatagtatttccaacttgattttcttgtggagaattttaacatatgtacaccttagtaattagtgccttcaaacttttacaccggctcttctatttttaaaacaccaaaccatactcttcactctttaaattttaacgtcacctcttccagaaggactcccctgataaaccccttaaggggctcatcactcttgtccctcccatgtgtgatacagcactattttaagccagagaattttttgtttagatcctagatttgccatgtaaccttcagtaagtcacaaaatttcccaaatgcacgcatcactaaaatgggagacttaaaatttaaaggctggaaattgtccatctgctaccaaatataacctatagaaaagtatttgatgagcaacatttttaaatccagttcagagtctttacaggaggaaatgcactcaactgactgccacaagccctaccactctttacaaccccgtctctatagttcatttctattgtctgtctggcatctggtatgcaatggggtttccaaccactggattattatcagttataccttttctatttcattttcatgtggtcatttccccactataaagtccaaaatgcagattcctaaattatggacttcaaaactagaaagagatgaggtggcaaaatccaaccttcctgtatcacacagatgaaaagactgaagccaaagtgctttagttacttgctcaatttaaatcaaccagaataaacaaaacattcactttgtgcaagaccctaccctggagctacaaagtaaaacaagaatcg

SEQ ID NO: 39085 - DNA, 901 bp, Bovine  19866881283440
ggtgacaaaactcctgaaataggagtaactgctgcatgaactccaacctatgcaccattttattggggtggggtggggaagagctttgcaagaaacactgatctctttctagaaaaagatcagtatgaagttatgctaccaaaaaatcctttacatttgtacagtacaccatgccttccaaaacattttcacttacattaaatagatgtgagacaagcctacaaaaccagagctaatgctttaggatgttaagaacaaagaggaaccaacacatctgggtcactaagtcttcaaaggtcccctggcttttataattcaacagatgattttccattctggtactaggagggctaacttacaggatacctctatggacgaggcacctggcatggcacattatctataaagactttctaagtccactgtgatcctttatatctctctttcgggttgacaaagaattcattttttaaaaaatcagctacattcttattatgagtaaaggaccactctacgtatcatcttgatattcattatttaataactatcagcaatagatttcatgatctcagtctcattagagaacaagtaaaaataaagcagttaggaccattacaacagacttaacattagcatgctgaagactgaaaaataaactatcaccagcaatttccaatggtaaacatagtccaaagtattttagataccaaagactgttattagataaagaatttggcatcactacttggaagatattttccaaagttaagaatattaaagatcttacctatatataaattggatctgaattccacgtttgtggtctcttactgccatatcttgtgcttctaagagaaccttaaacaaggaaaagaaaggcattcatatggctgaccttaaa

SEQ ID NO: 39086 - DNA, 938 bp, Bovine  19866881302351
aacattaataaaactgagtaccctaaatctgtataatataaactctgcacttaaatgaggtaattctggatttaggcaaagcttactaacatctgcaagacaactatgtgctctttccccaccagtcttagttcacctctttaattatctgggctccttttttgtcactgaattccaattgagccagagcctggtcaattgacattcctcgtatctggaattaaaggataacagacaaagagaaaataaataaattggtttacaaagtcagcattgccacttcagtgaaaagtaaaagccttacataatccaaataacttctaaaaatagctaacaagttacatgttaattaaatctcagtaaaattagggaaaatttttttcattaaaaataaaaatagctaataaatgcaaaggagaaaaatacacatttgagaaggtacaccaccactctctttaagttaaaatcaaacttaaaaatgtcaaccactaacctggattttaatagttttaataataaaagagagcagacatgacaaagaaagatgacaggctggcaaggaccctagtaggcataaaaggcacctcattctccaacggaagtaaagtgtattattatacatgtatttgctgcctttgctttctctcatatataaattttgttttctgggtaaaaaacttaaaaggcaccagttttgaaacaggttgaatcagcttttacagatatgtaagtttgcttcctagattctctgttcttgatgcctttgttctaaatatctatgaatccaacatgattgagattctgaggagggaaaaactgaacaaaatcagtttttgttcagagattttgttcaaatctctgagctatcatttttggattacctaccaaatgtctgaaaatgtaattatattcctcactttttggagaaaacagggaaa

SEQ ID NO: 39087 - DNA, 1503 bp, Bovine  19866881411333
atttgttttgcttttctagtacaattgcctgtacacacagtagtatcagctggaaagcagatggcaaaatcatggctcttggcaatgaagatgggtatgtgtttgtttctttaaaaaaaaaaactttgtaattgcacatatatttgatcacaagctagtgccatctgtaatgttagttgggaaagcctagctgtatttgatattcttacttatccctgatatccttaaataactcaggagctctctgcattattgagaactgcaaaataaataaaatatttatagctcaaagagaatgtttgcctactcttgttttggctgtagtatgcttcaaagaatgcttatctccagaattaagttccctaaatctcccttcattctttttaaagggaaaaaaaaaaaagcagaaatgctttttaggtcttactatatcctttccaatgttttgttttggtttggttttttagggtgttttgctttgttttgccctttccaatgttgatcacagtaacatggttactatttcagccattggcttattaattcttcttttagtttttccctggtaccatttattatttttagagcatgataaatacaactttccagaggttattgagatttattaaagctgctgaaagaactgccttttgtacctgattttttgtaagagagtaacctctgcagtttagatagggttatcctattctatttcacctttctttgactgatggaatgagggcgatacctgcttgcactgaactgtaatttgagcatcctttcttatcttggtgtgtttcttattccagatcaatagaaatattcaagcttcctaacttgaaactgatctgcagcatccagcagcatcataagcttgtgaataccattagctggcatcatgagcatggcagccagccagaactgagctatctgatggcctctggatccaacaatgcagtcatttatgtgcacaacctgcagactgtcataggtgactttggtttctttccatactgggggtggtatatgtgttcagctactttttgttccagtctttgtacattttccgtttttttttttggtattaaacactactcttactatttttctgctttcaaaactaatgtattcaccttatttaagacacaacaaaaatttcaaacatgacaatacatgttaacttagaaagtgaagtacctccccttattcccatccctcattaataaacatcgctgtttcctccaaattttctaaagtatagttattgccaagtcactctccaaaagatggcgccaatttatattctcgtccttcagtgtttgagtatgacacgaacaacacacatcccatcccatgcatgactgcatctaattcttacaatcctgagactagattttgttatcttattttcctaattgaggctcagaggggttagctcacttccatgcgtcccacagctcatatatgatagagcccagattcagtcccacactaattgcagca

SEQ ID NO: 39088 - DNA, 965 bp, Bovine  19866881722547
aaactgctgtctcaggattccaagatccaaccattgaaagaggtactagaacccatccatatacatataattttaatccaaatcagccagggttggcttggcagctagtgaaaatgaaggtggaggtgggaggaggagcgtgatgtgggaagagagatgcaaagacttggagtgaatcactgtctttatcaactaccacatgtatcaaagggaaagtctcgtgtacagagcagattacatttgctgctaacttcaggcagggcttctgacaagccgaggaaaggattactcttttttatggaaattcaatctagtttgatgctggaagttatggattcatctaaaatagcaagtgacaggcacagcaacacatcagacaccgctcaggcaaacagtggagtctagagcccacccatttctgcaggagcccttgatggtcagtgctcttgctgttgccatggaagtggtggggaatcattaataattttacagatacttcagggtaggggccaggaaacagcctcttcaaactgtgtgttgtagactcttcatggttaattcagaccagcatacacagcaatagattcgcaggatctttgcacagagcctggggaatggaagggttttctcacacctatggccttgggaatgcagttctccattcttttgcaagtctggggagcccagaggagaaagcatgcacagaagtcagggtaccccacttggtgtctttactgtgacatccctgtgacttttaatcttggaaaagacactcccctctccagaaaacatacaggacagatgtggtgggctgtgacagctattgctattttgtctctcccagaatgtcctctgaccctcttttgttttgataacattctcccctttggtggggactgaatgggaggaaaactgcatcccttttccatgggccccagaggtcatctatacacacacagcaggtc

SEQ ID NO: 39089 - DNA, 802 bp, Bovine  19866881942027
ctcttgaactaggatgatacagtgggacccctacattcatggatgcagaacccacagatagggaacctaccgatatggaaggccaattgtatcatggacgtcttgagcatgctcagattttattgtccataggaggtcctggaaccaattcccctacatataccgaggggccactattcaaaaaggcacagaggagaattctacggcagatatgaaaatgagatcaggagtctgctttgctcagcttttcccttaaggccagcaataagaagggaaggcatattttcacaaactttttcctggtgcctttcctctatcatcctgacccaactctctcgttccttcctccaggctcactaaacaccacagcagtctgagtgagctcctactccatgccagcagccacagagccaagtgctgaatactcagcagggataggacatacgtagcccctgctttcaggaaagcagattggtaaaatgaacaaaaattttgcactaattaatgaacctggtaacatgccgaggaggaagacaggaagaaggaggtcagcgtgtgtttgacacagcctgactcttagccagagagaaaactgctgaaatctctccccaagtcagctgctgatatatatcctgtatcaacatggggtgttatttatgtctccatgaatttaattaaccaatgacttccactggttcacttcctttgttttccagttgagcaacttaacagactattaggatcttccacagcttgcaaggaaaggggactggcctttccttttagttgagcctaagggttt

SEQ ID NO: 39090 - DNA, 3766 bp, Bovine  19866880137271
ccttgactagatgaacctttgttggcaaagtaatgtctctgcttttgaatatgctatctaggttggacataactttccttccaaggagtaagcgtcttttaatttcatggctgcagtcaccatctgcagtgattttggagcccaaaaaaataaagtttgacactgtttccccatctatttcccatgaagtgatgggaccggatgccatgatcttcgttttctgaatgttgagctttaagccaactttttcactctccactttcactttcatcaagaggctttttagttcctcttcactttctgccataagggtggtgtcatctgcatacctgaggttattgatatttctctcggaaaaagtgcaaaagagtatatacatagtataataccttctgtatatgaaatgaaacagaaatataaatttatctatcaatcatctatatatatctattctttttactaaaagaaacaccagaagaaagcatcaaaaaataatgaaaacagtacctatagagataagtgagaatatagtaaaaggggtaaggatgagaaggggagctctctgagtctatcaacttacacaggtttgattttggggggaaatattctaaaacaaaatgagccctgactcttcaaaaatgccaagaaagacaaaaaagaaaaaaagacaggaatttttatagattaaaggaaaataaagagacatgatgactaaatgcaatgcatgattttttgtaggaccctgtgtcatatatatctatgaatttacataaatcatatttatgtatatatatagctcatctatcaaacaaacagcacaatgtgaacattcaatatacacagttgtaacattgcaaaactcctaagtaatcatagtttaaaactgcaattgttgtaaagatttaatttaaaattttctttttaaaaacaaggttggacatgttaagagccatttgtatttcctttcctattcatattatttgcctatatttatctggggcattattggtctttactgattaataggagagtttcatatattaatatggagaaggcaatggcaccccactccagtactcttgcctggaaaatcccatggatggaggaacctggaaggctgcagtccatggggtcgctgagggtcggacacgactgagcgacttcactttcacttttcactttcatgcattggagaaggaaatggcaacccactccagtgttcttgcctggagaatcccagggacaggggagcctggtgggctgccatctatgggatcacacagagttggacacgaccaggttgatatttcattttaatttattatagtcaacagatatcaatcttttcctttcattatgatgtttgcattatgctaaggagacctgccttattcaaggtggtacctgtgctttcttctagtattttatagtttcatttttgtacatatataaaattaaacattttaatatataattaaatacttaaatcatctgaaatttatgtatgtttaagtgaagtagcaataaggtttaatttttctcaagatgattattcaattgtttcagcaacatgtgttaaataatttatttttccctattgttaaattcttatatttactcaggtaaatctcctatatattatctcccttaatccttaaaaggtcttgcaagataggtattattatagatgaagctactcagggcagagaaaacttgtatctcagagttagaaaaacacaacagcaatagaatatgaatgaatatgatgacttggagaaaatttaagaccatggcaaatgcatttgtgttagataaaagcttcataaattaataaatttcactgtatttattatagcactagccaaaagaaataataaatgcagtaaatgccttgttaaaaatatcatgttattggctaaattattagtgagcagtgaccttaattaacaaggtaataagcttgctgacttgctgatgatgcagttttttagaagtcatctgtgccaggtaagtcttcctagcaggataagaaaatatattactatgtagaaggatagaaaaaagtatttggctttgacaactgatgggggttcagaatggtgtgtgttccatctcctaggccaccttggagcctacctacctcccacccccatttgagaagacagtataaaaagatctgccctcattggctacgatcatatatgttatgtttctgagggagaattgatcttgggattctctgctgcttattctcttctgcttcttcttcacttcaggctgtagctctcagccacccagaagattgctgattgtccacatttctccataagacaacagtgttaacaacagtgtggccacagcattttggagttgaatttcctcaagcagcggcaagtcagagactttatttagccttacataattactgaaagcctcaatggtccatcgagtgttctcctgattttcattttcctgagtttgtgttaggaaaaagaggtcagggaaggtcaattccatccacactgctgatcccacattgaacattgatctgaacaggtgaggccagaagatttagacctgatgtaaatgtgaataaagaggcaactgatatggtctttggcattagtaataaaaagcaaataaaaagcaaatgagagcccttttacttatatttttgatacagtagtggtgtggggaaagtaatacataaattcacatctgaatctaaaaaagtcctacttctgagagtcttctttgctgacaagcaattattaatattaattcagaaaagaatctcctctgctcccccaaaaatttaattgagaggtatgttctaacaagtctgatgtaggctcagattcaaatcagttcatcaatccatgagtcaatacttatcagagactccaacaaaataaaatatcgactcagatgagatccccttcagagaataatttgatgttctcaatttctcctggctcaataatttaggaaaacgtgaggtgtgactataaagtaatgatactgattgcacttgtcacacgtgaaaatcagccttgtcatttatatcattctagtcacatataatttaggaccttgtcacatataaattaggacactttgagggaaaaaaaagaaaattttgttacagttatatctcaagatatcactgaggttaattgaacttgccattcctttaagttagtagattgggtttgattttagttttagaattttatgggtataagtgcttgaaatctatcaagactctcccatgggcaaggtggtgtgatgtggcacggccatgtacatgcacctgtgtgtgtgtgtgtgtgtgtgtgtattggtttgataaaagtggggctatacgaagatacaaaaaagacagaaaaaaactcctaaaagatcttacaatctaactgaacatgcaataataactaatggtcccaccattcccaacttgaccttgggcactttctttagcttctctctgcctgtttcttcatccataaaattaagatagtaatagcagcaacctcatatgcttagtgtgagaattaaaatggaactgtatgtgtaaagtgctaatgaacagtcaatgttgaatctactatgatgatggtggcactacaataccattgcagagggaagtcttttgaaacaattgtgatccatgaaagtgatctgagttggcttatgttagtgaaggagagaagcccagaaaaaaaaaaaaaagtctcttaactccaccacatctgcctaattattg

SEQ ID NO: 39091 - DNA, 1729 bp, Bovine  19866880357394
aagaactaaagagcctcttgatgaaagtgaaagaggagagtgaaaaagttggcttaaagctcaacattcagaaaactaagatcatggcatccggtcccatcacttcatggcaaatagatggggaaacgggaaacagtggctgactttattttttggagctccaaaatcactgcagatggtgattgaatccataaaattaagacacttactacttggaaggaaagttatgatcaacctagatagcatattaaaaagcagagacattactttgtcaacaaaggtccatctagtcaaggctatggtttttccagtagtcacgtatggatgtgagagttggataaagaaagctgagcaccaaagaattgatgcttttgaactgtggtgttggagaagactcttgagagtcccttagactgcaaggagatccaaccagcccatcctaaaggagatcagtcctggatgttcattggaaggactgacgttgaagctgaaacttcaatactttggccacctgatgcgaagagctgactcatttgaaaagaccctgatgccgggaaagattgagggcaggaggagaaggggacaacagaggatgagatggttggatggcatcactgactcaatggacatgggtttgggtggactctgggagttggtgatggacagggaggcctgacgtgctgcgactcatgggatcgcagagagtcggacatgactgagtgactgaactgaactgaaacaattgttataaaaaataaaataaaaactatcatgtcccagatattaggtgaaaacaaaaaaattaataataaaattttagttttatttggatgtgcatgaagttaaacatgtgtataagaaaggccttgttaccaagcagcctcttatgaccctttaaaaaatatctggtagggataatcgtacatggactgaaagcttaggcaggaaatttcaacttatgataaaacaactatttccagagtattatgaacttcataatatgtaaaaaattacaaataacataatttatgtcattatttgtatttattgccatgaataccatatgaagatacagagaactagttgtacattcaggatgtcactatcaaaacccagttcagaaaaatggatgagaatattagctggatatattttttaataatttcacgctttaaggtcaaatgaataaagctagtcttaatacatttttttagcaacttaggggaaatattctgtgagaatagatgcttttattttatgaaaatttatgaaaattttatgaaaattgcttcatgttacatttttgcatttgttgctctcttaagggccagtttcgatataagtcattggtacagaagtagtgcccctgttgggattcctttaaatgggtccagttggtactctcagtcagtaaacgatatgatcacaactttcaaaaagaaagtttttattatctttgttttctttcttgttataagccattaacccttttagttaactcaaaatctgaatttctacaaacttcatttttttaacccttcaaggtatcatcaaaaatgggatataaacagagaatattcctgatgtcagacagtgacttggttaccaagcttctgtaaaggggtaacatttaccatcacattttaaccagcaaatatgctcaataacagaacatccaaatccattaaagtgacttttcatcccaggagattcaggcctctttcagtaa

SEQ ID NO: 39092 - DNA, 1587 bp, Bovine  19866880359908
tgattagaacttacttttgacttattcatggattaatgttgcttgctgaagaaaataaagcagagtcctaaccatccaagatgcttgaggtgcaatacttgcagctttcaacattgtactggttacacaagtagaccatgatacaaaatcattcaatctttccaccttgctgccagacttgtcctgcatgcacagatacacataccttccagccccctccatcctgccacttgctgatgctatttgccaggaagtgaagatgtctgtgagctctgaaaattggatcacagggacagctccacagtggccccagtcatgctgacggcaagactgatcaatcaataccctgtgtgacactttcagaattcattggaaatgatgcccttttcaaatgacacctacattttatcagggcagctctagtgggggaaaaaacaccacatcaatatatttggttccagtaaactttgttggttaggaccaataagtctgtattcaacctccctgctcctattccagagattttgaacaaaggggagatacaatgttaaggcaacattgcaagctgatattttttctgagctcctaaatctcatgtatagcatggaagatggccatattttcttccaatgcaatagatctttaaaattatagacttgttgtggacttccatcacaccaggctcataatgagaacatggaaattatctttcagaatgaaagtttcagaatgaaaatcgccaggctgtcgttctaaatactactttgagagggtttgccctttacctcttccttaagatgctggagtggggacagggaggaatggggagcaaaaaggcagtagtttgctttctttatagtaagtgttcagctaactagaaggttagcagtgctgcctaaccataccagatgggaagctctgatttacctgctgagttctaatgaggtgacagattgtgttcgtgcacatcctaacatcaagcagcccattcaggccctcaggaggagaagtttcaaagggccttgaagggctaagaatgagggaagtgactcttgtgacattggaggacttggaaggaaagggtaagagaagataacatatagacataaaattcccagctgccaccatttgaataaacctccagatagtaggagttaatagcagttattctcaacttgagcatgctccaagatgatttggagggcttcttcaaacataagttgccagggcccctctacagagtttttgatttagtagatttggggtggggcctctgccttcacattttaacaagcttccatgtgccactgctgctgctgcttctctgaggaccacatttcaaggactattggtttagagcacctttaagttacccataaaccaaacaaacccagctgtgaaaataacacttgaactttttttattttattgtgtttatcagggtacatattataaagcatctctttaatggaaccaatttctcaaaatgttgtgggggggtttgtttggtttgcttttattttagtttcttgttttgttctttctactcaattctaggaaagaacaaaggtggactggaattttctt

SEQ ID NO: 39093 - DNA, 2685 bp, Bovine  19866880416817
tgtagtatttttttttttataataaagtttgtttatgattgtctgactctaggagttcaactgctatatagcaaaagtgatgttgcaaaattgtattaatgaatttgaaaaggtgttcatatcattaagtttaaaaaaacaggtgatgtaatgatgtgtttggttatgatcccatttaaaaaatatataacaaaaatatactataatataaatatataaccttaaaattcttcttatgtatgaagtatatgtcatgtataagacatattatgtacacaatatatgttatactccatatatcatgcatataccagattattcagggtcctttagttcctaatagaaacttggttatttccctgagagcagcatggagccattgtaagattttaaagcagtgtaacaataagatctgcttgtaatgattgctgtgtagaatatttcagagttgagcaagagaagcagctatagcacagtgaccaaaaacttgaactccagagcaagacagtctatagttaaatccaagcaacaccacttaaaagctgtgtaacctcagacaaggtatttaatctctctggactccagactgactcttctataaaatggtgatgacagtagtacttacctcccaggaaagttatgaggattaaataatgcaatataaagtattcagaggaggacctaacacagtctgaactctgtatgttattataattcccttttgaaaaataaggaggcttactgaggttagttagtaaggttagcaactaactaaccttgagggttagcaactcaaagttagttgcttgaggccatccatacaactacagtcttgtagctgtggtatagcttcagttgacgatggactggaatgaccacacattccctatcttatagtatggagcaacatattaccaatcaagatccccaaaagacaacaactctactgaagatacaataataaatcatgatgatacttgtatatacgtacttgattccaagtacagtaaaacatgagtgaagttctattagttttttgggacaactgcacattttctatatttttcatcaagataaaaactaagtacaaactgagtcttataccctagagggttttacctcatctgtctgattagctcctttcagtgcaatgcttctgctcccaaagtgggaggaaggtgaatggatttaaaatgtgggacaggaacatagcgatgtataccgttttctaggatccaaacctacatctgcccaactacaaagtttatgcttagtccattgatttacaggctttcacttctattaaaatatattgctgtggttgatttagggctcttgaaagaacattaatgagaagttcaaatctccttggtactacagagtgacattgccagaaatgctgtattaacagacctggctgttgacaaacttgtcaagtggaagaagttggtatggccttactctttgggatatttcagccagttaatttatcctggtcctcccttcaacttgtcatctccctgagagcacacttgtttctagctttcctcatgtgaaatcccatttcatcagagagggccttgtgatccagtttatcttagtaaccagtgctgggaggcaaatgaggctgatgaagtgaagtgaagtgaagtgaaagtcgctcacttgtgtccgactctttgtgaccccatagactatacagtccatggaattctccaggccagaatactgcagtgggtagcctttcccttctccaggagatcttcccaacccaggaatcaaacccaggtctcctgcattgcaggcaaattctttgccagctgaaccaccagagaactccatctttgggggcctttaatttctaatttaggggtttttttttttttttcatttataataatccctttcatttgcaggtaatttaaaaactgataaagtcttcccacatcctcatgattgcttttattctttacaacattgttaggaaattttttcctctaattcagagattaaaaataatatctatggctccaacggacatgaatttgagtaaactctgggagatggtgaaggacggggaagctgggcatgctgcatttcatggggtcacaaagagccggacctgacttagcgactgaacaacaggctccaaacatttattagtagctcaagtggcagagtttgaattcaataagccatgccttcagctcccctgcaacctgcccgtggtgctgtgtgccttctccaaacacaccctccccttcccagctcccgaaatttctgcatgtgctcgcctctgcttgccaagacccagcgtgaacaccagctttcttcaatcctgacagtgaattaatcctactctctgccatgtcctgagttttgcaaactgcagtggaaagaacacagaagggatcggaattcccacctctgccagttgttagttgggtgactttgggcaagtttcttaacctctctgaacctctttcctcatctctaaagtatactattgagagatcattttcagaaaaggcaaaaccatgaattcatacaggcatgaaaaagaacactcggtaaagattttattttactcatcacgagggaaccaggaaaatgttacggctggttcaaaagagaatctgagaaacagacacctttatggatcaagaatattgaaatgaatcaaat

SEQ ID NO: 39094 - DNA, 1154 bp, Bovine  19866880420245
tggctttcatcattaaaaaattcaaccaactagaatacaacatcctttgacctagtagataaaaggtcagaaagcaattttgaataataaatgagacctgttgacctcatgacccagatctggcagggtcagtgtttcccctttcaccagatgctgatggcagacagacacacacagacagctcagctaatgagctgcctcagcgcaggctgtaggtgctacagtattttcatgttatgtagcatgagagggagaaaaggtttctaaagctgctgtgttatggaaagagatatttatagaaatatttctattgtctttcttggtttttatggcttctatgtaggtgtaaaatttagtagaaacctaagcaatggctaatttttttctcctaattctgattttatttgttattttagtactaggaaaaaaaagttgcttttgctctatttatttgtattacagtaaggtgatttcaaaagaagtttctgaatataggagtgagcctactcatctctaaagatgtgacttttgtccttcattttactgcaaagagtcctcatttttggataaaggattgagatgtgcacagtattaagctatatagatattattgatatagtaattagttaaaatgtttaagcttactcgaatggacatagtgatctaatctagaaattttaaagtttcaacacaaataaaaacagaaaatatggctttaaactaaactatctgtcctatgactttaatgtttaaattgtttcagcactgcttttgggaaaaatcagttcttatagtcagcttggtaaatgcttgcattattctagtaaatatcctttaatatgtccttgttttgacctctttaagaacattcatagtgcatttaatttgtgttcacttcatattcttttaaacaaaaaaatgtcaggggtctggtcaggttccagtttagctaattacatttttcttactagctcccctttcagctttcaactgaaaatgatattcttcttcactcttcatattaaactcttgccaatttgtgaattgcagaagggccacttagtaaaataacattatctcccctcacagtaacacaacaccggtgagtaggaagtgtttaagccatttttgttatttactataaattagggaga

SEQ ID NO: 39095 - DNA, 4081 bp, Bovine  19866880537979
tgaagtgtggtgttggagaagactcttgagagttctttggactgcaaggaggtccaaccagtccattctaaaagagatcagtcctgggtgttctttggaaggactgatgctgaagctgaaactccagtactttggccacctcatgcaaagaattgactcattgaccctgatgctgtgagggattgggggcaggaggagaaggggacgacagaggatgagatggctggatggcatcactgactcgatgcacatgggtttgggtggactctgggagttggtgatggacagggaggctggcgtgctgcagttcatggggtcgcaaagagttggacacgactgagtgactgaacaagttaccctttgtcctgtaggggcaagattcaagggaaaagtaagagaagatgctctttccttctggtcctatgattagccatagaaaattttaaggaaagctctcatgtggaaaatctcacagtcatactaatcaatatcttattcatgtaactaaattttcacaatatcctcacagtgaatttccaaaacataaagctgacccaattttcttcttgtttgctcagtgattctccttgtttcttccacccctaccaatttgatttccattcccaccccatatttctaaccatgaatgtctcaaaatgagcaactattagcattttgagtggaataatatctttgttgtgaaggggctgttattacacaatggaacgcttacagcaccctggcccctgcccactagatgccaatagcatctcccttcctattgctctaacccaggcagaagacttgctcctaagaagagcatgaaataattattcccactgaagatgaagtatagactgatccccacaaagagcaccctgtattataacataactgcagtggcagttactagctatgcccttgccctatgacactgcaacctgataggcagccaccaccaggcattttcattcatgtttaaacttaggtacctaccatactgcctaagttacaatagacacccagtaaatgcacggtgagtaaattccagaaacatatgtcaaaagatacagatgctaggattccaaatctcttaaacttatagcaaccaacatattataaaaactactacttcagccaggaaaccctacacttcaacattaataagagtagcaagaatagtgtaagtcatttaggattgtgagtttaagttgtaagagataataaatgcaagggccaatttcaaagtccagctgctgtaataatgcccagtccttctttcaggaatgttcataaacattgagctgagctggtctgcttgcagttcttggcagtcctatagtgtaactgctcagtgatgggagatgttaattaattacactataaaatagaattacaattaattgttaatttaggttttaaagtgacaaactttaaaggctaaaaatagtctttgatctttaaaaggcttcttaatgagggcagtatactttaagtacatcattagtttaagtgtgcaaattgggtctagaggctactagagctaagcaaatatctattccaatatgttaaatgtttatgagttgggacagggacaattaattgctaatcaatgggccaaatcctaggtgaggtcaggttctgaaataggacgacaacaatagtaaattggatttagagctttccaatgtgacctgtaaaaacaccagcaagcagagactaaaagaatagcaaaaaggccaaactgacagaaacacccagataattaagatattactcatttagttaatagtaattttcaagggtgccgtttgtttggattaatgagccataatttgtagaattatacttacatgtctgtagttcagttacttaaacatataattcaggatataaaatagtaaaactcagcatagcttaaaggatgataacacttaactggtagctaggattagcaatattcataatataatttccaatatgatctcgacccaccatataatacttcatttttccaaattcagaagtaaaacccatgtattactttggtaagtacctttttaacaatcatgcaaaacttccactgtcattgctggtataagcagcaagctatgtttatcttataaatctatctgcctcaatattaattggtttcactaacctttagttcagatgagagattccagagacagagttgaccctcttgacttcccgtgacaatcatttgctggtcatcggtgatcatgatggcagtgatgctgtgtggaggggccttctttccccagagtgccacagcctgcagggaggacctcatggtgaaggaatcctggacacacagaaatggtaaaaagtgtgcacaattatcattcattaattttggaaaatgtgttgttgtgttgtttcactcagtcatgtctgactcacttgcaaccccatgggctgtagtccatgaagttcctttatccatgggatttctgtggcaagaatactggaatgggttaacatttccttctccagaagacttcccaactcagggatcaagcccgtgtcaccttcattgcacctgtgtctcctgcattataggtggattcttttacagctgaaccattggggaagtcatctcacaaatgtgtttgataacatagacttgaacaatgcgttctctcagagctatgaagaagggtgctttcccatcaaatagagaagaatgtaatcagacattgaaattagcctatccaccccagctctgactgtgggtgacctggactgctccagagcccctctaggcctctcaagaagaatagagttgtctagacattggaatttgaagacaactttgcagaccctctctccccagaaatgtcacctcatctaagtaacaaatatctaaacttcactattaaaaagcaaatattttctgtaagaacaccatatcctattcttcaaagcttcttgtatggctgttaaaattgctgtaatattcatgttccacctacacaacttttaatagtaatttttacttgaacggtttctgtatttgatattttcctaaatgacaattttaatgaaatcactatctccatgtgttagttacagggttaaagtacaattataaaaaaatacctttcaaacacaactttccaaacctatggaacacagcaaaagcagttctaagagataagtttatagcaagacaagtctacttcaggaaataagaaaaatctcaatctaatcttacacctcaaggaactaggaaaagaacaaataatccaaagttagttaaggaaagaaatcatacagatcagagcagaaataaatgaaacagagacttaaaaaccatagaaaagatcagtcaaattaagagctagttctttgaaaaggcaaaattgataaacatatagtcagactcatcaagaaaagagagggcccagataaatataatcagaaatgaaaagggagatgttaccctgaagaaatacagaggatcctaagagaccactgcaaacagttatatgacaataaaaaggacaacctagaaggataggataaattcctagaaatgaataatctccccagactgaatctgaaagaaaaagacaaaaggaacagattaataaccagtaatgaatttgaattagtaataaaatatcttccaacaaacaaaagtagaggaccaaatggcttcacagatgaagaggaagggagttagaggctaagaaagtaagaagataataatttccaaggaaaatagggaatcagagcaaagaaaaagaaaacccccaacctcccacaacactctgctatgagagctgcaaaacctggcagtcttagggaacttagtgtaaaattaagtcggcccccaatctccatcactcctgatggctccaaggtattccagcccagaacaatcactgcttattatgggtaaataaaagatgatgagatgtcaaacgcactctgcttaagaagtcagaagcagaaagtagtagcagttttaccaagttctaaggatacagttaaatagtaagtttcatttatcaggaaaattcaattttggggaatatctcatttccagagatac

SEQ ID NO: 39096 - DNA, 642 bp, Bovine  19866880551482
atttgatgacattattttatcatctggaaatcctgcagatgttgtgaccttctgctttacccctacaaaagcagaaaacaagtcaggtcctccactgctccagaacttctaggacattttattgatttttaaaaatatgtgtgtaacaggttatattatccattaatttcatttcaggctagtaaaggatggacagggaggcctggcatgctgcaattcatggggtcgcaaagagtcagacacgactgagcgactgaactgaactgaaaggatggtgctacaaaatatttgtcatacaacggagatttggaccttgtaggtttgagaaccacaggcttcacaaacaaataattatactaatatctaatcaattacattgtgataaatattatacagaaaatcacagagtaacctgagcttacagtctagctagggattcatgacatgaaccctgaagtaacaatctcagtaagtaccccagtcagctacttgccgtgtgactagcatcatatcaaagagtttgtcacttgtataaaaagtgttggtgatgaaagaatgtggcatcaattttggagtactacgtaggcatctggctgtagcatttaaagtcaagatgagtacggcactgttgtgtgtgcaaga

SEQ ID NO: 39097 - DNA, 1320 bp, Bovine  19866880574917
atttataaataactcaggactctctgggcttccatcgagaggagtgagtttgtcccccagaaaagcactggaaggactgatcaggaataaaagaggtgttctaagggcacaccttatctctgcaactgttgcctccacatttcatcccctccctagtcctccatctctgcactctcccatgcctttttcttttttcaggcttgatcactttgtaaagtctctctcttttcttccctctcatgcctgcttctttaattctctaataaaaaatttatgcagtctgagctgagcgtgctcactggttgtagccaggttgtttttgtaagggggtagctacaacagtatctctctatagtgtttctattgtttaatgagagtaattcaccagatcagcaaacatatcatctggaaacctcttgccttatgacagaacagatcagttcacactgaacggtttactggaatgtattgctagatggcctagcttggctgcagagaaagcctcttctgttcccactggtgctgaccagttcatctcagtggcttgcttttagacaccagcatgtatcctgaaaatagaataaaaattggagttggtctatgctgtgttgacttgtagcgaaccgtgactctgtgagtggacagtttgctttagggaaataatttgcccaagcagaatttggacattggacattttttttttggttgaatcaaagacagtgctacataatgacaaagccacaataaacttttttggctgtagttcctataagtaagatcaaattaatgccactattcatttgttttttgacgggtcattcttgttaaattatggttaaaaaccaagctgtttaattcctgcaatcccaaatttccatggaaatggatgaaagaatctgaaaatggcaatatatgtcagtaccggcatcagaagtaagggaaaggatggaaactttagggagtttcttcaaaccaggctgggattactagattcagggaaaagagaattaacctgtgactggcctgggaaacaactggaaggaaccttccagtaggtgccactataacatgtatctcagagtcctaggggaaggcgggccttgaagcagttattaggggtcttgatcataaaaacaccttggggaaaggtatgatgtgctggggtccaaacaaagtgaagtactgtggactgaactatgtgattcagttctaactggctctgctggagtggaaagggagcagtggcaatgcttgagggtgccaatgagggcagacataccagtggagagttgggatcctatattaccaaccttctaactg

SEQ ID NO: 39098 - DNA, 1676 bp, Bovine  19866880636741
atttaagtagatgtttctctgtttagaagacttactgctgctgctgctgctgctaagtcacttcagtcgtatccgactctgtgggacccccatagagggcagccctccaggctcccctgtccctgggattctccaggcaagaacactggagtgggttgccatttccttctccaatgcataaaagtgaaaagtgaaagtgaagtcgctctgtcgtgtccgactcttagcaaccccatggactgcagcctaccaggctgctccgcccatgggattttcaaggcaagagtactggagtggggtgccattgccttctccaatgaagacatatggatgatcaaaaggtacaagattctgcacattgctaattattagaaatgaaaatcaaaactgcaatgaggtttcacctcacactagccagaatggccatcatcaaaaagtctacaaataataaattctgcagaggatgtggaggaaagggaactctcctacactgcctgtgggaatgtaaattggtgcagtcactatggagaacagaatgacggttccttagataactaaaaatagagttactatatgatccatcaatccctctcttttatacagaaaagatgaaagccctaatctgagaagatacatgcaccccaatgtttacaatagctaagacttggaagcaacctaagtgtccaatggcagatgaataggtatacaattcaatgaaaagaatgaaataatgccatttgcagtgacatggacctagagattatcatactaagtgaagtaaatcagacagagaaagacaaataccatatatcacttgtatttggaatctaaagcagtgatacaaattaacttatttacaaaacagaaacagactcaggcatagaaagcaaacttagttaccaaaggagaagagagtggaagggataaactaggaatttgggattaaaagatagacactaccatatagataagcaccgatgtcttactgtatagcacagggaactgtattaaatatcttgtaataactgataatggaaaagaatctgaaaaagaatatatatagatgtataactgaatcactttgctgtacaccagaaaataacacagcatttgtaaatcaactgaactttaatttttaaaagtggttcaagttcagagacatttctactaatattgggttttaattaatttccacaaattcttttataaataaagggcacagtttatttataaagggtgcagtttagttataaataaaaggcacagtatgatcaagaatcagccttcccatggaagcagaaaaggaagaaatagaagagtttaccttctggggccatgactgtatacatgaaactaaagtggaagccagatgatttcaggagaggctcaatagaagagtaaagcgtgtttccttttgccctctccgcaagaataacagtactgtggaatgttacatggagggaagggttgccacttagtactcctgagattgttgtgtgtctttagtagatgaagtgatcccaggatactccacagagcacttcaggattcttacagataaaaggtgctatatacgtgtcaaatattattatacagcacttacaaaaaatgtttccacttattggtgtagactcactgttgagcagcttagaaatgatagctattgtttataatag

SEQ ID NO: 39099 - DNA, 1442 bp, Bovine  19866880648702
atgcttactccttggaaggaaagttatgaccaacctagatagcatattcaaaagcagagacattactttgccaacaaaggtccatttggtcaaggctatggtttttcctgtggtcatgtatggatgtgagagttggactgtgaagaaggctgagtgccgaagaattgatgcttttgaactgtggtgttggagaagactcttgagagtcccttggactgcaaggagattcaaccagtccattctgaaggagatcagccctgggatttctttggaaggaatgatgctaaagctgaaactccactactttggccacctcatgtgaagagttgactcattggaaaagactctgatgctgggagggattgggggcaagaggagaaggggacgacagaggatgagatggctggatggcatcactgactcgatggatgtgagtctaagtgaactccaggagttggtgatggacagggaggcctggcgtgctgtgattcatggggtcgcaaagagtcggacacgactgagcgactgatctgatctgatactgccatgctttgggttgcccatttgtttacttcgttttcacacaataaccagaggagttagaacaatgtgctcattcttttaaaaattccctttaagtagttactatggtagttgttgaagcactagagattgaaatgagtgagtaattatgttgttgaaagtgttcaaaatggccagggaagtatgatgactacttgaattagctaagaaaacatgccaaatcactgccaaaagatctgtcacaaaaatccattctctgcagttgagaagttaccagcactatgaaaaaccaaaatgaccctttgtaactttgactagataatctgtgattccatcatttgcaagtaaaactgagtgtacacgtgaatcccaaaattttcagaatgaggagacatgaagaactcagtgattcattggccattacaacattcaaaatattccatttccaagggggctgatatttcctcactgaaattgatttatctagttccttttctcttccttataaacctcaaagcttatttcaaattaataaagtaatattaataataataaagatgctaacatttattgtacaagatactttgctaagtgctttgtatttatcaattcatttaattctcatcaaaatcttatcagttagctactattattctccccattttaaagatgaggactgagattaagtaatttgcccaaaagcatgaagctagtaagctatatagccagggttcatttacttactcatcatcaaccaggcacaggggcaggccctcttgaagagccaaaatgaacaaggaagacacaactctatccttgtgaagtttacaaattaaacccaaccccagttcagacttcaaagtccaagctattaatcaccacaccaacccatcagcaag

SEQ ID NO: 39100 - DNA, 2108 bp, Bovine  19866880664320
cctggaaaatcccagggatgggggagcctggtaggctgcagtccatggcgtctcgaagagttggacacgactgaacgacttcactttcacttttcactttcatgcattggagaaggaaatcgcaacccactccagtgttcttgcctggagaatcccagggatgggggagcctggtgggctgcagtctatggggtcgcacagagtcggacacgactgaagcgacttagcagcagcagcagcaagtcaactattaaaattatgaattgatgactatcaccctgcatttagaagaattaatgcatgcccttgtactttactctgttaagagaagtatggtggggatttctaggtaatatgtcagactgacacttgccatcagttcagattgactgctaaaaaagggaaacagcctttggataagctggcattttcagcacaactattcttgaaacatagaaccacttgtatataatttttgaagcaaagttcatctgaagcttataggatgtcaatatttagacttgtgtgtctagatatctaatggcagaagtcttaattttgttctgttgtgggttgagaaagaccttatagagtcatggaagatcagagacctagggctttattttgacctataatgggaaagttttttacattatatctaaacttagtcaattaataatgactgccaggagcagtatcaaatgaaggattccaaggcctcagctaggatcagcaggaaaaagtcacggttgattagcaatgtctgttacaagttttgcatagatgagggtggtgtatgtgctatatagagtctcctgatctagttcaacccttttgttttacagttaataaaacgaagaggaaaactgaatcagtcacacgcatgatctgtgaataaatcaagactcaaacttaggttatccaattaaattcccttctttccccatctccttcttaaataagtcacagaacatttttgtttgcttatagttatctgtgctttacattttggtgcataagagaagattcagcatctcagggtaatcctttccttcaggatatttccctccagcttaaaacacatcttttctaggctactcaatcagaaatacagcataatgggagcctttgctgaatatgaagcagattcctagaaaacaagtgggcattgatttatttttattgatgtgcttttactaactgacaggaagtgttctttgaacacctctctcccaaccattccactccaataacccactgagtttgatcatttccaacacatggtccatcctgctgtctggagagctgagagttttaccagccacagtgctaagtgcgccaacaggcacctaagtctagcccattagaagctgtgttttcctgatgcaggacttgcatactgaccccaagataacccactcattgtgggacgtgcgaatgggaaatggattgagatatggatacattggctgactcttggcctttggaaaaaaaaaaggtttagctagaaacaaacttgcagatgaactattcacataacccctgtataaacgcagttttggggaataagatacaaaataagtgggaaaaaaatatcagctattttttatttttttcccttagagtacagatgttatctacttacaaatcattgaacaccaggcattgcctataatctccacattctatgtcactttctctgcaaaaatcagtagcatagaggcttacaatatttggaagactgagctgggaagcatggggagtattgctgttaggagaagagtgaaatgacctctgggctagaaacagcccattcagtccttttattcccattttccatttaaacactggacaaatgtagtattaacaaattctaataattctgaaaaaagtatcttttttaaaaataatgttcctgcccaccagacagagtttctcagagtttatttctgcttagtttgctttgtattttactgatataatatccaaatcactatcaattagaaaagaagggaaaacatatttcacccataacgtcaccatccagcaaactaaagtacttttttggtacattctcctgagcatgtatgtctgcatagctatacctt

SEQ ID NO: 39101 - DNA, 1691 bp, Bovine  19866880719940
acaaaggatttaaataatggatggtctttgctctttctcagtaggcaacagaatcaagtgaaaatagcacacacttagaaacaaagcaaatctggtcacttttaacccaactccaccatgtactagttctgggacattgagtaaattatttaacctttctgagtcttagatttctcaaatatgtaattatacctaatatgtacctaaaagtgttttaagaataaaattaaataatataaatagctatcacaatcatattgtctgacatgtaagagctagtcaataaatttccttccttcccttcagtttcttgattgtaaagtaactagataataaaaatattttgcctcaaaggaacttttgagaaaatattcttgagatatctaaaatatagtaaatattcaacaatgataaaaatgataatgctagcagctatcagtggcagcccactccagtactcttgcctggaaaatcccatggacagaagagcctggtagactgcagtccatggggtcgctaagagtcggacacaactgagtgacttcactttcacttttcactttcacgcattggagaaggaaatggcaacccactccagtgttcttgcctggagaatcccagggacaggggagcctggtgggctgccgtctatggggtcgcacagagttggacacgactgaagcaacttagcagcagcagcagcagcagctatgtttacttcatcatcaccaccacaaccactacccttgtctaagtgtgcctaggatggtagagatacctcattccataatcctgcactcaaatatgacttcccctcctagacatggggacagaatgttgaaatgtgaaacattctggggctgaaggcatatactcagcacacatcactcctctctactcccatgactagaacagactttgctagttgatcatggtattcagatgtggtctcctcattcctgacacactacgcagacccaccaacagattacaatcggcccaggagatgaaatatatctacccactgtgaccaccatgccactggaggaaatgggcttaaagcacaagaagtttttgggctgctatcccttaaaggtacagctgaatggattcctgattaactagtaggacttcagctcagggtccaaggttttgagagcaaattcaagttcactcaaaatgtgtgagaaacacagtaaggtatcctgaattgagccccaggacattaatggaaaaactggtgaaatctgaataccatctacagtttacttaagaacaatgttccttagttttgacaaatctgaagttatcaaaaaatttaaattttacttaaaaattagtatgattgacacaggaatagccaggacctgaaacccagccagctgcttcaccaggaagatagagtgaccaaagcttcaatccttagagctaatctggaataaccagatcatgtagccatgatgaccataagtgcctcacttccagggtcttcccaatttccaacattctgatatgatatggcctaacattgataggtaaaaacctttctgcataattttgttttctcttcatgtaactttcttttcaaaacaagcaatttatttgactgtcttttaagattctttttcttataaattcatacacctgataaaaaatattttttcagtcagtatgtctcaatttttcttttt

SEQ ID NO: 39102 - DNA, 1955 bp, Bovine  19866880721316
catctgtgatgtttgttgcccatctgcgaatccgccctggattgtccttctttctctttaactcttctgttatgctgctgctgctaagtcgcttcagttgtgtctgactctgtgcaaccccatgggctgtagctcgccaggctcctctgtccatggaatcctccaggcaagaatcctggagtgggttgccatgtcctcctctggaggattttcccaacccagggattgaatcctggtctcctgcattgcagtcaaattctttaccactgagccacgagggaagccctcttttgttgtgtatacccccaattatgagcttgcttggggcacaattacgcctaaggcaaagttggcaaaattatgcctttatggctcattttttgatgagccatgaaaaagtggcttccttacaaccattctgcattgttaattttgcgtcaccagaaaagctagataaaaagcaaaaagacccagtcaaatatgctgtctggcatagtgtagggggagaaaacctactctatttaatttactgaatttgttccttcaaagacaatccccggattcaggcaatccagtttgtgtagacccagcgagacagggatcaatatctggtttctgagagatgagactgtacgtactgcagattcaaaactaaaaatccatacagtcggctttgattcaaggcagccactgcagggctgtaggtcacaaaaaagaaggaacattctacctgcaccagtgtcctgattctttgttggaatgtaaaatggaggagaaggtgacttacttctgtattctcttgtaaatgggaaattgaggaaaagggatgttacccacaaaacaggttttattaatctcagcttgaacaggaagctagtttattcattcaaagtcttcctgaacacctgttctgtgtgtcacactgttaaaacaagatagtgaagatgacttctgatccagcagggagatgacacaggccataaggaacagctcattaataggcaaaaacagggagccagtcagatcctgagggtggggccatagaccccagtgggagacagaggtgaaggaagttctagtccgggggtgaaggtgaaggatcgctgtggtacggtggtttggagttggtccttaaaggatgatgacatcaggtagagagtaaaggttcgtcctaagaggagaggtctgtgaataaacgcttagaagggtggaagggtaggtcatataaatgggaactacttttccctttggaaaaagaaagtgttgggtccatggctgttttagtcacagttgatctggattcctgtccaggctgacaataggttctgtttctacgttctcccttgaaggatcaggcacatgcagccatgtgaaataatggtaataatggtttgtagttcaggcctctttgcttgccttttcagtcctttttactgactcaaaccccagaagcctacctgttagtatggaaagtgcatctgtctttttccttctgtaaagatactctgttctcctgccctttaggagagtttattccagaaaaggaatcatgagaatttggcagtgggagaagggaagggatccttgaagggaagagacttttccagcagctggggtatcagagaattagtagtaataagagtgtaatttgaaaacttactatatgcaggcaggagatgaatgatataatttagtcatctgatcaccctgtaggttagaactattatcctccctgttccaaggaggaaactgagatagagagggtgacaagtgttacctggaatcacagaactgaaaagggcagaactaggtaggctttgacaccaggtttgcttgatgccaaagccatgcacccaacacaaagctctactgttttgggagtgcctctccccctcctttttatttttctaccagtttcttaactttatatttttaaaataagatatgctcatttt

SEQ ID NO: 39103 - DNA, 1776 bp, Bovine  19866880768695
attcgtgtttgtaatttgatgtgaggcactcagggtgataagtttagactaaaaaagaatcaattcatctagtaagtgaaatcaataactgtacaaattatttgctatatgtcacaactttattaattttaaatattcagatttttaaataacatcaaaatattataaagactatatagggttcttctttattttatctagttttactgtgttcattagctactttgatgaatgcatggtgactagtattatttttctgtgagtagtacatgctcatttacagcattcaagtgaggaaaaaaaaattaaagctaataattttcagtacttaaatttagcagacaaactattaaacatcattacccacatatatttctaaatagaacttcttaatacttcagtctcaaataaaatgtatttatggcataaaattatactttggatcatgcaactatgactgatttctgctgggtacttaccccaacctatgaatcaattctttaaaagattaaaataaatcatgactatgaactctatgcatacttacttgtaaaatttaagaggcagtatgttagccattaggccacagaccaaaaaacaagcattatttttctgagcttgttttcaaatttcattatgaagaaaaaaaatgagataatgtacaatacacaactgtgagttatttttatcactgaaagttataaattttcatatcatgtcacaaagctaaagtaaaatcaagcatagtttaatttataatattcctaagcaaatcattcaaaatgcatgccaaagtcttataatatattacattgttaccttctgttctcactgtgtgtaaatatgctttaaaacatagttgcaattgatagaatactagataacacattgccttatttctctctaatcaccaatattatagatgtacatatcaaaaataaaaaaattaaaatgacatacaacattcatatgagcataaaaataccatttctgcaagagctaatttagaagccccaaaataatgtgtcattttcttatactgtgttccaaattaagaaagcagcatgttaagtataaatcttaatttatgaactgcctttgggaatgaaataaattctgggtgactaagttactttaaaaataactttgaatttattattttaagaaatattgaagaaaactttcataccggctcaacaccctgtactttcagcctgataatgcaagtgtcatccaaaaaaaagtcaaaaaatagatttactttatcatataacatttatattaaatcatttcattttcacataattttcctactagtcttctgccaaaatatgagaaagaaataggatcttttctctaagtaatttttccccagcagactgccactgccagcataagtagattaataatagatgctcagtgactcttggagtcttactggttttaggcagcacaaagcctggggttaacaccaaggtccttggggtttttctgctcaaatgacttacaaaaatattttactagatctcccttccaagaaacaaaaaaatatattgtcttagatttatgaaaattcctgggaatgtatgtttgcaaatctgacttcaagctttttctcccaatattaaatcagtttagagaagcccttccatctcctgcatggttgtttttcacgttgcctggtgccagtccaaatagggaaaccaatagtcatccctcatttctacaaaattcattcactcagttttttgtgtatctagcaaattctgctaaaca

SEQ ID NO: 39104 - DNA, 1858 bp, Bovine  19866880781497
tgtgtgtgtgtgtgtgtgtgtgtgtgtgtgtcagggtaagactgattatgctggacagaatcaaggaaaggaagagtttggcttctttagccattcaagactggctgtgtccagcagtggacaataggaatccagtcagccacttgcaggggccagggccatgagcactccatttccctttcctctccccctctctccacccacatttgactttgctgtgagggggacagagagctcacaggtcacctagtttggttcaattaatttcatacagcctttagccacagagagcaaatgtggagctcacagatggctctctgtcccctcactggtgcccattcttcttcactcccacccaacattgacattgacttgcacatgctaatattgtgccttgaggtcaatgtgccaaactaagtgaaacatttgccaaacttaaaggatgcatgccccagctcatgtaattactggggaactgttctctccctcttggaactggcattaacttaaattctccatctcaagaacaagaatgtttacaggatgctcccttcactgtcaagtaaacagctctcctatggctgcaaggtcttcctttagaaaatgctatcaactcagtcctgcaacagaaggcctgggatctgctcagggttttacctaaagtctccccttgtagtacgcacaaaaattatttacatccaaattcgaactagctagcatatatttggtccacctggttcacaataatttctacttagagaaaaggaagtagcagaatatctgggaaccagaagaaccccatgcatgcatgcatgcatgtagtggctgcagaggtgtgctgcctctgcaaaaaaaaaaaacaagttctctgcatcttcccaaataagagctcagaggttcctggggactggcggtatggtctcctgaagcacaaagagaggaaatctaacaagaagcagcaagccctagaaatcttttcacactcagaaagaaacttctgcttcatcagaactcagcacccaacaaacatgaacctcacctgagcttaaagggaagggaaatgttagcttcaatgttcaaatctacctcctttttactttctctgaggaccctaatggctaatcagaacatgctgattactcctagttctgtttctctgaatcactatttgttacagccgacccttcactagagagtcaagaaaatggatgagaagatcagaatgcacttttaatactgctagttaagtacttagcatgtgtactttagagcaaaatacattcttcagcacccatgtatttgcttagctcattatcattaacctggttttagatatggttagagacagaaacctgaactggaattttatggagataagtagctgccaaaatctgtgtgtgccaaatctgatagatagatacctaattttatctgtaataggctatattctcctgattgctctccagctaagactttcttgttctccaactctcttccacctgccggcaccatatgagtctgtgttttaaggactataggcccaacattctttttttattgagaagctgcagaactctaaccggtagttcaataaattgtattacatccccctcacactgaatgccctacacactttggctttccatgtgtaattgcaagctgttattagccctgagctgtgtccgttactggccacactcttgctgagcggtcaattttttcccctgccatttcctttgctcacaccatgctgaccacgttggccagaggcggcccgaggtttatagtgcagcattgatttttcttttctctcaatactgacagaatcatagatccaaggcaaataaagaaatgcatt

SEQ ID NO: 39105 - DNA, 1231 bp, Bovine  19866880827569
ttatatggttggtgatatttggtagtcctctcccttaatattcagtatagaaatttatttttattatatattcttcacagccattcgtgttttgtagtggttcattactttgagtaactatcctacaactcaaacagtccatatttttaaaatttagattgtttcctctttttatgctatttttacgtattcctgctatgaacctcttcaagcatacatagttttcattatttaaagttgtttctttagatcaaaaggatgttttcattctaaagactattgatataagctgttgaattattttttaaaatggttttaccaaccattttacataatacctacctccataatacctacctacataatatttatttaccatatttcaccagtcttaggaattattattaaagttttttttgctagttggaaggtaaaaaatggtaacttgttttgatttgcattttttatttatttttgtctttccttactttgattatcactggactattgagttcaattaaattaaaagaaagattaaatacaagtaattaaaattttgtaatgcacctatatgattaagtaagcaaatggaaacataggaaactagcttatattggtcatgggaggtctcttggacaattggtagctgtaaatgaaatggggagatttttggggggaggagaattaaaattgggctactggcatctgaaatcactcaatatacgttcagaatatttctagaattctcaggctggttaacaggcatttaaaggagcctcaccctccaatgtgtatatttgagcaattttgcttttgtaataaaaatttatttcaagcaaaacaaattattgttttttgagaaaatatatttgtgaataaatgtgacctgcttatccagtgtccagatcaataaaatattttacttataagatgccatagtcatctttgcatctaattactctcatgagataaatgattcctttcactggaagctccaaaggcagtgcagtactgtgggatctggaggtatgatttgtagatcccatctgagatggcttggaagtaattactgctaagcatagccatgtgctctgcttataagacacacctttgttccaatgatttcttttgttgcactttatgcttggtagatgtgtggtgtttataaggattttgtgctttctgtctctcccttgaataaatttgcttcataggcactttcttaacctta

SEQ ID NO: 39106 - DNA, 2633 bp, Bovine  19866880837569
cattatgtgagttcgaggattggcaaatcactagttccaaagctcagttattcccatgatagtccgaacctaaaagttatagatcttcaaggctggccctggggccgccatcactgcaaacaaggtttccaggatgaatctcatggctcaaggactcagggtgaaaacctgaaagcttgtctattttcatcaactgcactatactctccttttttaagacatcaaagacacctctcttggcactagcttttgtttgtttgctaaacacttattttaggcaaattatttatctcttagatttttattaattcttggaaagtgttgttttgtaacattttttgatctctggagtggaaaaaaatgatcctgatcaaaaagctaaataaaattatactgtctaaggggtaggagatccaaccagtccatcctaaaggagatcagtcctgggtgttcattgggaggactgatgttgaagctgaaactccaatactttggccacctgatgcaaagagctgactcatttgaaaagaccctgatgctggggaagattgagggcaggaggagaaggggacgacataagatgagatggttggatggcatcaccacctcaatggacaggggtttgggtggactccaggagttggtgatggacagggaagcctgatatgctgcggttcatgcggtcgcgaagagtaggacacgactgagcaactgaactgaactgaatgggtagtatcataaacatttctgctttcctctttaccagattcagtaaacacatttttaggagataactggaatctttcttcctttagcagagctttactggccacgcagcatctgtgtcctacattcagggaacacgtggatgagcagaatccagcccgggccctcctgaggctcacaggccactgagcctaaggcaacatggagaggaccagaggtggttatcaacgcctgtgtggtcccagacagcatgaagggcgacctgtagtccaggccaggagagagccaagtggggaaggagggtaagccaacccttagtgaagagacatttttacccttcacgtagtgaatccttctgaggctgctttttaaaaatgaaaaaaaaaaaagggaagagtctcttaggattcaagtgatgagcaaattccatttcagaaatataaggaacaagcaggcttccttcttaaaatttagctattgttacaatggagtaaaaaaaaaaactgaggctctgtggtcctcaggattttggttggttggtcaatgcctgtatccccccctgcaccccatttaagcatcacacaaagcaaaccctccgtccccattcacagatacatgcaaacacacactcttcaaatcttctataattttttcaagtgaatcctttgtttgctctgctatatgttacagcatcagtcactgactccctggcagacattaagggtaagaaagcaattatactcttgaaaaagcacatttatggacactttacatgtccattcaaaccttttccccttgcaaggcttgcctttggctgcctctagatacagagggcattttaaagccattatgtatgtatgtgcatgagtgcgtgtgtacagttgtagcttcaaaaagcatttacacatttagagtctgttcttacctttgccttccattaaagcaaataaggatcatgatacttgattttatatgggacatcacttttgaaaaatggtttacgaaacacccaaataaaatgcttttggttttcatagtttgcagagaatacattctcctataaaacatgtttttttgtttttggtattttttttagaaaagacctcattgattttcagatgggcttgtggttatggtgtgcacaattgattttgattcaggaatacctctggagttctcttttagatggatcagtctgtgtgtcttactacagtacaataatgagatgattttaatctgaatatgatatttttctttactattgagcatattttatattttatttttgtcaactatttttaatcttaaatgaaagaaaggtgcatttctactactcttgattcccgggctgaatgttttattttgcacacctttttctcatcagaaattagagaaaaagtgcattttttttcttgcttctctgtgttttgaaactttcctattttttctgtatatctgcagtatctttgtagaggcctgatttgggcttggctttcatttcaaaaagcattccactttaaagtagctgttcctttatcctatcaacgaaagcatggaaaagtaatacgagtaatacacatagcttaaaatgtttactcaagaagaataagacgtaagaagagataaaagagacaaagaggaacttggagcagtacaatttaggataattgtatctctgtctaagggttgttgtgagaattaaattaatacacataaagcaattgtaagagtgccctaccctgtaagcactcaataatggttagttagtgttattattatctgaaaaaaataaaacatgtaacaaaatagcctttacatactgtgtttcagagtgaacaaatctggtctagggttaaaatacagaattttacgtttattttaaatgttccactcccttggtttttaag

SEQ ID NO: 39107 - DNA, 730 bp, Bovine  19866880841023
ttaaagcctttgtttgtgtcttatccactgcctcttacaatagattcagatagatttttgcacaccagtttatgtttgagtaatgcttgtggagttgaatttaaaaatgacctgtctggcaaagggttaagacttgggtttgacaagaaataagtgaatagggactttcaaggaaacagtttctgggaagtgatagagactgttctgaaattctgattttgttctggtttaaaagttttaaaaaccacatatatgtggttactgctttgaatcatctcactgcagtctttctgcttgaaaaaatattcacatctatttggaaatagcagcaattaaaaatactaatgaatttcaaatttctcttaaatcttagaagcagagaacataaaaaattttgacatgctatgagccgttaagtgaaaattatgtatattaataccaatgcctaattgtggaagaagggaatatactctgctggttaaagtaagatacagtgtaaacatcaagatggtatccaagggtaagttaaacccaagaagttcctctactttatggtggtttgacttgagataatgctatggtcagaggaaatggagatgaactttggaactccttcagcttcaccccttcaatacaacaaactgcagacaaagaaaacatttctcattctgtgaaagactaatcttaccactgttctgggtcctatcccctgcaccttagtgattatcct

SEQ ID NO: 39108 - DNA, 842 bp, Bovine  19866880845092
aagagagttagaaagagacagagaattcagaataatgtaatttgtcatccagggaagtgaatagatgagaagtcaccaattattggcttgctcagcagagggaaatgaaaaataattgttgaaaataacacaaaagctcccagaaacagaagggttctcatttgagagacagtagcctctgagaaagagtctggtattaaattgcttcactgaatatctttactaaaccctgtgtgctttataatttaaatctggcaaaggaaaattatgttatgtggatttcatgtgaccatccctttggtttatattcaacattatctaaatagttcatgagtgggtagtcgactcccagtaagcctcagtttctccatctataaaatggagacaaacaatagttcccatttaagaagtgctttgtagaaataagataatttttataaacaattcacatagccataattgcacagtattcaagaaatgtagccatttttgttaattatgactattgttgttatctaaatcaaaagacagtgaagcaaaagagcaaagtggttaaaagcatcactcaagcccatgactagcaggctgtgtggtctaaaaatgccacacatgtttcaagatgtattatgattatctttgttcaatcttattctcctatctctaaaatatcactttaagaaaaggtcagaaatctacatttgaaggacttagccacatggtctcctcccataggccctccatccctgtttctggccctctgaggggcctcagtttaagggaatctaagccctaagagttgcattaagagatagagttgcctaaataacctgtgactctgaaga

SEQ ID NO: 39109 - DNA, 2627 bp, Bovine  19866880880405
ttgtatatatacatgcatccattctttttaaattcttttcccaattaggttgttacagaataatgagcagagtttcctgtcctatacagtaggtccctgttggttatccattttttaaaaagtacaactgcattgtttttaattttgaaattttaaatacttgctaatcaaacatattttctcttagaaaacagagtctaggaagaatttttaaaaatctgcgtattcataagtgtttatggttccattgccccaccaggatacctttcaagctatgcaactttttatttatttctttttgatgggacaggcagtaacgaagggaataaaacccactagtagttcttgaaaccatatttattccaacattgtattttaatatttctttttatgctccccaaatatataatcaaatgtagaacagttgaagaatagagagaaacataaaaaatggaatcctatcccactccctaaagatagctgctcctaatattttgatctactttctatcagacatctttctatgtcaataaacagatgtctgtattgtatttcagtcatggccctggccagaaactgaattcaacccaggtgggtaaaatgaagagactgtaatgaaaggactctgtagagggatgtggatagggattagggaacagacaaggaatggacattgaggccgttacctggacactcgcagtatcaggaagctcttaccatctctagggctgaagtgaatgatgagaaaatagtagtactggaactcaattcaagctgaagccaaagaggcgtgattactccctggggtcatagagctgcctgggttttgctggtggcactggtggtaaagaactgccagacagtgcaggagatgtaagagatgcaggttcgatctttggattgggaagattccctgcagaaggggatgccaaccccctccagtgttcttccctggagaaacccatggacagaggagcctggcaggctacagtccatagggttgcaaagagtcagacatgactgaagtgacctagctcgcatgcatagcactcccaccagaaattcagtactgaaacaaagagagctggaggaaattctcttctctttccttttgcagtcacctgcattagtttaatccaactgaaagtcagacaggaagggcagttttagaaatcggccaagggcacagagcaagacacagaagggtatcggaaggatggagtgggttgacaaatgaacaataattgacatagtgcccattatggatatgccatactttaactcaggaatctcctacagttggttatttatatttttttttcctataaaaaagcttgttttaaaatggccatataaactgatatgtgcacatttagtgctcgattaacttataggatatttgttccaaatgaaattatgaggctatttatctcttgctaatctgcagtaatagtttatgaactaccataactcatcttaagcttgtaactcgtgaaaatttgtcacctataattatatcagtgcctttatatttgtgatgtgactttttactttttcaaagcctcctcgggttgataatcttatttgagccccacaacactctggagacagctgacagctgaattccttaccacactcattccttatgaataagtctatgctgttccttttagtgtgtgtctggtattggctttgttttgagctgcctttaacctcagcaattccaattttgttgagaatttaatgaactactttttctttctcacactgcatttcatctagctaatatacttccaatatgtttattctacttgatacttatattatccttttcctgtaaaggtaggaaaatccaggatcaggaagactttccatttacagtttcataaagttaggggagaaaagtaccagctaggaccaaaacaattaggctgaaaaatggtctatgagggtctagaatatgcttgttcactgacaggcctagcacatgaatgaatggatgaaccaacctaagtgttcttggacttcaatagattgagtacaaatgagttcatcttaccattggccagttgtggtggctcttagatcctggctgcccaactgtagatagatccttagctttctcctccaagtcttccctaggggttttgaaattcacagcacatgcctcacttccttttgtagaagtctgtatattttctacaccagccaacttttcttatttttatccttttagttgtgcaaaaacttcattctatgtgtgaacagacctattctctgctccatttctcaagcactctgcctcctctgaatacatggagaaggaataaattgacactcaggcatttatcagatctttcagcactagagcaactccagagagccctagaaagaaaaataggaggtgtcagtgggatacggatttgggggaaagatacctagaaataaaaggcaaaggaaagggagtaaaaccaaaagtaattaattctcaactgcaccacaagcccaggggtggggtatagattaggccctgtgtcaccttactccagttgtggaggacaggatatgagactagttcttcacagatactttataacaatctattctcactttattcatgagatgta

SEQ ID NO: 39110 - DNA, 1417 bp, Bovine  19866880912557
attctctctggacagatgtcttatcagaaaaacatatgtagctaaagagctatgtacatattacccctacttaaagagtatctactgagataaacaagtgataggacctcctgattatatttaaatagcaacagctacatcctgcatcagaccttaggcttactttgtgttcagtgtagactggagactgggaaaaaaacaaacaaacatatactaatgcctagaaataaataaaatatctagtgctgctttataactaagaaataactgttttatggacaagttcagcaaaatgagttaagattagatttatgtgttttattatctttctgcaagtataatctgacacagaatattattttcttggtgataatttctagtgtgaattgctttaagcatgagatagtttgggatacatataatacataaacacagaagatcaaattatttactatccaagggaaaaaactgttgtctatagccagtctctacagtgaggtgtataactaggtgtctaatttgacggaagataaatggggatgagaaagtagtattagttggttacttcatcttttaaaataatgtttattgctctaagatataaaagttttcctgttatccagtaagtttgagcaataggctgctttggtaaggctgataaataagaaagtacatctagcctaatgcaagatacaagacagatacttgaaccatttatgaaattactgagtaaaactgctaacaggaatttctaagaattaacaaagcaataactaatttcacctgtagttgaagggaaaactcttaaggtcaggcattgggtaaaataaaattcctcatttctttattacccaaatataagaaattggtgatggacagggaagcctggtgcactgcagtccatggggtcacaaagatctggacgtgactgagcccacttaactgaacccaaaaatatacgttttaattgaagcaaagatgaataccaacgacttccttacagagatgaacttctttagttccccagggtggggggggggggcatgttgtactggcaaaaagcttaattaataggacccagaaaatatatttttcattccacttctgttcctaatagtatgaccttgatcttgtcctttcacttacctggactctggtgctttcactaataaagtgagagaattggactggacaacttccttgacatcttcctgtcctgagacctgaatattttgccagttaagaatccaagaccaactgaccactgagtatatcactgaacaggatacaaagagtataagtgactactagagtaatcttagaaataatgaaggcttttgaggccctttctgagttaaaattgctattttcctataagtgatttcatctgactgagggacagaggaaatcagggcaa

SEQ ID NO: 39111 - DNA, 748 bp, Bovine  19866880922076
agagaatgtaaagatgtatgctcagtgccactgtcaaaatgacattgacttctttttgtcttaaaaatgcaatagactttcctccagatctggtaaagtcagagctttttaatgtgctttgttaaaataaagggttagctttaaagacaaagcacaggttaacctagattctttattaatattgtatttgtggtgacagtacattgcacataattctataggaattctattctaatttagtaataattcatgtctgtgtattcagtatgacagcatcattaattatgtctcaatgaatatggaaaacatatacgctgttaatgctaagcattattagaagttaaatcatattttttcatgatacatataataaatagtaggcttaacacatcatctttaaacccagggagtatcttaacctgacatttttgttcttacaatttgtgttgataaatataaaacaatatttactataggaaatgcaaagtatagaatctgtccaggagaatttagccttcttagcaggagcatgattatttggttaccttctgctgtctgcttcctgcctacacagtgtgatctttttcctcctccttcttcctaatatcctgtgaaggtgccaattaccctgctgcttatcagttgaaaactatgcctggtgcaaagggaacatcaattatttgtgagctgagagctaagcctgctagaatcataataaaggaagctggagcttctagctaatagaata

SEQ ID NO: 39112 - DNA, 882 bp, Bovine  19866880936080
aaacagaagtaaatagaaggaagaattttatagaacaccattatcacattttttcttaatgaaaagcagcataattgtggtttacacagctccttaatctcacattaaactaacagattgctgacttatacagaacatggcagtccaagctttctatattgctgtgcttaattttaggtcattatcctttattatgtgacttgtaatccttaaagcccatgattgtgtctggatatttggcaaggattgtacttggcaatacagggattctacttctaagagtgatgatttaattgaaaaatatagtatgattagattacatacattgcttttcttttgtaattgactagtttcttatcagtgtttttttcaacctttaagatcactatttagttttaggactttgctttaaaaaagaaaaagctttcacaactgaaatacaagtagtttattattataggaatttatccatatgctcttaaagtagacaatttaaataaaattctggctcatccacaaactggataactgtagtcaagttacttaatctttctggtctcagttccctcatctacaaaatagtaataatagtaataatgattaatagtgataattctaccaaatgcatgggattgttgttacaattaaatgagctaaatcttgcagtgtagattatagactaatggctagaaagcaaaaggtaaataaatccagtattattactattattactactatgtccttgcctagaactgtgtataaatggcaataagatgcttagccttcaattcaaggtactttattttactatctatatgggcttccctggtggctcagattgtaaagaatctacctgcagtgcaggagaaccagatttgatcc

SEQ ID NO: 39113 - DNA, 1246 bp, Bovine  19866880944153
tgaggtaacttgcaaaaaaaaaaagtaacactaatgtcatattttagtgattaaaaagtactttcccatcgctctctcaattaacagtgacaatagccccaagatactgagaagtgagggacctaaggctcagagaatccaaacaacttgcctagtttcacacctgggacctggaacactttccagcatatcaggacccccacctttgcagctcatctaattgcataaatgagtcacaagccaaaatcatcatcattcatgctacagtatctcacacagccctgccttttccagagccaagaataaatttttaaaaatcgtatttcttttcacttattcacccatgctgcactcacctgcttgtgctgtgaactcttttgttcatcagtcccaagttagcattattcatttgttcattttacctgtatttgttgagtgcctactgtgtgcaaggcatcaatagcacagtgattatgttataggaactataattatagatgagagcattatttacattttaaaaattcacttcaatcatgcaggatacagtgatctatactgcattcaaagcaaagtaaatcacagggcagctggttccaattttttttttaagtaggcagagtataaataataaataaaataaaagcgtcactgtgaaaattttatcagaggtcataaatgtgaaggagttaagaggctgggctgcagtccagaccccgccaccagtggcgtgtgaccttgggtgagtcacctcacctagataagcctctgtttcctcctctgtgaagtacgtgaattaagtggggtgatttttaaagtaccttttctgatcagcagtctccttgcactgtagctaaaacatcactcagtgcatctgactgtcatccccaaaggtctcaggggctgagagaagcacagggacttggttagacacaggatctaaacggtaaaacactatccagagcaatccacttggaaggcaataagctcatgtataaacataactgactgaaaatttatgaacataatttttgaacataatatgttcaaacatatttgaacataggtttgaacataatgttcaaaacacgaacatttcaaattatgaacatttgaaaaattatgttcataatatatgaacattgaagaaattcctaatattggagcagtgtcctacaataataaataatactcaaaggaaattaaaaatcaataggtaataatgtatcaatatcagttccttagt

SEQ ID NO: 39114 - DNA, 1889 bp, Bovine  19866880970489
ctcgtactaaagattcagccaatttctaattagtaatagaaaaagaagccaagaaaactcagctgattgctttcctgtagcagccagatatagcctgaatacacacatgaacacagaaagctcacaaaaaaattaaaaatagacacatgaatgaatctcacttgtaaccattccaaagcttctttcctaatggttgattatttagctcttcattactcattttgtcatgacctggtttcaatctgatgtttttagagagcctggtgacttgcttgaaactcgtcttcttattcttcattcagctacagcttctctgtggaagtatttaaggagctgctgtgtcaaacactatttcttcagtgtttggattcatgtcctgggttctgacttatctgtctcttcttgaatttctggttcatttgtgatctcttgtagccaacagctccaatactactaagctagagttctgcttacaacctgactcatttgggtcagcctcctccctgttgactccatttctacttctgagcctggcaccttgtgtgatattagtttctaccttaaatgcaatgacattagtcaatatgcatatgcattcctagttctggaaacaattttgatacaactaaattccttgagagaaaaagcagggatttagtcagttttgtattctcagcagagagtacagtgtctagcacacggcaaggcaactgttagagaaatggtggttgaaggaaaaattatccgtatgttcttatgtcattcagttcagttgttcagttgtgtccagctctttgagaccccatggactgcagcacgccagacttccttgtccatcaccaactcccagagcttgctttccatcaagtcggttatgccatccaaccatctaatcctctgttgtccccttctcctcctgtattcaatctttcccagcattagggtctttgccgatgagtcagttattcgctttctttataggccaactctcacatccatacatgactactagaaaaaccatatccttgattacacggacctttgttggcaaaggattgtctctgctttttaatatgctgtctaggttggtcatagcttttcttccaaagagcaagcgtcttttaatttcattgctgcagtcaccatctgcagtgatttcggagcgcaagaaaataaagtctgtctcatgttgttggaatatcccattccatcagaatgtcattcatcttggtggcagcgtccttattttactattttaacttgtcaatatatgtgtccaattttcagccttagaacaattttaataacttgtaaacatctcttattaaccgtttattatgtctaaggttcagtgtaaggtactacaaatcttttattaggtcatctcatacattgcttgtatatctttctaaatagtctatatcatctggcaccctaatttcttgtttattcccctttctttcccacctctctgaactccttgagggcaaaagttggaatttattagtcttgtgcttctagcaggtaatgtcctatgtggctcatgacgggtgttccttaaagtgtgctgcctacataagtggaggaatgataaatgacagcaccagacatgtatcaaagaactgtgctgtaagaatggaagaaatgctagataatatgctaattgtcataggtaggaagggaataggaaaggtcattatagggacagtgatggttttcttctaaaatgttaatccggaggcattttttttaaatttatttttcttagttcaggggcaaactaaatatctgtctagagagctacaaggaaaaattaatgccaacagatgtttgaaggcaaaaaacaaggcaacccaggagaataagccacaagaaatgaagacagctaa

SEQ ID NO: 39115 - DNA, 947 bp, Bovine  19866880982541
ttgttgctgtgtgagaatgttgagaccttctcaggtcttgtgctcaggtcttctaatttctcaagggaagccacaattttgaatttttgtgagatagtcttaattttaaatgttttcaactgagtctagtttgaatatacagacatagaatgattgctattgctcacttaaaggctttttaccctaatgggttttgaaaaattatgctatcttttggtctcttctgttttttggtgtatcatgactttttctcccatgtatacactacacaaaagcattataagaagaaatattttgtaatactgttttaggcaaaaatactttctgatccattatttgatacagtagtttcaggtcagagattatcatattgagtgtttgaattgctcaccatgtttgaatgaaccccagatgttttgctttgtgtacaaatgccaagtgccagggataaagaggtagcactttcttctaactctccagcaattgcatgtgtgtgctatgcaattgcatgtgtgtgctatttccacattttgaagtgctctcctatttagcttttattttgcctggagggtgtttttctgtgttataactttattttcaagtacagtctgagtgcaggataaccacatgcccccaaaaggttgaaaaattgatgaagaaaatgatacagaaagaagagaagaaatgagcacaataaaccttcatcacattcacattatattttatgtgcaaactgtatttattcacttttaaattgttgtttattacatatacagtttttattgttcaattgctatactttttttttaacctgagaaaatagtttaatagggatcagtatatcaatttgtggaccaatataaaacatgtctctggagtgggttttgagcaacaggatgctgctttgtggcattcagtgaagaatggctgtaaaaatgttaacacaa

SEQ ID NO: 39116 - DNA, 1484 bp, Bovine  19866881012858
aatactggagtgggttgccatgcatgcctccaggggaccttcccgacccagggatggaacccatgtctcttacatctcctgcactggcaggcaggttctgtaccattagcgccacctgggaagccctgtatatatatgccacatcttctttatccattcctctactgatggacatttaggttgtttccatgtcctgcctattgtaaacagtggtgcaatgaacactgggatgcatgtatcttttggaattatggttttctctgggtatatagaatgagatgctaaaatttagatttgaagcatgagtgagtaggactcacaagacaaaacactagggaaccaagggaatttctcattcttgtctccctcctttagctccttcctgcttggtttcccttgcttgattagccacatttcatgactaccataatgacctacctggtctaatacattgagatttggagaactgtagataataagactttgacaggttagagacagccttactgatatgcctgatgattttctgccaagtctgattctatcacagctagcctggcagttgctacactgatcatccctcctctcctttcttccctctgtgtacaactcctcacactgagtcagacacacccctctgcacactaagccacacaaaactgcacattcctttatttctgggtcctctccttttaccatttttctgtacttagatattgctatgaactgactcgtattccctcaaaattcatacaatgaaatcctaccccctaatgtggcaaatttagagataaggcctttagggaggtaattaatgttaaatgaggtcataaggcaaaaaacatgacactgaaagatgtactccccaggtcggcaggtgtccaatatgctactggagaagagtggagaaataactacagaaacaatgaagagatggagccaaagcaaaaacaacacccagttgtggatgtgtctggtgatggaagtaaagtccaatgctgtaaagaaaaatattgcataggaacgtggaatgttaggtccatgaatcaaggtaaattgaaagtgctcaaacaggagatagcaagagtgaacatagacattttaggaatcagtgaactaaaatggactggaatgggcaaatttaactcagatgaccattatatctactattgtgggcaagaatcccttagaataaattgagtagtcctcttagtcaacaaaagagtttaaaatgcagtacttgggttcaatctcaaaaacgacaggatctctgttcatttccaaggcaaaccatatcaatatcacagtaatccaagtctatgttccaaccagtaatgctgaaaaagctgacactgaatggttctatgaagacctacaaggtcttgtagatcttaacacccaaaaaagatgtccttctcgtcacaggggactggaatgcaaaagtaaaaagagattcctggagtaataggcaaatttggccttgg

SEQ ID NO: 39117 - DNA, 959 bp, Bovine  19866881038447
aattcttaccctatagaacctagaaattatctttagaaatgaatgagggtcctttctgaagatatttgaggagtttctgagtagggcatcagtgctaatattccaagtttttcaaagtatgtgtatacatgcatacaagcatgtgtatatgcacacacatttgtgtgttacagagatgctaatagctttaaaaagtgattcccaaacaagttttggaaacactgggattaaacatagtgaagcaaatttctttatcattctaaagtacattgtaactctacaagaggtaaacatgacatgtggtatttatgtgaccattagacactaaaatatcttgtagaactaatgtttcacagaacacactttggggcccattccatagaatctggggtttctgttaagtgtaaattctgagaatggaagaagaagatgtttctgaatccaaggatgaacaaattaaagatcttagaataatggttagcagaaaaaagtttgagacatttaaaagtagatgtaaactgttatacatgaggatattctatgaagggcaatttggcaagttattctacacatatatatgcacttttattaagtggtgtttacatatggttataaatttcagcactgtttgaaaaagctagagataagaaagaacccacgtatgtacatgatagttgctaaattatgtggtacacacttagaatgaattgtatgcagctgaaaaagttagctaagatacaggttaataaatgtgaaactctgaaagactggacgtcttgctaatttttaagggctttaaatttctttcagtttttaaattttttgttagagtataattgctttacaatgttgtagtggcttttactttacaagaaagtaattcagctatatgtatacatatatcctcttcttacttgaacctccctcccatgccccatcccactcctcttttcatagtc

SEQ ID NO: 39118 - DNA, 1342 bp, Bovine  19866881047630
tattgttaaatatgtataaacatattttgagaaacaaattgaagatatgactgactgcatgaccactttaacaaatttgggaattgaacacattatttttagcaatgtatttgacattattctctttggtgaatcttatttccccactttgacttacctaaaagcctaatctcaattgaattgtgaatcttggtttattcagaattattttgtgatccacttttactggaaggccattgctactttaagtcatgtgattttggctaatgcaataaatttttgaatcctaatatgttcatatctgccaaagaattatccccagataccatcaggacttgatgaaggcagtctttatcctagtccagtgattcaatgggggaaaatttcagatactatccatggatattcttaaaggcaaatagctctttgcttaaaatttagttaaatcatgcactcagttgttaagcatgcaaagatttcttcaccttcctgaccacagtgaaatgtgagcaaaatggccacatttattggaaagatttactgtgaaaaattcaatacacagtattttgatttccttaaatatgacacatagttcccaaaagcagatcaaatctgatgtggcttatttagggaagcagtctctaatcctgacaccttcattcaataatttattttaatgaagaattttgtaaagaattaactaacatgtggcaatgattttaaggccttttaatggatagcatgctgaaagcccttaatctcccctgaagggctccagacacatcctccacatcctgtattcagcatcaggaacaagctcagaatgaaaacctctggtgatagtaactaagtccctcatctgctctgtctggtcatgattaggctaacaaatagaatttgtttttagaattgaagaaatcttgctgttgctgctgctaagtcgcttcagtcgtgtccaactctgtgtgaccccagagacggcagcccaccaggctccctggtccctgggattctccaggtaagaacaccagagtgggttgccatttccttctccaatgcatgaaagtgaaagtgaaagtgaagttactcagtcgtgtccgactcctagcgaccccatggactgcagcctaccaggctcctccatccatgggattttccaggcaagagtactggagtggggtgccattgccttctccggaagaaatcttaaccatcacctattctattcacttcattttgtaaatgaggaaagcaaagcccaaaggggctaagtgaccagtccaaagccacactactttaaccacaaaactgggattgttctcaggtctttagaatcggcgac

SEQ ID NO: 39119 - DNA, 1067 bp, Bovine  19866881077410
aaaagcatcaattctttggcactcagccttctttatggtccaactctcacatccatacaagactactggaaaaaccatagccttgactagatggacctttgttggtaaaagtgatatctctgctttttaatatgctgtctaggtttgtcataacttttcttccaaggaccaagtgtcttttaatttcatggctgcagtcaccatctgcagtgattttggagcccccaaaaatattcctactggatttagtcatcagttaattctccaaaaggtatttcatggagaatggaggagttctgaattattgatgtgtcagcctaggaagtatgttactttttacagtgtcggtttgcttaagcaggcagcatagttgttgcaaatcctatagttcagtattatctctttaacatacctgtgaggttttattgcaaaaacttaattaagtactgtcaactgaaaaaattaaaactccaagtgccattagggcacaggcaaactttagagttatggtgtggagccctgtttctaaaggaatttgtgggttgcagtagagctttgttttgctgttgatcacaaaagcagtattatggcttgcttaaaaaggcattttaagttattttttaaaaagggctttcccattcttcctttttagttcctgaatgcatttttacatagcactaggctatgctaagtcacttcagtcgtatccgactctgtgtgaccccatagacagcagcccaccaggctcccctgtccctgagattctctaggcaagaacactggagtgggttgccatttccttcttcagtgcatgaaagtgaaaagtgaaagtgaagttgctcagttgtgtccgactcttagcgaccccatggactgcagcctaccaggctcctccatccatgggattttccaggcaagagtactggagtgatgtgccattgccttctccgttacatagcacactttgccctaaaagctagatatgagaaatgtcctttaagagcttctgctctactgcaggtatcaatgctatgcataactataagaaaaataaaaacaattacaaa

SEQ ID NO: 39120 - DNA, 1266 bp, Bovine  19866881105252
tttcctcctgtaagggatgttcccaacccagggagggaatccatgtctcctgcctctcctgcattgcaggtaaattcttttcccagtgagccattggggaagaccttggagataggatagaaacatctaatgtggcaatgtcagatactcataaactttggttaactgtgtcccaattccctccattagtgtatataaatattatgaatcagtatttattgtgtctattattttgtgctgaactctgttctaggcaccatgataataatcagaacttgcccatgaacaatatctcatccttagtcttgcccaaacaggtaaaattcccccagaaattttgttttggtctggtataggagatgaaggaaggcatggtctcaagtaatacctatgtaaagtggaccatttagttcctggggcaccacataaaataatataaagcactaaaagtaataagaccttttcagtgcagattggggtcacccataaatgctgttcacttaagctctccaacaggcttaaataatcatataaaacttggtctcgtgttttgaatgtagttagaggaacatgcaatttagatttaaaaaatcaatgtatattagtgttaatctgaatttactttaaaagaaaaacaatagtccaggagataatataatgattaggaataaatttttacaagttttatttttttaaatgtctcatgtatttagtatctgagatcagttctataacaaagtttaaagtaaggtaaaataccagtggattatagctgggtaattagtcactgtctatttacttaagaggctttgagtttgtggtttagtttaggatttactgggaaagactggtacatggatggaagtccagcggtacaaactgtaatccttgcccaattatctagggatacaattaatcaagggacaaagacagaacatttgtgaaattgcttatcttctacagtgagattctggcttgaaatatagtcttatttgaggtgttgatttaaatcactgtttaaaatgtgacttgaggcaattttggtgaattttatgttttgtaaacggtagagtgcaatacggttattcttctgttttgctcttctgtgtcaattccttcatctatcttttgttgcttttaaaataaatatctggactaatcctgccaagagaagatcacaccccaaacatggccatcctaggtccaagaggggaatgtataagtgtgtgtgcatgcatgtgagcttctatgtcatgagtcacatgg

SEQ ID NO: 39121 - DNA, 3695 bp, Bovine  19866881137535
tatatgtaatgaaattgaatttctgagacactagataatttgtagagacactggggcatacctgttcccatcacttccaccaggtaataatgtgcctaacgatactgagtatggctctgttcagctcagttcagtcactcaagtccaactgtttgtgaccccatgggctgccacacaacagtcttccctgtccatcatcaactcccagaacttattaaactcttatccatcgagtcagtgatgctatcaaaccatctcatcctctgtcttccccttctcctctcacgttcaatctttcccagcatcagagtcttttccagtgagtcagttcttcacagcaggtaggcaaagtattggagtttcagctttagcatcagtccttccaatgaacacccaggactgatctcctttagaatggactggttggatctccttgcagtccaagggaccctcaagagtcttctccaacaccacagttcaaaagcgtcaattctgcagtgctcagctttcttatagtccaaatctcacaatcatacgtgactacaggaaaaaccagagctttgactggatgagcctttgttggcaaagtactgtcttaggtgggtcatagcttttcttccaaggagcaagtgtcttttaatttcatggctacagtcaccatctgcagtgattttggagcccccaaaatagtctctgttcccattttcccccatctatttgccatgaagtgacaggaccggatgccacgaccttagatttctgaatgttgagttttaagccaattttttcacttactctttcactttcatgaagaggctctttagttcttctttgctttctgccatagggtggtgtcatctgcatatctgaggttattgatatttcacccagcaatcttgattccagcttgtttatcatccagtctggaattttgcatgatgtactctgcatataagttaaataagaatggtgacaatatacagccttgacgtactcctttcccgatttggaaccagtctgttgttccatgttcagttctaactgttgcttcctgacctgcatacaggtttctcaggaggcaggtcaggtggtctggtactcccatctcttgaagaattttccacagtttgttgtggtccacacaatcaaaggctttggcatagtcaataaagcaggaatagatgttttttctggaactcttgcttttttgatgatccaatggatgttgacaatttgatctctggttcctctgccttttctaaatccagcttgaacatctggaagttcacgggtcatgtaccagtgaaacctggttggaggattttgaattaggaattactttgctagcatgtgagatgagtgcatttgtgcaataatttgagcattgcctttctctgtgattggaatgaaaactgaccttttctagttctgtggccactgctgagtttttcaaacttgctggcatattgaatgcaacactttcacagcatcatcttttaggatttgaaatagctcaactggaattccatcacctccactagttttgttggtagtgatgcttcctaaggtccatttgacttcgcattccaggatgtctggctcaaggtgcgtgatcacacctttgaggttatctgagtcataaagatcttttttgtatagttcttgtatatattcttgccacctcttaaatcttctgcttcagttaggtccatacaatttctttattgggcccatctttgcatgaaatgttcccttggtatctctaattttcttgaagagatctctagactttcccattctattgttttcctctatttcttggcattgatcattgaggaaggctttcttatctttccttgctattctttggaactctgcattcaaatgggtatatctttccttttctcctttgccttttgcttctcttcttttctcagctcattgtgaggcctcctcatacaaccactttgcatttctttttcttagagatgatcttgatcactgtctcctatacagtgtcacaaacctccatccatagttcttcagacactctatcagatctaatccctcgaatctatttgtcacttccactgtataatcattaagtaatttgatttaggtcatacccgaactgtctagtggttttccctactttcttcaatttaagtcgaatttggcaataaggagttcatgatatgacccacagtcagcttctggtcttctttttgctgactgtttagagcttctccatctttggctgcaaagaatataaacaatctgattttggtattgaccatctggtgatgtccatgtgtaaaatcttctcttgtgttgttggaagagggtgtttgctatgatcggtgagttctcttggcaaaactctattagcctttgccctgcttcattttatactccaaggccaaacttgcctgttactccatgtagctcttgacttcctacttttgcataccagtcccctgtaatgaaaaggacatcttcttttagtgttagttctagaagttcttgtaggtcttcatagaaccgttcaacttcagcttcttcagcatttctggttggggcatagacttagattactgtgatgctgaatggtttgccttggaaatgaagagataattctgtcatttttgaggttgcatccaagtactgcatttcggactcttgttgaccatgatggctattccatttcttctaagggattcctacccacagtagtagatataatggtcatctgagttaaattcgtccattccagtccattttagttcactgattcctaaaatgtctatgttcactcttgccatctcctgcttgaccatgtccaatttacctttattcatggacctaacattccaagttcctatgcaatattgttctttacagcattggacttcactggcactaccagacacatccataagtgtgtgtcattcctgctttggcccagccacttcattctttctagagttattagtaattgccctccattcttccccagtagcatattggacaccttctgaccttgggggggcactcatcttctggtgtcatatctttttaacttttcatactgtttgtggtcttgcagtaagaattactggagtggttttcaattttgtcttccagtggaccacgttttgtcagaactcttcaccattaccagtctgttgggtggccccgcttggcatggctcatagcttaattgagttatgcaaacctattcaccatgacaagcctgtgatccatgaaggggatatacatacatatatatatatatatatatatatatatatatatatatatgtaagttacattttaactattagtataaaggaaggatggggaatgagaagagtataagcaggtgatttaattttcttagaaataaattactagcctattcattgtccatctgatttagtcaattcctaattatctatggtaaatggaaagtagaaaaaataaggatgagcttatacatcccctgataatcccccaaccatatttcagaacatgtctatgctcagaaacattctaatggcattacagtttgagggcatagtactctagttgtctcactatggtcatatcacagagatcagtgatcctgttgtttatttgggtgacctcgtttctgtgacagaataaatgctctcatatggcatgcacatgtgctg

SEQ ID NO: 39122 - DNA, 1122 bp, Bovine  19866881168546
atttcaatcccttttggtgacacaatattaattaaaatagtttatgttgcacttcaactggaaaaagagtcagtgaaaatagcagctactcagaacacatgttctatacgcatcaacatggagggcagaaaataattttctctttctccgggcggcagacattagctattcaagagagttgctctgacttagtttatctctgtgttatcactgaaataataataataataataataataaaaaataagctcttcctgtttgtatagtttgctcaataggaaataaaaatacacatgaagaaaatgcttctaattctcacctgctagtgcctcaggaagagcaaaataaatgtctgtgcccacgcagcattatgggatattaagaatcacagtcactgtttctcttaattaaaaacagttataatgttattaaaaattctttttattttcaattcctaaataatggttgcaattgaatacattttctttctaacacggaaacataggacaagtatggagtttttcacacttaaaaaaaggagaaaattatgtaaatgtattagaggaaatgaattctcttttaacaatgatttttaaagtggcagttaattcacttaacaaaaacatttatcaaagtacctagtatgtgcctgactctggtcaccacttgaggctgagagaatctgaacttgaggctggaaatctaaattttaaccagttctccaaagatattcttaagcacatttgaggcaaaggaacttaaatcaatctcatcattgcccctgtaccacacaattaatggaatatacaaattattaataaaattaaagaaatattcactgaataaaagaccaaaaagaataaatccctcaaaaattcttgtttggggcctgatctgcatgaccacctgagaacatcaagacctagccggcctaatttgggccttccacagccaaaagtcctcatctggtccctaacctactatttttctctgcagtgactatagtttaaagtagttaaaagtctttttctatctactgccatctaaatgacacagagaaagaaatattccctgttctgtaggactttgtaaaaaaaactacctgaggtctttcctggaaat

SEQ ID NO: 39123 - DNA, 1640 bp, Bovine  19866881172958
atgagtcagtcctagaaagggtaattaaggcaagaggtgggagtgtgatctggctggaggagccaggacaggggaaaatggtgaaaagaggtgaggtaggagaatataaaaagagaggtaggatttgtctgcttctgacagaaaatccacaaaggtgagaagaatagtttcaaatgactcacttttgtgtcttgaattaatgctgaaatgagctggaagtcccagaaaatatctttttaaagaaccgactactccagtaatgctaagattcctttggattatgaccctcaagtgctgaccctcctctaccactctctataaaccactatggtgttctctctctataagcctctggatatatctgttttggctacgcttctgctaggattctggaatgtcagaaaagtgaaagttgctcagtcctgtagactctttgtgaccccatggactgtagcctgccaggtttcggtatccatggaattctccaggcaagaatactggagtgggtattcttgggcttcccttgtggctcagctggtaaagaatctgcctgcaatgtgggagacctgggtttgatccctgggttgggaaggtcccctggaggagggaaaggccactcactccagtattctggcctagagaatcccatggactgtataggccatggggttgcaaagagtcggacacaactgagagactttcacttttatagatacctgttgaattaataaatgaatatattctttcttcaaggaacctgtaatgtgtgtagaaaggagatgtattacacaaaagaagtagagaacagaatttggtatatgaccaattgtgtgattcagactaaaatttaagtatatatctccagaatcgatctacacattattaagatttatgttcttactagaaagaaaccaaatgtgtcagatagtatatcagtttgctagggctgccgcaacaagcagtacaaactaagtaccttaagtggcagaactgcatcatcttacagttccagaggttcggagtctgaaaccgaggtgtcagcagggttgttccttctgtggactgtgagcgagaatctgcgccatgcctctcttctagcttctggtggtttgctgacaatctttggcattccttctcttataggaatgtcaccccatctctgatttcatcttcacgtgtctctctcctgggtgcatctttctccaaatttccctgttttataaggatgccagtcatattggatttgggatccaacctaatccagtatgacctcatcatcacttaattaatcatatctgcaatgatcctattccaagtaatgtcacacttctgaggtttggggtgagtttggcttaattcctaatacatggaaagagggtagattttcttctactttgccggtttggtaccattaaagttttattttagtctcctctgcttaattcacttaatagatgagatctattgtaaattatgaataataaaatgaaggattataaatgagttatttgctttgctgtttacttaacaggatttatacacagatattgagatttaaaaagccttctgataagagtggctaacatttattgaatgttcactatctaatgattttcatggattttcccacttaactttca

SEQ ID NO: 39124 - DNA, 1618 bp, Bovine  19866881229168
actctttcagttcctttaaaggacctattactacttggctctcaaacctcacacatgctattttatcacccatttatttatttaaaaatttttagtgccttcagtgagccaagcagtgggcaaatcccctgaggatacaacaaggaaaaggcattcttgtagaatctccagcccctgcctgaaaacccttccccattcccaccactgcttaatgttcatgtcccaaactgaatgttatgtcttcgaggatttcctctctgctccccacaaacaggttaggtgtcctactctatacttcttctgttacaatactgatcaccctgtattgtcattgcctggtttcttgtctactcccccatgagactgtgagctccatgatgggaaaggaatacgtctaacttgctcacagttatatcttcaatgcttaggtcactgccaggtaccctgaggattctcaataaatatttgatagacagatagttctaggaattccaagaagtttagaactacaatatccttaaaaccacagataatttgtttctaaagtgaaaatttcaggccctgttataggtaataaagaagatatttggaagtatatatccaccagaatctatgatataaatggaattgtttattttttaattatactaataaataaaagagcaaagcaataatatacaactggagtgaatgaattttaaaatattgatgaccaagaatcaaatcacttgaataaaaacaaatggttataactgggatatttcccagttacctgaaacctaaagccaatgctgacattaatgaataaataaagggagtagggagaagagtcagtaaggactcagaaacaaatctaggattcttattctcacttaatgtagcttttgaagtttggcctggaactaaagcaaagaaatcagttcccattaagatatcatatacagatgcatctgtgaggctaaatatcctttcctggaaccatttttcctgggatttatcacatgagtgccaatataaagcagtgctaagtcacacagtagaatatacctccaccagtgtttcaaaaggtgcaaaaaaatgctcttaaatatgacactttttagtatcagccatctataaaatcaaagaacatgacattgagccatctcagaagccatgtctttgattgactgagataatgtggtctaagacattattttctcatggtctgagagcacagggatagaatttggaatagtgtaggtaaatggataattaacatacccatttaggctttttctctcaaatatcaaatatcttaaatgagctttggaaaggttctggatcacattcaatttgcaatcaaattcccttaataagattttacagtgcagaaattctttcttgctgattaaaatgagagtcataattttgagtcaggtactgaccaaacttcttacataaggagagacagcacgctggaaccgagtcatgaacagcctgggtgcttacaagtagcatgcgagtgtatttgaaggagcaagagatcttttcaagctcagatgcatagtagttacatctagaggcagtccagttttaaagttttacagcaaaggttcatactggtcccctgtgggtg

SEQ ID NO: 39125 - DNA, 1611 bp, Bovine  19866881300907
ctttgcagagacaactgctggtttccatggcaattatgtctatggcatctagctctccccctgcatattggtgacacaggacagaggaaggccacatgttcagttatgcataagttacagtcttggttattcaagaaagaccatcatttaccctataccttgagagtttaagatgttatttctaaagcagaaatagacacacaaatgtatggataccaagggggaaagtggggatgggataaattgggagattggaattgacatatatacactattgatactatgtataaaacagataactaatgagaacctattttatagcacagggaactctactcaatgctctgtggtgacctaaatgggaagaaaatttaaaaaaacccgagaggatatatgtaaacatatagctgattcactttgctttacagtagaaactaacacaaccttgtaaaacaactattgttgttgttatttagtccctaagttgtctccaactcttgcagccccatggactaacctgccaggctcatctgtcctatactccaataaaaacattttctaaaaagctgtaaaatttagtgtactacataatgaagctagtccacttgtaggaacctacgttaatgaaataatttagaatgtgcacaatgattttatcaaaagcatatttgttgcagcattaaacctaaatgctcaagaaaaaagagtaaaatacattctgaaacatctttatacatactacacagacgtcaaaacaaagcccagttttgggaaagcaaatttcttgtcaaagaaagatgctcatgatatattatttcatgtgaataaaagttgaaaaatagtcttatggtatgcttctatttaatagataataaatctctttatgtgtgttcatctatgtgcaagcatttttctgccagtatatacacaaaaatatgaacaattttttaaaaagatgctatgcagttgacgcgatgcatggtcaaagcatgagggcatataaaaatacagatctactgtaagcttggctggatcctttatatgacttgatctgtttctcacatcagaatgcattttttggtgcctgaatacaaaatacatgaggagtgtttaatttcccttgatttgtttccttctttatctcaaagcccctttttcatttttagagtgaagcaataatgaaaaatacatgaaatatgaggaagagagtcctaatttggaactatccttccagtcatcctaattgaaatactctctgaattagagaattcttcatgaaaaacagctttatgagaaacataaaatagattctgggaaaattattctctcccaaggatttgactgttgatttctgtcctggtcatacagaaaaagctgcacagtggtgaagcacagacactccatccagctccatcatttatgactctgacatctttgcaagttacttaacatttaagttccaagttctgttctgtaaactgggaataacaactactttcataggactgctgggcttaagctagtgggcataaagagcttagcattgtgcctaatacataggtattattcatatccatattaactattatcttacttatcatacttagttca

SEQ ID NO: 39126 - DNA, 822 bp, Bovine  19866881314352
aatggggaggatgtttcttgaagttgtttgttgccttgacctagccatcttcaaattttaatgaatatttgcatttctgcaaatgatgagaaaaggcaggaaggaatttttacacattaactgaacccaaaatagagaacagagagaggtaaaggagcataccatagtggctaagacagtgaagaatttgcctgcaatgcaagagaactgggttcgatctctgggttcgatccctgggttgggaagataccctggagaagaaaatggcgacccactccatgtgttcttgcctggagaatccatggacagtggagttacagtctatggagtcaaaaagagttgtatatgactgaatgactaacactttgatttttcaaaagagcataaccactgctgaccctgtcgccatatttgtttcggtaaattcttctatagagtccttgtcataaaactttccgtgcttttccattatatgttcttaagtgtaatttaaaacctacttattttgtattgtctacagttgaaccatttatttctttaggaatttctttaacactaataattaagcacaccatagtcaaaggcatctttaccaagtacatggactttctcctctatctagcttccaaaggtactacaaagatatttagaacaccagccttgtagttgtcaatattttgagatgtgtgatgagtaaatggaacaccttacatctttcagtggtagaactgtcaaagaatgtttatctttcttgcctctcaccccccaaatgtagactatttcagaatgcattacagaggaaataaacagtgattttaagtt

SEQ ID NO: 39127 - DNA, 842 bp, Bovine  19866881329233
catcttaatgtgacttgttgctttttgttcacaatagaatctgtatcttatagtggaaattatatgccagaacagtagatgggaacttggatatgtctcttgactcatgcatgccaggtgcctaggatctgcaggagcacatctcatttatcaagtgcctattttactaattcaattcccagaaggtaaactgattgctatttcattcagtttcttggaggacttcagagctaccttttaggtggtgataacagtatatatttctttatgtaattttgtttctgtcttttgactccaaaaagtaataaaatcctagggtcttgttttcctactcttaggttgactccaactttatttcctagctgctaccctttacctggatgactataatccccaatttttactctgaacagagctggagaattgaattagacaggactatcacctcctttgttctatatgctatacttttattattgagcttactgttaaatagagctatttttatttgtgcttcttataagttatagcttctccaattatgtacttcatatcttcatctcatcctcttagatttaagcctttaagactgttttatcttaatttttttggggggggcgctgcatcagtcttagttgcggcatgcaggatcttcagttatagcatgcgaactctcagttgcagcaaatgggatctagttccctgaccagagatcgaattcccctactttgagagtgtggagtcttagccacagggccacaagggaagtctctatcttaatcttttattgataaatttgataagcataaaatttcaagaatgcttataaattccccatcctc

SEQ ID NO: 39128 - DNA, 1436 bp, Bovine  19866881329252
tttggtttttgtttttgtttcgtaaagttacattttaattattttgggtgcatgcctagaagtgaaatttctgagtcacatggcaactctatttcacagaattttgttatctgtaaaatgtggtgaacagtccctctaagctatgaatttcaggaaaatgttatgaggatcaaacaaaaagtaaactaaaagcattccataaacactaaattactaaaaagctttaagtattattcacatttcaaaagcacaatgcccatcttcaacatagtagatgctttataaagatgtgtgtgctgttaacaaacaaacaaggagaaaaattaaaaaacaaggataaaaaatatattattaatcctgcattgtaccaatcaagcagaagcaagttactcagtggataccatgagtctgcatttgttttcctaaagcagaagaataaataaatgtcttcatgaaaaaaaaaacaaaactaactcaacgtcttcaaaggctttctatcctggcaatcttggcttcctgggtgactcagtggtatagaatccacctgccaatgcaggagatgtgggttcaatccctgggtcaagaagatcccctagagaaggaaatggcaacccactccagtattcttgcctgggaaatcccatggacagaggagcctggtgggctacaattcatgaggttgcaaaagagtcaagacatgatttagcaactatacaacaacatactggcaatgtgtttctccagacaggctctggaacgaatggcttgtgcatacaacagtggcgtccactagggacgtgtggtattccacttcagctctcttgaaaaagagctctgccaagtctcattatttttcaggagttaaaggtggactcacacccctccctgaaaactccaaggaagaagcagtatttttttaataaactgcaaattggcatccattcatagctgacatgttgctaccatttcaacagtgtgttcattcaggtgttctgtctgaattgagacttttaggcactaataataattaactactttcttagcaatgaaaaaagtcttaaatgcctatttacttaatggtcccctagggtgtctttgttttgaatgggattaaaaaaaaaaatcttagctgcaaaataagcaggtgattctaatcaataaagccagaggactatattgattactagaactccattctttagtcattaaccctgtgaattctctaccaaagccgggtaggactatttctacctcttagaacatagaaaggctcattgagaaactggaatctcatttcactttcatgtcttccactaagcttacagggtcatgtttagagagtccattccacaggctgcacatgtgggaagattactttcatgactgtctctcagtagaactgtgtttaaagatatttggtgttttcttcccattgg

SEQ ID NO: 39129 - DNA, 1184 bp, Bovine  19866881331390
aaactgtgctaatactttgtccaagaaaattattttaagagaatatttaaaatgcataaattcaaaaaatacattcatccccctcaactaaattgtaaacaaatagcaataaccactaggaaaagagagtacttggagctttttaatgattaagcagaaccctgcttgccgctggtagtgctctgggctgtagacaactcaggattatctctgggtcctggagagcagttctgtatgaactgaatctgacattctgagctagtttcgtaagtcaatatcatcattgaaaggaagccattgatcaatgaagtgaagctactaaaaatggattccagcctgggaaaaattcactggggaagctgtaaatgtgcctggcctgtaatggccaggctgggttctttgtgatttaactggctaggagctgaaggctgctggccagacaaacccctagcaataacacatctcaccaggttccagatccccatcaccctcttgaggcagaatgaagggcagaaggaaggagcaggcctcactggagtagactgggcagagatggggtctgctgggactcagtgaccatcctcacgccctggctaattccagcttcccagaagcgtgactctataataaggggctggtggtggccttgccgcgtctctgccctcttttcttgcttagtggctcatcgcacattgatggagatgaacaatggggggaggggctcagaggccagtaggttagacaaagaatgaatttgtgccttggctagatccacgccaattatgtctgaataaacaaatccatggtacaagccaaaagcctttcttcccccactcccccaacacactttttaatttttatcttgttccgaaaagttggacatattccctgtactgtcctggtacccagatggcctgtttgtgtaagcagtggggaagaaggtcaataatacatcagcatgcacagcctccactaaggtcagtcctgcataaaatacaccgtgacaacctgagggcaagttttaaatggtgctccacaacaaggttgcggggacgacagtgagggcggtgcatatgctgccttctcacacaggctgcgaaactgacttctgccccttcctccccgctgcaaagatatatcttcctgggtttgtttagtggtcttttaggcaaagttttctttat

SEQ ID NO: 39130 - DNA, 1724 bp, Bovine  19866881396424
tattagtctataatcaatactatttgctgtgtgctctgtcactgaaataaaaccatgattgttttgcaaataaagttttaattactaaaataaacatcctcattttgaaatgtagtaaccctgtatatcccctaacacaactttattaccaggtataaaaatcaacctaggttttaaaagtcttaaaacgttgatatttgaaaggaacaatctgaacttgtgtgttgtttttcagtgcaaacaggtcatatatcttgggagagagtctgaactcagttttttcacctgtaacatgaagataaataattcctagctcacaaaattcttgccaaaattaaattagacatatgtgcaaaccacacagaatttggaggctgctattaaaatggcaaaatattaaaaatctgaacttgaatattagtgcctgtaagtggattactattaacctgtacatttcaataactgctgtcaatattcatatacacagatatttatttaaatgctgatgttaagcctatgcaatcacttaactcattcagctatctcagagggaagaactgacagccaacaacttctgcaaaattgttaagaaaatgtctctgaagccgattgagacaactggtctcacagctttagccccttcaatctttaaaccatctacgatagtaagaaatatctaaattataaacctaaaaacttcctagcatctagcacaattcacaaactggtctcactccgactttgaacctgttccacttacccatgagattgtactacaatcaaactccttaagacattgctctatttccagctcaccagaggtctaaccttctctagactgtgtaccaaggactatacctcaaagaataagggttctataagtgaaagtgttagtcactcagctgtgtccaactctttgcaaacctgtggactggagctcaccaggctcccctgtccataggatttcccaggcaagaatacttgaatgagtggccatttccttcaccaggggatctttctcacccaggaattgaacctgggtctcctgcattgcaggcagattctttactgactgagctacaagggaaccccacagaccatacaccccatctaaaagaaaacagcactgcaacacccagacaaaatgcttcccaagtgaaatactattagagctgccagtctgcaacttttgactctgcacactccctgggaaaatgtttcattgtgactatagaatcatgaagacctcagtgctataaacaagtgtatcactacagtaaagtgttgttttaccagactacaacttaccacatcctattcactctcctcagttaactagcattgttttccgtactgagcttatagtcgggggcgaggggtgggggtaagcaagcactttttaaaagcccatggagggactcatgctgaagggtaaagaacagtgaattagaagtctaaggaccaggtataaatcctacctgtgagaccacctagctctggaactttgggccagttggttcatctctgcgacctctgtttccacttctttaaggctgaggttttatcaggttgtggggtaagttccctgctgactcaaaaggcccacaattctatgacttaagaaaacaagtcaaggacaccaagagtcagtccatatccagcccaacttcctccattacatctccacagccagaccattatttactaaggaagacaaagaaata

SEQ ID NO: 39131 - DNA, 1197 bp, Bovine  19866881610791
cctgggggaaaagagggagatgagcctgagagtcagactagaaagatagataatctagagcctaagggatcaggtaaagagtctttttcctaaatgcaatttgtgagttttaggtttgtggctttggctgcagtaaagagaactgtttggaagggaagggtataattaggaaaaggacttaggagattgttgctgcagctcaagcaagagacagaggtggcctgagtggcaaagtgatagcaaacacagagaatggacagacttgaggaagagttctaaagcagagtcatcctcagaatcatattgtgtcttccttttattgagtcaacctcccaactcatcttctcttagccttttatatcccaccattcactaataccctgagaatatgaaaatggagagaaaaggtacccttcccttcggccataaaacacttatgagaaattatcacatttccagtatcaataggaaagaggccctctgacatgaaacatgcatacccaaacttccatatcaaattaactaatggagacccttagtcttttcaaatgaaagaaatcagtaccagcacagctacaaagtaccaaaagtgagactgaaaattgtcttcattcctcccaacccagggttatgtctgcttgaccatccaaagggaacatggtggtcagcatcgggctgccctgaggagggaggaggctaacgtcccttcccctctgcttccataaaggctcggaccacttcaggactaaaatggatgttgatcatggattcttaaaaggacttgtaaaagaaaagaagtaatacattccctcctgtgttgtctcttttccctagaaaccctctatgaaaggtttttattatccaaggtagctttttagatgtcactccagccctaagtgtatttgcattaagatgcagcttatttcttgtgtctcccagaactttgccctcttactattagtacatttacaacccctcacactcacaacagaacaagagaagtcaaagtagatgaaagggaccagatccatttgctcctaaccaggccccttaagagcctcttagaggatcccaggttacaaaaatgttcatcttttccattcatgaatacctttttgaaggcagagatgggtctataaaatggcacaagaataaagtctgtttttcccactgccccttctagaatcttttcttcaa

SEQ ID NO: 39132 - DNA, 757 bp, Bovine  19866881653728
gcttagtttcttttatctgtatatttatcataaattgtacttgaattgcaagtgtttgatctttatagaaactatggaaaaataaaaaatagacaaaatttaaataatttgtagttttactcataacacttcggcatttgatgtgtattgttctaaaatgtgtgtgtgtgtgtaccatctgttgaaacatgctatatatactttagtaaaattgagtcatagtatactggtagactacagtccatggggtcgcaaagcgtcggacacgactgagtgacttcacttacttacttatacagcctattttataatctgccttttctacctaatgattatcttgaacattttcccatattcttgtaaaacatgacttttaatgattaaatagtgttccatcatatagatgtaccatattgactgaacagttttcttattttgaatatttaagtggtttcatcattgtagaataggaggtggcaggaattcagcttttctgcatgtggtatcagatggactttctaaaaatgactcttcattctgtctgttgcttccagctcctgctgtttctggaaacttgctgtatcaaccatctctccttttatcattaaggacatgaatcttatcctcttatggtagaactaagagtgtggctgcaacaaggccagacaaactcaaattttaatatcttttaaaaagttatttattttttactggaggataattgctttacagaatttgtgttttctgccaaacatca

SEQ ID NO: 39133 - DNA, 865 bp, Bovine  19866881787451
caattcaaggctcctaactctctgtatctaacttttactcccatattatgcatagtacatagtaggtattttaaaatatccatggaactttatcatattatcaatagacaaataaaatgaaatttcaactttttttttttttaaatctaagactgaccttaaaacagaccccattcaactagtttgaaaatctggtagaataacagcctttatgtttatattgggtaagtgatggcagctatataaggtcccaactttgtatttatttgcccgtatgctagttctggaagtaaaggcagagctattgtgctaaaattttatttcttttccttaccttacacttaaaaaccttttacaatatacagatatacaatatacagatattcatgattctgttaattcaaagaacaagcctagatcatctcttgacatagatatcattcccatttaaaagatgggaatcaaagagctagaagtgactcattgagaattagagcctagggctgtaattttggttcattttttccccctagtgtactgtgatgttagctaataaaataataataacaactatttattgaattcttattgtgtcccaggccctgtgctaagcacttcattcacattatgtcattgtaatcataacaactcttaaaggagacactattattagtgtcattttacagatgaattaactcaggcttagagagtttgggtaacttgtgacaaagttctgaagctagcatgtaaaagagatgggttttgatactatgtgaaagtgtttaaccacacacaatgctgtataatttcttgtacaagataacatagataaaaatgtagatggtaggaaagagaagaaggtgaa

SEQ ID NO: 39134 - DNA, 1136 bp, Bovine  19866880172588
tctcacatcctacatgacccaggaaaaaccatagccttgactagacggacctttgttggcaaagtaatgtctctgcttttgaatatgctatctaggttggtcataactttccttccaaggaataagcttcttttgatttcatggctgcagtcaccatctgcagtgattttggagccccccaaaataaaatctgacagtgtttccactgtttccccatctatttcccatgaaatgatgggaccacatgccatgatcttcgttttctgaatgttgagctttaagccaactttttcactctccactttcactttcatcaagaggctttttagttcctcttcactttctgccataagggtggtgtcatctgcatatcggaggttattgatatttctcccggcaatcttgattccagtgttgattgtggagtgataaccatataacaaattaagtagcaatgaagtttaaattagtcagtgaaactttagagatcattgaatgatgcagaagaaaaggtccttaaggggatctaagaaagactatgagcaggagtttcagcaaagtgtttacattttacctgtgagtacactgtgaagagaagtagaaaaaatgtcagtgctgttgtgagaagagcctgagaaaaacttagatttaacagttgagtgtcagaaagattttattggcagccctgacatttcacagcatgtccacagcggggaatcgagttagcagaaaaagaaaacctgtcaaaacattacatgcttgacttggaagaggaattttgatagattcattttttttcccacgtttttctcagaacactaattacaagagatgctcataaattttatgtgaagaaagaatttcttaagcaagtacatttgaaaagtttgggctaaattagatgagtaatgttcttcactgtgagacatctcagagtctttaatgtgttaatatttcttgtgaatctccaagagaagaacaaaatacacagcattcttcacatttaatccgatgttaagcttttatttacaaatcttccttttggcctttctcaaatatactttggggaaaaatgatatctgatcagctaggataatagatttttgtatctatattaagtcatattaaaataatat

SEQ ID NO: 39135 - DNA, 1444 bp, Bovine  19866880202003
ttatcttgggggcctccaaaatcactgcagatggtgactgcagccatgaaatgaaaagatgcttacttcttggaaggaaagttatgacccacctagatagaatattcaaaagcagagacattactttgccaacaaaggtccgtctagtcaaggctatggtttttccagtggtcatgtatggatgtgagagttggactgtgaagaaagctgagtgctgaagaattgatgcttttgaactgtggtgttggagaagactcttgagagtcccttggactgcaaggagatccaaccagtccattctaaaggaaatcaatcctgggtgttctttggaaggactgatgctaaagctgaaactccaatactttggcccctgatgggaagagttgactcattggaaaagactctgatgctgggagggattgggggcaggaggagaaggggacaacagaggatgagatggctggatgacatcaccgactcgatggacgtgggtttgggtgaactctgggagttggtgatggacagggaggcctggcgtgctgcgatttatggggtcgcaaagagtcagacacgactgagcgactgaactgaactgaaccaaacctttaactatctcaaagctaattagttgtttggttttcctaagttttaatgacaacacttcatacatatgttggatcttcatagcacagtcaagattcatcgaatgtgactgcatttatgatcaaggtaaaatgccttaattaaacaagtaattaggagagaaatgaatgcaaagtccaattagtaaatcttttaactgttcctcccagtgacaaaccaatagccattcctgtgtagtcagttggtttgatcatgagaattacatacgatcctctgaaatgcacaacagcaaaagtaaaaatgctaaggaaaaatcatgaatacaatgtagtagaataacgattagaccgggagccaggaaacctgggtttttggttcaggctgctgctcataagctgtgtgacataggataaaataccttaaccttccttggcctcagtttcctcaattattagttatggaagctggacgacatgaactccaaagtcctttccagtgctgacatttttcaagcttgtgttgaggaactcctccctttcaattcttattttggaagccacttgcttcctagcaccatgcctgtcaaatagcatccctgtcagcaacttacaaggtagatctgtcagtgcaagagagcagcttctgtctgatctagttttgtttacagtggcagcatttcagcacatcctctgcgctttcagcaggaagcagccaggcagcaaaattgctctagcataaaataaatccagctgcagggcatcttcaaaatgctccctatgtgtttttcaatttagcccactattaaaattttagagcacaatttagagctacagtctgcagt

SEQ ID NO: 39136 - DNA, 2908 bp, Bovine  19866880379328
tgagagtggagtccttacccggcaactttctgtcttttcaagactgtcttctaatccgttcagtagacttacagaatgagttgtcagggttgaatgattttgaaggaccatcttggtctctgaatagtatttggataaatgaaaaagatggcaatgttcatttttcaaatgggagtcatctgtaacaatggggcatctcacaaatgactgataaaggaaaataatgcctttttctattatggagtcatttacatggatcctttgggggtgggacctttctcaaagaaaatttatttgactttagttattagaggatttaacaagaatggggttttgtggagttttgggtcttgcttttttctattgtaaatcataaaaatgtgggtggttttaaaataaaacaccttttaacctttttatccaagcacatgatgtatcctacaagttaaatagatcccttaaagatcttctgatataagaattctaatggaaggcaaaaaagcataattatgtggtcaagcagagtagtacagtctcttaatttgctgtcaaattactttaaaagttttaattagcataattaagtagagtttaagtgataagatatactactttatgttttttatatgtatttctctctgtgagtcactgcatttaataggagcctttcagttttaattacctcctctactgttggccaggcgtgaagcacgaatcataacaacatggataagtggataagggccactacaagccagattgttcccaacctcacctgagttctcagtgcttttaagtgattccctctattgtcttcatctgttggctttcaaatatcttgactggcacccacgttttacatcacaattcagtatgcacataggcgtgttatagtaacttattatatacagtgattgtcttcactgtactcatggtactctggtttttttaaaacatcgattttggaaccttttgccatcagttcactgaaaaataccaagttgggcaactcagtctgccactctccctggtgatcatttgccatctcttctgctctcatgtctgaccccttctcgcaatgttaccagacgccctgaccccctgctttgcagtgagagagccactgagctgtgactttcttggtttgtcaccaacctgtgagtttctgcactggtaccatccgttcatctgtgtgctccctcccttcatggaagaggtttcttttctccacacctgctctagataccactctttgaactgtggccccacagaccgtgctgggtcagtgtgactggcagtcgtgcctagggtgtatgacacatgcccataaaccttaaaattgaaagtgctcagccccataaatccccagatgcttatgtatcttgataccacaaacttctggtgacctccactaacaggatagaagggatgaggtagagagagtcggtgacaaacactggtgccactaaacatgggaagataatgaaatgtgctgaccctcctgctgggtcacacctcctgctgcaaagatgtgaattgaaactcaccttggtgaagtcaagagaggttgtcatttggcttccagaatgatttgtttttgctttgctagcactttcagcaaaataagcaaaaagctgatatggtgtagaaataaagcaaaaactgtcattatcccaggtttaaaggccacagtgactcttctcagacttgaggctacattaactgtctgtgtctggttgaaagagtgagtggcagtgtttgtaggaatcgcaggactcttaaactatgtgactgccctctggaatcctgtttgaatatctcaaacctgtgctcccctgagttcttaatttcagtctgtctaatgcgcagggattggaaggacttcattggaaggaatgatgttgaagctgaaactccaatactttggccacctgatgcaaagagctgactcatttgaaaagaccctgatgctgggaaagattgagggcaggaggagaaggggatgacagaggatgagatggttggatggcatcaccgactcaatggacacacgtttgagtaagctccgggaattggtgatggacagggaagcctgggatgcttcagtccatggggtcacaaagagttggacacaactgagtgactgaactgaactgaatttaaataaatataagaatcactggagaattttcattcctcttataagaattcattttaaggacttccctggtggtccagtggttaagaacctgccttgcaaagcaggggaggcgggttccatccctggtcgggaaactaagatcccacatgctgcagaacaactgagcactgccactactgaagcccaagcaccataactagaaagtccgtgggctgcagtgaaaggcccagatgacacaaggaagatcctgtgtgccacaactaagactggatgcagccaaataaatattaaataaatattcattaaaaaaaaaaaaaagaatgggtcattatattacccaagattgagaaacactatgaaagcctttaggatgaagagacctgaacaccttacctgtaacatatagtcccaggcccacagagtggtatgattgtcaggatcctatcaaatctggatgaactagagtctcatagctcagttggtaaagaatctacctgcaatgcaggaaaccccagttggagtcctgggtcaggaagatctgctggagaagggatagcctatccactccagtgttcttgggctgcccttgtggctcagctggtaacgaatcagcctgcaatgtgagagacctgggttgggaagatcccctggagaagggaaatagctcctgctattctgtcctggagcactctatgactgtatagtcccatggggttgcaaagagtggacacaactgagcgattttca

SEQ ID NO: 39137 - DNA, 2291 bp, Bovine  19866880466266
agctatataatcatctcttggaataccaataaaagcacatgtatttctgggatggttaggccttgacgtgcttggaaacagcactgggcttgatggctccctgggtttcttccaataatatggtataaaactggaaaataggagagctgttggcatctatataagcagcagtgtactgtgctttcataccacattgtaaacatataaaatttttaagaattaccatatgccaagcttcttttgttcatgctcaatacagataaaagtgtagagaagaaaaaatattttcacttaaagatgtgtgagaacagtatttttctatatattacgagcagctgatgatctcaaaaccatcttctgagagactaaaactaaaattatgttgatttatatctattcaattgacatttccagaactgtttgtcaaattgttctgtggatccactatatcctttagtaattttaattgagtggggcctatattctattatataatatctttacagacattaatttgttacaaaatatttaggaatacaaaaatgtctactaagtattttctgaatttaacatcaataaggaagttaaaacttgtttttgaaaaaagatctgtctttcattccttcaaaacaaatgaactgatttccatcagttttgattctaaataggaatgatctcaaggagtttattagtaaatctgggggaaatgcagcatatgaataagtgaataaatataccacaagacagctatcaaaggagtgggtcacataccatagacgttcagagtggggtgacgttatttcttgttagggtgataggctaagcaccgaagaatttatacttttgaactgtggtgttggaagaagactcttgagagtcccttggacagcaaggagatcaacccagtcatcctaaaggaaattaatcctgaatattaattagcatcaactgaagctgatgcttaagctgaagctccaatacttcggccacctgatgtgaagagtcaacttactgaaaaggactctgctaatggggaagactgagggcaggaagagaagggggcgacaggacgagatggttcgaaggtatcactgaatcacggagttagaacaaactccaggggatagtgaaggacagggaagcctggcgtgctgcagtccacggggtcacaaagagttagatacaacttagtgactgaataacaacaaagaagcatatgtaatagttagttaaatcaacattcataaatctctccaattccccaagggagatagagggggttgcattcagaacctgttaataaagcatctcaataaagcatctcactcaccttcttactagtcaactgaacatcacaactcctactctgtctacctttcagggtcaccatgagggtcaaagtcaaaacggaataatggaggggaaagcacacagctgacatagtagagacaaaatatttatcaactgtaagaatattagttataaataaatgagttactcttgtaactcatagaaagtgtgaaaactgctcagttgtgtctgactctttgtgacctcatggactacactagtccatgaaattctttaggccagaatactggagtgggtagcctttcccttctccaggggaatcttcccaacccaggaatcgaactcaggtctccctcataccagctgagccacaagggaagcccataattcatagggatgacttcaagcgtaaaacccagattactgcccagaggggcagagagacagccatgacttggagctgactacctgatggtggtgccttgcaaacggtctatcttcttattgagctcagcgatgatgctgtgcagttctgtgatgcgttcctcgtaccgaagtgtcgttcgctcctggacgtcctcatgctctctcatgaggtgggactgctcacactgggatcaagagaacaagacagaagtgccaatgaattgacatacctaatagcaagagaggctaagtcttacagcctcggatcatcacaacctcgacacagagtatgccccaaataaacacatacctgcttgttggcccagaagacacatcaacagctgaacttcacaaagtccctgatggccactcaagtctctacctttttagctctacatttccaggtggctctagtggtaaagaacccatttgccaatgcaggagatgagatgtaggttcaattcctgtgttgggaagatcccttggaagaggaaatggcaacccactctggcattcttgcttggaaaacccctaggacagaggaccctggcggg

SEQ ID NO: 39138 - DNA, 1334 bp, Bovine  19866880470282
tccttggaggaaatatcattcctttagagaattttctaatgtggcataacatttaattctttaaatatcactgtgggaagaacagaagctttttaaagtctctcagactcagtaaacagtgtgttttcttctgtgtaaattccaaaagtccgccactaatccaaacagcgctcttcaaatgagagtaaatagaggaaaaacttcaactgaaaggtcatcaaaagaacgttcctaaagtacaaacaatagccatatgcagttgctactaacttcaggtctcttagagatgcaatgaagtctgggtacacactcctgttcacagagacaactgcagtcagggaatatcaagggactccttagaaaactttttgtcagagatcgacggcataggatagactgaaaattgaacagaagttggtagaatacaagagatgtacaagtggtggccctgctgtttctataaaccatttacacccagtttatagacataaaagaggctgaagaatgaggtcacggccacaagggccgaacaacagccactatatctgcacagtactcttaatgattttcctaaaatctttataagcattgcctaatttggtgataacctctgagatcaatatagattcatacccagaatcatcaatttcacaaagctggtcactatgtgaggtttttaacccaagtatgacactaaattttatatgccctctcctatactccactgaactaacgttatcaatgagtttccttctaaaactcttgtcattgaagtgttgagatagccaccaatctaaagatttcagttccaacctaccctaagcaattaccattcattccttggaccatttagaagtgctgtacctctggcaattcaatacaaagattccctacttcaaccaaactgcaactacccttccttactcctaatgaacttgctttgggtctccagttacctccaggcattcatggaacattcatgggatttcactaaatattcccagttacctcctctgaacactcacacctttatccacccccccaagtccaatgggcactttatgactacctccccaacagagtctttcatctccttgatcttctaacctattacagtgggagggtgggtatcacaacccagggaatctttaccagacacctcctctgctcctggttcactgatgtgtgctggacacagatatacgctcactggtgtctcaagaggcagtgaaaatcacagaatgtcagagtttaaagaggatattgagctattgtgtataatgccttaacttgaaagaagaaactaagattaaaaaaagaaaaagaaaataagg

SEQ ID NO: 39139 - DNA, 2996 bp, Bovine  19866880478750
gactagataggcagacaagacaagaggattcacagtgaagctccgaggaactctatttagaatttgaaaagaccttgatcctgggagagactgaaggcaggagcagaaggggacgacagagatgagatggttggatgccattaccaactcagtggccatgagtttgagcaagctccgggagatagtgaagtacagggaagcctggtgtgctccagtccctggggtggcaaagagtcagacatgactgagcgactgagcaacaacaaagggggcaaaagggcagcaaatgaaattcaaaagtatccagcagaaatagaagagactatgatttcacagaatccaagaggggagagagtttcacgaaggaagggtggtcaactcttctgaatgctgctcagaagtgggataatttgaggatgtaaaactatcaccttctctcgtatctttcatcagcattagtcacaaaaggctcacacccttaggccaggcgtcccaagtgcaaccaagctacttttaaaaatcagcagatgactcgaggcagaaactaaatgctttgtctggcttaggagacatctcactcagatccttagacctgtgtgcccccatctgctttggtctctctcttcctacctcagtttccaagctgctgaacttctagatctgatccgagtccttgagatcttctagccctgaaaaaatgattgtatgagttttatagagcgctgtattaattttctaggactggatgacttgcacagcaaaaatgtaaaccactctggaggttagaagtacaagcacaagctgtcagccgagctggctttgttctgaggcctctcctcaccttgtagatggccatcttcatccttgtgttcgtgtggccttccttctgcgtgcatctgcgtcctaacctcttcttttaaggacaccagtcatattggacaagggcccaccttaatgaccttgcttaaccttgctgtcgttgttccaagtcatgcccaactctttgcagcctcatggactgcagcacaccaggcttccctgtccttcactctctcccggagtttgctcaagctcatgtccattgagtcagtgatgccacccaaccatctcatcctctgttgtccccttctcctcccatgctagggattgaattctgaggtgccggggattaggacattaacatatgactggggggacacagttcagcccataactgatgtattagtctttgctcaagccttagacatgatttaagaatcttaccgcgataggcctacctttcctaggtctcagatccattcacttagtcaatttctaaatgatcttcttgacttcctgtctttctcttagtgcttttttaaattctttttttaatttctatagttttaaaggttactttccatttacagttattacaaaatattggctgtgttcctcatattatgcagtacatccttgagcctatcttacacccaatactttatctcgcccactctctcacccttctgttgcccctcctaccttcccactggtaaccaccagtctgttccctattgctgtgagctgcttctttcttggtacattcatttgattattgtattttttttaggttccacatacaagcgataccatacaatatttattttcctttgtctgacttatttcaattactataatgcccttcaagtccattcatgttgctgcaaatggcacaatttagttcttttttatggctgagtatttcattgtatggggcttcccaggcagtgctagtggtaaagaacctgccagccaattcaggagacataaagacatgtgggtacagtccctgggtcaggaagatcccctggaggagggcagggcaacccactccagcattcttgcctggagaatccatggacagaggagcctggtgggctacagtccatgggggtcacagagtctgacatgactgagcaagcaagcaagcgagtatttcattgtgtgtgtgtgtgtgtgtgtgtgtgagccgtacctgctttacctatctgcctgttggtggacactgaggttgttttcatgtcttggcaactgtaagtagtgctgctgtgaatgtaaggatgcatgtatcctttccagttatagttttatctggatatatgtccaaagtggatcatacggcaactctgttgtcagttttctgagccacagtccctccaccaatttacagtctcacccttccagtttagactttctgataatggccactctgacaggtatgaagtgatacttccttgtggttctgtcttgtatttccctgatgattagcaatgttgaacatcttttcatgtgactattggccatctgcatttcttctttggaaaaatttctattcggttttctgcctattttttaatcaggttcgtggtattttttggatgttgagttgtatgagctgtttatatatgttggttattggttggttatgacccttatcagtcatatcatttgcaaatattttctcctattcagtaggctatcttttcatttgttgatggtttcctttgctgtgcaaaagcttttaatttaattagcttttaagtttaatttggacagatcaaaaaaaaaaaaattgctgtgatttatgtcagattgctgctgtttcacgtagcctttagctttgtttggctgtcgagacttgctttaatcactcgggtttaaagttgccacaccgttggcctctgtacacagtaattcatcaggaatacacagactggtcccaggaaaattcactgagatgtataggacctttcttcactgaagtttagtgctctacgccttaggaagttagctttccagaagtagtcctttttttcccagcagctcttcagttcagactagccagtgatggctaatactctaagattgttattgggggtggggagatttatttcatggctatcccctgagaatatatgatcatataattagagaatgaaaggattcgcactgtgcag

SEQ ID NO: 39140 - DNA, 1522 bp, Bovine  19866880482888
ttactctttggaagaaaagttatggccacctagacagcatattaaaaagtggagatattaatttgccaacaaaggtccatctagttaaagctatggtttttccagtagtcatgtatggatgggagagttggactataaagaaggctgagcactgaagaattgatgcttttgaactgtggtgttggagaagactcttgagagtcccttggactgcaaggagatccaaccagtccatcctaaaggaaatcagtcctgagtattcattggaaggactgatgttgaaggtgaaacgccaatactttggccacctgatgcgaagagctgactcatttgaaaagaccctgatgctgggaaagattgaaggagaaaggagaagaggacgacagaggatgagatggttggatgccatcactgactcaatggacatgggtttgagtaatctccggtagttgttgatggacagggaggcctggcgtgctgcagtccatggggtcgcaaagagtcagacatgactgagtgactgaactggaccctaactttaaaatgtagcatctaacatttggaatttttcttgaaataaaagtcccaaagcaataagaatatttattagctacacttattacagtggataattgaaatatttatatccatctgtaacttttagttactctgttttcaatagctgaaattcacagaaattctgtgaaactggataaaattccaatagctgttttcctaaatatgaagagccattttagtcgtatttcactttatcacctttcttggaatgaaaaactaagctgacagtgtcaaatgttgaactgggaggcatgaattggtaaagacaggtttggaaagacttgctgtgccaaagtttataatcagagtagcaaacatgcccctacagtgaaagcaacctgtctcctagaattactgtcctcaggtagttagaaggagcctgtacatacttgattacaccaatgaaaatccactgtttcgcctctccttttacaacatttatgccatttcttggatgaacttaaggactgatgaaatataagcacggatcttggattcttcctttctctggctgtgtgccacccgcccccttttcacttttccttatttagggaccgtgcgtttctaatcagttactaacaatgttatagacaaaaattctcccaagtttttctcctctttcttcccccacctcctcctttaccatcatcgttatcatcgattcttactccagttttcaaactatttatgttgtcttaattatgtcacatttttctgctagtaccactttctccaggttcagaaattgaaacctgcgtaaagcaatcgcagtgttccttttaactgactttttgtttttgctttcccactcagttaaagattgaatattttttttaaactgacagtctggaacaaaaacttttttttttaactcctagtgaccagcccgaaaaatctgagatttaacttaagaggtaaaaataacaaccatgcccactgagta

SEQ ID NO: 39141 - DNA, 1712 bp, Bovine  19866880494849
caaactgagaagcggtgtttgggaggagttagagagtaaaatgattaaatcagatgtgaagagaccttagaactggatgggaaatggaagccctagttgaagggaaggtagatgaaagcgatggaacaaggtggttttgcttttgccctgtctttaaaaagcagcggttagagggggcctggcacccttagaaaccctgccatctactaagggcaagaatgtctccctgtgaggtccctgtaggccagaactgcttttgttgttgtgttcatgcctggcaaaatgtcttggcatacaatcagtgttggtccatgaatggtaggaggagcagcctttggagtaaggggttgggagttgagagaatgaaattatggtggtaatcactgttgctggaaagatagagatttaggggttgaatactggcattgaaaaataaacgtgattgtatttagaggcttacatttttgttgtgcttacgcgcatgtgtgtaacaactgagatgctgacgttatagtaacactgcctgcagtgtgggatttttttttttggtttgtaaagatgaggctacatgttgaatgctttctaaaaatggcatgaagccttttctgtgactcctggagtggagtcaggtcatagagctttgtctgacggaggctatcagcaacaaatgcccatgttcagaatatctagggattgaagattcgtgagaaggaaatgtgtagcaggctgcttggcagagaaaggggaattgactttttcttcccttttagcattggatagatgtgtattgtctgtatatgaattgataaagattggttatatgtataatttatataccaacatagttttatgtactgatatgttcttactgaaagatctaatgggatactaattatcaaatacccattggtttttaaatggaagatcttattaaaaggtactttattaagctgcaaataggtactttttctgtaatcatttgtaatcttatagcatgttagggccgttctcacagagaagccatgtgttaggcatgtgtcacatatcactctcacatttttcatgcttctgaaaatgtttttttttaatggggttttatgctatgtttgtttcaaataaagcatctccattcaggtgtgctacaaactgacctctaagcctattcagttgtttagttaaatggggtttgggggcggatgtccacacccaccatcaggtaagagggctctgtcttctccctcaaccatgtgctcaggtatgagagcagactcctacaaaccctgctatgtaggtagacacttcattgtgtaagtaggcaggaaaccagtcaccgagcctgttctctaaagagcattgcaaatgctctgacaataccttatgtgaaaaattgctttgacacacacgtggcatgtctgaggtgggatcctgataacctagtcagcatcaggtgaccagaagtctccaggctggggagctgcacacaggattgttgcagagtctgactgtgggcaccatggcacagggtaagactgagctcctgaaaatctcctttgattccctcgtccttggatggagctccatcttgtccttgggtggagtgcctgttccatgtttctggccaatccacaggtcttccacatcatgaatttcctcagtgagaagtcttggcccacctccactgagctcatttacaaaggctttaatgttgagaa

SEQ ID NO: 39142 - DNA, 2054 bp, Bovine  19866880533750
ctgactcactggagaagacccctgatgctgggcaagattgagggtaggaggagaagagggtaacagagaatgagatggttggatggcatcatcaactcgatgaacatgtgtttgagcaagctccaggacatagtgaaggacggggaagcctggcatgcttcaatctatggggtcgcaaagagttggacatgactgagcaactgaacagccaacaacatagctgccccagcccttgccccagaaaggtgcatagtgctgcctgatgacggtgcctgaaggagagacagaaggcgtgctgcttactctgcttatacgcttaggaaagcatcactttctatctgagcagtggtttccacttgacattataatgaaatccctataagactattcctagaagatgctaaagcaggatgaggcagtgacccaaagtgaaagctcaggttgaaaggggtcaggacagtcaccgagagtgccgttcaagtgcctccagcaggatattctaaaaagagtctcacagcccacctccagctgggaaacatttctagaaaggaggggaaagtgtccttttaaaaacaaggtatttaatgcccttttgggtttggagcggcactgggttcggctccctgtagtgaggaggtttcttcatgctagagctcccagtatgttctgcaaggaaagaatggacatgtggcctcagcttctggtgtctatttttatgccctggttgtgtgtaggggaaaatggaaatatattttcagtatgtgtgtttttcccctggtgtctgctgactcccacggaagctgtaaatccccaaatccaaacataagaagtccatgtcaggaggcaatgacccaccactttggactccattcaacatctacccaaagaatatccttggcaaagagcagtgacagcataatagtggtaaaaatagcaatcatgctctcagttgtcaactaaatataactcttaatggctaaagttctataaactaatcaatttttttgttctaacaaaatagtttgaaaatcaatgttaccttggacacacaaattcagtatgatatcagatattccaattgtcatataattagttgttttacatcattatcttagaatttccactgttccagtgtttcctatacagagtgaagggagaatagaagaaataggatttactgtatacttttctttctgtaagaaattatatattctgtatacagtgaaaaagataatgctgatcagtctatagataattttaaagagaaaatgagtttagtaagcaatggagaggacttcccaggtggtccagtggctaagactgcatgccccaatgtaggggacctgggttcgatctctggtcggggaactggatcccacatgtagttaagaccggcaagccaaatcagtattcataaatgaaacaatggagaatattggagccttggtttcaggtaaacctcctggggaagccaaaggttgaagggaacttgagattagtcaactggctgccatgtggttttgtgaagctaaggaagagcggcatcattgacaaatgagtgcttcagtagacaattgcccagtgagaacctgttactgaagagaaaggaaagtgatttagggtgcgcagtgcaaggaaaggggcaccgaaccaggagaagtaaagttaaaactagaacagactggggagggttgaaaggcaaaaattcatgcccattgtagttctcttttcaagctcctctaatgaaaaacagatatgccatcatgtctgcaagatttattcattcaagaacatcagaatcaactctacctttcccctgaaaggggcaatgcattaaacctttgctctacgcagttcaatcaggagacagacgaggctatataccgttttcccctgttataccgttttgtgcctcaagacattttcctttacagcactaaattggggttgtcatgtgaaatttacgtgtatgattgtttgataaaggtcactctcccccattaaactacaagttccccagtgacaaaaattttgtcttcttttttcgctaacca

SEQ ID NO: 39143 - DNA, 1670 bp, Bovine  19866880574977
tgggtcacctgttgatgggctcaggtagatctgatgcctctgcacgttctgtgtgtttggggcaggtacaacacgcctgcctctgtgggtttcaagggcaggaagcagagctatgcaggacagcaggcttcctctggttttcagacctgctcacccagaaccagtctggacacgtctctcagatggatgtagatggccttcaggccctcttcccctactgtgtcttattctgcagttactgtctatctgtaattctttggttttgccatttgttaaaccaagcctctgtgatgttgctagcttcctcgcactccagaatagtttttaaggaggaaaacaaaaatggaaaatgaaaaaaataaatattgtagaatttcaggagtcactctcaaaaaataagagaaaccggactacattccaaagcaggggattcgagttcaatccctagtccaggaagtaagatcccacaggccacagtgcaactaagcaactactgaagcccgagcactctggagcctgcaaaccacaagtggagagaagcccatgctctgcacgaagtccccagatgctgcaagacccaatgcagccaaaaataaatatacgctcaaaaaaaagaaaggagagaaatagaaagagaaacctctggaaggaacagaacttccctggcactctgaatccccaacagcaaagactgtctccccatgaaatcagtcctgcatcccatagtgtctccagacaaatggcacacggaggagggggagatggtcagtggacacttactagtgccctcagttacacgagcctttctgtcattttatcagggagaggagtccaactggtatcaccgatcagccagccgggaaggagcatgctccccagaagcctcaatttctcaagcaaagatgatgagagtcaatgactgctcaagtgtcagagatagaatactgccttgaaaatcaccagttcaaccgctttagttgatgccaaaggaaaagggaatgtagagaaagtctgctcaaaggtcacacagcagcacagaggtggtgctgggattagcctccatgctccttgcgtcatcatcccaattcaccctgttaccagcacactgcctcccgacatccgctcttttacatgctgagacatggacccttttaaactgacacaggttacttagatgaccagcccttttctgcgatcctgtgcgcttgctattggaatccaaacatcaatcaccgttatgtcacacacttcctgaggagtgcatgtgactgtttatggaagcagcgtggggaattcagatcaaatagtcagtgagtgactcaaaactggagacaaagacagccaacacgggaaaacacatgtgcctttttctaatgggctagaatccaagcatgtgtaatactacgccctccacttcctacgtgctggtgactggaaatcttggggttagtccaaggtcaacctacatgcatgaagggaactccctaggatggtcttagaaaagcatgccctcccccaaacgggtaaatttagggcacatcgttccaagaaacaatcgtaactgatgatcttttttccaactgttatgtcacacagggatttatactttttccttactgatttaagaggcagggatttcatccagaaggatttcttagaggctccttcaa

SEQ ID NO: 39144 - DNA, 5244 bp, Bovine  19866880624202
tcttgagtgtcctccgaggtgtgttttgtgactccgacttcacaacagtagcagtgccacatgagggagtactctgtttaaagagttaatttcaacctgggatgtctagttaaaaatcaacaggcgagtagtggatgcttaaaaccccattatgatcaaaggaaatttggaggatgccttggaccccttcatgttaaagtctcctaggaatcatctctggaatgtcaaaaaccattctgggagaactgttttattctcagttgcaggttggtcaacatgagagactcctcttgtaagccagaaaaaaacagaaaaacaaaaaacttcttaagtatatacctaaaatcaggaaatttgaaaaaaatagatggcctgaaaattggaagaagttaaattttattgtaacatagtgtgggctgttatataatttggtggtgggataaaaaaaaacgacctgaaaatgtatccctctgactgatccctaactccacctctctgtgtccgcttgtacactgtgatatgcaagaaaaggcagagggtccaagtacctcatagtggaacttgctattacctaggatcaggaaaaatgtgccttgttagggaagtgccaaaaggtaaagggacaatcacagtcccttcacttaaaaacattttagcccaaaggaaacagagactgggcttccttggtggctcgatgtaggagagccaatgtaggagacgtgggttcaacccctgggtcgggaagatactctggagaagggagaggcaacccattccagtattcttgcctgagaaatcacatggacagaggaactacagtccactgggtctccaagagtcagacataactgaacaacagaacaggcacacactcagctgaaaaacaggacttgcacaaaagctaggaaatgttccttatcctacaggctgttttccatcactagattcagggactcaaaggtcatcttcctgactccaggcagtagctgccacagctttattggtagaagttaacaagcttacctttgggcagccactggaactccagacccctcatcaagtatgagagattctggagatcaaaggccaacattggatagctggtgatatcctctgaagtactaagctttgatccttgactccccagagctttccataccctcaaaacttgccatatcctcaacttggctatactttatttgtagttcagtttctcagtcctgtctgaggctttgcaaccctataaatcgcagcactccaggcttccctgtcctccaaaacagttaagtctttctttaaaatcttccagcaatttcagtgtacacagaacataattaaagcatcttattgtgacttgagagttcctcctctaaaacccagggcagcctacatctattattatgttacctcacattctggaataacattttaaatgtaatggccaaaatctgtgtgcttagtcccacctgactccttagggacccatgccccctctatccaccaccagcctcctctgtacaagggatttcacaggcaagaatattggagtcggttgctacttcctactccagaaaattgtcccacccagggatggaactctcatcccttgattgtcctgcattggcaggtggattcttaacctctatgtcacctgggaaaggtaaattctacgtatttcagcgtgcagtgtcttggcttatgctgacctacaactgtcaatcttctctatctgggtaactcttcttttcctccgaatctcaactaggagattttttaaaaggtattgtcagcaagtaacaaaaaagctctagaaatctagtttacagtataatgaatatagacaattttgtattggcaatcatcaaagttcctaagggacaatttaattagaacgaattacataagcgaagaggtattacttgttgctacaactgcaatcatttcagaatacgtaatttagtaaaatgttgcacggcttaattttacacgttatacgtcaaaagtatttaaaattttttttaatctttatttctattttctttattttctcagatcaaaaagttttctactcaggcagagacactcatactacctaaacatttttgtatgtatcaatagcctataacattacgtacatatttttcgttctcaggccataaacacaacggcaagccgagttcgcatttcctgcccaaagaattaggttccttttgaaacgggttgaaacgaaggggacggaatctgaagcttaggtggagcagcggaaggggttgaggctcaagaaacagtggaggctgcagtagtactgcgtagtaagagtgaaccagcacccgacagaccattttcgcgtgttggccacaagacacccacgacagcatcagaacaagtgaagtgcctagtacagacatattaactccagagtgtggaaacagccgcacagtaaacttccggaaagaagcggaaagtgaaccgagggaagaaggcttcagacttccgcttttgcctacgcttgcgcatgttcgtttccgccgttaggcccgcctctcggcttagtggtgcggacggaggggcatggagaaggtggcggcgcgggagctgtttcccaagacacaggggtaagctgactgggagaagtgattgaaaagaaacaaacaaacaaaccaggaagagcctaggttgcgcacgcagcctgggacaaacaagtccgcaccttcctggcactattactggcgtccatgggctcaggaaggcgagaatcaaaactgcgaatggagacttaatggctgagggtagaagggcgagacggttttgtaaccaaaatataaaaaccaagatttcattacctagtactagagagactttcctgcacttgacgcagtggaaagggggcctccagaccgtattgcaggtgtgaccagtgatggtgtctgtttcgttttctcagccacaaaaaatacagagccttcttgaagaaggaaaaacgaaagaaacgtcgccgggaactggctagactgagagactcaggtaatggactcatcttgttttctttgtataaacttgttgcccctactgcggcccaaaattgaggccccagtgtcaaaagagaggtgtgtgtcttatgacatgcagggtctggttctctcgaaattaagttataaccatattagagaaaatactgacgttttaaataagacagagaaaggtacgctgaatcactactatttgtaaatactcgtaaagaacttgatgtcacaactgtaagaattgtgaatttcagcagctactgtgttaactacttagtcgatgttttcccatatactggttgagtatattaattagacattgttcagatttttctcaaactgaaatagagtaaggtacctatattgagccaaatggtaacggaaactgttgtttttcttcaactatttacaagcataaaactagtcgtggaatttgactgtaaacatacatacttaaaaccaaataaaatcacacaacccattcatgtttacataaatgtaatactagggattatatggaacaaagtcttaaaaaaatatttgtacagatagctgttactggattatgtggtgtttgtagtgctttattattgttgccttatagttgttaaacacttttttcctgttgggaaaaatagtggaaccttaatttgtccagtgataatacatctttggctgaaaaatggcagaacctaacattttcccataaacttgtgtgtgtaatgcagtaaacttagtactgcttagccaacatgcttataaattcagatggatgcactgctatcacacaacagtatcggcttttaatgtttgtcatctacattttccagaacttgctttttaagttgtccaagacagttcttggactgtagagactgtgacctcaagtaaacaggatttttggacttgagaaatggccatagaggttttgtttaccaatgatgttcccaggcagtgattctgctgctgctgctgctgctaagtcgcttcagtcatgtccgactctgtgcgaccccatagatggcagcccaccaggctcccctgtccctgggattctccaggcaagaacactggagtgggttgccatttccttctccagtgcttgaaagtgaaaaatgaaagtgaactctctcagtccctgtccgactctgtgcgaccccacagacagcagcccaccaggctcctccgtccataagcaatatgtggcatatttggcatggaaaaatcattgtaatcacacacaacaggtgacttgtttatattattaactagaaattagtccattagcggcagaagaaaatgtcaggaaaagtaggtaggataggttggagttacttactccttttcacactcacagcaaatcttggtaggtagttcatttgaaatcttcctttctaaaaacagatttagtatgtttataggtaggtcactactttgctttttattatatagctagtgccgtatctaaaactaagcagttgtctgtcagttaacagctttgctcctagttctgtatattgtgattcacagttcttaatctagagagacttaatgtatagaataaaaaatacttctgtttattcattgtagtacacattgaatgagccaacatattccctaaaatatagaaagtattactataagagtgaattggctaatgatttgtagaaatttctctaacattgatcttgcagttgtaggtaatcttttcagcatctagtttaatcttggatagcatgaaataaactatcttgtcacaaattaaggtaaaatgtaaaaacaagctacaaaactgaagtatgattctgtttttgtttgaaagaattacatgtataatacaatgaaatacttgctactttaatgtatgctggcaaatatttgattatacttgtagagaaaatacctcacttgaattgttcataattattttttttggactgtgtgaacttgattttggaggggttaaaggtttaaatgagtcagcaggtatttttgagtattagcaggtgcaagcaatgtctacttagtggaaatacctctgtaagtaattcagaattatatcctctgccagataagtgatttatctgataattgtatcagaagttactaccatttgtgggcttattctcttttaatttagaaatctgaaatagtaaagtttattggttagaaaggcagtttaatatagaacgggtaagcctttaaagacagcccactccag

SEQ ID NO: 39145 - DNA, 1298 bp, Bovine  19866880646294
tggagagtgagatgttttgtccaaggtgggtagatagttgttcttgaggatcatggttcagcccaggaggggaaccctgagtaatgaaccaatgatctacctgctcccagaaccgacagccctgccagcagacaaatagatgacaatgatgggcaggcctagcagctgtgagaagtagcccctccaatctcagccacagcccccgacccccttcctatgctgagtccaccccagagagactgttgacacgattacatatcctcttcctggtagccccgccagtctctgcaacaaggttggttgtcagccgtcaagtttatgaagtctcaccagtgctcctcagccagaagtgatttttgtcccaagggctatttggctatgtggacaccttttcgatggtcacacctggagtactgtggctagaagccaaggtgctcatagtgcacagaacagtcccctacagcaaagaatgtccaactcaaaatgtcagtggtactaacgctgaaaaaccatgagttaataagcaagtggcagaaaaatcagacacgtgagtcgtttttaagaactgatggcttagttgccaaggttcaagagtagccctgtataaacacagtcgcagtagtttatatggggaatggcgtgtgttgtttttcgatcatttgttttgttttgttcgttaagatcgccgagagggtgaagctctccaagaccaggtctgaatcttcgtcatctgatcggccagtcctaggctcagagatcagcagcatcggggtgagtgtttatgagttgcaaagggacatgtcacataggagaactacacaatggctcgtccatgacagaagcactgcccaggggccctccaataaaccgggtgattgtaataggaaatcatacttgatttccttccaaagggtcaggttaaaatgcttagtggttcgccggtagtgaattaccccttcagctttaaagggagctttttgtttctctagttgaaaccattcagaaagaaatgattgaggtcttgttactggcaatacagatcaaagtcttgaaatacttgctttatatcaccctgcttccccagagaccaagtgagtcaggaagctctaagagaacttgattattcgcacgtccctcttgaaagggaaggtgctctccactgagcaggatcgctgcctttgaagtacagccgatgctgggacagaccggaaccttccagctcagttctggagttttcttatgtagaatgccgaataccctggggctgtgaactgatgtatagtgaaaagagaataatt

SEQ ID NO: 39146 - DNA, 722 bp, Bovine  19866880670316
gtgatttaacaccttcaaggaaggtgggagtttccacttgacttttaaaaagaaaaaacacccccaaacctcagtgcttgggcatctgtgatataaaccctcatgaaataatgattcccatttctaagctatgtatacagtataattatgttattttccttttttcctgtagccctgtgggttctttcttggctccatatatctggggcttgattagaaatccatgctaaccaactcagggctggctattggaaatccattgtgactgacagaacaaatgaggtctctttatgtttagtcagcagaatctgcaacctgcttgtgccagcgagggcctctgaggttcggggatcttgaaaaatgcaggggcttcgcttacagacacaatatccaaatggctcccacttggaagcggggggtggtttgcgcccctagtttctggagcaatcacgtcattaggattaggtgagggcattttctgcacagcttctctcttccctcctcaagcaaagcgattaccatttaaccacatggccagaagtgctggcagtgtaaaaactgagctactacaacttggaaggaaagagcaaaagtggcagtgagtcagtcaggagggtagtgaggttccctacaaggcagcattcgggtccacctcagctggaggctccactataaaatcgacagccccggctggatcaagacagcagcctgggcatgcactg

SEQ ID NO: 39147 - DNA, 1671 bp, Bovine  19866880731944
ctttcctggaaatcttaaattgaattcttttgacacacctgccacggtacttgatgttatagcatgtatataggtttatgcaggttgtgaaagtcattcggttgtgtccgactctgcgaccccatggactgtagtccatggaattctccaggccagaatactggagtgggtagcctttcccttctccaggggattttcccaactgagggactgaacccaggtctcccacattgcaggtggattctatagcagctgagccaccagagaagcccaagaatactggagtgggtagcctatcccttctcccgaagatcttcctgacccaggaatcgaaccagggtctcctgcgttgcaggtgggttagctgagctaccagggttataatataccagggttataaccaggttaagccctggttatattataagtttatatagggaagccctgcttattatataggtttataattaagcataaatgtttaatatttattaaagtcactctctccccaatggaaacttaagttctaatgtaaactgtactatactttctcttccttctccttgttcctttcccatcacccccttatatgtgaacatttcctaagatatggtgcctctccccatttggacttcacatcctttcaaccatagggagctctttacctcgtaacttcaaagcctttatccgcaaccccaatctctccagagatctagttgagcatcttcaagtaggccagaggttttacaacacttcaattgcaacccatggttggaacatttcccttggcaacttaacgacatatacatatccaaaatatatgtgtcatgaaacaacaataatatcattctggctttttttcctatttgatttcattttaaaaacattttgattttttatgtaatttcaagacttacttggaagggtcataaacctgtagtttaaaacacaccataccaacgtgctgttaccaggtatttccacacagacatttcttcacaacctcaaacacaatgtatttatttcccaaatcatttctcaaccaaacttccttagtaaggaatacaatcattctgagtcactcaggatgaacattttaaagagtcattttggatccctgcttaccccagagttgctgaacctattgcctcctccccttcagtgagtcactccccagcccatcctttccattcttgccatcacagctcagttatactgaacttggaacagtgcaatcacctttttacctggttccctacttcctgacttttcacgtagaaggtgacacgtttgaatcacaacaggcagaaaggcacatcaaggcagaaagggaatgcagctctttggttccactgtgaccaacaaaggaatatgtagagaactgaaatgaatgagccttcacctgccttcatctactcaacaagctgcttgactcgctaaatctcgatccaggctgtctcatgcttctaaagttttgattataatccagaaaccgagccctggcgttgcggcaacagcaggcagacttacccatgtctgcagtgaccatggtggactggttttcagggacagacacagaggtctggtcctgatccacgctgtgagagtcctcgttggcctcatgtgactctggctgagctctgatcgcaattccgagtactcatcttcctc

SEQ ID NO: 39148 - DNA, 944 bp, Bovine  19866880838610
tcattaaaataatacagacactatttagaaaaatagaatacctaggacttatctaggagagttgactaacactgtttccaaagtattaaagtaagtctaaatacccacatatcgataattaataagaatctacagaacagcacagggaactctcctcagtgctctgtaatgacctatacagaaacagaacctagagtggatatatgtataaactgatcccactttttcacttgaaactaacacaactttgtaaatcaactatactccaataaaaattaatgttaaaaatcataaacaaacagataaacaaatacccacataaaaaagtaaagatcagatgcacaactgaatcaaaacgacaaatctataatcgagagtaggcagagatttcttagtggtgaacagcacacacacacagattcataaaaatcctgtcaataaagcaattcaaaatgccttgacaatgcccttgccccatcctaaaaagcatgaactgcctcagcatgatgttaactcttaccaccaagggattctgttgcttggctggctggctgtggaccccatttggttttttctttggattaggtgaatcttgatactgttttctgccatttccccttatactttgattctgtttttccaataagaaataaaatgtaaacatacagcacaatgtaacaggataaaacaatatacccctatgatacatttagctggttcgatcagagttcagcaaagccccccaaaatcttcctaaaacactgaagaaccactatcaacatctttcattatagagagcttcacagagcaagaatcctccaaagatacaaaataaaatagcaaatacaatgttcccgagaaacaactttgaaaaccttatgactatcaatagaggacactgaggcacgttgacttcagtccttagatcaggaaacaagcaccag

SEQ ID NO: 39149 - DNA, 2261 bp, Bovine  19866880866964
cccacagcaagggctggggctgcatcaacactagtgagtgcctgtactttacttcccttacagataaaataggctttctgaggctgctctgggaagctaacactcctgtgtgacttttctttttttttttaatttatctggaaaataactgctttacaatgttgtgttggtttctgtcacataacaacgtgaatctgatgtaagtatatatgagtcccctctcccgcccgcccccagaatcccacccttctaccgggctgaggctcccggagttctatagctggtccccactagctatctattttacacacagcaaggtatacgtttcaatgctactctctcaattcatctaccctctcctttgccctctaggtgctcacgtccgttctctacgtctgtgacgctagggagtttttggtgtattttccccctaggtaagaactagatttatcatgagagatacacattccacagacggagagcagtccatctcaaaaggtgagaggtctaggttgctggttttaagggaaaatatgttatgagttccaactgaaagaataatccaacctaaggagatacaatctgtttagaaaataaagcctgcttatcttagaaaggggttcccttgtggctccgttggtaaagagtctgcctgcaatgtgggagacctgggttccatccctgggttggaagatcccctggataaaggaaaggctacctactccagtgttctggcctagagaattccatggactctgtagtccatggggtcgcaaagagtcggacacgactgagtgacttgcacttcattatcttagaagagaagttcatgaacctaacagtcaagggagctcattctgaacaaacgtaatcaatggctttccatatctgtcttatatctcaaggctcctttgtgggctgaaaaatcacttaacagtagtttgagggaaatagtctaaagtaacacaaaatgacgtggggcaataatcttgtctgctctcaagcttgggtcctctctaaggaaagttctggaatgattttaggtggcctccttggccacatggccatggtcacattcacagacaggccttgtatgaccaggctcagatcctcgcaaggaaggacatagtcaccttagccttctgtgagtcgctgtgcgaaacttctaagcctgccctgggcttggttttcaggggttttcatgaacttcttgggaaagattaagttgcccaattaaaggagagaaaagaaaaaaaaaaaaaaaaaagtagcacagggctgggcctgtttcattgccaagtcagggtgctagttttctgtcctgtctaacattgccaacttacggactggtttctcaaagtttcagaatcaggttaccaagaatctgattctcctttaaacatgctctgccagaggacaactgcctccttagcgcctcattcctaacagaaatcgaattttctctggacaggctgccctgcctttgtaaacacttccttcctactctgcagaaatcatttttggagaaggcaggactgtctttccctgccccaaatcccctttctccccactgggaggggctgctcaacactttggaacatttctcctgaagccattaagcctcatgggtccattaagccaggaaaatctggctttaacattaaacgtattttcatagtcacagctgtgccaaacagccaggtttcatgtgtaaattcttccttgggtgtcttccaaaaactacgcataaggaggaaatctctgtctaaatgatcacaccagcaagcacaagggcatatgcttccttctaaatcccacaaaaataagactttctcaccaaaaaccagaagaaatttcaaaatacaggagcagaacctatcacagcctgtgcaaaggtccgtggggtcagggattttgttttacagacagttgctccagaccagctctgctgttccatgagcagaggtgggaagacagcctgcaggaggcaaatgaaccccacccccaccccccacccgcaagccagcatgaccacatgccatctcatacatctgtgctcggctctgccgcagcacccagcatgggttggtctaagggtgtgggagctaagttggagatctgcagcatctcaatgaacagcagacactttgctagtaagccaggagctctgatcagacagtggctccctaaattctgtcgccagctctagagacctcacaggatggtggtaagcagagcacaccagccaaaggcatgttttc

SEQ ID NO: 39150 - DNA, 1326 bp, Bovine  19866880902944
taggaggagaagggggtgacagatggtcgggtggcatcactgactcaatggacatgagttttaagcaaacttcgggagacagtgaaggacagggaggtctggcgtgctgcagtccatggggtcacaaagagtcagacatgactgggcgactaaacaacaaagcttgtatttggcaaatcttgctttcaaattatgaccgtaattaaggatatagcatagtaatgttctcacagatttagaaacctgaagatcaacagcatccattaaaacaaaacatactcatttccccaaacctgggaaagtatgaaacactaaaatagaaaatccgtctgggtttagtctgagaagtcatgtcatttaccatgaagagactataagagatcttctcaataagatagtgtgataggatatttaaatcgtttctcctcccatccccagcatcaccaagttatgtcttcatgggttgtttaaggtgttctgtattctcagaagattgaagacacgttaaaatataagtacaaaacagctgacaaaaacaaagacagggaatggttttggcatcatctgagacagtgagaatgatcaagtaatttgtacgttatttttctatcagaatgaaaatgtttctgtagtgagtatatttgaacctcagctgtgtgtatatgtgggtgtgcatgtaaactttaaattctgccattaagatgtcaagttctctttatgacacactggctttcatctctccattctgcagtcactgcaggcagaagaaagaaaatttggtatatttctttttcagacttctaagcaagcatgcataagatcactggattattgtgtatttcttgagatgttaaatattttagatttcttttgcagattactacctcatggaataaaatacgctgttctgtggtggtctaaattcttgcgagatgatgtctgaagtagtgctcattctattttgcttcctgattttgttttttatgaacatttcaagctatttgatgctactctttttgaatatattgttttagcctccttcccactggcattaatcatttcattttagttagcttagaacagagttcatggaaatccaggtgtatttatctcaggtggtaatcctaacatgaatggtgccactgattacctgtgttgattgtatcttttgaaccacatagaatgcaataaaactgttcatctattttttctccagcatgaattaactgcagcagttcattaagtgtcactgtttttacgggatgttgaagccattacaatttcagggcagtgattttacaacttggcatgattttagatactttt

SEQ ID NO: 39151 - DNA, 1360 bp, Bovine  19866880997100
ccagctgttctcaaactcctgaactcagcttctgcatcgcttttccagcctttccttggccctcctgcccgtctttcttgccttccaagctcttatttcagtttgtaacagtatgtccacttgtaggaagtggttgatgaatgtgcttgtggctcactcaactatgagttcttgagaacagggactatctggttttgttcactgttaaatcctcaggcctagcacaggaacctggcaccttgtaggcactcagtaaatatttgtggaaagaatcagtgaagtcctttttgcttcttaggcttaaatcaaaagttgcatttttgcattactggtacactagtacacttatttttatttttatagatactttatttctgtaaacataaaagcaccctttttgagaggtttctgagtttttctggagttgctaaagaagaaattgctgttgggatttttcttaccatattaagatcttatataactcctctgttctttatgcatgccccctggactcaggattgagtagatatacagattctgagatgatagctatccaacactgttaatgacttttccaaatgtgttaaaagtgttgttttgactagggtgaaatccactttctggaggcttcaggaaaatattgcagcccgaggtgctatttcctgatatttctattggacactgcctaggggactatgacacaggcagccaggaaactcaaatctgtggccatatttgagatcacagttgcaaggtgtttccaaaaagtgcaaggctctgcaaagaaagtaggaagtaggtgaatggctgggtctgctaaagtcacatcaccacatagacagttccagaaggacagagaccgagctttgacagtggtctgcaactagttttgaagaattttgacatgattttgacaagacaagcaaaaaaactaccagtattcaaatcttacacattccctcagtttctaatgcattgtatgggtattgactgggtaaggttcccaaacatgtggattaaacctttttgctttaccattcaaattgaccttcacttctaaaaacattttaaaatgtatcactaaagtatattaatttttgtttatgtatttactaaataagttgttactcctacttgtcttgcatttttgaccatctcatgggaagaagcttttacttcttgtaaaatgttagttggtcagttgtgtcgactctttgtgacccatggactgtagcccgccaggctcctctgtccatggagttctccaggcaagaatactggagtgggttgccatttcctcctccaggggatcttcctgacccaggaatcaaaccctggtctcctgtatcacaggcagatt

SEQ ID NO: 39152 - DNA, 930 bp, Bovine  19866881033440
acggactttggccatttcctgaagctatgaaaaagacattgtattgttaatttctaaggcctaatttttttttcaaaccaaataggatgtttattttgctctttaggaagaagcaaagaacttgactatttgcatagatcttcttacccacatgccttcctcctgagttcattcattgcctaatgaaggcactactgggatgaggaagagttggcagctttttgggggcattggtcccaagttctagggcactgtcagactagagcacattaggagaagctcttccgcatggggactggttgggaagccacattattttatttatttattcattaaaacctgttgaaaactgtgtccctgaagacggagatggtggtaaaagaatataaaaatatatattagactcaagcactaaccctgcccatcacgtgtttgcagtctcataaaacataagcagaaatgactattctaaatggatgcttgccataaaagcaggacaaatgaagatctactgatctgtgaagaatggctgagcccctcagagatgcagagtgaggagaaagtatcccaggatgtgggcccatgaagagagaaagggtgggtggggactagaatgtgcaaagcatgtgtggggaatggcaggtgttccattctggaatggaacctggattagatgagtgagttaaagccgccagatcatggacagttttgagagccaggctaaagtaatgggccttctgattggcaatggggaaaaatgcctctatgggtttttgagcacagaaataataggattagacctgtgcttttttagacattccagtggatttgtatcacactcatgagtaactaatatgaattcaagtagactaatgttgagtatgattctggtatttaaagaaacatatttttcatactagatggccccta

SEQ ID NO: 39153 - DNA, 1057 bp, Bovine  19866881056035
acttccataaatgtcgctctgttggcctgagcatgattgccaggattttaaaaagctgaggaaccaaatcagaaagtcctactctgaggaatccttgcctcccttgcagcaacttctgttttttctctgcccgacgaaaagaaacgtcttccataaccactcttgtgtgttgactcacctttttcacccgacacatctattggtataaaatgagggaatcatcagattggaatgaattttgagaggctgtagactaaactcccaagcaggattgtacccacattatcccaaagagaggaggctagccccagacttgaaaggttctccaggagagaaattccacagccgtcactacagctttgaagacacgaagtccactgtcaggagaggtgttgcgagcaagcctgagccctgcagctgaaatgtaaacccagggtgatggcgactgcccccagggtaacagcccgtcatttgcctgttggctgctgctaatctgccttcatccatcttgccttagagccaagtaatcctgctttacatttgtgatatttttctgggagctcgaagctaagctcagtttttgttttttggaaatgatggcctagattaagaccgataggaagactgtctcatggagtctttgggttttgtcattctgtccgttcatctcagatggtgtttgtgcttaaagtatattaacacacacactcgcattcagaattttgacaagagtcactcggccctctgaggagatggcctctgtgtatcaggcaaaagcttgctcaccgttgtttccagccatgtgcctggtgattgacagtgtaaactgcttcagctgaagcttagctttaacagtttgagtcaatgtgggttttgtgttgttgaaactgcagtgtttctagtcactgccagatttaacctttgctttggtgtttttatgaaggttagaaatgtttcattcttaagcagcctttaagaatatttaatactttctctgcatactgtcttgccacttgcaggaaacaaaattaggctgcctttgtcaatttttggtttg

SEQ ID NO: 39154 - DNA, 1562 bp, Bovine  19866881081884
cctttctttacattttagctctttctaaaatgcattgctcttctgccgtcattaagtaggcctttattaagctttatgctatagactggacccattgcttcatttgaaggagtcagtgcctttctttgttccattcagaatagaagtgctttatctttgtgcatacacacacacacacacacacatatactgattttaagccatttttaatagaattttgaaagaatgtctttcttgttttattacttaaaaattcaaatatcaaatcagctaagtttaattgtaattgaaggtgggcagagaaattacctttggatccccaagtatattattacctagtaagaatctaagaaaggacattctgtctaatttttctttaacatactttttttccaccggactgattcaagctatcttggagggaaagtttagctgttctgttcctaaataattgttcattcactcatatacatttgaggctttctctgatagaaatctaaagttgcaggtctctataccaaaaggtgaacacttctttttattaatgacacgtatttgtgtatattgcaaaaggtcaccaccacaagtgtacccttttatatgtgctttggcctgggtttttttcaggacatttcttttatagaaccagtagtcggtgaatttctctgagcatcagcatttgtgataaggattccctctgtccctctatagatctgctgctcaataactgccataatttagtactcctgcatactttatgtgatatatatataatgtatttatatatatataaagtggtttaaaatttgagggttgaaatgtgaacctaaggtttcattattaaaaggtaatataattacattagcaatattttagatcacttaaagcagttgttttataaaaacttgtctgtattttatttagaacttaacttagatagcagtaatttccctggagtgaaactacggtccaaaatgtccctccgttcttacggaagccgagaaggatctgtatctagtcgctcaggagagtgcagtcctgttcctatgggttcatttccaagaagagggtttgtaaatggaagcagagaaaataccggttatttagaagaacttgaaaaagagaggtaacttttcttcattaagcagtaaacttttatactccaatttttgctagattttgtcattttgtgacaatacaaaacaggaattatgaagcgtgtgtggtgggtgatcacaagcagcactagagagcattttccatttattgtctcaaagcagtgtattactgattgtccttatcttacatctaaaaatgtgaaggaggcagtttcttgggattctaatgctcaaatgctctgtacattgaataatgtacacatagtacacataatcacagtggctaaaatatgtaactgagttttgattgacttttccgttatcttttcaaatgaattaaatagctaccagattcagtataagctgactggtttccattattaaacaagtgaaacaatttatcagttttggtttcttaaaaaaatgttgcttgatacagaatca

SEQ ID NO: 39155 - DNA, 1835 bp, Bovine  19866881093260
acggcagcccaccggctcccccgtccctgggattctccaggcaagaacactggagtgggttgccatttccttctccaatgcatgaaagtgaaaagtgaaagtgaagtcgctcagtcgtgtccgactcctagcaaccccatggaccacattttataattcaaaacagaaagcattagactattcactaggcaatattaaaggtgaatgcccgaagcaataaaacagcagatgcaaacaaccaggacctactatacggcacagggaattatattcagtattttgtaataatccataatggaaaaaatatatacatataaaactgaatcaccttctgtacactagaagctaacacagcaatgtaaaccaactatacttcaataaacgaacaggaaacaccagcagatgcagattctactgggacaaccctctgctgataaaactgatggctctgtaaatataatatctatgtcaggtatgtattggaaaatttaacttacactcatgcacccttacaacctctgcaggaacaacctgaactgacctttctcagatgaaagagggccacatcaagatgtagagagcaatctagagttacctctgccatgtaagtgatcccttcactaggtcacctggccacaccagcagaagttgtaggatatacatagtggccttgtgagagggacagatgacagctccactcccaggaaccaggaagtgttagtatgaagtcaacataggtttctgcagcccctgcttagatttcaactactagaaaagtaatttcattagcaatttttgaaactatttttaaacttctgctatactgatttattctcaaaacttggtaatataggtattaaatattaatattaaatattaatattaagatattaaatatcttaacgtgtcccataaatatttatatttgtttaattttattttttaatatttttttgtatctatttggctgtcctggctcttagtgtggcatggggagctttgatctttagttatagcatgcagggtcttttattcatggcatgtggcatctacttccctgtctaggaaatgcatctgggctccccgaattgggagtgtggagtcagcctctggaccatcagcaaagtctctatacttgttttaaatactattcaaggatattaacttgaaaaatggagtcctcattcaaagtcctaaaaaaagaaagctctgggacagggggaagaggaaggcagctcagaagaacaaatagatcttatctccagggcctccatgaagagaacaaaaaaaacagttcattaaagttcacagggaacactccagaacagagtctggaatgaagtctccctccacaactgcttcagagcccagaaactacattatgaataaatcattcaaatcattcatcttatttgctcctcaaaactttcttttctctatgacacaggcaaaaggaaaaaagcaaaaacataaccgaagtactggctgtaattatctacaaaatagtcacgggtgcctataaggataattttttagtattacagttttctccataactccttcatcttaaaatagttcagtaatactaaccataatacaaagtgaaaacaaccagcaaacagctgacaaacgtaaattttacgacctcagtggtgcttaaggcaacatttacagactgtcagttgtatttttggtccaagtacccagtaggccagagaaggaaagtgtgggcatgcgtcgccctgccctgcagctctcctaacaaggaacacacagttgcagagagaaaagcgggtgtaatggggacataagcagctgagtggaaaatacatctg

SEQ ID NO: 39156 - DNA, 780 bp, Bovine  19866881106421
tagagttaagtgaaaaagcacctattacaaaacagtgtgtgctatatgatccaatttgtttaagatattcatgagtaaatatttttagaaggccataaatacaaactgtttattccaagcagatgagatttaggatgcattaggcagggttcagttaggaaaacaaatgcttttggatgtttcaagcaggatttaatttaggcagttggaaggaccagagaaaagaaggcagggtggggggcagctggcgctgtcagccttggcatcagagctgtgatggagagactgctgctgccccattgctgcccacagctcaggctcaggctggtcagagcagggtcttcatgctcaccaaagccacaatgacggccccaccttctcactgccttccagacctggcagacccaaaactatcccagagttaagggagtttgggaggtagtccctagggtcagtcttctttgatttggggggactacagaggaggtgtgggaacggaaccaggcacaagcaacatgcactgtaacctactgtctttggctccttgacaaccaaatgtatcctctcacacatatacagttccaaatggctataacgataccatcaagcttctgtaactatcccttgttcaatcgtattaataaatgtactcaccttcttatcgaaatgggagacccaaagtcccatttatatccatggctgggtgacctttcctcttctagtttaatggcaaattcacctaaatcatgtagcccagctattacatgctacgttttacca

SEQ ID NO: 39157 - DNA, 1015 bp, Bovine  19866881134875
ccctctcctcgccttttcctcatgtcattaacagtcattgcagtcagctataatttcccccacttggtcattttcttaaaacacacatgtaggcaggcacacatacacccatggctgcttctgattaattcagagggtttcttaggggatgattcagcatgattcatcagactgtttctttggcgaacccctgttaccaagtagccaatgtattttcagtagttaacccattgcataggctaaacaagactcatatttcttctagtttactgatgcagtacagctcagttataagtatccagacatgtcaggataggataaaaaattatggaatcaggtcttagaatgaagggatttttaggactagaagaaattcctctgattcagaagtaaaagaaggttattctaaatttagttctatttatttacagaatgaattttgtttaagaagtagttgattctgagaaggtcctagtgttaactgataaggggaggaaagttcaccgcctggggatcacgtgacgacagtcagaactaatgttagttttcacctgtttgttacgaagtatgttatgaactctggaaagcgttctggaactgtgtttcccaagatattgtttatcgaaatgcctactcactcatgatgtacttcagttaaagtgcataagaactgaagtacatgagtgaattcttaatatgtccctagcggcaggaccccacttgaaaatggggatcactctagtttccagtcattagtgctatttcctggagctgtggtggaggcccaggcaaggtggagactcatgagacaactggtgctggcgtctctggtgaccagaggactggtaacaagtggttataatagcttgtcttgatatttctgctttgctgtctgttttcgtgttgaattcacgcatctagtgtcatggtacatatattgcctgagtttttcagttggtattggagggcagcgtgaaagtataatgatgaaaattgtctcattgagatcttacta

SEQ ID NO: 39158 - DNA, 1068 bp, Bovine  19866881145815
aaataaattttatagacagggaagaggcccacacgagcaggctcggctcacactcaacgggtaagcatccccctgccagcacacggagtccagtggagaaagcagtggcgtgcgatttcctcgcggccttgccgtgtgaccctgagtgaccactcagccttgctgtccggtctgcccgcccctgcctcctccacctcatacaggggataccacctcctccttgccgcctcctaagcatgacggagaaacagcctgctcctctcagctgtgcccgggtcctcaaggtaggctacacgaatagcacagaagtacaagaagactccttcctgaaaactgcctctcctgagctgcatatcacagcttacttctccggcgggaaggctgttcagctagattttactaggaacatgagcaagacagggatctggggtggagaagggctttgcagcacacaacctgtgcagacaacagtggagacaaggtgccccgatacgaaaactcctcatgtgcaagacaggaaacctggtcatccagatggggttttatggcaagcctggagccaatattcccacaataagcgctcacggaagtggagggaatgaaatcagaccagatggaagttagatggtaaatgtgcgactgcctgaaggcctggttttgttccagacataagaaggttgggtgcagacacaccgagagcagggttgtggggctgcagctgctggggcaggacagggaccaggcagcgactggagcgtcgcaaggcccttcccggggctcctgccagaaaaggccatgccaagcttccaccccaggtggtgccagtggtaaagaacccacctgccaacacaggagatgtaagagatgcaggttcaatccctgggtcgggaagatgccctggaggagggcgtggcaaccccctccagtcttcttgcctggagagtcacagacagaggaggcttggtgggcttgcagtccatggagtcacaagagtcggacatggatagtatcttagcacgctcagcctctgcccgcccctctacacacctgctctcttcagtcctgttc

SEQ ID NO: 39159 - DNA, 799 bp, Bovine  19866881351362
ttccctggtatttgtgctttttattttgtccttttactgtcattttaatgaagtttgtaaagtgagcgtagataaatgtatacaatcaatttttactatggattacacaaggagatagcttatttacaaactgttagtagccaaattataagtaaacagataactgaagtaaggtatctatttatggctctataagctttaattgactaaacgttatgaagaaatagttataggtttttgaaatctacttaatttaatgaaaaagcttatcaagtgttctcagttctctagaacatctatttcaatgacactgcactaactgtgcacatcttctcttagaataaccacccatcattacatctgcaaacaaaagagacaatttactaacctctgcttctgttgcttgggactgtaaaagctgtcgtatacgaagtatgtccttttctatttgttgaattctggttattcttcgctaaaataaaataagtaaccaaattagatctatttttattgaaaacattagtttttaatattaatttaacattaaccattctatggttaccatttaaaagcttaggattgtataaaatcattctttttttctataccaaattatgtgaaaattagatacatatatatacatattcatatactgaggacatcagtgggatcagttcaactttttaacatatctaactttataaaacagatctctagatttaggaaaactgtacaaatgcaagtcatgtatctacttggaccataaagaaaagtgagagctgaagaattgatgcttctg

SEQ ID NO: 39160 - DNA, 744 bp, Bovine  19866881456696
ccctatagactgtagcccccggctcctctgtcctgggactgtgcagccaagaatactggaatggactgccatgccctcctccagggcatcttcctgacccagagatcaaacccgtgtctcttatgtctcctgcactggcaggcgggttctttagcacaggtaccacctgggaagcccaaaagtaacagtagaaatctatcaacaaatacatttcttcttaaagctgatataagccaaaaggaagtctagaataaaatctttgcctctattctggtgttaatgcagccacaatttaaacatgagatgctgaatactgagtcacagcttacattaacctaagtcagggtgttaagccactaatatccaagaaaaccacgtggaatctgaggagtacctgctgcaagtcctcgctttcagactggagctgagccacgagcgctctcatgcagcctttcatagagcagagagtagcctggaaagtcaagggttacacagcgttagtaacaaggcaacctgcagccacccataaaagaactagaaccatcaattacataaataaaagacaaataccctcctaatcctttgcaatattcattcctttcttggcaaactggaaaaataaagtgaataaataataagaaatgataagaaaagggtttgaatgtaaagtcttttatttggatggaactaatatgtgtttgacactttcaccaatcaagatttccagattttttgctgtcattc

SEQ ID NO: 39161 - DNA, 1435 bp, Bovine  19866881732459
aatgaaatgtgtatgctcattgccttcaacttcaagtggctgaagaactctagaaactgattttcaagagctgtaaaaggagatttattgataaggagtggggcagtcttcagccaagaaggccttccttctgtccccactgaaactgaaggaaaatgaggccgcgtgacctctacctggcggcccgtgtgccctgaggcattggaggattcgtgctgcaatatgtgaggtgcccaaaagagagtaagatgtcctctgtgacaaagattagggttctctcacccctgcaggtggggctctagacttctactacagttggctaaatcactgggggcctgcggagccctgaggttgattaaaaagaaaaagccagtgaggtggacagccccggctgcggcacggcagctgctgctgctgggtcgtggggtggcgcatgctgagagggccaagagacagtgactggagcccagcaggaggcatgagtcgtgaggtgtggctggcccgggtggtggtcaagaaacacaggaggggggtcattcagagaccaggcaggcgatcggaacttgagacggccccagacctgaacgcagagcgagaaccttgattctgagggagggctttgtccaggcaggaagtttgaaaatcagtcccaagacttttcaccttaatgacttctttagaggactgtggttaggaggtttgaggtgccagaactttgagaggggcacaaatccagagcagggagtatgatggagacactcgccaagtaaactcaaggtgctattttaatagctgctcgaggcgaatttacccggcacacgtcatgtggaaggcgtcctcccacagccaggctgtaactagaaaataaaagctgcatttacagaaagattaagaagttggtgatgaaaaaagatttgaaatttaggttttgatccaaggaatcaaactttaggaaaccaagattacattttaagcaatctctagattctgggaaagaggtttatgttagcgagcttatagaatttgacaagctaaaaaaagacacagaaaattgatagtagtcaggatgtagatttttatatcagcagggggtggcatggcagagataagttattggcaattatattaatgcacctgaattcctgctgctgctgctgctgctaagtcgcttcagtcatgtccaactctgtgcgaccccatagatggcagcccaccaggctcccccgtccctgggattctccaggcagtggacaacttttattcttgaaagaaacaggaagaaaataacctggtttatacagataaagagaagttcaatttatagagtaaatatttactgggatcacaaagctgtcctctctttctatcaaatgccccttttctcttgcgaacagaagcagccaacattatacaaaagggaaagagaacacctttt

SEQ ID NO: 39162 - DNA, 941 bp, Bovine  19866881830406
tttctacttcagatccgttgcctctctgctactgaaattcaggttttttgagacaaacagcttgtgtgtgtgtgtgtgtgtgtgtgtgtgtgtgtgtgtgtgtgttactacctagtaggtttgaatgtgtacatatgaatgtgcgttttcctgggaaaatacagtgcatgcatgctaagttgcttcagtcgtgtctgactcttttcaaccccatgaactgtagcccaccaggctcctctgtccatggaattctccaaacaagaatgctggcgcgggttgccatgctctcccccaggggatctttccaacccagggatcgaattcacgtctcttaggtctcctgtattggcaggtgggttctttaaccactagcgccacctgggaaatcacagtacatgcatataaaaatatagaaattcaaaatattgtttttatttttgcacaagtttatatgcttgttaaacatgctaaggagtcaaattatgaaagattaggaaacaaagtacttttgaaataggaatgtagaaatatattttggttattctgttggacacatggagttgggcttttagtattttatggtgatgttcctggcactctaattgctattatgtcattctgtacattttagagaagaagaccaggacattaggacagaattaagctgagaaatgactgtggaccttgagtgacctctttttgagtcagtcttgctcaggagagtagtcatggtcctaagaacttctagcctgtcttccctaagacatttcgtcaggaggagggtgccctgcagtagtttaaccaggaagtgtggcaaaggcgactcaggagctccaggagtcagactgctctaggtcaggctgggtgacgctggggtcctctgagaacttggccctgtgtttaatttttagtttggtctgagatttgtgacatacgaaatt

SEQ ID NO: 39163 - DNA, 676 bp, Bovine  19866881879328
aatcttacccctcactcctatgacggaacggaagaactttctcttcggcacacgcgctctgtctctctgttcctgtctgcctggggcctccctgtcctgtgaattcttttctgtttgggagcaggggtgatgggatgagcagaattgatcctgacagtcagggtcctcctaggccatctgttaagtctgatagatttcatagtagttgggttggaatattgtttgtaatctggggatttggggcagccgaatatattttaggcaacttgggatggatttggatctaattcccagagaaatactgatttaatgtaaacgcttcagcctttctctcttaaaggggcagatgtgctgttaacatctggctgaagtgagagtggggagagactcaggggagaaaaagtgcacacttatgtgtgcgcatacacacacacacacacacacacacacacgttagcattaccccagaacaataaatcacaacaaaatggcaggggagaaaagtgtacattcacatgtgtgcatgcacatacacatacacacaagtgtgttaccccagacacacacatacacacataccacacaagttagcattatcccagacacacacacacacactcacactcactagccttatcccagacacacatacacacacacacacgttagcattatc

SEQ ID NO: 39164 - DNA, 1747 bp, Bovine  19866880348394
attagcactgagactgctactgctaagtcacttcagtcgtgtccgactctgtgcgaccccatagacggcagcccaccaggctcccccgtccctgggattctccaggcaagaacactggagtgggttgcccatttccttctccaatgcatgaaagtgaaaagtgaaagtgaagtcgctcagtcatgtctgactcttagcgaccccatggactgcagcctaccaggctcctccaaccatgggattttccaggggagagtactggagtggggtgccattgccttctccaaggtgcctgctatttgttcattcattcattccacaatagactttcaggcactactttaggaatgaagtgatgaatagtccatttgttgatagcctacacagaaaatagactattctttgaaatatattttcattcttgtaaggttgatctgggattgattttttcttttgacacagaagaaccaagcaagaaatgttttgtttcatccgcatgtgtcaaagtggatgctctctcattccttcagctggcttggtaataaagagatactgctgggctgagacaggcaccagggtctatggtggtcccttactgctttcctcagggaccagtcctcttcccagtgtgttgaaaggtagtgccagtattccacgatgatcatggttgggcttccctggtaatgtctctactcttattttcttaatatagtgacaggatgcatgctgctgaggtggtaaatgggaagaagaagtgcagtgaactgtctgtttcttggggccttctgtattaatcacaggaggaggtgtcagacacggccagatgagagagccagctgactgaagttcatgtcggatccaaattagaatggcaaaattgggagaccttgatgatgctgaactgaagaagcttaaggttctcagagtggttagggctggaagaatcagagaggtcatctaatctagtggttctcagacttgaaggggcattagggttttctggaccccatcccagagcatctgatgtagttgatcatgagtttgtacttccccacaagctcatgggtgtgccagtgctgatgagaacccctgacctagtcccacagctggtctgttgagattttatagatggggagaggacacacagagataggtggaaaggacttgtctagagtcacacagatatcaggagtgaagttggagtcaaaaccaggaatcctggctcgaagtcatttccataccgtcactagaacaatattatttttaggtccaggtacattattatttttagttctactacaggatgatgacatatttcaccagctttgcctgatttggtcacaaatttatttttgagggcctttcatttaaaagctgtctccatcctacattttcttactcagttaatccacatttttgactacagctctgcactaggaattgcacttgaacccaaggtggtattatagcatggtagtctgaaagcatgggtctcaggaagtttgaccttgagtaaatggctttttcattttctcatctgaaaacgagaatagtaatacctcctaggacagcaggtagagcgccgagattgtacctggccctcactccctgaccgataggcctgatgcaatcattgttaactgggtagaacgtggtccccaccctctcatgcataggtgacttactgagtgctacaactgagagacaggggaattagaggaacaagcacagactggaattaggaggg

SEQ ID NO: 39165 - DNA, 1845 bp, Bovine  19866880361042
ccccttgtaggatttaaccctctctatagtcatttgtggagaaggcaatggcaccgcactccagtactcttggctggaaaatcccatggatggaggagcctggtaggctgcagtccatggggtcgcgaagagttggacaccaactgagtgacttgactttcacttttcactttcatgcattggagaaggaaatggcaacccactccagtgttcttgcctggagaatcccagggacgggggagcctggttggctgccgtctatggggtcgcacagagtcggacatgactgaaggcgacttagcagcagcagcagcagcatcgtcatttgagactctggcacatttccttactgatttgaaacccttagagagtgtatgtgtgctggggttaggggttatcacattttattcattttttttctttttcttagttcttatcccaacatgtgagtctatggctgctttgatatttatttggggtaaggagctggaaagggactgggtttcccctctagatcccagtgtctcctaagaatctgactccttgctctttgctgtaccttggaatggggagtctgtgtataacaagcaaagaagagaacttggctcgggaagcctgtgagcagtcattgctgaaatgtaaatgcaaaagattgaaaggaaggatgtgagagtgaagccagctgtctcgcttccagctgtagaatcatcagaagagctgccgcgctcaaggtcaaatacacaagcccaacttggataaaaattgccagggagttagagtggacgttctctgatgttctgatgactttgaatggggcactgtaattccctcccacagcaaggcttactttaaagaaaaaccctgctttggggatctccctttttgctcacctccctgcagcgtcagggcatgccaggcgaggttggcgtcactccttatagcaaggcaagtactctttctgagggcttcatagtgacaaggccctggcacacctgctaggtcttcaaaagtatttttttaacttgacgattatttaacaattcagtctcctacacttataatgcggtaaaatcagatgccaggagagggggaaagagttgctccggatgtcaggaatgcacagatgcactgagaacgctaaaaatctgaaaatcgcaaacaaacataagcgatgagtttttaaattacaaaaattattttgggtgatatacatgttccacgaaagctatttttactttatgggttctttaataatgctaaaagatatatgaagtaattaacatcaataaagggcttccatggtggctcagtggtaaagaatctgcctgccagtgtaggagacacaagagacgtgggttcgatccttgaatcaagaagatgccctggaggaggaaatggcaacccactccagtatttcccatgcctgggaaatctcgtggacagaggagcctggtggactacagtccatgaagctgctaaagagttggacaggactaaacaacaaaaaagtaaatgtttatatttttactctagtttaggaaaaactcttacgtaaattctattgtaaaaccataacaagtagacaaatagtttctccacacaatagatcttactgaatgtgccagggtgtcagaggaaagaactcaggaaagagaatagagacatttggaggaaaagggggaattaaaaaagaacatcttcatggaggaaagtacacataagtcatattgtacattttcgtttctcctgatatcatatagtcattctttttctactctgacaggtgagtgagaagtgttgctattcctttctacaaattaacaaaatcaaggcttaaaaaaccag

SEQ ID NO: 39166 - DNA, 1164 bp, Bovine  19866880429857
ttagtatgacttctactaaagagctaaaacccattctgaatgcctaccagcacagatgaggtacatgatggtgcatttcaaaatatggagcactgaatgcaaatcccacttactgaaatgaacagaggaaagaatgaattagagacaagaggtaatatcatttgtatgatctttatgtatgatgtgcacgtgtacatgcatgcttagtcacttcagtcatgtccaactctttgcgaacccagggactgtagcctgccaggctcctttgtccatgagattgtccaggaaaggatactggagtgggttgccatgccctccttcagggatcttcccaacccagggatcgaacttgcgtctcctgcattagagtcagattccttattgctgagccaccagggaaacccattcatgtatgataatacattttaaaataaatgttacttgcaaagctattgcatatatatatatatatatatatatacacacatatattggtaaagcattgggaagatatacaaacagactatagtaattactttatgaagaaagtatagagttggtgtgggcagagaagaaataaataaagtggctagtgagagatgactctgaaggtctattctacatacttccgatagttaggatattgtgatgagagtttatccatatactacatcataagtgtgcttcaataaagttaaggaacagaatgtcttctatgtactgcacatgtattcgattggtgggtcagcatagaaagctggaggaatcactggattcaaaattaaaatcaacaggatcactttataagtaggggtttgtattcaacctcatgtgtaataagaggacaatagtctctggccaggtaagctcacagacttgacgttgggacaggatgagatatgaacacaaagtcacactacaagggctctataaatcacaatcactgcttgtactgtttgtgttctttgacctctcaaatttccctggagagaaactgacaagattgtgataatagataatttattttaactcctttgcttgaaccacattattttatctcccctgtctcctttcactaaggtctgaaatgaaaacaaacatcaaatgaggctgtaggattttattttatctgtcacatacagctgtcattaaacacacttgaga

SEQ ID NO: 39167 - DNA, 1825 bp, Bovine  19866880479602
attccatggggcagctaaaattgctctggctacttatagttaagaaataagatcgaatctctgtccatgtgtgtattttatttattttttatttttggccatgccactccagggatcttagttccctgatcatgaagtgaacccagagcccctgcagtggaagcttgaagtcctaaccatgggatctctagagaattccccaaatatgtgttttacctgggttttttaatctgttattttccatccagtagcccaccttcatgaagatctgtagctttaagtgtgaaagcctagtgaggtaccaagtcctgtgccaagaggtcaccagaggaacctgtacttattcttctaatgaatttccagagaaaatgcttcttgtttaattcccaggaagaaaacaaaaacatgaaaaacagttggcacctagcgcttctgtcttgtttggtatgaaaaccagtccttttcaggaactggaggagggagttgctaccccaagggcagggtgtgccctgactcgtgggaaaggcaaactgcagtgacctggagggtaaggagaccttttcttagaacgaggtgaaagtcaggtcagttttcctgtattctggttgtttccaaactggatttctcttcttggctgcagtaatttcctttggagactaggagggtgccagtaatgacagctggatgggaccctcaagacccctctgtctattggtttgatgcatctgtgtgttcattcattccacacgagatgccaggtatacctgtgaatgaatgagtgaaactctagtctgggtttaggggatggaaacatgaatgctgtgccatccctgtctccagaagtcaagagaggacataaaagtatctgcagaaaatatctggtggctctaactgagcagtgaccaactctagggactctggggaaacttcacagataataagtgttatttgatggagccttcaaggatgaatggggatttgtctagtgagatagagaaggagaggatcattgagcaagagaaataacatgagtaggtgagaaagtgcatgtgctgtactgtgtgctaagttgcttcagtggtgtttgactctttgcaaccccctggactgtatagaccgccaggttcctctgttcatgagattctccgggcaagaatactgaagtgggttgtcatgccctcctcctggggatcttcctgacccaaggattgagctcacgtctcttatgtctcctgcattggcaggctgattctttaccactagtgccacctgggaggccaaagtgcatgcacttggaaactggaaatttggaaattggaaattccaaatccttgtaaattggattcattggggatggactgcagagtagaaaggccatggagatgagggtgcagggatgggcttaggttgagaaaggtcttgattgctgactgagaacttaagactgtgctatgaaaggagaatcacctagggaaaggaggtgattaggtctgtgttttaggaaagtgatgggttatggatggttaaagggggtggttaaaggggacctccttggtagctcagatggtaaagaatctgcctgcagtggagaagacccaggttcgatcccttggtcaggaagaacccccagaggaggaaatggcaactcactccagtattcttgctgggagaatcccatggaaagaggacctggtgggctacagtccagggggtaaaaagagtcagacttgactgagtgactaacattttcactttcaaaagtggtggtagtggagatggtgagatgtgggtcatggtctagtcccaagatacaagttaaagggag

SEQ ID NO: 39168 - DNA, 1440 bp, Bovine  19866880516077
ctgcattgtaggcagatgctttaccgtctgagccacaagggaagcccttcggtgcttttatttcagtaaaaagaaaacaaaaatgcttacaggttgttttcaaatgacccttgatgccctcaaaacagactaggatttaaaaaacaaaaaaagtaacaaaggttctgaatctttatccaacatatcttctctagtttatgtttcctttatacgaccttgaagaatcaggttgccagccattcattcattctctcctcctcactccgaagttaacttagaagaacttttaacactcttcttgccacaaggacaaattcatctcttgtatatctccacagatatcatggctcccagattctctttatatatctcctgagagctaaacctttatcttagaacctcatgccttaacagtttaaggctccagtttctattaaaggtaaaaatccttctggcaagattttactttggcatactctcaaagatgtagacctctttctttttgatagctagttagctagctggatatgaatatacagatataggtagatatggatatatatctgtatctcagtgtgagtacatttaatatattttttgtacagatgtgtggagtcagcagacatgaaatttggatttagagatgactggattcaaatcaaagattcattattcattagccacaagacatcaggcaacttatttacaatctctttaagcctcaatttcagtatttgaaccttgaaatattagtaccaaatttcaaataatattataaaaattacatatcagagacctgccatatagtagatacaaataaaatgttagcttcctcatgaactatatgtaaagaacatgaatttatatcttgttctggggtaggaagaagaatgtttgaggatattagcctagaatggaagagttaagagggcatgagggtggcagaggaacatgctgggggcatacagaatggagagcctatggcccatttcatggccttactaaattcatgattttccatgggaacaattttactccgtgtctttcaagagtaaccaattttacgcaatttctgtagctgaatcatactttcatacaattttagagcaggaagtgaagagataatattgttcaatctaactgttttatgattgggaagatcagccccgggtggtctggtgatgtacacaggccataagtgcacagctaagaagggtcctttcaactggaccacacttttctccaggtagctcttgtcgtgtacagtggttaccttcttgattggctggtacttcgtttctggtgtagctgaaataaaatgtccttcattctagcaaattatttgttctctcctttcaattgagtatccatacacaactctgtggccttgttcagaacaaactcaaactttgcagtaaatattagctcctaactaggatt

SEQ ID NO: 39169 - DNA, 1728 bp, Bovine  19866880672661
ctaagggtgttgtatctgcatatctgaggttattgatatttcccccggcaatcttgatgccatcttgtacttcctccagcccagcacttctcatgatgtactctgcatataattaaataagcagggtgacagtatacagccttgacgtactccttttcctatttggaaccagtctgttgctccatgtctagttctaactgttgcttcctgacctgcacacaggtttctcaagaggcaggtcaggtggtctggtatttccatctctttcagaattttccacagtttattgtgatccacacagtcaaaggctttggcatagtcaataaagcagaaatagatgtttttctggaactctcttgctttttcgatgatccagtggatgttggcaatttgatctctggttcctctgccctctctaaaaccagcttgaccatctggaatttcacggttcacgtattgctgaagcctggcttgaaggattttaagcattgctttactattgtgtgagatgaatgcaattgtgcagtagtttaagcattctctggcagtgcctttctttgagattgaaatgaaaactgaccttttctcagccagtgctgagttttccaaatttgctggcatattgagtgcagcactttcacagcatcatctttcaggatttgaaatagctcaactggaattccattacctccactagctttgtttgtagtgatgcttcctaaggtccacttgacttcacatggatggcatcgctgagtcggtggacatgagtttgagcaagctctgggaattggtgatgaacagggaagcctggcatgctgcagtctttggggttgcagagagtcaggcacaactgagcaactgaacatattaaactgaactactggcctgccagggaagtgccagtccttcctgttttgttttcagatggttagcttgtgttgggagcttgcttgtaacttcaggtctttgaaggtttgcggtttgtctttcctgaatgctgctactccatcaatgatatatttatctttcttatttaaaccttttaaaatgattacaatttcttagtttgtttggaaactgagtacatacttgctgtttggttacatgaacatatcttgagtttcaatcccagtgctcccacactgcattcctttcatagagcaataatttatgaggcaacctaaaaaattatttcaggtgtgtctgtgttgcatggaagcctttttatttgtaattcatgtggcctaagggcttgctggttctgtaatcagggtggagtcttatatgccatggatcttctattctcttgtgctccttgttctagcttgcaaaagccatgagcagctgcaggggaaattaatgattaaaattttaatattccatactatttgttgcaacctaaacatgtatgctactggaggatgagacctgtgacatgctgatactgtgtgctaagatggagaatattgctgcagaataagacttgggtgttgctttgtttggcttcttggaaatggagataggaactgggtcttatactgttgaaaaagagaagaggtatggatagtgtcattttcctcttctcgtattcctttgggaaaaatgttagattcatagcatgatttgattgggcttcccaggtggctcagtggtaaaaaatcaacctgccaagcaggggacatgggtgggaaagagcccctcggaaggaaaggcaacccacaccag

SEQ ID NO: 39170 - DNA, 1524 bp, Bovine  19866880675604
atctcagacacagccctctcccatttttaaatgattttgcttactctccagagtgtgtggtaaaactgaagaaagtctaagctggctaatatgggcttttactctggtagactaaggcttctgcctccgtttcaggcaagcatctcagtgattcttgaggatgtgtttccttcggtcttggttgcctgttcctatagtatgctcatgacagtgaacactgggtgatatttaatcacatccttggaaaaagtgaaggaattcaaataatggaaattcttaccatcctttttgactgcatcccctctgaagaaactttaatcaggatttttctttaatgagatctatccgtggtgactctaaatgtaatttaatttttgtcagaattcagttaagctttactcaaagacccttgttcgatattgatttcagagttcagcacagcactcaagccctcagatggatgttttagcattttaatttcttctgaaatttcaaaagaccagtaagctgcaacactaaaaatgtaaagagttctcttcagcgggatggtgggggagctgcgaggataaaatgaaatgtttgttttgaagatggagtttgtatgaaggaggaccgtagggctgtgtgtatctctcttggagacaaagccctttcacaggaagcaccagcaatgtcattcattcagttgcctcctgttccgttagtggaaaggagatgtctgaaaaatgtcctgtgcagaatggagaaagcctatcgctgggcctcagtctgtgccttttgttgttgttattgatggagtcagaatagtaaagatagtggtttagttagacaattattcctgtgtaaggaccaccctgcttgatgttctgagttcaggaaggagattagtctaaaataatttaatttattcttgcctaaattagtcatcaattatatacataatttaggtaaaaatacaccagctatggctttatgtttgagtcaatggttatttatatttgccagtgatttcttaaatccttaattcttacatgtatatagctgcaattaaacaaatttgattcattaaggcactgtaatcctctttactaattttatacatgctttcttttgtattttctattgattgatttaatgtgaatatgtacatagctttccattgttaataatttccatttttagctttttatttgtttacttttaaattatgtttacatactcctttctaaaaacatttgccactagaaagatattgggtatttttcaatctttaagtattgtatatactgctactgctaagtaacttcagtcgtgtctgactctgtgtgaccccatagacggcagccaaccaggcttccctgtccctgggattctccaggcaagaacactggagtgtgttgccatttccttctccaatgcatgaaagtgaaaagtgaaagtgaagttgctcagttgtgtccgactcttaacaaccccatggactgcagcctaccaggctcctccacccatgggattttccaggca

SEQ ID NO: 39171 - DNA, 726 bp, Bovine  19866880695469
ccatgtaatcagcatgaatagcaaagaccgtataatactcatgtttctatttgttgccctcaactgacatggttggtcgtttgttttgttttaaataaaatggggaagcaacaaatatattaaatccatctgcagaaaacccatatttgcatgtggaaaacaaataagtgggtgcctgaatgggtgattaggcatgcaattgcccatctgcacccggggccccagcctccctgcaggtgcgcctgacacaggagcagagactccgaaaggcaggtcctccaccatggagagcgacagacaggagggaaaccgtgccctccgcaaatggacttgttctgagctgcgccccctacccccgccccatagggtcctggttctccagtcactgtccctgtatcttacagctgaaaaccagaaataagttttgccatcctttgcttagatttctgcggattctttaaaccacaaaggcaatttttttttctgagcatcttcgatatgttcttaataaatatttgttgttgcatctatctttatgagaatgggtgaccccctcccctgtactcttcatctgggtcattctactcatcacactggcctcacttttcagtcttaggaccttggcaactgctttctttcagcttgaaacactctccccactctggtctccagcttactaactcatagccttcaggccttgctcctgtgcactcataataagacctt

SEQ ID NO: 39172 - DNA, 1249 bp, Bovine  19866880713864
ctgatgtgatttccctataactttccttggattttgataaatttaaaaatcccaggaacaactctttgcacttacagaaattaagagtgcttaaaggggaccacctgatggtgtcagtgtgattacagcgagagagacccaggggaaaagtgacatataatgaaacaaaattggtgcttctcagcctagagattctcctacctatgccaaatcttgaagatgtttcggcaagaaaaaaaaataaagaaagaatggagaaagagttaaagaaatggttaaagagaaaaaacataaatgatctgaattaaaaagcatatagaactggcattgatgaaccttaattcctttgagttatgtttccagcagtatggaattcatgccaattaacctgccttctcacaccaagtccctcggtgctcatagctaagacatgccagcaagaccaccttttctgagtttaagattgttgcaaatgtatctgataaattccaacattctttccagattaaactgtataataaaatcagaaataggaatagatggatataccattttgatttctgatcccttgtatgtgacattttctatcacctatcagcttttagaaacttctgtttgtccctgatgttcagggtctttttcacttgtaatacacaccacaagtatacttccactctcaagggtcatgtcttttggatcaagggagatttgacaaaattgttacttgaataatttcttatccactgtttactctggtctttctggagttcctagtttttggatttagagtttatggtttcatcttctaattttttttgttttgttttctcttgtattgatgatctctgtgtttttattctaattactggcttacttccttaatttcatatttcaacaattttccagacatttttattgtcatatttttaatttctcaaaaactttgttttattctctgattatttatgtatattttgtctttaaatatatgaaacaactttttcttatatcccagatgctttatttagtcttatctctctgaggaaattatttttaatatttcaccttggcttcttccattaagtctgcttgtttcttttttattttttattttatttacttatgtattctgttttgtgaaagatttttctcagttgtttttcctttttcatgaaactgtctcctttgccaaattttctatcagtctgagaattttttcttgttgctattaaagaactctttatatatt

SEQ ID NO: 39173 - DNA, 2432 bp, Bovine  19866880777264
aactgagttctataaatgcaaagagaatgcaaattaagaaagcttgaagttcagtatttaaaactggtatctttctacttttattttcataatactttgcccatgagaattgttagagttttgtacaccatacactttggtgagcaaagtttcaaggtttatttgggccatttagaaaaagcaaacctaattctttttattttatggctagctgaagccatagagtttcatgagtccttgttgatctggtcttaattaaaactcattaggtaaccttaaacaagctacttaacctttctgtgcctcaatgttcacatctggaaaacgtaatgataatagggcctacctcataggattgttaggagcattcaatatgtaaaattacatttctcccactttatgaagcacctttctccctcttggttcaatttctttgaggttgatatgtatgctgtaattgatttcataagatttaattgtgttacagatttacgtgcaggagttctttcttccttagtggtaaaaaattaacaatgcattttactatcaaaggcatcatattgtatgtataaagtgcttttaaaacagagtctgaccctctgggcttccctggtggctcagtccttgaagaatctgcctgcaatacaagagacctgggttcaattcctagatcaggaagatcccctggagaagggtatggctacccactccagtattcttgcctggagaattccatggacagagagcctggtgggctacagtccacagggttgcagagtcagatatgactgagcaactaacacacaagaaaccaccaggctttttcagagagattcgtgaaacctaggtcagctagcctcgctctctgctgaatgttagagttactaggtcaatttaaaattcccacaccactgactaattcaatccagatctctaagggtggggacacccagtcatctgcatgttgtaaagcttcctggatggtcccaaagtccaggcaagatggagagtttactagttccccaaaatgagccctgggaaccgtaagatgtggcaggacttcctggggcaccaacccaaggcccaggaagagagtcctgatggggaagacaatgtcagggccctgatctcacgtgacctaatgggattcccacgtcatcccacatctctcacatctctacagaccaggcagggagcttctggggccagggcacatctccccttcctgcaccccagcctagaagaatccaaggacagggactgtgtcctaagcatgtcctaggcatctctattcccagcagtgaccaacttgagcagcatccagaaagacgtccaaagaacagtgagtgaaggagagaagggaagtgggaagggtgcgggggattccccaagactgacaaggcgtggttggggtacggggagggcatattttccttcagggaaccagggggtcatggagccagactgcatgcaggaagcttcatcttgggctccccagggacctcatatgccacagcggtccttggagaaagttccaacttggcaaccacaatgtgaccctcctcaaagcccccaggaagctgtgtccttggggtgggcaggagaccggggaggcaggcacacacacaattgctcctttatccaagctgttcttcctcccccctgctcccgcagagaatgaaaaggtcccttgtgggcaccagccctgagcactgggacgggacccaaggccctcagggcagcgcctccctcagcagcggccctgaggctggcacagctgtgccaccagggctgctcaacagcttctcccccacctcactcccacccccaagcagcacccccttgcagcctcctcagagccttggtcccctcccagggctcaagatatgaaggcagaagaggctctgctatgaccccagccccaacctgagtcctgcccttgaaatcagaccaagccacggctccagccacttggagagatgaaagccctccccagctgagtcttcaccaaggctcccagttaacctgagtttcttggcccacatctcaagggcgcaaatggccaccagccaccgcatcctccactggggacttggctccatgtttcaacctgacagacagcctgggatctccccagagttggggagaagcagcacattggctctatatccagagcagacattctgggcctcctgtcctcacaagagactgaaggctctgagggtcagacactcagcctccgctgagtaccttgccacacaggaatcctcggccacagagcttacatcactgcagccctaaggctcctccaccctggcccaggcaacagggtcccaggacaggagacagaaacccagagtgtcagggccctgaagtccccgagggtgggcccacgagctgcctggccaagcaaggctctgtgtgcttagcca

SEQ ID NO: 39174 - DNA, 864 bp, Bovine  19866880834176
gaacactttccattatgtaaaagcctattttgttttcatgtcattcttagattacatcatagagtggctgcagccgtctcgtaccgtattatgaataaatcaccagcttaatcatagaatgagccagggccctagatttaaaaggaaaatattagatcatttttaataactgatataactcaagccagtcgccattgaagcagggggaggtgatgtcatcctaaagaagtccaaagaggaactagagagggtcagccctgggcaggtcccagagaagcttccatttacaaaggaagaggtggctgatggcagctgagtgggatgcgttctctggactgaacgatcttgtcatgaaaaccaacaatgacttctcaatagaccatcctcatgaaacacaatgtacaaatagcttgttcccaaaacgactatatttccaaagaccagaaaacatgaacatattatgatgtctgtatttatgtcttgggagccattgagcaaaattataaatattaaggcttttagttattcagaaaaagagatgaaagctggggtgacatatgcaaatgccacaggtctgacgtaagccaaggggacagtacaaagtaaggacactgagacaatggcctgatagagaaaagaactagagtggtttctagccgtcacaaactattaaggagatttgggaaaatgaaacatttactgtgcaccaactatgcactaaatatcatacacaattggcactttaaatacacatgctgctttgtgagcccagaagaatctaaaaggtaggtgctagtagcactattattttcagatatggaaaagtagtgtgaaaaatgattaaatgatgtaagtagatatgca

SEQ ID NO: 39175 - DNA, 1082 bp, Bovine  19866880839324
gttaagtttttttttctttctttctgatgttattataagtggaattgtttccttagtttcttttctggattgttcattgcacagaagcacagttgatttttgtgttagtctgtgaactcttagatggcaggagccatgccttctttttgttttgcagagttaatacaaaaatataataacatttattaatatttgtttatgtatatttattttacattagcagtaatctttgtcttttttttttccttttctctctcctgctttagggtactactagttcaacagcttctcctccagtctccacccctgtcacaggacataagagaatggtcataccaaaccaaccccctctgacagcaactaagaagtctacaatgaagccacagcctgcaccccaggctggaccaatccctgtggcaccaattggaacactaaaaccccagcctcagcccgtcccagcttcttacactacagcatccacgccttcaagacctaccttcaatgtgcaggtgaagtcagcccagcccagctctcattacatggctgctccttcaccaggacaattttatggttcagggccaggggcccaaggttataacactcaaccagttcctatgtctggccagggtccacctccttctacacggggaggcatggattatgcatatgttccaccaccaggacttcagcctgagcctgggtatgggtatgctcccaaccaaggacgctattatgaaccctattgcgcagtagggcctggctatgggggcaaaaatgactctgatccttcctatggtcaacaaggccatccaaatacctggaaacgggaacaagggtatactccttctggccctgggaaccagaaccctgctgggatgtatccagttgctggtcccaagaagacctatatcacagatcctgttccagcgccctgtgtaccaccactgcaaccaaaggtaggaaacttattaacatagtggtgggaataaaagggtacctatcttggcctgccttccccagaaagcagatcctaaggcaaaagtgttaatatatgtgctacttttatttcattaaaaagtaca

SEQ ID NO: 39176 - DNA, 2333 bp, Bovine  19866880999570
aatgtgtacatagctttccattgttaataatttccatttttagctttttatttgtttacttttaaattatgtttacatactcctttctaaaaacatttgccactagaaagatattgggtatttttcaatctttaagtattgtatatactgctactgctaagtaacttcagtcgtgtctgactctgtgcgaccccatagacggcagccaaccaggcttccctgtccctgggattctccaggcaagaacactggagtgggttgccatttccttctccaatgcatgaaagtgaaaagtgaaagtgaagttgctcagttaacaacccccatggactgcagcctaccaggctcctccaacccatgggattttccaggcaagagtactggagtggggtgccattgccttctccgagtattgtatataacatgcctataaataactgagtaaaatgttttatgttattttattttgaattactttctaaacgtaaatcctttgatttatgttaccaagtttacagcaatttggagaactttttctagatttaagaagatttttttccaattttcagaactgggagcaataacaagaccaaatgttaaactataacctctatccgcttgaagaggtttgtttacatttgttttgaatcaatttaataggtacattatgtaatggtttttaatttgagtttttataattagcaaaatcaatgagattcttttatactttgatgataggtctcttaaaacttagttttggttattctagtggatttatttaaatgaacagattaaaattaagagcactaacttcctagggaagaaaagtagtataagtaagtgtacatggttctagtccttgctctcgtggtgtgatgttagcaaggtaatttaatttctgagtaccagtatcctcatttattaaaaggaggtaataacttcttcccggtcttcaaagggaaggagtaaataagtgtaatattttgtacatcatgaagaagtggtttactaatatcagggcttgacctgattaataatattattattgttgctttttcccttagcttaatttgatagaatttagaaatcctctaagtttgggataatttaatagctgcagttgctatggaaatactgaaataaatagatgtcatagaaagagcatgaggacagatatgagaaagaagttcatgttttgcttaagaagatttttgtgttggcataggcagcaactgtgcctcccacttatgtggccttctgcccttagtgaggcaggtttactcctaagtacagatttataaaagagttgctgtgttcttagcattgccaaagagtctggacctagagacctagtgcatcagagattctcagcaagtctgtttatgaaatggcagccaaggatctttccctaaaccagggctcttactcagagtggatggaatccaacccttaactctccagcagtggaagttagtacagacatttttattacagttacaatctaagtgattaaaagacctcaggaaatcggaggccaactccacaggagactaaacacttgaaagttcctgaatttgacacattagtggccaacacacacagtcttttgctctctctgtcactacatggctacagtcaaagcattctaacttttcaagctacattaagaggcaggttttgtacctccacagggaacttgtccttttagatgctcaacttctcctaataaaatgttttaaaagcagttatggcctgtgctttatgtgggtattaggaaaggacctgagagtttagactaaacttgaaaaattcacatgaacttcctttcttttttcttaattacccatttctgctctctcatcttcctctccttctctccctctctcttttacatgcacacacacacacatacacacacacacacacactttcttcttatgttacatcatcccacaggcactgtcccaggaaggagaaaaatgattcaagcaagagaatttgtcaagtatactcttgagagacttaaccatgttaactactatgaatagttctctcttccatttgcacgggcccttgcgttttataatgctcctgagcctctttaactgtaccttaccatacctgttagaaccttgtgaaacagacaagggggagatcctttgtcctgtttatagtggttttgatgttttcaaagtaatagccaaaatgaagactagggaacagatctaacttgcattttattgctggatccatactgctgccctgaaacgagagtttagctttctaaaaatgtatagatactgacagcccccgggattatagacttaaaatct

SEQ ID NO: 39177 - DNA, 1118 bp, Bovine  19866881007750
tgggctcattgtttttcatagtttacttggtttatcacccagtgagggacagcttgacatttacttttcccatctgtttgattctgatctcctgtaggtgtttctccaaacttagcaaaactctcttgaccatatgaattgatagcaagtgctttcttgtgtatctatcataagacagttacatccagaggcatatttgacaattagggagcagtctcagatggttaagaatctgcctgcagtgcagtggacccggccgggttctatccctgggttgggaaaatgccctggagaagagaatggctacccagtctagtattcttgcctggagaattccatggacagatgagcctggtgggctatagtctgcgaggttgcaaagagttggacatgactgagcaactaacacatgcactttctttctttctaaggaaagagaatgaagtctggagcgaggcatggcttctgcatcctctggtggatggtggagagcgcagtcattgtgctctccagggacctgcctcagttcgggacacttgtattattgtgcttagcatttctgtattactttacatttgcaaagtgctttccagtgatttattagctgtgcttgtttttaatagcccctggaggtaagttgatattcagccttctgagaacataaatgcatagagaaggctcatctcatcagatattattggatctggggtcaggactttgaactcctgggataaggccatttggggtcattgcctcatgaggattaataggagatcaagtggacttaacttcagctcccagagtctctcaggcagaggtggaatgatggcagctatttaaagaaattgcatagaagccattatcaaaagacctggattccagtcctgactcggctgttgaccatctgtgttgaccttgagctgtcactttgcctatatgtgtcttggattcagtctctggtaaaacagcgtttgtctcccaagcccctttagatctaacattgtgttaaggatgattctatgactttgaaccccttctttggaaggggtagttggtgaattatatgacaaggaacatgggtgtccatctcagtcacggaaggcactctgcaaatgtaa

SEQ ID NO: 39178 - DNA, 1250 bp, Bovine  19866881016171
aaactcaaatttattgaaagcttcctttcctaggaattgtgttgatgaaagactgtgagggtgattagagatgaatgtgatcttcaccctgccagttagcaattcactctagtggaaggaacagacacacacacatacacaaatttaattcaagatgatcaattctaaaatggtagcaaagttttatgcagcggaaaactcaaacaaggaaaatgaattctgatttgtggttatctgggacatacatttggggaaggcacagtttaaacagtcttgaaattgtacaagaacttttggcaggatggaagttggcaggccccgcctgccaggcccaggggaaggagagctcagtgagtgacgggaagaacagggtctgaagcgtgagagaagggagttttggagaaggactctggaacagtggacaagtggggtcacaaagagtcggacacgactgagagactgaactgaactgaactgaactgatgcagggcacttgaggctcatatgaggtttggttttattcagacaacagtgcctttggaggtgacagagtagatcccatcacagtgacaaaagtgaaagacccagaaacaaaggtagaggcagtctttccactcctgctccccagtggggtggtttggggtggggagataaggctgaacagtggcttctagaagggatctgatggcccctcccagaaaccacacctgaccttcttctgtaaataccaaattacctgttcatttccccaattacctaatcagtgaaatcaaatcaatcactgttaattctaactttaataaacatacttgagtttacatataggctgttcttcctcaaaccataaataactgcacgatgcatgtgaactttgccaaggaggtttaggtggggggaaaaataacattcaattaacaagcttgtcagaagctgagtcattatacatgacaggaaaacacatttgcaatattaaaaaactaattagaatatatattttctagaaagccataccatattaatgagaggggaaaagcctctgtatcaaatctcagaacaaagcagaaagggccttgtgtgttacaatccagagccaaggggagcagtagagcctcatggggagcgtgctgcttgagtgccaggctgcccgcagcaaagcctgattctgccccgggagctacttggcctcaagtatgtgcttaatctcattgagtttacccatccatcacatgaggatggaaacagttgtgaag

SEQ ID NO: 39179 - DNA, 836 bp, Bovine  19866881029578
ttacagttcgtgttctgcaaaagatggaaaccaacaagggtcctgttttgctagttgcgaacgcacacttcacaggaatgcattttatgtctggtattctcctgccgctcccttgccctgtttctctttggccatatatggaactgagctctaacgtctgggtcacagaactcaggcctcgggtatgaaagcaatctggtttcggtgctgtttgtctttactgaaaatccgatgaatccatctaggaaacatttactaaaatgcaaaaggcaggaagaattgattcacaccctgaacttggcacacagaaacagattattcttttgctcacccaaaggtatgctaaccagattctgtggagaaagtgacaaatttaacaaatataaaagtttcttgctcaagaggtgtgtgcatgtgtgtgtgtgcgtctatatgtgtgcaactcacatgtgtgtcggggaggggagggtagttgtcctaacagagttagaaagacaaaattgatgcaaaaagcaagacagtaccatcaaaccaataacaatacatactagggattcatctttcctgatatgacttagttatctctttatgtggtatctgactctcaaacttttgcaaatagcacttcagaaatagaaaatctctttgaaaatggggattacctgcaattattatttcaatttaaaacaagcatttagtaagcatctataatttccaacaatattcctgagaagacttgtgtgtgtgctgtgctcagtcactcagttgtgtccaactctttgtgacttcatggactgtagccctgcaggctcttctgtctggggatttcccaggca

SEQ ID NO: 39180 - DNA, 1440 bp, Bovine  19866881103654
aaaaggaaacatgtgatctatatatatatatcaagatattatgctcactactgataagctttgcctactgaaatttaaattagaaaactgtggtcttccgaagcacatacataaaaaacaaagatggctccacatttatgctttttttcagaaaggatgcagggtgttatcagccaaatgcatccaaatctgatgagtgttaggaaagcataaagtatatcatcttatgaatatggcaaatattgaaaaatatctgcaaaacatcgataccaaccaaaacctagacttcagctacagcatcaaaaaattcttgcatccttcatttgtaaccaaaaacaaggtctgactttgttcacagctcaattagtcaattcatttagggcagaaggcctttttcactcatattctggatggatccaaatgtattaaaagttcaaagagtattacataccatttcaaagtttatttcaaactaagcaaattaaagaatacagaaatgtgttatttttcccttggcttacagagaaaaaattaaaaaaaaaaaaaaaaaatcagcccgaggtggtccaaagcataagaagtcactgtttcaaatccgagaattcatatttacttttctaaactcttaagaggtaggttataaccttaaaaggctggaactcctcaatggaagggtgaaccactgtctatggaacaatcacccctccataagtactggggtagagtagaagtaacataacatttgaagacagacaatctagaggcaaatcaaatttcaccatttactctttcagttggagcaggtcacgcgtctttcacttcttcattgttaaatgagaataatacttgacagcgtattcagttttgtgaaggttaactaagaaatctcactgaatctaaactgatgagacgattattcccccaaatctttatttggcaatgtgcaccatctgttgggcttcctggtggctcagacggtaaaaaattcacctgtaatgcaggagactcaggttcgatccctgggttaggaaggtcccctggagaagggaatggctacccactccatcaattaataaaaatgttgaggccatctaaattcgactaagttcaattcaatgaaaatttactggatgctcatcatatgtgatataggtctctgccagatgtcatgactggagggagggagggtaggagggatcaggagaaagggagaagggaggagggtccatgtgacttacagtttctgtctcctgagatcctcctatcatgtggagaagagagcatttcacatatgaaatctctaaagaaaactcaacactgtataataaagtatcccaaagacagtggtgctgacaatggcttttaatggtagtgttttgtgaagtctaatatgaggttagggaagggttcagagcaacagagaacagaccttgttattcc

SEQ ID NO: 39181 - DNA, 860 bp, Bovine  19866881129846
acactcctgacctcaaaagtggagctggcccatggcaagtatcttcccaaaagggaaaaacagaagtaaaccctgacgaatgaatcaaaggagcttcaagtgagcagattcctggcaggaaaagtcaagaccctcttctagattcactaaataagttatgggacaccaagactgcaaaattccactgctttatctggcccagaacttgtggaatgagaggataaaggcagatcttatcacatctgtaaatggaaaggattttagagcccatcacaaggacaaggcaaacttcaaggctttgatattgaacatgtgtaaagtattcaacctccctgagctcaagctttcctgtctgcaaaatgggtctaatacacctacccatcaaggtgtatgtgaccatttcttgggattccataccagcatgcaaagcacagagtctgcacagagtgcgccttaaccaatgttcatcctcatcttccaaggtctgtctacaacttctcaaagcctatgattctgtggttctaatttactagaactacaactgagtctaagccatgtatgcttcctaagtctgttagatgctgtgtgttccatgactataaattcatttactttgtcatccaaaaataaaacacatacctgaaaacataaatatccaaacgttttccaccaaaagcaaactctttggaacagttttgaagatggccttcaaattcagttgatgagccagacagtagtaaaaacctcagtttaatgcccaagatctcatttaaactgtccatcagccctataagaaagatttcctattgtccactgaggaaactaagggtcaagaagtcaggcaaccgtccaagatttgg

SEQ ID NO: 39182 - DNA, 1798 bp, Bovine  19866881141689
tgatttgaagtgtttttctaagcaccttcctagtcttaagtttttcattctaagatgaattttataaggcgaatatgaaaattgaaattagattaagtctgcctgagggtaaggagaagaagctcaatgctaatatttggacaccttttcaagaccccaaatttgctgaaaaactataaaagctataaataaaacaaaatataagaaaatcaggcaataggcatgttctgtttatgtcagcagagtatttctgggtgattcttcttgtaataatgtggtttccatttttagattatcatattcagtaaagacttactttttatggaataactaatacccaagcatctaatatctagtgagataagttaagggctctcccttagcaaggcgagcatagggagatcccagacaccaagcaaatccacagaaactgcacaaaaccagataagctcagtagtgggctcttgcatcagctcctgttcatgtacttttatttgtagttctgtctcgggcaagagataccacacaaggggagtgcaaagttgaaggtctttagcaaaaatttggactgtaaacacagcttggcattatcagcattctgttaagttcaaagaagttacaacaaatacagcttgctttatttctgaaacaaaactgtgcacatatttgtggccataatactaattaacctgtagattgctcctttcatctattcagtgtgtttttcttctccctgttacaacatgttggggttatttttttcccatctggaatattctcaaactgttctcttagaagcactagggagaggaacagtatatgaaaagactagagagactgacttgcacaataagattagagaagctatagacgtaaatataacgaggctaaaggatgactaaggagtgccatgatggtagtctataaatatttgaaaggtgtaaatgctgaggaataatttagcttggtccaggtggtacaaatggatgtgatggtatgtcttaaagacaagggaagatctctgttaaagaaaaactttaaaataagttgttgtccatgggatacagtgaaactggaacagaaaagcagttgaaaaacattagcataaaagtcatctgagttaaattcgcccattccagtccattttagttcacggactcctaaaatgccgacgttcactttgccatctcctgtttcaccacttctaatttaccttgattcatggacctaacattccaggttcctatgatatattgctctatactgcatcggacttaacttctatcaccagtcacctccacaactgggcgttgtttttgctttgcgtctgtctcttcattctttctggagttatttctccactcttctctactcttctggaacatgtgaatttaactcagatgaccattatatctactactatgtgaaagaatcccttagaagaaatggagtagccctcacagtcaacaaaagactctgaaatgcagttcctgagtgccatctcaaaaacaacaaaatgatctctgatcatttccaaggcaaatgccacgaccagtaatgctgaagaagctgaagatgaatggttctatgaagaccttacaacacctgatagaagtaatatccccccaaaacgcccttttcattataggggactggaatgcaaactaggaagtcaagagatacctggaataacaggcaaatttagccttggactacagaaagaagcagggcaaaggctaatagagttttgccagggagaacgcactggtcatagcaaacaccttcttccaacaacaca

SEQ ID NO: 39183 - DNA, 1474 bp, Bovine  19866881169043
ccattgcctgctccctcaccattcataagtaattactctcttctgtgttcccatcacatattactcattcctctgtaatagcaatttgttgtgccctttacctccagtcagttatttatagaagtgtctcccttcaccccccacagtggaaacttctgagagtagggatggtctctttgtctgttctctcttcaactgtacctgccaggatgttttgtcctactcttgagactttctgtaatgctaaattaagggggcagacagctctgctcatcagaaaatcacgtgaaaagtttctttaaaagagatttataagaaagtacatgttacgtaggcatgggatacaaagagttatgctcaaaaagatgaaccaaagtgacaaaaataagaatgctgaggttctttaactgaattttcagtgacatgtttcatagctgtcattttgtgtgtggaggtaatgacatcaaaagaaaatacatcttaaggaattgatgcagtttgctaaattgactcaaaatttttcctgttttggaaaaattagaattctcatctatcaagtaagaatttttattctaattgaaaaatcacagtcatagggtaaccgttgttattttcagtcttttcgaaacatgtattagatataaacacagtagatatttaggttaagatacagatataggtgaaggatatttggaaaatgcaagagaactttcaatgagtaatgcatgctttcctgggaggcagagctgtttgatggttatatactgtgggcttatttgaaaaactaacgagataaaatgatgtcttcatctgtgaaggaaaccaaaaagtactgtcattatttgggaagccttgattaccagaatcaagaataagtctttattcccaaattaaggtagataatacagttatttgaatttaaataatgtcagtggcattccagtgaagcttgctgagtcatagccatgttctcttcttactgtaccacattgctcttctgttgggaatacctacacttaggttatgctttccagtcttttttacatcatgattcacatgaaaagtgatggccttcattgagcacactggagggagtagatgaggcttctcctggcccaaggtaactaccgttcagggactatggaacctctggccccttctgccccttccaagcatgggccacctgggccccattggaggcgctgtgtattagcctgccagttgagaagctttggactagagagttgttttgcatgattaaatagattgtgtttcatttttgtcaagtatcgagagtttgcttattcatgatgaaactaatatttatggagcatcagttttaggcaaggatactgttgtagatgctagggatcttacaatgagttttctggcttaccctgtgcaagccaatgaaattgacagtagatgaactgtcttaagatctcaacgtgtttcctgtcttgttttatacgca

SEQ ID NO: 39184 - DNA, 697 bp, Bovine  19866881171275
agcctgacacataaggtcttccatgttctggcccaacattcctttcagcctcatgtcccaccacttccctccgtgttttctgccactggcctccccagattagtcactttccccgagaacaccctgagctcctccctcaaggccttagcacatcgtgttccctgggctgatttcccacctcctcatacgtggaaatcctcttgtgtgctcaggctcagtttaaagtcatcttcagcagggctcttcctgaccttccaaaggacacccgcatgtactggtattttgcacactcttctcccatcttgttgtgggggagtgtgtcctctgtaatccctttgagagctcaaggcaggtccagctcagcgcccacctctgtagggcccatacacagtgcctccagggcaggaggtgctagtgaaagtctgctttgtgcacctctgagcgcagggcatctgacatcgtggcagttcacggttgcgccgggagctgggtggggggggtggtgtgttcagaagctcatactaggattacctgcgatttgtttcatcatgaccccagacatttgaattctgtttttgagtcactctggtatcagctcactcttaacctttctctggcctgcttcccacatagctggcagatgtcttcttagcactctgaacttagggctctggactttttatttcatgtaagaaca

SEQ ID NO: 39185 - DNA, 2349 bp, Bovine  19866881174399
ctttgtaaaaaaggactttgaaaattttggtccagtggttatgagagggttaaagagagcccatcgttttgtaaccaggcccagccattttgtataagccatgtcaggatgttgtctgcatgctgtctttgctgatcacagtaatcgggtcataagagaaagagaagtaatagagtgtctcttagcaaccaaccccaggagaaagagaaaattactcaaacccagccatctagccagggaagtagaaaaatagtctgaaagtctgttgaaagtgcccaggaacatgattcctacgtggcagctcctataggctggcttgggtctctctctctcttttttaagaaaacggaaagtaagaaataaataaagaaacaaatatctgaaacagaaacttttctttctttgtcttccttcctctctcttgtggtaatttgttttttgaaacttatctcagaaagagggagaaagaggcaaagagtggcagggacccaagaatctttgtctcctaaaacaggaacttggtggtcccaagtgtgagcggatgctgggagagaaaggtggtatcatttcattgtccttggtttttccaattgagattggaaatggtagaatactcccccaaggagtaggaatgcaaaggctagaggtggtattattagttttctaagatctgcttttgcctgccctgcttgttaactgtgcagcagtcagctctgttgttgttcagtcgctatgtggggtctgactctttgccaccccatgggctgcagcacgtcaggcttctctatcctttaccagctcccagagtttgctcaaactcatgttcattgagttggtgataccatccaaccatctcatcctcagttgtccctttctcctcctgccctcaacctttcccagaatcagggtcttttcaaatgagtgggctctttacatcatgtggccaaagtattggagtttcagtttcagcattggtccttcgaatgaatatttaggatcgatttcctttaggattgactggtttgatctccttgctgtccaagggactctcaagagtcttctctagcaccacagtttgaaagaaagcattagttctttggcactcagccttctttactgtctgattctcacatccatacatgactgctggaaaaaccataactttgactatgtatgtcagctctgtagctgttaatatttatcactacagactttggttcaaggttgtggtttccaaacttttttttctgacacaaatggcagttataaataaaatttgctttgctaattatacacatatagatatatataaagatgtgaaagaaaatttcactccacacaacatgctgtcactttacatgatacacgttgatgttttctatttcagtttttcaaaatacttttggggatctagcaaattgattctatgatccattaatgagttggtttgtacagtttggaaagcactagtctagggtcagcatttgccttctgttttaattgaatttaaaatgatgccaaatagcaagttcagccatgggaagagtccttggccagcactgtgatgttccgagtgatggttgtttaagctaaatattttttttttgtcatctgttatgtagatgcatcctaagatcatggcttgaaatttagggaaatgaacctgaggtgattcctcttggcctgtcagcagtttagaaagggtgccatagtgtggccaggaagcactggactggactcaggagacttggttccattgggcacattcttttctcatttggggctccttgtttagtgatggggttgcattcagttcagttcagttcaagcgctcagtcgtgtccaactcttcgtgaccccatgaattgcagcatgccaggcctccctgtccatcaccaactcccggagttcactcagactcacgtccatcgagttggtgatgccatccagccatctcatcctctgttgtccccttctcctcctgccctcaattcctcccatcagagtctttttcaatgagtcaactcttctcatgaggtggccaaagcactggagtttcagctttagcatcattccttccaaagaacacccagaactgatctcctttaggatggactgattggatctccttgcagtccaagggactctcaagaggcttctccaacaccacagttcaaaagcatcaattcttcggcattcagctttcttcacagtccaactctcacatccatacatgaccactggaaaaaccatagccttgactagatggacctttgttggcaaaataatatctctgcttttgaatatgctatctaggttggtcttaactttccttccaagggagtaagt

SEQ ID NO: 39186 - DNA, 1402 bp, Bovine  19866881208860
gctcttgtttgcaggaaataagaagataatcttgcctcaagggctatatagtcaggtatttaacacaattatttatcagctgcgtaagcttcaggcattgtatgtacacttttagaccatctataagatatactctgtgaagtaaaattattggaattttaactttacatgtgagcaatttgtgatccagagtagcaaaacataatccaattctcttctgacgtcttgaaccccaatacgatagcatagcaagtttgggctcaggacctcagagaggccaaattcccagagacaaattctaaaattcacaagtggccccatgcgcacatacgtgaaaagtatacctactggctcagcagcagtaagtacccaactggtatctttcatttcaacaaatgtccagttcacagttttatgtaaactggaaatatgtatgttcaaataacaaaatataccaaattaaactttcatatctgtagttaatgtattcactgaaagatgacatgtgacgttcctggtaattcttccacagtatgaaagtaagcttagcagttatcttccaacatggtatttttgtggagaggacagaccagttactcaccatgacaaatagtgatatgtaggattagtattaaccacctccaatcttctgttcaaagagactacctttatcatcattacgcttattttagctacaaggcatacaaaggaaatgggtgttgaaacgcacaaaaatgtgacaatatcttatctgagattcggctcttgctcttaaaacacaacgttcccatgcatttgctgtggtaaaatctaatcatcttgagtaaaaaacatagacaaatttgtattctgttgtttatttgcttttaaataaaaaaaaagataaaggaataaagggaaccatgggatctgagactaaggctaccaccaaaatagatatttaaacagtgggagagaaggaaagaaataaggaaagcagtcctgacaagaaagctctttaattttgcaaatgtgatgtgtgcttccgcatggacatagagctaattatttccactaagattgtgttataaaatggagaagctcaacaggcagctttgtgagcttctttttaaaccaatgtctaaatggagtgactcaatgtaatgtaacacaatcatctctgagccaaggtcttgcaaacaaatcacagctaaaacctaccccagggactgtggccaggacaccagagaaggcttcctcttccctccctaggctccagtagagctggcttctcctggatacttcagagcacagctgccttgcttcccttcctcctagttcactgctgagaccttacccacatcacacactcagagcacactcttacactggggcaagtcaaatgggcattttgggaaagaag

SEQ ID NO: 39187 - DNA, 2106 bp, Bovine  19866881220162
ggtttttatttagcctttttccccgtatagaccccaaccctttgctgattttgattactgcccaccacggacatccctgaaggctctaaggtagtcctatcctggtaagggtagtaaagctcatacatgtaagtagactgcctggaacaacaaagatacctaactgaacagaaactgtcctccagttcccatcctgatctgttgtcatagatttgaactctgtgtaagggccaggaggagcctcagaaattcaataaagtcatttttatagcagagaaaacctaaagtccaaaaaagctgactgatttgcctgaggttatatggtttattaatgtcagaggcaggaatagaaaccatgaaccttgctgatgccttcaaagaactacctgctttctttgggactgacatgaagaggtttaaccatatgcggctacaggccccagagaaacatccctagaaaatgttgggttgcataaattctggttggagaggttagaaataggacagcatttgcttcagccccaaccaaggtggagagtttcagatttccaggttaaatgcctctgaaactttatgctagaaccttcccactgccctagtttgtttatttttaaatcaagcatgaactcaccactcggtgtttgccagagtttggatgaatgtcagcatcaggccactgtaataatggcttaagattatttaatcctattacttatacacttcattaggctgagtgaattgttggcagtggttcagtaaacttcctactttagtagataaaagggtggaaagaaaatagggaaggcgtctgttcctcattttctttcatatttatcttgtatctcttaaaggataaaggaatggtaattacccatctacagcatggagtctgcatcagtagggtcttctgaactgctctgtaccctcagaagagaaaaaatgaaatacattttcaattaaaagaaaaagggtttgggcaaaggagagagagaaagagcgagtgtgtatgtgtgagtgtgtgtttacgctttcaaattgatcttaaaaataagcctaaaaataagttcaagagccctaaataagatatgtagtctttcatttaagggacctgatatgtagcagcaaaaaatgttagagaaagaatatggaatttaaagtcagacctcattcacactcagctaggccagctaccatgctgtatccacctcatttcatttggcttaaattgcatcacaagtagaatgaaagtggtatttcttacctctaaaccctaagtgagggttcagagaagttgacagggcttagtagtagaaacatatgcgggctttgagtggtaaataactgcacagaccaagcttcaaggacatacctaccaaacctgcaaaggagaagtttgcctaacttgaatcactaaaggtcagttattcaccagcattaccgtttctggaatgttacccgcagattgttggtttgagaattctgagtctgaggggcaatggccagccatgaaactctggaaacttggtttccccaaaaggtgtcagagatcactgctttgatgtcataatgttgttgctgtttagtagccagtcatgtccagctcttttgcaaccccaggtttatagcctacccggctcttctgtccataggattctccaggcaagaatactgtagtgggttgccatttcctcctccaggggatcaccctgaagtcctcattaaaagtaaaattctggaccactccccagaattcctgcacaaacagccagaaaattagcatattttacaaggctcttggggcagattcttagatatgctcaggtttgagatccctgtgcctctaccaccagccccttctctgtaagaagtagtcctcaaataattcactattaccccccgtctctctcctacacattcccttacaacacatgaccaaactggacatttcccctagccattgctatcttagccctctctctgtgtgcccagactggattgctgtcttgtacctttccccatctccatcacttgaaaatctgtgtcatccagccttaaaaagcttttttggaacttccccaatttgatgtggcctttcctagatatgca

SEQ ID NO: 39188 - DNA, 1242 bp, Bovine  19866881249111
aactcctaaagttttgttgccacttgagagccgtcttttctgggtttttccaataagtgttaatgcgaagcagcccattctgcacgagaaaagagagaaaacagactttgaggtcagttcctcatccacctcaacgccatcagccacaccacatttccaccctttgtggacgaagctcaggaatgcagatcctgtccccagctccccgctcctgctctccagtctggccgacctaaaactgtctccaggatacaggactgttccaaggaacactgagagcaagctctgtaagaaaagaggaccttgccaacaccagcgctctcaggataacaaagcggcctgcaggcagggcaccagggccaatgtgctgatcacagggctgggagctcgtgatccctgacaaccgccaacaccattttagacctcagtgtccttacacaatagggggaaaaatgctcttttctgccactgttctgacgtggcactctttgaattcaaggtacttgtgataatgatgcctcacattatcacatgctttactgtttagtaagtgcttttccagacagtctcatttcatcattactgacaactatccctggagggttatacccattgtagtgatacgaaaagtgaggctaagtaagatgtaagtatactccaaagatcacaccaacagcaagtagtgaaaaggatgttgatttgaatcggacctatttataattactgttctaaattcttctacatacaaaatgtatgacttctggccaactgcttaacttttctaaacctcagtttacaggctgaaaattagagatgaaaatagcccctctgtctaccactcagggcagtaataagaatcaaatgagataatgtgagcaaaaccctctggaaaatgcgtacacgttaccaaagtgtagaggattattgtgattacttgtcaatgactgtgcattccactataaacacaaaaaagcactgaggtcattctcaagacaaagacacagcaaggctctgggaattgaagggaaatgattcgatgtcctttcagggttctgtctatacactactcactcatgcaggttgaaactcagcagcaactgtcagattttcaaccgccacatcacaaacatctacaggacaactcaagaccaactcgccccttttggctacaagcaaatgatagagatgggcactaggaagaccccaagccccattcagagcctcagtccgaaaacggacctg

SEQ ID NO: 39189 - DNA, 1144 bp, Bovine  19866881256538
aaaaagagtgcctacacctcactgtgtacagtcatgaaatatgtataatacatgtaaaacctgtatacatgtagtatataataagtgctcagtgtatggtagttttattgtaaacagaactcattaatggggatatttagaatcatgtcaaactagagaacctctgctccaagcagaagtcttgatgagtagcagagagagatttaaggcttcatctagctctactctttgtgttgctcttcagagaagagtaagataaggaagatgtggtctttcttcacaatgaccttacagtaaagtggaaggtaccaacatatattatgtatattatatagtatatacaatatatatacatatgtgtgtgcttatatagataagaaaaaaaggcccaaaagttatgaataaaatacaacagtaacaaacatttatatgaaattactgctgacttttaaattggagactatgtcccaaggtaggttatagtacctttctatttgtacaaaaccattttacaaaaaagctccacttgcaagtaaggtagattatatatctggatcctggactccaggaggacaaagccttcatttttctttaatcattcacatcataacccaagtaagttaaattcaaggaagcagcaattgtacactgtccaggtatttcctattttgctgtctgcctgtttcctactgaactgacaaaggaaaccaggatcagatgcggtccaagcttgcaccagctctgattggcctctaattattcaatagagatcacaggtacatttctgaatggtttggacaacaacttctgatgagtcccaaactctcctgattagaatgctttaaccaaaggaaggaaaaaaaaaaatcagcagacaaagaaaaaaacattaaccatattttctactatctgcaattcttagcctagtagtaatatactctttgttctgctgaaaaacattctatattgattatgctgacactgacagtaaagctgtgtggtggctggctttattttaattttttctcttcacatctcagatgagaaagtgggttatgattcatcctgcacaatctgagtcaaaattcatctttgtctcttttcaattagttcttctgcattccacattaaaaagcaagagtag

SEQ ID NO: 39190 - DNA, 862 bp, Bovine  19866881263580
tagagagtggttatgagttctggaaaaagctgtgataggactgctctggtgcatgtgtgtgttttgttttgcttttactttttagttttccgagtctttttaggaactgtgaggcaaccttcactctgggaagagtgcactggctgtctttctgtgtcttttctttcctcttcctgcctggcctggggccttgtccagcttgtgatgatgaagtgtggcaaggccagctcctgggagccgacctgaggtctctgagcagaccctgggcattcttcaaggttccccaccctttttcctcctccttttctcttctttctctgctccctccccctctctctccccacccccagcagcagcagcagccctcccctccctaaaataaataaaccagtcgctccaaaaggttccaagcacattagtcacatatcccagaagtttaatacagaattattttgacagcgagaacaagaagtgttttctagttgaacgcacagaacttgcttcttccaactgggctttctgccgcagagacagatgatatgtttttagatggatctgccgcgcaggagactgcgtctcttcccttggaaacatgacaaactgctcactcccgaaagtggttggggaaaagatgtgaaatgagagggagagggagaaagcacagacttattgagaacataactttctccctaataacttcaatcagccaccgagagctttctatgtgtttatttatttatttggccgcccctggagccgggaagtccttttttaaacctcgggctatgggtgttctaaaagatgaggacaggtcgagttattgcaatgcgggtggctctccaagcattccagttgaatagct

SEQ ID NO: 39191 - DNA, 1231 bp, Bovine  19866881265389
ctattctgcctgaaaccgcaagacacaggaaaacatacagaatggataataaaagatgctggaaggtcaaagcacacagcaggctcagggtgtcacagctcagggtcctgccctcctctgtccctggtgctattcctagccatccagtctctggacactgtaaatctaaggaaggaggataaaaacatcattccatgatttgttttttcttttacagctcctagggtcaatcattgtttcagggcatgatttctttatatggtatatttgccaaaaggcttaggtgtcaggtttatttttataatattcataatgaatctatttatagatgatttacataggcctgtcatgaccccaaatcagctgagatttcaggcattgctacctgaaatcatacaagagcaagtgttctattatgaagtttgagcattgctgaggcattctagaagaatctttcttttttttttttacatcttgtttagtttttggcaaccagttaaaactccttgggacaacatatgcaggaaactggtatttacgatgaaagcacaggaggaaaagcatagcatcgtgaaggaggatctgaggtccctgaatctacattgtttacatgataaaagaagcataagacttccgcagctactgtcattaaggagaggatctgtacgcataggacctggaagaaagttcaagagcattagaggactgacccccgaagttactgaaataaacaaatagttcccaaattttgcttgagacccaatcagaattacctgacaagttttattttgttttaatgtagactcttgggacccatgccctgagattctgattctgtaggactgatgtgagcctcaaagacagtgttcttcgttgtttttttttgttttttttttttaatgttccccaagtcagtctgacgactggcctgctttaaaaaaccattataacaatgatctccaaatggtgcataagagatggcactccgaaaaggagaaaaaaacactgagaaatctatatgtatttatttatatatggttgttacactttttactttaaaatatagatgcacagaaagttgtaaatataatataaacagtcccaagaaccactcactcaccttctcccaatggtaacatctaaaaagatataatattaaagctaggaacattgactttgtttcattactgttaacgagtccttattcagttttcaccatattttaacctgt

SEQ ID NO: 39192 - DNA, 1318 bp, Bovine  19866881365674
ctctattaactctccgtgagtaaataaaaagcatagatttatttgacaatgagtccaaatggtacagggttttagaaaagggtaaagtctcaggaaaggtttgattaaccctgattttaatatatatgaaaggaggtataagctctgcctgatttaggaggtagaactgggaaagtaaatcagaaaagcttcccagtagatgaggagacacttgacatttgattgacatcttagatatagaatagaagcaatgactgtgaggtaccaaatatctatggagcattttatattttatcaatcatagtttctgatttcatatcatatctgacttgatctcattagaagacaaggtcacaagtgggcagaaactttacctatttgaaaaataaaaccccgcaaaactaaaacatcatatgggtaggatacagattaacttatttttcctatgagatttacttttgaattctctctgaacacaacagacgtaagtgatcagtggttgatacaaagaccttaataatgcaatatgcttccctgtggtctgttggagcctgcttgcagtccaccattgacttgaggcagagaacgtggctagtctaccctgcacagttgccaagggaacagccagcgatttatgacatcatgatctgatcagggtgaaatagaagggccccataacaatgccaggagatgacaagctgcttggaaaatcacaatgcttatccaaagtcatctttcaaaacacatatgtggcaacagaaaatccaaaccaacacatacaaccatgaaaacaattacttttttcaataaatccatggtgaatcctgacctaaatatacaagtcaaatactgcttttttttttaaacagttaaaatttgctgttatttttgtctcattcagagatataatcttaaatcctgacttagattattttaactgacaacagccccaaaggaaatgagtccatgttgaaatattttaatagcaaacctatacctggctctatagtccttgaatatcttggtttttcctcataaaatacaagaatagaggcaaagcctatatcatatcagagtctttagagaaatgctagaaaagctatccaggtggtctaggagttgccttgagttcgagggatagggttaagtttggaagaaaacccaaaaggcatgaggaagcttgttataaatacggtagcaataagagggaagtgttgctgctgctgctgctgctgctaagtcgcttcagtcgtgtccgattctgtgcgaccccatagacagcagcccaccaggctcccccgtcccgggattctccaag

SEQ ID NO: 39193 - DNA, 890 bp, Bovine  19866881394224
cgttccctgtcacctcccgcccctcctgacaggctgctatcttctcagcaaaggctgagcggggctctgctcacaccctcacagggaggcgtctgtgatgctcctgtgttggggaagctctcacccagttcctatttatgcaaaagacaccctgggaataaataaaggtcctcactctcacaccttctactcctaccaaatatgcacatgaaaaaaaattgaaaataaaactcacagaggtggggattctctactattgagagaaagtccttaacacattactcaggtaatcatttccatgaatgattccatgcacatttttttatttttctattgatttacaatgttgtgtcagtctacagcaaagtgactcatactttagacatacatacagactttcttttttcatacttttttccgttatggtttatcacaggatactgagtatagtttcctgtgctatacaggagaaccttgtttaaccatcctatatataatagtttccaggggatcttcccaacccagggatcaaacctgcatctcctgcgtctcctacactgcaggcagattctttaccactgagccattggggaagcccatatataatagtttacatctgctaatcacaaactcccacagtctttccctctcctctttccccttgacaaacacaagtctgttctctatctgtgggcatctttaagagctagaaataaggcctaagaaagcaactagtccaacgccccttatttacaagtgggcaaactggaattcagagcagagaagggcattttggtcagcccagtgggcttcctgctgaattagagcactgttttccgttcctccggggcctcctgaggggctagggtgtgcgtgtatgacacagccta

SEQ ID NO: 39194 - DNA, 1081 bp, Bovine  19866881406813
acagtgctatttggctggctagaactcagctctatgtttaagaaatgagtgggttgcagtagagtagtgtcttcccaagtagagtttgtcagaattttggaaatctgaaaagtttccactggttttctgcctgtttcccctatcattgaattcactgaggctagaaaccataacttgttacccagtagctggcaaaattcccggtatttacaaggtggtcagttaatggttgatgactgtatgaatgacaccatttaaaaaaaattctaaagtcatatatttagaggcaactaatgtatttctttgctattggatggcttgggaagataaagtgttttttctgaaaggaaaagatatttgaatctactattctttttctctgtaagaaaagctattgtatcttaaatattagtactaatattcattttgtaaactaaaatgaaagaggagaaaggaccaaatgcttattttttaaaaataacaaccacaaaatgttttttcttaatcagatattggaattaaatcatgctatacatacaagtttacgttacgttcttttattttcttgtaacattataacataggagtgagtgagtgaagtcgctcagtcgtgtctgactctttgtgaccccatggattgtagcttaccaggctcctccgtccgtgggattttccaggcaagagtactgagtgggttgtcatccttctccagataagagggttagcatactataatatatataggtcttgagctttatcaaagcaaatgttgaaaacagcaccagcatgaaaagtgtcttagtttattcgccattccagaggacctcaggtatcacagtatatggaatcaaggctttcctgagatgccctgtgcaaccaggcagttttgaattcttctatgcaaatcctcttatcttataaggaaaaaattgagactcagagaacagcatgagcaaatttgtttcaacccaaaaagaaaagaaggatgacataactcttcattttactttcagaaggaagttccactgaagaaatgaggccccaaatgattgacctctgtcagccatttgtaggatttcac

SEQ ID NO: 39195 - DNA, 1104 bp, Bovine  19866881429354
tgtatatatcttatcaataaactaagattttcccttagatttatttgctaaaaaagtgtatggtcatggaaactgagacgaggcacatgatcagtagagagattttacattttaaaatgtcaagagattataattaatacctcagttgaggttaaacaaacaaaaatacacatttttttctttgtgggaaggatgataatcattttgcaactcacaagaatcaaatttaaaggtgtgtcatttctatggagctatttcttgtggatcactatataaagatatgaattttacaacctgctgagcacatcaaacaagtttaactgtataatcaaaatctgaagacaaaagacttctaaatggtccttactctatgaattcaggcctatttttcatttcttaccatttatcgtgcctgaaatatttaaagtaagttatgagggcctgaaatataaagcactccttataaaggaatattcttccctaataagtgaattcaatttttctaactctgtggaataaaatattcataatggattaatgtgaaaggataaagacacaattaaatgtaatttctccttattaaaattgatgtcagatattgggtttagataggtatgctttaatagaaaatatgaatgtagcagagcataaaacatattactgtattatttttttcttgcagtcctaaaatgcaggagtaccctctgaagtctgcaggcagttccattaactcattgttatatttatgagcaaataggcccagagcccattagataccatagtccctattgcaaaagtaaccttcagtaaacagagtaattggcttgatgatgcctgtgttaatatccatgttagctctcttgtcaacaacctcgaggaaatctccttctagagtctgttagtgcatatggaaatacattctggcctggaatggacatagatgacacccttgcagagttctgtagacatttagcctgagaagcaaaaggcaacattcttactacttttcagtatcaacaaactcaaaacaatgatggccactgaatgataatcattcactgggcttcatgaagtatgagatacatatgaagacctcagaagtaa

SEQ ID NO: 39196 - DNA, 1554 bp, Bovine  19866881510801
atcaaacatggaaattttcaggagcattctgaaagaaaccgtgggcatcttttgataaagatatggatccagacacagaatggtgtgatgagaaggctccctgggcaattctgaggtgggatggatgtggactgatagtggtgaggtcagggaggcagtgaggatggttttcccactaggagggagaaacaaggagaagcactggattttttactatcagtccagatgaagcatcagcctgggcttctggaggactgtgtccaagtggctggagaaattggctggagcctaggagcccaagtttgagtactttgcctgacctcatagctgatttatttcgaatcatcactctcttcactgaagcatcatttctccaacttgtgcttcagaatttggatacaaaatgtatccaaagttgccggggacctttaaaaaggttccatttgctgtctcagttctagtcctcacagattacccattcccacaagacactgcagattcattttggatgctctaacgaaaagctgctctaatgcaactcctagaaatccaaaagattgctttcaaattcaccaaaagcttttgaatttgaataacacctctaataagggtatagaaatcaaagtgctctctctcctcaaagcatttaaaaacacactctacccaggcaaaaaccaagggatggtacttacagattctctggtttaaatgacaaaattttagagccacaatgtcttcctctgaccagctctgcgttcttaagtcccttaagctttctgagcctggatttccccatataaaaacaacagcaacaacacaggcacacacaagaaccaaaacctgtatgtcaaactcaagtttagattggaaatgttttataaactggaaagcacttggaattattactaatgctccttaattctaaacacttaatgcacatcaccctataccaaggcagtgctgactgctaacggtgcaaagaaatgagtaagttaactcctagatgaagatgaaacacatacttcagtctaagtaagaaaatgataaatgttataaatctcattttacttctgctgaaaatagatagaagggaaccagatctagtatgtaaccttactttatttcactagagttgggaaatggattataaaattttccttcaactttaagaaagtgttgtaactcagaatctttctgtttttgttgttttatatagttattattgaaatcaagttctacatattccaatacattaatttgtttatttaaggtaagggaagttttaagtcctgcactggaaggataatattgacatgctggatgaatctagaagacagtggtcagcacagtaagaggcctgatatcagtacagataacacatggatggagaatttagccagaagaagagaagattcagatggacttgaaaactttcttcaaatacctaaaaggctttcaaatgaaagatgtattagctgtcttttttgtggacagatgagtagatgttgtaaggaaagagacttccatccaaaacaagaagtaactttataacct

SEQ ID NO: 39197 - DNA, 825 bp, Bovine  19866881591975
aatacatccttcaaacgatcatgaataaatggctcctcttgttactcttataggagttctagaaataagactcaatgtgaagaatccaatagcgtaaaaaggaaggcagcagtgtaagcacttctaaaagtagcttgttgatttagaatcaaagtaacatattatatgtcaccatagatttggactgtgagtcatagactgttaaacttgggaggcagctgcgctggactagaaagaaagttaactgggagtcaggtgatgatggctccagcgctggcagcgccactgacctgctgcacgacctcagacaggtttagccccatgggctctcctcgttcatccaaataaagaacaattcacctcaaatctctctggttttgtagtttgatatgaaattcaactagtacttgttcaaaagataccctttcagaattcatgtacagaagatcatccactgttgtcaactctacttgcaagttaggaaagaagtcacatttgaaattgcattccttgtctgaaacaaaagtgttacataattaacatctaaagtgggagataagagtcttcttcctctccatgcaccactgtggatgctggataccaccaactacagcatagaaggaacaaatgttcaggatgctaaattcttccagaaacacacacacacacacatattcatatatgcacacatgtgaaattcacacatggaaaatagctttcaattttccttcaaatacgctcatttcccattactcgatatgaagtactcatgtaagcataaaacacatttcccagaacaatagatagacctttaaaaatacaacc

SEQ ID NO: 39198 - DNA, 1546 bp, Bovine  19866882091016
ttctcatataatagataatgcagatgatgcagattcaaataataagaatatagtgatcattttaaaaaagcatgttttctctaaagggaggaaaaaatactgagcaaacatctagtgactgtgctatgagcctaatgtgctgtaaatatagtgtccttgaagcattttatgtgaaatatttgataggacttagcagatttttgcttaccgtgttgtctgaggattgtaacacaccacctattctttttttttttttcgctttcggtcacccaaactcccttggacatatgtgaacggaggtctgtttgtttccactgaagcaaatatagtcacttgctcacactggtggcttccctcactgaattccactactattttggaaactcctgtatgaaaacacagcaacccaacctgtccccacggagccgtatgggtgatttccacgcagggctgcccagtgtctgtgtagtgaggttcagtttttgataaaacacaaaactgggctttgtttccttttggtaggcttgttactacctctgggaattctggtgtaatagcaggaagactggcattggagtcccaacacaggtcttagaaaatctgaattctaattctaatctctcaaggctttatcacattggatgaattgttcctaagcctagtgtccttgaggagagggtagaaatttatgacctataaattcctttcagctctaatactctgtgattctgttagtgatatacaaataagtcaactttattttttccttttcagaaattccttcgtgtctatatctgtactggataactctcttcagactgcctttcaaagttggccacattttaacttcaccccaacaggcaaatttcagcaatgagaaacccctgtaggacttgagagaagggatcgcattcttttacattttttgtctcttgatggcttcttagtagcaataatagactggaatggttggttctattgtagtagttggttgtaaacaagagctgttgaacgaagctcaccatatttcctcttacctacagctaagaaatttaaaatgcataaagtaattcagagtcatttcagttcagttcggttcagtcactcggtcgtgtccgactctttgtgaccccatgaatcgcagcacgccaggcctacctgtccatcaccaactcccggagtttacccagacttatgtccattgagttggtgatgccctccagccatctcatcctcatcattccccttctcctcctgcccccaatcccttcccagcatcagggtcttttccaatgagtcaactcttcgcatgaggtggccaaagtattggagtttcagcttcaacatcagtccctccaatgaacacccaggactggtctcctttaggatggactggttgtatctccttgcagtccaagggactctcaagagtcatttccaacaccacaggtcaaaagcatcaattctttcggtgctcagctttcttcacaatccaactctcacatgcatacatgaccactggaaaaaccatagccttgactagaca

SEQ ID NO: 39199 - DNA, 2276 bp, Bovine  19866880341484
ccctgggattctccaggcaagaacactggagtgggttgccatttccttctccaatgcatgaaagtgaaaagtcaaagtgaagtcgcttagtcatgtccgaccctcagcgaccccatggactgcagccttccaggctcctccgtccatgggattttccaggcaagagtactggagtggggtgccattgccttctcctattctttgctagcactaccctaagtgctttatatggattgtttcattaaccatttcagaattatgttttaaaatccacataaaagtggtgattggctgcctgtgtgacaacaggcagacttttaaatgtagagatgtccagtagagttaccaaagttcccctgcctgggagggaagcttaaacaatttcaataaattcttgattggctgccctatagacaaaggaatagagagaaacactgaagtagtagaaacccaaacatttgcttcataatttattatatgatattactttgtaatagcttgtccttgaaaaatattttgttcagttgaatattattctttgtaatgtcttttatctatgattgcaacggtagagagctaagaagattctaatgtagaaaatcaacccaactgtcatcatcattgggtattattttcaaagacaatactcttcagatcaaaagttaaaaaatgtgctgtttctacttactcatcatttccttgaacgaacgtgtttttttttttttcatattaaacaaattttatatatttaaattattaacacctgtctagggatgtgaaggcatactaatgattaatgttaagggtatgactttaagtttaattctaggaaataaaagagaacttgaaatttagatagaaatacaagcatcagtattgtgtttttccaagaatgttggcagtttttctcttctatagatatttggaatgtaaattcttcccagaaacttaaaaaaaaaaagaaagaaagaaaaacctatgattagttgggcatcgtcttcttactgaataacaagcaaggtactaagctggtggatattatctataaacaaaagaataagagggatattgagataatgcttccagtggcaataagttggccactaaagtcttagaaggcattttcaaccagaaattcttaagaaattatatattcattagatagtggttcataagactgttcttgagtgatttatttttattttcaaagatttttgccttgtttcatgtaaagactataaaattatttcattattcacttcaaaatcttccaagaatcctttcttctattctgagaattttaactgaatttattgcataagaaattggatcaccatctctaaaaaataatgatatattagaattttaatgtatcctttaacagctgaaagctgtgatacgtttatttatcctgccacttttttaaaagcaaaattgaaacgaggtagcatacagaaataaaaatcctatgtgggtaactttttttaacaataaaagcctattttggtttgaaatatttgtcactttcataagagtttcataacacgtaatcttattttaccacaggtaaatgataggaaaaagacacagagctctatttcatgcaaatacactttgaatttcattagttctttgttctgaaacaagatcttagtctattcttccattcttttcctgacccaatctataaagccattgtgttttgatcattcagccaatctgggacacggatacacatgcattcctcccacacactttaaaagtattaaagactaactacaccacttctctgcaaagtcaggcctattgccaagccaggggaatgtggagaatattttacttgcagggacacccttgaaagtctagtggtggactggagtgactggccattgcttcagctgagagtcactgtaagagttgggaacaaacgtgcagaaaggagaatggcaactgcatcaagcaaagagcccctaccctctccttgagaacagaggaagttggaaggcagaggcaaaatatcctgattgtgaatgctcatgtcacacctttagatgcctgaatgatggaaatgatgcaaataccagtatcaaagctccagtcagattctaacaggggacttcaaatggacctcagggagataaggtagctgaggtgtgtccattctcagactttaagacccaaaaacagtatagttgggccccttggataacacaagtttgacttgtgcaagtccacttatacacagattttttttcagtagcaaatactgctgtaca

SEQ ID NO: 39200 - DNA, 2074 bp, Bovine  19866880388696
agtcggacacgactgaagcgacttagcagcagcagcagcatatctaattaaacttgattttgtttcctttttcttatgttttaactctctggctcttaataccaaaattattctaccataggagcatcagtgaaagatattagccttcttatagctaaatagccttaaacattgcttagtatagaatatcagattttcgtttgtgacattcaggaatcccaacacgaaatgaatgaatttaagttctttttatattcccatgagaaatgatctctctctctctctctctctctctctctctcacacacacacacacacacacacagggttaaagttggagagaagatcaaataaaatcacagcactggaggaaaactctgtccctggttgcctgtcagtagacattatttttttctctcccataaatacccatcaccactacaaagctattgtactgggctattgcactcaaaacttactattgacaatagctgtgggcaaaatagaagccatggcagcttgctgaggaagcagctgaattgagtccagcaggcgcgccgggtacatcccttctgtaagagtcatctgactggcagcttgtagccttgagtcaaaatccaccacaaaggcaattagctcttcaccctcagagatggccttcgtagttgtgcaccaaagctgaccccctattaagaaaaaaaaggaagagaaagatagaattgacatagaatgctccagcctgctgtacattggattgatgttaacagcaccttctcattttcacatcagtttctactgggtggagtgttggatcaagacaacagctgccctcctcttccctttgttcacttaaaacaataaaacagccagttattttaccagcgacacaggtttataatagcaaagaactgcaattcgggacaggcaactatggcaaaccacatgaaagtctggtaaaacaagagaggaaatttttatagaaaaggggaagttggagagctatgataatccaaaagtccattggaaactggaagtttgaaatatagtggcttttcattggctgagttgttacagactttcattggctgagctgttgtcaggtgacgagaaatgctttcttcctccagctgagcggcattaaatagtgtcacttcctgatggagatacaaagtccatttcttcctgttgggctctgtattgaagttaagtggtacttgccagctcctgcatctgaccttcctactccattttatgaattttcatacctcctgtgtggaaaattatatttcttgcattaaatgtactgttcagtgatcaacagtgggagaagactaaggaccgagtatagacataatctgtacagagttttgtcaaaacgttgacaactttttgccttctggtgcttgacttaatcattaaccgtgctattacatggtatatactgccaaagaacaagcatggtagggatccaaccacaaaatgtattccaagtgagcctttgaagttactcttcctgtaccttactcctctttttctctctttcccagacactgatatatcagatactgatactggtatgtgtgtgtgtgtgtgtgtatatatatatatgtatatatatatatatatatatatgatacctaaaactacaaagcaagtaaacaaacttcctaaaatttagaaagtttaaatgaaattccagttagttttgttctccgcacaagtctgcttccatttttttttttttttcccggaggggcggatgctgagtgatctttatttttataatatttcttataatacagcttctttatctctctttaccctgactgaacttcctgaaaagaagatacaccaaagatccttttcaaaaaggcttatttaaataaagatttgtttaaatgaaaagaaccctttcttcaaacactaagatagactctggctcggcgcttcaaatgatcacgtgtggtgcattaaaaagaaaattaactatgcaagtacatcttctaatgtattggaatgcgatagcaaatgctcatttatttaacatgtttagacaggcaaagcacttatattt

SEQ ID NO: 39201 - DNA, 1138 bp, Bovine  19866880525651
ttaacatgtattgcttatttaatacttagaagtcctgtgtgtatgtgtgtgtgtgtttatgagtgtgcatgtgtagttatctcccatcttattcattggggtggccaaatcaaataatttaattaaatgttcaaaatattaagcgttgtggcccagataagagaaaaaggcaaagccgagacacagaagtccagtgaccaactggtctactgccctcaaaaattctaaaaggtttccagtctaagcatacataggaattctgaaaagtttaaatccctgagaaaggtgaatttggcaacttcaagattattaatagtgcctaaaacacacaaatcagaatcagtgcataaagtatataagagtaaaatgaagactattgtataaaatcatattttagtcaacatgattaaaatgcccaagggataactttgaaacaatataaatatttctcattttatctgtggagctgtgatgtttccaagtgttccaaaggtgccttttccactttttatcctcctggtactaagtggagcagaaataaattaatgattccccttggttttaatcacctacttaataagtgtttcttacgaaaaataccagctagtagtgtgaacaaaaattatttatcatcttttcttacccagagttcttatttctgcatagaaaagaagttcttttaggtaaagttggccaaataatgtaacatataaaatggaaacatttgaaagtgaaagggagtttgattgttaatctgagacaacaagcataaactggcacatcctaagaaaaatactgaattataaagaagcaatttgatgtaccttatttaacatgacctttgtttagggaacatataacctatacttacaagctccaagtctagcattggtcagagttggttacatcagggctattcagtgcacggccttggactcctgccatttggtgacctgtttgttactcagctacaacaagttaaggaacttgtattaaaatggtaaatgttcagtccgtaagtcgtatccgactctttgtgacaccatggaccctccaggcttcctctgtccatgaggttctccacgcaagaatacttgggagtggggttgccattttccttctccaaaaatgtaaatgt

SEQ ID NO: 39202 - DNA, 1097 bp, Bovine  19866880527559
tgctgctgctgctgctaagtgcttcagtcgtgtccgactctatgcgaccccatggacggcagcccaccaggctcccctgttcctgggattctccaggcaagaacactggagtgggttgcccatttccttctccaatgcatgaaagtgaagagtgaaagtgaagttgctcagtcgtgtccgactcttagcgaccccatggactgcagcctaccaggctcctccgtccatgggattttccaggcaagagtactggagtggggtgccattgccttctccgttttaaaagtctacttttatctaattatcaaacccaaaataatgtaaatttcttttagagaggaattagttgcattgccatcttttcaaccccacaccctattttctgttaatctactctgtgtttgctaatcttgttaatatttaatgcctatttaatgtatgttgtctaatattctattttattacagtatttcaagcaagcatttagactcatttgaatcaaacttctttgtaatttaaaaagtatctttttatctttggtaagtttcagttttccctgcaaattatttttaagctgagtttttctattcttaatggttaataattcatctctctgaaattgggaacgcatctttaaaagaaggtctgcagcaatgatgtcttatgatgtagtgtctgaggcagacactgagagtggctgatctgagcagatgtgagactgttttggtcaacatcacatataaatttcagagtcaactgaatattatgttcttttatagctttcccctgtaaggctgtgctactgtttccttctgctttttgccattgttttttcttttttatatgatttacttttgatgtggagagaaagatagatgtaggggtaaaaagatgattctgtctttactggttttctttgacaatacaaacatgaacttgatattgattttagttactttccttaatctcaagtatgggggctttctcccagtctggaaattcttagtattatacatactgtcaattcatcatatcctcagtacacttaaatttaggcgtatctgttgttagtgggttgcagttgtataaccagattc

SEQ ID NO: 39203 - DNA, 1155 bp, Bovine  19866880562242
cttttgagtctctgagcctaagaatacaaaacaaaggatggttccttctctcatacaacctgtagattaggacagagacaaatgaacagactgcaacctcatgcgattaatgatttcacgggagcagtccatggtgacagaagcacagaggcatgacatttaatgaaaactcggtgtcgtgaaagcttcccagaaaaaggaaccaataaaatatctgaaatttggaggcataatcttaaatgaatctgaattctgtaggtttcacgtccaggggctccatgtttaaaaaccattttttttttttttttcagattaaaaatgagaaccacttccccaaagaaaaagattattggagaaggaaatggcaaaacactccagtgttcttgcctggagaatcccagggacagcagggcctggtgggctgccatctatggggtcgcacagagtcggacacgactgaagtgacttagcaccagcagcagaagcagctaagttattgtgcaggaaaaatggcatcttgaaggtggtgaaactaaaaacatttcagtgatgcaaaaataggatccagagagagttttaagatgctaacaagagacaattaacgaaatattcctactgtttgatggttgattgaatgaagtcctttccctcattcagtatgggccaaatttacccatgatcattttcatcagtaactactaggaaaagaagatggcaggatgactacaaatctcagaagacatttgatacacatagaactttagtaaatcactcaaatgaaaatattatcattcaactattaagggcttgattgaactagtaatttcatataataaaatgccttcattaaatgtcacttatctgccaaatcaaaactgtagagcttagatttcaacttgggccaacatctgcagaaatactcagtattgataatcctgattcatggaacaatttgatctaatttgtttcattatgcagcacatataattagaaaacgactgaaaataaatactgcagagtattcagtaaagaagcactaaaagtagctggtagtacacaattaacagctctaaagaaattacattttacaattattttaaaccatttatgaaactgattaaatgtacaatatgcatcacattaataaaaataagt

SEQ ID NO: 39204 - DNA, 2256 bp, Bovine  19866880574341
tgggggaattttttttaattacaagaaaaatatcaacaaaaatatttgcatcaggttttggtcactgtatatataaacttcttttccttcttaataaaattgtaatctaacaattcccatctcatcacatagatcaatttccctctacttattccttcagtttaataacatcctttctgaccctgctttattaaaatgattctttacatgtacagttcattattgattaaaccttctaaaaaactcattttataaaataacggctctaaaaatgatgcctgatttcactggctaattacaaacagtttgatagcaaacagtggttctctaaatggtcatcctcagacccacagcattatcatcatcagacaacttgatagaaattcaaaattgtcagactccaccccagatctggcttcagaaactctgagggtgaggcccatcaacctgtgttttaacaaaccctgtaagggattccaaggcacgctcaagtttgagaacaactgtaggaatataaatgctagaagtcactgtgtaacagtacaaattatatttttgttatcatttaatagaaacagtataatattttgaaattaacataggctccatcctttgtgtactacagctgattctgtgatcaaactacttatcaccagggcaacttagtgcaatcagacctgattagtggcaggttaggtttgcttatttagtgctggttaatggttctcccaaataatgccagagaatctagaaagtgcttcagtcacattgtttgagacaattctgggatgacatggaacagactagagccactacttcaggctgatcccacatgttactgcttcatacacttccaggagccctgaataatgcaaacaattgagcagccagtgaatttggctaaaaagtttttcatgtgtgtctggctatggtatagaaaaatatctttatacaaatagggattgcatctcaatttttaaaaattacagcctgctatgtgagttatttgaaaaccaggaacttcaagcagcatggcgttctcctcatcctcctcttttgaggatagggcatctcgtgagacgaaaacgtccagccatcagcaggcctatcaatcagtggcaatcagtgtgaagcaagaggtcccagccagatcacacaggttcctccacttatcatctctcactccaatcccttattatgatcaggctggtgcacaaaccaagtgtggtctccaggattttatggagcagtaccgtggccaaccttcattgttaaccaacatatgcggcttgcaaactacatgtcccggcaccaccgccttgaacagaatagtcaacaacaggaacaaaataggccactacagaaatctgttccattttcacaaataggtgtggcctcctgctcctggaatgctgccaatttggccctccgtttgagtttgacacagtaaataatgatgaatattctctctatgcctgtacagtcctgcacacgttttctgcacagcgggaaaaacaattccttacacaaaacaaagcactgttgtggatcctgtacattaggtgggaatacaaactttataagaatttgcctaatttcacaagtgtatgtgtaattttccaaatttccattctgacagatctccttcatcttcgggggatggaaaaaacaaaacaaaacacagatctatagttgcaaaaccctaacaaagcgatgggggtgggtggcgctttgggggtaaaggtggaaacaaatcaacatgcccaccacgctctaattgtgccatgtgctgggatacatatcaaaagggcactttataacaagcgttctacactgtcattaaaccactatacaggtacctcgattcagtgcttgtgaacatctctagaggccccagaaggcacttccccataaaacatatcttcaaaaagacttttattttatactagcacattaaaagagtatctaaagacacagaggcactcaatatagctatatttttaagaagaacacttactctctggagaattaggagagcaggtagggtgccagtgataacaaagtagcttatccacactgctccagcagaggcaacgtggaggaagcatctaagggctctcttaaaaagaaaatatcctctgcctttggcaacaaaggctacaatagaataaaagcaagcacctttacagggcagaagttatagggtaagccaaaaggtggaaagctcacataaatgaactctctgctggtgactca

SEQ ID NO: 39205 - DNA, 2924 bp, Bovine  19866880587008
caaaacattaacatttaaaagttatattggggaggagcttcttgattagagaagaccaaggtgcaagcctcttctgtggtccccatctggtttaccctacaccagctgcctctgccaggccacccaaatttgaccctaacaagattaaagttgtatacctgaggtgttccagtgggaaaatcagtgtcacaggtaccctggctgccacagtcattctcttggatctgtctccaaaggaggtgggtgatgacatggccaagacaactggtgaaaagttgggagtacagtgaaactgaccattcagaacaggcaggcccaggttgaagtggtactctctgcccctctctgaacatcaaaccattcaaggaccacccagaaatgaaaaaaaagcagaaaaacttaaagttcaatggaaataaggtttttgatgagattgcaaatattgcccgactgatgcagtaccaaccttcggccagagaactctctggaatcattaaagagaccttggaggctgcctagtttgtgggctgcaacgctgagggctgccacgcatgtgacatgaccgatgatctggcggtggggtagtggaatacccagtaattaagactacagagaaaaatattttgataaagggtcattgataaccaaaaagaaatatggaatattcaaatagttacagggaagtcatatcaactcttcatgaaatatgaagatactttggtagcaattcttctcagatttatgctcagtgtggtcatgcatgcagaccacctgtctactaagtctgaggttgtgaactaaagtcgtgaagaaggccacagacaaacttcaataggttcatgagcaccctaaatgttatgcaatatcacatgtgtatatgcacacattttatctgaatgaattaaaaatgttgtaagaaaaaactttgaaatacttaatgaccaaagacaaactctaaataaattgatgaaataatagtagttaaattagtttattattcaatgtgagagtgactgatattctatctggcattaattaaaatagagatattgcttatagaacaaatgtctgtatggacttgcattgcatttgtagaagaaacagttcttgtgtacagaagcagaattcaaatgtttaggtagtgaagaagttacctaataaattacaatattcttatggaatgatgcttccatgtgtagccaatcattgggaaacccaataaataacccaagcaccaataaatcctcaagtgtttattaatttcttactctgcttctagggggtctgtgcagtggtgataatatgactcataggtttgtctgaacaattatcaatatgcttggcattttattccacagtgtggaagaaatgaaagaaattaataaacgtcaactgctagccctgtgtactaactattgaaaaaaattctttatttttatctgcttacttttcaaaggatgccaaactggttccttatgaatgtgatacccattggggctagtgttaatacagtaaattagactatcctgaagtgtactggaggctcaaggtcaaagccagtttgtactgaaatgaatattaacttgactaatgtttccaaatgtctaaactgcagaggtatactagaagtttacagatgtatcttttatttgaattcatgttccttctgtgttctctacacttagggtatccaattttagattataaatgtattggcatctgcaatgtgatttgatttctactttagttcattaaaattgtaaccatcatgggatactaaaatttcactagattagagaaacaatatcaatgcttttaaactggaagatgtgtaaaatcgatacttaaaatatctcttaattaaagaagcaagctaaagtgacatatcatctttaacttgttatcgctaacattacttttgtctacaagttgggataatcatctttctaggtgcttacaaagatgttacatttctgaaaacaagataaaataggtatttacttttcttgaaggtcctcatgagaaggattaacacagtttgctgtgtgttactggtctacctactggatagacacatcccaggagacacaatttggactcatatgcttcccaagtggtacagcggtaaagaatccgcctgccagtgcagaggattcaggagacagaggttcgatccctgggttgggaagatcccctggagaaggaaatggaaaccctttccaatattcttgcctggaaaattccacacaccagagcagtctttgagggttaccacagggttgcaaagagttggacacaatttagcaactaaacaacaaccaccaatacataaaacagcaaaaatgtttcttccttcctgccaacagcttaacactcacatttccatccataaagaagttggaaggacttaaaactgattcagattatatgtttatgatgacatgatcactggatttttggtggtatttccttacactttatttttaaaaatttaaaccactttattgaggtaagattggcttacaaaaatcaacatatttaatgaatacaacttgatgaatttgaagacaaggctacatcttacgtattattctgaaaatttaacaaggtctgcttttaaaacccacttctacaatattgtctgttaattaaaattcttcttaaaaataaccaatattttatatacagtggagtctcacggggcttcccagaaggcaatagaggtaaacaacctgcctgccaatgcaggcgatgaaagagatgtgtgttcaatccctgggtctggtagatgcctgggaggagggcacggcaacccactccagtattcttgcctggagaatcccttggacagaggagcctggtgggttacagtacacagggttgcaaagagttggacgtgactgaagcgacttagcacatataca

SEQ ID NO: 39206 - DNA, 1298 bp, Bovine  19866880597122
agaaatgccatggtgttttgttttgttttgtttttaatcaatgaaaaaactccacttgggagattatggccaagagggtgactttggaggttgtgactaaataactaagagtttgatcggataatatttaaagatgtttaggtttgcagaagcctaaggagtgaaagaaaaaaagactccataaaacttagaggtcttcagaactagatggaaaaggcatttccatatcctaacaaccagagaaatgctccatccaacagagatgtggggataggaacttgatggctcctgttagattgctctgtccttttctttctgttttattacatattatatttaaatctagttaaatttactttttcccagttttattcagataataattatacagtgatatataacacaatatgtagtgacatataacaccatacaagtttagagggtcaagcataaggatttgactttcatataggcagaaaccaacatagtcttgtggagaccactctatcttgagcatatgttttcactgatgcagtgaatcccctaggagtctgtcagccttttagccaaaatgtcttgtccttaaaagtacagcttcaaatgttttgataaagcaacacaaaattacatgggataatatactcctaacttgtgttaggagtatataatagtttctttggtaggagagtaccttttaaacctgggaaattttagaattaaatgtacaaatgtttgaaagaagagaatctgatgatctttattaaatggcttatgtatgtttatgattttatatggaagtaatatttcagttattttggcatattagaaaaataagttagccatgtattcaaattaattcatacttgtgatttatgtagagttcagaatcacttaagacaaccctatattcatcatatatgttcaaattattagatacataagttattttagtacttgggaatagtttgtttattatttcagacaacccaagtacttagaaggaaagtaaaaatttaatgaaattttaaatgaaaccaaatattttccaaaggcaattaggtggttggtaaaatttgctagaattttaaatagaattatatgaaatgtaactcaaacaaaagcctcttaaaagagaagataggttattgcatttgtaactttaatggaataagaacttttaaaacaaagaaaaaacacaaattgacttttatgcatacagaaatatcctagaagtcaccccaaaactctttatgtaatgcataagctgcacaggtaaccagttttactaaaaaaaaaaa

SEQ ID NO: 39207 - DNA, 875 bp, Bovine  19866880599136
gggaccctgtacatagcctttttctttctctcaactgagaaagtttcccttgcggttgtgctgtgctgtaccgttacacgtgctctattttctactctactctaggcaattctctttcatttataaaatgctagtcatgaccttctaaattgacttcatgacccgtttatggatcgcatcctatagtttgaaaaacagtgttttaactgactgaaaggtgacaagcgcagaagagaaaaagaggcaatgcacagtttcaatagatgaagtgaattccacttccctgctttgacaaaggtaccagtgaaagaggagaagagctgacgttcagaaaactgatgtaaggggacttggagggagggggatcaggatgtcctggtgagatgggggcggagtttaccattctgttcagactaaatgaaatggtccattaatccaggaagaaaaaagcgtttagttcattaagcaaaagacaagtgtaatagctgtgtagtacttcagtttgctctgccattagagccaaagttattgagagaaacactagaaagagaagatgggagaagagagggatttgaagaaaatgtttataaccttacttcaggcctctaacaataaacaatatttctattactaaccaaatgtgactattaagataccgttttaaagaaaagatttaggttagggagatgactgtcatattgggtggacaaatcactcatgtgtttttttcctccaaaactaatagaagctactataggtcaagactagctcgaagggaggcacagtcattcaagctgaaaatccggctgaaggtggcaacaagtgccttggaacaattcaattagctaatcacagatggctgccagacatgcagt

SEQ ID NO: 39208 - DNA, 1196 bp, Bovine  19866880726485
aaatggtgggttgaggttggtgcaaaaaaagccacaatttgtaagggaagcgctgccaatacaaataatagtgtcatgctttcaggtctgtttcatggagggctgaagtttgtgtttctgtctacaagtttgcttccttatgacccccttttcttttccctttatgctctcctaactccagaaattattgtatttggcttaaaatgtgaaaaatgctccttaatatggggacactttggctaatggacttaggtcaaaataatcgatcctgaagacaaggtaatccacccaaatccaatctttatgctcttcttaattttattacatgcttcacagacagtcaaaactgggttcagaaatggcaactattatgcagcgtttaaatccatttgcctcacataggtctgtctatcagaaataaaatatttcacaaacatgcttttatcatcctctcccatctctggcaaagataaaaacacagagagaagaagaagaggggttcaaaaagaattaatcaatgtaaatataagagctgtggctgatgccaacatattagtgctcattctaatgcaatatgaagaataaaacaattaaaaagataatggtaaataattttaatagcatagaaatacaccctaaagccaaatcacattgtaaaaatagtaaaattagctttaattatgggtgtgcaattctatattagtaaaataccacaaaagtccagcacactaatatataaatataatcatttcagagtcatggaaaatagacagaaaaccattttcttatagaacataaaagcgtaataaaaagttaaaatagtggtctactttatttacccagtaaatcgtcactgcaggcctattgtgtgtgataggtgttgtcctagacaccaaattcagcagtgaacctcttcccttaagagttcatatcccaagagaggaggaagatgataaataaagacacaaaatgtatccttggttaaatgtttaaaagcattatagagaaaaaagaagtcagaaaaaacccagagggaggtttgaaatttaaaataagatagtaggacttcctggtgatccagtggttgaaactctgtgctcccaatacaggggacacaggatcgatccctgggtggggaactaagatcccacatgctgctggtgtggcaaaataaaataagatggtgaagggaagac

SEQ ID NO: 39209 - DNA, 822 bp, Bovine  19866880786457
taaagagatagtcctttctagaatgccaaatattaacatgtctcagcttattaacttaattgcatttcagcatttaaaaatgtacccttattgaatgatacatacttacccctttatctatggtggaaacacattctctggtgactgaagtaagggacttatgttgctattcatttggtgagggaatgaactgataattttacacagcaccaggcgctgaattagacagggtttcaaaaatacctgcagtgttcttctgaaatgtcctactaatccttcagaattgggaaagaaacaagaactccaagggaatatgacttggagaatgagagctccaaagctaacatattcactcataatttttagcaaacaaagattgcattgaagaaagtattcttaaaaaaacttttttatgcccagaaacacctaattttcgatttttcgcacaatttagccaaacaccaaaaaaactgctctacacagtatcacttcatctaaaacttgaatatacattcttctgaaggaaattgagaaggcacctcttttggaatatagaacttaatcaaagaacgtagaataagattacttatttactaccttttaagaaagttacacattgaaaaggggttgtgattaaaataccaattataagtccatttttgatttactttgtttatggggaagaacaaaaatatccatattagaaatccatatacgtatatctagtcccaaatctgtcattttagcaaacacattagcttcaatcttgttctctcaaaactttttccaggataaaaactagtagcaaaaggacaacttagt

SEQ ID NO: 39210 - DNA, 1769 bp, Bovine  19866880840381
tgttcttccttggtaaaatatatctgtcaacacaggctaaaatattcttcacacattttatgtcatattttactattattggaatttgaaactttaaaacttctttatacaatggacataaaatagatttatggtatgacattttattgccttttgtatatgttagctatatatatatctcattgattatctctgattaatcattagttgagctgtttcaattttcttaaagcagtagtaagaagatttgaggtataacagacacaggaatctttcttacttataaggtttgtagtgaaacaatgggcttccctggtagctcagggaaagagtctgcatgtaatacaggagacctgagttcaatccctgggttgggaagatctcctagagaaggaaatggcaacccattccagtattcttgcctgggaaatcccataaacagagaagcctggcaggctatagtccatagggtcgcaatagttggacacgacttagtggctaaacctacctagcgaaacaacataacaatgattaattcaagaaacagcaaaagttaaatatatcttttatctatatatctttctgacttcactggaatgtctttagaaaagtaaaagtatgttcagacattacttaatacgtatttgttgtttgggtctattttcatccataagttaaagatcttcaagacaaatgtgatttttgagtttatatctatacagtgaatggagatataaattaaatggccatactttccagtatgtgctagctgtttgcgtgtttcacaagacccaaatcaaccggactgaaagctgcagttcttaaacactcttgtgttagtaattttcacaccaacgaagtgtttccactaatagtagcagtagtggtagttgccggtaatagaagacctactgggtatgcactgaatgagagctttgcttcctcttaaatgtattacattcttttaattctcactagagccagctttacagaggtaaacacaattactttcatttcacagctcaaacaccgaaggctcaaaagagctcagacagtggtcaggatctattcctcccaggtccctgtgattccaagcccacccactttcactgtgattgactgtctggcgttacttcacaatacaaatcagatcgacatttttacatacagccaacaatgtttgttttaaaacaaccactggtaatcatttattattataaatactttttcttttgatatgttttataaattccccatgagaaaatactagtattctgaaaatttatgagaaatatgattagatactacaaagttgtcctcttttaatttttctcttccttaggtatgcaagtaaatttaacaaagataagaattcaacaaggtgagttaaagtaagcataagaaaggtctattcctactcagaaaattattataagatggagctggaacaaggttgccacataccagttcatgtgcttaatccatgattctaaagtagacactaactttgcattgtcacaccacccctatttacacatgttatatcaacatctgcttaacagtgttttgactcaggccaggaactgaaaacatcataaaagtcacactaaaaagcattatatccctgctttggttaaccatatcagactgaagaaggctcttgaagttccagtgccatcacttctgtgatttctctttgaagagtttcttaaacttaggaaatgcaatttttctacacatcactaggaaattgcaaattacgtgagaga

SEQ ID NO: 39211 - DNA, 1287 bp, Bovine  19866880848198
gcatgtatggatgtgagagttggacaataaggaaagctgaaagctgagtaattgattcttttgagctgtggtattggagaagactcttgagagttccttggactacaaggagatccaaccagcccaacttaaagaaaatcagtcccaaatattcattggaaaggctgatgttgaagctgaaactccaatactttggccacctgatgcgaagaactgactccttggaaaagaccctgatgctgggaaagattgaaggcgggaggataaggggacaacagaggatgagacagttggatggcatcaccacctcaatggacatgagtaaactccgggagttggtgatggacagggaggccttgcatgctgcagtccatggggtcgcaaagagttggacatgactgagtgactgaactgaactgttctacctgtataatattttagcttttgtttgcttcagaattctctaaataagaatgattattttaattgaagtgcactcaaaaagtattttatttatgtaagtccttcaatgaattctataagacaaactactttttaaaaataccacaggtttacgtttagatagaatgtttttgtgaccattaaactttctgcaatattataaaaacaaacattatgtactaaattatcacttcctaaggtctatacttctgtctctttccttttattatatttagggaaaaatcagtatagttcaacttcaatagctgtcaaaatgcttaatatatcagaaatgttattgtttttggaaaaaatatataaaatacatatgatatggattcaggccagaaatggcacctcatttagttgtaaatataaaaatgccatgcactcactttatttagaaatattccttaagtgtttggtttatactgacattcaaccaatctgtgtttattctcaaatttgagcaggatacctccctatcttatgtttaaaataagtattctatcaataatttctaaagacatattcttctcatgatgatatttagcatgctattttgcaggctaaataatatgcaacttactggttcataaaggataatataaggggagaagtcattaagttatcacaatcttaacctttagtataacaaaagttttgaatattgcaccaataatgtacaggaggcagtttatgaaaattaaagtttggaattgaacatttctagacaaatcattaaatttattcttctctgcaataatggagagaattgctgttccaccaaaatgcaaaacaaaatgtattcaagattatttggtg

SEQ ID NO: 39212 - DNA, 1890 bp, Bovine  19866880965579
ttctcgctgtatgcttcttgacctgcatacagatttctcaggaggcatgtaaggtagtctggtattcccatctctctaagaattttccacagtttgttgtgatccacacagtcaaaggctttagcatagtcaatgaagcagaagtaggcatttttttctggaattctcttacaagatgtgtatttataatacgtgtatacttaattttagggcttccctgctagctcaactggtaaagaatctgccagcaacacaggagaccccaatttgattccttggttgggtagatgccctggaaaagggataggctacccactccagtattcttgagcttccctggtggttcagatggtaaagaacccacctgcaatattggagacctttgtttgatccctgggttgggaagatcccctggaggagggcatggcaatccactccaatattcttgccttgagaatccccatggacagaggagcctggaaagctacagtccatggggtcacaaagagtcagacatgactgaatgactaagcacagcgtatataattataaatgttaaataacttgttattgttttcataatacacatcatataacatctgaagaggttgaccaccccccaaactcgtttacattgtataaatatttgatctttagagtgtgttatatctatcatactagaaattgagaaaggataaaatgtttctttttattgtcccctacaattaaaagtgacttcagaggaagagtgagagacaagtaacttcataaataactacttgttattcagttacgactatttgtgctaacatgcaagtcaatatcatgaaacaagaatgccttgcaacaataaaacccggttcttctcaaagtgagacacagcactgagtttgaagcacattcatcacactgactcaagttcagttgagggaaagcaaacatctcagtgttttttaacctggcaaaaagacacaaaaacgttttcttcttttcatcattttaagaaggtaggaaagcaaaaatattgtctgagttacctctttaagcacaatttagtctccttgagaagacaaaatgctgagcttggaggtgaccgggtaacacagaattgaagcccattttgaagacactcccggttgtcagcctcaggagaaatgtgatgtagcctttgataagaataatggatttggctcattactggctgaagacacgtgttgtgagatggagtatcctcaaagcaacagggaaatttcagcttccttcaaaatggcaagggttgaggcactgatgaggctaacagtacacacaggtactaagaaacaatctaatgcagaaggcttcttctatgggattacctaatttcaaaattagttgtaaaaattcatgtcaggcttctaagagatgcaactgataacaacaaacacctttttttctttattaaaattttttttcaaattgaagtgtagtttacaatgttatatttctggtgtacaaccaagtgattcagtcatacatatacacattctttctcatattcttttccattatagtttgttacaaaatattgaatatagctccccatgctatacagtaggattttgttgtttgtctgttttacatatagtactttgagcttcccaggtggtgctaggaaagaacctgcctgccgatgcaggagacataagagacctgagttcaatccctgggtcaggaagatgtcctggaggagcccacggcaacccattccaatattcttgcttagagaatttccatgaacagggggagcctggtgggcaacagtccatagcgttgcaaagagtcgaacacgactgaaatgacttagcacgcatgcacagtttgtatctgctaattccaaactcctaattcatg

SEQ ID NO: 39213 - DNA, 2483 bp, Bovine  19866880967725
tgaaaagctaagattattatctctttaatgacgcaaactttccattataatgtgatttctcaatatttgtgagtagaaaaatgccacacataattgtgataaaaatttaaatcaataatttagattcttgttacaatttacataaaagaattatttttgcttctagtgttttgatattttcagaactagtgaaatgaacaaaaatgtttgagtcattttaaatgaaactcaatacattagttatttcacaatttccaaaaatagtttagacagatctttttaaagtctcattcatttttcgttcaaattccccatcctttggaagcaataatgaatatcattagctatgagtgtatgcctgtgtgtgtatgtgtgtgtatatgtgtgtgtatatgtgtgtgtatatgtgtgtgtgtgtgtggcatggcatccccactccagaactcttgcctggagaatctcatggacagaggagcctagtgggttacagtccttagggtcacacagagtcagacatgactgaagtgacttagcacacagcacgtgtgtgtgtgtgtgtgtgcgtgggtgtgtgtttgtgtgtgtgtgcatctagcatgtaattcagtggttttaactctgaagctggcgagatcatgtcctgttttccttctggcctaaaggtgcctttcatagtctttcattttcatattgactttacccagaacctagttgaaggttcaatcagtgaaataaaattacattacaattatttctacttagagaaatatgacagctagaatttttatgttaattaatctttggttttttattattgtgtgactacctatcataaatttccttgcaattcagctttagtacattctataaattattttagtttattccagcattaacctgacttgcaaatggttaaatctgcactgagtctttcatgctctaaaatccagcatgctctatattaacatcagaagaaactgttttgatattcagaaataattgtaatagcaagaataaaccacaattcactgaattcatggtcagattatattcttgttatcatgttagattctatgtaagtaaattagtacatcttaaacatgatgaaccataattcacaaacatactcatattttcctcagactcggactaaagaacaaacaggtcgctgctgttcttgtcgagcatcccacagccaaatgaggaaactcctgcttcctcacctgcatacccagttaagcaccatctgtttcctgttttaatgtgatatctcacatagtttttccaaacctttcacatcagtaagcacaatcctaatagacagttaatatgaattaagaagcatgttttcaccaaaactgtgttcattttttttctctctctctctcattttctgaaatgtgtaacactacactggctgagccaaacccacttcagtagcatgaaattccctagattaatataggttatttacagcatattgactagactctggtatccaggagcagggggctgggcagtacagaagcacatgtgcctaacaaggaagctgggattttaattttgcatggaaggaagtagctcctacttcatcttgcctccttttctaatagttaaagccttccagctccctaccacctccatcccttaccatatgaaattatcaaaatcatgaggatctgagcaacccagtcatttgcgaatcttctttctgccccatctttactggctttactgttttcatctctgacacatttactggctggggccagatctatcaggtaatgacgtatgctttagtttcccataagttctggatattgggaaacaaacagtgattaatttgtttcctcttgggaaagtggtttgagtcccatgaaatcaatgaataaaatgatgtgctacagacacttaccttcagctggattcccaaacagcttctcactttccattcttacaaggatgtgtgctgctgatgctgtttatcgagcttctttagtgaaggagtccaccagttaaattgttatggagccttttgtataagaattctttatgaatgccaaacatgttgctttcatggaggacatatagtataattaagtgtttctcaaactttagcatcaaaataatccaaaatgtttgtggaaacacagaacactgggtcctacctacctcctcccatccaaatttctgatttagtatttccatcatggagcccaataatctgtaacaggtttccagaagatgctgctggtgctggtcttaggaccacactttgagaaccactggtgtattatgtagagcttcaaggatggatttggatttgtctgtattttagacctggctctgccccttaacagctgtgtgaccttgaaaaagttattaacctcttgaaacctcagtttgctcagctgtaaaatgacggtaatactgacttcatgaagttgtagtgagattaaataaaggatgcatgggaagcttag

SEQ ID NO: 39214 - DNA, 1107 bp, Bovine  19866880987036
ttgatataaaataagatataaacaaaacaggcatatatctatctcttaatatcttatatagtcaggtagaagcagaataaactatgctatattacaacatgaaattgtttcataaactataattatgtaattatatatttatcaagttttactatatctaaaaaatgcctttagtagattgcacaatggagatctgttaatggtttgcttacagaaaaagcaatgaatttagtttatcacatgcaaaaacataacacatattatcatacaaaattcatataaatgatatcatcatgactcattcaacattgtgtaaaatcaatcatgttaattttgttgaaattttcataatgatatatctggcatcaaagatgaggtaaacagaaagtttgaattgattcttacaaataaaatactaagccttgaacaaaatttgaacaccctctggttccccaaaaatgagaaaatgctaactcccctgaaagcacaaattgccttcaaatgttccttcattttttttccaataattgtggcttaaggaaaaaaccaaactgatatcaaataaaaaatatgttttgggattttaatatggccagaagagtgataccacaatgtcataaggtatttcttcctttttccagtcttatgagataaaaatacaagtaggacactatgatagcctctatttctatattctaaaaaaaaattactttccattttgcattgttggatgagttatgcaagaaaaatttaatgattttaaaataaaatttttaaaaaggagtactagatccagaaaaacagagggtttgccaaggaacaataatgtcatgtggagggagggggaagtggaggagaagggaaaggaggtctgtgccaagcaaagctgggggctgttcaatcagctctatcagggctccatcagtgtctccactccagccaaatccagagaaaacaaggagtcaaagattcaggtcaataagcttataggcgatttgcacaaacagctcctccagcaaggtaaaaaacaaagtcatattggcttttctttttcattccttctctttgaactccctggtccaaacacaccctggaaatgtcaatgtt

SEQ ID NO: 39215 - DNA, 865 bp, Bovine  19866880993922
ctcttcccaaagatacattaaattaggggtgaaatattttgtgcacatcaatgtctttatggcaatcatgaattttccaacttatattttatcacattcccaccagttatattacctcactcccagtccagtactctccatgtgttattcagctgacttcatttgtttgtgacctggtcagaccttggctccaccatctgagagagtttaagtgggaaatctcagtaatgcacaagcttctaatccaacaccattacatttgttcagtcagaggtctcagaattacgatgcctcccctttctggtgctttgatatgtgagttaattctgtagcacacgttctgatttcatagactttggggcctaaatctatgtccccttgaccacagtaaagacatctgtaaaatgatttcttctgaacttaaactctgtctgaatctcttgtttctccccattttgtgccttcttgagcaaccaagccccagtatcataaaaatcctcatatgacagaatgtagaatcagcctatatgccgtctaccaacactgaacacctcatgtttttctattagtttgttgttctgtggtttccctctatcattacaagatgattacatatggaattgtctttaaaaaatatgaatgccaaggtatggaacaaataggcaatgaggagaaatgaaccatgcaaacaaatccattttgatttcctctttgccactaaactcaagacttggtctcttctgaaagatttatgagccttcctaccataaaggaggttggattacagctatgcttactttataaaatgaaattctgccatcataggcaagggttcatggctgtaattatttcaatgatcttccca

SEQ ID NO: 39216 - DNA, 1898 bp, Bovine  19866881031939
cgagtgatacttttatgacaacttatgaagaacaaataaatgatgtttttttccacaatgccttggtagtttaatcagtcttgtggcaacttttctatcacgtcttgaaacctggaggaaggcagattgaaaattttgcattgcacttttggaaagttggtttatacagtctgacacaagatacattttttaaaagcatacatttattgtcacaagactgcaaggacatgatatatatctagaactgcatctattagaaaaataaagcaaggtttaatctagcactttaagattcagtgttgcctcaaaaccaaccagaacaaattcagactcaatgaactcatcatgcttgaaataatatagagaattctattattttcaaaggtagtatactttctaggcagcttcatgtgactatatatttttgcaagtattaatgttggaaaaaagttttgatttggagctacactgaaactcagactgggccaactgggaaactggactgtcatagtgatggtgatattattatgtgccttaagctttactgggtttctatagttctgcacagaggcgctcaaagcacttcctgtgttttatatcatttgtcctcacaacattccaataatgtaggaagggggcaaccataattaaagattagatgtgtcagttttccattgtcgtggaaactcattaaactggaacctattcagcctgccagccaagacaattaagcagtcatttcacttatcagtgtaccaattacttgatttttctgtaacttcctctccattttctctgagacaaatactgcatcttccataattttaatgttcaactctggtgataatacttcttgggaacagtgttttgggacacttccgtttgtgaaatttccttaatgactcttctgtagcattcaactttcatatttacatataatgctgatgtgaaaaaaatttttttaatcatataggtaatgattataaaaagatttagccttctactttttttacaaaatattatcataccatatattagtaattaataatcaatgccactaactaggaaaaaatacttccttcagttgtgtggcagaaactgctgtttgctaaaaccatggttctcttcttatacacaaagctggatcagatttcccagtctccttcttagttgaatgcaggcaagcgactgtttttaccattggaatgtacacgtgggcagtgggtactaaccccaggctacttgctccttcatgttatttttttctctgactggctaaaatggagataaattcaagatgtctttggaggccacatggtgaagacattagcatctccatcagtctaggtccttgcatggctttatggaggaagatcacgttggcccatgcagaagagtgaacaagaagtctgttgggttttagccatttatacgtttggagtctatttgttaccacagttagcatgtaataactattatatcattgtttcactacaaaaatataaatatgtaggaggagcttaataacgtagatatatacaactaatgaaaacatttattgaaataaatctcattgaccacaaactatcagaagagaataaaaaactaagaagccaatggattatttattaggttgaaattgcctcaaaacttgtaagatgtaaactttataaataagacccatacctctatgtatagataaaatatctagttctagtttttccacagtttgtgtccagttgatatcaaaccttacccaaatatcttagttaacatttaggtttttgtagacccttattttggagaaggcaatgacacctcactccagtattcttgcctggaaaatcccatggacataggagcctgttgggctgcagtccatggggtcgctaggaggt

SEQ ID NO: 39217 - DNA, 1112 bp, Bovine  19866881034051
tagaggggcagcatggcaagagactactgagcatgcagattgtggtggaaccacagtgggacttgacccagaagagagatgtatgggccagagagatcaagaagaacaatgatcatagggtgaaggacaggaaataatgagaggaagcataagacagggagataaatattttgaaaatgaagcattacaggcaaatctgagcttcccataaacatggtagagagagaaaatgtaagaataaaatagatataatttcagtggtcatgcagtagaaaaaaacagagtttatcagaagaaataaatgttatcccctatttgtgagctctgagagtcatttatcatcattagggtatttgaactactgttggataaagggcattcagatagggaccaaagtttttgttagctgctgtcccacaatatgcattctccattggtcttggctttttggatgtgtggtgtgagtaaagtcttaattataataagtaaattatattgtggcgatggaacacagtggtaatgagtgattgcttatgactcatagtcctacatggattatgagaaaggagaagcctctctggagtgattgttaaacaggaaagaataaacaattagattgtatggaaaacggtattcaaagatcataactttctcagattggtttgctctttctgtgtagactaggtttactcgttagggagacagtttagagagtgtgagctttggttttactttttgttgttgacggtgatggtgctgttggtgatgatgatggcgataatgttgatgtcggtgataatgatagtttcctaaagggaatgctgggtttgaagcttgaagactgagtccagaaaactgaaagctaatggtttcttgatggccaaacaacagatccctgaataggtcaattacagttcagagtaacttactttgtctcctctttggaacaagaaatggcttaatttggtagaatcctcttctgaacggaacatagtagttgaagtggcttttctttttagttgcagtgagggtttttgttgttgttgttcctttgaacaggtttggtttgaggggaagcaggggaagagaaaataaacttatttaagcataaa

SEQ ID NO: 39218 - DNA, 3060 bp, Bovine  19866881195791
aatatttgtggaagggataaatgatgaacagtaaatatattgtagtcaactgtccaagcaacatgaaaatattcagtcaactggccaatcaatatgaaactatgtgtttaaatacacagtatgacttatgagttataaattttttttatctttcaaaataatattgcattttaaaaatcctgtacacattttcagactgttgaattaaatattagcaccccgaacactcttcctccagtatatcagtgcagttttcaactacacaaaatcatctgagtaaatggactcacatatcatgcccagccattaatgattacctttgttgcaaaagtattccacctcttcacaactcagattttcaggcccaaattctgtggaaaagctttcctccagtggaaagtccccctttgatataatgtctgtttcctctgatggacattcttcttcttcctcttcaatggcatcctctagcggcccttgaaaaagaagagggacactgtacaaaaaaaatccaaagaattgtgtgaaataaaatccttaaacagggtctttttgattaaggtggtgaaggaggataaggtattctacgaaaggacaagtagcacctagacaagataatgccacatctgcatcaacaagtatactgagcaatttaacaagtggaaagaaacctgttcctgaaattactaaatagaaagcaacctccatctcccatccttccccacctccaacttgaagaccaaagcttattcttttattctctcctgaagagcaaaactgtgcactttatgttcatttgttagaattaactgcctggtaaagagtacaagtctcttttacacttgttgtacaattttacctgagattttaataaagatttaaagtaattgaatgcattttaattgaactgagattttaataaagtcaatacttttaaaaatccatcttaagagtggattctgagaaaagatttcattatatgtgtttgaagcttgaagaaaaaattacatatttctctccctgatgaaagcataacccctattcataattaattgaattttttctgaaatgaaaagtagttttctaatgaaaaaaatgtaatttgtatttatgtgatactttttctgtaataaaaatacaacttcccttagagtgaatgagtcaggtgcattacattaatggacctattttattgaaaggaaagggtgggctgtagttgttgagatggatctgaagtggatgacatggaaataccacatggccgattgtgaatttctgactgcccagaagaatcaaagtatccgactcattttacgaagtggaagcctgcatttgctcctaaagaagcactgtggcatttcatccaaagaacacaattatggtaatttgtactaattgtcactcatgtcagcagtctcatcagacaggctaaatacttaaaaggcttaggcagtctctttctcttacttcttggaaatgtggatttaaatttaaggtacattcaagccaaaaaaaattattacagagtttctttgtcctttctaaaatttattttttcttcttttctccaaaataacaaatgttaaggaagaaaggatgcactaattccaaacactctggtaatgtgctttttcaattctaggtggaaagttaaaaaaaaaccacgtgtgctcagttgcattcaaaagccatggatctcatattagtttttatctcttgttcattatttcaagtaatatataatctttcaccttttaacaattatgtcaagtactaagacatgcaaggaatatataaaatagtaataaggtaaaatattacaatcactaaaacagttatttgaataattttaattattaactgcaagtctaacaaggaataaaatagaatattttccatgtttttattttttcaagatacttagttttaataacaagtttggtcaaaataagacacctaaaccgtctcacttttatatctcatataggactttcaaagtactttcttatgtgatctttaaaataacccagtgaggtaggtatggaaattattattctttcttttggtaaatctggaaagtaaaggtcaggaggttagctaaccagaataaggctacaagttaatatgtggaaaagttgacatgaaaactctattttattttaaaatgccttttataccacaccactatgcaaaccattcttttgtagttataaatgcattctttcataagtaaaactataaaacaggttactcataaacacagaatccttcagaaattgctcatgtctactaacataactttatttttaggtgtttaaagatctagtcttaaaattgagaaacctcttactgctcttctcagattatcaaaaatcaaccaaaatttaaaccctcccagcaaaaataaccaggaaagtcttttttacagacattaccaaaaataaaataattgattatgaatatataattatttgcataatttatatccttaccaagtcaatctataaaggaaactgccttaatatcagtttatatcatgtaacagacaagacaatctagacttcttttggaatacatactctagggtttggttaacaaaaaataaatctctaattgtaaaataaatattttaaataattcatataaattttactgaatgtcttttttacttgtgtatgctcttcaattacaaaagcctatatattataaagaaagtgcatgcacattactagaataaaattaatagtaaaatactttgttttttaaaaataaaatgtgagcagactttctaacattcgtaaaagagtctttattgaagataatatgtacttgaacaattacttaaaattgtccaggacttaacaatttggctccaatagtatacattaaaataaaatttaatcacattattaaaaattaaatggaaactcttatgtgaaattttgaaagaaacccacaaaacattgatatagcctcaataagtgtctaaccaagccattcatatatatacacatatggaaaaaggcttccgcatcatatataacttttatttatcaaaga

SEQ ID NO: 39219 - DNA, 1016 bp, Bovine  19866881242583
tgtacctttgttatttattgagatttttgaaaggggataaatgtgctatttttgctctgaattaaaaaaaaaaattaaatgtttcctaagaattcgtatagctaagagaattccagtgagctttagaaaccgagctgatagtcctagcgaaaataacgtcattcttacacataaaggggaaaaaaaaataaagacaactgaagtgccagtaaaatagaagcagtattttatagcataccgcagtaaaatgaaaacagagagcaattagtgaatgggggccggaaaagttgtcatcctgtaaccagctgtaatctttaagtatctttaaactaacagatactactagggttttctttcattcactccacggttactctggcaggttataaacaaacatacaggcataaagagtccaaaacaaagtggttgtcaaagggatgaatgataggcagtgacctcacatacccaggatggtagtatgctcagttaggcaggctcagttgcctagagttaggtgtattccctctaccgagccctggctgatagacacactcccatccatctttaatctctttgttttgttgtttaactcaggctgttaaattctgtttaaaataatatttgtatgtaagtatgaggatagataaactagaaggaaagtgagatagttaccaatgtcatttcaactttttcttcctaaaaaaggaaatcccagaaggatagatatatttggagtggctcagatggcgaagaatctgcctgcaatgcaggagagcccaggttcaaaccttgggttgggaagatcccctggagaagagaatggcaaccggctccagcattcttgcttggagaattccatggacagaatttagtgagctgtatggtgcatgggatcgcaaagagtcagatgtggctgagggacttgcacttttctcagtcttactttgcattcgtaaagagccttcagatttttcttataaagccatctatttgtatttaaattatcataaaataca

SEQ ID NO: 39220 - DNA, 1308 bp, Bovine  19866881273870
acacatccagatttttttttttttttttaaccaaattctctgggcaatcagtggcccagtcacattggcacaaaacactttcaatgatattcttcccaaagcaactttgaaatgacaaagaacattcttagaaatgttaagtgggaaatctacacttttcacacagataaataaggatgttatcaactactgatttggggcattcacttcaactaagggtaaatcttggagaaaaggtagcgttttcaaattcagagttcctcaagggcatgatacctgattgacatgcccatctataagcttcctgattacatctatttttttccccagatgtctgattttattttcgactttactttgccacatttgaataaccatctaacagattaccttgcacataaattttatgaatgttgctataatttgcatgaattatgtttatatttctgtggtggattttattttccaacctataacttttgccataaattcctaaatgcaaaagaagaaattcaacagcttcttgagaacatttgctgtgtgtatagacttaatcaaatcacttatctttgcttttatctacttgtcaaagtgtattaaaataatgcattaggagtggatttagggtgaactgaagatgtagtactatgaataaccatgctagggcatactgataatgaaatcatctaaaagaagctgaaaaggataattatatcacttttaaaatgtatcttataataaattaaactatatgactagtatactcctttaaaaactatttttattttgattaaacaaatagatgtacatagctttaagggtcaaatagattttcaaggcttataataaaaattagcagttgcttgtcctgtttaacagcccagtgacaattcttgctctcaaaggtataatcactgtcaaatcttcttagctaattctcttgatgctcatctcatatttctaaataacatgttttactactttaaaacaattattagtttagatattattgactatatcaccatctactataaagatatgaagatataatggctgtatatacccataatacacacattattccaaatttttggtaattcagaagtttatattttagtagcagtctatataggctatgatgattacattttattttgacctctttgtttttcctgaagttaataattattttctttgtcattttctcagttttccatgacctatcactactttatccccaaattattagccaatgtaatactgtccagtatgttattacatcagtacattcaaagacattaattagca

SEQ ID NO: 39221 - DNA, 850 bp, Bovine  19866881322400
tgttaggcaggctgtattatagattataatcatatagtaggctgtattatatattataatcatataatataacttggacaggcttgggttggtttcctctcacagacatttattaacttgtcaccttgagcgtattacctaatctccctgaacctcagtgttgtcttatataaaatggggatgattataagtgcagcgagcttccctggtggttcaggtaaagaatctgcctgcaatgcaagagactgcctgcagtgcaggagctgcagtttcaatccctgggttggggagttcccctggagaaggaaatggcaacccactccagtgttcttgcctgggaaatcccatggacagaggagccttgtggactacagtccatggggtcgagagagtcagacacaacttaccgactaaaccaccaccaactaccataattgcagaagctttatcctaaaatatttataaagaagagttttgggtaatattaatacatatacagagtgcttaccacaaattatagtaagaagtaaaactcatcatatattagttattactgttgttattgtatttagtgatgttactattattagtcattacacccttcattgtgcctgattatctgggtaagatcaaagccaactggaatgaatgatataattaatagactggtaagtgtctccataccagcagtcctttgtgattaatattttatgatgggttccattttcaaattaaatttaacagccttgatagctatgcagaggccaataccgaaatactgagtcatctcattggataattttctgttagaagtaatgggtgtcgagtttaaatgactgacttcactgga

SEQ ID NO: 39222 - DNA, 1140 bp, Bovine  19866881347877
ttccctttttgttcctcaggcattttttgaaatttatacttttgtcgtaaaggcgacatccccctacccccaaccagttgccaggtaatctttgtgaaagtggaggctcttttgaagttttaagattgaacaaggaaaatgcacttccagaaatactaagtgactgcacaagctgaatcactccttgaccctggaaaccctctttgtgaggtttctgaagtgtgaagtatgcccagagagaggaatgctatttttatttatttaattaatactcatcccacttttttatgtcccaggcaccattttatgaaattaagagctattcaatcctcataacaactttatgaaatatatactgctacgactattttaaaaatgatgaaaggcagaaagagtacctaactcaagcatggtcccacagctggtaagtggagattaatgtaccatgtagggaacagcaagggttccatgtcacaaggagagagaaagagggagagaaatcagatgcccacctatgaatttacaaacactttctctctcagcatcccaactaggactaaacataaactagacaatttggtcttaatcatgattttgaagtgagatatatgcattactacatttgttcctattattatttgaaatacctaaacacagacttcattttccatgagcaaactgggtgttttatccaaactcactatttctttggtactgattttctcaattttaatgtatctcactgttgattactattctcagtgtttttttaaaaagacccaacatgaaaatctcattataaaaataaaatacaaaaataaaagagaccagccagatagtttctagatttagtagttgggggagggaacctttttttaaaaaaaatattcaaacaaactacacttgtcaattagtatctcttattcacattttaacatttatctgggtataaatgtatcttgtatttctttcacagtagaaaattatatgaagccgtgtgaatgaatccaaattttttatgtccttattttttcttattttttacatacacatcgagttctatcagcattaaatataaggttctggatgacttaaatacaagtattaattttgaatggttgagagcaaaggacagcagga

SEQ ID NO: 39223 - DNA, 997 bp, Bovine  19866881405761
tgttggggccctagttattttattttactgttgatgtaagagcttcttagtgagatttcatgacttaagggtcacacagtgctttactgacaaagaccaaggactcagtctctagatagtaggtcctgtgctggaaagagtataggacttggagttgaatgtcatgagttcaagtcccagcctagctacttcttaagcattagatgataggtaagctctttatcatttctgagtctgcttttgcactagaacttggggctactcctctgggatgtggaagaaaaatgcacgtgaagcttcaataggaaaccatagcacactatgtaaatattaatgtgatttgtttttctctgctctcaaatattaataattttaattctgtttctattctagactgtaaagacagaaaaagaaaatacttcatgattggagcagtaactttcaagtgaaacatttttttaaatacaaaaatacattaccaaagccagagaacaatatcattccctttaatatgtcaatcaactagaatttattaagcatctactatgtgctcaatactgcagaggccatagaaaaagctatggcatatttctagcctaaaagagctaaacaatccgtcagaaaaatgcatataaggaaatgccaataatgtaagataaatatcagtaaagactggaagcaatgacagtgtggtggtgatcagagaaccagcgagacaacaagaacagggcaagggatagactctctgtagtgatggggaaaaccttgcaaagagttaagaatttgcttttgccctgaaggttggatatgatataaactggccaaaaagacagagatgttagcttctctgattcatctctctgcttttctctgactcagtggttccattttggttaacatgatcccagaagcaccaagcagattcttatcggtcgttttctaataactgctgacctatcagtagggaatatggaaagacgggcatggagtataattt

SEQ ID NO: 39224 - DNA, 1232 bp, Bovine  19866881445646
tgtttaccctgagctctttgctccagcaaaggactgctgctgagaagaaaggtttgcctcaccccagtggtctctttacattgttcagagtggattgccctgcattcctgatgtcttaactgtcttaatacctcttctgaacattattttaatggactctccttaggttgctacactctaaggcacacagtctattaaagaccagaagggaactgcagaagaaaacactttgttctgtctagaactcaaagcgacacctaaacttttttttttttccttttttttttttttttttaccggctacagaacgaatgctgcctgaatgagtaatgattagaaagcgtttggaactgtattaccataggtgacagctctgcagagataggcaggtaatgttaagaggcaaggataagaggctatgacattatgtctggagggttaaggactcacagtcaaagcttgaactgctattactggatcaatacttctcagttcaacacttatcttgactactggttagaggcttttgtagatatgaacactgagagagcaaaataaaactgaaaaaaaaaatgattgttgctgttcacttacatgtggattgctgaagttatttaggtttcagatccacaattcctttttcatggggcaaactccagtgacctgaaagcaggataaaaaccaacaagttatgaattatagtgcttgctcccctgtcctttcccttattctgtttcgaaagaaagtgaaaccacctctcctttttccattttgtgcccagtcctgcttggatttctttgtaccttaatatttcctctactttctaagactgtatttgcccagagtgattacaccattcaaggttaaaactcttgaaagtcgacaggaaggaagtatgaagtcatatctttgatatttgggtcatctgtgaaagaaagacagccctgaattgaaaggtgtaatgaacagtctctgaattgtgttacgtaaaagttaggatccacacttctgtctaaatgtaagacatacttatattccatatgtaacaactaattggaatgagctcagagtttcttagtctaactttgtaactaggttcacgtttctatgattgctgtaaataaaaagttgctgtagaggatgcgctgtaacctccagaaaacaaggatggttgggggcgaaggggggactgttcatgaaatctaaaagaattggtttgtgaatacagaatt

SEQ ID NO: 39225 - DNA, 1007 bp, Bovine  19866881505840
tttttctaaaaattttttctgttctcgtggaaataagcaatgaagagttttttaaaatcaaggtcattttagaggaagactatagaccaaatacaataatttttaaattcaaaggagaatacatactggatctgttaattaaatgttaggctaaggtttagaatgtcagtgcattcttcattatgcaatcttgatttattaagcattagtaaagcataactgaatcatttctgtatttgcatggtgtatatctaaactaagaaccctaagaagcataacatacatttaaaaaaaaaatagacataaaatgctgtgggtaatgtcttttgaaaggtaaataatgggtgactttttttgttcggcaatgggttttttgactcacacaaatgaagaggacttttcaattaaaagctctctgaaaaaatgatttaggttttttggaattccctggagatccagtatttggaacttggtgctctcactgccagggctcaggttcaatccctggtcagagaactcagatcccacatgcaagctgcatggcatagtcaaaaaaaatatatatattttaagatttagttttccttctttaatgtaatcttgaatgtaaactagatggtttaaagtactcaactgatggtatcacttacttgcattaattgtcacatggtcactttgctctcaaattgacatattaagatgcattgacatagctgccaattttgcctttaggaataaatcaaaagaattaactcagttttcaagataacaaaaatttcaccatctagggaaacaatgtttgatgaagtgaacctgtattttcttgccattaaattacttggaaaagtgagactggcagtatgaacgtgaactgaagtgtggaaactagctggacagagtggctttatccagactgctgtcgattttgttgaggcatcagtagtaccttctatctaagcattcatctttggtccccttttcataagttaatttcactggatgacgtt

SEQ ID NO: 39226 - DNA, 619 bp, Bovine  19866881884331
ttgaaatgcatacataaactctaaccgccccatgcctggctatgttgtctatctaattacttggctaatgctgaatgagccaaatgcttaaagaccattaattttcctctcctattacttcctaatacttctcagaaaagcttgtaattttcttatctaaatgtttcaagtattaggaaccactgctgaagttggaatggtaacataaatagctatgaaaattatctcagtaaccagatattattttcactccctaggatccatcacaggcaattttgttccaactgctagggaatgtcagtgaccaaaatctagaccctgtctccctttaattctttgcattcaagtctaagtatgctaagcaaacagctctagtcttttattttagctttctgttggccctaagagatgcagtaactctgtagctaattgcatatattttaaaataactcacgtaagctcttcaaactatagttagcatagagactatcacatattagaggatagcagtttgttatttttcagattgacatgggctgtagcaattttcaagggtccttgctcctctgtgaaggctagttcaataaatctatgtcaaatttcccaccattcatctaag

SEQ ID NO: 39227 - DNA, 1158 bp, Bovine  19866881891161
attagttcttaggtttttagatccaggagcctaggaaatggtaaatttagccctttgatttgtgtgtcttgatatgtcatagttctgtgcccaaaaaactgatcagttttatcaggctctgacatggctgtgatgctttgtggcatttccaccagagcatattgtatcatcagagagaaggtccacattgcaccagctttctaattgggatcatcacctaaccacaagcctccaagtttctggagaactgagacatgggttagatgctctgactctctccatccgtgccctagcctcccaaacatttgtactctttggttacactgcaagggaatttataactcacttacttttctggaaatctaaattttgagtccaataatacagacacatttatttccatttctaccaaatggagagctttatttctggcttattttccttttgctcttcagtatccaaagcaaccctgaaattcaccaagtcatatttatgatttttcatttatcaaagaaacaaatacaactcttacttgctgttcaagtttcaggtcattgatattttttctgcatcctttcagactagattagggatccatacaatgagctccttcacgtctatggatgctcctagaacactgtcctataaatgcttctctaattgtttaccttatgtctagactaaaaggttggtggcagggggccatttgtgtcttcctcatctctgcatttctagtgcttgtcatgtaagtgtgcccactgagtgtttgttcaatgtaactgtgaagcctggaacatgttcttgtacagttttggttccttaaataccctttggaggaaaaaatctctctgaattgttatttattgcgttctcttgctttcagtccaacagtttggcacacttcagaaccacatactgtaatctacatttgaggctgaataagcgctgttttaggggagaagtatacacgaggctttatgttgaaactgtattatatattgtaggtaactggagacattctcccatcagtcatgccaatcctctggtggttttttctctgctttttgtactggaggcttataaccaccatctgaaaccttgtaagtaaagaccaagcactgcccatacacacaagaatttaaaaagactgaccacatg

SEQ ID NO: 39228 - DNA, 1824 bp, Bovine  19866880017506
tcgagttggtgatgcctccgcctctcatcctctgtcgtccccttctcctcctgcccccaatccctcccagcatcagagtcttttccaatgagtcaactcttcacatgaggtggccaaagtactggagtttcagcgttagcatcattccttccaaagaaatcccagggctgatctccttcagaatggactggttggatctccttgcagtccaagggactctcaagagtcttctccaacatcacagttcaaaagcatcaattcttcagcactcagctttcttcacagtccaactctcacatccatacatgaccactggaaaaaccatagccttgactagatggacctttgttggcaaagtaatatctctgcttttgaatatgctatctaggttggtcataactttccttccaaggagtaagcgtcttttaatttcatggctgcagtcaccatctgcagtgattttggagccccgcaaaataaagtctgacactgtttccactgtttccccatctatttcccatgaagtgatgggaccagatgccatgatcttcgttttctgaatgttgagctttaagccaactttttcactctccactttcactttcatcaagaggctttttagttcctcttcgctttctgccataagggtggtgtcatctgcatatctgaggttattgatatttctcctggcaatcttgattccagcttgtgcttcttccagcccagcgtttctcatggaaaaggtataaataaaatattctatcatatcttgtgatgtttttcacatacaagctatttatctactcttacctatatcatcatcaatttatggtatttgtgtttgcttttattctgattttttagttttggcagaaatatggtgacagagttgttatcagtctaattttcaagcttctgaataaaacttcccactgcctttcaccagcttttgcatttttcttcttcctggagaaaatgtcattaggaggaaggggaaaaaggaaaaagttgagagtttgagaggaggctagagctaaagattacttcatagtgcattactaaatcagaaacgatctttttatttaattcattctttaaaacactacttcttttatttaatgtgatgactttttaggtaaatgtgggccacagaggatatgccttagtgttagaatcattagtgttgagaaattctggatcgtgggtaatttataatctcagttttctggtttaatatgttttctttttcttcctaaaaagtaagcattacttgttatatttaaaggtcttgattttaggaaccaaaagagtcagagtgcatttaggacaataaaaacactctaggtgttcttttattattttggcagcttggcatgtggaatcttagttcctgaccagagattgaagctgtgcccactgcagtggaagtgtggcgttctaaccactgaactgccagggaattcccactataggaattttgaacaggaaattttatttcatggaattggtaaatcagttttggtaaagtagagaagccaaacactatggcggggaattctagagatgagcaacagcaggaaaccattggcgtctttcggacagagagagacagtgggaagatgcagtgtcaccaagctagccctggatgttgggactgtgtggcatgggttaaaaaccccgaagagggctcaaacccagagctgggaccgcagaacctggggctaaagaactggagttggaaccatagtgtgatgtagaaagaggagaaataccaaggcttctcttctgccctccaggcctctgcctttgcctctcttattgggg

SEQ ID NO: 39229 - DNA, 1402 bp, Bovine  19866880253910
ccttggactgcaaggagatccaaccagtccattctaaaggagatcagccctgggatttctttggaaggaatgatgctgaagctgaaactccagtactttggccacctcatgcaaagagtcgactcattggaaaagactctgatgctgggagggattgggggcaggaggagaaggggaggacagaggatgagatggctggatggcatcaccgactcgatggacgtgagtctgagcgacctctgagagttggtgatggacagggaagcctggcgtgctgcgattcatggggtcgcaaagagtcagacatgactgagcgactgaactgaactgaactgagtgatttgggctctcgctgtatatgaacctggcttttgtttccattcttttcctaacttacaaacaaaagtgagtacttgaaaaatttggggctacacgtttagattcctttgtttctaatgtcattgtcatgaagtttttattgttgtgtgtttcattattccaggatttgcaaaaatcagtattatagattctgcacatactgcaaaatgtcctgactatactatatttatagaactatataattttaatttagttttatcccatggggaagatttttcacatttgagttacatactgtatagaaaaaagtaacaccagtatttttaaaaccgatacagcccagaacatgattacaaaggaaaagcaaaaacatatcacacctttcaatgcagttttagctagctgtatttcactagaggaaaacagaaattttctaaaattacatgcagttagagttttaatgaatccaaagcatttctctcctgccaattaatacttagggcaaggttacttgtaatgcattactcctttttcttgctacaactaagatgaaagcattgattaatatagtgtaatcaagaatatgcatataagtagatatataagtacaaacatatgcatatgtgtctgagtgtgtttgcgtatatgcctttgtaaattttcagaagatcgaaagctacccacccctaggctcacatagaaactgcaataagaaacaagagtccaaggaccattcttcactagattacttgcaactcaaatagggcatttcaggagcaaaactagtgattgtgttgctatagcaattctgccatgttcccggcaaccatgtatatgccatagcttagagttttaatatgcccacttcaaagtcagaatagcacaagtgttaaaagccataatgtatttttaatctaacctttggctaatatatgtgaagattttaaaaagtttcttgttccttactttaatgggaaggaacgtaattaacaagaattctgggttgtaatatgaaatggatttatcgtcttaagaaagtttaagaaacgatttcagcttaaaa

SEQ ID NO: 39230 - DNA, 1908 bp, Bovine  19866880346075
ttggagctctgtcctcacataccaactgacagcttgagttaatttattcattacctgttaattacattcttattagggaaataataaggcaatttaaaaagaaaaaagaaacatagaattaaagaatttgtatctttgaagttcattcccacccaaattctcagagtatgaattattattgttgttcagtggctcagttgtgtccttctctctgcaatcccatggactgtagcctgccaggcttctctggccatgggattatccaggaaagaattctggaatggcttgccatttccttctccaggggatcttcctgacccagggattgaaccctggtcttctgcatcgcaggcggattctgtaccactgagccaccatgtatgaagtatacatgtagagaaatatccatttaaattgctatagaaatacagttctctgttcttccttggtcatatttgaaaaaatgaatctggtatactagcctgaattatttctgaaagtcatttggaagaagtttagctctagggtatccttattctaaagtgatttttttgaagtgtttttcaagttaggtcataaaaacacaaaagtatctaaaactctatgaaactactggcaagtattatcagaaagaaaatgcttatgtaacttcataaggactctgttccatctcattccaccctgaaagtatctgtacatgaatttagaggaaattaccaaaggcagacctgtgtctgaagaaaaggatcaaagagatgcagacagagtcactattatcagaaagacctcaagtcttacaagatcaaagtcttggtatgaaatgcatgtcttcatacttaattctgcctcaacccaccatccaccctccaaaagtaaaacctccaagaggaaactatttgtgcaactgtagatctgaaatctcagtgagtacatagtacctaaatactagagaactgtcaccatgcgatctctgctcccctcccaggccgcccatggaggactctcagactctcttgacccctgtggtgagctgtgggcctccaggagccctgctgacccgccccgtcatcctcactatgcatcactgtgcagatccccagcaccgaggactggaagatacagctcaagaaccaggcagcgcagggacagtgggaggtgagcctctgtggggataaaggtgcagttcatgcggataagcacaggcgatcatgggaaggcttttagttttaaagcaaaacatgggtggaattttagcttattctcaaaatgagagagagaaagggaaagagagagggagggggagatggggagacagacagtcagacactggctcctgagtgctttatctactgactggtaagcacaaagaaaatgatgaccagtcattagctaactcatagggaaagtgcacttaagagtcttacataaatcccttttgaatatacatactatcttgggaagggaaatatatatatatatatatatgtagtgtgtatatatatagatatgaaaatgaaagtgttagtcactcagttgtgtctcactgtttgtgatcccagagactgtagctgaccagacccctctgtccatggacaactcgtccaggcaagaatactgggagtgggtagccattcacttttccaggagatcttcccaaccagattgaacctggatctgccacgttgcaggcagattttttaccatctgagtcaccagggaagcctgtgtgtgtgtgtgtgtgtgtgttttaattttcaggtagagaaacattgcacctgggtcagaaaatgttaggacttacttgccaacaagtcctggaaataggtctgaatttaacctgggaaagcaggaagtgtgtatcctaagctccaatgcaatgaagactgtgtatagcaccttggctgtctg

SEQ ID NO: 39231 - DNA, 1604 bp, Bovine  19866880390048
ttcttagagtccttctcatccattaacttctttccactctctgtggctgttttagttctggcccttctcccagggctctgtagtaagctttagaagacagtatgcctctctccctagattacccaatgtttctttaggtattagaatagttaatacttcctctccatcccagattttaaacattaaatactcatacctatgagtggtttatttacctttcagaattaggacttagaagataaattgacttagagtaatataggaattttttaaatactggcactttatggggtgcaactataaaaactcatcacggccatgccatcttgtaatttaaagtttctgttatttttgaagtactgcaagaggaattctgagtcatatattggataattaaaatgttagagcaaacatttatacatggaggtaaatactgtgttcagatggaatattcttaaaaactcttcctgctaaattcatcttttgatctaatttccttttctaattttagctttttgtgtactggttttgaaagagtgaggctgttaatatttttttttgtgtgtgtggtgagtgcttcattgcttagcccacagtgttaatgcggttaaggacattggtctgatttcccaatggttcagtaatcttcctgtagtctgtagtcatggactgtcctccaaaccatgaccaaccatttcatagatgttagtcatgagggagacagaaaaggggagtcgggatggctcagtgtcaattcattctaaaacaaattaaggcacatgccctaccagatgcggttcaggagttttgccttcttttatttaaaagtaattcagcctttattcagggcttcccaggtggcgctaccataatttgctacagattatgcctctatggccctcaacagtgttagttgctatagttttccatcttctttctctggtctttaagttggatggtttactgaatttactgagatgcagtgtgttgagatgaaaaggacatagtttttcaagtcagacccctctgctctacttctttcactaattagttgtgtgcccttggttattctgaatctccaactttctttctttgaaaaaaataactatatggttgtaagtattaaataatatacataaggcaagaaatagtatatgcataataaatgctaaagttctctatttatcttttgtgatacataaaatctagtcagtcaggaaagttttatatagttaccagttatttaacactttcttgatgccaagcatgctgtatatatatgcagtttatatatgtgtgtatatagtttatgtatatgtatatatgtatatgtagtatatacatataatctctacttctcatgataacttcaaaatgtaatttataattatttcttttaaaatgaagaaactgtgatgagttgctatctggggtgcatggttatcaccaaagcacagtttacagtaaattgggtgtacagggatatttctagggaagtgatttttaagtattatagttgaatgactacctggatagaaaaaaaaacatccaggtaatcatttcacgaaaaatttttgttgtaaaaaaaacagactcttggggcc

SEQ ID NO: 39232 - DNA, 1224 bp, Bovine  19866880470940
aaaaaaaaaaaggaaaaaaaaaaaaaaagagatgtaactatagattttaataatccttgatttaatagcactgtaactggggagaattagatgaacctaagctttcatagagcccaaataataggacatttagaaaatgtaagacatagttactctgactgacttttcagtaatcagcattctggatggattttaaacggtctagtcatcaccatcattttagtgtagatgtatcccggttctaagatagtgctattgctcaataggtaacagacatttgttaggacagtgtcgttgtaaactgtgtcatttctcattactgttcgcaaatacctgagacagtctcggcacccaattcttattgcatacaactttcagagcctcatatcttacacacatctggatcgttgatgctgtgaaaacactccactgcaccataaccccattgaataaaagaggaaaaatttaagagaaaagaaaattcctacacagtgtaaaggtattttattgtgctctatgataatcaacaaattttgcttttactgctgaagtttgaactatgtctgacatttttttttcttttcgatacaccttgcagtagcgaatggctgtaagatgaaagataactgataattttctctccctcctgtcctctccctctccccatgtgtgtgttttgtgactcaggtctatttttttcaaatatatgatttggttcatttctgtcatttgtagcatccacaaatatttagtcaagtatttaatcttcccatgaaatgcttcagagatttgtcatataaaatcactggtttctctttagtgctaagtcatagcaaattatcatcttttttaggttgatttcgtagagtgttaagtgctgtttaaatttcacttcgatatggagctatttatttttctcctaatcacttaaaatagcaagagctaatcaactggagtttttctcctttttatgaatacatcagtttacccctgactcacatacatgtttctgcctttaggtcagtgggaacttttcccagctatgtttttttttttttttttttttgcccccttcattcctaatttctctcaggaacaaatggcagcatagttaagcattagaaacttgttgctaaaggtgctaacctaaacatcagtgccaggatacgactgagacttaatagactaattaatttgtctactgcacctctgacctgggaatta

SEQ ID NO: 39233 - DNA, 1667 bp, Bovine  19866880488893
agaaaaacacaaaaaatggaataaggccttcaagacatcagcttcgcgctgatgggtctgtcagtacctcagttccctgttcgtttgcctttctgaactgtttatttaggcactcttgagtgttcctgcacattgactacattagctgaagttgatggaaatgaggttattctgtagtaagctgacagtctgggtccttgatgtccaacaattgaaaaaccagaaatgatgccctgttagaagaaagtatattaaggaagtaaagtgagaaaacaagttagagacggaaaacattgtttccattgcagggtcagtcgtttgtaattgtggagtggttttgaaagctagttttgtctatgatgcaggtaaagccagttttgactgcagaacaaattagtagagactagatgtccttactaattgactgtgatcacatgacccagatggaaaagtcccaggccaagtttcttagtggacaaatgtcccctttaccaatggctgtctcctcagccagggaaacaactgaataagccaggaaatgacttccacgataatgtcttagcaatcagtgtttaactaccaacaccataatcaatatttgctgctgaatatatgcgctttttttttttgagcaaacctaggaagatggtgtggagaaggcaatggtaccccactccagtactcttgcctggaaaatcccatggacggaggagcctggtaggctgtagtccatggggtcgctaagagttggacacaactgagcgacttcactttcacttttcactttcatttggagaaggaagtggcaacccactccagtgttcttgcctggagaatcccagggatgggggagcctggtgggctgccatctatggggtcacacagagttgggcacgactgaagcgacttagcagcagcagcagcggtagcatatatctgtctacatgattattaagtatgagggtaaagacatttttgggcttccctggtggctcatagggtaaaagcatctgtctacaatgcaggagacctgggttcgatccctgggttgggaagatcccctggagaaggaaatgataacccactccagtactcatgcctggaaaatcccatggactgagaagcctggtaggctacagtccatggggtcacaaagagtcggacaccactgagtgacttcacttcacttcacttcaaagacattttaagccaaacaagttctcaaaaacttgaccttgcatacactctttcttagaaagctactggaggatgtgcttcagaaaaataatgaactaaactaggaaagaagtgaggctaaacacaggaaagggatgatgagaaagacctgggatgtcagcaacgtttccagataaagaaagcaagtaaccccagcctagaatcaaaagatagatactccaggaggggatgtctctagaagaaaataaaactgattatctgctgtttttaaagatatgcaaaatatttagttcatttggaagctttgggattgaattaactagtgtattaaaaaccaaggaaatgataaaataattgctaaatccagggaatacaaaaaattgaacaataatcatgatcataatataagaactgaatattgactctagtgattcagctcttttggggaggatggcaggggggaaatgtat

SEQ ID NO: 39234 - DNA, 1672 bp, Bovine  19866880527630
caagtaaagcacagaaggattaggtaacttgcctgaaaccatccttttagtaaatggcagcgccatggtgggtttccttctgtcatatcctacccttagtttaatagatacatctttagtgtgacattttggtgctcttagggactgctgaaatctaaatgactgtcagcttagcttcctcctgtcacctatctctacttacccccttcctccaacacatacacatccctcacaccctgcaaaaataacctatggccaaagtgttaactgtgctactaaatttagattgtattttgactcaccgttctattttctgattcttttctctgaagtcagcattgtataaaagctgtaaaccaaaaagcacaccctctcttttggcacaacgaatgaagcagtcactttccccagccacatttacttgctctgttagtcagaagtggcttctttattactgaagaaggggtgttttgccagcttctttcttcatttattcttaaccgcttattaggcatccctgggccaagttctttacaactgttaggagaacggagattggtgaattatagcatgatcagaggcttggagtctagaataccatgattctaaaattcttcagtaaatcttcaggaaaatgataatgatactggtgctagtggtaaagaacccagatgccaacgcagaagacataagagacacgggttcaatccctggggtagggaagatcccccggaggagggcatagcaaggcattccagtattcttgtctggagaacccccatggacagaggcgcctggtgggctacagttcatagggtcacaaagagctggacacaactaaagtgacttagcatgtacacacctgtacctcatgtctttaaaatggtttgcagaatataaagcttctatttatatgcttccttgctgaagtcagtgatacagtatctggcatatacacaaatatgctcatattaattttataataatagagtattataaaattatataatgattgaatagaattatcatctgaacacattttattaatttgcttatttacaaaatttgatttaagacatctctaatcttaaatatcatttttgtcctaatctgtgagtacatatgaattatatttctatatgaagtatattttattctcaccttctggattcaaaactacaacatttcagaaagatttatgtattatctatttagtagaaacctttcaattactttctagtatataaagactaaatcacagaagataaggaatttgagagacttgttagcaatcatttaccatgtgctgttgtccttgtaaactcattttaagctctgttggttgtcacacactgaaggatgaagggaacagtgtggctttggctggagcttatcactgctcagaataactttggtgtattatctttagtggcattttagcttcgttggtccacttcaaaatgtccatcagagacaccaaagattgacttaaactttgaagacttgtggctccatacaaatctaattttggaaccctcaaagtttggaatttggaaactctaattttgaaattctgccatatctgacaacagttctttctatttgaagggcaaaggggaatagttctgatatttgtaattaatgactttaaaaatcacctctcttattaaaa

SEQ ID NO: 39235 - DNA, 1630 bp, Bovine  19866880660158
tgagtagcacctgttttagatctcggacccacgcttctcgcgttaatatgcaaataacccgaggacgttgtgcctgagcccgccctcagagattctgattgggtaagactgggatggagtcaataacctggcatttctgagcggctctgacggtattgctggcccacagaccacgctggaaggaggtgttctctcgcttggacctctctgaaggtgagggaccttaagaaaatacaggtagaaaccagcgttgtttttcttcctcttgtctaagaccagagacacccacttcagtttctgaaaattagatacgttaggaaattatgccctactctgggaatcctgcaagtttcttttacccttttttctttgcaggattttacggcacttgtggaaagcagggcagagacaacagcccctacgcagacctggcttttggccgaaacagaacactttaatgacccagtgagtgcgcagcccggcgagtaagtgaggagttaaattaaatctcaaatggtagaggtttctcccatcattccatatcgggagtgttaattttcctaacctttaaagataaacttcatgggaggtgggggagtggggtaataaaagagcacgcagggagccaggtgtaatgcatttgggtgtttggtctggttgattactctttctgtgatgctggaaattggcctgagtccaaatcctgactagaccatccttctctataagaattaaccaggtcagtggctcctacatttttatcgtgttagtagctcctctgaaccaacttcagaagcttacacgtagaatagcccacaggtaagcatttctcacgttaattttttagtttttctctttctttttttttttttttttagtaaaagatacttttaattcacaaaaccactaaagaaactcagggctcctcatgttttcaggaacagggtttgtaagtcagttaaccagaaggtcgcctaaatttcttctgttgcaacattcaagcacctgtgaggattgcagatttgttctggttgatacacatccattgacattatctgcaatgactttgacttgtaaagagtagtttgtttttaatcatgattcgtgtcttcagtgcttccctctcccccaaactaacaaccagcgttgtttgttgttgttactgttttttttttattttcaaactattgaaaactatttggtctgggggtggggggcgcggaggaaagattgtctgcagccgctcagggaggtctgggagttgctctgttttcttagctgtgctgtgcaaatgaactgaaggtttaacacttaggtgctgtttgaagatataatacaacagagcccagaggagggagtctgggcccgccattgccggcctggcccaaggcccctcggtacagctgctctgggggctgcaaagctagaatttgttgccatggcttagacctaaacaaacccctgcctgttctggtatgtagattatgttcttccaggacagccctgctcacttgttttgcgtccatctgtgggacacacaggtttcaatcattccttcaccgtctcccattctaaagctgcagtttgttatatgatatagtgccttgtcacttagcagcagacgccacgg

SEQ ID NO: 39236 - DNA, 1454 bp, Bovine  19866880664301
tctttgtctgagacctggagcatagtcttttgaaatggaatttacttccaaatgattcaagagcaatttaaaatgaatgactgcaaagctaattttatctgcatttggctgcccatccatcagagaaataattcatgatatattacaacaaaaggcaactggaattaactatttgaatgagacttcagcttatttttaatattttgattaaaatatcctttgaaagacaaagactatggcttatattacaagtaacatattaatggatacatcatttaaatttaagtagtggaatatataatgccttaagtgtattggacaatttgaaagtactgcatgatttctaactctaaaagaaaaaaactttttttctatgtttaaggaaataatttccaaataatccccatacattattaatagtgacatgaagtcagcatgctatttgacatgcacttagctgtgaaagagaggcacctccttctgcccccgtttaagcctttattatttctgacttttgctaacataaaatcctaagtgttttcctgcctacagtctctactttgccatgtgttctatacaccatcttagaaaagtttgcttccttcttcaaataatttaatcaatgcaatgtaaagcatgatggtaagtttctttttgcttatcacattaactaaaatatactgaatgattgatgaggttttgaggaaatatgtatttgcacatactggctatagtgtaaattggtatcacagtagagagtatttgaaaatacaaataaaaactaaatctatgtatacacccaaataggttatcccacttcttcgaatccctgtttcagacataagggcatcagaatataaatgtatacaaagatgttcactgcagcattgtttatttaaacaaataaatgatacattgcaacaaaatacagctgaaattaactatttaaatgagtctgagaacaacttaacaacaaactaaggaatgatcagataattattaatgatatatccatccaggagaacactatttcatcaataaaaataaggaggcaaatttgtatgtattaaattaaaagggtgtccattattcactaggcaaataaaacaagatttcagccaatctgtatagagtgatgcaacctcttgttaaagaagacagaaaagaaggaatgaaaggagagagggcagaaagagcagtgtgtgtgtgtgtgtgtgtgtgtagatggctgcattaataaatcacaagaaaaagtgtaaggcaaagcctagaagccaaagctcaaaaatattaacagtaaatacttcttgggggagaagaatcagagagctttagggggaattttttccctctatttggaggtggatttttcacatgctagattacgggaggatttctattttttaatgtgttttttgagtttggtattttaaattaagaaaaggggaaattag

SEQ ID NO: 39237 - DNA, 1494 bp, Bovine  19866880688319
catattgtctgggatctaaggtggtagctataaaaagaggcatgtcattcattccctgccttcctggaattgccttgtacagaccattcccctgggtttttccagctaaattttaattcactcaagccctagagttccccctcttccctcaggaggctgctatctctcagcctgagaagtttaataggcagagacaggcgaaaggatattgaagaaagcaggggctttctaacatgtaactctataccagggaaataccaaggggtttcacgaatttattctcataatgaaaggagaacccaagcaaatggtaaagcataatctttttcactctctctttaccctcttctattttgtcctctctagactgtgatctccttcagtgcatcaggtcttagttttatctctagttacaacaccaagtatctgggtcatggttttcgaatagaaagtctatgtacctcctctatgctgcatttttacaagcctgttttatcatgtccagttttcaagcctggttgtatattagcattactactgagcttagaacaagtaaagaaaaagctatgtcctgtttccaattaaaccattctctctgggggtgaggccaggatataggtattttccaaaatcccccactggtgattgtcaaatgcagcccgagttgacagccaactgccctaataggtccttgttgctcttgctgtcacattcttggagatttctttcaaaacagatttttaaaatcagattgaactctcaatgaaattaggaatgagtacaagacttccctaatctgaactgtttttcactgttagatattacacttctgtgtgctgtgcttgcatttttttgccaggttctaatattttgctaattgtagttctcatgttatacatgctggttttgtataaccaaatagtacttttcagaggaattggcaagagtagttatttcaacaggtatccccaaggggactctgaaaatctctaagggatgactctggattgatggtatttgagtgagaagtctataaagactccagagcaagtaaaggcctctctcctcaagttttagcattaggtaattggtggctcagtggtaaataatctgcctgcaatgcaagagtcctaaaacacttgggttcaatccctgggtctggaagatccccaggagaaggaaacggcaacccactctagtattcttgcttggagaatccatgcacagaggagcctattggggtacagtccataggatgagtgaatgagtgagtgagctcactgagtgagtgagtatgcacacactattcattgttattgtagcattttaaacaaaaaaaaaatctctattctgttttttaaaatgccccatatatatgtataactgattcactttgctgtatagcagaaactaacataacattgtaaatcaactgtactccaattaaaaattatttaaaataaaaataaaataaaataaaataaaatgccccaa

SEQ ID NO: 39238 - DNA, 1167 bp, Bovine  19866880694103
tgaagtcccttttatctaatttctatgttttctcttcacaaacagctcttttttgacatctcaatttccattaataaaataaccaacattccagagacagcctcaaaactttggggttatccttcacgccagtctccctcatcctctatacccaaatatttgccaaccacaacagattccacatactcaatatgtcaggaatttgtccctttctttccattgctttggccaccatgaagttcaccattttaccatctgtgtaacttccaaaagtgttccagttcttcctaagcagaaccccaactgctctgcacaaagctctgttccaagtgattttattttcaaccctgagtggttcccctccaccaaaaaaattaagtgaataccccttggcatttaagatccactcagtacatggcagttttcttcatacagaacctacttaaggcttactatcctgaaacttcatttctccaccatttcctagtcatagttccctacctttactcatggcatttctgctcattgaatgtccctttctcccatatcctcttcccagaaaggctgcttgatatttcaatgatgatctcaaacactggctaatacataattttatttttccccatccacctctgaccatgccctcacagaacacctgtgtcttgtatagtttctaaatatgtcctgaacattgtttatttttgcttttacattatgccattagtaatccactggctccatgagggacaggaaatgtgccacagctatttctcatctagaggcacctaatggtctgatcataggaacactgtcagtatttgcagaacttggttgaaaatgtaaatgcattaatgcaggtttggaagcaaaccaactcatcaaagagtgaatgaactggtctgtccactagcacgtttactgcccctttcctggacgctaagactgggactcgcactggtcacatgcagtttcatccaagttcaccaattatcgtcagtgaaacttaagttctttggatgaatggattatataccaaaaaacttgaagcaaagaaagtaaatatcaggttaatattaagagaggaactatctttttcaaaggaactcctatcattccaccacaagggaaaagtatcctttcattaagtgtcaaaataaacatgcttta

SEQ ID NO: 39239 - DNA, 2626 bp, Bovine  19866880760099
agttagatttatgatataaatatgtgtaagtattagaaaaaaagaaatctcaaactcctaagtgccacagcataaagatcagatttacacaaaaattaggagattctaacattacttatgtttctagaagggaatagacttgggtattgggaagagatgtatccattaaaaaaaaaaaatgcatttctatgcttgttcaaggctttaaaaaaaatcttgttcatgtattacttttatttaaaaagttttaatatatcagtaagaattaagtagttaaaagagagattatatagtaaacagaatgaaaaatcaatagcatttagctgcttagagagattttaaaactatccaacctctaaaatctttaatgagccttagaagcagacaggtgcatctttggccctctcctctaacgtgacatttggcatcaacatcaacttgctcttagtttaaagtttgctttctttccccagctatgccttctgctgctccacttgtagcatgatatgccctgcctcaggctctaaaatggcttatatgcatctatctcaaaagcatttgtcatctgtcctaatccagtgcctgctaaagaccaaaaccagttggcctcgattagtcaaatgaagcctgtttgtttgctctttgaagctaggtagcaaatacaagagttttccagcttgccatattacctgatgcttctgacatgaaatcagttagcatagtagctgtcatgaagtcattctttctgtttagataagaaagtagccaaagctctcaggttgattttaacagactcctatagagaaaggattagagtctctattaatacactcagtcccaggattcctagaatactgggctattctactgatcttctcccctcacattcttccaatgaattattcttctctccacagtggggtcttatttcaagggcgttcactagctcacttataatgtcaacttgctatttttaaaatgagatcatcaaatcattaattcactttaatgtcagctttattgagggccgattttgaaagtacaattcaacaagtcttgacaaatgtacacggttgtgaaatcttcatcacagtcaagctgtaatcaactccagcactctccaacaggtcaccactgcccttttgcagtcattcctcttcctgaccttccagcttctggcaaccactagtctgctttctgttactatatttttgccttttctagaacttcatacaagtggaatcatacagtgtatagtgtttttgtggatgacttctttctcttagcataatatgttaagattcatccatgtctttgcatgatttaagtcgtttgctcctttttattgctgtatctcattatatggatatgctatattctattcattcattcacaagttgatgggtatttgagttgtttggcttatataaacttataaaaaggtgcttacaaatttttgtgtgcatatatcttttatttcatttgggtagataccaagaagtagggttgctgagagttggatttaagtctactattactatctgctattattaatctacaccttactatttgttttttattgtgtccatgtgtttccagctctttcaccccatcctctgcccttattctgaatcttttgtagtaattatttttagcattccattttgtctcaactactggtttgagaactccatgaacagtatgaaaaggcaaaaagataggacactgaagtcagtcagtgcccaacatgctactggagatcagtggagaaataactccagaaagaatggagagacagaaccaaagcaaaaacaatacccagttgtggatgtaactggtgatagaagtaaagtccaatgctgtaaagtgcaatactgcataggaacctggaatattacgtccatgaatcaaggcaaactggaagtggtcaaacaggagatggcaagagtgaacactgacattttaggaatcagcaaactgatggactggaatgggtgaatttaactcagatgaccattatatctactactgtgggcaagaatcccttagaagaaattgagtagccatcatagtcgacaagagagtctgaaatggagtacttggatgcaatctcagaaacgacagaatgatctctgttcatttccaaggcaaagcattcaatatcacggtaatccaagtctatgccctgaccaataatgctgaagaagctgaacagttctatgaagacctacaagaccttctagaactaacaccccaaaaaagatgtcctttttgttataggggactagaatgcaaaagtaggaattcaagaaacaactggagtaagaggcaaatttgttcctgaagtacagaatgaagcaaagcaaaggctaatagagttttgccaagagaatgcactggtcatagcaaacaccctcttccaacaacacaagagaaaactcacacgtggacatcaccaaatagtcaacatcaaaatcagattgattacattctttgcagccaaagatggagaagctctatacagttagcaaaaacaagaccaggagctgactgggctcagatcatgaactccttattgccaaattcggcctgaattaaagaaagtagggaaaaccactagactgtt

SEQ ID NO: 39240 - DNA, 1596 bp, Bovine  19866880787588
acaaataaaagcttgttctgtgggattgtagccattaatcttactaaatttgggtaactgaaatgtagtgagacatactgatgatgtttttatttgaaatacttcatgaatagacaatctgagacatgcataaagcataatcttcggtaacagtagtgtgattactcttatatatggaatatgactttatatatgtagtgtgattattcatgtatgcagtgtgactactcttatatgtaatgtgactttacacattaaatacacacatcaaatcaattgttattctctgtataaaataattattctaaacttaattctcatatgctgggaaagattgaaggcaggagaagaagagggtgatagaggatgagatggttggttggatggcatcactgactcagtggacatgagtttgagcaagctttgggagttggtgatggacagggaagcctggggtgctgcagtccgtggactcagagtcagacacaactgagtgattgacctgactgaactgagttctcattaacagagtgaatattttctaaaggaagttaggtggactttgtttaaattttggtaaatgatgcatgtaatttggacgccctatttgaattttattccaaatttttaaattctattcagtggaaatattgcctttacaagaatagagctttaaaatttttaatatgtttgtcaatgaagataaatgattctaaaatatgaatcaattgtttgttatttgatttccttctcagaggtccttctcttaacactggaaactaacaatttttctttttggtatgagaccagccccaaaataaaaatagaaaattggcaagaatccatgtagtacattgaggcttttccaccgagtcagtctgataacttggcgagaaagtagttaccagttagtgataacagagtagtaattatccccaaatatatagtttctcttattcttcttttgttactgatcacaatagatttatcttaatttcacattgacattgtctttaaacacctggattcatgtggccaacataatcccagctgcacttacaaaagttggttgatcagagttccagaacttggattttgttgcttcattttgttctagcatgaaaatagtcttggctgagtggatcatggaaaaagcaagagagttccagaaaaacatctgtttctgctttattgactatgccaaagcctttgactgtgtgaatcacaataaatgtgaaaaaattctgaaagagatgggaataccagaccacctgacctgcctcttgagaaacctgtatgcaggtgaggaagcaagttagaactggacatggaacaacagactggttccaaataggaaaaggagtacgtcaaggctgtatattgtcaccctgcttatttaacttctatgcagagtacatcatgagaaacgctgggctggaagaagcacaagctggaatcaagattgccaggagaaatatcagtaaccccatatatgcagatgataccacccttatggcagaaagtgaagaggaactaaaaatcctcttgatgaaagtgaaagaggagagtgaaaaagttggcttaaacttcaacatt

SEQ ID NO: 39241 - DNA, 1470 bp, Bovine  19866880800655
caccagatgacccactggaaggtatccagctggaaaaacacccagttttggattcaataaaggcaatcaaagagagggaagatggagcaaagtaatcagaaatttcctacacatgtcttgaagtcacattcatgtcttctcttgtctcacagcatttcctctgaaagaagttctaagatcacgtgagcaatagacagacactgtgccccaaaaggcactgtaacaagagggcagaggctctgtttgtgcactggatactatggagtggggatggcatgtcagcagaagagcttcgtgaggagatgacctgggtgtgaattctgctgaccctcagctgttaactgtgaaaccctggctatgaaccctagtcctttcatctctaaatgtggagctcatcataactcacagaatagtgaggaataaacgaagtgaggaataaatgaaattaccagtatgctgactctacggtagctatgttttgtattcttactatacactaaaacaacatactcgtcattgtgacttcacaagaaaatcgcatctctttcacaacaaaaatgagtgggagaagactgtctcatttatttgagagagctgtcttgtgtttgttccctgctgcatggtctctggtgtacattttcatttgagatcctgaggatcctctagcttcactttcataaacagaacttcattgaggcacaccaaatttaatagagcaattccctctgcacctaacttcaagtggtaggcatagtaagaggtgatttatagtttccttttctttaaagttaaaggcagaagagcctaaagcagaattgtctagctttgtcaatttcctgctttctccctccttcatccagagagtacaattatcctggtcagggtgctaactaaattgcaggaagaaaaatcacacaaggcacctgagtgcccacgtcttccagcttcagcacaccctgcagcagcttcttaaggtttgatcttcagccatagattatggtgatcacatggaaaatagcagaccacaaacactttctcagaataaagcacaagccaatactcatctctgtttaaaccaaatatccatgttggcaaaaggccttcagggatggatatacttagtgttaaccttgattctagacagaagaaagaagaaaactaaaatataaagggatctcagtttgctaatcttcatttctcctgctgcaaaagaagggcactcagagggactgtgaatattactttacattgggaatggaaaaatgaatatttgatgtgcacaaatacaagacttttagtgattttctgttgctcaaattgaaggcacatgaataatgaccatggaattttattattttcttggacaggctcatgtttgtgtaggtgaaagtatatcacctgaggaaaacactgttctgcgtcctacaggttataaataccgaatctttactcaagagcatagtaacagag

SEQ ID NO: 39242 - DNA, 1248 bp, Bovine  19866880801108
aggtttttgtctatggaaaatataacgacttcctataaaaagtcacatgacacagggtagctaaaaatggagacagcaatgtaatgttattaaataatgtaggaaatggtttcatgaagaaaacttccttcacctcttcttggaaagtctctggctttaaggaagtgatggtagagcccgtcgttaaatcacattcagtcttttgccctcgaactgagtagcctgtatcaacaatggatggtacatgcttgatctctatattgtaaaacaaaattaaagtaatattttctgcttatttataaaacacaggaatagatttaaagtgattcacaacttggcaagttttaattttatttcagcagagaaaataattgagcagtgccatgttcccagtcttaatctctttttttatttgatcttcactttgtcttctaaatagataacaaaccaatacaatattgtaaaggtaaataaaataaaatttttaaaaaatgctgcttaattctgcagtccagtatgatttccaaaacaaacttattggaaattgaaaataagttcaactatacccgtggttaatcttttttctgtttttattgatgaatttaattattgaccctcggtaaactacttctaagtataataatacagtttttaaagtttgtcttaaagtaagaccagagtctttggaactttttgtttacttgtaaatgtctagaaatgaggcatttgtcatatatcaaaatacagtctttctctgaaacatcaagttatatttaggttttgaaagatttcttattttataaaaatagctcacctctttcaactttgtgtaaagatatcaggctgggctaaagtgacaaagaatgccttaaggggaactttgaatgaataactttgaaggaaaactattttcaccaaagacttgtccaaatttaattagttacgggagttaaaggcagggagaaaaggccaggagcctaaagggatttcaggagtaaagtgtcaaggagaagtgaggtctcacatggcgaaggaagtgttgctcctttaaggtttaataattttgtgacctagtgtcaagtgttttgatttccagtggcaggagaggtgaaatgagaaaaattaaccaacactttatcttgctggaggtgattcctacccttaccatcttctttggtataatggatatattatattttaagcagtaaattttgaaagaatgtcacttgctccatcaaaaaagataaa

SEQ ID NO: 39243 - DNA, 1686 bp, Bovine  19866880816585
gagttgcagagagactataatcagatgtagcatgttatttcccactcacaaaatgttataaattcaactttgattagtgaggggatgtatttagtccaaagctatgcacacctcatgatatatgatatttatagttgcttagaggatagacatatttttttatacaggaactggatgtgtacttataaacactaaagaaccacctttcaaatatgtatacttctgttatattttgtgcaaggatttcttctcatgtaattcctatatatttctgtcttatagaacttctttaggaacagttcaaatgagaaggaaaaaaaaagctgaagttcttgacaggcactggactacatgtcagtaatgcggaaatgaataagataaaaactcttcctaacccttgaacttgccttctagtgaggaagaactataaacaagaagaagagtagagagcaatgggtggtgataggtgatatcagggggttatgtccaatatttgaagcagggtggccttccaaagaaggggtgttttatacctgaagaatgagtaggagttatgacatgagatggtgataaagtgtgggaagtgtaatggccagctttatgtgtcagcctggctaggctgcagtccccttgttcaatcaaatagtaacctaggtgttgctagtgaagtcttagtgctgcttatttggctctcaatggatggaatcaagaacacactttttatctaggataatttctcttactcaaggaagctaatttggggcttaatcacatccagaaaatatcttcacagcaacacctagactagtgtttgattgaataattggggagtgtattcttggcatcttgacttgtaaaatagactgtcactaaagagtttaacaggaatgaaataaatatgtgctattatgaatataatgttaaattttcaaatctttattggattcttttaaactataagtcattattttagttaaaatataaggattaacttaagatttatgttgtcttatttatctattgataattgtttagtttctataatatttttctgagcgatcttgctttattcattagattcctgaagttcaaaataatagaataggatttataactcttaactattaatggagagtaagaacgcagtagaacttatcatgggggggaggggtagaactttttcttaattcactatataaatctttacgtgttgtgtgttagtcgctctgtcgtgtccaactctttgtaacccagggactatagcccgccaggcttctctgcccatggaattctccaggccagaatactggagtgggtagccattcccaacccagggatcaaacttgggcctcctgcattgcaggaggattctttgccatctgaaccaccagggaagcccattaagtttctaattgtgttagcaaacctttctgacatcctaaaattaataagcacattaaagtgaaagtcagtattaatgaattataaacatgttatttatataaccagactaattggccaatttttattataaattcagattatcgtaaacttagtatcttttatttcactatctcattttataagaaaaaaagatttctttgagagataaaatgcagcttgactatagcagctaggacagccctagtatagagaagataacccacaaatatttttgagcaaatt

SEQ ID NO: 39244 - DNA, 1043 bp, Bovine  19866880817751
atattagaatatgtcataaaatgactaagtgtcaaactaagaccctattgtatggagaggcttggccaaaaaaaataatataaactatatcctaattcaaaaataagtgaaatgaaaagatagtattgatttgaaagattgaatatctcttatatttatgtatagtaggcaatgtatagtaggttatatatagtaggcaatatttataaaattctggtttagttatgtcttggcttactcatgagtctgaaagattataagcaaacttgagatatttactgataggatttccatacttaaatatcagccagcgagaataggtttgaggcctcaaccttgtttttctaaagccttctgattaagttgtcctctcgccatggctaagcctggctctgatgctacaccaccatcacatggaaggggactcagcccccagactaaaatgacatatgctgtggcttttgtcctagctcttttgcttttgtaggatgaccttgagtggcctccaaaacttcttgttctccattgtaaataagagatagtaatatgtattcctgcgtaattcacagattaaagtcattgtagacgacgcagtgcatttgaaggcatttgggagacttgtctggtaaggcattattcttatgtcttccagtcacccaaaaaactagaacatttctatctgccagctacccttttttcagcacatcctgccctcaaagtatctgctgtatttttagtaaaagttaaaaggaaaaagttgaccgtaatcctgtgtatttctttctggtcttttttctgtgcatttaaaataagatgaaaagcaacaatgcatatattctttcgtaagttcctgtttatgtataacataaatttttttcttgaattctttttaaacattatttttgatggatatataagatacttatctgagaagacatactgtgtttacttaattcttgttctgtacttgaaaggttagattgtttctagttttctttttttaatgcacagaaaattccttatgcaaaatttttgtaaaattt

SEQ ID NO: 39245 - DNA, 1177 bp, Bovine  19866880827510
ttgtagaaattgggtgtgttaagaaagtttatccatatatctggatagcaataaaaagcgtttcctaggaaactgtaagatcctgtaccacacagcatacagcccaacgaagaggaaaattaggttgatttctaaattcaagatacacatttgtacaactgtcctgaactcctgtggcggtgtccgagcagagtgggcgtggacatcggtggctgtgtctgccttctctctcccgctgcagtcttctctgtggggctcactggtccagacggggttcctcctcagctgtgagcccctgggctctcctcctgcacttcagccccagcctgggtcagtactgcccttctgctaatgacactactgtttcatgtcttcccatttcctctaagacagctgccagcacgctcaggtttccatctgggaagttctgtgcttcccagagatccaggatgacaccagttggacttgatttggtggcaaagtaattcaagtacctgtaattggtaatgggaaaaagggctgaacggtgtgatttatgggtctgttttcttttcggtgttgacgaaacctttttgtttctgcatttctataagtatcctggtcccccttgagaaactggggcttgcagtgagctgtcctgaataactagctcatgtttaattaggtcagccccagacaggagacgtgatgcttaactttgttaacctcaactctgagtaagataatttaagagacaagatgtctatgggtcacatcctgaacaggaaatcaagaggcttatgttttctttccagcccagcctctgatcatctttgacaggtcaggcctggggttttgcttggtagtgatggcaaagttctaaagagaagaggctcctgaggtctcttcataacagcactgctgtgtttagcatgttaattacccatccagcattaggtcctgcttcaacagtaggtgaggaacaataattagtgaatggctatatcatttaggggggatttagcccatcagcccttgcgaagtagatcataaaactcgatgcttagaaaagtcagagaagcccaggatgtctctcaaccatgtatctgcaacaccatggtgcaagagacaaggtaggcacttaatacatgtggcagaataaaagcaagtaaatgtgcagaggaaagacaaaaaagaa

SEQ ID NO: 39246 - DNA, 1830 bp, Bovine  19866880841337
aaattggtatttacattgatacatccatatccttttttaaatatcttcattaattaaatatgtcttcatttcaaaaataaagacagccaagaaaaaaaaaatggaacatttgtcatactgagcaattatattcaaaaactatttttaaataattttagaattatattctacaatttagcctgaactagaaaggttaactcatgcgtgcttttgcaagcatggggggaggtgtaagaactggttcacagatagtaaatcaaaatcattttgataactatctacttccctgaagttattaaaacttcattggggatttttcatcataaggttcaaataactcatgttctttccaggttgcagtttcagttaattataaaaggaagaaaaaatgtaagagctgctaaaaagtcaatgccaatgaaaaatgaatggtcaaatgctcagttttacatatttcaaatcatggacaggtgatttaatttgcaataacattcatacattcaaagccacaaatgcaaaattcaaggcatttttggtatctaccaagattgaggagtcatataagttttttaaaaaacagggtaaaaaaaaaaaaaaacagggtaaatcatctttaattattttcaaagactttccacaacaaatcttcaaattttgaatgatcaaaagctccctaagagatgttatattatcattagcttgattatgtaccataacaaatgagtatctcatgcatatattactacttaaatatatacacattatgaaacacattttaatatcttttaattctaacaagagacagctttagactgcctttgtcaaaatgggattaaatactttcattataattaatctttacgtttttctctgctttattttggtcatccatgcccacagacagtgcctgaaaattatcatgacccttaaatattcctggtagcttggatcttccttgtagctcagatggtaaagaatctgcctgcaatgcaggagacccgggttcgatccctgggtcagaaagatcctctggagaagcaaatggtggtccactccagtattcttgcctggagaatcccacggttagaggagcccagcaggccacagtccattgggtcgcaaagagtcagacatgattgagtgactaacactactacaactactaaatattccatctcaaaattcacttattcatacatcttaaaccagaaccttctgtccttaggcctactcatccaactgtatcaactaaggctattctctgacttcactggaacctcaatttccttgaatcctagttttctctgaatccactatccttctccttcctctacatgctaacccacaatcaagcacaagaattcagtccatggcactctcattgtctcaaattttgctttctaagagaacacattctggctcatagcttcaattaccatatgtctatttccagcctaaatctctattctgtttctcagcccagtgtattccaacccagtattataaaatcaagctcatttgcttcacccataaacctacttctttttcagtgttctcttagtgagtaagtttcatctctcaattgtacaggcaagaaatctagaaggcacttggaaactatcaacagatcctgttcattttacatggtatttctctttcaaatttatccatttctctccatcttagccttgcccaaacctaagcttttaatgacctacctgcataagtcaaaactcaacaggtgctcaaagcattgtgtatatatcacaccatttatcaatctttcaattttacatttcatagtgtgattatttgaacaatgtgtaattt

SEQ ID NO: 39247 - DNA, 1900 bp, Bovine  19866880851381
ttgggttacatgctcccctccccaccagtaattgtggtcataggaccagaatgctctgattggctggaggagtcctgtatagcttgagagtgtaggagacatttctgtcacaaaacaagaggaaatggaagatgagcaaagaaaaactatatgttttcactatatcttccattaacaggtgatgaaactaaggttcagaagggatcaatgtcttggcgatgtaagtcttctgacactgagtccaatgtgtcttgcacattttctgtcattcattcagccattcctgtgaagattcaggtttgtaggtaattaacagtaggggtgtttttagacctacaacatggtattctgagatactgaagagtcacaagttgtaaatgggtaaattgataatgggaatcatgaaaatattttttgagtctttggtttagtaggattcaacctgatttcccaatttatggaaaaagatagcttgattttccttgacagatcatacaagtgaaaactgtccctgtagtattttcagtgatgtcaacagaaacaagttcagatagcttccttgtttccctcctatcctaaccattgaaaggacttgatttgctttggtttggatgtggttctcattttggtggaagtgaagtggcacattagcctgagggatttgtgtgtgtttgaaagaggcacagacattcgaaccgcccacagctgccctgcataggagacatcttcataaatactgcatgattctgcatccacatttgcacagagtggcacaaccttgataaccacattttattctagttcagtttttgttgactttctgcttcactttttgcagcagtctgtctggaagggatgagaaggataatgatttcacaagaacttgagttgaacccgtacagaggaagagggagttagggggagggtctgccctgaaatcaacctgcttatttaagtagatttgaagaaaaacagagcatgaaaacaacaaatcagcctgacttatctaggaggagtggataaaatagtccctgctggaggaaacgtgtaacccaatccagtactttatcacatcttcctgaaaccttgaaataggtctatgaatttatattgtttccgaaagccctatgagccgtgctatcttaccctgccccactgtgaaccctgaaatcaatccattgctctctcaaactttgggaaaatgatatgcctctaatgtcaatgaactagctgcgttcacagaatggcttttcactccctgagtttactgaagtggaagacagaaagggtatgactttctgaaaataaccacatgtgctcaaagacctagattttctaggcatgagtgcatttctgataaaaaatacctccttagtgtgaagaaacctggttattcctcctctccacaaatcgtttgcatcctttatatttgtaaagattgtcaactcctatttctcttttggagatttgataaaacagaggccttggtaaaaggaaaatggataccgttaaaggaaatctacctcctgtaataaaataagagctctgttttagatgcctctgcctttttacaaatctccctcctctgcctcagttaacattagttcatagtcgttatttatattatatatattctggagaggcccttcgtagatggggagaatgcaagttaagatttctggctcaagaataatagctaaaagctgtggaattttgcatttgagttgcactacatgtcttagaatattttctttataatctttttacaaattgtcttagcttactgttacttatttcacaatcattttaacagtgctcatatcttattctatagggtaaacaactttcaaatttcttacacatattcgatactgccctgtttctctgttcctgtcagcgt

SEQ ID NO: 39248 - DNA, 2092 bp, Bovine  19866880855870
ctgtgcacttttgtgagttttacattatgaaccataacaaccttttcgctctatacaagtgatagggtagcttgatgcttaacaaatgaagccagactctgagctgtgaaactgttaacagatctagtaatgacatgggcctctgtttggaacatttcataatacaactggggaaaacaggagtgaccgccatttagcacattggcaaagaggtttttctttacctcttgttctgtataagtccatggaattaatgagaaattgattttgcagtttgtgtcagtagatctagagtctcttcagttgaattttatttcgaaaataccagatttttcagcatttgaacattctatttccagcctttaagcagaaaatcaagtaatattttccttgactatcaaaaaatagtgcttccttttacttataaaggtaagaatctagtgtgatgtgaaaaaatatcttgattaaacatctatgagttatatatgtgtagcaaaataatatctgtttttaatctgaataataataaagcaaaaataaatcattttaatagagaaatttaactgttataggcttacctgaaaaattccttacatattctgccttattaacctttttctctttgaataataatttatgactgtggtttgcagtgacaaattatataacttccatgtgtctatttttatagtaaaaagaaataaataacttggaataatgtcatttcctgggatttgtaaaattctgcagagtgttttaaacaagagagatcaaaattcttgagatgggaaaatttttagaagaatatcctttataattccctgtctcattataaatttatgctcttaagagaacagtgatttcacaactaatcatgtacaatccttgctaaaagaagtgagtgctgccatggaatattgatgtgtatattagagttacctcttatgaccctttcagcaacaaactcctattttttagactgtcattgtcatcactaatttttttttgagtgggagttgacagcttctttgttatcagtgaaagaatataaaatatttttcagattgctagtgaaaaagaaaaattgtggcttgtaaaaatgtcaaatcttgaatttgtcagggaattgtaattctaaattttatcaattttgccatttagttcagatatcatttaggttgatgtgagggttcatttttatgaatgagacatctaatacttagaggacaaattgatctgcagaaagctttataatatggcttcttacagaagggactggggcaaatttgaaataagcttcatataattgaattttcagtgacaagaattgaatttatactacatatatttaacaatagcctaaaattatgaattatgaatttagtttttaacttcaattactaaagtttctagtcaagcaaaaaagccaaccttaaataatgctgtttcttttcaaatgctgtcatttgagattataactcatagtttatataatagtatgcaaaagtgcaaattcagagaacagtcctgactttaatagaaaaaatatggcatcataatcagtgtattattgtgattaggttgattactatcactcaaaaatgagaaatttaatgatagatatgttgaataaatctgggaagaaattttaaatataacctttcttgaacccctataacaaatattttttatttaggcaaattttacttgatgggcttaacactacttatgtgcttatctagaagtgaaggtagctttaacaacctgaataaagtgaaatatttgctggtataacttgattaggagtattggtatggaataagtccatttttaaagaacagtcccaattcttcacagatgtttgcttttttgagctaattggtggctggctgtctttcaggtgaattaatctttgtttgattacattgtaaagtccttgagggctggattcttgctttccttgtacctccccatgattggggtagagtaggtatttagtacacacgtgttagctgaagtaatggtcttgttctaagcaggattttgaagtcagatcacatgccttggtgtgataggaccagccagccaaata

SEQ ID NO: 39249 - DNA, 2003 bp, Bovine  19866880937669
ttaacagtgttacaaataggcaaaagtcttacctttctctgtagcctcttttgtataaaatatcttagaactttaatgcagttatacttttatttcattctgaaaatcaaatactttaggacttcatttaaacttggcctgctactgctaagtcacttcagtcgtgtccgactctgtgcaaccccatagacagcagcccaccaggctctgccgtccctgggattctccaggcaagaacactggtgtgggttgccatttccttctccagtgcatgaaagtgaaaagtgaaagtgaagtcactctgttgtgtccgacccttagtgaccccatgggctgcagcctaccaggctcctccgcccatgggattttccaggcaagagcactggagtggggtgccagtgccttttttatataccacaggccttatccaatactctgaaatataactgtgtacagtaatgcaaatataatatggctattgcacatacaaggtatttgtaacatgtatttgaaagtgaagtgaaagtcactcagtcatgtctgactctttgcaaccccatggactatatagtccatggaattctccaggccagaatactggagtgggtagcctttcccttctccaggggatcttcccaacccagggatcgaacctgggtctcctgcattgcaggaggattctttaccagctgagccacgagggaaaccctcctactcacataattggagattcaggtttacagactcatcttatattctgaaatcttaaacctttataaaaattcattaagccagttcatgctcaaaagcctgtcggttatttatatgatatatagcctaaactctgtaaccttaattcagaatcctacacaatctgcttccactctgtctggctttctttccaaccatttactataggagccatctgttccagtaagatttttttttgtctcatgctattgcacatataaaatatttaatcctgcctctaatccttgctcatataatttcctctcttttcatcttctctatctctgtataagttcaattcatatttcagcatccagctctgccttcagtgttgggcccagtctaatccatcccttactctgattttccatctttattccatttgaagacacttcattttaaagtgactactgttttttacttagttctctattacatatacactgctttttctatggtactgtgaacctcttgagtgcatttacttcagctagcacatagttcatcagaaatggttgctggtatgtcttgttttgaactgaattaggattttggggcaagagcaactattccctctttatgctttgtaccatttgtggatgcccgtattggggaaatgtgagcagtgggaactgtcccacattttagccattcactcgtcatcccagagcttaaggctaggttccaatttggcaatggaaccatgttgtgatgtggcactgagccgaatgtagaaaggttggacaagaggttctatttgattttggtttgctcttcactcacatgacccctttgatcctgatctctcttattcattttagtatgccgcagtctccctaaaaggaatatggataaatgatactgaaagattatcttttacctccccaaacttctattttcctgagaagtaaggtctgtggattctgtgaaatgcttaacatgtagttaaagcttagaatattccaaaaatttctatgtggttatgtgtgaaattccatttcatgaaatggaactgaggatgttggcttgatagaattaatagcatttattaaatcctaacaagcaattgttcagctactctaagacagagaatagatttgaatgccatccattaggatagtgctgggagttgctggtgtgtgtgaaaagaagtgggggtgtctcttaagaaggggaagatagcagagattttttttttccaagaaagttattcttaaaatttcaagtaaactcattctaatgctatcttagat

SEQ ID NO: 39250 - DNA, 1121 bp, Bovine  19866881000733
gttaaaataatgtataggaaaaataataccccaaataatcgatagatctaataaagattaaatcaaagggatcatgaaaaacttcactgaacactcaatgaattttctcatactgctgtataaagtaaaacttttttagctaataaaaatcaccaatgaatgttcacattagtgtttaaaaataaggaattatgcaacagaactggactgataaagattactcacattatttattatgtcttggtgatgccttcaaccatatctaatacacttaattcataaacaatcatacagaaaagagaaggaatttcagttcatcttccgtgagatgagctctatctaagtttcccacagcatggccatctttgggctcactgacctcaggacccataaacactagggcacatcattaatcactttaattgcaaagttgtcaatttgcaataacaaagcaactccagaggggaaaaaagtgagcactcaagtgtgtagagggatgtctctttaaaccatttccccatatttaattgtacttctagttagtcggctttcctaaaactcaaaccttaaacatttaaatcacttatggcaatgcatcagtggtttttttccaaatgatttgagaacatataaggattattttttctacaaacaagagtacaaaatagctatgtatcagtgtgctgtatatacagtagtagttatatatcagggcttcccaggcagctcggtggtagagtccacctgcctatagaggagacacaggttcaatccctgggttgcaaagatccccagggggatgaaatggcaaccccctctggtattcttgtctggaaaattttatggacagaagagcctggccagctacagtccatggggttgcaaagaatcagatacaactgagcatgcacacatgcagcatattattaacacaatacctttcagcttataaaagattatactcaccacatacacatgtattcattttcatacacatagtctcagtttctttctctctctttgcattttctctattaccatctgaaccaccaggaagcccctctctattactacgagtactaaatatagacagacagaaataataacccaaagtccacaga

SEQ ID NO: 39251 - DNA, 3311 bp, Bovine  19866881011369
cctccggatttcttatttaggaagtttctggtgtctctccagtattctgtctcttaagtccatttctcatttccatgcaccaaaggcccttttcttcctttgctccagcagggagcatcaacaagactgccaaaaccattcagtaaggaaaggacagtcttttaaacaagtggttttgggaaaatatgaatatccacatgtaaaaagtaaagatgaatccctaccttatacaacatacaaaaatgaactctaaatggatcaaagaactaatcataggaactaaaagtataagactcttaaaggaaaacatatgggaaacgtttcacattccttcattgggcaatgattctttggatatgatttcaaaaccataggcaatttaaaaaatagataaagtaaacataaaacttaaaacctctgtgcatcaaagaaaacaatcaatagcatgaaaaagcaacctaatatagcatgaaaaagcaacctatgaaatggaagaaatcatgtaaatcatatatctgataaagggctattatcccgaatatgtaagaatgcctagaactcaacaacaacgaagaaggaaatggcaagccacctccagtactcttgcctagaaaatcccatggacagaggagcctggtgggctgcagtccatggggacgctacaagtcagacacaactgagcaacttcactttcacttttcactttcacacattggagaaggaaatggcaacccactccagtgttcttgcctagaaaatcccatggatggaggagcctggtaggctgcagtccatggggtctcgaagagtcagacatgactgagtgacttcactttcactttttactttcatgcattggagaaggaaatggcaacccactccagtgttcttgcctggagaatcccagggatgggggagcctggtgggcagctgtctatggggttgcaaagagtcgaacataactgaagcgacttagcagcagcagcaacaacaacaaaaacaaaacacaacccaattttaaaaatgggcaaagactttacatagacatttcttcaaagaagatatataaatggccaacgagcacaccaaaaggcgctcaacatcactaatcactagggaaatgtaaattaaaatcacaatgagatatcatctcatacccaacagaatagctattatcaacaaaaacaaaataattatttggagaggatgtgaagaacctgaaacccttgttggtgggaatgtaaaatggtacagctggtatggaaaagagtaactctttaaaaaatcataaacagaattactttataatctaacaattctacttctggatatatatccaaatgaattgaaagcagaattttgagaagatagttacacacccatgtgcatagtaacattatacacaagggctaaaaggtaatagtaactcaagagttttacaatagatgaatggatagagaaaatatggaatgttcacatgatgatgcattattcagccttttaagggaaggaaattctgacatatactacagaatggatgaaccttaaagacattatactgagtgaaataaaccagtcacaaaaatataaatgctgttattcatatgatgaagccataacccctcaatatgatagtatttgaaggtggggccttttgaagataatcaagcttagatgaggtcatgaaggtaaggcccccataatgggattagtgtctttataagaggaggaagagggatctgagctaactctgttgtgttctctgtctctctctgctctataaggagacagcaatctaactccaggaagggggtcatcaccaggaatccaatattctggcaccatgatcttggactttcaggcctccagaatgtgaaaaatagatgtccatggtcgcttaagtcactcagcatgatgtattatgctacaactgcctgaacagaatgagtttcaactttgcccaataatgtggacatatttaacactactgaattgtaacatgtaaaaatcattaaggtagcaaattttattgtatgtatgttttaccaaaattaatttttttaagaggtttgtttttttttaagggggtggggggaaacaacctttgcccaacccaggcttccaaaatattatatcccagccagggtgaatcagagagttgatctactcctgccccatttccatcctccgtaacactgtgaagaatgattaactgcttaaaatcctgcagtggctccataacattgtctctatctgatccaatcacctgcaacagaagcatctgccccgcctcattctccagtttcatctcttgccaccagtttccatgtgctccacgttctacttgtatctgtattttcaattacaattttctcttatattcctgcttttctctcagctctcttcagttcagttccgcaagatttcattgaacatgcactatgcgttgagcacttggagacaggatacatagattagttaatggaatgcttctattttcaagaatttaaaagtctagtggagggacactcataaagaaatcccttctaccataataatgtcatctgtactctcaaagaaactcataatctaagctttttaaagtatttcaaagacatactgtttcatgacaaatgtgcacccaaaatatatttccatgtaaaaaattagaaatccattatttatactgtagaaattctatttactggccaaatattaataaaaaattgaaaatattaatgtaaaatttaaaaatatgatccaagcattgcacattgattcaaaaacttttgaaatatcaaagaaatttaaaaagcaaaactcaagaggtatgtgtgggtaaacatacatatgtatttattaacatgcaattatgtgtcagcactataacattttaatagtagaaaggaaaaattgcaggtacatttttaaatacattgatcactttttatcactttaaactttaacttaggtaatttttcctctttactagtttcataattaaagtttctcctgccatttagagtaaacacaatttcagacatgggagagaagaatgaccagttcaagttcaagggttcactgcacatgaatatccataaatgccccttgacagtcttggtagtataatgaaccttgcaattactcagcaggccatcaccacaatacatgaacataatgctcgcaacgtcgaacaacaaaacattatacaaataatgccaaccaactgttttggttcacatagggcttttggaaaccaattaaattgcaacagttcctcttaaatctttataaacctgcaacgagttttc

SEQ ID NO: 39252 - DNA, 1102 bp, Bovine  19866881051561
ctcaataaggaaatgtggcagaggttcaggtgggtcagatggaaaggtttctgggagttcatgaaaaaagtcgtcatctgggaaaacaagaaaatgaaaaatgtttagaactttgtagccatttgcctttcacttgctatttgttcaaaattaataaaaactgtgggcaatcattagtcatatccatttcacctgccttctttaatcaaggtatacagaaggcttgcatgtacttcaagagcatcacacctaaacaataagatgtttaggaatcattttctaggaacttgcaatcagctgtgtctagcttgagtcgaaaggtataggaacatcaacccttcaactgggcatgtgctagtgtccactggatgacattttgacatctaagggctgaaaactccaccctcagatcctgctaagtgccttcatttttgaataaacaaaggcctgagctgacttacacctgtgtagaacaattaactgcacctttttccagtcccctttccctgagctccccacactccccatgccttagacaaccctgcttctttattctttacttcatagatacctctagatggcgctagtgggtggtaaagaacccgcctgccaatgcaggagatgctggagacaaaggtttgatccttgggtcagaaagatcccctggagaagggcatgacaacccactccagtactcttgcctgggaaatcccaaggacagaagaggcctggtgggctacagtccatagggtcgcaaagagttggacacaactgaagcaactttgcacgcacgcataaatactctgaacccttgccttcggagaggtggttctgagacttgctccttgatacccatacttagctgcccttttccctgaaaacctatgcagctctgcattttggcttgctgtatattgggcaaaacaaacctggcttgataacaataatgattcataaatcatctaattaagtaatttgagtgcctgttattaaacaggcaatatgttaggtctagtgactagttgtttaaggatttagatgattattcttatttttacacatgacaaaatacaatatctagggtgataattatcttgccctg

SEQ ID NO: 39253 - DNA, 1881 bp, Bovine  19866881051614
ctctgccctccttccccttcccctccccaacctgcgcctagtcaagattcaaagtactgttcatcaaactgaggctcatatgcattcagtttgagtcagggccagcatttcccatcccccttttttgttttgtaaataaaatggactacaacagaatatattacaatggattgcatgtgaaactacgtgtttttattggttcagatctgtaccagttaggtcatgaaataaagtatacttttcactgtgtattgtgatgaagagtttgaaaacaggggtctactttggtgctactcaatttgcagcccctggacactgctgccaggtcgtttgttcctggtctgcaatgggatacgtactgaaattgagaagaagcatttacaagtttttgtagcaatttgacattgccagttttcaaggttttgatcagtggatttgtcccattaaaaggtgtagaccagtttgggtgttgaacttgcatgatgagagacatctgttttgagttgtttactgttaagaagcactatttgaggatttttttatatgtgagattcacagcatggtggagagaatgaattgtctcagaataataagcttattacaccttttggtaacataggctgaatgtgcttctaatttgctagagtttcaaattttctttctgtaatgacagaggcattaaagaatataaaatgttttataatctctttgcttaaaaaaaaaactttgttaacactggacaactttgaaattctaatataggtatattttacaataatatccattaaatcatcaatcagaaatatatgcaatacatccttattttataaacaaagtttagtttctataaacagaaataaagtttctggaataaaagaaacaactgactgtgttccagtcctttctttgtgatagaataattgtgacgttaatcacaaataagaattttaaaagaagaacaaatatttgaacacttaatcagctttaaattttccttttttcagatttagatattattatcatatagactactttgaattactttaataagattcagtgatgaggatgattgtacttctgaactgataagtgtgaaatttagggctcatcttaaagttattaaggatagatctggcttatctacgactaaaagtagccacatttgatcattaatttttaaattcctagactctgagtactccagatttttaagaaacctaaatccaccccaagttattttttaagtgttaaataaatggaaaaacctaagtttagactataaagaatgaaaggttttcatttctgtgctttccacgagacagcagcctgactttgttttcctaataaggctgtgctaaatgttggaatgcttatccccttgaattttactgaaatacctaaaaatactcactttaccgaaaaatttcacaatttaatttgtttagcctagacaagaatagaaaaagtgatgtatctggaaaaagttagtggcaaaattatgcctccagtattaacatagggcaagagagcatatagaagtgagcctcaaagagcattatcttacactttggatttttgaagaacaaattagttattttgttcttttccatctgtattctgtttgtctttatatatttaagatctggggcaagttttagttcctctctcttctccttccttaagtagcagctcatatagttcaagcatactcatgggctactttattgcttggcattgtgttgagatttactcttctttgatgtgagatttggatttagctttcttacaaaatgaagtactatatttaggaatacgttttcatctgacttagaggggtaaaaagacacggtccttatagtggtatgaagtagcttatgtgtt

SEQ ID NO: 39254 - DNA, 1481 bp, Bovine  19866881053886
tttgcaataaccagtatgcatagtataaactcaggaagaaggcttggcttaatgcaattaaccaaatcggaatttgagcaagatgatctaatgagtccctaagccaaaagttaacagcaaaaataaaatgactacttgatttcaaaatgaagggagaactgacccaatgcaaattttctaattattgtccaaattactgaaaacaagcgagtcaaaaaaaattctattttatcttgctgaaacttagctgtttgcaatcttgccaataaaaggttacaaagtggaagcaaggtatcttccttacccgacactgaaaatctgagccttctagtcctagacatccagaagtgaccacgggcatcccagagtcatcttcttctatcatcgtgaaacaatatccatctgtgctaaagatcaaacaggcaaagtaagtgtgtgtgtgagagagagcgagtgtgtccagggtaaaaggaattgaagatgtttaccacttgtttggggcttccctggtggatcagtggtaaagaattaacctgccaatgtaggagattcgggttccaatccttcagtcagaaagaccccctggagaaggcagtggcaacccactccagtattcttgcctgggaaatcccatggacagaggagcctggagggctgcagtccatggggtcatgaaagagttggacacaatttagcgacttaacaatagcaacagtttttgtaattactggatttagctactcattcagcggttacagagtacctgttacagcacttattccagaccatccctctgaacagggatggagatacaggaggcaaataacaaagacgtaattcttcctcttgtgaaactcaccacacgataattgatatttaatcaaataagtggttggtcgtcatgatacctaatttatacttttaaatacataatccactgccattcttatacttaagaatcgtaccttgtataagatgaaccaaaaattattaatttgtgaaaaagttactcccaaagagtagaataatatgacggttgctttcagtgggaatcaaaatatgttcttttgctttcttttttaaaaagtatttatttatttgactgtattgggtcttagttgcagcatgtggattctcatttgcagcgtgtaggttctagttcccagaccagggatcgaacctgggccccctgcattgggatcgtggacacttagctactgggccaccagggaagtcccttttcctttctttttaagggctatcagtgtgtaatccaatgttgtgacacttgaatgctataagatattagagaccaggccacatgaatattactatctgctttaagcaaagttctgtttccaacctattgaaccaatttgaagtatttatatatgtgtactctatcttcaaatagattatactttcctttattccaaatcatattttcacatctccgtgtttgggtctatgtcaagtctgcc

SEQ ID NO: 39255 - DNA, 494 bp, Bovine  19866881102454
tggtgggtacattgaaaaaaggaaaagggttctaattgtgttttttctattagctaaaaggtgttcttctaaatgtgagagcaaacaaaaccactttgctcatacacaaggaaagccctctttctgaagagcagttatttccactttttataaatgtaaaagattgcccagagttttaacgcttttattgctttctgattattttttattgaaatgcttattgtttcttgttaaatagctgctttaattatacagcagtggcccaacttctcaaccttttccagaagaagcccccagtttccattaaagagttttatgggggctccccacacgtcagatttcacacagccagctacattggctttttataaaggtctttgaatgcaatgccaaggcctcccactaattgttttatgggctcggtgtgggatctgcatccctgactgaggaagccccatgttaaaagactgtgggagtgaggagttgtcaaacat

SEQ ID NO: 39256 - DNA, 1640 bp, Bovine  19866881119443
tttttctggtggtgaggatggtagtgcaagtttaagcaaaagatcagtggttataaatgaggtttaaaatgctaaatttggaatgaacacggtacggttggaaaaaatgtgagaaagtcaatttggcagggaaagagcatcacattgggaagtcatgagaggttaagtgtctataagaaaagaagaaaccagcttttacagttgctcgaaaaccaggctgggtttgtaaactcatgttaaagactattaaactgtagtatgacataaaaagaattttcagagggtcagaaagtttttttttttttatatactatacaaatttctgtatatttttaatacacgagatgagcatatattttacatattgctcatgtctttaaatacatttgaaagcatttgcagtggccttgttagcaatgcatggtaatggtaggtagtcagcagtttcataagacatgtggtgtgtgtgtgtatgctcagttgctcagtcatgtccgactctttgtgaccccatggactgtagcctgccaggctcctctgtccatgagatttccaaggtgagaatactggagtgagttcccatttcattcactaagacacgtgagtaccctgaagtaatgtgttcagttcctctgctctcctcccatactctgtgagaaaatgtaaggtttaaggatccttttctagacaagtcatatggacttgtggataatccctgagagagtttgtaagcattttatggtttatcttgaaagttgaatattcctttggattattaaaatgtctcttctcaccttttcttttaaatatttttaccaatattgtttcagccacatgtgctgtctttataaggacagcattctttcttgaaatgtaatataaaatttcattacaaaatgctcacttgggttccatttcataaagttaatttacttcacagagctttggaaatgctttgtctcgtggagtttttgatctttgattaaaatgtcaggtaataaaaatattatgtgaattgagatatatctgaaatcaagtctagggtagagaatataactttagttacaacatggaaagttttgtgcattcgttattatttttgaaatccccttaaaagtgaaaaataaagaggtcagtgtgataatctaaaaattagttttcagagattcatatgttaattgaattgtctgtgtgttttcagtgtcagagtagaagtttaatagctcttgacttattgtttaaattaagagttagtagtgacacatcttgaattattgcatgatctgcacgatatgcagatgacaccacccttatggcagaaagtgaagaggaactcaaaagcctcttgatgaaagtggaagaggagagtgaaaaagttggcttaaagctcaacattcagaaaacgaagatcatggcatctggtcccatcacttcatgggaaatagatggggaaacagtggaaacagtgtcagactttgtttttctgggctccaaaatcactgcagatggtgactgcagccatgaaattaaaagacgctcactccttggaaggaaagttatgaccaacctagatagcatattcaaaagcagagacattactttgccaacaaaggtccatctactcaaggctatgggttttc

SEQ ID NO: 39257 - DNA, 917 bp, Bovine  19866881136388
caaagagccagggagagctggttacaggccagaggggctcccttcatacgcacagacctttaaaacagcttggatttattgtggctcttaagtggcccagaataatggcttagcatggataatgtcttggtttaattggtattgtgaaagccgatagtttctagcgtggaatcccttgtctctgcctttcgaacaatccctcccaggctccctgaatcaatacagccgtcacgtggggctggcgaggagcctgctttgggatggccaccacactgggaagcagctgtcccacgggactgcccagatccctgggttccagctccctgcagcacggggttcatgtgagtgttcctgtggaaggacgggctagagactttctgttgccaattgacccctgcgagagtctctcccggttaagttggaggggtggagacggaactgacaaaggcgagcagaaagtgaccccttttacagaagcagagccccaacaaggccctgaggtggggatgctgctagaacggaggacggcctttgcagaggaaggtgacatttatatctctaagaaaaacgagcctagatgatcctaattcccattacggcatttctttccaaggtcacgatatttctcttaagtcttcctaaatcttttgaccttaaacatatttcgctcctgtccttttttaaggtgtgtggaatatcctaacctttgggaccccaaagcagcctggacctggaagaagctgtcttagaatttagcacactgtgttggggttacatgtctatatgtcggtcttcctccagccaaggttcgtgagtgtggtttgcggccgggacagaggctcacttgtctgtgtgtcccagagcctggcgtggttcctggcaggcatactgaatgagtgctcccaggaaggattgaa

SEQ ID NO: 39258 - DNA, 1417 bp, Bovine  19866881139273
ggaagcccttagacactaagcttatagtaatttcttattgcagaaaacaagaaactacctagaagttaaaaaacaaatgttcaggggtgcaaagaaatacaaggcggctccagaagttctagaacaacctaaaaagtcctatccctaatacatagatgtgtgagaccaacttttccttagaaataagcccagaggtagataagcaacatggccacttccctgagtgctgccctgcggcattttctttaagggtgtcacaaaccggcctgactgggcagctggaagcggcagctcagaccaggcatccgtggcaacagcagctgcgggagcagcaggcagagcccagaaatgaggagacttgacgggaagtgtgtgcatgtggtcacccgagtccaaccttgttattattagggatgaggcatggcagacagactcggggggggagcacagagctccccagcgtgcgcacagacagagcagcagtgccgctgggcgtgacagtgacccgaggcaggcgggggaggccagctgacagtcagatgttccctctgccggctctgcagccagaggagaaggcagcccacggggagctgagcttggtgtcgctagaaagctggcagggcacgggggagggggacagccttctgctttggaagaccccaggcccgaggctggaaggcagaggagatagccttgagcaaagagagagagtcctcatccctggatgacaggggtcatttccagcacaggatgaaagagtgaataggaccaaggtgagctgcataaaagctggtgagagatgggattttttaaaacaccaggcagcacagtacttgagggcttgtcttttgagcttcaatgtatgtgaggctctgaacacctgctggtttgttcgtggtgcctggggagccctgagtccattgtggtagaagcctgggcgtgggtctcctgctgcacagctcagtcttccatgctcggtctagcgccctccctgcagagagtgtgcagtgagagtccctctccacggagtcatagagccaaaccaaaccaaactgaagcctcctggcatgcaaggctggctgctgctccatttgccaccctttgtgctcttgacctgcatggaaatcttagtaatatccccacgagagctatgtccacctgcccaggtgccaggcattgcccccaggccccttggcagcagtgactacagccagttcaggcctctgcacttccatctagaataaagaatgtgtggaccactcacatccagacagtaccaagaaagaagcaagacaaaaagaagcaaagccttgatctaacctcctccaaccttcttttccagaagagattttaatgtgttatgtgggatttacgttgcatcatgtgtttcttccttcctgtgctgtgtgctcagtca

SEQ ID NO: 39259 - DNA, 2250 bp, Bovine  19866881170997
attgcttttatatcttgaatctttttctatccattggtttcaacttccctttttgaaatggacttgactttccttctatcttttgttgcccctgagggcaataaatagcctaagttgcctggatgtggccagttcagggctggcatgtgcgctttaagtgttcactgctgtagaagtgctcattaactgttgaggataaataaataggtacttctctttctgatggaaattcacagacttttgtttcaattagcagatgttataactgtcttccttctggtaaatggaagatcctcccagcattagtgaacatcatgtacgccccagtggtaaactcggtaaattcatcagtctgttggtgaaagttaatattctcctggagggatatgttagatttccaaatttaagtgactttgttaaaagaagttgagattgactctttgtcaaaccagttcataggtttccatgaaaatctgataaaatattgaatgatttataacttgtaactgtatgtgtaaaatatagtctgcctcaattttgttaagttggaaatgtttaaatgtgtatgttgaaaaatatagttctgaattaaattttgcatagattaatagagacatgagttattttagattacagtgatagaattatgacaatagaatttagtttgggagaattatttactattagtattagcacatgtttttgtccttgatatgaaattacttttattttgtcagttgatacagtctatcctggattgatttacttttctcataatccagtatctaatatactttgaacacatacttctaatttatgtagctataaattatatttttattttataatacttgtctctggtttactattccttaattagtgaagggtttcttgtatttttatatagatatatttatgccaacataaatgagtcagttgaagtaactgcaaaactgttacattggtgcttggcacataatgaacactatacaataacattagggaccacagacattctttccaactagattataaatttgtgtgtaaactcgttgaacgtgggaccttatttttcttatacatcaccttctccctggcatacctggcacagtgtttagtccagagtgcctataaataaatatttgttgcatgaatgtaagcccctaaggaacagtggtcatgtaaggtgggaagaggttgcagaaagtggagtttttctggtaactcatgacaaagataaacacatttccttctcttacctatttttatttggtgcaactgatatatcttacaattacaaaatgactatggttattgaaagtggatgaggtgtcattaagccaggacacactgacatggctgtcttctttctggccagcttccattctcattcagtatatatattaaaggccatagttggtagcattttgaatattatctgtgggcttaagtgaatatttgggggtcaagttattcaattaagctgtgtggatagaaaaaatatgcatacacacatatacaaagggaaaatcctgagagaattaatgagcattgtgcaagccctgctgataaatgctgtatgtctaattttaggcagtgattgatattttagcatatataaaccattaatgtattaacctttataaattagtaagtgatgttttaatattaggaatgagatattttaacatatggagtgttactttttatagttccaaattgcagtcatggtaatgaaataaattatagattttattacatttatgtacttgccagttcagtagagaactcagatattttatagggtcatgaaaattagtcacattttcttcttgtaatgataagcacccatattaaaaattatcacatttcaggtactttattttttgatcatcattgtcttatctttcccctttaagaaaaagcagagcaactactatacatatataaagtaattttatacttgccaattgatcttcccttgggggctactgtaatttttataaatagcttgctgacttcgaagaaacagtagttctgtccttaggaactcatctggaaagggcatttctttggggatatggagaccatgtgtggaatttcagctacaggaaaaatcctgggatttaaacaaagaaatattgcctagtttaaaattgaaggtctgtttgtgaaacgttgccttgctcttaatagcagtattttgtttttagaccctaatatattgtggaattatagtccccagtctgg

SEQ ID NO: 39260 - DNA, 1010 bp, Bovine  19866881179639
cttgttttttcgatggttcagcagatgttggcaatttgatctcttgtttctctgccttttctaaatccagcttgaacatctggaatgtcacggttcacgtactgttgaagcctggcttggagaattttgagcaattactttgttagagtgtgagatgagtgcagttgtgcagtagtttgaagattctttggcgtggcctttccttgggattggaatgaaaactgaccttttccagtcctatggtcacttctaagttttccacatttactggcatattgtttacagcacggtatatagttataattccatatatgctttcatacattaattctgcaggtaaatattgactttttctctgtgtgaaattcacttcattgagtgtctctctttttcattcctctctataccacttttaacttcaacagcaatttaatatattattcacagtagtatcttaacttactaaccttgaaatttatttctatctttgttatcagaggcttattggcaaatcaaatagacaaggaataatagagaaggaaagaatggtgacctaggacacactattctacaaaagtaattcatgcttctttgaacgtgcaaaaatatttgttgaaaattagctagcatacaatgtgtatggtctttgagttgctcattaatactccacgtgtaatcttttaaaattattgttggtagaaatagagaattacttagaatgactttttttcttttactgcatcagtataaagtagatgggtacagctttcagagcacagtgtgagcttaaaataagactgctgaagtcatgtttcttaactagcagagccggttttttggtcaattttaagctattttttttttttcccactgaaatgtagttaatttacagtgttgtgttagtttctggtatacagcaaattgattcagtgattaaatcactgggtcagattctttcctattacaggttattagaagatattgaatatattaatagttccatgttctat

SEQ ID NO: 39261 - DNA, 985 bp, Bovine  19866881222844
tatttgttatctcacttggagggtatctccataaaggcagtgataatgacattttagtggtttgattaatttccctattagctgtccaaatataaactgtacttgtaactttacattcagagagattttgtttcttttcctttttgtcctcgttgggctttcctggcatctgtccagatgctgttacttaataatatctgtatggcttattttctgctcagaaagatgtagcgaaagaccaaagtggtcacaccttgctggcagtggtggctccacaggccccatgtctccctcagtccttaaggcaaggtctcactgagcctccacagaggaaccttacagtgctcagctctgggacgtggtgagtacttaattaaaaaaaaataaaagcatgtttaagaatgctgtttttcatggactgcccattacatgagaaaatgaaaatgctatgtcgagttctgggccaaattttaacatttatttaaaaattaggtattttatttttttggactgagaaatgttggaaaatttacactgccagtttagacactgcaatgttaggaggatcatttgagaagcggcaacctcaaagtaattttatactccttgagttacttttcactttgatccttactctggcacttgaaggcagctcatggagttgggcaggtggcaggcacagagccatggacctctggtgtttgagacaactcaaaaatccatcctgtgctaagtcagtgagaatggaagatcttcttgattagtgagttttaccactggcaccattatattctggtacccttggtccatgttctaaagtaattaggtcttattcctggagatccaccttccctcactactccattatctactgtcaaatgtccctcatgttctccaggttctatccagcttcactcatacttattttgtggggtttctagcagtttttctgggcaactatagttcatccctaatctcaggtcat

SEQ ID NO: 39262 - DNA, 1416 bp, Bovine  19866881313967
ccccgtccctgggattctccaggcaagaacactggagtgggttgccatttccttctccaatgcatgaaagtgaaaagtgaaagtgaagtcgctcagtcatgtccaactcttagtgaccccatggactgcagcccaccaggctcctccatccatgggattttccaggcaagagtacaggggtgggatgccttctctgtgataatccctagagctcctaattagttttatttcatccacaaaacgcaaacatgttctcaatattacaaataagaccatatcatatggacacactatcctatgcctgtaactcttaggcaaaaatccttaacatctgcttatatctggagttgtactctgaagctagaattcagtccaataatggtatgccataaagtgacagcaacaattaaatttgatattagctataagatgacatttaaacatggtatttgttgcatataactacagcttgaaaatgaaatgtttcaaacatgattatttataagtgaaggcaaaccctacttattagcatgaaaacagttttgtttaatttactacctattgagacttgcttatttggttggttaacaataagtaagcaaagaatagtttaatctcagtggcatgaaacataaatattcataaattctaaagcttaatgtcttgacaagagtgtggagataatcacaaaatttcctacatgttcccagtcatttatggtcattaatcagttaactttacagatagaaaagaccttacatatttttttttactaaagtggtaaaatacagagagtctattcctctattttaataggcctcaatagctctaaaatctctgagaattcaaactctttccttgcatcttcatgcagctatgaaaataaaattattctgataccatttaaattctttcctgccacaacataaatacacatgccaaagtatgcaagattaaaagaaaaatccatttatcagcaccagcgctacataaaaaccaatcctagtcctcccactttttctccttctgaagcaacaatgataggcaggtagacctcaaattagacttgcttgtctggcttctagtccctcgcctgtacctaagcactctgtaatcagagaactcctttcactgtaaatagcccctatacaaggtaagtgtggaaacagcttctaaatcatttgaaacattttcggcacagctggcagaacacctgttaatatttgaaagtagatgagtgatgtttgaaacacaaaacaatagaaactaaaggactgttcacacaactttcactgcacacttttcagacaactttaaatatactcaaggactttggtgaaaaagcaacaaattacagttaggttaccattttcatattcttctgaaaacagagatcaacccacgaaactaagctcc

SEQ ID NO: 39263 - DNA, 553 bp, Bovine  19866881604441
ttcatgtaattccatgaacaggggccattcagtatttcacgaggatgcagaataccaaataacgcaggtaataccagtgactaaaatacttccacattataaattacaaatctatggtagttaatattaactctgagaaacaactagaatactgtatggttagtagcaactagcaccccctcccacctgccccctgctactcaagagcacttcagaggcccaagatcggaattttttaaagtaaatggcttcattactggttttatgggaactattattagttattttaaaatttaactattcactctttttaaaaatactttccaaaaacaatatattcgtttccatacaattcccaacttgattcataacttctctatagacttctcattattctggaaatctaaaattacttcttaataaaaatgtactctaaatgcaaattatcaacaaaattaaaatgtaaattttcttacacggatacatgcacataagtgactcatacctaggaccctggaattctcatcctaaagaaccagagtgtacatctttt

SEQ ID NO: 39264 - DNA, 810 bp, Bovine  19866881662120
ctgaatgtatgaactcggaaaaagatctgatctagaattattcagagttatcagcatattgatggcaactgaggctgtgggaattaatgagattgttcagggaaagagtagcatgaaatagaagcgctcttaaggtataagacaaataacagaaatactctggggacagagagagaggcaggagaagaaccaggagagtacatcatggaagccaaagaagcagagtagagaatatacgggatccaaaatcatttctatataactccagagcctatgaccctaagcattcattcatcaaatatttactacatgcttcctgtgtgccaagctctttgccaggcactaccttgacccatgaaaatatgaaagcagatcttctcgaatgcatctcaacctggaagtactaacttctacaccagttgagaagaaggggccagtgataactgaggtgattaatttctgctattttaatttccttaataagcctgctagggtaaattttggaataatgtatgaaagcattattttttatttgccctgctacacttcacatcttagattatcacttttaagcccttcatgtattctgtaaaagatatatttcctacagagatgtaactttctttccttccacctggctgcacattctttccagccattataattaatggcttcaaagttcttgaaatataacatatggatataaagctagattcttcatgttttgagaaatatttcagagaatttatataagctgcttcagaaagggaaataaattataaatctaccgctttctctaaggacaaagaa

SEQ ID NO: 39265 - DNA, 953 bp, Bovine  19866881684661
cagaagaatattaactctggacctgacatatagaaactcgccatcaacagtgactgaaatcactgaatattatcaaaagtgtcatgattcagcctgcatttaataagttgtacatatactcccttaagagcgactgggcacaatatggaaaataccccatttagacaataagaggttggttttcttaaataaagctaaagtgaactacatgtaaaagtcacctcagaaaatatagttattgctatatccaggcagtaaaaatatcagatgaatgtactgtataaaaattgagtgttaaaacttaattatatggaattcttttcttacactattatttgctacaattttctagatctgtatttattcacttactcattttcttcatgcactcatgtatacaaacttttcagctgctaccatgtgctaagatatggagatctgaacataaagaacaaaagttaaggacaaaatttaacagatgcattcattcccagggcattttaggttaagagccaaggttttgccagaatctccatctattacatccacactcttttcccagtttccacattactccccagagtaattctcctacccccatcaatgcaatataattattctgtgacttttctattcaaaaccatttcaactgctgggaacaataatgtaagtatgatttataactgcattataaattcattccattgtgacttgtgaatacaaattaccccaactggtgaataaaagccttcagcaataaagctgtagctttcatttatcatcaatcaaaaaatactcttattttcaaaataaattaaaacgaggctgtttcaccacatatttataagccgtataaatatacttcctttcagggagtaaaatatatacagacaatgtgggacttcacatccacgatgagcatctgatttaagatctttaaaggagtcagattc

SEQ ID NO: 39266 - DNA, 2770 bp, Bovine  19866880387969
tgataacaaaaaaagtagatgggtaaaacaacaattttggtggatcaagagagcagagcatacaataggctttccctcttacaatttcatcacagcagtctcttttttttcaatagcatggttgaagatatttattgtaaaaacttgatcatacataaaagcagagggatagtgaagtcccatatattgatcacccagcttcaataatcatcagtgttatgaatgccaatatagcttcatctgtctccacccctcaccaccctttccctatggactaatttgaggcacattccaaacatcacattattttaatctccaataacagcagtctcgtcttgaaatcagttactagatgactttccctatagaacaaagtcttagctacttccttgacgattgaattagatgaagcgtgtgaatcccagttttcttactacaccttgcccctaagaatctcctgctgaaaatactgtcatcgtttttttctgtctttatgccttttgccacaccctgaagtgtctccatctttccccaggcccctgccatttcgtctcatccctcaaaattgatatcaaaagccaactttaggtaaggcctacaaacaacatttgcccttctctgtaaacgttttagagcacttagcaaacaccggcatggactgtgtatccatctcatcttgtatccatctacaagatcggatgtctaggagcaaaaatcaatggtatcttgacatcattgtcagcatctgtcatgttttgcacatacaagatattcaataaatatttgctgaatgaatgaatgtgatgttgtcatttattggcatagctttattgttgcagtgctcggaagattctttgtgtctaaggaagagagaaattgggtgttgcctttcctagactaggagaggtagggatccctagttcattgaagaaaaagaaacaaagtgggtaaaactggaggaacacacagaatatccagtccctccctgggctcttgcatcagaagaagagtctgaatcatatttatgggagactgataatgagatacctgttgttatgctcacatgagctcttattttgtggtaagagcatcactttcaaataccaccagtttaagatttgttattaggggacaacttacatttaaggcactctaatttttgaattccatgaatatttctgcagtatcatctacccacagtagaaaaaatgagagtcttgtggaggtgttctaaaggaattaaacccaaggtggcactctttggaatgggttaagaaaccacctgccaatgcaagagatgctagagagtgggtttgatccctgggtcaggaagacttcctggagtaggaaatggcaagtgttcagtattcttgcctggaaaatcccatgggacagaggaacctggcgggctacagtccatggagttgcaaagagttggacatgactgagtgactgaatacacacacacaagattccaaagtgggaaaatgaattattctagtagagtgctttgcagtttatacttaactttttcttacatatcagcatatcctaaatgaaactgaaaatagatattattaatatttccattgtttcaagaaaggatattgatagcaactgggaattagagtgtgcaaattgcccagagtcacacagttagtgaatgatggtatcaatgtatctctacatacagtcatattggataatgggaaatttaaaaaaaacacattttaggggtcaaggaccacaaaacaaatattaaaacgtttgaccctcctttgttcagatgtttctcttcatattatttatggtaactttctatgtctcaggtttcctcacatgaatacatgagattttaaaatgtactgtaaagacctgtgaggatcaattgacaattcacctgtggtatgcacgctgcaaggtgtcgcccagaatagacgctagatgagtgccagtttcctgttattccacaacccttctcttcatggaaaacattcatggatgcatacaccagaaacaacacatacgcacacatacagacatattcatgcaaatgctggactagtacttataaaaaagaagagctgctatatagagcatcgacctataaaattgataagcattcagttaagcatggctgtacctattactaatgccactcagctgatgcatccaggatttcacaagagaactcttgtgatgtgtacaaacaacatcaagtgactgaagctggaagggtatgtgttggattgggtggctgagggcaggagtggactcaaacacatccagtacaaatcatcaaagggtaatgtgctctatcctaaaaatctgtgattatttctagtttgcataggacctcagagactgtacaatttcttttcatattcctttgtgtattagtcactcagtcctatcagactctgtgatcccatggactgtagcctgccaggctcctccgtctatggatttctgtaggcaagaatactggcatggggagccattccctcctccaggggatctttccaacctgggggttgaacccaggtctcctgcattgcaagcagattctttaccatctgagccacaagagaagacctcatatttctatccctggtagtaaaataaccctatatgggctcacagagaaatcaaccttatatctcacagattctactccaggatagagggagaattaataagcctagccattgaacataaaaatagggagaaagtgctgtgatttacactgaatttttaggtaaagggaatt

SEQ ID NO: 39267 - DNA, 732 bp, Bovine  19866880455152
tttcgttgtattagttgagaacctttgaatctgtcttgaaaaacaaaaaaatcaaatggaataatggcaaagacttgtgtcttcattaaggacagtaattaagtaacctttttgtgagaaataaaatccagtgttggttaagtacagacagtaagatagtaatgcagggaatatatgaataaaagcaaaaccatctcccaacttagaagtcatctccacaaaggtaagagagaaagaaaacaattatgttattgtataaacattaaaccacaatgtgatacgaataacaggcaatctaccaagagattacaaagacaaaaggaaagcacacccttttatatagtctggcaaagacaatcttttccacaacatgttttcaaaataaatgattgtcctaaagaaaaaaaacgtcagcaccttcctaagtttacctgggaattggagtaaccatctgtgctagctaattggctttatccagaggagaaacaattacactgactaaaaaagtgatatacatacatatacataaaatatttccatccttcattttatatattgagtaaattcagtattggctttgccaatgcctgctcatatggtttacatcttctgaactgagggatgattaacaagtttcgcattcctgaaacttgtcaagctttatacccgtttcagtccattttcagcacatcatattattcttccatttaaatttcatgtatgtcctttaca

SEQ ID NO: 39268 - DNA, 1715 bp, Bovine  19866880487454
acgggatcctgagtcactggtgactttataacatgcctaacccttcatttagggccctcaaatctacaactactcactcaaataagagtatctactcaactaacctcaaaacagttgaaattgagtcactgaataattgtgattattataatcacattaattgtgatcataaatagatgaagtttaattactaatgtgtaaacaaaattggctcatatccaggtaacacatgaaaatatggtaagtccatctttgttctaatgttcaatgcactgcaatatttttcacaatgctcttgcaagattatcctttaaccatcctggagaatggttaaaatcatgattgtgccttaaggtagacacatacaagccagatataagcaaagaaatgagattctataaaatgacaatataaaatcaatctttaaaagtacagaggcttcccaggtgactcagtggtaaagaatctgcctgccaatgcaggagcttcaggagacttgggctcaattcctgggtcaggaagatctcctggaggaggaaatggcaactcactccagtattcttgcctggagaatcccatggacagaggagcctggaaggctacagtccatgagatcgcaaagagccagacacgactgagtgactgagcaagcaagaagtgcagtacaaaagtcattagtgttctaaacaacagtatcaaaaataaattggaaatcaaacatacatttcctcaaaatagtcattagaaatgtatcacccattcatttaacttgtgttaaaaagcctcatgattatatctgcactgagtacttttgcaggaaactctgtccctaccttcaagataattgatgtttgaaacagaacacttagctataggtgcttagttgtcacagagatttgtttgaaatcaaactttgtctctgaaaaattgagtatgaattaaatgtcaagcaaatttttgagttataatttagagtgactttccgactttcatttgctaaaatgggaaccacaaattgcttgagatggtttcagtgctttttgcagaaaataatggaagtcaaatttttaatattaatattcttacaaaaaaattcagtagtaacctttctcaatcattggcataattcttttctgttgtttgtttccactgtctttttctctcttttttaattttttaattgaaggataattgctttacagaattttgtggctttctgtcatacatcaacaagaatcagccataggtacaccccatttcccctccctcccagacctccctcccatctccctccccacctgcccaccctaaaagcctgtcacagagaccctgtttgagttccctgagtcatacagcaaattcccattggccatctattttgcatatggtattgtcaatttctatgttactctctccatacatctccccttctcactcctctcctcccaccttgtccataggtctgttctctatgtctgtttctctgctgctgccctgcaaataagttcatcagtgccatctcttcagattccatgtatatgtgtcagtatacagtatttatatttctctttctgacttacttcaccctgtataatgggctctagcttcatccacctcattagagcagattcaaatgtgttcctttatatggctgagtaatgttccattgtgtatatgtaccacagcttctttatccattcatctgttgatggaca

SEQ ID NO: 39269 - DNA, 1456 bp, Bovine  19866880494015
ttgagaaactagttttacctacagctcatttaacctccggttgtgtttgtgcagtaattttttaacatttgcttgacattgatcccaattttcaatttatatctttcacagtgactctgtgagtcatattctatattttttgtattttcagtttgtatatagttgttattaccttaaaaagagtaatgattcctgaatatccttcttctttggtgttgactaggccttccaaatgaacaatgatatcttatttttagtaataatctatgttgttcttatagacaccttattatgatgactaggtagacacaagggtttttcaaaaccaatttaagtggtgtagctgttgtaatatttttttaactcttaacagaattatatcttttatttacttttagaaacaccaataaatagtctatagtgactttgtgtatgttagtcactcagttgtgtctaactcattacaacctcatagactgtagctcactaggttcctctgtccatggaattctccaggcaagaatacttgagtgagaagtttgttctcttctggagggaatcttccccatccagggattgaacctgggtccctgcattgcaggcagattctttaccatttgtgccaccagggaaaccactgtgattatatctgcagagttcatatttttcacctttatttcagagtagcatagtttaagcatcatatgtcatgctcacatgttttatattcctttcataattcactgtaaaataagaatgttgtactcataaccaaattattttaatattctatgatcctgtttttactattactagatattaagtgttctttttgcatgttaaatttttatttgaaaataaaaccaaatacctttaatatatatttatataccatcttttgatttaagacagatggctaagaattgttattacaactaagaattattacagatatatgtgcttttatgtttttttattttatcttaacagaatttcatggaatgtcgattcattcattgtctctattagttgcctgattatctaataaagtgagcgaaatcactctgtcatgtccgactctttgcgaccccatggaccgtagcctatccggctccgcaatccatgggattttccaggcaagagtactggagtgggctaccatttccttctccaggggatcttcccaacccagggatcgaacccaggtcttctgagttgcagacagacgctttactgtctgagccactagggaagccctgattatctaataagtagtctataaaatctatgaggaaagtggtacaactttcaagccaaatatacgttttcagctttacctaaagtaaaagtcataaaagatacctgttctttaatgtttactgaagaatctaatgaatatttaaattcatgacttgaaataacttgggttaactgatttttattttcaagacatttc

SEQ ID NO: 39270 - DNA, 1060 bp, Bovine  19866880504862
tcatcatcggaggggttctgctctgtgggttctgctgttgcaaccgaaacaggccaaggcacagatatttagcccctgggcatcgtgtgccacatgcacgtaatccaccacggccagtggcagtgctcagtaggacttccaccagttacgtctaacacctgctttcagctcgagctgtggattatgatccatgtgttttatagacgcttgccagaaactgtaagtatgccaggcaggagaatttgctttatgaccgctcttaaattgagatgagaagtttaaagggcatgtagattgtagtcacctgtggcaggaagagaaatgacttacttcggaccctctaacctcatgtgtattaaatgcatttattattctagactcaatcttcagtccaatttgtgtaatctactgataaattactcttttttcactatcatatattatctattaaaaggtctgaattctattgctattgatatgccatagcaataaaacatatttactaacatgatgacaaccaaaatgatggcttctttcttttttaaacaattagctgaaaaacaatggacatcaaataatgcttttaattgaatttatcaaaatatggaaatactagttcaatgaaaagatttgttaatcctttaggaaactcaaatgcattagcaattaaacagttttagggaaagggagctttgatttctgctaagatatttaagaagatgattttaaagcctctaatgtatatagttaaacttgcttagaattatatatacaaagaaaaacaatttataaatgaaaaataatatgctttcaaaacttatgatgtgtacctacaagcaaacagaattatctgtcttgataagatacaacaatagaagactgtgaacactcaattcccatcaaaagtaaatacagccccgattaatgaattaaggtctaggtgttgaagggaatggtttctgttccttgttttattctttagtcattgcacaggtctatacatgctaagtagaatgaggactcaaggtcatgattcaggcagttaggccaaaataagtat

SEQ ID NO: 39271 - DNA, 2242 bp, Bovine  19866880520509
atgcttacttaatattaccatattaaaatgtatcaaaatatccagaattatgttatgaattacatccaaatgcaacatgaaatgaaaatgtcaacttgtctgaataaataaaacatttgctcaaccactgtttatggtgtcatcctactaaatacaaggccctttgaagacagtagaagctgatgtgcattctgcctttgaggaattatctatttaatgacaggaagtcacagtttcattgggaagcttatatgctaatggtaattgtgtgttggtagtcaaccacaagtataaactccttgttggcgtatgtgtgttcctgacaaatctttggaagtaagcatttggatatggaaaggtcatatcctttaaagatttcagtccttatacaaaagtctctgatacccctaacctaatattttaaggccaacttctatttttgtagttatacttaataagataagggtaagatattacaactcttgaggcctgaaagagaataaaaacagagagaatatcagagcaatttagacctagaatgaagcacagattatctggcttaacccttaagtttaccagaagcctactgttcaacctttagatcgttagtatgtgagaaacgacaagacaactcccttgatcactttttccttcttcttccgtctcccctccccaccttactgtattcttctggagtactaaagggacctcccggggatgttttcattttgagcagaagacagatgccagtgccgatttgaagacatcacatgactgagcaactaagtaaacatcatggttttaggaagggaattgggatgcagcctactccttcatactgatgcagcctccttatccatgctcttcttaatgatcatagagcagtgttggcagactttttctgcaaagggtcggagtaaatattctaggcattgtgctccctttcatttctacccaacctactccactttgccgtgtagtgtgaaagcagccatagacaatacaaatgagtgtggcaggggtccattcaactgtgtttgtagaaactgaaacttgaactttatacaattttcacaggtcatgaaatagtatctttcttttaattcttttcagtcatcggaaaacaaaaatcatgcttagctcacaggttgtacaaaaacaggctgtagtcagatttggctggtgggccatggtttttctgtcccttttgtagggaacacttatgggatgtcccttatatgtatactgattaatctaacctagtcagagttgatacccaacgaaaataaacataagggggacataattgcctcaaccctcgttgttgttcttgttgttgctttgtcactaagtaatgtccaactctatgtgaccccgtggactctagcccaccaggcccctctgtccatatgcttctccagggaagaatactggagtgggttgccattttcttctccaggaggatcttcccaacccagggatcaaacctgcatctcctgcattgcaggctgattctttaccactgagctacctgggaagccaaccctagttaggatcccagaattttcaggattattttccttatctctctacatttcaagatgatcaggtggtggaccacacacataagataactgcccacatgacctggtaatcaaactttgttctatgcttattcagagaccaagttctgctggactgtgccccatatttatttcttatttattttcctttcccctcatctttgggattctccgcaggtgatgtctgccagcatttatggaaggcagatgcctgtctgtctactgatccactcagtaatcaaggaagcttcccagggaagaagtgtggataaagctccatataaagaggtgaggtagttgttgggagggcttcaaactgctgagtcattgctgcgtcatcatttacaagttgccatttctgttacaaggcaaatgtgagggtgtgtgaatttatgtacaatttataacatcaaattcagtgaaacatttgccagtagctttatacagggtggatcaaagtaaaggacagaagcctagagactggaaagaaaaggagattaagatttcatcacagctccagatttcagccacacatcaaaggtgtttgttctgttggcttgttttaagaacatgcttaaatgggttactgtataatttatttgtcaaagtaaggattttaaatgccgttaaactaaagacattatgagaaaaccaatttt

SEQ ID NO: 39272 - DNA, 2290 bp, Bovine  19866880794095
gctgagtggaagaaaggaagggagacagagaagatgagattactgcttaagtttataattttatattggaaggaaaatagtataaacattgtcaaaaaatgaaaacaaaatagcttctggaaaggtttccctagtagctcagacagtaaagcatccgccagcaatgcaggagacctggattcaatccctgggttgggaagatcccctagaaaaggaaatagcaacgcactccaggagctttgacaggaaaattccatggacagaggagccttggcaggctacagtccatggggttgcaaagagatggacacaactgagtgagtaaattccctggatggtcagttctttttaacaatgaaaaattagagcaactaaacattagactctaagttgttaaaggcattagaaaatatgtaactagaaaataaactagtaaaccactttctaactagtaaaccactttctattttaaagaaaatataaagaattgcatcaggaaaattagcctatagattgaacaccataatgcaatcattttcacttctgttgagttttatactcttatcttcaatcagtgaggaataagtatgtaacaatactttaaatctcttgcctcctctttctatttccctataactgtaaattaattgatacagtttggcagatgaaatctttgtaatactaggaagtatttttataggcttcctgggtggtgctaggggtaaagaacccatatgccaatgcaggacaagtaagagaaatgagttcaatccctgagttgagaagattccctgaagaagggaatggctacccactccagtgttcttgcctggagaattccatggacaggggagtctggcgggctatagtccttagggttccacagagttggacaccactgaaacaactccgcacacacccaagtatttttacttccttccctacaacactagcaacactttatctccctgcctagattttaagttttgaacaattactttagttaatagatagctcaaataatgactagtgaagtcacttcagtcgtgtccaactctttgcgaccccatggactgtagcctaccaggctcctctgtccatgggattttccaggcaagagtactggagtggggtgccatttccttctccaagggatcttcccaacacaaggatcgaacccgggtctcccacattgtaagcagatgcttttaccctctgaaccaccaggaaagtccacctcaaataggtgcttgattaaatataagataaattgaaataaattaatacaaaattagcttcctataggcacctcatatatccagctcatagaaagtcccggggtctttcaaatgtcatatctgaaacctgaaaacaaaaatagtattctctttatttaaaatatctgaatgtttaactcttatacaccataactacatttacaaaaagtttttcaatatttgtcatggtccaaataaagaaaaaaagaaagaatcactcagactatatgatggagtagccacactctccgtttttgtagaacccctcaggccactgattaacacaatcaattgagtaccagaccactacatctgattaagcactccctgattttattggcaatttaagaactccagcttaatactgaggaggaaattgagaagtattaaaactcatacatcttttttctttccaagagggaatacttcatttggtatccagtcctcactagataagggataatcaatggagacaaacacattgtatcacggacatgcataaaatgaataaataaaaaggaaaatatacccccaaacacaggattttaaccaacagccttactgttgagtggactgttctttccagtgaactcctttgcaactcaagttataataatgccagtaacaactaatgaaatgagatctctgctcctagaaatactaggaaccagcatattatttaatactctttcctgatttcttcaacatttcctatgaataagaaagataagcttctgtaaaaactttcaagagactcgaaacatgcctgaatagagaaaaaagaaaagagaggacaccaaggactgatggggtcatctctcaatctgatgttggaaaatggactcctataaaatagattgtcatattatcaattatccagggggcttgcctggtggctcagatggtcaagactctgcctgggggagatgggttcaatgtgggttcaaatgtgggagacctgggttcaatccctgggtcaggaagatcccctggagaaggaatggcaacccact

SEQ ID NO: 39273 - DNA, 1226 bp, Bovine  19866880818357
ttaaatatttgtcattcaaagcatatgatttgattgtgcaaatgttgttgacacaacagcagtgaaacttgcctgtgaaggcttcactatgcctaatgaaataaaagatttatgagacctttgttgttggtgttgtttgtggttaatgcacaataatctgtattgaagacagcaatacctgtgatttgccacacctactattaaggaagtatagaagatgatgtgaagatggtgatgttaaaactcaggaaaccatctaccttttctacaacggcactgtctattcccgccaccatgatctactatggcaacaactacggggctatgaatatgataggcttagctgtggctatcaaggatatggtgactatggatatgactgctgttgcccctattactatggaaaatattggtcataaacattctactgaaaaactctagagccactgaacccattatatttgtcctcttgtgaaacagagattctgctgttgggcttactcatctcatcctgtctcttcaaaaagcaacaatcaaaattgaaatctaaaccatcatgaaaataattcagatctcatctttccctggttccattgtgcaagatcataaagatttttttttcttaaatgcaatgaaaagtttccttttgttctctaagtatttcttttaataaatttaatgtctttgcaaatatgatacactttcacatcattgcatatggatgattgtaacaaaaaaacttgtatttactatcccaagggattgactgaccccaaagcttacctccaccctttatttcctagtttttgtctctctgcatatttctcatgctgtttaaagctgaatttccatgggacatagttaatttcttcctcatcaataaattcaacttccttttacctcacaaacaaaatggctcaaaacacacgtgaagtctggtagctgcatggggttgtctgtccatttccctagaacacagaggaacattttaagtggtgcttctgtgagttttccaggtgtctgttttctatttgctggtatactcttagttgcttgatgtcattcatatagaatttgtgtcaagcttgaaattgaatatataagtcctgaggcagccctaagaacctggatgtcctttttttttttctaattttattttatttttaaaatttacataattgtattagttttgccaaatatcaaaatgaatccgccacaggtataca

SEQ ID NO: 39274 - DNA, 1863 bp, Bovine  19866880848303
taaacatctctgtgtttatttgcttttcttacaatcaataatgttaacaatgcattgctatttgtattttatgggtctctcatgtggccctagtggtaaagaatccatctgccaatgcaggagacataagagacacgggtttgatccctgggtctggaagatcccctgaagaaggaaatggcaacccactccagtattcttgcctggagaatcccattagcagaagagcctggtgggctacagtccatagggtcacagtcagacacgactgaaatgacttggtacgcatgcatttgtattttaaaactaatgtgtatggaactacgtccatgttgtcttctctggtctatgttccaatatgcttcacacgaggcttctgtatgagctagcttgatcttcgttctgtttgtatataaagcttccagagctatctttatccctggagatacttagtgactcagccatctgtttttcagaaagattcttttcctgataaacctctctccctagtcacttgccatgaatgcaggagaactggtaagggaatataggtcacgtagaacatactcattagacttttccccatagaagagccctttttttggatgaagttcatacggaccccctacttttgccttggagtgaattcactgctttgcaggccactctgctgcttatcacctggcaaagtggcaggacacaccctctagacatgcctgaatatgtctgctcactaggaaaaatagagttcattactaaggtagctcttatttctactctttctatgtctatagtgatgttgatatacatgctttggataactgtcacattagagcctaacaagatatctttaagacagggtgttcattttcattttttaaatgagctgaacaagccacaccaggggttaaatcatttccccataattcagttcagttgctcagttgcttccaactctttgtgaccccatggactgcagcacaccaggctgccctgtccatcaccaactcccgggagtttactcaaactcatgcccattgagtcggtgatgccatccaaccatctcatcctctgccatcctcttctcctcccctcttcaatcattcccagcatcagggtctttccacatgagtcagttcttagccactgaccacttaagtggccaaagtattggggtttcagcttcaacatcagtccttccaatgaatattcaggacagatggccctgagggtagatgtaactaattgatggtcagaattaacaatcaattcctcattttgaggatatcctaaccccatcaagaaggcttatttggtttctgtttagaacagagttttattatcacatttacaaaaatctatttggcaaggcaggatggttctctacaggtctactttattaaccagaaaataaaacaggagacaaaaatttggctaaacactgtttgttgtaggcctgccaaaggaacagagtggccgctgtggagaaaggcaagattggacacctaaagtctaactgaccaaaggtgggaggaagtgaaatacagatctgaaggagaaggaaataagaaggcttggcatatggggagggatcgtgttatatgagtcactgagtaaaacccaggaagggagaggttagttaaagagaagggaaatgaatcagttccatactgcagaggcaaggattaaaggataaagttggaaaatcagaagaggaaaccgtagattagattcaggtcgacttttgataaggccttgaatttatttttctgaaaacgtagagttcacttacatttacataaatgtcaaattaatcaatcaaatcattctgctgttgttagtgtctttcacgcaatgcgttta

SEQ ID NO: 39275 - DNA, 1832 bp, Bovine  19866880873981
gctcctctgtctatggagattctccaggcaagaatactggagtgggggccatttccttcaccaggggtcttcccaatccaggaaccaaactcgcatctcttatgtctcctacactgacaggcaggctctttaccactagtgctacctgggcagagcttccagtggctctgtaattacataacctcagattgcttttctttttaatttgtattccactgcttttctactgactttggcaaaacccaagtaattttatccatgatgatcaaagcatggttataaacttattagtcaaatgatttccagatagtcaaatggaaaacaaaaacaaccaaaaaaaaaaaaccccttcattttctattttggtttttgttatttggtttgtttgaacttgccttggcatttgccctcctaaccgaggccaatttatcagggaaaaagacctaatctgaaatttattcccactcttgtccacttcaatctccctgcctagactaagagtaggaaaatacagagtcttcatgggtcagaacttcaattaaacttttgggtaactgtatggccaatgaagacagtacggggtgtattctaaagaaatattatattagctttgagacacaagtccactgaaatactgagttttaattataagattatagaatgattcctttgccctaaaccttattatcacaccattgagggtccagtataatagtaggttacagcagaaagagctacaagatagagactctttctgaagggcatttagaaattccaaagccaagaggaaaccaacctacctgcctttatctgcttccacttacaacaaatacctaactcagtccaacccctaatcagattaatacaaattatcacactaaagacctctttcctcaattctcagtacccaataaatgtatctgactttcaaaaacaaaaaactacaaggcatgctaaaaggcaagaagaaacacacttagagaaaatcaatcattaaaatgagtcagatataataaagatattggagttaataggctgagaatttaacaatctatagatatgatattatgctttttccatttattctattaatatattgatttctattcatgattttctaatggtaaggttttcttgcattcttcaaataaagcttggttgtgatatattctctattccgtctcttagtaggttaaattttcttatatattcttaagaacatgtgctaatgagaaatactggcctgtactccctgataatgataatatatttttatttggaaatattgttgatttcaaaattcatagcagtattccctctttccttattctctggaacaatgtttagaattcaccagtggaattatctggccttaaattggtattttgggaagatttttaatcatagctttaatttctatatgagaaaactattcatattttttcctcttgggtcaagttttataaatttaacttattactataatatataagttcaagataaatgattttgcttttattttataaagtattttgaatatactcaaaagaaggaagaataaatacttcaaaaaactttatagatttaactattgttaatgttttgatatagttttttcatgtttattttctcaagagtgctaaaataatttacttcaagctagtttatccctattttctttgaaattaacatgaaaattttcaagaaaaaatgaatttaaaaaataaactaaaatgtgattgtcatcacagggtctcttcaacctttagacatagaattcctttgtatggctggtgaagaaaaacatgcatattgactataatgaggaagat

SEQ ID NO: 39276 - DNA, 1874 bp, Bovine  19866880923699
atagtgcttccaactgttagtctaactctccatttttgcagattaagaaacgaaggctcatatgggaatgcttccaatgcttccactggaatgggaacaaaatgcttccaagggaacaaaaaaaatagaaatacagtttaaaatatgatataaatattcacaacatttataggtgggcacatatatatgggtgctataagaaaatttttctgattttatctgtagctttaataaaatctaaaagcttgcacaaagaaatatgacaattaggagacagtatttaacagtgtattttcccagtctgtacataattcctgtacttaaaaattctagtctatctcttctttaaagaaaacaattgtgaatacttaagaaagcattttctgagtggctatattttctttgaagggcattcaaatatagatcatatgtagcaaggctttcaaacatttgttgattacaaatacaattttaggtagtctgacaatcatccttttggggagaaatattatcaataagagtagattcactgaactagatattgcgccaaaactagaactgattacagatatcggatggaacgggccagatttctgaacaatcacttcctagagacatgtgagttaagtcaacagattgctatggaaacagaaaaggaaaggaacacatccttaggaacagaatgtatgatctgacagtacacatttatgctgtcacagggaaaggagaaagaaaaatctctacttcaaggcagtcaatacttttgtggttcttgtacttcctgacaaaatatttgatctgcttgggcacccaggagaggagacacagctggcaagggatcgagatagattctaacacagaaatattacaacgcactcttacaaatgtgttatagaaagccatcagatttacaattctgtcctccaccagctccctccctgtcactgagggaacacacactagaactcacacatcaaaatgaaatcccaaggaaatctaagaaaaatgtaaacaggaaaaaaaaactgtttaaaaaaaatagcaagttcaatgtcacagtgagaaaacatttaggttttttgtccaaaagctgttgctctcttcaattgtatcttaaaatattcatttaagaaaattgaggtggggggctttagatattcttttggagaaatctattctaagataaaccgagaagatgaagaagggggaggatcaagatggagagatttataaacttgtttgtcgcagtgatctttattggtcagggatgaactgtgggatacttgtatgtgctttactcctgttatggaataacctgcatttcctccaaattcgtacactgaagccctaacctcttaggtgactatatttggagatgtggcctttaaggaggcagttaaagtttaaggaaatcagtacgtgggaccttaatccttatgaaaagagagaaagactcctgagatgctcacactgaggaaggaccgtgtgaggacacagcaagaaagcagccactgacatgctaacgaggggcttccccggtgactcagcggtaaagagcccacctgccaatgcaggagatgttggtttgatccctgggtcaggaagatgccctggaggaggaaatggcaacccgctccagtattcctgctggagaaccccattttcaggacttgactgagggtctgaacacaaatcaatactgagatagaagccccattttaataacctgtgaaaacattcacttctgcctgacacaaaatgaaaaaatgaggactaaaactttgtttatttttgccttttgtagtacctgaactcatgttcctagggcctcacactcagcctactcttttgggaatggtagttcagtaacatta

SEQ ID NO: 39277 - DNA, 2380 bp, Bovine  19866881004546
atcttttacttctgtggagtttcaaaaatattgatatcaaatttttgcataaacatgttcccaagacatatgctttaaaaatagaacataaaggtattctttagtttctgaacttgaaaatatgcatgattccatgtccagtaagttgacataatgttgacactgtattttgggtaataaattactatacaaaatcacttagtcagagtgcaaaaaggtcaataggaaggtaatttatattcagaggggtttcgcttcctcatcataaaagcttttttaattaaggtatacatatgtggataccatagaatgacttcttttacgttacaaagctgttacattaaattcagactaaatcaggattacagtaaaaataaatatgaatattttaaagcaattattagacaagaatttaaaactatggaataagaaaaatgagatttcagaaatttaatttttatggagtatagttgatttacaatgttgtgctagtttctgcactacagcaaagtgtatcagttatatatatacctatatccactccttttttagattctattcttatataggtcattacagaatattgggtagagttccctgtgctatacagtagatttttattagttatctattttatatatagtagtgtaaatatgtcattctcaacctcccagtttatccccccttcccctccccagctcttggtaaccatgcttgttttctacttctgtgactctatttctgttttataaataggttcatttgtactattatgtttagatttcttagaaatctaaagaaagcatatcatatatttgtctttcactgtctgacttacctcactctgcattagaatttctaggtccaccttgtcactgtaaaaaaaaaaaaaataatttaaaattaaaatttatgtttggggtctaaaaattgcatactcaaataacatgtattaaatgataatcacaaaaataaatatatatagccaagaggggaaaaataaaaaggaaagggagataaagggaatagaatttattgagtaaaattcctaaccagaacactaaataagtatgaaacataaggaaaacaattatgtaaaaataggtaggcctcattttagaaagaagaaatttgcatttagataatttaatcatataatcaaatgtatttacagtatatgtggctttccaatgtttgactatatgtttgatttgattcatccatttttatggaagaatattgagtccaaattatcagggactgtactcagagctggtttttcaaggatgcacagaacaggagttgtctttactgttttaaaccggtataaagagatctgaatggaaaggtattagaaataatgcaataaagataaaagagtttttcagtaatccagggatactgtgaccagagaatgtgttggctatggcactgtaaagtaacgttgtctgtaccagagaatttgtcaagtagaatttatagttttgaatttcaaggcagactgaaaaggtaagaaactgaaggataagaaaaatgcaatgggattatatgttttttatgtttatggttagggatgaaacagcagagtgttcagattagaccagtgaccaatatcagaaaaattggtagaatgatttctcaacagaaggaaaaatgtctgataatgaaacttctcaaaaattgaagttggcagccttgtgaaaatccctgttaaaggcattcaataaagtactcgatcaccacttattcctttgttgtcgaaattcaagtatatccagtggaaagaatgatcttgactttatactcccttccaattcagatttcatggttgttacagtgaaaaataatctaaattttggagtctgccagattctgaaaaagttgattgaaataaaacatagaaactaagataagcaaaaaaaaagaaaaaatgcccccctaccccaacaaacaaagcaacatgactgaatgtttggtcatgaaaggttgaatgtttggtataaagttacatttcaattagtgaggcaagacatagttttaataaactttggcaagtgctttgacatgtgtctgcacataagaaccaggaggtgctggcggtggtggcttagttgctaggtcatgtcaaactctttgtaaccccatggacatatagcccaccaggcccctctgtcctttggatttcccaagcaagaacactggagggggttgccatttcctcctccagggcatcttccagacccagggatcgaacctacatctcttgcattgcaagcagattctttcctgagctactagggaagccccaggaccaagaggaggatgatccagttcagacaataacacggaggaaaggcatctcacaggagcgattacagat

SEQ ID NO: 39278 - DNA, 1248 bp, Bovine  19866881023093
aaaaggaaaaaaagaaaaaaaatgggtaaaatttagatgaaaacaagttggacaaaatatatgtacatcccttttttcctccatccaatatgctaccatgagcatttttatgtcattacacatcaatgttcacctaatcatgtttattgttgttgctcagtgtctaggtcatgtccaactctgtgaccccatggactacagcctgccaggctcctctgtccatggggtttcccaagcaagaatactggagtgggttgccatttccatctcccattatattcataatgctgctatattccattgtaagaatgagcataaatataactgaaacatagtttatgcaatccactgatcaaacgactttttttaggcttatagcaagataaaggaaggcattttgtaaactgtctctttgaagaaaattatatttgctagcaattacacttggtttcatatagcacatattctattaatgttgcttaaacaagtaagatttttatttttctctcttaaaaagggtagagtttggcagctcaggtctggcacagctactctgataattcttggagaataaagactctgtccagctttcccttcacagcgatccagcatacggcttttgttctcaaagtctcagaacagctgggtgacctccaggcaaaggggcaaaatgtgcaaaggagcaaagactcaagctcctgagtctgtctgcctccatcagaagaaaacagaactttttctgaagcctgacctgggtggctcccacttagtctcactagccagatataggtcccatggcaaaactaggtcaaggaagtgttgagagaggcatatttttaacaaagcagatttctactccaaaaaaaattccctctcttagcaaacaaggaaaaatagattccgggcatgtaactcttggtgtccatcacagaagtatatgcataacagttacatcttattcactggttgattaagtgaccagtgatgtcttagatctgacctacagggaaagttgcatgtctctaaacaaaattactgttgcacataacttatagcctaggtccatccatttgtcaaatcttttaaattagaattctataaacatttcccatatgtaataggaaaggagagtggagagaaattcatctatttcttattcctttcacaacaggcaggcaacattctgctcaagatttcttagcaaaataattaattcaattgtctttgtgctaaaaagatgaaggctta

SEQ ID NO: 39279 - DNA, 1607 bp, Bovine  19866881113415
aatgggaaaccaaaatgtgaagaagaaaataaagatcaccttttaaatcaattatgcagagaagctttgttaacagcttagcattttagctttatatatatatgtttacaaaattgtaacaatgtggtatattcagttttatttatttatttttttcccttaacagcaagagtatttctagatcattagtagtagttataatggctgcatttgtatagacattgtcatgatttatctaactattctactactggtagacatttatatttctctcaattttgacataataaaaagtattacaatgaaacactgtacttctatagaattatatatgcatgtttatggttatttcctatgagttaaattagtagggattaaattaatggggaagctcatataaactttctatctctttctctctcttactctctctccctacctccctatggtagcaaagctcagaattcaaagtatatgttttttccaccactagaacttgtcttcagttagaagctttcagggatttcaaagcattccttagctctttacttgggcattgtcattataacttttcttaaaaacctatatctctaaataaaaaaaattgttcatgctgactgtcatgatcaagtaatacagagatgggtaaaggaaaagtcagtatcacctgcttgtcacatcccagtcctttggtcccttgtgaggaggttaggagggggacattctgtacgtggtgttattttgaagtcaaaattttctcttttgcacatgtcttagctgcatgacttgccttttgttttgtttttttttttctgaaaaacacctcagtgtctggttagaaacaggataggggtcagtttgaacttgttgtaagagtgctgtaagagttacctgttgaagatatgataaatatgaaagacatctgaaaaatatccctgatgtaaatgttgaaaatgaagaaggacatcctgtcccctaatggattttcaagtgctttcaaaattgagaaaacactgaacaaatctgaaagacagttgaatgctatgtcatcagacagaagatattgttttcaattagagatattgcattgctatgtaaagtaaatgttagaatcatttcatttttaaaaaattcattttcacaatgaagaatgcctttcctctcagtctaggagaatctagacttttatattgattgaataaattagacctaaatgggcagtgctacatttgagtgactgttagtctctcaattaactaaaagtgtctgactctttacaaccccatggactgtatagctcactaggctcctctgtccatggaattctccaggcaagaatactgggagaggttagccattctcttctccggggaattttctccacccagagattgaacccagggctcctgcagattctttaccatctgagccaccagggaagccatttagctgtttactaatcaaaaggttggtgagtcagagcaggcctcacggtaggcacagcttataagcacagtaattagtgttcattaacaaatatccaacaagtgaagtttctgtaacaagcattcctacttaacagttcttggaaccaataggctagtatt

SEQ ID NO: 39280 - DNA, 3271 bp, Bovine  19866881175266
tcccttattttattttttgaaatatgtatctctacatatttatgttgaatgaagaaaaaacctgtacctttaatatgggtatgtcccgtagtatatgactcctggtaagtactgagatagtccaaagttgtcttattcacctctgattcaaaatttagctgaataaagcaacagtttaataaagttggggtgtgtttttaaaaatgtgtatgagtcttcaaagtggatagattagaagttcatcctagtcttgtcgataacatacataaaaagggttgaggctttaaaaaaaaacaacaaaaaaccagcatgttgaggagctgtgtatatgtcagaatcatcggaccttaaaatttgcaggattgagaagaaaagtgaagccaaagaagtgggaaggagagagtcaatgataaaaaaaaaaagaagaagaagcaacaaacaaatgtaataagaagtttgtattttcattttataggaatcagtcataagaagccatcaaaggcttaagcaagagtgaaatacattcagttttcgattagaaagcatgttctggtcaagacatattcattggaagagaaatatagggagatcattcctagttttgtcttttcaaaataacttccactaaaggttttgggtctcttaaggatgtaggatcagagagatctagaaagcagtttgaggaataaaccatcaagctagtccactactgtgaggtaaaatcacatagttgagtgtactaagtcctagccacttctcttgcaggcagttgaggttagtcacacatgtgttaaaataaagaaaaactgaagcaccaggttcttagttctgacttaaatgcatttattataatccaaaccgaataaattcttcccacacccaatcaacactgaagagcattgcaaaccataattttatgctaaggagagatgaaaaaaagatgaaaatgggaaaggaacagctttcattgggtcaggcacaggaaaaatcaagaaaaagcagtcactactaggaaaagagcagaagcacgtggagttcgaattttcatcttggatcttcagggtgagtattggcctggaataaagaagctgcaggcttccttaggtagagcaagacggacggtaaggactgaacacataaggcagagtttggcatccactgaagacagggcgcagaggtctgaggccgctggacacaatgctgatgggatgaaaaccacagggcaaagaacccgaggggcgatatccacaagggagaaggcccgagggtcgcgagcagctggacacataggtcagcggtctataagacactgagaggcaggatccagaggggtaagaagaagctggaggaaaactggttccgtggcagggtcttggcacatagcaaccagaagaagggtagctggaagtttcacagctgctgggctcgcagttggctggctggcagctggtaggttcactgcaggtctcctggccattgctcaggatccaggttcggtcctgacagctactgggcaagcagagagcatctccgacgctcacactcggagtgtagaggccgacggaggaggcgacaggaatgtgacagggactcctgagagaccccaaggtgtagtttccggagcagtagttgtggcaagacatggcgaggtttcaggagcaggttgtcgtccgttgcaaagaagtgagtgtctcaggtttctccttcatcttgctgtcttatataccccgaaagaaggcggtgattctgcccagactcttctgcattgtgtgacgccgcatcacaactcttcattagagtccaggaagtgatgcttccacctcccataaaactggatgttccttgcaaggctttccattgattaaggatatctataaagcagcgtgactggattttaatagtatctgtgctccttaaattactcaagcaagacagatatcttgaaggtcgttttccttatttcaattataaccgccactccataagagaacaaagctggtggagctgatggaattctagttgagctgtttcaaatcctgaaagatgatgctgcgaaagtgctgcactcaatatgccagcaaatttggaaagctcagcagtggccacacaactggaaaaggccagtttttattccaatcccaaagaaaggcactgccaaagaatgctcaaactaccacataattgcactcatctcacaggctaacaaagtaatgcttaaaattctccaagcaaggcttcagcaatacatgaactgtgaacttccagatgttcaagctggttttagaaaaggcagagggaccagagatcaaattgtaaaaatctgctggcagcatcgaaaacagcaagagagtgccagaaaaacatctatttctgctttattggctatgccaaagcctttgactgtgtggaacacaataaactgtggaaaattcttaaatagatgggaataccagaccacctgacctgactcttgagaaatctgtatgcaggtcaggaaacaacagttagaactggacatggaacaacagactggttccaaataggaaaaagagtatgtcaaggctgtatattatcacccgacttatttaacttatatgcagagtacatcatgagaaatggtgggctggaggaagcacaagctggaatcaagattgccaggagaaacatcaataacctcagaaatgcagatgacatcacccttatggcagaaagcaaagaacaactaaagagcctcttgatgaaaatgaaacaggagagtgaaaaagttggctttaagctcaacattcaaaaactaagatcatggcatccagtcccatcacttcatagcaaatagatggggaaacagtggctgactttatttttctgggcttcaaaatcactgcagatcatgattgcagccatgaaattaaaagacactttatccttggaaggaaagttatgaccaacctagatagcatgttaaaaagcagagacattactttgccaacaaaagtccatctagtcaaggctatggtttttccagtggtcatgtatggatgtgagagttggaccataaagaaagctgaatgcagaagaattgatgtttttgaactgtggtgttggagaagactcttgagagtccctcggactgcaaggagatccaaccagtccatcctaacggagatcaatcctgggtattcattggaaggactgatgttgaagctgaaacgccaatactttggccaactgatgtgaagagcttactcattggaaaagaccctgatgctgggaa

SEQ ID NO: 39281 - DNA, 1800 bp, Bovine  19866881240357
ggtgagaaataaaatacatttaatgatttgctacataatacatagtgagcatgaaaatacctcttctttatgtggcttaaaagtaagtgcttccacttagaaaaggctttgtaataattaagcagagcaagcatcactacttaattacatgaaaaaaaaatgaaaggaattatagtgaataggaagagactatgaatatttaaccatcattatattttctctgaagcaattttcttcacacatgtttaatatgtaatcttaaaattcagaactaagacatcttccttctgtctatatacatttattattactattttattaggtgcaataagatagatgattccttggtacagaatttttatatattaaataaaaatatgtatgcatatgcatgtagactaaaaattttttaaatcagctagttataattaacaaagttagtttcagtatttatctttgtagttaggggagctttgataaattgagcttaattgggagcacagaaaataagcattagtgctctcaaatagtatgcaatcatttatgaaaatatcttcatagcagcatctcctttacccctcatttgaaagaatccttatgcaccaacagttagctgctaggcatttgcatgtgaggttattcaaccccctacaatctacataaagtaatgcatgctgctgctgctgctgctgctgctgctgctaagtcgcttcagctgtgtctgactctgtgcgaccccagagtcggcagcccaccaggctccctcgtccctgagactctccaggcaagaacactggagtgggttgccatttccttctccaatgcatgaaagtgaaaagtcaaagtgaagtcgctcagaccccatggactacagcctaccaggctcctctgtccatgggattttccaggcaagagtactggagtggggtgccattgtcttctccgaagtaatgcataaactatgtattttatatatatagtttatgtatatattttctatacatagttcatataataatttttttagccaagtgcatttattaatatagtacgtgtaaaaaattacatcctaaatacaactattgtgatttagatggaacaaagtgaagctggactgcaaatgaaggacatttgtccctgagttcatatttttaagtaccatagatttgagtttcatttcaatgaggtcaaaaagttgaccctgagttaggagtcaaaaatctattgaaatcacctctttcctgcggttttaacttaggctacttgaacttggtcccagttttcttacttttcaagtgataattatactatttacctctcaatatagatgtgataattagttgaaaagtgttttttggaaaatatttgccatacaataagggcttcataatttagtttttatattcttggcagagatattatcagtatacgaaataaaaagtagctactttaagaccagtgggtctcatgatcgaaaatcttgtttgtatatgtcacatgactatctttttatttggccaagcagagatttttaaaattaaaagtatgtgtgtatgcatcagtcatgtctgactctttgggatcccgtagactgtagcctgccaggatcttctgtccaaaggatttttcaggcaagaatactggagtgtgttgccattttcctcctctagggtatcttcccaacccagggaacctgcatctcctgtgtctcttgtattgtaggtggattctttacctgctgagccatcagggaagcctaaaagtatggtcagcctcaaaacaaatacagtcatcttcatt

SEQ ID NO: 39282 - DNA, 1005 bp, Bovine  19866881365380
aaaatttacacgctataaatttgatagtagattactttttaaaagtatttgggctaacatctccatcttcttagctaatataatttaagtccacttatatgaggcattccatattcatccagctggtaaaaagagagccgagcagaattatttttccataaaactcatttgagtcttacagagtatcatgatcaggcaatgatatcattgtcttttatgcaccatttatatcacacatatcagttgttactaagcgtaaatacatgctttgtaatatggcaaaccacatcagggatggctgagaaaagaattgcagtaaaatataatgctgaatgcagggaggaaagaaaagagccatatctcaacatccttcaaatgaccctctgagtcacaaattaaaccagggatgatgaccaactgttctgagcatacaatgatgccttaaatcaaaggccatataaactataaactgtcttcgactgtaaaattcaagtaagcctatttaccatgctgctaatctatctgattgtaattagacaacacattaaagagattgtcttcttttaatttttaaaatttatttatagataatttttgactgggctgggttttgtcactatgccagggctttctctagttgaggccaacagtggattactctctggttgcctagttgcaggggcaggcttctcattgccataggttctctagttgctcagatctgctctagggcatacaagcttcagtagtcatggtgctcaggcttagttgctccatggcatgtggaatcttcccagaccagggatcaaacccgtgtcccttgaatttgttggtggattctttaccactggaccatcaatgtattcctaaggagatgttcttatacaacttgtagtgtacaaagacattggagattggctgtcaagaacatctcacccacaggtgcagtgcacataagccttctaggccagcaggggatatttagatcttctctgatgctgttgg

SEQ ID NO: 39283 - DNA, 521 bp, Bovine  19866881567195
ggttcagttcctgggtcaggaagatgccctggagaaggaaatggcaacccactatagtattctttttaggagaatcccatgaacagaggagcctgatgggctacagtccctggggttgcaagagtcggacatgacttagcaactaaagcaccaccaatatgtatatttttccatatatggaaggatccagcagggtcacttttcactttcatgcattggagaaggaaatggcaacccactccagtattcctgcctagagaattccagggatggaggagcctggtgggctgccgtctatggggtcacacggagtcagacagactgaagcaacttagcagcagcagcagcagcagggtcaaggcaatgaatgtgttaaaaactgaatttgcacatttgtgccaatcagtgaccctagaatcactttaaatgaaaatatcaatttgtcttctctgcaggtagcagttaagagaataaagcaagtgaataaactcttagtaggatacctactaagcatttaaaca

SEQ ID NO: 39284 - DNA, 1851 bp, Bovine  19866880411805
gtgtcctgcatgctctttcctctgtgttcgcctcttagagcatgggagtctaagtgtaatggcacttcttacttggtgactggcttccaagagggcactccaagaaataggatatagaagccgtcaatcagtgtcttacaagacctgagcacagaatattggtatagtttcacttctatcatattctgttggtcaaagcagtaagatagtctcaccagattcaaaaggaaaggaccaagactctgcctctcaatgggaaaagtgtctgagaattatgaccacctttcattcataacagatatttcaccaaaatctcactggctttgcaatagagatggaattggtgaaaaaaaagcatgggcatttttttgtccgacatacataaattctaatcccggctttaccatttactaacagtgtgatgtgtatggtcctcaatttccttatctctaaaattgtggcagtaacataaatgccctagagtattgagagaactagtgaaaacaatatataaaatgtaagatatggcaggcaataaatatgcaaacctaacaataattgctgctgctgctgctaagtcacttcagtcctgtccaactcgatgcgaccccatagacggcagcctaccaggctcccccatccctaggattctccaggcaagaacactggagtggattgccatttcctcctccaaggcatgaaagtgaaaagtgaaagtgaagtcgctcagtcgtgtccgactcttagcaaccccatggactgcagcctaccaggctcctccgcccatgggattttccaggcaagagtactgcagtggggtgccattgccttctctgaataataattgctagcgtttattgaatacttagtaagtgctcagttcattgaatatgctttctaaatggtgtctcagtgagtcgttgccccttcctggagtgacgtgtcccacactggatggctcaaaaagagcagcacccattttctccagcttcagttgtgttcgtccttgagtctgctccgtttacctgtctgatcatttttcactgccttgttgcttggatctccatttccacatactgtttatttcccatttatgctgctccctaaggacccaagtgctgatgcacatttggcacttctttgacactgccttctccgtgtttgttctcagtgctgtcagggtggttcttgacagcttctcacacaatctgtcagcccctctgagcccgcgattgcctgctcatcagagccaagacactcgtgtctttgtttccgtgagtgctctgctgtcagccttcctttatacacggtggtgggtgctcagttgttggcctacccaggaacacgatgatctgcactttggagcaattatttaatttgaggcaattacttgtaggtgttctttaaagtgaagatttttccaggctgtgactaaattttgatacagcagcttcccaggcagttaaggaactacttcatacccagaaggttgtcgctcagtctgttgtcactggataaaggtggtgaccctttattttcgcagcaagctgagtttctattgcttcacgtcctgcaagcagtcagatggtttttgtgtttttaatatggagacaaataataaaatttggttttgatagaggtcacctattattagtctttctcctccttactctcaaaatatcagttcagttcagttgctcagtcatgtccgactcttcgaaaccccatgaatcgcagcacgccaggcctccctgtccatcaccaactcccggagttcactcagactcacgtccattgagtcaacgattccatctcatcctctgtcgtccccttctcctcttgcccccaatc

SEQ ID NO: 39285 - DNA, 1509 bp, Bovine  19866880597278
tctatggtttttcctgtggtcgtgtatggatgtgagagttggactatgaagaaagctgagtgctgaagaattgatgcttttgaactgtggtgttggagaagactcttgagagtcccttggactgcaaggagatccaaccagtccattctaaaggagatcagtcctcggtgttctttggaaggaatgatgctaaagctgaaaccccagtactttggccccctcatgtgaagagttgactcattggaaaagactgtgatgctgggagggattgggggcaggaggagaaggggacgacagatggctggatggcatcaccaactcgatggatgtgagtttgagtgaactccgggagttggcgatggacagggaggcctggcgtgctgcaattcatggggtcgcaaagagtcagacgtgactgagcgactgaactgaaagcccttaaaagtagagaggaattgggcagtctttttagcaagttctggtttgtcctttccaatcacagtagcaaatatatatatacacacatacatacacacacacacgtatgaatatatgggtatacctctccatttgaactccaaccaaagagatttgaatacagtactgtttatttatagaattctttgcaaatgcctaagtcaagatctctcaccaacatcattggactcagggttccatctctatgtgtagctgacaatcttcacataattttgtgtaataaaatataattaaacattttttaaagttaaattagatccctcctctccttgtccttttctctctcctcctccttttctctctcctccctgagtgtaattagttgttccacacttttccacgtccaccatttggaagaagtttgtgacatcccagtgacttgatgaatacactcttcatttcactgcctttcctatttcagtcatttgttttaaaatgatatatgatattagaattatgaaagacagcaacagactaagcctcaaaacatccctttgagtgttcttcctcatgctagttatatagtcagtttcccccttgtaaattattatagtgaggaatttattagggaaaacatcatttaaaaattttaacagctgctataaactgtcatttgcagtgctcagctgacattcaaacagctgcagtctatgagtgagctttaactttcagctgctggaggtctttcaactcctgttcccatggaaatgaggagggctggatgggtggaagggaagtgagggctgacttacaacatttccccatacattatttttcttgcctcctcacaatttccatggaaatgagggcgtaagtgccactccaccccaagctttggagagcaatcgttcatgtgtaaacaacagtggatggaccttaaacaggcatatacaaaactaatcttaacctttccttccacctgtgcagccaagcctacttgcaaacatattcttatttgatctattttcccatttaaaatgatttcttttagttaacttttagaaagttagt

SEQ ID NO: 39286 - DNA, 2019 bp, Bovine  19866880609914
tgcttgctgaagccgatgacagtgggttatgacgttcttaagtggaaacaaatagtttgggagaaacgtggatgaatgtatatccttcgagagtttggaagaggggatacttttttttttcagccacaccatgaatcatgcaggatcttagatcctcaaccaagggttgaacctgtgacccttgcaatggacgtagactcctaacccctgggcctccaggggagtccctggaggaggaactactaatacctctgcccacgttcctcatttggaaagcaaagtataaggatttgagaataaagtggcagcggtttgacatttgcggcgaacaagatggctacctccatgctcggatctctgctgcggatcgtctggcaggtggttccttcatcagcttcaggccaagctcgaagttactatgtcgattggagaatgttgcgtgatgtaaagagaagaaaaatggcctacgaatatgcagatgagaggctatggatcaattctctcaggaagaatattattcttccaaaacaccttcaggaggtggctgatgaagaaatttctgcccttccccaggatagctgccccgttagaatcagaaatccatgtgttatgatgtcccgtccacgaggcgtaaagcggccctggaggctcagccgtatcgtcttccgtcacttagctgatcatgggcaactgtctgggatccagcaagaaatatggtgatcagctccagaacctactgaccttgcaggaaaaccatttaggcaagaagagacttttctaatagataaaaacctgatttttatttgagtgttctgtcagtgaataatagttttctaaacatattgttcccaagcatagtgcaaagagtaattaaaaaaaagaagtttgtgggggaaaaaaaaggatttgataccaagtaaatgaagtattatgaatattatgatctctagagtagaataatttcatttattgagcactttttctgtgctagaaaaattcattttaatccttccaacaaatctatgacatagtattgttatctttattaacaagtggaggaactgaagctttgagggtttaaacaacttgtccatgaaggtgctacttcagatggccgggctgggctttttgaaagctacaaaaccctgggccttaactatttcattatagtgtctgtatttaaaatagacagtcagcaaatttgagacaggttactgactaaaagtttgtaagttatttgcttagatcatagaatacattttcccatggaaggtgattggtgatgacgactgagttcttatcagctcacaaatgtatgtttaaagtataatatacgaaaagacactttttatctgccacactaatgattaacctagacagcatattaaaaagcagagacaaaaaaataaataaaataaaataaaaaaataaaaagcagagacatcactttgctaacaaaggtccatatagtcaaagttatggtctttccagtggtcacgtatggatgtgagagttggactataaagaaagctgagtgccaaagaattgatgcttttgaactgtgatgttggagaagactcttaagaatcccttggactgcaaggagatcaaaccagtccatcctaaaggaaatcagtcctgaatattcattggaaggactgatgctgaagcagaaactccaatactttggccacctgattcaaagaactgactcattggaaaagaccttgatgctgggaaagattgaaggcgggaggacaaagggatgacagaggatgagatggttggatggcatcaccaactcaatggacgtgagcttgagtagactccaggacctggtgatggacagggaggccctggtgtgcctgcagtccatggggtcgcaaagagtcagacacaactgagtgactgagctaaactgaactgaacgattaaataacaaaataaaaatatcactgatccaagaagtctttaaaaattatcttaaatggcaggacttggaaaatgtcaataaagaag

SEQ ID NO: 39287 - DNA, 1842 bp, Bovine  19866880653128
cgtactggagtaggttgccattgtcttctccgagaaaaccctctagtgtagatttaaatataagtaagttgaatttatagtagttatttcctgattggcatttttctaatgccaactaactaccattcccatatctgcagctactgctaagttgcttcagtcgtgtccgactctgtgtgaccccatagacggcagcccactaggctcctctgtccctgggattctccaggcaagaatactggagtgggttgccatttccttctccatttccatatcagggtgcttcaaatattaatcaagtccaaggtatagactaaaactaacacatatcacactgtgtagcctgtagtgtcttcatttaaattgtagagtctaacagtagggtaggactgtaagagctatagagaggggtaagattaaggaggaaacagctcactgcggtttatttctctcctcatcccataaaggaagcagaaagaaagtgctgtaagcaaaaggcatggagctaaaaacataggcctactaattgtgccacgcagttatgtttgtctgagtgaggacctaggagcctggtgtatggcgcctgcagagcaggctggaaagaataccccggagccaggtcattagaagatctaggtcattgccaaattgatgaaagtgtgaattattttggtagttgctagttgtgtgaccatattttctgaactaaacactgggcacatgggcttagcagatgtttgtaaccattctgaatatgagaagcaatctggagtacgaaagaacatagaatactgaattttttaattgttttggtagcttataggacttagaaggtagaatatttgacatcagaactaccttaaaaaaaaaaaaaagtctggtcccagaaatgataagaagtcagtaaggttttaagacacagaaagatcataactgtgctagtaagaatgttcactggaaatggtgtctacgctaaactagaaagggggataaagaaaggaggaaggtgacaactgaaaaaaatacttataaagttatgaaaacagctcaggaggaaaggcctttgttagatggcggcagtacaggacttgcctggcggtccaatggttaggatttcacgctttcactgaagagggcctgggtttgatccctggttgaggagctaagatcctacaagctgcatggtgcacccataaaattaataaattaaaaaataataaattacaaaaaaataaaaggagacagtagaaatacaaaggaaggaccattaaaaccaataatagagaggcctttaaagcaagtcttccttgctcattttggtcaggccaagagaacccttccctcctaaaacttctttcaaactagtctatacaacttatttaacaatcacatatggctataattagtttttcctgggcatgaattttcttaatccaattaggatgccttatggtaaaaacaaacaaacaaacaactgctttatttaaacttggtatctcctgctttaattgaaacaaaaagctgaatactcagtagatgcttaatgcagatttgtcaggttaagcacattcttcatgtctcagggttcacaaggaccgtgttaagtagtcaaaatattggaataaaaaaagagataaagactgtgcctatatattttccttgagtatgggtattataggagacacaatgacagatagctgataagtagaaagatacagaaattcacttaacataggatatttctgttacctaaatgagaagactgtgataaccaattaaaaatggcagttttccttgatatgtttgacagagccaataattagctctgctctgtggggcaat

SEQ ID NO: 39288 - DNA, 699 bp, Bovine  19866880794049
ttgtgtccgactctgtcgaccccagagacggcagcccaccaggctcctctgtccatgggattctccagacaagaacactggagtgggttgccatttcctcctccaatgcatgaaagtgaaaagtcaaagtgaagtcgctcagtcgtgtctgactcttagcaacccccatggactgcagcctaccaggctcctccgtccatgggattttccaggcaagagtactggagtgggttgccattgccttctccccatgggattctggagtagactaaataaaggtggggtgccctacttaggacaaaatgtaaactatggttaaagggtgcctggaccatgggggccgggtcagaagagaggcaggcccaggcgcatctccactctcaccctgggcgcagtcgaggccggtgaagccctcctcgcagtaacactcgcccgtgtcacagaagccgtggccgctgcagtcgccggggcagcgccgctcgctgcagtcctccgatatgaaatcctcatggcactggcagacgccacgcacgcattcgccgtgcccgctgcagttctcagggcaggcggggtaggcgcagtcggcgcccacgtagggcggctcacacacgcagcggccatccacgcagcgcccgtggccactgcaggcaccgggacaggcgagccgctcgcagtcggcgccctcccagccgtgtctcg

SEQ ID NO: 39289 - DNA, 1136 bp, Bovine  19866880818364
tttgggaggatctggatagaattctgctctactgaatctgtctacaattaaagtacttctaaattttaaaagaatatatttgactgtttcattctgtcagtgaattatcttttctcttggacttaataaacatactgttcccatgcatagtgcctagtgttgagcattaaaaagtttctgtgaaaaagaaatgttcactgttcaattgaatatcattttatgataagttcgtgttctagtctttgttgatttaagtatttcttgcataggaaagctgcttcccacccccacagccagcctctctgattatcactgattatctcactggtctaagcctctgtgtcctttctccctgccacagtctcaacagccagagggacggccgggtctaaggctacatgactgcacaagctacagagtagtggtatcaggctttcccaaaacagcagcaccaatatacatctcacccagaatatatcagtgtcccatggatgcagatcatgtctcctccttggtaaattcagacatcttatttcctggtgttagacagatatcaagttgggggtcttgatttccatttaacatcacaaatggtgaccatgactttattcattgcattcccactgtgtgaaaagtttatgaagaaggaagacagtggaattgggcagagggcaagggtaaaccaaaatggcccatcagagtggccctgaattgggctgaagtggccgaggctgacatcctgcctgggtctgtcttaggatcagttgcccatgtgcaggcagctctgcagctcaaaccacccctccttccttgaaggtgcatctgggaggcattttccagggtcctccctcaaggcaggttggaagagccctgatgagagctgagaccagtcctgcattggccacttggcagcttgtggtacttcagaaaagtccttcccttcccagagcccctcatcctaccaggtatcaggggctgagatacagcccctagtgaccccgtgtacagcgcttcagcagtcacccgggggttttctgtgccccccacctcacaagccccttacaggccaacagccaggcagcaccatacttcctggggcagcgcggctcctgtgtggtctgaggacctgcctgtgt

SEQ ID NO: 39290 - DNA, 1591 bp, Bovine  19866880969680
tgctgaggatctctgcctggctgggggagggttgcagttctagctgccaataacaaaacttaagctgagatccctacagcacaagctttattcagcggtcaaagaatggagaagcgggaactaagtgcacaggtcaaattctggcccacctagcaagagagatttaattttgaagagtaaaaacaaaggaaggaggagtgaagttaatgatggcgagctgtgtacattagtctacctgagaaggaacagtgatttttcaaaggagtggggtgccactctctttttatcatttttttgactcctaatgtcccagtcaaggctgctggtaggcatgtcctttaatatgccactatagaaattcagggtagagtgagactcagggtctgttggaggtcatattcaccatcttggtcccagctggttctctctccctctctttctctctctcttttttttttttgtacctttctttctcatctctggactgtttaaagattaatgttaacttctgctaaaggcataggttgaatggttttgaactaaaacttggagcatcactggcaacataagcggtcaatattaacttctaactagatagtaacttctgggggtccaccacggtgccttacccaggctgtgtatcctccacacccaccttcatagtgttaagcagtggattggccataaagttcatttgggtttgtccaggtactatgatttggccaacccaatataaagtaggtgctcaaggaatacgttttggctatggatccccacccctgttccctcactgtctccacccctgttcctgttctgtgtgcagtggtcgccccccagggactgcagctgctcaagagcacggaggattccctgctggtgagctgggagccctccagccaggtggaccactacctcctcagctactacccactggggaaggagctctctgtgaagcagatcaaagtgcccaaggagcagcaccgctacgagatccttggtttgctgcctggaaccaagtacattgtgaccctgcgcaacgtgaagaaagacatttccagcagcccacagcatttactggccaccacaggtgaggaagcagccaggtttcccaggagaggtcctgctctatacatcttcttccattgtccccacaagtacccttctactactcaggccattactctgctttggagtttgtaaaacacagctgccgcaatcctaggttctgaagaaaagtctccattcttattcccctcgcgctgctcctccaagccagtgatggagcctgctggattgggaattacaggctcttctccatttcctgagattgttattcatcagttgctcagttgagtctgactcttagcaaccccatggactgcagcacaccaggcttccctgtccttcaccatctaccagagtttgctcaagttcatgtcccttgacttgatgatgccatccaaccatctcatcctctgccatcctcttctcctcctgccctcaatcttccccagcatcagggtcttttccagtgagtcagcttttcatatcaggtggccagagtaatggagcttcagcttcaacatcagcc

SEQ ID NO: 39291 - DNA, 916 bp, Bovine  19866881051867
aatttcacaatgaacagggaaataaatgtaggtgcccttttagttttgcgttcaccaaagtggacatccgggcttccagacccagccctgtcacttcccaagctgggcaatcttaagcttaatttctctaagcctcagctgtctcatatgtgacttagaaataataataagacctaccacacaggatcataatcagaactaaatgagataattcatgagcagtgcacagttagtataatgcctggggcatggtaagctctcaattaattcacagctaaagaaaaagcctctagaagcaaggaaagtcctgccattttccagctcactgatggtgattcactagtccaccgttcatgcaggctgtacagtatacactgtatggttaaaaattaatgtatattttattctttatgatcgcccaactatataattctttcacatcccagctatgcaatctgttaggcaactgaaacagtgaattcaattcttgcaccatctcactcttattctcaccaccccaaccagctactgccaggactgaattgaaaagaactacaaaacttttcaagaaagtctccaattcaaatatcccttctttgccggctccaaggattagcctttacccagcggcatcaagctcacagcctcccaacatgacttggcaggagcacagagtgtttgcacgaggctcacaattcaatacgggctcagagcactgtctaaaaactaaaaattacataggacatcttgcatataaaactaccatgatttcaaattcttttctgattaataaattacaaacttactgtcaaatattactgattcagagcaacatttgtcatcatatattttcttaatccacagatgctaaatctattgctactcccctgcgaaagtctttaatatctcttgacat

SEQ ID NO: 39292 - DNA, 964 bp, Bovine  19866881156636
tatgtttaaaagatatggatcatgactaaggatgacatctacagagaagaaacggcaaacatttgcaaggactttgtttttctattacaccaggacatgcaaactaagactcttggagaatggtttaaaaaaaaaattacaaatttaaatcctaactaaaattatacttataatagttcctagtaataatgtaaagactccaaaagttatttgatttttagatagctcaattcttaatgtctctattatggcccactggtaaaaatgctccacttcagaaatactcaattatatatgtgtaaatgtaggtatccctcacctaataaccatatatgtacatacaaggcaaacacatgagagaatattatgtttggcactataaaacttctttcaacctcactacataagaaaccattaacctaagttttactcctgggatacttgaaaagtactactaaggtataacagtgtttagttttataaataaaaccatgaaaacctgtagaccttggtgcagctgtaacaatgccaacagcaatacttctattttaattcccaggaagttatgcctcaattgctacacaagtacaactatcatattagaaaagaaataacagccccagaggaatgtgcaaggccccacctaccatagacctgggcttgctgatggccaccagactagtgaggaagtcttcgtcgtgcagctggctgaaaacatgggcgtcataggctaccataatggagacttcttccatcatcttgccagctgtctttccacagcagcagctgctgtcccagctccagaccagactatccaggggaaaatcctattgcagcttggtgccagtgcacacacccacctgagtttgagggggtggagtgtcaaaaatccagaggaggggaaaaaaaaaagcagctgctatcataggcttgtctagcaattcacccccagtagaaaactgag

SEQ ID NO: 39293 - DNA, 808 bp, Bovine  19866881206642
tgatgtgatgcagttgtgagggtctgatggggaagtttgggaacacttctccctggagacactggcctggctgatgtgtgcttctccagaagctaacctggtcctgaggtttttagaagtgcttttcagtgcactttgagcatgttaacagggtaagatttttcagtcaacactttctcttccatggtctgagttccgctgagtgattcgttaaatgaaaaatatctgaactgtgccagctccaccctgtacatgcatatgccattcttatattccagtgtgtttttccatcgcacggaatgcaaaacatctggagaaaagagagattcttcccctccctcttaaattaactaacagtctagccaggtgtgagagtgtttcctgaccttagaaattattgtgtcttttttggtcatgttaataaggcacataatacaaatttatttgcaatccaataaaatatcccatcctgcttttagaatataataagcaataaagatatttcttgaacactcatgttctagctaggataatacactttgaaagtttaattggcaattcaaggccatttgtaattaaatgctctagaaattcaagggcaaaaatggttgccatttaacatggtcctagaaggcctcagtggagtggccagtgtaggggctgaccctggagggatgtgtgatgttacctgctgtgagcccttgaagggcagggaccaaggctcgtcatctatatatctaaaggaaccatgtctctaggacccaatgatacttggcaattaatgctcgttgaactgacttaattgaca

SEQ ID NO: 39294 - DNA, 683 bp, Bovine  19866881237248
acctgcagctctttagactgccttaggtagattgtagtcttgaggggagacgcacagcctcacccttcgctctgccgaatccccggaagagcagtgccggggctccagggtccagagcccgttctcaacccggcactggctgcttgtttccaggtctgcagccggggacggaatataagatcacagtcatccccatgaggggagacctcgagggcaagccgattcttctgaatggcaggacaggtaagaaccgcgtggaggcactgtgaatgcatcctgtgctctcattctgctatattcttggctgactcctctttggataaaaactctgtacttctgtgtatagagacagccagtctctctgtgtactgacatttctggcggaggagtgcggggcaggagaggggaagcaaacttgttctatctcacatttttcttgctgttgaaaatctccacctggctcttggagtcaaggggataggccgtttccaacacctttctgcttattttaatagcttcaatcactgacttctttccaaggcatttattatcttggacttaggcacacggctccacagtacccaagacaggtgatttataactttttgcttgcatttccggtggtttttcatgacaaacacactcaagggagtttgctttaaaatgtcaagggatattaaaga

SEQ ID NO: 39295 - DNA, 1585 bp, Bovine  19866881757389
taaggtattggaatcagtcagagcttagatggaacagtttttgaggcctacagcttcaatgagaatgcccttctctatatactgttctcatatttgtttctttctgttccccctgctgcatgtacagatttgtcaaacaaaaaaaaagacaggttctttttttcacccacatgcaacagttgcaacagggttacaaccattcctattagtttttaagtctttttctaagattttttttgtatgtgaaggagaaaaaagacatttagcctatttttctttaaagcaacacaaatccttatctcactatattggttaacttcaattttagactgaattatagaaattctattttctcttagattttggagagaaatatatcactgaaaatgtttattgtagcatttgaaaaataaatgaatgctacccagtgctaaaaattaagactgtaaggtagtatgtaatatactaaatctggtcacatgtggaatggtattggtctgattccagggagcagattaaccagctgtagtccccaaactgggccacagaaagctgatacagctatgcattcagagtgagctaattaagcttatttaaaactagacaatgagacaggaggggaagaatggtagcagagctatgtaggacactgttctttaccaccaccaaatgctacgttcactggaatagtgctggcctttgcactgcagatgctgagaaacccgaagcggtattttttatgtcagttgccattgggcaattaggtcagaagtaaatatacattcttgctgaaaatattcactgtaggcaggaagctatagatatttatgctacacaaaatttaattcaagactaatatgctgggacccttgcctgtccggtcccagtggttaagactgcccttccaatgcaggggcatgggcttcctgatcctacagctaagatcccacatgcctcggggccaaaaaaatcaaaacataaaactgaagcaatactgtaacaaattcaacaaagactttaaaaaacggtcctcattaaacacacacacacacacacacacacacatgccaaacagcagttgtataaaacaggctgagtatgtctgtcttcagattcacctttaccgtaccctactatctgaaaaggaaagcagtgggaaagcgagagaaattgagaacctttactgtagtcacctaccttaaaggtagtccctggaaggaaggaagtcaaactggctagaaatcatcagcaggagtattcaatgcatgataactgcactgccatttttttttctttctgaatttatttttttattgaaggataattgctttacagaattttgttgttttctgtcccacctcaacatgagtcagccataggtatacatatacccctccctcttgaacctccctcccatcttgcactgccattttatataccaagtgtttaacatgggaagaaaaactcatccctcctttgcatttttaaaaacctcccatttgctccttcactccacagatagatactgataaactaccgtgttgcaggcaaagccagccaagaacaaatgctcagtgcggcccct

SEQ ID NO: 39296 - DNA, 1078 bp, Bovine  19866881869358
ttactttgtagaagacaaagcttcactatctgtggcctgaacatcagcttctcatccgagtgatcatgaaagctccttttagaaaaatgatggttttgaaccttggtaaaacacccatcactgcttacagtctccagccccttgtgtagggacctgactattctagatctactaggtggcgttagtaggtagaatagggaaaaggagtccaaaatggcggtggctaaaagacaaggaagagaaaagcccacgaaaataaaacaaaagaaggtccgaggaccagagtgaggacctcaggtaaaacaaacaacactcctggctggcccaatttacataggacaggtccagggagagataaacatataaatagaagagccaaagctagcgcgctctctctctctctctctcctgcgcgctggggcactcttctcctcgtgtctttggatcgatgtgccctcacacctcaaagatggattttcctgctatcttctaaataaaatagagctgtaacactaagctgtaacactgatttgtctaagagctataacatggtccattcgagacctgagagctataacacagtctatctaagacctgagaactgtgacacaccgagagggctttaatgtccgttactccaaatctttgttgtgacgagacaaagagccgaggaacatatactcgcgtgacagaactaagggcccaagaatttatgactataaagtacttgattatcacaggaaatctcaagaatgtggtttgcgtgtgtggaaatgacaaaaaaaggacagtaagagaatatcaaaagaccataaatagatgataaccacagagaaagaaattgaaatcaaagttagagtgaataatcacaatagaacaacagtatgttatttttttcattaaagtcaaatgatcagaattaggaccatgaatctactataattgttcttcattttcagaatgcaaaccgtaaaaaaaaaatccttttgttttaatcttggttctctttgctgcatctgacattatacaatgctgcttatcggtaaaatcaagaaactcttcaaagatccctcttcct

SEQ ID NO: 39297 - DNA, 1178 bp, Bovine  19866881308901
tgtttatttgtaaattatgaggaaaggtctggaaagctaccagtcaaacttctcacagtgcttgccttgaggaagggactgagaaaggaggtggacagtggaggaggaacttcactttttaccctctcactttcacagcgggtttgattttgacacaggcatgtactgctttcatagttaatgtttctatttaaatagcaaaggcagaaaacaaaaaactgtcaaacccatagtggaaaaatggatatttaaactgcaaaccaacggagacatgacaatcgaatggaatgcaagattcttgacgatctggacagcaaacaaaaacaaaaaacagctctaaagagctaatcaatttatatgtactataatattttttttttaattagaggataattacaatattgtgatggcttctgccatacgtcaacttgaatcggtcacaggtatacatgtgtccccgcttcttgaactccctgataatattcttatgttaacgttaaatttctcgagaatgataatacttgtggttacaaatgagaacaatacttaagtagttaaagtattgtgatgtctgcagtttactttcaaatgtttcagcaaaaaaaaaaaaacatatagaacaagagaaagcaaacatggcaaaaaatgtggagcaagttcgttaagtaggtgaaaactgttaattattctttcttttggttttctttagatctgaaactttggaaaataaaatgttgaaggaaaaatgtcaaccagtagctggaacctgagtgtcccaggaggcgtgaaacctgagactcccaggaggcgtgggatggcaagacagcatctccatcggagcgctgacagccccagggcacccaccttggtggtaaacagggcatcgacgtcatgccaggcccggagcttggcgcgagcggccagcgctgtcagcacgtactgtttgtctgggatctgaaagcagaggcccagggaaattaagagaagcagaaatgcatcaggggaggggcttgagagttctggaaagacaggcaaaaatagtccctggtattgattctgccccttacgatccacaaagctcttgggtctccaagccccgcactgctgcgggctcttcagttaaggcctccctcacctcccacagactcactccgttctcctacccctaacgccaaggc

SEQ ID NO: 39298 - DNA, 1031 bp, Bovine  19866881653758
tgcatacacattatactataatgctaatatacatatatgtttgtaaataataaggtgaagagacaaataaaagcgattagaggtggtctataaaaagggattggggtgggggcaaaagagggctctcatttctccactagttggattttttttcctaagaatgtattatttttatgaatttttaaaagaacattaaaggaaaaataaaaaaaacatctgctaagacaacagtgtggggagaagttcgaatggccaccgtctgatactctaccgtctctgagacaggttcttggcatagatctgactgacaaaatcttgggcttgaaattttaggggtgatgcttctccctccctacaggccttgaggtgctgggaggagaacagctcgctcagatgctgcagcacttgggggtgcggcatgtccttcgctgtgcagaagtttaagagtgcataaaacatgccctccagccacttgatgttgaggcttattccccctaaacatcagtgagaaaggaaacaccagtgagcaccacctaaaaaggtctacagggaaccgaggacaaaccccagacagtgaacggctaccttctgtccaagacagtttggttatgtaaacttctttaccagaccaagagccctgggtgtgccctttataacacgtcatgtgttaaccctacctacagataggttaatgtagacattgctaatgacaaatgcatcttgggaaatctctggaatggttcttgcaataaggcgcactgcaagattacagtaaggaaaagccatttggtcccagaggctgcattcttttgtttaaacaggctctcctctctggttgttgccaactcatccttagaaggtctgattaatcacacttctcagcttttcctttaaaaaggctgctttttaaaaaaattttttttagatttttaaaaaatgtggatcattttttaaagtctttgctgaatttattacaatattgcttctgtttatatatacatatatatatatacacacacacacatacacac

SEQ ID NO: 39299 - DNA, 2332 bp, Bovine  19866880434738
ccacatgccataactagaaaagcgctcatgtgccccaagtagagaaagcccatgcacctcaaagaagacccagtgtagctaattggaagaaaagaagaaaaaaaaaagcagatttaggatacatgactgagagtaggctttttggaaacatgggttacccagtagacagactgtgttattcaggattctccagagaaagagaaccgataggatatgtgtatatatataaagagatgtgttataaaggaattggttcatgtgattatggaagctggcaagtcaaaatctgcagtgtggaccccaaattggagacctaagagatgaaggtgcaggtgaaatctgaaggcactcggctggaaattccttcctgaacagggaggccactcttcctgttctatttgggcattcaatgattagataagtctcatctacataatggagggcaatgtactttactcacagttcccaactaaatatacatgttcatctcatccaaaaatgccttgcaagttaacacataaaattaaccatcacacagaccaagtttatacttaagtgacagtgcaagtggttttgctcagtcatgtccaactctttgcgatcccatggactgtagcccaccaggctcctctgcccatggaactctctgcaagaatactggaatgggttgccatgccctcctccaggaaatcttccagacccaggtctcctatattgcagacagactgagccacctgggaaacccttatacttaagacaccagcaaattacggtactttaaaagaaaaaaaaagactcttgaaaataatctgatgtgtgatatttcagaaaaaaacaatcatcatccgaaaaaattggactctggctatcttatccttaattttacagtttagcatttttaatattttgattagatgcagggtggagagggaccaaaaaaatctccataatccactctaatattgtagtgcttgggacccttaaaggccttgccttctcgtcatcactagaaatttcaagccatcactatacgaattttttctgtccagtgctttagaagtgataatgaaagtgaattgaattcatttggcaaatattaggcctgccaacaatattcttactttctgtagagattgtgaggtcagcatagcataaggggcagcagcaagacatcgaagtcacagaaagcctcatttcctaactcttttcaacacttttctatcagtgggatttttggcaagttacataactctccaagttgcaatttccatatctttaaactaaagataattgagcctatttcccactgctgtcacgaggattaaaggagttaaagcacttggaactctgggcacagtgtctgacatatgataactcaataaacattattctcgtgatagccatagaagaagaaaatgagttagggtaaaaagcatacttgttggaccgaatccatcgatactttctacatgttgcacaacagatattcctggtaaggaggccactgaagaatcatcatggaccccattcctctatttttggagaccatattctatatatcaagcatattaataaactcatatcccatgttaagagaagcattcagaaggtaaactgttttgtaagattttctaaaaatacttttgctataagagctatttgaaagggaacgtgttagtcactcagtcatgtccaactctgcaaccccatggattgtagcccaccaggctcctctttccgtgggattctccaggcaagaatattggaataggttgccattgtcctctccagggcatcttcccaaaccaggaattgaacccgggtctcctgaattgtaagcagattcttaatttcttatatatcaacttggaatttcaggaattccttaaaagtaaaaatctaaaatgtttcttacaaactggaattttcatagaatttaatgtttaatgaagttgtcaatattttgtgtgataaacagtttaataaacatttaaaaatttgactgcattttaaaaaatattttggagacagtaaagctgtatacaagtaacaaatattcttgaaagttcacagatcctagatattattcttatactgcataatggttcagcggtcttgcataagttttaagttcttcagaaaagtagaaagagagacaaagagtgggggtggggagtcagaaaaccaagcttccatcatgagttaaaaaggtgtttataaatttttatttttaatcatgaaacatttcaaacatacagaaaagtatataagaaatataattcattccattgcttattgcatctcctgttttacttacaagataatgtacttt

SEQ ID NO: 39300 - DNA, 1484 bp, Bovine  19866880439281
ccagggattgaaccctggtctctggcatttcaagcagacgattttacggtctgagccactagggaagctcagccactggtaaagatggatctaaaaataactaattaaagggtccttttaaagaagtcctatggacctacagtggaagggacttgagattctgcatgttaattaagagaccctgaatatgaactgggcatagatattgcttttcagctatctcctgtaccaagtaaggcagcagtcttcaaacaacttaaaactcgagagtaacatatgactccttgttctccagctaccattttagttagctccactgctgaaaactcagggctattcttttcttgcctgctgtccagctactgaagactctgtgagtggctgtgcttgatgccattgttccctttcctcatctcctccctcaactggtctcacaaatacaagtttggtcactgcctaaaaggcaccctctgagcatttcctaagagcgcagcccacctgcttgtggtttttcatatcattctcaagctcgtgagaggcatgtttcctactttttagtataccagctattcaaaaagttcccacggattccatgagatcctcctgccttttgccaggaaaacatcagagcatacagtacaaggtacctgtaaaattcctttttttgtgtccagatatttttttttaatgtaaaaacaacttcagcttaaaaaagttaaattccaaagccagcaagttctagcactgaggattctcctctattctcaagaacagggaaatcaagggagtttccattttaaaccatttaagaatcctgtgctttctgagtggaatccttgagagccatgacttatcttgtgtttgtctcagtgtttggttctcagagacaagggtcaaaatgactttcaaaaggctggctttccccgggggctactttttatgtagaagccctcatctcataaacaattgaattagttcacattaaccactatcaatggcaaaagtacacaaaacctaaagaaatcacctaaaataatgtttttgaaccagctgctaaattaagtaatgtatttgttttattgcacatttgcataatagggcaaactagaaactctctgtaacagatgtgctggtggcagggagatttgattactggcttctgttattaatcactgcacgaatcttaaatgatttgtttctacagtttgatcaatttacatctcagaacatacatttatgtacacaatgtagagatgaagcatctgttcacacctttctggaggcatcaatatatttatggaaattgaagttttgttaaaccaaggcacaggaaactttggtcaaagactgacaacttttggaaagatcccattatttattcctcgtcaagctagttaatagaaaaccattttagtacattatgttctgatgtctattgtctctttcatgggaaacaaacaaaatatatgctattttgaaactca

SEQ ID NO: 39301 - DNA, 1555 bp, Bovine  19866880578657
tatttcttaatataaagtatttctttgtgtatttttcatagtctatagcttctaccggagaaggcaggggcgccccattccagtactcttgcctggaaaatcccatggacggaggagcctggtaggctgtagtccatggggtcgctaagagtcaggcacgcctgagcgacttcactttcacttttcactttcatgcactggagaatgaaatggcaacccacttcagtattcttgcctggagaatcccagggacagaggagcctagtgggctgctatggggtcgcacagagtcggacacaactgaagtgacttagcagcagcagcagcagcatagcttctacatgcccacaataagtagaaagcagagatttactgggcagacagggtgatttataatgataccagcttatcttgctttctgctgccctatttgatatggttaattaacatttcttcagcttctaccactttaatttaagagagaacgatagtacattttatatatgcaaaatgtattttcagctgtttacacgtgcaccatatctacccatacttcttggagggtagaaacagcacagaaaaagccttttacttatcatccttttagacatggtgtatctagtttcttctgcttgagcacaagcctgacgagtgtcttgtctctttacatcttgttctttacatagttcttgtctctttacatcttgtcttctgtgtgagaatgaaactgaccaatatggccacaaacttagaatagaattttagatacgtcatcactgacataataaaagccctcttccctcactgccatgacataattcttttgatccagcccaaaatagaattggccttttctttcctgtttctttgtcaacagctatttttgcaaggttttcattacttcttaattgttcaaacttcctatcttcatttttcttgttaaggaccgattttacaaatgagttcattatctctaccattttagactcatcattaatttcatgctcctcatttattagtggacctattttctctctgctacttcttttctcactgcagtatctgtaaaatgccattttttttttttttagtccccttcactagctttattaagttctttctacataactggtagctttcctatgtttaattgatgtatctctctctttattccaaatagcaatttttcttcattgaatttaatataagatggtaaaatacatttgtatttacacttcatatttgcacacctcattcttcaaataaattttaaatctgctctggtcttcttaaaataccaacagaagtactagcagaaagaaaactgagacaattccatatcttataaatgaattactgtatacaataaatttcttcatccttaattagtgaagatattcataacagttttatcaattaggctgataaagagcattatttaacaatgcccttggccagggcacataggaaagccaaggttagaattttagttgctaaactgaagatattagcaattttagcaactgggggtcatctgaggaaagaatgtatagga

SEQ ID NO: 39302 - DNA, 3626 bp, Bovine  19866880588987
gatttccggaaagtaaacagttaaaccttggatggcaccatgtagccaatacccctcacccctactcactgtaccatctacacttttgttcaatttttaaaaaactgaattcaggtgtatcagtttggatgtggacaaagtttaaagacaagctaaggttgcaaacacaagtatctacaagggtcaagcagttggaagaagtgagtgaagcagaaaaagcaaaagctggacaataaacaccgtcagcttccatgttcagctgatgttaggtggggtaggcactgcagcaagctgggtaagtcttggggcagttgcctgtcagtaatagcctattattgccatggggaaatgtcagcccagggttaccagatcttccaactttttccacagtctggaaaatacaatttttacttgcaaactgatttaaaaagttggtttctaattcaattcaaagtaagttataggctgaactaaacccacttgtcagcctcaataaacttttaactggtttgtattctctgcttcagaattcagttctcacatggatgtttgggaattgcatggccatggtctaaaaccctgatgtgcacactcaggttaccgcaaccaatcttggatgagcttcacgggaggtaaccagatgcaagggacagtttattttaaaatgttgcttctacatctcctctatttaagaaactatttcagtgctgtgtatataggctcttaagatacacagatcaattgtagaatggctctgttccaaacatgtaacaaagacaggtaatttctgtgttcatcactaccactctggaattgttttctcctgttgccatggtttccattctgaaaatcagaagcattgaacacttccttcctattcatcctcagggacagagtggaaactaacttttgaaaagaaagaaaagcttgtgtgcaagtcactacaaagtttggcccactaatgctcttatccgaagaggtaatttagcccctggtctccaggaagtaataaaaacatgggctccttaagtctgattatccttcaagttctagtttagcctcctcatttcttagaaaaataaaactgaggagtgaaaagtattagctgttgtgttgttcagtcactaaatcatgtacaactatttgcgaccccatcaactgcagcacgccaggcttcccagtcttccactatctcctggagtttgcccaagttcatgtccactgagtcagtgatactatctaaccatctcatcctccgccaccctcttctgctgccttcagtcttttccagcatcagggtcttttccagagtctgctcttcacatcaggtggccagagtattggagcttcagctggtggttatcagatgtcaactccacagactctcatatgtcataaaattagtgctgcaaagtcttcggaaatcaatgctccttaggtagagtagcaattggagccagaattcatttaagtcagcctggtggtgtttctgcagtatccatgcactacccacaggcttctcagccctgcctaagaagcttcaaataataggaaaaatgaacacaaaaaggctttaaaaatggaagcagtttgttggctctttactattaaattttcagaggtagggtggacttcaaacacaatttgatcaaccatttcattcccatcatggtgatcatgatcatctttatcaccatcatagcaaattgtaaaattatgtttatatgtgttaactactcttctaagtatttcacaaacatttactctataattttcaccatactcccatgagatgggtactgttacaacctgattttatccttgagaaaaccgaggcactgagagcttaaaccccccaagtttgcattgtagggccaggatacaaacttgggctactgattccagagcccttgctcttagcctctgcacaaagattcagattgaactagtcaaggataatccttagggatcagtggttttaaaaatatctctcaggtagattgtgatatgctcccaaggtggaaaactaatgctgttaacagggggttaagaggtgaaactgatgtagagtaggcaatctgaaggtccacggcaaggaataccatgttggaatttaggcctaactgctgctctgcgatgcttacatcccaatggaaaagaggagtaaacaccatcaactgatggaagaaacttctggatggaactgctgagcactgctgagcacaatgactgctcctgcagggaccctttgcccaaagaactcagatattacagccacagtatgtttgcagggtgtccattacctgggtattacaatttttatattatggcagtcagagactgattataattaggaaagagagaaaaacttcccagggacatggtgcttcactatagatcccctgcctctaactctcgatgcagaaatctttgcaagagtactttcatggatctcaatgacaacaattaagcttgaagagcatgagaagacattttaatcagaagctaattaagaacaatgggggcatatgtattactgatgtgtctcgagtactctgactgatctgggagattattccattaatatctggatgtaaacagacaccggacattttctcaggatgaagcaactgcactctgaagtttccacctccaaatctggcttttacttattagatgacaaataaaaatgagcaacatttacctttctggggaagatgtcaggtgctgattccacattttaggacagcatcaagtgtaatacctgaaaacatttacctttctggggaagatgtcaggtgctgattccacattttaggacagcatcaagtgtaatacctgaaacaacggtggtcaagaaaccagtgctaatcatatttaattgttgctccattataaaataagactaagaatatatctggccataaacacagagggatagattctgtgagtaatagaaatataaaaataaaaaataaaaaagccaaagtaaccatcgtagtagtattgtgtaggttttaccttctgttagtgttggacacaatacaaacacaatagggcattttcagggaggaggaagttctctttggcatacagtctctgcttcaatcaagcaatcagtccatagtgtctccccttaccaaaacaattgggttgtttccctctaaattagcttggcatttttaagtccatgctctctcaggaaccatgcttgctaatcaatggtgcttgctctgtgaccccagttttcccggtcatgcttctcaaagaggctgtccaggaaacttcattctaaccttgtttacactgctggtaacagataacagagatcctcttatgtaaggagtgaattttgcatatggagaattctaccatatgacttctgactgacttcccagcattttcttccagtcccttctcaagtgagcactgaaacatgcgtcaggcaatctgggttgtaatctcacaatgtctaccactgtaagctatttcaacttctctgagcttcacttttcttgcttcacaaaacaaaaaaaagatgagatgattttagcgtcttccaaaattaaaggtgttgtggatgctatttatttttccttctggctttcctgtctcctctttagtcc

SEQ ID NO: 39303 - DNA, 1606 bp, Bovine  19866880645673
aaagaaaagaaaatgctgaggaagcctattggagaatagtacatccagtgttgaaaatcagagagaaacatccaacaaaattttggatttcctacttgacccacatgcagatgaacccagcgtgcagtgttaccttctggattctcagcacaagtgctttggagccacttcactgagaatgtgaaagaggttaccgaaaatgtgggaaaagagaacggaaggggcgtgtaatgacaaggagagaacaatgcgggcctgtggaggtgaacagttttaaaatcactaaagaatacaaagaaaaacaagagattttaaaaggtatgatttgagagcttaaaaagggagaggatgactaaagagaagaacaatggttctcatacagccaaaaatgagagtcagccatgacaagtggggtctgggccaaaggaaagtgggtagaattttagacttatcccatcctcacaggaacaggtccatatgcctgccacagggttaatagatactgccgcagccacagttggtctaagagactcccacaaaatcggggctatgacctcagtctcacttcttctaagtgctttaaaacatgagggccaggtgtgtagctggggtttaggggcagcgtcgactcacaagaaaaaagtcctttggtcttgcttttagtagcagagataaaacattattttaagaatctaaaaataagaggttagcaaggaaaagaagttgtttctcaggtcatgttaactcatggcaggaggaatagcaggaagtgccagagaaggcattgactatttgaagacagaccactatagatttctcccatctccagcaaaaaaattcattcagcaagtcaaaaagtaacatgtcttctgtgttgtgaaagttgaaaacttttaaagctgcttttccaagagctgctggttacagaggatttgtatttgggtttactttctttctttgtttatgtttaaaagcaagttttctgaacccagtgattttccttgtggtctagcaggtcaatacatgctttggaaattttagaaagcatgttttatttattttctcaaccaaccaaaaagccccttaggaaccattgtagtctgttggttaagtatggtttcattcatatgcttcttaaaggtctgttatttacagacagacagtaatgactttatctgagctaatcgagttcattatgtcattatatatttagggcatgtcctgcattcagaaaaaaatccctgtgagaacccggtacagagtgccaagaaccacaatagtattcatcaaatttcctgattgtggtgttacatgcattgtttttgtttttatttttttctctaagcaaagattggcaattcacttcttgctccaggagtactcaagcaaaaacagttcagatacctggtttcaattacttttcagtaaccgtccagaacttgtccccagctgaacaggtaacagtagagacttttggacattgagcggtgtcaagggagaacacagacacaaatttgtcactacaaagtaactatcagctatttggtatctgtgaagtgcattgcttttggggtccccagacagaggaagagattttaggaactgg

SEQ ID NO: 39304 - DNA, 744 bp, Bovine  19866880697095
atgataaatatgcaactctacaaactcttgttgatatttaccatctctcatggcggtgacttagcaccagcacgatggtggtattattaacaccacaggccacgtggaaagcagaacacataaacctgatgatgatgattttactgatgtaaaatcagtaaggattttacaaagacttttcccccaaattacttcctagttgacaaatgtagatttatagatgactaaatgaagaatggctttccgtttagatcaatgctcattattttaaattacttttgcttatcttctatttcaagttttcttgtggtccaatagttgaagagatttgtgaataattaagtgatgctggtgctatatgagtttcatcagattcttcaaatagaaaatgagttaagctactaattgttggattacttttttcatctagttcaaattaaagcttttaaaatttcactcctttgtaggtattcaaatgccacatggttagatgcaacaataaaagtaaaattacttgttttgcagtgaaaatctgaatgcaaattttggggaatatggcattataatcataatgaaaagaacaatgttattaattaagatccttatgtagtagaaatatgttgtaattgactgtagaacatatataattcaaaagtccaaatttgggatgatattttacaaagaaaatagaagttctgaaaatttattataaatactatatatatgtagtagtatatatacata

SEQ ID NO: 39305 - DNA, 1750 bp, Bovine  19866880828605
ctacagtccatggcgtcgcaaagagctggacacaattgaaacgacttagtacacacacacatccttttttccactgtgcctaagcatgacccagaatagtccacctgctacactagttctgatagtgcagagaagggccttgtttgctcttaatggttagcccagatagtagaatctcatgctaaatcagcaccttttcagatgccctctgtgacctgaggttgattttctctaatccagaccactgttttgaacaaaccttctatgaccttctgcttactgcccccttttctctgattgccagcgctgtcccttgtgcatcttatcctgctgcttctggaaggagatccctgctcctttctggatgctttgcatgtttgatacattctgtttcatgacctgctctttcgttcctctgtccctttcacttttggagagtattctttcagcagagcctcctgactccttagaattgcttttataaggcagttactgctggtgtttgcaagttcatctttactttttttcaaaaccaaaaaggaaaaaaaaaagataaaggaattggcttcagctcagaggaagcattctgggaagagaacgcatgcggtcctgtgattctgcatcttaaacaggggcctttcctcatgatgagaattaccttggcctgggctgagccttcccaaaggaccctttccacttaagctttttattaaaaaaaagtaaattgggattattgtattccctcactttacattggaagtaaaatttttaaattaattgtggcctaaactgatagcaaacagagaggttctgatagcagcctggcggcctcttgtttagccagcagagatttcagttattgcttctgggaatggcttggctgagatatttttaatttacatttttttcttccttctaatgaaggattgaattatgacttacgagaaaatccccagtgtcttggggagagagagagagagatgttgactaacttcctctgacttgattggagtgcagttatttatttgaagctagttttaagtcacaggggtggcattctgaaggatttctgcacataagggagcactgtccagaaaatgtcgttggctcccctcaggagcccactgtgctctgacttcagtgggcagtgttgtaaaagattagaagggcatctctgtaccagttactcacactcctggaatgtccatcccgattggaccagtcaaccaggtttcaaagtcagaaacagctctggcccctctgaacctgcctctgccttagcaagtagggaattccaaatggtagcctctccatatagccaccacctgctaaagggaacaatccctaacagacagaacagatttgtaaatggtaatctccgctgtaacaatcgctctctgcctgctacatagtgggaatggtaaaaatgtggatgttgcaaaacataattactggcctggaaatgttccttctgtggcagatggtatgatcaagagcagagacagacatgtccttccgcaaaccaagggtaatggttacacaataggcttaggtaatagccactagaggaggtagctttaggtaaaactcagttatgtgtattaaaagaacctcttttaatccggacagctcaaggaaaaatctctcttgaggacaccgggcttgagtcccactaccagcacaggatgcccggtgtgcgcttcaagaacagagtggctgtgtcgggtttcttgtgttctaaggtaatgca

SEQ ID NO: 39306 - DNA, 2144 bp, Bovine  19866880900251
tattttacccttcttccatattacactgctgttttcaaatgtcattctcacagatcagtggttggtttttaaatctgttctctccccattaaaagcaaatagcttagatggtatttcttttaaatgtagaccagaaatatctttaagcgaagattatttaacctgactgaattttttaaaaaagaatttaaattataaaattttcctgttgactacctaatcaacactttagtgctttagttgtggaagaaaaagactcactttatctgtgtttggtaaatattttaaaatgcaatgcccatacacacagtttggttcttcaattacttttcctccacactgacaaaccatctaacgctatttaatggcccttcctagagcgcttcatgattcagagtcttccagctgtgacaaatcaaaaggcacctatgtattctttggggtttttatttgcaaaaatgtcaaaaattcaatttagttttgattttgatgtacattaatcttcacaaccttttatgcatcaattaactggtaaaagttatgagggcatcttttcacggaatgtgtcatgaaggccttttagtctattttttaagtatatattctttgctgtttttgcagtgagctacacttttaaagggcccattcttggcttctctttttggaagtctgctttatatgaaaacaagtttagttggagttccctaaaagtgcgtactctttatctagaatggttctagtgaagcaggatcatagcaaggacatgcataactgagcttaaagatgtttatttatgttttatttttctaattttaaaatattattaatgtatattatagaactgtaagaactttagaaagcattcagcccaactcatttttacagatgagaaaaaaggggtagagttaagctggacatcttgtatattcaagacaaaacctcagatccttttagtcttctctagagttatcaccctgctcttgtcagcctgaaacagattttgtggttaagaggttacaatcctttcctgcccactttcatacagttaactgagcttctgaaactgagcaggaccctatggggctcctgggcatggaaacctttccgtgtcccccatttcttgtggagaacagactccagcctccatgattgtctcaaagggtaaattccaaagggagatctgaacagttgctaatcggggaatggaagggatgcaaagttaagagagaaatagccaagaaacaatggtgcagccttgggcggcacagtcatataaacacgtctttaagtactttatagaattaaaacccagcaaatggaagatgtcaaccttcttcataccataaagatcacctgagccagtctaaaggaatcagaaaagctcaaaaaccatcatgatattgtaattatcctccaattaaaataaataaattaaaaaaaaaagattacctgagaccagattagaggagcaagggccctgtacacaccataatcttatcagcaacctcacctttgaagcattgccataacacccctcaccaaagagccctgggttggaatacacaggggaggcgcctgctgtgtccccttttgccttgcagagcagtaaagctattgtttcctgcttcacctaaacctctgtctccaagaatcaacttggcacctgtgtacagaggccaagcttttcagcatcacttccacattgatctccattgagaactgtgagctcctcagaataaaactgcctaggatgtctccagcacactcaataagacattctgactttagcctaactaacaagaatgagagaatttctaagtgtgtgcaaaatgtggagctgcccctgttccacgagaagaaatgaatacccttttaattttataccattcctttggcctaaaccctttagcatagaagcctggtgtggttatttggctttcctccctcaaattcatcagtaggacataaatcacttctggatacttcttgcttcttcccattctttaacttttggagccaactttccacttaatctattattcctgggaccctagacatggtaattaacctcagagatggaatttagtcaaaaatgcactttgcaaactgctttacattagaaaaactttaattgtgttcagcaa

SEQ ID NO: 39307 - DNA, 832 bp, Bovine  19866880914769
tgttttaaaattaatagagcttcaatcttttttattttgccaatagattgagttgtgatgcctgctaactctgtcttcattctgatttagtaagcatttattaagaacagttttatatttctctaactgcatcaccaaagcctctctctgtcccctggacattaaattaaatataaaatagattgcaccacagctaaataaatagatccttaattttctcaagcaacatatacacacatgtataaaataaaataaacggtatagcgttgggcgttgggagtagagaaaagatggctcacatgtaggtttagttatcaaaatccacagcatataggctgacagcttttgaaatacataaactgtttctctctctcctgtttccatagcaacagagtgcacaaagccttcgtttttgcacatagagagaaaaaaaattgggaatggagtctggaattgtctgaaacaaaagaaaaatgtagaaaatggaaaattaagcatctatcgtcctcaagaccttcacacttgctcatgcccccttcacatttgttatttaaaatatctatttgaatacatgttagcatagctttgaggagctgggtcaggacctgaaagattagagcattacacctcccctctgcaagtcggaagtcattgctgtctttgttttggtcaatttcattatgactccctcctacaaggcattctcaccagagttttgttgactagcttttggtgtgttcaccacacttcagattaagatttattttcccttctccaggggatcttccgaagccagggatcaaacccaggtctcccacattgcaggcagatt

SEQ ID NO: 39308 - DNA, 776 bp, Bovine  19866881053298
attttttttttgtattaaatttggagaatggatatccataatggatgcgatgccataggattagttgcagatgtccattgggcaaagatgtttaggaaattctccaacatgaagaaatataggggtgcaaattccctagaagaaacaggaataacaaaatcagttttgaccagatacatatggatgaaggaaaagtttgagatttttttgtgctattttcagggattccaattacaatatgaaatctttgtaggcctaacagattatttgcaaaatgcatttctcagctaaaactacacattttggtttctgttagattagtttttgtcattccggcagctgggctggctcatgctcatttaatcacctttgtcattacagaaaccagagtaaaatgacatgcctaagttcacacaagagtcagggataggaagaaaattagtaaaatgttccgtccactagcttcccggttgatacataatccacagaaacatcatatgttgtttatatcaagttatttgaaattcttccatgttgtttctcattaggaatatgttttcccaacacacttttcttttttttgctagagaggaaatatggattaatttcttgccagttctgtgcatagtcctactttcgttatattaaatgcatcctaaacatgctataggtttgttttggattgtttatagaaacatactgggaaggaaaggaaatgattgctaagctggatttcagtaagggagtaatcagaggctttcatagagctgatttca

SEQ ID NO: 39309 - DNA, 976 bp, Bovine  19866881137979
atacaaggcagtccgcatgatcccttcaacattacagtcctgattgtataataatgcagaaactacaggccagttagctgttccagcaaattctccctgtaagtggtaaatttctggaaaaaaataatttctaaagaggcttttggtggcctgaaagagttaatgcagattcctaaacagcctggtgacagcctgggaatagtgatatttggttgactatgacaaagaatctgatctccctgtatttgtagtgccaaaatagcattgcataagctgtcaagcctcaagcaccaggagcctatcaccaaatattaatttacctgttgtgtgcatctaataactgacagctctgaatcccatatcatttttggtggccttcctactgacatgttctttgattaagaaaatagtcagccagaacgccagtgtgtccctaatgtggccacctcccatttagcctccttattatgctggaatatttttctctaaattagattttctgtcttcatagtggcagtttacatgaatttaatacattataaaatgtgcagtccccttgagattccgtgatagattgtggtatttgaaacccatatttccatgggaaataaaagcgtaggccatggccaaatattttatcagcttaacattatcttgagataatggtactattaatgcttgtcacccctgtctgtttcccagagcttgtgttgcttcctttcttgcctctgaacaaggtgctgaaagttttagagctttgagctctactagtaatattcaacccagataggtaccctttgttctatgttgtctaggaaaaatcatgcatgatgagcccctctgttatttccccctcactgatactgaatctagtttccaattatggctacatgggatgggacctctgtatattacagcttggctgtgatgggccagtgatacagtgtcaaggatagcagcacagctgtgatctctt

SEQ ID NO: 39310 - DNA, 779 bp, Bovine  19866881231726
taagccctttgaaaaagataaagaaatatgaaggatgtgtttcctcttccctttcctttaagaaaaggttgaatgtggtttattacccttaattattatgactcccttgattcacctggcaacaaattggcttatcagccagggactattagttgtgcattagcatcaagttagacactgtatcagttttcaataaactcaatgaataataacttgacatttgaacagagctttgtaatttgaaaactatttttcacaatattctttctcttcatgtttagaccctggagcaggggttgacagattacagccacagaacaaatctggccagccactagtttttataaatatttattgggacacagccatgttccttcttgtacgtaccatctgtggttgcttttgtgctacaaaagcagaattgagtagttacaaaagatattgtatagtccacaagattaaaatatttactatcttgtacttgacagtgaacgagagctaagccttgctctgcagctccatgttggtatcctctttaagtcagttaccttcacagcctttgtttcacagtgatatttgtaattgtactattgttttctaaagtacaagctacgtgaagtctagagctgtgtttgacttatttttttattcactgaaataattaaaataataggtgatgaaaacattaataaattcatcttatttgattctcttaaaattcctacgagattccatacacatctttacccttcatatctggaaagaagtaaaataaagtg

SEQ ID NO: 39311 - DNA, 1859 bp, Bovine  19866881233802
ttttattaggtttttctttatgcactactcgattctacacacatttcattgcgtctttcagcagaggtgaaaactaataagaaaccataatttattgaatgaaagcagttcatttatttgaggacaattaactaacctctctttagcattccatttttccagttaatttatctcaattaccttgcttctttatgagataacttgttgatacatttttgacccagagtgaatgcatattaaatgggactaatgtattaacattatttgcctttaccaaatatttccaagacatctccttcatgaatatcaacaaagaaggagagaaacagggcatgcactgggagtctgttatacaacagcaacattttagttatgccgtcacatttaaccctgtatcatagtgaaaattgcttctggaagctttaaattttgaaacatgagaacagtggggcccagcaaggttcaacagctggtccaatgacacacagttaatgagaggtggggacaagacacaagtccaggtctgacgataacaaagcctattatctttccaacacagtactctgactcacaggcaaatgagaaaacaaatcccctctagagataagatctggtgtctggaaagattaaatgacatacagcaaagggacactttgagtcatggagagccaggtgccattcctgtgttctggactgaggtctgccttgaatgtgtccttaaagcccaatcctccgtagggaaccgtgttttccatctgtgtgttgcaagcttcccactcaggaaaggttccagattgacatctggcaatttaaagttcccctagagttatataggatgagaatctggcttatattttcttttcccaacatagcagctcatcatgactcggctgtcacgggctgttacagtggttggcaggcttggtgtgtgcaggaagtcggggtgacagagccaggatgcctcagtggttaaggatgagaacagaggtcccgagcactgccactgactccaactcctgctttaggcagtcacttaacctctctctgcccagtcttcccatatagaatggaaacaggaacactgataaaaatcctcagagaagctatgaggcagaacccctccacaattaacacacagagagaacaatggaaaagtttaaaaccatttcagtgtgagatcattcggtataaaatgtcattaaaatgattactgtttggcaattctggtccagcaagtcttcaatatagcattggctgctgtgtgtagccagccttttaggaactgctgaggcaagaactgctttgtggagattttgaaggacaataatagaaaaatcaaatttttaagaagtgcattagatcctctattctccagctttccaaaggcttcttgatgccattttctacatcttcttcaagttttgcgtgatccctagtccctgcattagagtttgcatcaaagaaactatcagttgagagtcactagttcaatgaatcaacagttcaaggccaagagaaaccataatgaaaggtccttgggactttaactgttggatagaatggctaatggctctgactttccttgtattatgtggaaataattcctaagtgccaaattgttaagaggtttcatatttccattttccagtttctttgggctctctaaacatgcagtcagttgcacaggtgtatagcttgggcaaacacccactaaagctttactggaccctcaagctcctaagaaagtgaccatccacacctgttcatgcctgggtggtgtcctccttcactgctttgcttctcccatctatgtgagaaatgagacttgctctccataagatgtgcttcatatgctatga

SEQ ID NO: 39312 - DNA, 1264 bp, Bovine  19866881269939
cccaacagctgtgcactagcatcgaagctctccctcgggtgctttcaagcctcagtcaggacagtgatgagggaactacattggaaatatggagcttctgatggctcaggtgagttggtcaaaatcagaagaaaaaaagaaaaaaaaatcacacttcaaagggttgtctgcattaagaaaagcacaatgaaagaggagaagagagagggcagccccacaccaactctatcctggaggctcttcttatcattctgctccagtccctgtgattatgaggagggaggggaagcacccactaatcagggcagtgtggtgtgctattcacaagctcataactggcagtaaaacagaaaggcccgtgtctgctctgctgagtaatttccacactgaggccctgagcagagatgttgtgtcatttgtaacatctgccttggcatccaggagccaaagtaagctagttagagagttccactgcttctttctccctcctcttatgacaaatctaaaggactcagggttatttataaagaaaactagtctgagctcttcagagagttgtcagtttgatgcaggtgagacagaagagaggattggaagttaggaagacactctggcctcttatttacctagaaaagaggggagagtagcatcaggtgtatatggagaaatcctcaagtatcaaagcagaaataggaagagtagagggggtgggggtcgtcaaaactgcacaggtgggaagatggtctttatgccttattagttttcaagctcttcacaatgtctcagacaacaagagtgaacaatttttatatatgagacaaagctccaggagtaatggggcttcccaggtagctcagtggtaaagaatccgcctgccaatgcaggagattcaggagacaagggtttgattcctgcgttgggaagatcccgtagagaaggaaatggtaattcactctagtattcttgcctggagaatctgatggataatggaaactggcaggctgccgtccatgtggttgcaaagcgttggacacgactgagcacgcatgcacacatgctcagtagcaatgatggggctcgatactaactgctaatttcaaaagtagttggtttttaattgtaatcttaacctttcctacttatcctaaaacacagattctagaccagtgcttctcactcttaatgtacatacgaatgacctggagatattgttagaccaaggattccgattcgaagctctcgggggacagaatacaacttccag

SEQ ID NO: 39313 - DNA, 1172 bp, Bovine  19866881350329
ctgcaggatgggcccagaatctgactttcagctctatctgtgttcccatctacctttctgtaagtaagcttcaaagagaggtctaatttaagacgtacggtgtgttcaaacctgtagtttcagataaggattctccctcttacataatgcattttaaaatgagagcaaaaagcccatgtcagtgttggattttcactgcttggctctcagtattcttgagggcttaaactgaaggagatcagggtttgtgagccacagtaattagtgctggtggcagtaagactcgtagaactgttgatgaaaagaaaccataatttctgttaaactccttagggtcttttttctgaaagggagccttgctatatttctttttaaagcttggatcaaataacttaagcagacgctatgacaatactatttgaaggaaagaaacctatggtatgactcactcacccaccaaaagagactcactctatacacctactttttccttggctttactttctgagtcttctgagtcaaagcctttgaaaatcagtctgcatgtcaaatccccatgaaaatctacttgcacacatctttactgttcatccttatccatttcacctttttcagtgtaagctgaaacaatttagtgattcattaataaggtccacatttaccagaaatctcatttttctctccaagttaccactgctttagtgcccatcacctcatctgctgaagactgagagaaaattcctttatcctcagaattttacaaatcctccagttcacctcaactctcctctctgagagccctcggttactgaagagacaaacttgcatatcaaggtcagaaaactgtccttagcagcttctactctagtatataaaatcaccctgatttcatttgcccttgagagtactgggaaaatttttaattgagtagagggtactcttaaagaattaaatttggtgctcatattatatccaaataccactgcaaataacagatatactgcctgccacagagtaggtttgctgaatgagtccttgtaaagattgtagagctactgtctgagattatctggttgtgcaatattttattcaaaaaaattttactgaacatttgcatggcaggcatagatgcaatgtgcactggacctcgaatccatcatcctgcctccaaa

SEQ ID NO: 39314 - DNA, 831 bp, Bovine  19866881422092
aaatgtattccacgttacagctgtactaatgtacttatttggccagtatcttattaattgatatataggctgggtcttttctttagttactgaaacattgcttcactaataccctttgtgtgagtgagtacatttgtagcccacattcctagaagtgaatatactgtatcaaagagtaagtgcaactaaaatttgatatttacaactattgtcaaagtactttctaaagggaattctcctaccaatggcagttgagaatgcctgtttctctataactttactaaaattgcaaaatatcaaatgtttttatctttactttttgaaaagaagattcgattttcttgttgttgctacaaatgccatcaggatatagcttatttaccttttcacttgatatgaaaatcaaagcaacaagaatgtatcagtttcatttaactctctatgaaagaagtttaaagaaaaaggtgtgtgtaaattctcttcccctcacacttcaacccccaaattcatacatatgttttaggtttctttaaaaaagaatgcacttggatacaaaacattgttctaatttctaatatgtgcagctccatttgcaaagagcaaaactagctataacaggtatgtaatttcatggtgtcttatataagtggtcatattttgtgaggagaaaatgccaatgaggcatagttaaaggtcacctattttaatgaaccagtttatgactcatggttttacccttacttttctttctctttttttggtaggttatactttgattagcatagagatgtctagtattgtagtacttcaagtttaatattcttatccaga

SEQ ID NO: 39315 - DNA, 2464 bp, Bovine  19866881564211
gatgccttctaggtctcctgtctatgataaggaaaatgaattcggccaggttgtaaggtaactaatatgtatcagataactgttatatactcagtcttttgcttgatcatgtggcaagtttaaaagtataagaagggatctttgactttaagaaatgtagaatttgttatggtaaaaattgttcacgttactatcaaaaatgctataagatcaaagagacaaatttttgaattacttatctgtcaaatagggcttcccaggtggcacagtggtaaagaatctacctgccagggcaggagaccaagagacacacattcactccctgggccaggaagattcctggagtaggaaatggcaacccagcctgatattcttacctagaaattccatggatagaggagcttggcaggctactgtccatgaggtggcagagtcagacatgactaagcacacacacacacctgccaaatactgtgtaaaattctttctatattacctttataatcctcatcaaattttttttaaaggagaagaggaaccaaaactcagaaagtccaacatgtgtgctcatacataggcagtgagaggtggagtcaggacatgaacttagggatctgattgcagagagtggattcttaacctctgggctgtactgcattgtacacattgtaaataagaaacttatcttgcaattactaaggtaaacttttaatagccattatctcatgtaattatcacaacaaccccatggagtaaacgccattttttaattgttgttttacaatagaaactgagtcaaagataggccttgtacaaggacacacagctggtagattggggaactagcatttgaaaataggctgtcagtcacaagacatttcttccctaaatgtttgaaaaaattttcagtttgtgagcaagtgccaagaatagcccaataaacacacacacacacacacacacacacgcgcgcacatatccattatctagattcaccaattgttaacagtttccacatttgtagaaccactgctaaccactataattatatagctgagttatttgatcagattgaatgctataggaatttatttaaaaattaaattaatagatatgagtggctttatagaggtgggtcttaactagttcttgaaatttttagataagtagagaaaaagaagatgttctgaaatagggaaactctgggcacagcaggatgctcatgcaggcatatgtgaaggaaagatttaggttgaagaaccatagaaaacaaatttcgggcaaaattatgagtatctggaagccaagcaaagagttcaggctgattatcatagaaaaaaaggagcctctgacagccttttcatcaggagaaattgcagctaaatattggcatttataaataattaatttctttgttttttaagaacttccacacaatatcactactctgaggagtcatagcactcttctcgttctcagacaatgctttggaaaatcagtaatctgaagaattattgcaatgacattgcattgagtgatccttacaaaacttagcaaaactgtaatagaaggaaaacatgtgtttgtttgtttttttaatgatttctttacccacgtttaacatcttgtctttgttcttcttaactattaataggacaaggaagagaacaaatttcatgcttgctgttattgagactgcagatatactgcagaatggcattttatattccagaattttccctttctctccaatcaaaaatttacctgacctgtgcctgatgtttttaaggccctcctaagtcatattatccaggccagctaacctaaagaatttaggtgctagcttataaaaatataatgtattcctcttaaccaatgtataggggtgaagagatttaggagatgttaaacaagctgaaaatatggaaccctttaaatcttaccacataggtggccaaaagaaaaaaaaaaatggacctatgctgtgttcatccctgaatgtgatcactggttttaataaatggagaagtaaaaagtatgctgagcttactgaaacactgaaggttttagagtctcactgcattctagaggtgtggattcatggtcactgagcagaggagctggaaaaggaaagctcttttaccacctgtatctgagagtcacattgcctgtacttcctgtgcttgacaggagaaactgagatgaatattgcaaaacaaatatgctggccatgtgtatgatatgctactaacatttcaaacatgatgcagatacatgacacacctgtcatcctaaccttgtaaatccctctggttctcggggtggtgagttgtaaacagtaatgtttccaagtcagtagttttctctgctatttcagggtcagaaagccttggaataagcaataaatacaaaagtttattctacagtcttagtcaagttaaaccaatctcatgcaaagatctaa

SEQ ID NO: 39316 - DNA, 1347 bp, Bovine  19866881646949
tctttgaaatgaaattgaaaaggaaaaaccattttctttgaggacaaagttcatctcatttggtgtgctgcacctgtctaattttcttcttggagaaagaaatcttgactaggaaaattttaaaaaaatcgtttatactagtggaggtatgtatcataatgtttaattcaaactagtgttacattctgagaaaataaatataagtgaattactgtctgtttgaagctgtgataaatacctagcttggctgaaattattagataccattattctgtttccaaaacgttggcgaagggcaacagtctgaacgacgctgaagtgagcactctccaatgttttcctttgttagggaagtgcaggtgtgctgtatgatggtgggtgttatcacactgaaaaccgacacatacccctcaaaggtgttccaagtaaataccttgcctgcttccaaatttggaaaaaaaaaaaatcagcacctatttttagagtagcatgtttataaatattaaaattcacaattgacttttttaaatgccactaaataaatactttagataagtctgtatccgtagcaaacaagagggctttgctatctgaagttatgacttcctgtaaataagaatgctacaagattacagatcaacacaaaatgaaatacaaaatatgagtgaatatgtcatctaaactggaaggaaatatagctgtgaccccagacaaggatttatgttcaagatagaaaaatgatattttagtcaatggaaaaaagaaagtaatgaaaaacaaacccaagggtaatcctcccctttaatgcatcttgtctcctatttccttgcctctttggtctttttctatttccatgtcagctctccttgttcaatcttacctgtgcgattcgctacatgtttatatataaatcccatatattggaaatagatgcatgattaaaaatgagaaagcatttgaaaatgaaaaggacaagcaaaattttatcttatctgttagatcatgggaaacagatgatctcggcttttgccaaattcgcctcaaaaatttatattccctagcttccttctttgtgaatgttttccatttggaactacactgtcagtgcctttttatttgttctgtatccaaatgtggattcagctggattcctctgattttgttttcattccatttgtatctctgtagaagactgttccacatatccacaccctttatgcaaaatgtaatagctattaaatacagtgttcaccatgaccttcaaaaacgaagacctactatttgaaagttttggacagtagctactttctttttaaaatcaaaactcaaccaatgtcctgataatca

SEQ ID NO: 39317 - DNA, 3185 bp, Bovine  19866880424510
cctatctcccctagctgacctttctccccttagcctaaatatcatctcctcagactggcctcccctctttccgtatcctcagcacccaagagaacacctagcatttagcgtatattcagtatctgttgggtgattgccagataataatccatatttgccaactgagtatgatactgtcaggaaactcaggaggttgtgcttcttccccatacccagtggaaaaacgaacaatctaaaaggcagatccaaggtggaaatcttccttttgttttgtcctcctaaactggaagctagggagttgcctccactccaccactccccacccaataaagggagaaaggaaggggaggagggcaagagggagggagaaaaagagagaaagagaaaaatctcagcgaagactggatcatactaagtttgagggagaaaaagttatgacttctccaagttgttaatatgtttatgtcagctgaaagtcttcaagaggagaaaagatgccttgtttctaagaatgatttgaccaggcagcagtgttcctccccgtcttcctccttgtcccgaagatccagggactcatcttggcatgcattttgcaaaacaggaagttaagaacagacatgtgcaagacagttaccgtcatcccaggccctgacgaggcgtttcaggttcgtcacttgctttggcccctctcccttttattgatgaagaaatgagcctcacagaggttagctcactcaaccaaattcacagaaccatcaaatcaagcgtagcggccaggatttgaaccattgattccaatggccttgatcttctcactgctacacaattcttctcaaaatgttgcttctaattcactaaagcagatgttcttgctagcatgcagtataatcacctcaagagcttataagatacagattcctgggccttctactagcctatttaattcagtaggtccaaggttggacctgtacatttgcatttcttttttaaaaaataatttattatccctattttagccaatgaaatctttttattattttattttatttttctggctgcactgtgtcttcactgaggcccacaggctcctctagctgtggcacatgggcttaggtgccccacagcatgtgggaacttattttcctgaccaggtatcgaacccatatcccctgcattggaaggtatattcttaaccactggaccaccagggaagtcccctatatttgcatttctaacaagtccccaggtagtgtctgatgttactggtttggggcccacattttgagtaccactggcttaaacagcaagtatcactgtttctttttccttttttttttttttggtaatagtgttcttagaggcctgagaagctgaagactctttcaagtagttgttcctgccttcaaatgatacaactaattcattttaattccacagatatttcttgagtatctactgttatagacccatgatgcaataaacagagatgagagtcagaaatgactaactccaggtacatggccttagggagacccttatctggctggtggcagcatgggctgaggaagggcactaaggagagtaaaaataaacagatgactgtgataacagcatgtcaggtgttctgatgaatgcagggacccagtgcccaggcataactgggccctccccgtctgcgcgacagctgggctggggaacagtctccctacagagttggcacctgactggtctcctacatcatgattagtagtcagctgggaggaacaggtggggttccaggaaatccaagagcaagtgcaaaggcatggagataggaaagaatgtggtttatctgaggacgactcagggaaatgttgatgccaagactagcatgcagatgtgtctagattcaggccagtatggggaaccactggaaatgaggatggaatttggttgtgaagggccttgtctacataccgtgggttatgaatggcagtcagacaatgaagaaagctcataattgaggtaggtgtctcctgaacaagataggcaatgaaagtgaaagccgctcagtagtgtttgactcttggcgaccccatggactgtacagtctatggaattctccaggccagaatactggagttggtagcctttcccttctccagggtatctttgcaacccagggatggaacccaggtctccctcattgcaggcagattctttaccagctgagccacaagggaagccaaacctgctgcttattcagacatacgttcatttggtaaattttttttgagtctgtgctgaatgatgagagcagtacaaagaagactcaaactctgaacctctcctttaggaagagagaaaacaattatgacctaaactccaatatgaaggtgaaaatctgcccttagtagaaggtgtcaagggacttccctggggttccagtggctaagatgccacgctcccagtgcagtggagtgtgtttgatccttggtcgaggagctagatcccacgtgcccagctaagagtcgtgccacaactaaagatcccacgtgccacaaagacctgaccaaaaaaaagcacaaaaggcatcacgacagaatgagaagttgtggagcagcctggaggaaaagcggtgacccaccgggagaagcccagaggccacatttgtgataactctcacaggagactcagaggtaaagcaggtcccaactatcaccctcgcagaccttcatgagtatttgtatacctagttctctgattcaccttcagaagtgtagggaagaaggtaggaagcttacaatccaaaggcttttagagaggggttgcctgtagacttacgcctgccttttcctccttgctcaacatccagagaagagctggcctgcgtgtctccgcagcctgatgaaaggatggatgtgccagcctctaaataattgctgcatgaatctttataagcacacaaatgagcggcactcggctggtctgcagtggcggttatcacccgcaaatgcttcaaagaatgggaagcagaggctctattcccttcttcccacactccctgatgaatccacactcttagaatatgagcaaagactgactgatgagctgatttagtttagctttgtaggatttttcccccaatttagcaagcaatgaggacccgcgctatttctactcttccattggctcttaagtctcat

SEQ ID NO: 39318 - DNA, 1707 bp, Bovine  19866880491690
cttggtgtttctaattctcttgaagcatctctagtctttcccattctattgttttcctctatttgtttgcatcgatcactgaggaaggctttcttatctctccttgctgttctttggaactctgcattcaaatgggtatggctttccttttctcctttgcctttctcttctcttcttttcacagctatttgtaaggtttcttcagacaaccactttgcatttttgcattttctttttcttggggacaaagtcaaccttaccccctacttatgagactcacctaacatggcagaactgtgtacatggcaaaacaaacgtgaactactccctgtgactgtctttgttctttgcctgtatagtgtggcatgttttcataagaaaagaaaaatcctgagaatttttgcttagtgatactgacacttcagtcacatcacttccaccatgatggggttgccctgccatgttcataccctgccttgcacatcattgcatcacctgacatgcaaactcctcactcaccttaagtctctctgcgtttcagcccaggttggcactagtttctttcttagcagctgtgattatttgaaaataatgtcaaaacaaataatttccttttttcaccgcctgacaatcatttagtagctatgcctattcccgagtctctgccctcatctctctttaattattctcttcctcctctcctccatcaattcccttggctaattcagaattccccaagaagttggacagaggcatctgagggctgggaagaaagaagcaaccatttcctagagctcagtgatgtttcaggaccatggacagcgatattggatggcgataggaaaaatccatttgtctgtctttgcctgtggttaccaggcccctgtcggaaccccacaggtggtggaggtgacaaaactctacaaagacactttgcagtgagaaccattctccccagagcttagaagccaaaccttataccatcacatacaaagaagagattgcatctgggccctgccgttgtcctaatgtcagctcgcttggcatttaccttccttccccaggctgacctctgatgatgggggcaggccctggaggcattgttctagctgggcaaatgctgcagccattgtgtcggcatgggagagctgccggttcctttccagcccaacactgtaattttatcaactctggctcagagaaacctatatttataatgctaattaggagagcacacatttaatttgagtggaagactgtttgtatctcgctgagcctgagagcacagggctcaagcgacaacagtcagaggcaaagcaggcctttctcccttctccaagtatttgaaacagggctgagccttgccaaacagtttctctgttggattaaaaagagacgaggggggagggggtgagagtgctgaatatgccggagctcagaaaactttgcgtttatctcctgtctgcataatatatttctctgtgcactgagaaaacatgcctcttatgttatctaattgtttcctgacacatttagcaacatttcacactctttaaagtgacattaacattgctgacagtggaggtgctttcattaggtgggctttgaattgtagccaggatgcactgcaggtcttccaacaggcttgtagaagccgagaaaggcattatttatgaaaatagagccttggccaacagtgcccccgtg

SEQ ID NO: 39319 - DNA, 1275 bp, Bovine  19866880507621
ggagaataattataacatgtgaaacatactcaaccttcagatctgaaatgacaggtaaataacacaatttgaaaggaatagagtctctctccttagacaacgtttatgtcctctcgcttacaatgtaaatatgacaactcacaataacgctgctcttagcctcacaaccgcatttgtgcaggtgctatcaccgagaaaaatgagcatctatcttccagcttcaaatgtgtccacaaacggtaatttgaggcagccattcttcctaaacaagaatttccctcaatgctaattgcttctaagggctggtcagttaacggtgacaaatacttccactcattaaaggagatgccattgagaatgggtcccacttaatgcaaggatgctttaagtggcaggtcacaagataaaggaactttgggtcccagggctcaagtgacacctcccatgtgccacagcaaatggctagagggctttgagctgattgggtcaaaaattagcagatatgacaacactgagaacgtgattctgcatgtcaaccattgtgatgtccccaccacagcaaaactgtcaatgtcgagcaaagactaaatgtcaagtctggagatcccaccaccttttaaccactcaccacttctctgactggtatttactagggaattgtgacaaactggagagtgggctcctgtttggcttctgtatgcagtaaagtttatgtatcttgttgtcaaataccatatcgatactatacatcagaaaggaataagataaaaatttactcctggggagaaatagcattgaaccaaactatattaggaccttgacagacaacaagagaagggatttctagaagaatttccaaagaatcacttgaacacgaacaactcatttttgctgttctgctttgtatgttctggttgctgtttccaggcagtggaggatgcatggcgacggtatggcatccctaaatccttgagctgctcccagctacattcaggagacacacacatattccctaattctgtgtgtgtacctaattctgtgtgtgtgtacacataatgcacgcacacacacaggccaaatgaactatgagaaaagcctcaaaagaaaagaaaatgctgtaagaatataaaaatgggagaactgagggacattgtggaaggcctcactgagatccgtggtcactgagctaagagctgaaggatgaagacagaagggaaaggcaggaacgagcaagcaaagcaggcatgcctcatttgactgcactttcgtgttgct

SEQ ID NO: 39320 - DNA, 933 bp, Bovine  19866880535174
cctagaattgatggcgtgttaaccttgcatattcaaagaaaatcaaatgagtgcttgcaggaacagttgccaactgcaggcaatggagacttcagtgcagatgaagctaaacacctgatgtgggaggcattagggagagcctgaggcatagatgagaaagtggcaaatcagtagttgctgaaaatcactactaattttatcaaattctctacctcttacacggtgaacatcaaacccgcctgcctgggtcagatatctcttctatggtcttgtacctgggaagatagaaaggacaggagaatgcacctctgttcccaggatctggcaccaaaaattccaccagcgaagtctcctccaggagcaggagcgtcctgtgcatattcagctctgtctgcctttgccttacttactttctccgttcctttgaacagagaaagatttgaaagcagattttgattaatggaagatttaaagagtattaggacatcttgcaggagcaaattggggaagaagagtcttcaaggaacttggaaatgagccagtagcaggctgccattctccacttttcttcattttcgggaaagctctgcttcctgtgtcgagatcagatcatggtttaggaagcactggttcctatggaactccaaattttcccttaccaggaggtagatctgataggttagggttcatcaaagtaatgttactgtttaaaacagtaactgttttaatgttactgtttaaatctgcatacttatgattcaaagtttaaccttactttttctcctttcctcccttcctctcttctcatttcttgattcttaagttgctgtgtctctttatggagatataatttatataccaaaaaattcacccactgtaagtcctagatttaagattttcagtaaatttatacagttgcacaatcatccccaa

SEQ ID NO: 39321 - DNA, 944 bp, Bovine  19866880568296
tttcatttgtccacactcgtccaaatacgactgtaaatatggaatctcttaatattgcattggcaaaaaagttcctttgagttttatgtaagacgtatggaaaaactcaaatgaactttttgtctaacccagtagttttacttttcttttaccttttaatgaagtccttaggcttatagctatcaaagtgtaggagataaaggtataagactttgtcaacataatttggtctcgcatacacattacctcaccctacagctttgtagccctgtagtggtgacttgtgtatatttgttttgtaaatataatgtgaattaaagtgaaatttattttgagactgttttactattctataatagctttgaaataattagagaagcatttgaaaatccataagtcaaagagtaagctcctgtttatttagcataatcataaagctggtaaggaatcagtcaccctattattttatgaaagaggaattttgatatccaatgtgttgactttttttctaagtccaactaaagtcagagtcatctgaagagctttatagaactacacagactaagtcccatcgtaagcctcctcatcagtagcatgggtaatgccccaagtggaaatatttttttaagttccccaaatcattctgacatccagccaggtttaagatctatggacctactctatttcatgttaaaattttatgtatgtctatataaacactgtgtgtctccattacatttattaatataaatacatatttatcattagatcatgttaattcctttagaaagtctgtatttgcattatatataaacccaatctatacctatagatgtacagaaccagaaatattataggcagaatggccacaaatgtttttctaaaaattattcagttcctgaactatacactctacttagagtatagaggttatgaactcccct

SEQ ID NO: 39322 - DNA, 1536 bp, Bovine  19866880575551
acctcgtgcaaaggccctgaggctgggatgagcttggcctattccaggaacagagaggagagcggtatggctgaaacacaagagagagaagttaggaggtggacggaggagattatgggccgggtatagtcattgcccagcaaaggcatgccaggcctctcttggcatcttttttcatcatctccagtgggacatcttcctgtcctcaggtgcccaactcactctgctcaagtctgaccctagcactcctcggctctgccttgctccctcttctctgcttactgggttctttgggaaacttaccaaccaggccagtcaccaaatatgctggcagccagctacacccaggttcttgggaaacttctggcaacctcccaccattaagactcatgcagatccaagttcaagtccttgcttggccaccaaccagagtctgtggccctgggtgtgttatttaacttctctaatagcctttgttcctcctgagaaatggggatgagaataaggtttctgggagggtgaaatgagataacacatatcagcttttgcattttgcctggcacatagcaagtgcctagaaaaaaaaaaaaaaaaaactacttcttattcttgatgattctgttttcctctgctacaagaaaacatgtcatgaaagaatcaggagttgcacctatgtagatgtagtctccttgctccttatgtcaggaatcatgtttgattcttctctatctgttcgatactcataatggagcccagcacgatgattgttacagtcctcaaatacaggtgatgctgtttcctgcccggaggcttgggtcttgttctcatagctgggggacagacaaccccgcagtgcccacactgggccagtcagcacctagtgaagcaacttggacaccgaagacatggagcctgcaagtaggaactgaaaatgacaggcgaggccacgtggagggaaggcaaccactccccaaccctcccaagcacggcccaccgctctcatccttccatgcttcctggagcattcagccctttgaaggagagaaaagaagctgtgcagagctttaatgaggaatcagccagacgcactttgccacgggcctggctggaggcggaaagagatgcacaggcccccaggagcgacccgccgctgccaatcgtcactggatgccaccgcagcctccacgctcgtgtggcttcaagcagacctcactgacacatgctgcttccctgcagtccaaccacctgctacacgtgcctggctatctaaggtggcatcaacatcagacgttggaggctggggatattgcctgcgcagagccaggcactgcaggctctccatgggacaggtcagcgtttgccactgcccccgtctacatggaccaggagcaagcaggtggaccagataacaataaacttatttgcccactccctgccctctcccaaggtcctggccccagtagtaacttcttccagaagggccatgagtctgtctctaaccttgtcctctgggcaggtgtgcgtggcaggcttcca

SEQ ID NO: 39323 - DNA, 2156 bp, Bovine  19866880581035
cactgttgaataaatatccccagaaagccagcccacttaacaataatacttcaacccacataaaatccaaaccatttttgtgacctgaagtacctaccatatttataaattaaacactcccaaagcttcttaaaactggtaattttctggcaaacagaattcaaaaggattgattttctctcaagtaatattagaatccccgagctaaatattagcagaaatctcaatccactgccgatgttagacaaaacaagagttcatatactctcatgccttcactttttcttgctaaccagtgaaagcacatccagaaaattagcatctgaggacagttttcacctatagtattagaaaattatgcctttatatcttgtgtggtaattcagtaatgaagagcacagtgtcacaaagatccttgtgaatgattgcgtacactagctgtcccacagatacgtgaaatatcgttctcaaaattttatgtattaatttttctctttaaatcaagtcagataagcttaacaaggccatatatttttttctgcttatcttttacttgtgaaatggcattattagaaaaatcaacacaatttcatttatacatgttgctattatttaattcatatattcagctattgtttctcagcagttccaaattcttttaaactagcattaatatataaatttgaaatgtttttacacttatgtttaatgccagcatatatctatgatagggcttccctggtggctcacacagtaaagaatctgcctgcaatgcaggagtcctggattcaatccctggatcaggaagatctcctggagaatggaatggcaacccactccagtgttcttgcctggagaattccatggacagaggagcctggtgagctacaacagtccatggggtcacaaagagtcaaacacaacagagcaactttcactttcacaatatacagactacttagtattctaagcactttacatacttgcactcgtttagtccttacagcagtattatgctgtattattattatgtcttgatattttgcccattttaaagattaggagaccgaggcatggagaattgagatggcttgtgcaagtgtcatagcaggtaagtggcagagcgtaggttctaatcaagcagtctagttccaaagtccccacttaaccattctaccatgcaggtgaaatccccgccctcctggagtttatgttcttctgagtagacagacaataagcagaaaaacattacagtcattttcaagggtgataagtgctttgaaggaaataaagcacaacaaagagatacaagactgggacacctcagacccacacgtcccagtgccgcagggtcacagattcttctttaaatgaaaactgccctccttgcttccgtggagagaactgaagagccagccaagacagatgtcccttctctcttctgaaaaatgcctttcccagggtcatttgattggttgttgaacagcgagcaccaccgatggtcctaagccattcctgtgcccctgggctgggcagccagttcagaaaaagatgactgatgcccaaattaataatgagcaatggtcccacgcaagtaatcaccttccccgacctgttcctcatgggggtgataactcgaatcccaggtgaagtatatccttctcacttcgccaccaaggaagctacactcattcctctggctgacagcaatttgtagacgtgggtctgggtagccggacatttactaggttgctaaggaacaaatgccttggttacaagaggctccaaaagcagtatctgtttgtcatatccttttagatcatttattttatcccataaagacagctgcgaccaatgaactgtaggatagagggaagctaaatatgaacatttgtttcctgagagatggaggaaatttctacttcctatacaacatccctccccaggcccccagacacaaaaacgaaaaccatgtgctttcctccacaacccttacaacttacaagtaagttgttcagagtcacaaagtatttcatgaaatggttatttttttcaggcacggccctaagcattatctcatgttatccttgcaacatccccaaaaggtgtaggtattattccctagcagaaaaccaggaaaggggttcaagaatcac

SEQ ID NO: 39324 - DNA, 2848 bp, Bovine  19866880595288
tgtgcatctctatttcttgcttttgtctgggggcctctcatattacatttagattgtatcctttatcatcccaaattgacatttatgcttttacttctattgtttccctagcttctccctggtatggatcaacaatttgttttaatctgtgtcacttctcttatctccctcgacacagaggagcagtcatttggcaccgccatccgcctacagaggtggtgttatcaagagggtggtggggtcctgccccttctccccactatctaaagggctggcgaatgttaattgcttttccagttagtttataagaatgcagaaaccactgaatgcagcttgactggttttgatgaaagtaatggaatgctagtgcctatgaataaataaatctgatttacatagaggaccattgtgggggtggataggaagctggtgaatgcaagcaaattatagtttaaggacacattattccttggcttttattctaagtgcgggaggagagcttagatttccttggattcccagagcggtggggcgcgggctgggggtgcggggcggtgtggaggggaggtgggcggcgatcccttggcttcagagaaagatgctttccaagagcggccttggtctgaaacttaagggggatgcgttctgtttggaaataagctctgtttctctgtctcactcttgcaatccccttacaaaaagaatagcaagccgtgaagaatttatgagcagtaaactgaacatgttggcgtgaacatcagagtgccctggcgatagatccggcaaaaactctcagaggcagacgggatcgcaaccatttctagttcgagtttatttgcgtttcctaaattcccgcaagatcacggtgactcaagatggaataaatcaaggcactcttattttcagacgagacaaggcaaatatgaaggaaagctgtgctgtgtgagtagcctgatcccagctgactgcctagttgtaaaggtgggagcatgttctccatttgcaacagagaggaaataagagtcctaacatcagggtgtatgtgttctggggcacccaggactgtcctcagataggcccatctgtcaggaaaggagctggccagaggatatggacaactgagcttgacacctggactaaaggagaagcaggaatgctgtgttttacaagtgactctgttggtggcttccaacaaatgaaggaagattaaacgtcaaaattcaatcacccagagaagatatgggtcaagtattattcttggtgctgggagtacagtcatgaataaagcaggtcacagcctccaggccacatatattctcccacccagcccttagcaggttcaaggaggtacataattgaaggagatgttgacatttacatacacatgtttactaaataaaatgctcagaaaagagacagttttctttgcatttagcctcattcatgacatggtagcatccagaaggcctaagaaaacacccccaaaagaacccagcatgcaagttaggagttaggtaaaaatcatcaacaaatataagggggaagaaaacccatctgacttattttgcccgttccagggtcctctgtctataactatatttgaaattgtgttattatacactatgacccatgcttatcttccaagttcctcataatcatttctcaggtcccgatgatgcattgataggctatagattaaatatgaaattaccacagatctcaagcacccaaagatttatggaccgagggctaggcctcgtatcaaatcaaccatctaggaaaatatataattttaccataatattaaaaattactggcagcatcttcatcttatccgattggtggtgtcctgatgataagccacggtacgcaaagagagaaatcatgtgataaattaaggaagagacattgaaaaatatatttattatgtttgtgtgtgcaaggatttcacttgctgtgtatcgaataaaaagaacttattttttaatgcccacttcctcagttggtgccattcacaggagttactaaagtacataggtagggaaaacaaagggtatagttagagtgatgctgttgattctaaacagaaatgtttcctggtcaccatgaatgatatgcactagaagacctagaggggttacaatctgcatttcattctcctctccagaattgtcttgagagtctagatccttatggcccaaagggtggtccacagatcagcacgtttgcaatctctgagagattgtgagatacagcctctgaggccccccaccccagactcactgaattagattctggatcttgagttagatccccaggtgattcatagatgtattgctgtttgagaagtgtaggttcgaggcaaatcatgctgtgacagacataaagcatgaaaggaggtggggagctcttaatgtatctcggaaagtgtcctgaatgaccgtgagacatgacccaaatgatgatgatgataaaccagagcagcaaaacagtaaaaatggtagctaatgtttattgaacacttactatgaacaggacgctctgcagagggtgtttcattcttgacccaacataatcttcatgaggacagccctatgagtagacagtaaataaatatttgctatgagtaaatatttcctgtttacaaaggaaataacgcctaagagaattaaagaactttcccccagtctgcaagcttgttagtagcattgccaaggtggacgacacccatatctgtgtggcttcaaaacaactgtaagatggtcccgttagatagaattgctagttgacaggggaagctgtatggagggagaacctggaatattgagcaggaaattaagtcctgaaa

SEQ ID NO: 39325 - DNA, 4046 bp, Bovine  19866880605177
tcgaggaatggagatctttatttgtgggagaaaaaacccaaaaaacaaaaactagtgtaggccaatattagcattaacattaaatattatgagtatatatgaaaagtcaaagtgttgctcagtcgtgtaccattatttgcaaccccatggactatagcccaccagactcctctgcacatggaattctccaggaaagaatactggagtggattgccattcctttctccagggattcttcctgacccagggattgaacccaggtctcctgtattgcaggtggattctttactgtctgagccagcagggaaaccctatgagtatatatacatgtatatatgaagtatgccaggcctttgaagtactatacttgaactatcttattgaattctcaaataattcttaaaaaatattaatatttgtttccattttacagatgaggcaagtgaggcttagagaatttaagttacctgctgaaagtcacttatatgataaggatttgaagaacaactcctgatttttgtgagcaagcctgagtagatttagtttggagttgaaagtgtcacaaaacatgatcaatacttctgtgaactgagatagaacatcctaaatgctcacaaccgtttcttagaaattttattgcaattccttccaacctacagatttgagtacaagcccttggggcaaaggataaacatgtgcctgggaaggtccctgcgggtacaggctccagttcgtacaagtcacccttagggacctactaattcagagagtctctgcacccagcaggaaggaagttcaattaaaggcaaatgccacattgtgcatctctgctgatgggaatcacctgttttacacgaatacctctgactctggtctgagggaaaaccactcagagcatttcaagtagtggaatcagaggttactgaagcggaagttatcagccagaccctgtcctgtattatctccttgcaggagaggaatgagaatgatgttggcgatttttgatctgattgtattgggaagataatgtcaatgaaaattgagtgttattactagtgcaaagtaaatgtcggggcagactgagacatttaagaaaaaattggagaggccactttccagggaaaactattcaattttattaacattagagctattacatgccttttttctttttttggcaaaaataaaataagataattgagggcacctgataaccaaatatcagagtcaatttatataagggtataatccagaatggaaccacaagtgacctgttttactttgctagtttctctttttcaaaatgaaggacccacaactgcatatgcaaaaatatgttaactactctattctgaaagtttggttacttatttggtacacactggtaaccataaaatcaaaatcctttgaaagtataggtattaactttttcttgctcgtatcctactctgcccttcatcatccaactgttttaacataaatgaaatggggtcatatgcacatttttgtgtaatattggtaaccatgatgaagactcatgcactaacaataataaaaatattaataatggtcctactaagaatagttccatatcactgcttactatgagtcttgtactatgtaattttacatgcattatcttattcctttttcacaatgacctccgataatcctaaaatcattgtccatttcccacgaaggaagcagaagctcagaagagtgaaagattttgcccaaggtcacatggacagagcctgtattttaacacagcccgttcacctcggtgtctgtttcatatcactcctcgatgtgccttccacttgcacagtctacttatacaacaagatttgtgatacttaaaatcatattttaaaaggacctcagggttatttaccccgtgtcctgattagtataagatcaattccatacaaagacatgccttaaggttgtacaaaccaaaactataatgagagttcaagaagggtttagagacattcctggatgatagatcttccccagttagggatgcccctttgaggacaatatcaagaagggcagctctcatcatgtcacaccaatgtcccttggcgctactataaaagacaaaatattgaacagtgtggactataattcttaccccatgggactttttcatgttcttctgattcttaaaatatatctaagtaacctatttctacaattcatcaagcttaactgtgaggaataactgaatcttgctgttccttgtccaactggaggcaaaggtgaagagttcttattagaagaaggccctgctatttctgcagcttgttttgttggagagaaaacgattggtctatgagaagatctgggtccttttttcatctctgcttcccaggtgctgggtgaccctgagcaaactctgatcctcactttactcattaacagtgtgaatgacttgaagctggggtgcttctcctcaaagaaaggatgggacaaaaaaaaattcaccagtcagcagagacagaccagggaatctgtttatctaatcccgaattctagatggaaaaacgtgccttccgaaaaatttatcaccacaggcctgcccttaggcaaatttgggattcaacatttacattacaagcatatatcaggaaaccccaagacaagaaatcaaagtgatcttgacttagttgtattttatagagcatggcacaagccaacacatatttctctgcaaagatggaatgtctctacaaggatgggatacagcttcaagtcaggccccacaaaatatacacagataaattccagagaacataagctcactctccaaaactgcaaagtaaacaaggaaacaggtgttcatgagcagtcatcagcagaaacgacagggggaaaaaacctttagacattggaattatgagagtcaaattgtaacgtaactatgtttaaatattttttaaagaactgaaataatgagcaaagaactcttggggacttccctggtggtctagtggttaagactctgtgcagccaacgcagggggcacgggtttgattcctggtcggggaattaaggatcacatgtgccactgagtggggcccaaaattaaaactcctaggaataaaatattctaaatagaaattcaaacaccaaaaaattaaaagcatctaaataaaaacccaatgtatattagtcacatattagattggaagatacaaaaagtttattcagaatattgaagagagagacaagaagactaaaatttgagagaataggaagtaggaagataaaaggaaaatgtttcgcagtctttctttcctgaaaataaaaggaatgaacagaatgtgggataataatatggctaagaatttttccaaagtgatgaaaaggttgaatcctcagaaagaaatatacacctacctagccacaatgccataaaattgcacaatatcaaaaatgagaagattttgatgactatgagagattagaaactcaggttgtctacaaaagaaaaatgttattctcaacaaatttttcagcaacaacaattaaagccagaaaagaatgaaaatcttttaaatctttaagtcactgaaggataataaatgtcagcctagcattgtgtaactgactgaactattattcaatataaacagtattaatagatatttttcagacaaacagaaaatgagaatttgttaccaactgatcctaaattaggggcttctctggtggctcagacagtaaagaatctaccttcaatgcaggagacctgggtttgatccttggattgggaagatcccctggagaagggcatggcaatctactccagtattcttgcctggagaatccccatgaactgaggagcctggtgggttacagtccatggggtcacaaagagtaggacatgactgagtgactaagcaaaagatcctaaattaagaaactttttgaatattcattggaaggactgatgctgaagcttcaatactttggctacctgatgcaaagaattgactcattggaaagatcctgatgctgggaaagattgaaggcaaaag

SEQ ID NO: 39326 - DNA, 1402 bp, Bovine  19866880606081
ctgaagcatttgagggtgatctttcctctgaccctctatttgtcccacttcacttgagattaatgagctgattctgtggtaccaggataaataacacctctaaatccttgattctcaccgtgattttcacattcacacatcaaaaggactggtcacagcattccatcccccttttgaggattttgtggtacttacctcagctccagatctctaaatcttaggtggaattgccctaaacccagaagtagcaatgccttattttgatttctgctgttggtggctcacaaaacacgtgactgtaggattgggcaggatctagggttaagtacccacagcccaaggaaagacatttgcggaaattaattgctcccaacccctaaggctttggagttatctttggagttggtctctcatggtgttcattagcatatcccatcaaaatccagaaagctctggatttctatgccaagggtgttcctcaatgagattgtatttgggctccatccatgaatatatgccaccaatggcctcaacctctacaattagaaaggacctcctaaatacattaaagatgattcattcaggagatggaatgatggactgctacttatgatggcccatgcccttcttcaaagccagccctgatatatttagtaaactcatattctttttcaaaaaaaaattacctaatcaaatctctcatcaaatgagcaatccattgttgatattatgaaggcctttaatctaccataaatctttattagaactcatccagagcttctagtttgagagaaatgtgattatggcactcttaaaatgacattacatcattggggtgattggtttatcatttggagaagagacatcaatcataactagcataaccacacagtaaatgaattcaacctttctaccgcggaacaatgacactgtaattgctcaaaatcaggcttaaaatgaaatcggaaaatgctctttcttcaaatatgatgttaacttaatggaatatattatgaaaaatcatgtttgaggaaattctatataattaaaaatatgtggaaatatattcccttttttctttcatcagaacctgattttagctacaggatcattttttttttccctttgcttctgagattatgttgcatttaattgaactatcctcgcttatgttttgctgctttttatttcatactatgtaatcgtgatgaatattgtattataaaggacaagaggcttttgaaatgaggtgcacctgctgatagctttttaaaaacagatgattattagcaagaaaatgagcttttaaaaactatctccttttatgcatatatgtatacccaagccaagatgatttccataagaggggtcaattcatactcagggctgtctagaatgtttt

SEQ ID NO: 39327 - DNA, 2064 bp, Bovine  19866880711171
cctgacgaagcagaccacaggactatattctgagcatgtgtaacccgctaggtgtgtgtctttaggtagcttgcttaccctgccctcctgtcccatctaggtaatggggattatgagaggggcttcttgacagtgttagtgagaggtcacccaagacaaaagatttagcacaaagctctgcacaaagggagtgtctgataaacattggaggccagttacagtgaacatttctgagtttgctggtttcttattttggtaaacttattgcagttcttgaaaaccacaagcctattaatgaagaatatacaggattctggattttaattaatcccagacagctttctacaagtaagaaaatatactgggtgggttgatatgaatccacagttcatggttcttcagagactgacaactgtaggacccttctctcacggtggtctttcttaagtaggaagtcgcatgattccttcagaggcaaagcctggaacagagcgtgtggcgttcagacgccctctcgctccaacccctggtcccccaggtgtgttctgtgccactctggaacacgatccagccctgcccagttctctccccatctcacacagtctccctgtccaccacattccagccatgctggcctatttttgtctttcaaaaacagctcttctctttgtcacagggttcctttaccttcaagtctctgtttaaatgctacctgctgaagaacctcccatgaaaccctctcgtgcttgcccctccttcccagtatacatcacttatctttattttcatattagcacgtttcactgcttgaaattttcttcccagtctgcttatcatctcgatacccactatagaaggtatagaaggtctgtggaagacgactcttgtctgctttatggaccactgcactcttaactactggaaaagtgcttggcacatactaggaattcaacaaatacttgtcaatttaatgcatgcccaaatccaagaatcaataagggggttgaaactgaaacataccaacagcatcagagagtccatagaccctttggccgtaggcatctgtcttgtcccagatgaaggtgtaggccaggttaggagaggcctggaatgacttctggaagaggtgcccctctacagcaaccatgagatgaaccttgatgaggttcaggggcactgtggattgggtcatggtgatcttcagcagtgacttgtagcctgcggtcctggagctcaggtagcgaagcttcacggtggaaccagggagctcaatttcttcatgaagaacctggaggagaggaaacacaggtggaaacagtgcatcaaacacaccccagacgctaagctgcgtgcaacccacggctacccgtctgctatcgtcctcaccaaagcatcccaccttacaggggtggggtgtaagaaccccttcccatggctgaggagagagaaaaaaaccaacaaccacaactttatcctgcacgatggggcgaaggggctgaggttatgatttttggattaataattattcttggtcactgttgtgtttctttttaaaaccacactgttggcaaaagatgtaaataagaacagcaggctttattgctagttgcatgcaaggaggccacaagaggctgtaattatatgaacctgcaacttccactgacaattggtataaagcaacagggaagcaataatgtaatatgccctctgtcgtaacaccgatgtagatcattaaagcgcctcttatcatgtatctctgtgactaacaggaataaaaagcaatttgcaggtggcgtgcacatatgtgtatcgtttttattctattaaaagctccagtgactgccaaagtcttgaacaactatctggaaacatctggaatgtccaggagagattcggttttctctccagggacaataaattatactgtgaccttactttttgtccctcccgcttaatagtagtttctggcttaccccaggagaaagagacggtgggaggaagttggccagtgggtttgggtcagggccggatcgagagtcccaccccgggacccggagctcctac

SEQ ID NO: 39328 - DNA, 1892 bp, Bovine  19866880750119
ttgaatgctcttaactgcaattttgtggcatgcttcagtatttattgttttagagtcaaagattcagggagagagaataccctctcagggagagagaattctttcatatggaaagagataacatcaaacagtgattgtctgccttcgatcatgtattgatagatggctggaacgagaatctgaacagttcaccaatgtaacactctttttgatacaccaaagtcattgcaattttacttacaaatacagattaggaagtgaaagactgattgactctggcagtttcaaatgcattatgtttgttctgaccccagctcaaatgaaaatagaatgattccaaacctcggaatggtcccgaaactgaaattactcatttgaaactgccaggactgatcagtgcaaaatcaagttcttctgagtccttcatttggagaacatcaatttcaaggatttaagataatcgtctcaccttattatcagataaatcttcctttacataggcagctactgtctttcaagatagtgcctcactttctaagaaaggaaagacaagacaaaggtactaggggaataagtgatcaaaataaaaattagagaaaatgaatcagaagattttaagcaataaaactaggtttctcttaatcacttagaatcacagaaattctaaagcaccaagaaatatgtagcccaaagttgacttttgaaatacggggaaactgagtccctgagaatgaaagtaatttacagagtaaaaaaggacgaggaagttgatgagaactgactctgatttttgccccgattaagatctatgacataaaatctagcatcaacaacatccatagtagataggcccattctgaagcaaaaggttaattttcaaaacaattagtttctcaaaaaatactagccctcaagcagttgtgaaatatttctcgtattgctgttctcattaaggagaataaacagagaaccgtttggatttcttcggttgtttataattcctttagcaagttcagacttatttgtgtctgaggaaggaagcctcttatatcgaaacatggcatataaactaacggctggttttgacattgaacttcagctctaggattggtaggagtgtttgcacttaatgtttataatgtacaaatagatccttgttaaatcctcagcaagaacagccttgtgtaaacccttctccaccatctctctgttcatctccctccctccaaaaaatgaaggaggaaaaactctatcacagtcactaagcatggggattattggaaagacggaatgactgtttggtttaagtataatttcagtgtgtaaatgttcacagctacctaagaagttaacagaaggtgaaaccaccctacccttactcaaatttccctttttaatataaattctcccccttgaattccctttgaattcttctttgtcctctgttgttttctagtgtgatggtaagttgtatgcccaatggcccaacaactactggggtgatgaggaaatagcagccctaatttaatgctaattatgtgccaaactgttgactatcattgttccaagtagacctaaaggacaaaactaagtagcatccccattttacagatgagaaaactgagataactaaaagctaggtagtttctatagcgtctcatagcttggaggaagcttggctttaactctgctgtgctcctgtttgcccccttttactgcactgtctccactgagcacacccctagaggccttgagttccaagaatctctagatctcattcctgttgatttcatcccactggtgaactttctgtgcaaataaatggtaggaggaaaaatactcagaggcactgagaaatctctcttcttccatcaggacttctgtgttgaatt

SEQ ID NO: 39329 - DNA, 1047 bp, Bovine  19866880763393
catatatagacattaacagtgccattaaacatctcagcttcttctcaagagtaagaatcacaatgaagtgtctgtgagactggtatgtaaatagggaaagtaataacgcacagactcttcttaaaatactttctatatcactattagtttctgcagtgacattttaaagttatttccctctatgttctttcctagttagccaatggaatgctcactcacagagagagaaggcactttctgatgcacatttttttaaaagttggttaaaattcacgttatgaaattgcaaaagtgttgataattcattcaaacttggttttttcccatgcacttttctaaagaaaatttaaagtgtcaaaaatacgtatcttgtgctcattattaaatgctaaataccacagtgttttgagctgcctcgtggccattgtaaagaaaacaggtgttctgatagattataaagtgtgagtcagatgatgtgtgggacagaattttaatgaagctgcaagcatagaactctgactggcctcttgaatatgatgctcagaagtagttttaaagacaagatagtaagaatacaattcgggaagcattcattaataatcaacaagtaaatgggacatgaaaaatcattacagtaaaagaccttagcattacaatgtaatttaatatagcattaaactaaggagaaggtgggtataatttgaaaggacatctatgtctttgtatatgtgcaaatatacaaagaaagtatcttaatcactacattaagtcaagaccgtaagcagaagtcacaattctagatgcagaggtgcctctggagatgggaaaagactcatgattatggaatccaagaataattatcaatttctctaattaggtttctatttagagatcttttgtgaaacctaacttttttcccttttgtttttcactaaaatgtctaggaagaaagctgagtgaaaacacacttggagtttcaggtgtctgaggaatttcaaaagaacagatctaggctttgtatcttcaacctcttaaaaggtcttccag

SEQ ID NO: 39330 - DNA, 2065 bp, Bovine  19866880772443
tttccatagcacattcgggatgatgccagagaaagttcatttcacacctgaaatggttagacctcataccgttccttacagtatctttctgtctgtgctctcaaccctttaaaaaaaagaaagaaaagcaaggagaaggggggaaaaggaatgatatcttcctctggaaacatcacacggaagcaacggtttcacggtggtgcgttaggaaactcttagatgtcaggcaccgaggagatgtgaaacagcatctggtgcttcccgtgcaattttttaaaaaatcatcaaagcactttacatacatgaaaccaccgacacttctgtgggggaggaattattatctggttatcatgaactgggaattgcggcactgagaggttaaatgattttcccagcaggtgagaggagaaactttcccaggccggccaggagaacttccctatttgtatttgtcttctaatgagggctgctctgatgatccacaggaaaattttgggaattggggtaatgatttatcagcgcaaggtttttaaaagccatttcccatgtttcaaagtgaaatttgaccatgagaattcatcgcaaatgagcccagataactgaggctgacacaaattcgtttttgaagtgaaaggatgggaggattggccttgttttcaaactgttaattttcttgttaatcatggggttggttaataactacctggttatgactgtggcagagagagattgtctgaaataggtcatgccttcattcagcccggcgtgtcctgtcttgatggaaggctcgggaagcacagaggctcagctgtgggaggggcgagggaggtggaattgatgacactgtgaccagctcttccagggatggggcagatggaagggctggcgcagggcactcttctgttagagaccagagattcaggacagacttcacagggagccctcaggggacaggagggtaacaatggcctgagatgtcattcttgaaatgtaggcgctttttaattccttaaaattgtttttttgttaataatgtgaattaagtattctctcattctctgtgttctatgaaaataaaacagttggaatatttagacaagattaaaatgactgttaaaaataccccaaatttggctcagatggtaaagaacctgcctgcaatgcaggagacccaggttcaatccccaggtcaggaaggtcccctggagaagggaatgactacccactccagtattcttgcctggggaagtccatggatagaggagcctggcaggctatagtccatggggtagcaaagagttggacacgactgagtgacttagcacacggagatgatcactgttaaccttttgttatgtagagtccctctctctcctctctctgcataagattcgtgagagcaaggactttatctttttttcaatatatttttaaaataggataattgcttcacaatattgttagtgtctgtcatacatcaacatgaatcagccataggtatgcatatgtcccctccctctcaccccgtctcagtcttccgttgtcacagagtaccagttttgcgtcatacagagaatttccactggccatctattttacacatctgtgtttcagagttaactctttcaattcatccctcctcttcccttactgtgtccacaagtcagttctttatgcctgcatctccattgccactctgcaaacagattcattaggactttatcttaattgttcaccactaaattactaacactcagaactgttcctgagcgcatagtagaccctcaataaatatgtgctgatgtaggacggaaagaaaaacccattacatgtattatatgcaattatatattacacacataattatatgtgatggaatattcatgtaattttcaaatcccagtcagagaatccaccttatacaaaccctctttcaaatggcaacatacgggtaccatgaaccatcacatgcagacactaggcttcagtatttgagggctatggaggccgactgcctgagctggaatctacacttcagcacttactagcagaatgaccttaggta

SEQ ID NO: 39331 - DNA, 2563 bp, Bovine  19866880785916
ttgcaaagcattatgaaattgttacttcttattgcaccaactgttagggtgtttgagagcaaggaatatgtcctattcatttttcttgtaaatgattattaagtataatgccaactataattttgtaagtgatttctctgtgtagaaattgtattaaggactttatacgcatcactgctgctgcttctaagctcctcaatgatactgtccccattttacagaaaaaaatattgatctgcaaaaagcttaatgtatttgcaaagaagcatagagctactccgtatgatgatggtacagcactgctttgtgcaaccagactgttattaaccattaaggaaatgttcagtggacgaaatgcttcgagacctgcctctaaagatctgagtagaactacttttcattccaccccaaaaagtagcaagactcaccggaaattgaaattgattaaaataatgccacttgaatactcattatatatatatacacacacacacacacacatatatgtgatacttatcactcaacctatatatttattatattacatgagtgagtgaaagttgctcagtcatgtccaactctttgcaaccccacggactatactgtccatggaattctccaggccagaatactggagtgggtagcctttcccttctccaggggatcatcccaacccagggatcaaacctaggtctctcgcattgtaaacgaatttcttaccacctgagccaccagcgaagccccatatattatattatataatatatatatatatattgtagattgagtgataagtattgcatttaccccataacaaaacagaaaccatcaaaccaaatattgccccctcttccaaaaaaatagcaaatgttaatgttattgattaaatctgggagaagctgggttcaaacagataagagaagtttttactgttgaactcgtccaagcttttaatatgacaagagttattatgaagtgccaataaaaggctattatatgaattatttttcaaactaacttcactaagaaacactttctttgtggagttttgtactgcactgactttctatggattatattttagaaaattcccaaggggatgctagagcaatcagaactgttcagacttcttcatgcatttaatgctgacacacaaatggataaagaccaacactgtaaatcagcattttattttgtgcagatatggttcagtaaatgcaactgggcacttggtacactaatataatgagcactttttaacagacattgttttctaaaaagaaaataaagttatgcagaagaaattccttgcatcattctatgcaaaatgcataacggatttttaaataaaattccaaaataaattgcctgattaagacaaatgaaggaataataaatgaaaacactgaactcatatatttaaaagggtggaaatacgttgttggagaaaagagggaagaaagcactaccatttacaaatgactcaaagagaaaaatatggttgaagatgttaacatttttctactattctatatatgcacaaaagtgaataaggtaggttgaaaatttcaacaaattgaatttaaggcatataaatatatgcttaaaattttaatatcatggttctattcaacttattaggaaaaacaaataagaatgacattcgagcaaaagaaaaaggaaaacagaaatccctctattactatgaatttagtataacaataatagtgcaaaaatatatataaacacacacaagtatattttacagagcagaaggtcccaaaatagactatactgcacaagacatttaatatagactgaaaatataggtgaaaaatacaagtgaaaatgctgataattgattaactttgaagggaaaatagatccttatctgacacatatataaaatttttaatggattaaaaattaatattattaacaattcttaattactagaagaaaatagtacctatttattgaaccttataatggggattcttttgaagctgagaccaattcaagatagttagaatactagaaatctttactacatgaagattttaaatagcttcatgtgaaaaaatacaataaaaaaactcctagggtaaaatatgagtaaataatatgacaagcagaagttgaccataccctaagaatattaagagtagttataaagaaataaatctttattaaaaaaaatgaaatgaagcagaaaaatcagcggaaagtaaataaatttaaagtatataatcttaatataaataaatatcataaatttaaaaaataatattatgattacttattatacaggcaaaataatcaaaaggacatgtgaaactattattagtatctttttatatagcatttaaaaatgtatattttcaccagtatatttttccaaattattttataagaagcatataactagatttttataatcataaaattaataaaagttatctcttaaatcagattatatttttaaggcatacactttcatagaatattaatgtttttcagtgctatttaatacagagagaattcccacaagcaataacaaagg

SEQ ID NO: 39332 - DNA, 2204 bp, Bovine  19866880818887
gtttcctaatcctgtgaacatgacttggatgtatagagtgtccatgagttactatttgggtcaagaaggaacagaggcagggaattctgtgttgataatgcaggaaaaagaaaacctatccccaaatgataatctactcttctcatcatgggcacccttctacaagctagtccccaaacctttctcaaaactcatcattgaagattctccccctctgccgctccgtgagacaggatgtgctcaaatcagtctcttgaccacacatctcagtcctgagaagaagagaggcctggagtgagcctgctgaatttcttgagttcccgtaccaggaaaacttaaatgaaaaactgagtttgccatgaaacagtaaaaccttatacgaccttcaaacggttggatggcatcaccaactcaagatacatgagtctgaaccagctctgggagatggtgaaggacagggaagcctgcagtgctgcagtctatggggttgcgaagagtcagacacaactgagcgactgaataatgaccttccaaaggatgcacagctaccgaggggaaaggggagtagggggaggaattgggagattgggatggacacatacacactattgatactatgtataacacagacaactagtgagaacctacaatataaaacagggaactcttaatggtctgtggtgacctgaatgggaaggaagtccaaaagggatacatatatgtacatgtatggctgattcattttgctgtacagtagaaactaacacaacactgtaaagcaaccataatccaataaaaattaattaaaagaaaaagaaatacacttgtgtgtgtgttggtgaacctgctatgagtgaaaaatgagatgggagcaatgtaccatacccgaccacgctgctgtctccatcgctggcttccttgtcaatttcagcagcaccaccctctccccgccccaggtgggacctgactcaaattgtagctcattagcaccaagggagagaagtttaaggaaaaatgtgtcataaacaatggtaatcctggcttaagcgggagaaagcgacctttctcccctccctaaaacaaatcactgttttgggccaggcgtgcctgttttactattaccagttaatacgaccgtgggccgaagatgcagctgtggccccgggaacagcctccagagccaggctgaacctaatccctcaggtaatggaaaacctatttctatttctgaggcctcactactcttcataccgaagagccttgtgcctgtcacacatttattgaagcttattactcatcgagacagcggggtccagttagtatttggaattatattttaaatcacaatttttctcttatttattttgggattccaaggctatggtgaaagcatgtcagagttattcttcatgtgctttcaaacaccttaaagcccacccctccccctgaaattcttttctacgcagagaatctttacgcatacgtggaacatcttcagccaagacacaggggtcacccctgtgctctgggacctcaggactccaccagatcacagggttctaggggagagatttccagtctcctcactcagcattagagtaatcttccccaggccactggctttacttctccctctcacaccacgctcttttctttggctttcaaagataaatggatgcagtctctgaggatgctggggacggaggtgggaacagatgggctaaaactgcagtctcatcatccagtggaaaaataaagaccaccttaatctaaagcagaggattttctgaactgaccatgaggcttgagcttattcactaggctagtggtgaatatgtggttttcttgttcaacagaagccagaggaaaggataattctctctagctattcatctggcctcctgccgtctttatcttcccaagaaaaatatatacaccatatacactacagtcactcatagggatgcctccccgtatattttctctctggtgcatgcttgctttttcttgcggcatttatgcatttttcttcctcagtcatgtttttttttttttttttaacatgctctgccattagaatctgcaccccactttttcatgtgaaagaaaatcagccacaattggacagtgtttgcacaacacgtttctctgcaatttacacctagttactttcccgatctgggagtctttctttacatttccac

SEQ ID NO: 39333 - DNA, 1441 bp, Bovine  19866880820094
cgtattataaataggcaggaaatgttgactgaaagaatgaatgaacaagcctctgaatgacaggaggcaacgagattacacccacatgccatgaatgcgatgcgttaacccctcttgcagtcagagattgcctcgtgagagatccgtcaaacatggaggagtgaagcaaaactggcacatggacatcgtatgtaggctactgtctgttaactttccatttttactttacataccaggagagcagattgatattgcattttaattgtgtatattagaggaaggcatatggttacaacattttcctatttaccttctgtaacatgaaatttgtcatttttttcccccaaaataaaggattgaagggagagtgcctgctttttacaccagttcagttttctcccgtgcaaaagtctcctgagatgtgtaacgagtcaatgccaagatgatgctggcaccattttcttattgccatggtgatctccagctctcctgaaatctcaagggagactatggtattttatataaaagcaactcgaattttggtaattaaaaaagctggaaggaatcatctttctacattttgccagcttgagtaaatatggatacaaattatgtctagggaggaaggagatgattgcagtttattaggtgggtaaccccatgttagaagatgaaaagcatcatggaagtgatgtgtggggtatttatgccaattcagagccctactgtgaatcttcaagtattctcatcacaaccttccaacaaacagctattctctttcctggcgttgctcgcattctaaaatagagttgaaggtatgattgtcagagtattttaatgttggaagcactgtgtaatgtatgtaaatgttggcagttatcaaagtaaagggaaaaaaagtgattctcttaaactggaaattaagttagacaagcataattcagactctaggttaatcacagcctccccccatcaggaaagttcttacattaagagttcttttgaacttcatttgagcaactgtgctctcctagaaaagcctcaaagattaaagggttttgtttcacttcagaagacactggaaatttttttaggcattccttttcagctataaaatgagcacttggaataaatgaacatagaggcaaacattaaagggcagaacatatataggggagaaaccagggctggtggaaggaaagtgacttcttgtatctttgggtgtaacttggtgctcagtgcgagctgggaaaaagcaagaggcagctaaaggcagggcttggggtcctcacgtgtgtgtcgtcctattagggcagctaattgtcaagggcaaagaaagagaaagagtagaacgatgctctttaattaggaactttacacaaatgtagattccccatttgcagatgggcattttaattgatttttacaaaaccacctacac

SEQ ID NO: 39334 - DNA, 872 bp, Bovine  19866880848875
atttactggcgggggaaaatgtccccttttgcccttgttctgaagcactgctgtccccctccgcttgcatgctctgagcagtcagaatcatggaaaagccagcgatcatggcaagtcaagtcggtaactctctgaaactgactgatagtggacagcaggcaggaacatgatctacctgggttccccgctgttctgacattcaggactcagaccctccatgacagtgtctctccttttgtggctgcaccacgctgtccatctcctgccaagccggtgattgttctagtgatcgttctctcaaaatagctccactccagggacagcccccatcccatttctcgagaagagaaatgaataggtctgggctgatgtgcaccgagggttgcagtccagctgccagtctgggagttgagcttgacttggagggtcaggtaagcgagccgcggtgcagatgcttggaaatgcacgagacagctacaatgcaggggcgcttctttaaaaaaaaaaaaaagaaagaggggggaaaccgattccccacgcatcttcacattcattcgctgttattacgagcactcatgtccatttgacgagttacatttcctggaggagacggagcttagccccacgcagggataggcaactaactcacatctcaaaccattatagaatttctcatttctattggcatattctatcaaggaacataagttctatggggattggcagactagccaaggtgactcatttgagctgaaaagagagaaagagaaagaagtggggaggggggaggaatgttaaaagtctctcggctgcattgcacgaaacggctctgcttaaattttattgaggatcgcgctctgaccaagtgccta

SEQ ID NO: 39335 - DNA, 1057 bp, Bovine  19866880859265
cggatccgcaagacccataacccacttcatcccatctcacccttcagcctgggtccagtcggttagcctcacttcacagacacgttagagtttaaacctgctcatacagtgaatatgtagcagatttatcatcatttcaaacttgccttgaactggctgatcaaaaggcaagtttcttctttgaagattttcttttgtaagcttcactgccccaaatcaaaaagggcagtggtacagactcccaggactacgctctgcattttctaaggcaagtgccttcaagtcctggagcatgttttctatttataagtgggtgtgctgtgtgtcagactaattcctgatgcctctttttttggtccacaagatttgcatgacctaggaggactatgttttggaggaagttttttagcccttccgagtttagttttaacacgattctgctcttccccgccccccacccagactttcacacgaaatccaaagtgaatgcctctgaaggggtcttgatgggttttattggatcaaagggctctctgataataaagaaaccgcacagagatttactgagtgcattaaaaaagaatggctttgcgtcagccctggtaaaattacacacccataaaaaaaaaatattttggccagccactctttcagaaaagtgagtggtgatttccaaaatggtggattccttttcaagtttttcagctcccccattcttgacaacatccctccaggactccaagtcagaaacctgaggagcatactagatatttctgtcttcacctccatagtcgacacaccacaacttctatcaccaatctgtcttctctggaaggcaccgctcacagatccctcctgttttctctatttccacggctccctttctgatctgggctctaaccgactcatgccctcactcgttattgcctgagcctctggatcagcctccctgtctcctgtcttacttcccaatctatctgaatcttcaatcaattagcgaataaatatttatggggcatctactaggtaactgacatgctatcatgtcgtaatttta

SEQ ID NO: 39336 - DNA, 1818 bp, Bovine  19866880863552
cttatgtcatgatattcattcatttgacaaatacttagaaaccacttactagttgccaagccctatgataggtgatggtgtgcaatgggaagttaataataaatgaataaatgaatgaatgaataaataaatgagagagacttcctgctccatggaacagaattctaatttaggagagaaacaagacattattcaaataggcaacaaattaaaaatgtaattgaaggctaaggaaaaatactttgaaggacagaaacatgattttgcagaacacatacgaaagcaagaggccaaatttaatgagatcaaagatttttctgaggcagcaccaggagctaaagatgaaaggaaggagagtgaactgtgtgacactcagggaagtctatttcagacaacacaaaacagtacacgcacccacaccctggctcaacggtggcagagcacccatggtccccaggagctcacagcaggctggcatggcaggaacttggggcttaggggagagtggtatgaactggactggagaggcatgcaggaggcacaacagttgatactatgtcagtaaataatcctgagtctttttcaaaagctgattctgagtagatacctctgaatagcagaagagtatggaaccactctgaggtcatcgaccctcatggagcatgtagacctgtgcccagtttggagctgagcaatgagaaggagatggaactagggaaaatgaaacctttaagaaatgttcaaggaatcatggacatcatatgtgatgaggaaaagattgggggtgggggctggataggctttcaggatcagcatgctttctgcacagctgaacagtccctggctaatttccctttctaatgagaccagcacaaaatccatccatttaggctattcagcttttaggtaaatgtaccaagctgtcggggtagcgaggaaagaggggttgacattgatggatggagttaaataccagagtctccccccttcacgcagacttttctaaagcactattgtgacagaaaggcctggaagattccaggtgggcagggcaggctggagagagtccaagtgtctccctcagtgggggaggaagaaggctggaggggggtgtccctctgtcaggatggaagggtcctgttcagatctggcaacagccttgcatgtggtgggatacattcctccaaccaggtccagagggacatatggctttcctctgacgcatttttttttttttttttgtccagaattacaaccggagcaatatccactccttcattcatttctgtggtagggctctccaaccttttggacaataaattgttatttatcttggttctaaaatagggatgacattgctcctgacctacctttaaaaaatggttaaattgaagtaaggaatgttaccgtgccttgactcaataactggatgtattataccctaaacgtaaaagatcttaaccaagccagactctttggaaagacctgagactatgtggggagtggtgatcattttatgtttattttctgacagttgtcctgatcagatgttaagattcatgactttgccctacagttctcatcatttaaatgaatccagtggcaaaggaggtggtgggttacaggactgttaccagggtggatgtaatgttgacagttacattcagaaccaaggatacttactgcagacgaaaggcacttagaaggcctagaatcctcataacaagtctaggacacatattgtcatttttttgcattttacagatcaggactgaggcatagagaggtaaaataatttgctcaagctgataaacagag

SEQ ID NO: 39337 - DNA, 962 bp, Bovine  19866880914523
tcagtgcacagagaaaattggagaatgagagagagggggggatctgaatccatccggccaaaaggaatgcaattaataaaatgaaatgcagagaacagaatgtggacacagcatcgttgacattggatcgcattgccctttacaatgtgtgtatgtttaggaaaatcgcaccgactccctttgtccttatctctggccaccttgggagttttgatccttaaaatcacaaagaggacagagaaggatcacaaagcactccctcttggatgcgctgccatccgtctttttgatgtgaaacatctaaaaccaaattctcaaaaataattttccactgagcatttattctgcgctctgtttctctggtgattcttaacaaaggttttgttgccagtgcccagaggaaagactaatttaaatgtagaaagagatgcttaaaaaataatgtcatctgttggcaaaatctccgagggtattaccttcctttcacacaggcagggagctaaacctgattgcatttagggttatctttagcagctaaactcagaatcaaaacattctcatgaggactattgttctaactaatctacttattatgcttttattcagttttaatagtcttttattaaaaaaaaaactcaaaggggacagcaatggattttgcaattattagcgaggaaagcacagcctatgacctactagcactggtttgtctaagaatgttcatcttttgaaagctgtattttaaaccattatgttaattacaggcgctcactcccctctctgccatgctgccctctactcccaacaaagtacaaccagtatgaagctggctttcctccgatttggaatcggaggtggaagagctcagtaggtgtgatgcatgactgctgcttaaaagaatgagatggagcagacgagggggcttattagaaaaagaaaaaaagttacactctagaatatct

SEQ ID NO: 39338 - DNA, 834 bp, Bovine  19866880940432
actcctgccttaaagacagattctttaacgctgagctaccggggaagccctctctctctcacacacacaatttttattaaatgattttgttttcacaagaggggaagtggtgacttgtactaaaaagattgagagtttagagtgaagtgatgatcactttattctgagaattcatggggacggaggctatagagcagagagaagagagagggaccaccattccttagtctcactactcaatttgacagccagcctttgagcccctaacctgtgccaggcatgatgctgggtgctggggctgaactttgataacccacgtggctaccaaggaaagaagtgtgcacaacaaaagaagtattggtttttgtacaacatcaaggactgattttctctctcccctcgagtgttagcaaactccgaagacagcactttgggggcccctcatttgccttccttcctgaggcacaagtggccaattctgagagcagttgagttgtgcttgaaaaatgtcaagtgcatttggaaactacacatttttgctgacgcccggagtcccgagctgcgctatttccatggccaaccactgggaagaccttcggttggggcatcacaaatgacttcttggagcacactaagccggcccccgagagggataagctgtcttaagagctagtttaggaaaaatccaaagtgccctgacccttcttggccctcccattgaccatctggccagaccatcaccctgtggggtctttttgcttccttttatttacctttattcttgcgtcatttgactgtgatctttgagtaatcagagtctgcattttcttcaac

SEQ ID NO: 39339 - DNA, 1191 bp, Bovine  19866880945686
agatctagagaaatttaagagttttcatgaaattttattgtaatttataaaataacctttttaaaaacaaggactaagaagccatcagtattgactaggaaggaatcacagagtgcaagcaagccaaaagaagaaaaacgtaacccaacagttttactattgttttctggttatataagcagtgatataggcttgttatggaacatttacaaaatacagaaccatgcattgccactaccccactgttagcaatctgttgcagaatattccattcttcttttctaggtgtgtgtgtgtgtgctatttcttacacagatacggagcaacacataagtaatttttgacattggtagctaactacatgcattcacatcgtggatattttttcagaggtgacacttatgacatatgacctattacagttatgttccaaccatacttattccttacctatttaggcatttttaaaaattcctgcaacagggtatcttttttttattcatgaaggcacaagaagctgcttatgcaaatgttggatatcgttcatgttttcttatttttaaggccatggctatgtcttcctttctaggacaggtctttcttccttgattaggtaggctggccattttcaattaaaccaacagtaatgaacatgaataaagacatattcactccccaattccatgccctgataatttggagataatagacacccctcaaatatatgataataataataccattaataaaataatgtaaactatattcttcaaatagtgtccaagaagtcacaaaactacagaaaacagtcactaggaactcaagcaagtgtcactatttgtttctctattttcctcttacactttctccaaagaactataacctgctagaaatttcaagttcaaactgatttttagagttcctgacctgggaatacagaatgactcaatctaaaaagagataccaattgagaaactgccataggtacccacagaagtgcaagatttagaattgatcctttaggtcctaggttgatgggactttagcaatatccaaggcatagtttacacagagaagttgaccctatggaaatttccatgttcttgaaatcttatgttacttggtcttttgctaaggaattaccagcacactcacgcattctttctgatagcagatcccagtagagctaag

SEQ ID NO: 39340 - DNA, 1374 bp, Bovine  19866880978317
aggagaaagaaaacagtgcttcacccagttcttacctcttcatctgctcttaaaaaaaaaaaaaaaaaaaaacctgaggcattctaaggctgctgctaatttcacttttgatagaaagtgatccttggattaccataattcttggccatgaacccaggaacccctcctcctgtttgaattgaaaaatcattttggaatgggagaggtggaatttaggaaagaacacatggctttccagccattcaaaccccaagcatgtattttgaggggcagaaggctaaaaaaagaaaaaatgaatgctgccttatccaaccactgtctctgtgccaagcctttatagcatcctcttccttcattttgacagccttctgaggtaagtcgggcttgtgtcattgggtttgtttctttgtctttaacggaagagggaaatcaagtgcagaaaaatctggagacttttcattggcacataactggaaagcacagatcggggtttcaacctgttctttctctgtttttcctgaactcatatatagaatagatttgccaaaattttcaatcccaccagttacttgacttgtatgagaagcacttctaatgtttgtacagatatctttctttacatcctgaaaagggcactgtgctgagagacctgcattttattaccgtttctgctacgaaatagttgtgtgcctgtgaattagttaagttcttggggccttagtttttccctcagtaaagacaggaggttgagttagataatatttaccgaacttcaaccattttccatcaccattatttttggcacatctataagaacacctataatttatttgtttgatgtaaatgaacttatttacaaaagcagaaacagactcagacatagaaaacaaagtaaaggttaccaaaagggaaagggggtagggataagttagaagtttaggattaacagatacacatgactatacattaaataaacaaacaaggactgactgtatagcacagggaaccatattcaatatgttgtagcaacctataatggaaaagaatcgaaaaaaatggaaaagaatctgggcttccctggtggctcagtggtaaagaatccacctgccaatgcatatgtgggctcagtctctgggtcggaaagatcccctggagaaggaagtggcaacacgctccagtattgttgcctggagcgttccgtggacagaggagcctggtgggctacagtccatggggtcacaaaagagtcagatacaacttagaaactaaacaagagcagcatatgtgtgtgtgtatgtgcgctcaccgttcaccctctgcctcctacaccaccacctatctccctgattcattgtacggatccctgtcttcctg

SEQ ID NO: 39341 - DNA, 1204 bp, Bovine  19866880980175
cattgcttaaaactcagttatttaaaagcattctgccatagtatatgctgttttaagcttactggtacagagactaaagggaaagtgggttcttagtaaagtccttgtaatataggacgacaggaagtaacatattttcattttttccccaagagtctgcggtgtgctcacctgattttatgaatttttggacatgatgaaagtgcatttgggatctcatgatgtatagtctaggctactgaggacctagtccacctcactattagcccctactcccatccgactgaattctagagaggttcttggttggtagggcaatgaatatttcctctaatatcatctgtgctgatgttgggttgggttgtttctcagttctgagtcgctgaagacgtttgtcaatggaggctttaataattaacagaggaactcaaagatgtagtatagaaacccttccacccagaaggcaatgttgctgcttaccactgcctgtctacttggtgtttcaaaggttgcatattggatactttccttttcactttacatttaggatggaaacttttttccttccacctcattaccactatgatgttctgtgccacagtaaaggcctataaagataccctaagctctggatgacagcctgatgtgtgctaatgccgttgacaccattagccaagggctaagtcgagtgcgagtcagatcagacgttgataactggcaaggtaagcaggcagatcctgccacggcagaaggaattctgatagaataagatcattttaatgttgtttccccaaactaaagcttgtgcagcctacacatacacgaatgcatgacttttaaaggaagacactgtgagccttttaatccaaaagaagcgtcccatttttgaattactattttaataccttttgttgaaaagactgctattctgctaatgttgatgaactctgctgctgactgtatgcgactaagcttgtttccagggaagaaacccacgatgttttctttgtgaaagatggtgggaaatagttcttgaaaggattacaggactacgtgaaacttaattttctcttccctcccagtaataatcttgctgaggtcccattttctcatcaccacattgctctaataagtacctgttcctgttctggttgcaggtttaccttctataatccctgcacaaactccaccatcagacaatctc

SEQ ID NO: 39342 - DNA, 1516 bp, Bovine  19866880993554
cataccacttcccactcgctgtaccgttccaagcctgtcacaggaatagatgaatgtgctggtccctctgtgtggattcttcttgcatccggaacatactgctctctggtctcagggctgcctcatgcaactggctccttgtcctcatggcagacatgcaggaggggccagaaatcctccctactttttcgagggacaagaatgagaaaggcacagacaaagcgtgtgtggggaaccattgtggcaccgtggctggtggatgagagagtgcaggtagagggatagaggccggtccatttctcccaagcccctctcactccccgtggtcctgccaggattctgatatggtcatctacagctcatcttttctcttccgtgtaattcctgggctgtaaactttgcgaccactttggaacctgcgggctggaagttggacacaggcaagtaagttttcagagcgttcttgggagataggtgcacaaatcccatgagtagtaaagggatttgtgggcgtaacttccctgcagtgctttgaaagtttattccgttcagtgtatcgcagtacagtagggcgaaaataaaagaaatcactccaccatggccgtttgaaagggatttaaaaaaaaaaaaaaaaaaaactcctttaagatttaattgtttaaaactcctttaagactttaggcatttccaagaatgttctctctcacggttttgtttgcagctcttcttttaggcagaaggtcattttggcactaacagccttcctcaaaaggataattaatacgttgcagcaacccctcccttcaagtaggaagacatgctgtcgtctaccgcatccccaaaggatgataagcaaaccgaccctggaaaaagtcaccaaacatattgatggttgggcagtcagactgtaaattgaagttgccacacagatttattttctccagacaatggccattcctttaagttaaatagcacactgggttttttatatttatagaagactaatcactacttacaaaaggaggtatctgttcccgagtgagccttgacaatatttaggaagagattctgtagcccacctgacttgttccgtcttggcaaagccgtggttcatttaaaaaactcagagggcccagtgacctccagtcaggacttggtggagggagtcactggctggagggcatggtggtcgactctgcaggtacacgtgtctcagtcagaatctcaggcttcccatttactggctctggatcttgggctagtcacttaccacattattgaccagagatgtaattacccaagtgttattgaccagagacatttcagtattcacttacaaaacaaatcgcaggccacagaccttgctaagtcgcttcagtcgtgtccgactctgtgcaactccatagacggcagcccaccaggctcccccatccctgggattctccaggcaagaacactggagtgggttgccatttccttctccaatgcatgaaagtgaaaagtgaaagtgaagttg

SEQ ID NO: 39343 - DNA, 1955 bp, Bovine  19866881011918
tagaaaccctagctaatgaatttagaatcaggaagaacaataaagcccagtttgttgactaatttattaacaggctatttttgctcatgccctgcattgcagataatagtaataaaaatcttaggtgagagaagatggcttctccgcagtgccttcattgttttttaaggcctttcattgcccatcagcttctctgtctttaaggaaatggaagagacagcagagagggcaccagacaaagaattaagagaccaagtttcaaatccaggctcagccagtcattggctgtcatgggcaccatctgtacagcaaagatatggaccagatgacctttgagcccatcttaactgtggctcttccctcctaatgtgatgcagaaaaggaagccacaaggctgcctctgataaggggttcatgccaatgggggaggactatctagatgaatatacatcccccatctccactggtattggacttgagctgacagttgtcctgctgtgagctgggtgatgcagtcagtactcaggctataggtgtcacgggactcaggttcaagtcacccctcaaccactcaccagctgcatgttatatcaattccttgagcttcaattttgttatctgtgaaatgggagaataatgtacacactccataaaatctatgcctggcacacattaagggcttaataaaaggtagccacgatcacccatggttgtcatgacaaaatgatctgagacccaacaggaagtgagacacatttcttgagtgcctcctgtgtgtttgatatccccaggttcctgcctcttttataccgactacaccctgcaaggttggtttgatcaccccctctccccatagagatataaatggctgagagcatgtgcttgattccataatcagctccccaattctgagccctgttagtgtgggcaaaattcccaacaccttttgggctcaattttttcatctattaaatgggaatgataacagaacccacttctggatttattgtaaagggtaagtaaggtaatgcatactcagtggctcagtactggccactgaatcagtactttataaaaatgttagcttttattctagctgaggaatgtaaagctcagagaggtgaattcattggttcaaggtcatctgcttatgagtagccatgcagggctttgaaccctgatggggctgaatctctcagggactcaggagagggagatagctccttctttaccctgttgctaagctgctctggcttggctgccattctcagactgcctggctgtgggctctgagttcactcagaaggctcactgggagcagttggctgggggctgcctgggtctcagggaaggaagtgagtctggaccctacttctcatttgcagcagttgagagaacagagtagggccaccacgctaattgtcaccttccagacccctctcctcactcccgcttacagaaggctattttcaaaagagagttccccctctttgttccagcacaaacagcacatctcctgatcgatatgacatctcatcctctaaaacatttataatgtctgcttcctaggattccagtggccacgtgccacgcgcagcccacatcgccttcccttgtagttggtggtcttagggaccagcaccctcttgaacaagactgctggttgctgttccttaaagagagctgagtattgttcggattgtcagccctgaatggtaatcttcagggggtgcggcggggagaaagatgcattgaggtgtatgtgtaaggattgtggggatgtgttttgctatcacaaaagctcttaaaatccgagaccgtgatatatttgcagaataaaacctaccgatattatcattctctaaaggtattttgatcacatgggtcctttcttggagaaagaaaggcttttattttagttctttcccgggaaaaataacagcaggaacggagta

SEQ ID NO: 39344 - DNA, 1201 bp, Bovine  19866881014379
atgctgggtttcccagggccccaggcaaggctttttaaaaatgcaagtgtcaaggcaaactgtcatgcgtgtttgccttaagtaccggaaaagcttgtcactgccatcttggaagccttgatgaagatgcagacggacaggctgaggcacgggagatggagagctgcccgatgggaaggtggcatgcgagacgaaaaggcaggggcccaccttcaggcattttctttgcgagtggcagaattaaaacaaaacctcaaggagagtctggtaaggggagggtgccttgcagacgctgcagaggcttggacttgaaccggggtcccgtctggctctgaggtttggcttgataagaagtgaagtggttacaggacacaaaaaagccgtgtctgcctttctgggagaggacatggggtggatggagaggtcagggacctggaaggaggaggaaggtcagggcagggtgaaggctgggacaacatctgcgcatctttgggtgctgggcagggctgaggttacagggtgaactgcgggcagcatgtgggctccatcacctggctgcccctcctggaacctggtgcagcctggggcaaacgacccgatgttgttgaatctcagcttcttgagatggaaaatggtgaaaatgactgaaaatatctcatagggatatggtctggattaaacatgggggctcagcacatacctgatgctgagtagaccctcaatcactgctgcagctaatgagcaatgacccctgtagatggcctccttgaagtaactgtttcttgcctcttagtccccattcctttcttccttatgagatcctttgtttaacagccgagagcctattttatttatttcatttatttggccgcactgagtgcttagttgcatcatgtgggatctctcgcagctttagtagttgctgtgtggctttagaggctttgtggcacgtggggtcttacttccctgaccagggattgaacctgagtcccctgcattgcaaggcggattcttaaccactggactaccaatgtgctgttaacttttagctcttgcacttccggtgtgttcatcaaagtctttcttctttctcaccacaaatggggtcataacacacctttggataaatccctctgcagggtccatcagaataaaccacagggggcttcactgggccggaaggtgcccctgccatgggcct

SEQ ID NO: 39345 - DNA, 2672 bp, Bovine  19866881047774
aaaaagtctaccctgttcccgcacagttctacagaaggcgacgtccagctgcaactggggcactggaaggaaacataggcagctttgtactttgccatgaaatgttatgagccaccatccttcaatgttccaaagggaccaggaccaggtgccaggaagccacatgacacacctcaatctcccaaatgtatacagataagggagaatttcccaacgcgtgggacaagtatcgatggtgatactccagggaatatctggttcacatgcttgacatttaagtgtattgaatcacagagcaagcacggtgttggctttttattatgtcattgagaaagcctccactggatactagcatgtctttcttcctaatacaagcaatccttattatttgtggatttcatatttgtgaattcgcatattcactaaaatttactgttaacccccaaaaagccagacctgtggcgcttccacagccattcatgaatgtgtgcagggcagggaaggagttcagctgtcctgtgcacattccagctgaggctgaacaaggacacgctctgccttcttgtctctgtctccccagtgttaaagtgttatttcacagtctctttggtgtcacgttttcacacgtttgtgggttttgttgatgattctgttctttaaaatgacccctgagcacactgctgaagtactgtctagagatcctgagcgcaagaaagttgcattatgacttatggagaaagcacatgtgttcaataagctttgttcaggcatgaattacaatactgttggctaggagttcagtgttagtgactcaacaatatctattaaataagattaatattatttaatatattaaataagatttaattctgtctttaaacagaaacatgagatagaactatgtattggccagtcagtgaaaatactgtgaacagagaggctcataggaacctaaccctttttcctccctaagagcaaaggcttagtattccctaattcagtgtccatggtgactttaaaactatcatgaataatgaggatcgtccttacaattaggtgacagcagcatttgtaagaatttgttaacacttttgtttccccttatttgtttgtttttcatatattaattatctttgctgttactttaaatttatggcataaatacaatagtagtataaaatttcattgggttataaagtgataaagattttctctggatgcatttatttaagtgaaataactgagttaattgaaacttatgtaatgtcaagccaatgataatatggactaggaaagatggtagtaaatgcaaacacaaaataatatgtgaaggaggtaggaaaagtaaaagtttatgggaacttggtattggagaaggcatttattcatctttcttacttattgcccccttagagtctagttctgtagccacgagcacatttaatagagattctgtgacttaagtcaaagcagtgaaaagggtaaatgtcaggaatggggtgagtgtatggccattctaaatccaaactataacccttgaccttctagacagaatttatgagggccgtgggttaggagttttccgtattggttctttgttgttgctgttgttcagctactctgtagcgtctgactctttgtgaccccatagactgaggcatgccaggcttcctggtccctcaccatctcctggagcttgcttaaatctcatgtccattgagttggtgtttctttataattaattaacagtcttctgaattactgttaataatctaactcaccagatgtggccttcaaaacacaagtgggccagtgacccagcaagctggttctccgccatgtgataaagatgactcgcttgcacccctgggaagggaagatgttcccaccccacctcagtaaggcactgagatcatttccaagttcagctctttatggcaaaccattcttcaacgtgcttctttgggggaatgggggggcacaccacacatcatgtgggatcaaaattccctaactagagattgatcctgcacccttgcattggaagcctggagtcttaaccactggactgccagggaagtcccccaacctgtttttatagtaaatgctcaagagaaaggagattttttgcacttggagcaaaagatgtaaaaaccaaaaaaagtacaagggagcagtcaaactgaaatgagaacaattaaagagacaaaaagtcccattagctgccttttgggtacttttttgatcttttcaccaaggaattagtagcttttaattttccccaccttagcttaaagtactgctggtggaaaagaaaggagcattatggggggaaggctgctttggattaaaaaacaaatatagggtgaagtcaatcaagcagctgtcagatgccatgaacacagggtctgcttgcctagctcagtccctgggcttatgctggacaacaaaagtctcccgtataaaagcagaagcttttttacacctcttttctaatcatcagatgtgtgtctccacttggcttgacattttttatgatcatctgaccgactggctgcttctgccacttaaaacggaggaggaagggttgcttaattttcaaagcacactgaaaggacaatgcttttgaagtcggatgtaagctccggttctgcgttctgttcttagcaagg

SEQ ID NO: 39346 - DNA, 764 bp, Bovine  19866881195375
gaattcttatttcatacatgttccagtgagcaaggaaatgtatatcacagatgtggtgtaatccgggatgctaggcttcagagctatacatgatgctgattcagtcactggaggccagaaagcaccaagttccacatatggcttcaccctctctccttagaaaagtgactctatttccatcagaagaacattttttctcatgcctctcttagatcattaaatatcctacgctgatcatcatttcacctttgcaaaatagaatgacctgtttaaatggtccccatttttaaatcatttttctccgaatggggccaattttaaatggctgaatgccctcccacctagggaagggagagtgaaaacggctcattatttcagcagatcacacaagccttgatagaggaacgtaggaggtaggaagccagaattcagtttgatgatcacatgatctttcttcctcaaaccttcccattcaactgaagattttgggttatgatcccaaatgagtcaaaatagaagcttggaaaaaaatttctgaatagcccctttgctctattctgtgtatacttaatacagatctgccccatttctcagtccttacattaaagctgacttacccagaaatgtgcctacatttactagttttttttgttttttttttttttggtagctggttaaatatgtccccaagtggaggcaagatgtttggagagatttgaaaataagtgaaatataaggattcgactcaagtcactaaatgcaat

SEQ ID NO: 39347 - DNA, 973 bp, Bovine  19866881204216
ataaaatgtgacaattccatcatagtgacataaatatttttacctgaataatccctgctgttcctttgaaactgaaaattaattcacatattgttttccctggagtagcccaaaaacctacttttttttttttcctttaaggtagagactgtgtgtactgatgctgaaccaagtattatttctgaacagcgattttatttttccagtgcatgctatgctaaaaagcaggataatggtactgaatatagaatcaatacatattcaaatggaatctgtttattttgctttgaaaacatgggctgaattgtgatatccacaatctactgttaatagtatcaagccattaatggctggctttgtgcttcctatgaagaccgatttcacataacccaggcaagcctggccatgccgatttaatcagcctgcttctcggccttgtgagaggatgatcacaggcctactggtgtatcaagagccatggggaataactctgaaggatgctcctggttcaaatcccagctcagccccttcctagttccatgaagccggaaccaagcactgaaactctgccttctcaacaagtgggataacatcaaccaccccagggtcagagccattacactgccctacaccaaaagccactgtgcttgtcgtcatttatatgaacggtgctgtgtgcaacctgaacatgccggcctgctcaagggttgtcacgattcaggtcattctgtttataaaatatttagcacagcccctaccatgtagtaaggccccagggaatgctcaatctttttattagttttaacatagatcatctatgatttctagtttcacatcccaattttgaaaaggtttgagaaaatactgtaatccacgttccatgtgattttcctatcaaggaagcaatgggattttgtaaattttctaagtattctctatatgttttcagagcaattgtcttggcaaatttcat

SEQ ID NO: 39348 - DNA, 1389 bp, Bovine  19866881269930
ttttaaaataattttgtaataaatctcagccctcttctaaacctaagaggtgtagttgggaggctaaatatactgccaaagaaacaccagtaaaagcaaagcaaacagatacaaaaggtgcttttactttctgcttattttggggaactgatagcactcatgctataaacccattatagccagtgattccaaggagtccctggaagagtagaaattgttatctgtataaaataaaaattaagcttattaagcaccatcttgtgcctcagcatccagtgtgaggatattcaacttaaatgaactattttcaaacaatgttgatgaaactcataatttaaaaagcaagatttggagttgccagaatagctatgtgggctgtgccaagttattttagcaactaaccaatatatctcaatttatatcagaaatctcttatgggatatagccaaccatttcaacacacaattatgggcattctcaagtccttcctgtaaatttttatgtctcattccttgtattacctaggtaatctagtcagcaagatgtcttctgatatcttcaagatatcttttgagcttatataatcaaatacaactgatattcaactattttcaaatctagaacttcccagtccacttcctaggcagttctgaggttgcctgtctgcttaaactccctctgaaacagaacatcacatgactcaaatgctcactatttcagttttgctttaaaatccaggtttgggaacttcagtttgtggtccaggggctaagagtctgtgcttccaattctggggctcaggtttgatccctggtcagggaactagatcccacatgacacaaataagagcttgaaagcgacagctataaaaagaaaaagtcccacatcctgaggatcccttgtgctgcaactaagacctgacacagccaaataaataaataaaatcaattttaaaaattaaaaaaaataaaattcaggtgtattgcttataaaggctgatcatgacttcctaagagtgcttctacagactgagaaattctacctcaaatcctattcttcatggagaaatttgggaataaagacattgcttggtatttagcaacacctcaatgtgaaatatctacttggttgaattgattaaatctgtggctggaagtgaagtgagtgaagtgaaagttgcccagtcatgtctgactctttgtgacccccatagactattcagcccatggaattctccaggccagaatactggagtgggtagctgttcccttctccaggggatcttcccaacccagggatcaaatccaggtctcctgcactgcaggtggattctttaccatctgagccaccagggaagggcggaaagatgtagaaaatgtatcatcattc

SEQ ID NO: 39349 - DNA, 1604 bp, Bovine  19866881345835
tggactggtgggtgacatatctactgtaatatattcctcaattaaatacgtggatagaaatagaatttaaatattcaggaataataattgttggggagaggagccctaagcgatattcctcactgtctatcatttttctattcttacttctcaaatttagggcttattaacatttttctaatatttttccctcaagcgagcagaaaggtgaatgctgaagtaaaactgaaaagtaacagaaagttacattacaaggtagtcttatcataatttgtaccctagctggtcgtgtttacacaaatctggatggttcttaagaataaattacaacttgagggagaaatcactatttatacatgcttttaccaaagagaagaaaacagaaaatgaaaaaagctaaggagatagaagttgaaaaataatagtagatatttatgaagcatttaccatcatctattacacatggttatgtagtgattatagtcattctctcctctaatcctcaaaatcactcccatcaatctattataacccccattttacagatgagaaaacagagcctcagagactaagtccttaggccaagatcatacatcaacaattggtggaactgagtgcactcttgatttctaagcccaggtttcacgacaccacctcacaaggggaaggtgaaagtatttcatttcaggccatggtttccttctaggagggaagagctctctcttgaggctttcacagcaaggagacaccctttcactcctgcccatctccaacagcttggaggaacaagtatttcctgcacgttctggagaatccaggaaatgtggtgtacaaatgaaagattttcttcccaagagtgctttctgtgcggcaggactcgcagaagaaagaggacaaactggaaaatgcagtcagggacagaaacctcagaggagaaggctcctgcagaagctgtgaaaaccttactgggcttatagcaaaagtcttttcttcacattacaaatgttgacatcaatattatcatgtaaatgcttgttaaaagaacaatacctcctggaggtaaaaatgagtccccttaaaaaaaaaaaaaaagaaagaaagacatcacagatcactatgcagggttttttttttttttgccatactaagggagcatgtcagatcttagctcctcaccaggtatttaaccattgccccctgcagtagaagtgcagagtcctgaccaccagaccaccagggaagttccaccgtgcagatttatggtggtaacaatttctagtaacaatttgccaagagtcactctgttctactgagtgaaacacaggctctggtgtttgttgctgttcagtcactgtgtcgtgtccaactctgcgaccccacggactgcagcatgccaggcttccctgtcctccactatctccagagtttgctcaagttcatgtccactgagtcagaggtactatctaaccatttcatcctctgccacccccttctcctcctgccttcaatctttcccagcatcagggtcttttctactgaattagttcttcgcatcaggtggtcaaagtatggagtttcagcttcagcatcagtccttccaacga

SEQ ID NO: 39350 - DNA, 1224 bp, Bovine  19866881360172
atggaaggatggatgatttctgtaaaaccctgttcccactttgcacgatctaaccatagaagactagtaaagtggtctcggccacgtgcaagtgacagtcacacacactgcttcatttatctcttcatcaaaatgaaacccctaaactgaaatggaaacccttaggatcattattatttcccccccatttcatagacgaggcaactgaggctttagagattcagcacttttgtccaaaatctaaaatttaataagcgactgaatcagaattttaattagacaacgagtttagtgcctattcttgcttcagctatgatcctgtcgggaatcctgcccttgttttctactgaattaaccccagagttggttacaaaaaactcccaaggttatcaatttcaccacatggtttactcagttactaggaggtccctctctctccctttctccctccttcagttccaaacgttgatactcatcatatgcccacataggactgtacactaagtccccgacacaggaaacttcaagtagcaaactttcaaagacatcttcaacgccaggtgttgccctcaatctcctattgcagacaatccttcagttctaccatctcccacctcctccagccagtaagtcctttgcctgttcactagaccccagcccctgtatgccagctgcttaaaggtactgtactctaagcttacaaatgttttatgttttgtgtttctttatgtattacttgtgcaagtattataaacctgttatagtacagtactgtatagctgattctggtagctgggtccctaggttaactttgctagactaacgaacaaatgggacttccgaatgctctctaggaacggatcttgtttgtatgtaggggacttactgtacccataagcttgaccaaggccttgctaaagtcgtgtgattcctcagcataaccaagtgatttgccggtaggcaaagaacgcttcatgtgccagctgacgtttttgtaacattagaaacatcactggtgcttcgcaaccgtgcctgcgctagtcctcagaaggtggaagcatctccagaaggtcagtggtggaggaagaggcggggctggtgaacggaggagctgttccagccctggtggagcgcaaatgcggctactctgcctctccgtctgaagcacacacagccgtggcatctaactgcattaatgagtttcctggggattgcagccggagc

SEQ ID NO: 39351 - DNA, 972 bp, Bovine  19866881410938
cccattcattcattcgcagccttggttcatttgcagcccaaggttctttcttcacttgcatggtgaaatagccaataccccaggaattaaccagatcgtagcacagcgctcgggagaaagggtgtcgccttaaacgactcttgagtgtgctgtccagtcaggttcctcatccaagaaaataatgcctagcagggcatccccccactaccaccaccgccccagcagctctgtcccttgccaagagacacactcctgctgtttgtcccactcaggtattgcagttgacaagaatgggctcatgtactttgtcgacgccaccatgatccgcaaggtcgaccagaatggaatcatctccaccttgctgggctccaacgacctcaccgctgtccggcccctgagctgtgactccagcatggatgtggcccaggtgggattctctctctcctctcatttcccatcactgtgccacacctgattctgagtctgaacttctcacctgggttctctttgtgttagaagtagagtgggaggagatacagatcccaggtttgtctgcagaaggtttgaaatgaactggacagcaagatggaatgggacatgtgagacaggcatgagagagaaataggagaaagggagaggggaattctgctcagaagcgtggagctggtgacatgctccagccgtggcagattatagggtaggcgttactgtgtaattacctctcttctccatcattatcgtgggtttgagaacataccatacggtactacatgtcaatcagaacttccctgttaatctgaagcaattgcaccctcactacataaacctttactttgtgaagttgtaactgagcagatccctctgtgatattcccccaagtgatagtcttttagtctgggctcttacattagcagagaacagaggttcactcaaatgtacaacaggagtaaaaggactgtatacttaaaacaa

SEQ ID NO: 39352 - DNA, 1503 bp, Bovine  19866881627857
tctctggaaactagctcttgtgtcgttactgttgcaggaacccccaggttcatgactgtctccctcaagcaacagatcccatggtctcccctcaggtccaccagctgggaagggagggagcccaccctgccagaagggagtgattcctgcccctcccaggcagagcatagcttccaggcacatccaggcgtgtccatcagggtgctgtctgcattcctgctccatctgtcctcgcaaccccaagactccacatcccccgcccaccccagaacctccccactactcttcagcgttcctgggaactgagggctttatcctcatgaaattttatgacactgtgcaaggctcaggaaaatctgcacatgttccattttcagaaatggagtcctaatcaatgtctccatgtgcagaatgcgagtcctaatgaagagccaacactagtaaaagctaacatttacggaacacttaccatgtgctgggcacttatgaacatttaattcgaaacacataagtacactaagccctctgaacacactgatatcatttaactgtcaccatagccttttagttatgaatgaggatactgagacacagagacgtcaaggaactcacctagttaagaagcaactagcaagtggcagaactgggatctgaactccagactctgaaccatgattttaacccctgaatgctaatacttttcacagcaactagcaatatgtatttataagaggtgatgtatgtgtgccaagtatgaagctatccatcacaaaagcagtatggttcaaggactaagaaagtaggggtcaggagaaggagaaccagctgggctgtgatgttagttctagctgctgctgtgccagtcaaggtcacaatctgaaggcagatgacgtacacaccgagtcacgtgaggagagtttatcaagtagactattttagaagtcgtggttggggttcagggaaaacaggagggttggtgcagtgttcccaggctggccaaagagggaacttgccagcatcatcaaggagcaaggggagggagtgaagaggagaatcggaaagagaacactatatggattgggccacttgagaggactggcatcttggggacagagaaatagccagcccctggccccatgacacagaggaagctggtaataagtacatgcttccctttcctccatcctctgatctgttcccactgagtaaacagttggcagccagaggacgagggcacccactgatgcagcccatgtggtcagctctcaggatggagagcaaggtcctgagagatggaggggcacgtgaaggacaaatggaaaatatggaacacagtcattatcgtgataaactgggacaaacctcaacctccctgggacttgatttcttcatcattataatgagacaattggaccacatgcaatttatgctgccttccagctctgacattttaagatttgatgaatccaccctccacctatgtctcaagagattttttaaaag

SEQ ID NO: 39353 - DNA, 1191 bp, Bovine  19866881731171
gggctggggcccggcagtcggcattttaacaagtccctccagcaggttctgaaggctgctgtgtgagaaccgctgcttcaggatcaagtcctaagtccttaaaaaagcctccaaggccccacatgatccaaacctgcccatctcatctcctgtcacttgaggtttctgctctctgaccttcagccacgctgctctgctctgctcgagaacacagcctgcctgcatggcctggatcctcctcttatgctttggcagattcctcccctaaaccctgctccctgcactcactttggcaaagccatgcatccttggcttgttcagagaaggctttctgactttcaactcagggttctgcccccatcatatgacttcacagcaccacctattccttctaaagcacgcgccatcattctaattcatcctttgtttggagcagtaggtctccacttggctgcacattagaatcacttgggagccttgaaaaatcctgattgtaggctgcaccccaattaaatcagaatctccaaggatgaggctcagacatcagtattttgatttctcgagctccccaagtagttcctctgtgcagctgagattgagaactctcagtgcccgtcttcctgggagcctccaggcctcctgagagcagagactctgttgtacaggctgttttccccgcacctggcattaaagatgtttgttgaatgaaagcataaataagccacatggtgtttctgctgcttctctgtgtccttgagtcagcagccaggtaaagggaaaagcttcctgcaggccacaccccctgggtggatgacacctcctccaagtcaaagaagcagctggttccagtgctgggtctaaaaccaggctgaatccagtggccgtggatgcatgctaggggagtctgtgcattttaacttggaaccagctgatgccttctgaccaaagagacaggatagagcacccagggagaagggaggagagggagagggagaagagaggcatgttggtagattaagagggtgacaagagttgcacaaaggcaaggatgacaataagaagagagcccaatggtttaatttggttcttggaggataatcaagttgttgtagctcgtgctgcctattcccacagctgtccagcaaataatgaatgtggtacctacccggtatggaaatagggacaaaggca

SEQ ID NO: 39354 - DNA, 1554 bp, Bovine  19866881785531
acaactgaactgaaagaaaaatatatctgaggctttgtcttttcatgtcgatgtcagggttgagaatgcagaccaatgaacacctgttacaggacagaggcgtgcacccaggggcgtgatgagttgccattcacactctataagcatgcatatttcaaggcttgctgttagtttccctaaaaagctagcacttgattagaccaatcagaaagatggcccaagctcccatttgaatactttattttgtgaaaaagtccatcttccaaaagcatagcctgggctggcagtgaggcctccagcttgcagcacaggtgtgctgccaataattcactttggttactgccaaacagacgtgacctgggaagacttcacttcacctcaccgactccatctttgtgcaaatctcatccacaaccatccattttcctccttgcccacacctcattttccctgttgctctgcaattatttattatctggctcagtaattgttttgtttacagtggccatgcaaactctattgttagggggggaaaaaacatgcttctttgcccatctagattttcctgtgtgggcaataaaggatgttggtctgtaagagctcttaatatacggttctctgtgttcaattttccaaaagatgaaaattgcccaaaagcaaagtaggcagaagtatggtaagatgctgctgcagcccaggttcctgctgatggatgctggccccctgaatgtcagggagctcccgctagtcactgctgtggcccctgctttctgaggagctggcagtgtccagctttttggaatagcaagtcctccgcttcacccctcccaccgtctcctgaactgcttcagttagtcatccctggccttttataaaaccaaaacaccgaaaggcagaactgttagcccagcctagcagatgaggaggctgaaggaggcactgggacttgggatcattttttttttttagtgattctcatgtatatatttcagcatttgatcccacttcacataaaatatttacttcatgacgggcgatgggggaaatgtcatttttcaaatttctttagcttaattacaaaagatgtaaatgtggtctcgcttatgggaaaaaagttactcttaacaatgaggtgtaaattggtgtctgcttaatctgttcacagtaagaataaaacctcacactcgcctcctcgcccttatttttgcagtagtacctgggaagttaatgcattctcttgctgcatctccagtctcttaaagagacaagagagaggggtttcctgcctcatccttctaccagctgtaagaacattcatttccagtatctcttttggactgcggacagctgctatcttttttgacctcagtcacgggcagccaaaatctaacctttttctggtctcttctctctccccaaccattgtggtctcctgcagatccccaaatggagtaaaattaataggggaatcagtgttatttatacaatgaccttgtgctcctgggggaagtgcaggcgctattctttcacttatgatgttttacatttcaaaga

SEQ ID NO: 39355 - DNA, 1112 bp, Bovine  19866882076335
gcatgaagagatggatgaaggactgtcccttagaaaacctggaggcaatcattccttagcatcctttcattccaggaaagctctgtggtagccttagcacaacagagtagcccaaggtgatactgagaatcttggggggtgcccagtggctaactggctggctagtggagtgctgcatcttcctgcctcttttccttgtacaacctggaccctcagctaagttctgatggcttgaatacatcttctttgccggggatttcagcatcttaactccatgccagagatcagtgggtttataaactttgataaagcagtggaagcagcaagtttcacatactatcacccatcatattttcatatcaagcagaaaaaataagtttcagtagtgttacaaagcatatttatttatgcagacgctctttttatccttttctcgacagaatattggcacagcagttgaaatggggtgggggcggggggagaaagcagcatgttcccatttttcgatacccttcctgccaacttggaattaagaccaacttcaagatttgaatatcttcagcatgaatctgttgctagattgtggtggaaaacttaaaacaatagaagtctcaaagtgagatagatagtagtttgccatatgcataccctctgtgggcatagtggcaggcagaagagggagagaggttataccttcttctgctgctccgtctctgggaggccccatcagtctggcaacttctgaatcccacccccctaccacttctgtccactgcagtcacggctccaccacctaccagccatgtaactttgctcaagttatttcttgattgcctgtttcctcatcagtaaaaaggaagtgagagcagagcctagctctgcaagggttgttgcaagagttaaaagagatcatgtgcattaagtgccgagaatggtgcccgcatctgttgggataccgacgatgttagcggctattgttattatcgtgctttgcatgctaagtcactttagtcatggctgaatttttgcatccccgtggactgtaacccgccaggctcctccgtccataggattcttcaggcaagaatactggagtgagtagccatttcctt

SEQ ID NO: 39356 - DNA, 1677 bp, Bovine  19866880397408
gggctcctgctggggcctgagaatcgctgacttttgtctttattatgtaacatgtgtcacttaatacctggcaattcagtgtaattgccaggtaattcagtggtaacataccaagatatcttatttatatatttttaatttattttttggctgccctgggccttagttgctgctccagggtgctctctagttgcacaagcaggggctactctttgttgcggttcatgggcttctcatcggggtggcttctcttgttggggagcacgcacgctagggcacgcaggcttcagaaactgtggtgctcgggcttagttactctgtggcttctggaatcttcctggatcagggatcgaacctgtgtcccctgcatcggcaagcggattcttacccactgtaccaccagggaagtcccaggtgtcttattttcatggtggtcatcgggcttggtggggcggatctggccagagggcaaaagggaatgtggtctctcccaagtggtgggagctgttgagagatttgaactggtagtatgaacatcagatgttctgattcttaagttttctgtctttactccctagaatggcttcaataagaaaacccagccgtcctgtgcgtgacatctttggcgacctcagtgatatttccttagaagattcaaagttgggggacatgtggaactctgatatcagtagacatcttaccaaaatagcacccggtcccagcagatttttaaaaagaaaccagactctgggtggaaaacacttcctgccaaaagagaacgctgtcctggggagcgagcactggcactcttcaagtagaccgtcaaccactgcctccaaggtcagggccaacgcggcgctcgtgaagctggcacagatagagaccaagatcaggaaccggaaggtgcgggtggatccatcggacgcagaatccgaggactggctccctagcagagctgaagaaactccccctaggaggacggctgacctttcttcacagaacacaggacaactctcccaggaacaggcccttgaaattcctgtccctgagacagacatgccgagtgggaaggtcagtaggtttctaaagaagagagaagcacaggtggaaaagatacccatggaagcccaggttgggaaggagagggatgctcaaagacccagagagaaacaacctcctagaacactggattcgccagacagtgatgaagaggaaatgaaaaagttgctggggagcttgacagaatcttctggggaaaaagaaacaaccaccaatcagggtttcaccaaagccactgagaaagaacaaacaaaactggtctcggtaaggtttgcatgtatttatccatttttgttttttatttgtttatctggctgcaccgggtctcagttgtggcccgtgggatcttccctgtggcacagggactctctagtgccagcacacggctctggagctcctgggctcagtaggtggcgacacaagttgctctgtggcacgtggtatcttaattccccaaccagggatcgaacctgcatccatgccctgcattgcaaggtggattcttaaccactggaccaccagggacatcctgcattttgcacttatttattttgtacttgtttgtattaatactttgcatttgtacctttatgtcatagcactagagtcttgagggga

SEQ ID NO: 39357 - DNA, 741 bp, Bovine  19866880517844
actaggacctgccagccaaaccttcacagttagccctgactcaccaccctctccgcccagctgtcctgagtctggacacaacctcgtctccaggggcccccagggtctagctcccccctgatgcttggcattctctccccaaaggtacttgattttcttctgccccctggacctcttttacaagtgtgtctgcttcctgccagtgaaactcatctttgtggctatgaaggaggtggtgagagttcgcaagatcgccgtgggcatccatcacgcccatcaccactaccaccacgggtggttcgtcatgatcgccaccgggtgggtcaaaggtaaacaggaccatggccagagcaaagggaagccaccccactgagaaccccttctctcagccatcttatccaatcccatgtgggagctaagaccccatatgccttgggaccaaaaatcagaacttaaacagtagaagcagtattgtaacaaattcagaagagattttttttttaagtaagtaggacaatgaaacattgatagctaatgcctctggagaaagctttctcagctgcgccctactcacacgtggggctggacccttctgtgtgtggaggccgtcctgtgcattgtagggtgttgagcacatccctggcctccacccactcgatgcctgtagcacctaccatcagtgcaacaaccagaaatgtcttccagacgttgtcaagtgcctcacagagtaggaaatcatac

SEQ ID NO: 39358 - DNA, 1654 bp, Bovine  19866880567025
tgtgtggcttcctcgcctttccggctggggtttctctgaacagctgagcaggttaccataacgggggctgaggcactctgatgtaggcaggtaggcctgtgccctgccacacggcagggtaaccactgaagtgagatcaccaggggagaggctcctgagggacgcctatgacaaagcctgctgggcggcagctggccgtctctgaaacacacctgccccgagataagcgcttgtctgatgtgataaaagctttctatcgagggcactgcacgtgtgacacgcgagctgggggagaagtgggccctcctagtcaggctcctcacgccaccccggagcacaaggtgtgcctgctgtgagtttctggtgaagaaagacccgggaggacaggccgggaggggacagcagcctcccctcctgctgccggccccccggcgggtctccgggagtgccatacctgttcctgggcctgtcatgggagggagggctgtaaaaggcctccacggccgccagcagcctctcgctgggtggcatggggggtgggaggcggatgtctttaggatccaaaggcttgtactcgtggtcttccagctgcaacagagaacacgctgtcaccactccctgcctcagcgccccaggcccatcccatccagggaaccgaggggcagcagacagctgtcctgggcatcagagtgcctcaggcggcccttcttgggaaaccccatactcttgtagggctttaaccacaccaatgactcagtagctacagaattctctctctaccaaaaatgcaaagaccctgtttatccagaccctccgtggaccccagatcccctcacttgccgaccactgagctgtgcccagatgcccacctccggggccccgctctgtgcccccttctctgctccagcccctaccccaagggcagccccactggcacctcgacctttagctctccacgctgcccccgtgtaacctgtctcaacttccagggaggggcaatgaccagagtgccctgagccctggccctggctcccttctgaccccctttcctgccttgcttggttggttgaccaccccttttctgagaaacgcctgtcctcagtccctggacaaggggcttccaagtccaggaccaagaggaccccccttcacacccagccttctcgagcagtaccaaacctgcagcccaggacggacgctcagaggagcagagggacatgggccttgctcacggccacgtgtgagcgtgcaaggtagggtcgttaactgaggcacacccttaatgacaagctgatcaagttcattggggtgcaggaaatgggggggacaggggcctgggaaacaacgtcttgtagccaagtggggaatggatcctacccgtgaccgtcccacctggaggacaagcatgcgtggcgaggcctggcgctcatctctgcaacgttaccttcacgaggggggccatgagcccagcagggaggtcgaagtagggcacgttggggaccaggctggggtcgtcatggttgatgtgcggagggccctgtcgccgcatgtgcgggggctgcccgttgaagccgtggggtggagggccgaagtcagggtgctggggcccaccccaaggcggatgctcgttgatcccaaggtgaggcatgcggtg

SEQ ID NO: 39359 - DNA, 1208 bp, Bovine  19866880576226
tagctcttgttcctgcggtagttctcgtaggggtcgtcaagggccacgcccacacccttgtactggtcccacttgtcccgcacgtccccccccttgatggggtcctggatcccttgctccttcacgccgaggccacctgatccactccagcctgagagagagacggatgagtggttacgacccaggggacccaggggaagcccgaagcgttgcgcctttaccctgatgtgaggttcagtgcaaatgcctaccgggagtccgcgacacgcagggcacacacttggaactaacgcggtgagaaagagcaccggcagaagccctgcaggtttctgttttccaagcgggaaccttctgactccctcagccccctcaaaccccgagtgcccagagcgggctgttctgtcttccccggaaacttacccattttcaccagcatctgatgtcctttgttctcttccccaagccttgagtcgggtataggaggtgctgaattagaacccagaccagccgaggaactaaaattaagacaggtaacgtcttttacaaaagagcggatacatttattggaatgaaaacttagagtattacagcatgtggcttctatgaagggtcgccagcgtgagacggacacacacacacacgtttcgggtctctagccgccttctttatcctcttcgccggccagttaagggggtcccctaagatgacggtccctgccccacacttggtggcaacggccggccacaccgaacccgtcaaatggttagaaaacagagcccagccctggccttgggcttcacaacgtgaccgcagaggtaagagcgaggagtgagacgtgatgccaccgtcactgcgctagcgagcgcccaggggcccccaggtgccgcctgggcgcgggccgcctagagaggatcttctaacgacacgtttcaacattcacagcaaagcatcagagggttccagtgctaccagagatcattggacagttaagacagaaatcttacggcggggtggggctcctggaccgtgaccggtgcctccttcctggggagtaggacttggaccttgagcgcgagcgggagcgggagcggctgcgagaggagcgggagcggctgcggctcctgtgggccggggagaggaaagggtcagtacggccaccgagaggccccaggcctcgcaccccgtgcagcggcgccctgctacctgga

SEQ ID NO: 39360 - DNA, 1479 bp, Bovine  19866880713954
gtggctctagactccgtgtggggagttgtagagtgggctggtagacagggacgagcaggtgggtggcccgtgctagtgccaggtaatgggaacaccgtggagggctcgtggcaggagacgtgagggtggtgtcagccaggcgggcaaggctggagggggtggaactggagcgggagcagtcacagccttgcagggtctggctgagtgtgaatgcatgacggtggcagaggcccgtgctgcactgggccttcgtcacccccaggcagcctggggcagctggaactgcatgcccagacagcgctgcccgcattcccccagtctctcggcaccgttggaggccttggtggaggggagtgtggcctccttttggccccagagtttggggttctccgcgcgggtcactcctgttccagtggctgccctgtctccccagcaccaggagcagcactcggagggcccgcagtgccccctccagtgagccgcacctcatcttcgtgtacgaggacaggcagatcctggaggacgcggcagccctcatcagctactacgtgaagcggcagccagccatccagaaggaggaccagggcaccatccaccagctggtgcaccagttcgtgcccagcctcttcttctcccagcagctggacctgggtgcatctgaggactctgccgacgagggccgggccagcccccaggggcaggctgcagaccctggcggcgaccggaagaagccggcgcctgggccgcagagcagccccccagaggagaaggggggcttgcgggcgaggcgccggccccggagccgcagccaccgcagcacaagcccctggacgacgtctacagccttttcttcgccaacaacaactggtacttcttcctgcgcctccatcagaccctgtgctccaggctgctgaagatctaccgccaggcgcagaagcagctcctggagtaccgcaccaagaaggagagggagaagctgctgtgcgagggccgccgtgagaagggcaacgacccccgcccatgagctgcggctgaagcagccgagtgagccccagggcctgccccctgggcgccgggaggggagacgcctgccctgagggagcttggggcgggagccgcgcgtgtgaaccccgcagccttccccgtggcagctgtgtgagccgcacccgcagtgaccagggtgccgcccgcaggtgaagtggagctggaagagtactacccggccttcctggacatggtgcggagcctgctggagggcagcatcgaccccacgcagtatgaggacacgctgcgcgagatgttcaccatccacgcctacgtgggcttcaccatggacaagctggtgcagagcatcgcccggcaggtgagcaggcagccgcgccgggccctttccttcattcctgtgctgcggttggccccgtggttggcagcttttcttcactttcagttaaggtagagttcatgtaatgtaaaattcac

SEQ ID NO: 39361 - DNA, 901 bp, Bovine  19866880759099
ctgtgggtacatctggagtcaatggcagtacagacagagatgacaccaagaaaggacttgagcagtgcaagcagagtttctaaaaggccaagtgagacctgaaccagaccgtcagggtgggaaagttgcctgtgctggcattttttcttccttgaatgcactggcacaaatgcagcagttatgagcagctgggatcgagcacgactgagaagaaaacgcataagaagccgacttccttgactgcactcaatgttgaatcatcaaagagctgagagctaaaagggctggcggtcagaggcccgatgccccagtcaacacagaggcataattccctgacaaagtacctacttcggaaccagctaagaaaagggcatgttcttggcacaggccaactcaccaggtcgctgctgaccaggaaagccgagagatctaccaggacccacgtggggatcataaaaaagatggcatggcagcccaagatgttcagcagccggagatggtggatccttgaatctcttaatacctgaagagagaaaacctctttaaaggctggttgtaactataagtggcaagaggggctccgcttacccaggcccgaaacatggtggctgcccattatccctggtatctgaccttgactgccaaacctgcaagtgcgcccatgacgagacacacggcccatggtgaggcacactgcccatgacgagacacacggcccatggtgaggcacacggcccatgatgaggcacacggcccatgatgagacacacggcccatgatgaggcacactgcccatgaccacaacaagcgccgtgtttcatatgcaaaggaccgagagaagaaaaacaaaacccagcaacactcaattgctggtaaagctacagtgaaacaggcactctga

SEQ ID NO: 39362 - DNA, 2160 bp, Bovine  19866880762102
cgacagccccgtgcacacggagcagcccaggacagagctggacaagcccgaggccaaggccagcctccagagcccttttgaacagacgaactggaaggaactgtcgcgcaacgagatcatccagtcctacctgagccggcagagcagcctgctctcgtcgtcgggcgcacagaccccgggcgctcaccacttcatgtccgagtacctgaagcaggaggaaagcactcggcgcggggcccggaagccgcacgtgctggtgcctcatggcccgcccacggacttccctgggctgagccgcgaggtcacccgggacgatctggacaaaatccaggcccaccagtggccaggggtgaacgggtgtcaggacacacagggtaactggtatgactggacgcagtgcatatcgctcgacccgcacggcgacgacgggcggttgaacattctgccttatgtctgcttggactgaccggcccttcgggctctaagtgcattcccaccttgcagtcagccagggaggacgggcgccagggcccgccgcctccagtggttgggaatccggggggtccggcccggggcgggagggagggggcgagagtctctaggtctctctgcactcatccctctaaattctccttttgtgaaatgctgctaccagtttactaacaaaattgcaaaggaaggaccgcgtgaaaggaaggccagcaaagtgagttcagaactctatagcaaaccagctataaaaagcgttagtctcccaccccagaagaggtgcggatgcttcccagccctggtgagctgggacctctagttgcaggcaggcacagaaaaacctgtgggagaggttacctttaacacagtgacagaagcacgcatctcatctttgcattttctgtttttaacatggccctaagcgtctgaggcagtgggcagtactgtggcctcggtttgcaccccattggccagctttcccatcacggtgcctcagctgtagtgagctgctggcatcaggcaggccggctggccacccagttcgacccatgctccctgggcgtccacacatttgtatctggtttcagttacagcccagtttttaaagaaatgctgcagaaatttgttttctaaagtttattttgccccctcttccatctgaccaccagacgagtaacttgccttttgttcttccctcttcagtttccccttcccacacatatctagaaaagttcacctttctagacttcccttcccttcaaaacacaaaagtaaccgcgggtgctactggtgtgtaagctgtactgttgggcgagaagagacctgtctgtatgctggaaacactcataaccattcctttagattcgtttgccttatggttatttgtcataaacgcgatttgcaaaaacaaggagccttagtgaatgtacagtacctagacttctgtgttctcaggacgcagaagggagcaactttgctatttggtccagtaagtggacaccttgtgatataaatgtggaaataataaaaaaaaaaaacatttgcacaaaccagtctgagaattgttttttaatttggtcctttatagccacattcatcctctctggattctggattagccaagacaacctggaccccatatccaaggttcaggtcctatagctagccaggctgtgggggaggtgggcagggcagtcaccaagtccagcctattagccttctgcatggagactgacctctaccttgcctttcattcattcagggtcacaatgcctctcccacctccagagtcatctgctaactctgggtgacagagtcggagagaccacatctgtctccattccagacctcactttccctagaaacagctttgccctcccaagcaggctccacaacccaggtctcaagtgaccttgtcttacccctgaaatatttgcagttcttccttaactataaagtgatgatcttttaattcttctccctcatctctgaaaccataagctttggctttctatttttttcagtctggaataataagtcatcttgaccatatttacttgatgtcagatgaaagaaatcaactccccctttagaggagcagccccaccaggcaaatcaggaggtccagaaacatgcaatcaacccagagccacagttgcagagccttgggga

SEQ ID NO: 39363 - DNA, 2505 bp, Bovine  19866880819657
attggtttataatggctacatgatctagctagctctatgtccttttacttagtaatttgcaaagtttataatgacacagcttggtgaatttctacatgttgcacacattcataagacaagaccaccacccaaatggaattacaggatcctctgatctcttctagtctataaccatcccattttcatgaaatgattcccagtttatctatataccaccttattactggacacataggtggcttccaatcttttgcccttataaagatgctgccgcgttgatcttccttgtacggacacatttgtatctgactgcttcctctggatacatttctaaaagttgcaaaatcctgagtcagggggtgtgaatgtgtagctctcagttgacatgctgcgtctgtcaatcctgttacttcaggattcccctccctgtgcttctgctacgctttgcctggacagtgcaattatggtactgtattaatgagcccctaacccgtctttaggacttggcttcaaaactagctccacaggggacttccctggtggtccagtggttaagaatctgccttccaatgcagggcatgcaggtttgattcctggtcggggaactaagatcccacatactgcagagcacctaagcgctcacccccatgccacaagagaagcccgctcatggctacaaaagatcctgagtgccacaactaagaccggtcgcagccaaataaatgtttcaaatgggtaactacatattctccatacgtctgtgtgtgcccatgttcatccttgtgtatatttaatgcaatacttcatttattaaatatttgatcctccactgtgtgacagatctgcataaatgtgtctgggtgtgtgtatacaactaccatgtatctggatgagacattcattcacttacttcacatgtatttaataaggactcttctgtctactgggcttttctgatagctcaattggtaaagaatctgcctgcaatgcaggagaccccagctcaattcctgggttgggaagatctgctggagaaaaggataggccacccactccagtattcttgggcttcccttgtggcttagctggtaaagaatctgcctgcaatgtgggagacctgggtttgatccctgcgttgggaagggaaaggctacccactccaggattctgacctggagaattccatagactgtatagtccatggggtcataaagagttggacatgactgagcaactttcacttcacttctatatactgggcttcccagatggtgctagtggtagaagaacccacctgccaatgcaggagacttatataagagacacaagtttaatccctgggttgggaaggtcctctggaggaggactggcatggcaacccactccagtattcttgcctggagaatccctaggacagaggagcctggtgggctacagtccgtagggtggcaaagagttggacacaactgaagcgacttagcacatccacatgcacttttatctactggggacacagaatcctgtacctttaacagagctcacaagtcatcttaatgtttcttcttagtttactaagagcaggtcaatggagtgttttctagatttttttcttaaacaatctgaatcatgctgggggtgggggggagcagcttatttctaaggaaccttgatttaaaaagacaagtctgaggttaaaaataatggcagaacccgaatatactcgggggagggcttgtttcttttgcttatctgtagtgagataaaaagtatctccaaatgggctggtttccaacctggacaccatgtacacaaagcacctcattctaggagggagagtgaataaagagaggtaatttgcccatatttattttctcctacaagtgtgatgtaaaacttttcacacgtgcaggagcaggcaaccacaaccacgtggggaagcagccgttttttgcaaataaaaatgcttcccagaagcatgacaaatgcaagactaacaggtgtagcacagagccgaggcgcgcatgtggttctcatcagctgcctctctcctgttttaaatgtaggtcttcctgtaacaagaagaaaagttatttctctcgaggctgcggctaatgatccactcagcctgccttttttacccctttgcataaccgtatatttaacaagagcttccacggagagagccggcaatgaaagaaggcaatgatgaggctaggggcggggagaagcccttagacttgacatttaacagttctgggttcgaccgataactctgggtgaccttgggcctcagtttcctcctttgtaagggcgtttcagttttccagcaccaccattcaaagcagggtgggagggttttttaaaccaatgattctcaacaggggtcgagtctaccagccaggggacctctggcagtgattggggacatttctggtcccctgcaggaaaagggtgttactggcagagaccagggatgctgccgaacattttgcaacgcacaggaca

SEQ ID NO: 39364 - DNA, 759 bp, Bovine  19866880880028
tttcactctcttcctctttagagaaaggacacggggtgggcccagcatgccccagaacccctgattctcttgtgtttttttttttttcccctgagtctcataattcattaacagcagtattggaattatggccctgacactgacaggaaaaccaatccaactggatatttttcacctaatgagaaaaatataaatagacataaaaaacagaaataaattctgaatacacttctgctggcttccagcagggtgggagcaaaacccagcagcacactggtctctcaagccatattttccactttgaccaacgccaagcataggctaaggacaacagagctggcaagaggtgacggagccacaggctccagggaaggcatctcttggcagctcccgccaaggccccgggcatagccaggacttgaagaacgccatgttctaatcaaagcttcagcctggactgcagggacatagtttaacttcgtgtagaccccagttccctctcgagcatagagagttactttgaaagcacaaagtatgacacagaagtgcagactgggaggacagagaacgaccatcaacgggatcattctagagaacgacactgagaacaataatgacagaggagacaggcgggctggacttacacgatcatgcagaacatcatgaagacattccacagggcgatgaagattcgaaagtatctgaggctcagcaggaactccccggatgttgtcacctggaagtcagaaagcattttca

SEQ ID NO: 39365 - DNA, 1397 bp, Bovine  19866880887875
ccattgttctttctttggctgggccccctgagggtgggactcagaagggctccagcagagtatggtcctgttcagaccagatgaggcccagaggcagagagggcagccatctgtcccgggacccttccccaagtcctcccttcctgtcttacctggcaaggttcggggcctgcacttgcccatcctgtctcctgccagcaggatggggcagcctatgctgcctcaatctggattgacccctgaatacaggagagtagagtctgtggaagggaaggcgaggggcccagtgtccagaggccactgcgtgtgtcgggtcactgcccgcgttcctgccacagggccacagttgtttggccttgctggttggccctccagaggctcggtagctttgttacctgggaagggaagagtagactgggggacagcaggcaaggatgctcggagtcaagagaaccccttggggagggactgtttgttcaggcccaggcgagggtggaagcgggtggctttgggcttctgggctaatggaccgtgggcaaggccagatggtgttagctggagagtggagaccatcccaaaggtctccgaggagagggcaagtggaaagggcccagggccaggccctatgagacagggtgaacatagctgggacaggtcataggagttctctgctggggggtgagtatacggaggggagctgcccaagtagccgccaaggggatacctggacccccgccgcctcctcacaggggctgcctctcctcctctcctgccagtcatctgcaagcagcaggccccggagctggaaccggctgcgaccctgcctcccctgccccagcccccgctggcccctgcggcacccgtcgcgccagcccagggcaccccatccatggacgagctcatccagcagagccagtggaacctgcagcagcaggagcagcacctgctggccctcagacaggtacgggcccgctcctcccgccccacccctcctcccgaggggcacccggcactcacctctgtgcctcaggtttcacgtctgcactggcgctaaggacggggctgtcccattgcccagggcttggagcgagacagtcgtcgctcctcccgcgctgccaccgcctttattgtgtttagctcaacccctcacgccggaccctaaggttgggtctcctcccagtgagctcattgcataggctttgacacacatgcccccatcatgctgcagcaggtgtgacaagtgagcctgcacgtcggaaatggtgtgacagagaacgccaggtggcctctggtgccgttcgcacagttcttgccagttaggaggaggctcttgtgaggtggacccttttgtcccagtccatcacagcctggtacttggccagatacagtaggatcaa

SEQ ID NO: 39366 - DNA, 897 bp, Bovine  19866880958772
gaccccctgtttaagataactatgcaggtggtcactactgggcctggctagggtgggtggctttagtcagtggttccccctaacaactggactattcgactgtttcttgactgcttttcctttattcctgcattgtctcacttcccttaagataattaattacttagatgtgttcaagggcaagcattgaggccaggcttcaatcacaaaatggctcaggccaaaatggtttctcttatgtcaagaaagccattactggttcccttactctggggacccctaactgatctgcttatattaatctaattatctctgtggaacaaccaccaggctcattttaagggctcggcatgcctcacccagggttactgagctaagtgcctgagccgagacttgagcccaataccacccctctccaactctctctcctccaggccctcgtgggtgaccagtacggcccctgccctgtccccacgcagatcgaggaaaaggagtgggaggcgctgaaggctcagctgaccgccaggccccgcgacctggagctggtggcacgatgcttctggagagacgagaacgcggtgccccccgcctacctgctgcaggccctgggcactggggaggcctctgggcctgaagaggccaccctgctctctgcactgcgctccggagcccaggaggcccgcaggctggggctcatcagccaggagcggtggtactgctaccaccggtcaggtgaggctgccaagactcccctaggggtccctgggaaatgcccaggggttcaaaatacacatcacgctttatccaaacaccaccgcctgcatttctataaatgctaaaccaacctagctcccggaggcccagttctgagaaagattatttttctatccaagagag

SEQ ID NO: 39367 - DNA, 608 bp, Bovine  19866881042698
aaagcggggctctgccttggtctgagacgcaaggagtacttaggcccagaaaggtaataggaagaatcccactctccacaagatcatcttccgtcggcagcgaccccaagaaagacccagcgaagccaagtccactctcagaaccgaaagggactctccacgcgccttgggcacccggctaggtgtaaaggaggccgggggggctcccttcgaagccagaaaggttcttccaaccgggaggaaaggtaaacaagacttccctcatcaccgagaaggccgagacaccggcggcacgggctccccgagtcctaccccggacaccagttgctcacagcctttccccctcccctcccccccgccgggagggcttcccgggggtcgcgggtcctatggtaagggcgaggcggggaagcaccgtcaggaacagcaagggtcgtagaattagagtggatgagggggaaaaactctagtctcagctcccatctgctcccttcgcccaggccgcacgaaagcctcggcctcacgtaccgagcgctgccgggctgcccgaccagcccccggcccgggcccgggggaagagagacagggatggcagcggccctcagggg

SEQ ID NO: 39368 - DNA, 1248 bp, Bovine  19866881076508
tcgaggtaggtggcatcttaattccccaccagggatcaaagctgtgccccctgcattggaagtagagtcttaactactggactgccagggaaatcccagaagattctattttgaaagagtaaatgtttgaggaaacactggaccaccccatgtaaaccctcgtgttgtggctcccaggaatattggtttggaaagacctgtcaagaggagaaaagcagattagggagatggcctggctactccaatggggaaattgtggagaacaccaccattgacatagctgtgactgtcaaagatgagatgaactcagtggaagagatctcagagaatactgatgttaacatctacctcgttggacaacagaaaattccaagtgagcaggcattctgtatgtgtaaagaatgtgggaagcgtttccagcaaaatgaagactaatcaatatcagggaattaaacgcacacacacaaggtgtttgtattctttgtaagcagaagccagcctctctctctcatctgctttgaaatgaactctgcttgttctccaacccagaggaaatttgtggacaagtcccttagtttttccaggcaaatgcttgcaggtattatgaagtccattccagtctgatgctcatcgtgtttaaagccacttcctttttcaggcaagaacacatggggtggtttatgtattattttcacaagttacttctcttcctgtgctactcgactcatctgagattgggggagggatggttcagggttctgtaggtgtcagaaggaaagaaagatcaggaaatgtcttacttgatgggtacagctggaaccaggtatgagtaccagctaaccgtgggctctgtccaaacgctgatctccatggtgaacccttcagtgatgggcaggatgccatagagctggtcacatctgtccctcgctcagcttctgccttctccaagtgcaggagacacagggtgtgcccccacgcccgtccgtcctttccacaggcaggggctctcagaggcggagttaaaggatgttctgtccttggatgatgaggtcctgcagagcgtgtaccaagactggaccccacccagcaaagagcttctgcgcttcccacccctgctgtgggtgaggcttcgtcgagatctgggtaactgcttggccaggcggcccgtggacggcttcacccttctggccattgctcacaggtgagtcgagcgggtggtacacggcggggggacgccaagagcaagga

SEQ ID NO: 39369 - DNA, 1097 bp, Bovine  19866881231646
acgcagccctgagagggcaacggaggccgggagggccagacccggctgagggggcctcacctcgtcatagacgctctcgatctcgttgagcaggctcttggagcgaagcgccttggtgtcgttctgcttgaagttcacggcctggtggtccagggacttgaggtacgctttctcatactgctcccgccagatcttgttgaagccctgctgggcctcccgccactcctcctccttggccttcagcctgtgggggcaagcaggctcattccaccccagacccacggacccgttccaggcccggacggcccgctgcaggcacgggggtaggctctgtgccggatggagggcggtgggagcggctggcggcctcgctgcagccggctttacggacgctcaaacgccactgccctgcagcacccccgtcccggcccgcggcactgactgcgctgcgtgcggctgctgcgctcccagtggatgggactgtcgggctgctcacgactggggccccagcactgggcgtacaaccagcccagggcagccacttaaccaataactgttcacagcacagggagggcgccaaaatgtgtgattaaacaaaaggcaagccatgatacaggacagtcccatttgtgctttaagataattactcttcatgtttaggcatgatcacgtgcagagtggaatttttgaggacacaaacaatcactaacggctgtacttttgtcttggggatggaaaagggagagaaaggaagaccaaaaaacacaaccagccagcctgagtccccaaggcccccctcagattacacctgggacaaacagcagtaatgagcccctgggtggtgcagtcagaagcgtgagggcacctttttaggacaacggggacagcggtgacagggttcttcttgaggctctcgatgatctctggggctttgtcgccgtaaatgcggtggatagcgcggcgctggatcacttccgatgtgccccccagacagtcgtccaaccggaacttctcctggtcttccggcgccatgcgggacagcttcttctggacgctctccaacacccggattgggccaggtggtctccaggacaacg

SEQ ID NO: 39370 - DNA, 621 bp, Bovine  19866881404093
tgggaaatgatgagggcggggtctagcagggtgggcggggcgggcatagaagccggaggcccggaagggagcccttgcctcccctcccccacaaggcagatccagggacccaagccgtgagctcagactggcggcagcgaagggcggagtggaattactgggaacccttttctttattttccaaacttcttgaatttagattgcatttagttcaaaagttttatttttttaattttgttttcataaatactaggcaaatactcgcgtgaaattccaccaggtcagggctcagggcttcccgggcactgtctccactctgtggagcgtggtcctggcccctagggacttctccatcccaggcccaggcagaggcgagggccaagtggggagcttggagttcccagggccctgacagcttcgcctcgcccgccaggctggtcccctgaagagcgaggtcccgtggccgttccggaggagggggtgacagtcacgcgctgtggctgcgcccgcgcctgcagcatcagcggggagccggtgtgtggctccgacggcgttgtctacgccagcgcctgccatctgcaggaggccgcctgccgccgccgcgtgagattggagcccgcg

SEQ ID NO: 39371 - DNA, 1293 bp, Bovine  19866881411950
taaattttatttaaaaaaaaaaaaagtggcatgcccaaggagcagagttgcaaggcatccactcccagtactttggcacaccaccagggttgactgcagtgcccatggccacgacctctccgcctgccttcttcagaggactttcatctgtagttctggtgtggagcccctctgagcaaggagcccatatgcctgcccgggttgctgagacagtgaggggtcggggggcaattacctcgaacatcaggccatgcttctggcagaaggtctgcacttcgggagtaggcggtgctctggagggcttccctctctgcgtccatatctgcaaggaacagcatggaggctaggaaccggacaaactcagaacttgtccctgcctcacagctctgcttttagcctcaggtgctcttacaaaggaaagctgtgacaaacctagtgtgtgtgctcagtcactctagtcgtgtctgactctgtgaccctacggaccgtagcctagccttccaggctgctctgtccatggtgattctccaggcaagaatactggagtgggttgccatgccctttttcaggggaccttcccaacccagggagggaacctgcgtctcttacatatcctgcatcggcaggtgggttttttaccactggcaccaacaaacctagacggtgtattaaaaagcaaagacaccagtttgccaacaaaggtctgtatagtcaaggctatattctttccagtaatcatgtacagatgtgagagttggaccataaagaaggctgagcaccgaagaactgatgcttttgaattgtgatggagaaggcttttgagagtcccttggactgcaaggaaatcaaaccagccaatcctaaagggaatcaacactgaatactcatcggaaggactgatgctgaagctgaagctccaaaactttggcctcctgaggtgaagagctgactcattggaacagaccctgattctgggaaagatcaagaaggacaaaagggcaacagaggatgagatggttggatggatccatcactgacccaatggacatgaacttgggcaaactccaagagatggtgagggacagggaggcctggcatgctgcagtccatggggttgcaaagagtcggacacaacttggtgattgaacaacaacaactcttacaaaggttaggaccgttcatgaagaatcaaaagctacaaaaaataggaggcatgccagaaagaccaactatgcctgagactttcctagtgttagtgctaaaaatcccacatcccaggaaacccctcagacc

SEQ ID NO: 39372 - DNA, 872 bp, Bovine  19866880422057
ggggcaggttattattgctggcagatggttagtctgattcagccaaggaagctaataagaatccacacatcaggagtctccaaattcccccaatttggagatagcttcctatggagatcaagttgagaaatatagaaacaggacctgtggtctaacagagattatttatttgtaaatgcaattgcctgagaagtattacaaaagtataaaaatcagatcatgttcaattatatatttaatggataaaaacataatgatatgaaattcattctggcccagaacatctaaggtatgcagaggcaataccaatagatcatcggggaaaagaatagcctgaaatgtcattaattaaccaaagaacagatatttattggccattattttgtgttaaataagaggattccagaataaataagacatagtttctacactcaagggacttttaaactaatggcaggaagccagggggccagggaggagctagccatattaaatattgcagactctgcctctgccccctggaccttttgtgctcaggctggaacaacagaaggccactctgcccatgtgtgcagcaggctcctggtgctgaacaaaggccccagcccctcccccaagagcagccctcagccagtgactctctgaggttgagatataaatatctcaacacctttacccctcaggtgggataattctaagacatgtgttttgtactccttccaggagtttcctcatggacctagactcttggtggtagcttgataactcatcagcctttatcatatactttatacatcagccttacttgaatccttgtctcaagcatttccctggtggctcagacagtaaagaatctgcctgcagtacaggag

SEQ ID NO: 39373 - DNA, 697 bp, Bovine  19866880448218
ccaactctcacatcccgtacactactactggaagaaccaaaacttcgcctatttctgttttgtaagtttgtttgaaacattttttttacattccacatataagcaatttagattgtcataccgagtgaaataagtcagagaataatgcaaaactttaaatgctgggattaactaactacagcagtaaatgctagaatcatcaaaattctccaagattaagttacacgccatgacttacacatttgcctggtttttattttatgtgctgcacagtctaaccccaacctttgactctgtaaccaccctggtttgagttggggtttgaacagctgcccagcccatcagtgcttcagtgtgtttgagcaataactcatgcagagatgcttaagagctcacacgtcttcaatagactaaaagcaagagaaataagattccatagcaacaacatgtcactctaaatcatcagtgctgtttcacgaacaatgtgagaactgcaatagaaaatacggcagggagtaggaccagttcagcagatatgattggctattttctgggaattagatcactttggtcagagagaccacaaaactgctcatttttattagctaagctgttgaatctagaaagctagaaaaatttgccattatttgctactttgtctttcactgaaaaaataaaagggggttttattttcctc

SEQ ID NO: 39374 - DNA, 1890 bp, Bovine  19866880453847
caactgagtgactggactgaactgaactgatcagttgctttacaatgttgtgttagtttcttctctacagcaaaatgaatcaactatgcatgtacataaatcccctctactttggatctccatcccatttagatcaccacagagcactgagtagagtttcttctgctatacagtaggttcttattagttaccttttttatacatattgtcaatggtgcatatatgtcaatcccaatctcataattcattccaccctgctttcccacttggtatccatacatttgttctctaggtctgtttctctatttctgctttgtaaataagattacctttaccatttttctcagattccacatttatgcattaatatacagtatgtgtttttttctttctaacttactccactctgtatgacagtctctaggtccatccacattttgcaatgtttttgaaaactcacacattcctagtaatttgctaaagtgacatagctcacagctaggaagtggccaaacttgactttaaactcaggtcagaagagccttgaaggcagtatcttcttcaccaggccagactgggggattcattccatccagaagtcctcttactggtgccaaaggccactcccatcccagacaaaactgagcccccagccacagctagagtcagcactccagaaatctgtctagtcccagtgacaagggtggtggggcctctggactcaggttctaattaaacagaaaacacagcttccctgggagcatgtttgaagggaggaacccagaaaggagagagagggagaactggcaagcacccatcactatatcttggaaatggggttcttagttggggttcttcatagagacagaaccaacagaacatttaggaaaggtgatttataatgaggatttgatccctttgtttatggaggctgaggattctcaggattttcagtctgcaagttggagtttaggaaagtgtaactcagtctgagcccagagtcctgagaaccaggggaactggtagcgtaaatcctcatccaaggactggagaagaagggataagatgtcccagctcaactgtgagacaggatgaaaggggcaaattcctccttcttctgtctctgtattccggattagatgatgtccagagtcagacacgactgaagcaacttagcagcagcagcagcattcattttggggagggaatgctgctttatagagtccactgattcaaatgctaatctcatctggaaatatcctcccaggcacacccagaataatgtttaatcttggcaccccatagcaagtcacactgacacataaaattaaccatcacacatggggccttgggaaagccatgcaggcacagacgcctcctaggatccctctggttcctgccagcagcatcctccctcagcaatgacagaaggaggcattatgtccccagtgtctacacaagggcttcagacaacttcttcagctttcccggagctccccagttgctgtgccctcaggacactcccttggatggaattctgggtccaggctgtaaggacgccaccataatcattagcctcatctaccgccacatcttccaaaatcatcagtgccttctctgaatctctaattgtggtttctcaatcagttgcttgcaaaatacatttttgtgtttaacccatcactggcccagccactctaaaataaagcagatccagctagttgtacatctaatttccatgacaaactacacttttgtctgggtggaccctggcacagtttccttttaaaaattgaggtgtggttgctttgaaatgttgtgttagtttctgttgtctaacgaagggaatcagctatatgtatacatacatcccctccctcttgaatctcc

SEQ ID NO: 39375 - DNA, 4440 bp, Bovine  19866880522342
ctcttaaaatgtgaagaccttcaatggagggattcatggtctaaatggaatttacatgaaacactaaagacaaattttaaaggttattttgtttagtgctataaatgctaacatacaaaacaatcctataaaagataagaattatgatataatctaatctctccattcagcttgtgttgttatttaaatttttacaaatatttctttgttcagaaagtacataaagctctgtatctaatacactttcaatttcctttttatttaactctttgaaggttctaaataatgtttttgcacaaaaaaattgacagctttcatgaattattgcaccattgtaacttctcaataataaacacatacgtattcttaaaccagttgatagaatttcaacaaaaaagtaagagattttttcatatatttgattatttcatatatttttcatatattttattattaccatccccacatttcaaaggaaacatgtaaacagaagctaaacttaatggaatattctataataccaatattgctgactttatatgttagtaacctatgtggtcagagtagttacacaaaatctgaggatgtcagaaatgaggctgaactgggtatcgaacttctagccttccagagctcagtgtccatgcatggcatgcctggaacagcactaaagggggccctggcatcctttctgagcagaggcttcccaggtactcaaggctcttctattcaattcatgtcctctgtcttggaccagagctccttccagctttactcatacaatcattggccactcccccaggctgcagtgatgtttatgacatctttcataatggccacggttgggtcttctctggtaatccagtggctatgactccatgctcccagtggagggggcccgggtttcaatccctggtcagagaactagatctcatatgtcccagttaagagttcacatactgcaactatacacacacacatatgtatgtatatcctgcacgctgcaactaaagaacccgcaggccgcaacgaagaccaaagattccacccgccgcagctaatacctggtgcagccaaataagtaaatagcgaaaaatgctggccaaggtcgtctacacaccataattgcctgcttccctttagtctctctttcctcacccacttgctggcaagtcctctgaatagcagttgggctcacacgtgcacaccctgtggtgatgttcctgtttctctgtagcagaaccgccatccttacggtacatccttggttagcattcagcatcacaaccgtttgcaggcgcacaaaataaagggctggaagaagagccaaacccagtgtagagagtgcatcgccgatcagctgccaagggcattgtcggcgcacccatcagccaaaacacgcagggaggtctttggagacagttgcattgattgagagcctatgagaactttcagaattaaaaaatatatattttaacaactgaacactggagacgtacacacacatatatatttccaagagagtcagtgtgagcagacaatgccagtgtggctcttctgtttgtgtgtatctttgtctccaccagactggaaactctttgaataaaaaagccaagtctttctatctgtatatgcccagctttttttttttaattaaaaaaatgtctaactttattgagacataattgactaataaaaattgtacatgtttatgagtacaaaatgatgtcacatatacattgtgaaatgactactgcaatcaagctaatgagcatatccatcacctcacacagatgtaacttttggtgtatgtggtgagaacacatacgatccactctcagcaaatttccagtatgcgatagagtattactgactactgtcaccatgctgtatcttagaccataagaacttactcacctttttaactgaaacttggtaccttttgaccaacctcttcctattaccctcatcccccagccccagggcaaccaccattctactctgctaacttttaaaagttcaactttttaaaactccacatataagagaaatgatgcagtatttgtctttctgtggctgaatacgcaatttttaaagtaaaacctgctacatcccaggagcttaataaacatgagatgtttattaaatggtgaatgaaggagtgaagtgaaagtcactcagtcatgtccgactctttgcgaccccatgaactatacaatccgtggaattctccaggccagaataccggacagtgtagcctttcccttctccaggggatctttccaatccagggatctaacccaggtctcctgcatcgcaggcagattctttaccagctgagctaccagggaagcccaagaacactgggttcggcagccttctctatcagatcttcccgacccaggaatcgaactagggtttcctgtaatgcaggtggattctttaccagctgaagtatcagggaagccctatgaaggagtgagaaaattgtcaaagggaaccatgatgccccacccccaggtcacctctggggatgaacagtccctgaggcacctgctcagtctgccctgtggatccagctgcctggtcagcagagcagaagccacaaacacctcggggaccctggtggctggacataagaagaaaggacaagatgctgatcccctcatacaactcagaggagacggtccacacttggcaagggaccctccatctctcctggccagcagctgagcattgagtccccaggagcacgcaggtggcaggcagcactctgtcatccctgccaggagttcgctgtgagtgggcacagaggacccactttctcccctccccttgaccctcccctgctgctccacccctccatctctcccagttggcagatctcctggactgttctatatttaactctctaaggctcattaactacccaatccccaacttcaccaccagacccattcaaaggagttctttttcggctacagttatttttcttttgagtattaatttcctttaacacttgccctattaatcactttaacaatgaaattaagaaaattattttaatgaggtaatgggtgataaagaggggacgatacacatttatttcacagcaggccagaacgtcttgataaaagtcagccttgtcaataatatattaggtgggaaagtgcttcaggagggccaggctgaggactgttctgtttcactgatttaaatgctcctgtttctatcaatgtggctgtgtccatgctttcaggccccataaagtgggatgccagttgctgagagtcacaggttgctattttcttccagaattcagtggccaaaaaaaaaaaaaaaaaattattgatttggctgtgatgggtcttcactgctgtgcttgggcttttctagctgcagtgagcaggtgcttctcttgtggtgtacgagcttctcattgcggtggcttctcgggtgtgcaggcttcaacagtttcggctcccaggctctagagcgtgggctcagtagctgtggtacaagggtttagttgcttcatggcatgtgggatcttcccagaccagggatcaaacccttgtctctgcattggcaggtggagctttaccactgggccatcagggaagccccacgccgcctttgtcttagagatgaagcatcatcctcttctacttctttggattccaccctctttatatacgccctctgccatccctctgcaccttcgcgctcccacactttgtgccctttcccttctcccctgattggctcctcctgtccttagcccattgagccacagtataaatatggttttcatctcattccccaccttgtgttttattgacaccaagatatctctttcaggtctggtatctcccacctgtttttgtttattttcattcccaccaacgagagtcattgtgctcatctaatagtggggtcactggccataggaatgggggcatctaggacacgatgaatggaactggcacaaaacccaagaatcctggcctcctgcaggatgctcctcctcagtcctgagtaattgactgggagcatctgttgcttccttgcctcacccaggccttccatgggctggaattcaggcaaaaattcttgcaaaaataagcagcccattcccttagcttaaaaccagaagtggattcaaccattctactcaaaggcataagccaaaagaactgaaaacaggaatccaaacagctattcattcagccatgttcatagcagcattattcacaatagccaaggtgtagaaacagctcaatactgacaaccaaaatatggtctgtgcatacaatggaatattattcagccataaaaagcaatgaaattcctgatacatgctatgatgtaaatgaactagaagatatgctccgtgaaataatcaaggcaaaaaagacaaatattgtaggattccactta

SEQ ID NO: 39376 - DNA, 2373 bp, Bovine  19866880586714
caggcaagaacactggaagtgggttgccatttcctttctccagtgcatgaaagtgaaaagtgaaagtgaaatcgctcagtcgtgtccaactatttgcgacccccatggactgcagctcccctaatccgctagaagaacttttacatcttttctatgttttccatcttttctgatccaactttttggatctttataacatcctcatatctaacctgtccataagctcatgtctaaataaggaaatagagcaacagcaacaatatctgagacttgcccagagttatccagatcatttccatcagggctgggtgaaactcagctctcctaaggctcgtttactgttcttgccaatggaccatggtctatttagctttctcctttggtgggttttatcctggaaagtttctcctttcttctgccttctcccctcctccctaccgcgttactgccagcacagaatctggcagatgaatgacctggctgatctcccaagttttcctctgaaatgtagacccccaacatccttcccatgtggaattccaaacacaatcactgctgtgtcagaaaactattaactgtttgagcagtagaccttgccaccagcccggagaatgataagcacgagaagggaagcaccgcactgcctttgttcaggtctaagggaagatgcatgacctagtttgggttggtgatgctgtttttaaaaaataaaatatagggattcagagacctgtgctgagagcttgagctctgtggggaaacagccttctctgagagaccaataaacgtgtgctgtggcttatttatttggttttcattggaggttgaagcagcaaccagtgggctggtcctgaggccagaacttctgcaaatgcagggccatttaggatgctggtagctttgttgtcattttttattccttggagtgaatcagtctgatagcctgacaaggctgctgagagacagcgcgaggcccttgttttgacagttgtcccatcagattgagtagcaggctgtgtcctcacaggcagggagaagaccgaggcatgatgtgggtacctgagcagagagctgcatgatagttcaagtgcgtgccactgccagggggctgtgtgcctctgcaggcactgcagagccactccccaggctggtttggaatcctctgacttgacccagcaggtaattttatggtttgcttccaaaacaccagaggaaaatacaggaaaatctctaggcttccatccatgaaaggtcagcctttgtaggtattccctaaaaggaatttcatatgtttggcaatggtagcatcactggaagataacccacagtcagatacatgcatatttaagtgcacttcctaagccccttctcttgctttatttttcccatggtacttaacatttgcagagtcatgagtctgtatactgtctgtcttcctcgctaaggaatccgcctccatgaggccagggctttgtctctcccggccgcagcccctttccataaaacagtgacaggcgcataggtcgttttcattaaatagctgttttttctcttgtggcctgaagcccttgtactgttgaagatttattaacttagttttcaaaagcttcaaagttattaaaatgcaagcatcctgagaatagcaccttacgtcttaataagagttctcagctaatacattttgagggtaggagactctgccatggcattaaggaacatagatactttctagaatcgtgctcaagtggaaaggatatgggtcagagggacctgaaacaggaggggagaaacagggagaagacggtgggtgaagcctcaaaggtggcctcttgatggcttttcctgtcggtcctgcctaggagtcatgtttgactctccagcctctcccagtccagcatcagctcccacaccatgtatcagtcagctctggtgcaatgactttttccctttcctctccattctcactattgaccccagagagtcagacctcatcacctatcccctgatgtcaatggccaccaaaccagttcactgcttcctgcctcccctatgagccatgcagacacttcctgtctcccctatgagccatgcaggccagctttctagaataccactttcatcttgcttccctgcactagccattaggactgcttatcagtatttctgcttctccgtttattgtcatatgatgggaactagttctgctcaatgaattggaagcggaagtgacgggtattgcttctggtcttgagcacttcactgctaatgtgagaccctcccacattctttctctccagcaccctgattatcaacatttgagattagcctgggtctctagtgatcaggatgagaagatcttttctgctaactcat

SEQ ID NO: 39377 - DNA, 1396 bp, Bovine  19866880642856
gggctggagggtgtctaaaagctggcttccttcttgtgagtgtcctcttggcttgtcggatgccccactggcagccgctgctggcatcccccatgattcagactctgcatcacgttcccaatggccacccacccccaggcccactccaagaagaatctccccatgggatttccattacaaccccctcaggcatttgcagtggattcaggccagatctctctcccatcagtgcctatagggtccatacaaaacacccttgtctcttttgctctcataaaccccaacatacagtccagccccaatgcagtggcaacttcgttagcttcacaaagaatacagtggcctgtcgggccttcttgcctttgaagttttatgagcaggagccagacgccagtgtcctgggtcccctaactgtgggaaaataacaagcactccaagtggtgctttcctgtgacttgaggtacaggaaaggaacctctactgttcccccttgaggggaggggaagctccaagcatggcctccttcaggcatcctcatctaaaatcctcttggtttccaacaatcggataatatgtgatttcctcattgtgggtgagggattttgagagttgtgataatggatttccagatagctcttttataaattctgcatgtagcctagtgtgcttcgatcaatttaacactctgtaataaaagtgacagatgcttaatcaactcaagttgtttgaagcaaaatggaggatttaatgtaagaacattgggatgtcttctggaacccaagagcaggttcctaaaacccagctggagtttaggaatgactaaccaggggctcacatttcctcaggactctctctgcatcttgaatcactcttctttcttggtctctgcttcatgctgtcctctctctctgcaagttacttccttaacttctcccagtctggttataggaaacatggctacaggcagctcccaagatacatatctcattgtctagcctcaaaaagagagaacttccactctttcaggccaaagaacaaaaaaccagggcaaagacacatatttcattagtcaacatgctcacctcaaccaattagctccacttgggtgcaggaactcattgtcacatggcagctcctcaggcaacctggttgctgcctgagataaaaaaaatctcagaagaaggtggcaggtgctaggagccccctgggcacatttccaactgttcagtcatttgtgaacttgtgctattgtgcctggtggctcagactctagatctagtaggattggaaggtagtgatggggttctggtttatgcaaaagtccacaggaacagccaacatagtcaacaaaagggtccaaaatgcagtactttgatgcaatctcaaaatcaataga

SEQ ID NO: 39378 - DNA, 1078 bp, Bovine  19866880649871
aacacagaggatttttaggggtgaaagtgatctatatgatactatagtcgtggatgcacaccatcgtacatttgtccaaacccatacggtgtgaaacaccaagagtgaaccctggtgtaaaccatggtctttggttgatgatggtgtgtaaatgtaggttcaccaatcacaacaaatgtaccactctgggggaggcaggagtgaggacagagagtatatgagtcatttctgtaccaatcccctcaaatttgtggtaaactaaaacttctctaaaattcagtccattcaatattttttaaaagatatacaactaagttaagaatggggaaagttatttgccgactactgaagtctacttatgacaaatctaaataactgctctaaatattattgcaaattaaatgcaactgtcaaataatttttgaaagagaagatacaatgtaaaaataaaaatattttatagctaatattctgtatcataaaactccagtttaattaaaacagatggaaaagtagggagggaaggggaaaatagaattgtgatggcagaaaaaatgtaaaatgtctgtcaaattttttatcctacatgtatatagtcaaaaatgttattttgtttgctatttttatcctcaaaatatgcatattgacttctatttgtgagtttatgatgggctaaaaatttggagcaacactcctgctagaagcaacagaaaaattccggaaaggtatttattaagggtctttcaaagcagaggagttctgacagcataccaaggagttgctagaccaaagtgtaagggactggaaagaaccaggcattgtctgtctctgcaaacttgaattccacctttgacggcaaacttcagcgccttagctagacaaaaggggcaggtgtaactgcaacatttatccatacataaagctgggattcctaaaaggctgcaacttcacaagaagggttaattagtagaagtcaacctccctctctgtcccaaccgctcacaattcccatcccaaactgtcagtaggaagggtgttcgggtccggtcagaagatagaggggaaagtaaaacaaaaa

SEQ ID NO: 39379 - DNA, 1330 bp, Bovine  19866880690192
ctgtgtccctgtctaggctgttgtaaacaattctgcaaggaacaggatagtgaaaatcctgatttcatttcctttggtacctatacggcagtggtacagctggattatatggaacattggataatgacaaaccaacccagtaggaacctctttttttgctggatgtgttttaggagcacagagattggactctcaccccagctcaggctgtgttctggaggaccctgactgatgacaactctagatttcctgagaccactgcacatcctagcatggatgccttgggccgctgagggactatggagctgaagcagtgcctgttggtgtcccagggtcctggcaagcagacttttaactatgccccatgtcagaagggagcagacttaggaggagaacaacccccacacctcatcagaaatagaggggaaatgacttgtctcttctgcattagactctaacctactgactcaaggctcccacaggccacttttttctcttgtatcccccaacatccttctctaatgagttcccttgcctcccctttttctaaatttgtacaatccaacagctggagaggtttttatgtctcctaagggagccagctccaatcattcctttcccttggctggctctggaagtctccagagccccaggtccctgggcaaaacttccagatacctagcggcagacttccagcagaaacccacctgtggtgctgttgggctgagcagatctgtcagtgtgcaaactttcggcagcgtgggccttaccgagcagtcccatagaccctgctgaccccaggtccatccttctgagcaggacctgcagggcagggccagggctggatgctggagctggagagacatccacggtcagtgctcagctgcagctccccacctcctacccccatcccagggctttgaggcgcggcgtgcatgctgacttcccctcattcagcaggcagagctggctactttccaaacagtctcagccctggaatccagacttttcttctccccttcctctcctgcacctcagaggactttgatcaaagcgagaagagaggttaacaggtttcatggaagcacaatggtgcagaaagcctgggagacgtagttagctatctgtcagcaatttaaacctagaaggtttccagaaatgactgagctgggaaattgacccccaactttctggccttttgccagttagagggactatgaagaatggagccgcagcctctagttcagagcacaccctccaggtgaatctgctccactgctccagggcctacagtgagcacagccttcctcccaacatcaaggatcctgca

SEQ ID NO: 39380 - DNA, 1572 bp, Bovine  19866880799464
aatgctttggtttattaaatatccctgtaagtcaaataagagttggaatttgaggaacagatggagagaaagtctgagtactggtcatatccttgggtgctgggggtgaggttggacccctcctgccagagtgagggcttgtgatcccatatttctcctctggctctcatcagcctcttctatcaggtaggttgtaaacctggttccttaagtcttaaatgtaccccggggctcagaacagacaaggaggattggaagactggtcccttttctgtctttttcttttgtccacacatgcagtaaataggcttcttttcaatttttaattgcctcatgttacagagtgtttgactcagataagccatttgagtggaccgaggagaatagtaataggctataaacgattgaagttagcccaccaaagtcattctccagaccctccgtgatgatctatttcctcagtttcaggagcatatacaccatgtctctcacatcaagggattttaaaccactaatagaaaaaaagaatttgggtaataaaaatcaacagatacatgccaggcgtaaagattaaggcgactttctgaagttctcctctgtagctctttgatctgcatagacatgtaaatggactgcctgttgttttccagaaccctgtgtcagactcccttctcagaggacccagagaaacaggctccatctccctttatcactaaatcttcaggtggaggggaacttcttagggtgctcctcattccaggccatgggatcgctccttttcctctccaggccctggagaaactttgcgtagagcctcaggtatacaccatcttcaagctaaaaatgagcaatgggggatgggggggtcttttcgcaatatttggaaaacattgttagtggatagaaatttgtctactttaaatttcgttctcataagcctttgacaccagatcctccacttatttaaattagaatctagcattagatgctgtctgatagtgtgaaaattttatgttgagctattttaagtttaatatgtccatatttcatgatccacaaagagcaccaccactgatagctgtgtagccataaaggacaagcttgatcaacactggaatagatcatccacattctttttaacccaactggggcatttacatcttagaaagatggtgggtccattttaaggtatgtatttgtaaacatctgtttgcttctaaacaaagcataagcaaacttcagcagagggatgagacactcaacactctggcccctctgctccttgaccttctcacatccagccacagtattcttctagtcttcctcccacccctcactcctatgaccataatagtgcaattaacagaaactatatacctcttctcagggcttctccagtggctcaccagtaaagatttgcctgcaatgcagaagactcaggagccatgggttcgatccctgggttgggaagatcccctggaagaggacatggaaacccactcctgtattcttgcctggagaatcccatggacagaggagcttgggaaactatagtccatagggtcgcaaaga

SEQ ID NO: 39381 - DNA, 1081 bp, Bovine  19866880819845
aaaatatacttccaatgcatttggctattgcttgtattactctaccatgtgcaaatgaagagtcttctgtgcaatcaaaataaatctatgaaggtggcttgcctagtttcctcttctgcaccaggcaatgtaagctccctgaggacataagaagagcgaagaggaggcagctgcccactgctgtcacaggaaacctctgtcttagattggcagccctgtgcagcccactaccaggaccttctgtgctgccctgggtaccaagcaggagggtgtcacctgaagcctgctgcagttgcctctgtgctcctgggagaaacagaggggagaccaggcaccagagaacccagatacagaaagaagttctggcctgtaccatgtaggtcccacctcacaaggaatcagtgggtctatgtgagtctgtgcatcaaggaattcaccttgttgacatcaaggtctatcacgagaagccctaagcctggtataggctggtagccaagtcacaaacaacagcttaccccgtttctctctgctttctggcctgtggatgaaaaaaaatccagcgctttgcttttccaggccctcaccaactgccctcccaacccagaaaggagagaggctgagccctgctactccagaggaagcagacatgaggcaaaggccaggttactgccatagatagcctgacaacccagactgagcagcaggcagggaggcactgttcatgtaatgagtgtccaccacagctcacaggaacctcatggccttcataaacactcacccattcatccacccatcatgcggtcactggctatgttttttgttagaggaaccagcaggcagcccagccccaaaagacaactgatgacccccaggagaggtgggacacacaagtcctccacggatgtgtcccctcctcacctgtgagctgggatgtggtgttactataagtaaggtgtttgtctttgggattaaggcagagcccagcctttgaggacaaagtaagtatttgctatttggttcccacccagtggtgggagccagaggcccatcactgtccccacccccaggccagttgccttgt

SEQ ID NO: 39382 - DNA, 1476 bp, Bovine  19866880940467
ctgaagagatcgccctgggtgttctttggaagcaatgatgctaaagctgaaactccagtactttggccacctcatgcgaagagttgactcattggaaaagactctgatgctgggagggattgggggcaggaggagaaggggacgacagaggatgagatggctggatggcatcactgacttgatggacgtgagtctgagtgaactccaggagttggtgatggacagggaggcctggtgtgctgcgattcatggggtcgtgaagagtcagacatgactgagcgactgaactgaactgaaacatattcagcccataaaaccagttcaatccagtggcttccttacaaccctctttttgcaccctcttgcagaaaggcctctctctttgaaagttcatctggttcactgtcctttaactctcttgttcatctttgtcacccgttctccatcttcctttcactcccctcattcattacagattttattagctggctcagaaatatctcttgctctcagctcctgtcaccatgctgtttcacatctataccaactatccatccaaagtcttatctctaaagttccttgacatcatcaactccaacaacactcactagctccattccatattagcgtcaaccaaccctcctatggctacactctggatcttctcatcatataactctcccacctttagaaatgcaaataccagtagacgaatttttttcccctccctcatcctaccacgctgctgttagacctcattgagatcttcagtccttcaagtccaacctatgcatctgcctcccctactagaccctaagctccctgaagtcacggctgtgttatactctcatcacttatggcaatgcatggtccagggagtcatgcagaagatattcatgaaaaatgaatgagtgaagtggctgccactgcacacctggtaggtcctccccacagtctcttaaaggtgttgtttggtaaatgacattgtagattcccctcaagggtatttggacagaaaccacaaggttagaattctaattctggatccattgccactgatctacacagtcttggacaagtcccttgccttctccctgaatctcagcttccttttgtctttttctgctgaattattattaagaatcaaatgaaatcatgaacatgagagtgacttgaaaatgtgaagaactctatagaaatgtgagaaatattatgctaataccaatgagctttttatttctcagggtgtactgtgcagattcacattctactttagggaggaaaagctgtgaaaatgttgggggaaccaagtgcccagaaagccaaagatgaaccatcaggttttcagatcagcgcaacctgtttcttccagcttctgtgattccttcatttaccaaacattcatcaatttcctattattttcagttactcagtacaatacaggcctgccttcggggagctctgtcttttgcgggg

SEQ ID NO: 39383 - DNA, 803 bp, Bovine  19866880992949
ttactatcccagtgggcaaatactatattacccatttcgcggatagtggtccaaaggaagtgtacatcaaaagtgagagcaacaaagaactgctgcttgggggtttacatgctccaacttcaaaagatcctcattgctagatgaaaatatctccaggacttgactccagaacaagtctatatttctcatgcaccacattcggaatttaaccccttcccagctgccatttccttgagaccagcctttttcccaaagggtctcaatgcaatcttttcctcccattcccctgctgtccccactccctcccagaggtcactggttccaggacccagctcatctatttgacattggtatgccttgctgtagtggtcgacgggtttggcagcagcagaattgttctgagcagaattgttctggtgtatgcctccctggtaacttcaacccagggaggttaaaaagcaaacgagcaagacagccagcacttgttccttcctcctgcttcttctttgttacagactttcctgagtaggagttgggtctcccgtctccagattgcccagtgagaattcacgcccattaatattaatagaataagcatttgtaagtcagatatttctgagcatcagcaaagcacaggattttcctgataaaaggctgttcttcttggcttaccctgggtttgagatctttcttggttggcacagaatggcttctgctgtctcttcatgggtgtctgttgcctgtcctggaaagggtataaatattgacacataagccttgcagttcaggcttttcttatggca

SEQ ID NO: 39384 - DNA, 1415 bp, Bovine  19866881030167
ctttcccctaaacacatccttcttgctctgcaggtcttggttccaatattgtctcccacagagagcttccctgaccccctaactaacattgttctccacataccctgaccccacttactttgatcataattccctaattgatttaatctgacattaatttacttcttaaatcgtctttctcacccaagagaataagctcaaagagagtgggaacacctctgtctagtttgtaacatttctgcagcacccagaacatttctttgcccattgaaggagttcagtaaatatgtatggactgaaggaagataggctgccttatcagcgagcatccaatatttctccctgccacctgtttctcaccttgcacctgtcttcatgctatcttttcaaacagagcccacaggcagaatttatactcttctgagaataaggatacatgaggttaccatcctgcaccccattcctctctagcaagggcctcccctctgccaggtgaacagacagaaagtgcaggtgacttcaggacctccagatatgccttaggaaaaaaagggtgtttgcaggggcctccttagctgacaggatagcttggcctagcaggaagtaggtgcatcacagaatgagggtggacgaagtctgtgcgtttcaacatggacttggtggcatgtcattgtgtgcaaatctagcaccgatttgtctcagtccacgatcgggtccacagaggccccagagcctctgtttccagctgacaagggcccctccttgctctcaggcgcagcagagactgagtgccagcgtggcaggtgcatgccgggaatctgatcagcattcagcttaggcagcatcggggcctcattagttttaatgaattagcactttggaaaaggcggggatgatgttacagctagtgagtgcggatcagctgccttcgtttatgccccagtgaagagccatcttcttccttcattttcctttctcctcccaggtgtggaagcctgaaacttctctaaatgctggaatgaaagacctctgcattttctatcctaacccattctccaagctgtttatagaccaaaatcacggcaatttttgagtcagtgcaagatggaatcatcccagctggaaattctgacgtctggtgtgggacccagaggtgctggtgatcccactatcctgagcagccctgtctgtccccctacggccccagatcctgcccctgaagccagacaactgctccttgggtgggagtgcctggatccccgccctcaccagtgatgcggacaaaaaaattctttgggacagagttatctgaagtggaggaaatcaagaattggtgaaagtgaaggattttttttttttaaatctgtaaactcacattcttttcaacataagtggtgccactgcaggtgggaagt

SEQ ID NO: 39385 - DNA, 963 bp, Bovine  19866881037798
atatctttcttattatatcccagctgtgtactgggctgcccattcatagtatctgtcacccatagagcttgagtcaaggggtgggggcatgagacccaggcagcatcaggtgacagcctcctttggaattcatatacatggggaagctctctttctcctctagggttcccaagtcagcatgatgaatgactaaagttttctgaagacatatagaccaagggagaagcctgtctatagtagaaaaggaggaagcaatgtgtagagcaaagctgagtctcaagaaggaaagaaatacgatgattgaatttctgggtccaacccacctggagacacattccaccttcttcttcccagctatgtaaatcagccaagtgcccttcttccttcattgatcttgagttggcaaatctcattaaatttatggcaagtaggtgatatttaatagccctgtccttagattctggaaaggattctcatttgataggtaaacacatatctacttttgaaaaatcaatatggcacggccaaattttgaacttttctttcaatatcaggtatagattttggctatgataagcaatgaaactaagatgtaattgctcatgtttgctctcctttatagccaaagttgtttgatggacagcatctgaataaagcagtctttctgggcatgttttctcatcacccttagatttcactattgaacttcctgtggggggtggtggttgctctcattttcccaccagcctggaggaatctgtccatcacagttaaccagacattgaagtgaggtgggtacaatctctctatgcatgccaatccagttgcttctcaacaatgggttcatccatccattcaattcaatcatccattatacaattgtcttttagtacagacccagagacagtgaaaggtgttggggatgcaagtcaaacacatgctcatccccactaggcttataac

SEQ ID NO: 39386 - DNA, 1170 bp, Bovine  19866881058958
ccaggagaggtttacagcattatgcagaatgcataatgggaagccgtctccaggttgaaacttaaaaagaaagttatgcttcttgtcaaagaaagtttaggtatttccttcctctgggaacacttatgaagaccaaggggaatacagatgcataaacagtgactacaatggagaagaaaagtcgttcctaggattagcaaataaactcggcacccagcattttataaatcatttcgtagagaaaccaaatcttccaggtataccaactggtccttaaaggcccttctttgaaaatggcttacacaaagatgagaactttctctaataagaagcaggatccctgcagagtcagacattgctgctcagacaggatgggatatatggaagagaatgtagagagcatgaaataagaagcatttagatgggggcagacagaccctgttccattattcacacaaatgttttgaggaggaatcggagatggtagtgtgcatacatctatcataagcaatttggtttagaggtttaacaattcctttcatgattttaatgaaatcatttgttaaagaacgcttcaggtattatcatatgcttaattcaggtgaatcctattaaagtatcaaaaccaggtaaacagtagtgtgtactccacccaccctgacaaaactggttgaataaaatttcattttaaggaggtgggctgcatgttaggttctgctggactaggcagagagcccataaaggctagccctgattcttggaaatatttatctgaagcctataaatcttaaaaatctgttgtgctaaacttcatagacacctcagctgcctatgtttctttgcatcattaatttccactctctactcactgataagagagaaggctccagaaagatgaattttataataactatatataaagatataagtatacacataaatgttgttgctgtttagtctctcagtcgtgtccaactctttgagacccccataaactacagtacgccaggcctccctgtccatcatcaactcccagagcttgctcaaactcatgtccattgggtcagtgatgccatacaaccatcttttcttctgtcatccccctcccttcctgcccttgatctttcccagcatcagggtcttttcaaatgagtcacatcaggggccaaa

SEQ ID NO: 39387 - DNA, 899 bp, Bovine  19866881151324
cttctctatattaattcaacgtataagaaaaatgtgtgatgactctagatagtaaggccgattacagtgtcagggaaatctactagtttacttatggatcttcaaaggctgccaaagcacaaatcaccgtgctggcaaatagtgatccaatttactgtttaaatcaggaatgagtgccatagtctaatccacagcggagcagtttagaacccattgagtactaacttagcataatctccagtacccaactgatgattccaattgataagtcaattggaataaaaagcatctgaaggagaaaagcattgtaaaggaggcaattgataaggcttcccaaccttcttaaaaaggaggcagtcttgagttgggccaaacacgtagactgtttttctctgtagtgacgaatatggaggagagagtactttaatctctcatattagaccagtatcacaaaggggctaggtggatgaggccagctgatgagttgcaaaggaagtcaatggttatgcaagcctctattttctcaaattaatttttattggaatatagttgctttacaatgtgtgttagtttttgcattgtagcaaagtgaatgtgtatatatacatatatctcctcttttttggatttccttcccatttgggtcaccacagagcactgagtagagttccctgagctacacagtggattctcatcagttatctattttatccacagtatgtatatgtcaatctcaattcatcccactcctccatttctcctcttggtgcccatacattgttctcaatagccaagatatggaatcaacctagatctccctcaatagaggaatagataaagatgtgatatgtatatacaatggaatatctcagccataaaaaggaatgtaattggatcat

SEQ ID NO: 39388 - DNA, 875 bp, Bovine  19866881265787
tttatgaagacaatgttctgttgcattctaacctccctgtgaaactgattttagatagaatatttacccacccccacacccccgtgccatgtagctttttgagagcttttcttttagccttgatcgtctaagatttcaaaacttgtgtgaattagcattgtttttgacaactttactagacacaagttgtgactttttgatctagaaacttctatcctttattttgggaagttctaaaatattattttttaaaaatagctttatcttctctgcttttctgttctctctttttgaatattttgttgttgaacttcctggactgatcttacctctcctgaaattttttctttgtctcttggttctatcagttcagttcagttcagttgctcagtcatgttgactctttgcaaccccatggactgcagcacaccaggcctccctgtccatcaccaactcctggagcttattcaaactcatgtctattgtgtcggtgatgccatccaaccatctcatcctctgtcatccccttctcctcctgcccacaatctttctcagcatcagggccttttcaaatgagtcaggtgaccaaagtattggagtttcagcttcaaaatcagtccttccaatgaatattcaagactgatttcctttaggatggactggttggatctccttgcagtccaagggactctcaagagtcttctccaacaccacagctcaaaagcatcaattcttcggcactcagcttctatatttttggacaaatcctcaactttatctttcaatctttccattgatactctcttacttcagttactatattaactgaaaaattttagacctttttatttttctccattcctttttatagcaac

SEQ ID NO: 39389 - DNA, 1078 bp, Bovine  19866881359660
ccactcctatgggatgtgactcatcctaccagacccctgttctccattcacgtcctccatgaatccttctctgctccactcccacgaggagggcaaatcacaggtcagtttgtttgtagaaagtgtccatgaggggaaattcattctagagcacatctttttgctggttccggtttccgggagacccctcatctgggtaccccagccccttaccacggggatcagttgcccgtgtctctagtgaagagtagcgctggctcaggaggggtccctcatcagagtgctgaggattcttggggaccccgggcaccgtttgttctgggtcagaggctcgccgaaaggtcctggacccagccagccatctgcccatcctttagctgtgtcagggtctatttctacccggttcagtgtttcttcgccacgtctcagtatgactgagtttccattgtgcccatgtgctcatcttgctctccctctgctttatttttagtctgccccttctcccagatggattctaattctccagccctgagcaaatgcttagcaacaaagcccaggagcccagagccattttccaactctccaagcagcacctctttcaatggagaactaccttttcagtgctttgttccataaggaacaaacagagggggttactcctagttcttcaacactggctggtagctttcccccctcccactttcctcttttctgtctctctgctttttagggtaccgagatgactccggcacagaaaattgcctctttgggggcaacgaagatgttcagctcattttttcctatgtactggcttgcatcagatcaatagagattctttctacccctcgcagatatagaaagatttatatagcccacatggcatgcttataatatacacatgaggcctgataaattatacactatttattatgctacgaaaatgataccctttgcttaattaaagtagccatatgctgcagtgcaaatcattctcattcattaaaatcccaaaatatgttttttttttaaaaaaggacagccagcagcagttggaagaacacaaccagatcacacaatc

SEQ ID NO: 39390 - DNA, 1466 bp, Bovine  19866881587527
tggtgggtatccgtcttgccagctaagggctgagcccagcccccagtccagaagagccggccttgaatgcctgaggcttccgttactggagtccggtctgaagtccttgccagtgaacttccaatgagcacggtggttggtgtgtgggcctggtccttccacccaactgattaaccagggaggatcccgcctgtcccttagtcctgccttggcatcgggactataatcaaccaagaatgtcgtggagggtgggtagcctagaggtggaggcccaatctgacatcttacgcagtctctccctcaaaatttgcaaagcctgaagcaaaggtacagagcgccctaccaagtgcctttatttttacactgctgactccaccccacaccactaggcatctcctgtacttatgcgtgggttccctgccgacagttcaagctctgtctgtgtctacctccatccccatcagtaaccattctttgaccaatcttcaagcctagaggtgcacacacccgcggtgaagtccacccttgggaggatggaccgccccagagaagaggccattataggtagctgaaaggcagtttcaggtctgtttggtctggggttccaaataccttgaatgttgtccagaaggggatgctggtatagagtaagcactattctccgcccatagcacccatgggagagcagatgttcttctggcttcttccaggggtatggataagaacagctatcattgacagaaagcttgctatgtagaaggcacagttctaagcgtgcttcttatatccacttacttgatggtcaaacaaccttgaaagtgaaaggcgctcagttgtgtctgactctttgcgaccccatggactttacacagtccatggaattctccaggccagagtcctggagtgggtagcctttcccttctccaggggatcttcccaacccaggaagtgaacccaggtctcctgcattgcaggcagattctttaccagctgagccacgagggaagctcaaatgaataaccctgagttatcatttcctattccacagatgaggagatgggaattgagacattaagtaacttgcccaggagcacacagcaagtaagtgcggcagcaaggttctaaccagggcagcatgactcccgggtctctgttataaccatctggtgacacagtctcagcagctgaagtggcagcagggctccctgcccacatcacacacaaggccgggctcagtggaggctcagaaaccactctcctctcatttcccttcctgtccgtagctctgagcataacaccccagtctcagccttgtctgccggggagcctcggcaggcaattcacagaagtgtggaacagaggctgtctgggggagggagtgtcaggaggcctcccccatctcagacagaggagggacgtgatcacagctaattcctgctctttggtgagtacctgctatgtgccag

SEQ ID NO: 39391 - DNA, 1185 bp, Bovine  19866881804036
acaccgaatcagagccagaggcaaagcaagaaggaaaagagtctggatgagagaggtgaaagagaaggttccagcacaagtcattttcttctctttcaggagtttacatcagttcagttcagtcgctcagtcgtgtccgactctttgcgaccccatgaatccagcggcgccaggcccccctgtccatcaccaactcccagagttcattcaaactcatgtccatcgagtcggtgatgccatccaagccatctcatcctctgtcatccccttttcctcctgcccccaagtttacatcaagtaaagtaaattacattcaagtcatctctgaaacttttcacctttgtttggtttaatattctccagggaaaaccaagttgaccatgaacaacagcaaacttaagcactcaatctattttaatccttgagcaacatatttctgaaataatctctagaaggcgtttcagattttcaggaggaagaattgtatcttcagtgaattactatttattgaggctttaataaatgtttattttatttatgtttttgctggctggctgctttttgcagtccattaaagtgaagattatttttggaagaggaaaagtacagagtctagttttcagattgggtagaaacccaagaaaaaacttccacatgatcaaggttttaatctcacctgctgaggtggtttttgctacttaatgatacattttggtaatggatgtgacaccaaaggtcagccacaaatagagctcagagccaagggaatgaaaatcactgatcagactcccttgctgtattaggtagcgggaagtttccaatcatcattggatttgtgacacagagaatcaggcagtgattctagaacctgcttcatggggaggaaagctgggggaggctcagtctgtgttgtgtttgcttgtttttctctgtccagtcatgtgaagaaagttggctggcagtttttttctttattattgttgtccatgacacaattgccacattatactggagccttttgaaaagccggtgtacagctcaattgcccaattcccattgtgcttgaatggaacgtgggataggctttgcaagcacaggattctctccagtggcatgggagaatgtgtcttcagaaatttcagagaatatgccaaaatctgcccaggcaacagagaattacccagg

SEQ ID NO: 39392 - DNA, 1619 bp, Bovine  19866880705866
ataattcggataggcttttaaaaaatgacttatatgtcagtattcacatttcaacctcaaattcctgttcttaggactgcaagatcaaatattttgctgtgagataatgatgattatcaacaaatcatgaaaatgtttctgaggcatgcatgttttcttttatttatcccaatatgagttcttataggaaaacaccaaaagtatggagtctcacttaagtgcaaatagatttttttaaccatcttcagagctacaaaaatgattcactgattcctatttaatagatctgacatgatagtatatagtgtagaaagaatgaccttcaagttctctcagcaacgggattcagtgtacttccctaggcaagtactggaagctttcctttagatacatgaatgtgtgtgtgctagtctcttgggtgtgtcccactctttgcaaccccaaggaccatagccctccaggttcctctgtctatgggattctccaggcaagaatactggagtgggtagcccttcccttcttcaggggatcttcccaactcagggcttgaatccaggtctcccgcattacaggcagattctttaccatctgagccaccagggaagcccaagataagtgtataaacagaaataatctcattacccatgaaattttgtcctgggaaggcaagaaaaaaagttttgcaatgtcagccgagtggtggatactgtgtttctttcttttttaaaaatactaaggcatatttagtattcaggttctagatttttatgaaaaagtgagaaagtgacaaatgttagtcacttagtcatctccaagtctttgcaactccatcaattgtagcctaccagactcctctgtctgtgggattctccaggcaagaatcctggagtaggttgcctttcccttctccaggggatctttatgagtcagggattgaacctgcatctcctgcattgacaggtggatactttatcgtctaagccaccatcaagggaagcccgtagattcttttaggaattatcaatttttttatgattgttaaatacatatacttgttggggattttgatcagaattataaaaatatgtaaaaatggacaaggtttttgcccattagctaagcaaaccacttaatcaatcattatttgtttttatatattcttcctttttctcataaactttataatatgaagtatttatttttagacttaatatgtcccattccttaagggcatagattctacagacacaaaagagatggactgtgaagtagcttcttttcgtgacttagattgtatttcacagactgccctgctctgtggtattaaatgttttcagaaatggtggcaagctttcatgagtttagccagtctccctctttggaagatacctctcccagctctagctctcaatcctgttatcctagatattgtaattggattagccccagttcaccagtgagaatgaggttcaggcatggcatgaaaattgcctgaaatgtctttaaaagtagctatctacataatactctattactctcctgtgggtttcccatgaggcaatagaatgggattcagtttccactaatgcactcaaataggttctagtggtgttagggat

SEQ ID NO: 39393 - DNA, 1410 bp, Bovine  19866880820239
tagaaataaggcaaaatgctgattttgttttgattcttttagtaattaatttttttaaaattgtcttagagtacctgtttagaggatataaaaataactatcctcagtctaactgccttaattatctaaaaagatccatgtccttgatatacttacaaaaattaattaacttatgcaagagagagtatagccagcaaacttatttttatgtatcataaagtcagaccattaatactgggaagtcctaaagggaaagaaaataaaatgaaaactaggaagccctgtggattgaaattccttattgaagaccattacttaataccacgataaaagtagttaacatgagtgcaatgcttgaaatatgctaagtactgtctaaagcctttgtaagtagcaacatattcaatcttcacagcaaccctttgagggacaagtattattgttcctgttttacagagggcagatattaagtaacttgtccaaattcacacacaaatcatgtggagacagaaactgaacccagacgatttatctgcggattcagtgcccttagtgactatgccatagcacacctcaagctgtagcaaagtgcttctttccaccctctccaaaagggaaaccagagtactgcagaatcagcctcggtgtgcaggttggtcagtgggccttaatcagtgtcccaggtctagcccaggaccttggactttgaccttgaaacaacatggaaggacctagaggacgttatgctgaatgaagtaagccagacacatgaagacaagcaccgcgtgatctagctcgacatggaatctaaagcagccaagcccagagaagcagagcaccgaccagggacctggaggtggggaaaagggaagacacgggcctaagggtcttgtaatctttccgttacaacatcagttctggatctaatatagacattagtgactggagttagcaagactgtactgtatacctgaaatttgctaaggtggttcatcctaagtgttcccaccacaaaataaagagaaacagacagaactatgtaaggcaagggtttattaaataattgtggtgatcatgtcaaaatacatatatatttcaaacattatgtcctatacttcaaatatataaagcttttatttgtcaaggatacttcaaggaagtcagaaaaaaaaataaaataaaatggggacctcagaagtcatcaacagcctgcctcttgcacactcaggaaggataaattatgtttacaattctttctgtctgtaatctcctttcttgcaaaggactcccagatccttcacccctgtgataaaataacagaaataattcatgtagaatttacatgccatcaataattacttaattggtttttttcctactgaaactttaaactgcctcttgtttaaagga

SEQ ID NO: 39394 - DNA, 1889 bp, Bovine  19866880844143
aacttcttactatctagccgtttttcaaactgaatttaaaggattacaaatcctgaaaatacctgtactaccacatatcttggtagtaaggtcttagctggagagtcccacccaaagtctgtgacagtatatttgatatacaatattgcaaaggcacgcaggatcgatggcatgcagtcagttaagtgttgtcatgtgtatcaaagtcaatccactttttatagagatcagtaatgcacttccctttaaggaactgaaaaaataaagtgcatcagtcattagtatgacattgagaagttacatacacataaaccaacacatttcaacctgtaacttcctttagcaccatcattctatacccaagcttgcattttggcataataaagttaagtgtaaggtggctataaaatacagcatctatgaaaaaaagccatgttatggctgccgtgggaccatcactagcgatttgcttttgcaaaaataaagaaattcaaaattagtgtttggctcaactagaaagtgtgatggcctcagataattgctgcctataaataactctacctcatcgggatgtctctatttacataggatatatttaggttctgcacttagtaatacctctcatataatcaagtgttggtcatctttgtaaggaggggaaatattaatcaaatgctctttgatgacaagacatagcagtggggccattcattttccagaagctatttgaggagcagactcatcaatttgcatagcacttgacaactccagatttttctagcttttgcagatggtttgaaaggtacaccaaaaagactgagctgtaataatgtgaaattaattatgaaagtaaaggtatgggtccacttgttatcatagggcttattttattttcttaaatttctcacaaatctgtttttggaatggtttattttgaatgaaaaaaaaatgaacaactgaagttttcagagaattaattgttattattaataattccagcatctaaaatctctgtactactctgcacattccatattaaggaatgataaggccacaaaatgtaagggttctctgtggatgataaagttacaatgagaagatcataaaaaataaggattcttaattgttagaatatatatccttcacttttcattcattgccttatgtctttaataactaaacagaaactagatggaaggttgactattaacattttcatgttgcaacttttatttatatgtatttctttatttaaatatttatttatatgcatttctttatgatcttggtaaaggaaaagcaggaaatgccattttcagatctgactcagctattgtactgttatgtgcccctggagaaataacttagcttctgtggacttctgtttactcaatcctgaagtatagtgctcctcttgaggagattaagagtgtctagcatgaagaagtgagaaaaatggatgtctttccaaaagtagatgtgtttttttaaaaaaaaggaaagaaaaaaaaatagaacaggctctttagtcagcattaccttggaggagcaattaggaaaatgatatccacaggagatactcttcagagacagaggtcgttgttttctggctctgtctgtgtgggaacaatgcctggagaattaagtaggtgattagatgcatgcagtatttgcagcaggactaagaactgagaaagagatttaatgtgaatttaagaaagtttgataaattgacgttttgtggaaagcttttcacttgaagtgaaagagtggccatttccctcttgctcagtcactaagtcgtgtacagctctatgatcccatggacttcagcacgccaggctcctctgtccttcactgtctcccagagttgctcaaattcatgtcca

SEQ ID NO: 39395 - DNA, 1496 bp, Bovine  19866880935835
ctctaggagacagtgtaggacagggaagcctgacatgctgcagtccacgtggtcgcagagagtcgaacctggcttagcgaatgaacaacaatgtggtttcttaggtaacttataatatcgctattgggaacagaacaaactgacatggaaagacccagcatgccgtatcttgcttttgctaagtggaaattttcccaacatcatttccaaagtcacttgttcaatccaggtgggagcacatcacgccctccccacccgggcacttacctctgcagaatggggctgggaagtcccaggaggccccgttcccagggctgacgatgcaggtcaggatggcgtggccctccaagacgtagccagagagacagctatatcggatcttgtctcctatgttgaatcgtgtcccgtggaggactcccttcaggatttccccaggatttccacatgtgtggctgggtaaaactattgggaagaaaaacaaaagagaaagaaacataagttaaaggaagattttctactgatatcagtctatatcacaaaacatagacctcatttgaattacttaagttatcaaatctagctatcttaattttgcctaaaatgcaagtagcgaaatggattcatgttgtataaaatctacaaattttgttctcctgtaaaaatatatgtgtatgcatgcacactcagttgtatctaattctgtgcaacccgatggactatagtccatcagatgcctctgtccatgggattctccaggcaagaatactggagtgggttgtcatttccttctatatctatatatatatagatagatagatatagatatatacacacacacatacacacacacacatatatatgatatataattaagtggattttgttaagaggaaaaaatacagttctgcttagattcaattttctatatgatgcctagattattttcctaataatgagattctacaatcctatagaattagcaattagataatatagcagaatatagatagctgaaaaaatcgttaacagaagcacatgaatggatatgcatgctatatttttccttattccccgagaccagcactgcctgacacacaccagtaataaatgttcaatcagtgtttgatggataaataactgaattaaagaataaattaaaaatctcatttgctaatctatcagactttcataaacattgtactgctattatattcccggccatctgtaaggctctatgcatttagagcaactgactgacaacaaagtttcaggtgtaggctctgacaaagcaggcactgtcttcatctgtgtttcaacaaggcagccctggttccggtcttgcctggccttctcactgttcccactgacagcactctctgtttaattcagctgctttccaaccacatggacatgatgctgtttcatactcatagaacgaaattttgaacttgactgaatagacaaagtggagaattgttggctattgttgccatatt

SEQ ID NO: 39396 - DNA, 709 bp, Bovine  19866881093055
taaatgagatgctggaagtactcagtatcaataatggccattattattgaaatcattattgctgacaagctagaatggaacaaaggtggaaaccaaaggaaagcagttcatcctctgaaactctcagaggctaaaatcgtagaacatagtacattttggttttatttttaagattggtattaagtgataaacatttcagttttaattgacagcattttcttctcaatatcctcaatattatacaaattaatagttctctctttccccataattgagcataatgagtgtttccagtatttgcttctacacataatgctataattagtgtctctgtatatatagcattgcctttgtttcttctgtttaattatttcctaaggaaagaattcttgggatgttatttatgctttgcaaacttgctgagcaaatttccatgccacacatatttttactacaattactcttggatttgatgttcgcatttccttttaatttgctgaggatttaatagcatgaaaatgatgccccaaagttggttttttttttttttttatttccagtagactatgcctgctgtctatttgtgtttgttcatttaagaaacatttatgcaggacagacaagatgtcagatatatttaacagtcaggtcagtagactctttctgtcaagggcaataaagtaaatgtttcatgtatttcaagccatat

SEQ ID NO: 39397 - DNA, 1355 bp, Bovine  19866881146719
cggacacgactgaagtgacttagcagcagtagcagttgatacacagcactgggcagctgtttctgttggtcttggtcaatggagtccatgtccagactgaatcccatcttgggaagtcctcagggactgcttcctctaaggcgtgcccaatgagctgatgaaacatctccccccacattgctagcctccctcagataacataacctgcccaaaccttggaacagattctggggaaactgtggtcaccattttttaaaatatcttcacgatgataaaagcacagatagatcatcagacactgtctctcaggatggctgtggctggtgggtggtgtaacaggttggacttctccactggctctccattgactctgtcctgtcagaagcaatatggcagacatgtcctgagcttttcttgggtaggaacaaagtctgtccttatgaggagactgaatctgtatcactggatataatattacattttagacagatgtctaaggaatggtgtgcgaaattcattccatgtttagattctgattcccataggcagtagctaatcactccctctccccaatggtgaaatgtgcatagggggattacaatttgacattggtatattcagtaattatcataccaatattattgtgttaattgttagctattaattagagaatgatcctatttaaagaaaacacgcctccaattacacatttattttgacataacattttaaactaaagccatggttattcagtaatcaggtagtataactgcttctttaaagaacacagatcctatacacatcactattaatattttactttcttcatatgttataaattaggctgagaagcaagtcagctgctactgctaagtcacttcagtcgtgtccaactctgtgtgaccccatagacagaagcccactaggctcccccatccctgggattctccaggcaagaacactagagtgggttgccatttccttctccaatacatgaaagtgaaaagtgaaagggaagtccttcagtcgtgtccaactcttagcaaccccatggactgcagcctaccaggctcctctgtccataggattttccaggcaagagtactggagtggggtgccactgtcttctccaaagcaagtcagcagtgcctctgtaatcagcaaagaagagctctgctctaccaacagtatttctgtgaactttataacatttgtcacaggacattttattcatgtaactatagtgatctgtgaccatttggacatatttttgcatacacctctatttcatatataaatgtagaacaaaataaaatgcgagaaaatacttcaacagaataaattcactgaatgta

SEQ ID NO: 39398 - DNA, 1783 bp, Bovine  19866881318335
cttagagtcatataaatggtttataataaaaaaaatactgtattgtatcttaattttcatttaatccttaacactttatgagtaagtcctttattcctatagagatacagcaattttccaagttttgacctctagaggtagagaagagctgggattaggtgtggtccctctaaagagaattggccaactttttatgtcaaaggccagatagtagatatttgtggctttgcagtttgatctgtgcccaactattcagttcttctgatacaatgtgagggtgattgtcacctgacacggcttgataacattaataaataaaactttattaacaaagataggcggccactgtgtaggaccctgaccctacagtcagagttctttcctctccttgggaagtcagcctttcttttcctgtgtcagttttgcttcttaaataactgattttctcaatgcccagtcaaaaatgtaagtggactctgcagaaggctgacaatcgatggatggaaccgatgagacaacttgattagttacctgagtccaacaccaggtgactcaggagtgagcgtcagtgaattcagtcattgttgagttagcagtcactgcattgtctgttgtttgtacacagagcttgtttacaaggtttacctttgtgtgtttaagacacagcagtaatagtgtcagcagttcctgcagtgtgaagtcccagctttccaagattcctttgcgtgtgaattttgtactcagaaactcctgtgttgacaggcttcatgctttgatttcaaccccaaaggtcttcctagtgtaaacttcttagtgtaaaatgtaatatcaaccatttcaagtccctacttccatcttatccatgcccagagaaattaatagaaaatttattagagatggctgctgatacacaactttcatgttgctgggaaaattgtttttttgtttcagaaataattttcttagaacatgcattgtcacatacatttccttaaactttgatgttttgaatgtggcaagttaaccaatggaggcctgatggtaaatagcctgtatgtctctcatggtgccctccaaggaaaagcatgggatgtgtgtcctggtaccctgggaaggtggggacacttgatggtgcaaatcggcgccagtgagaacatccgactcagcacagctaaattgtaatacgggcactgctctgctcactgccatctgacagctgtttggttcctctgtgaagtgaattagtgctgtcattttactaatagaccaaaaataaaatcgctggcattgtttccagccgccagttctcacagaagccggtcgagatgaattgccctctgcttggtcacagccatgccagttacggaacaggccagcagaacatgaggcatgattcagaatgctaatggaggacagcggagtgcttctccaagggcgctgcctagggggcccgaaaacaaccccagacgtttgtgaactccagggtgtctgcctttgcaggtgagtctctagacacccacccctcaggcctgcagcactcatgtgtgatcatgcaccaaactgaactcagacacacctaaagctttttttatgtgtctggtcttgtgcaaactctaaacatgattttgtgagaaacaggagagatgcgtcctgccgaatggagcttcccaatgagaagggttgtgtgtcctgtactgggatcatgcgatgccctgtggagctatgtctgtgtgcttctttttgatcatcatcatcagcaatggcaacaacaacaaaacccctg

SEQ ID NO: 39399 - DNA, 2770 bp, Bovine  19866880344876
atgagtgtgttaaaatagccagcagcctaaattccttagcaatttaaggatgtttgtttcttgttgtgtgttacctgctccacaaaacacatgatgccaatgtaaaatatggcttgtatacaatttttaatgcacagttacaattttcaatgagccatgtacaagggatatactggatcatgtcatttgcataaaatgtcactcagattggcagttagttcacccttttgctgtccttgacacaacacacagaatgctgaatcccacactgtcattagtgatgacaatcagaataaaaatcagtcacccaatttaactaaaagaatgaaaaattgaatcacctctgatttgtcaaatcatttcacagagtagtgataccataaataaactatattaggcctacaaagggattaaaattctcaccataacatttatgagcaagccattatatttgaggaagaagagattaaatcaaaaggtttggatacttttaaaatatattagtacttgaaaaggattaaataacttgatgtatcatctctccagtcaatcttcattgttcatttgcattttaatacccactgtggacaagatgcttttcataaggggaatgactgaacagtttttaaaaattgagttctgtatgctaagggatgggtaatttaccaagtttataagagaggtggaatatgatggtgaaggatcttgaaacatatggggaatggttgaggaaaatgcttttatttagcctcaagaaaattcagcagaggacatcctagatgctttcatttattaaaactgtcatatggaagtagattaatatacaaaacaaaggcaaatagaagacacaaggaagccagtttctactcatcataggagactttgtaaatattagagctatgcatgactgtccactctgcataccattggaaatacccaaacataagttggggttgagaacactatagggaaaaattattgtataaaagaaaaaaatctaggtagatggctggccagtaatgtttccttcagtgctaaatttctctgttctggagcttaaaaagacacagacatgaaattacccaagaataattttaaaagaatatgacagaaattaacaaatgcaaaagagaaaaatccacactgagtgtgaagtcttgtcacgggttgggtttctccagaacgtgactataagactgaatttagtttgctgaatgcttatccagggtgaggacaatctctgtagacaggagaaataggaaataggattgagggaagagaaaagttaagcaaagatttaggaccagtgacagcctcagcctactctgaaagttgctctgaaattcgaatatcctttcagagttgtccctgagttggaccgagatgggttagttcttcatacagatttatcagtcattcatttggttgtggatccaaggcagagaggtaaccttgcacaaggtcacttgtgcagcttgaggtcaaggctgctgaaagagctaatggctgaaggctttcagccagcagcactcccaacaattggggccataagtcctgcactgaagagaggtctgggggacacattatagtgtccaccaggtccactctgtgcaaattgaatctatttattgataaacaatttgtgaacaacttccatggattctagcagacttgtcttcttaaatgaattttacagaggaggaaagttagtggaacaaacttcagatactgcagccggtctcagaggcacagctgaccctcattgtctccccaccagaggaccagcactcttcattctagatgccaggtcagtaacaatatcaattcaatcaacaatggtgagtaaaaatccgtattcttcggcacaagcacagacccctttgcactatgcgtctcttccatcagatcctgtgaaccagactctttaaggagtcagggaaaaggggctgttgggaccaagagcacgcaggtgtttctcattcaggactcctatgcctacccccagcccccattatatctcctgagatcctgcaagacacggcttcctctgggaagagtgagctggcggaggcagcagttaaggcttgattctgcagttgtcagagcttcccaggcacctagcacagcccagcccgtcctttccctgcccatccaacggggcccctgctcattccttgcacccaccctgagccacagagcgcatgtgaaggctccagtttgtcttcctgggaagctccacaccccacgccccaaccaggacctgggtctggtcctcaggtgccactttggctactcaaaagaggggaacatttcctgacagaggggcatgggcgaagaagccagcaccccatcacagggtgtgggcatcagggctgagtcaaaagaaagatcggggctctgaggctgttctggagaaggctccggcagcaggcagcctcctgggagaattcctgacacgttgcatctgctgggaggaaaaattgccctgaggatactgtaaccctgtgctgagctgttggactgctcctgcgtttgacctgctagagctaagcctgtaatgcaattgactggtatgctggggcttgcctagaaggtgatggactccccagccagtgctggtgtttgccgtgaccaggtcgcggatgtgcctgcctttgacctacactgggaggaagccttgtgcttctctctctgcgggggctcccaggacagctgctgtctcagcgagactctggcctttgggtcaggggagggtgttgtggggaaacca

SEQ ID NO: 39400 - DNA, 1805 bp, Bovine  19866880367230
tatgcatgtaggggttaagtgaatgactgaaataaagaagcaagaagagaaacaagttcaaataattataatgaattgatattatctaggaagttactaccaaaaatgtagtagcatcatcaacattatctaggagcatgttggaaattcaaactctcagaccctatcacagactgaatcagaatttgcctttaaataagacctctaaatgatctgacacagagtttgacaactggtctagggtatagctgaaaacaaagcaaagctaatttatgtagagcctagggttataactttcaattcttctttataaagctaacttgaataagattatgatatcaaggagtgggaaatagaactggagagggaaattttgtttattttggatataaaaaaactaatgcaatgatttgaccttagtgtggcatgtactggtacaaggtcagaggaagttatggtaaatgtctattgagggaatgcaagtcacataggaatgaatttacattgattcccattacggaatgtttgatctgaaatactttccctctgatgacagttagtgcttctcctttgttaagctggaaggaaatgaaactcactgatttgccaaagtccaggaatagcagtgatagatcaaaataaacattaaatgctagttcaaatatttgtgtgtgacagggattggaattgaaagcacacttggttgattagctagtgataaaaactcttaaatcctgagttttatcacacctaaaaaatgagaccagaatgaattgaaagtctaatatgacagctccctaaaatcttaccttcaaaacaatagtcaacattaaagatcaaaagttaaattgaaacttgaagttgcttctgcctacgtagctttgcacagtctgacaattttcttcctctgaattggccagggtaaaaaggtatttgcttacaattatggtttcttaatttcatatattctttcagttcacttcagttgctcagtcttgtctgactctctgcgaccccagggactgtggcacgccaggcttccctatccatcgccaactcccagagcctactcaaactcatgtccgtcgagttggtgatgccatccaaccatctcatcctctgtcgtccacttctcctcccatcttcaatctttccaagcatcagggtcttttcaaatgagtccattcttggcatcaggtggactaaatattggagtttcggcttcagcatccgtccttcccaatgaatatccaggactgatttcctttaggattgactggttggatctcctagcagtccaagggactctcaagagtcttctccaacatcatagttcaaaaacattagttcttcgaggctcaggtttcattatagtccaactctcacatccatacatgactactggaaaaatcatagctttgactagacagacctttgttggtaatgtctctgctttttaatatgctgtctgggttactcatgacttttcttcaaaggagcaagtgtcttttaatttcgtggctgcaatcaccatctgcagtgattttggagcccagaaaaataaagtctgccactgtttccactatttccccacctatttgccatgaagtgatgggactggatgccatgatcttagtttcctggtgctgagttttaagccaactttttcactttcctttttcactttcatcaagaggatctttagttcctcttcactttatgccataaaggtggtgtcatctgcatatctgagggtattgatatttctcccggcaatcttgatttcagcttgtgcttcatccagt

SEQ ID NO: 39401 - DNA, 877 bp, Bovine  19866880369361
ccttggacaacaagaagatcaaacccagtcaatcctaaaggaaatcagttctgaatattcattggaaggactgatgctgaagctgaggctccaatactttggctacctgtatgggaagaactgactccatttgaaaagaccctgatactgggaaagattgaaggcaggaggagaaggggacgacagaggatgagatggttggatggcatcactgactcaatgcacatgagtttgagcatgctccaggagttggtgatggacagggaagccaggcatgctgcagtccacggggtcactaagagtcagacatgactgagtctgagtgactgagctgactgactgactgacaggtatgaaaggtatctggagacagttttggcactaagaaggtgggacttgtatttccttgaaacccaaaatggttcagaaataatctgtgtaatgcttatatttttaaataagtttatttttgaaaatacattagaaaatgtgagtgttctcaaacatgaaaaatgagtattctccggttcacttctgtagttagtctccttgtttttgttccaaagaatatgcatgtagagacttgcaatggcttgctacagaggactgagtagtttgaatttttctcctggactcggaaatgatccagattatttggcagcctgacttcttccagcttgcgttgcatttgaattttaatatagtatcaatagacataactatctcctttgaatattttattcctttcctttacagagtagttattccaatcagaggataaaataacaacttaaaatgcagtctccaagtggaaatcaggccaaccaattgaaagtaaagtttaaaaagaaatcctacctcaagagtgtagtgtgta

SEQ ID NO: 39402 - DNA, 892 bp, Bovine  19866880465477
ttctaactgttgcttcctgacctgcatacagatttctcaagaggcaggtcaggtggtcttgtattcctgtctctttcagaattttccagtttattgtgatccacacagtcaaaggctttggcatagtcaataaagcagaaatagatgtttttctggaactctcttgctttttccatgatccagcgggtgttggcagtttgatctctggttcccctgcctattctaaaaccagcttgaacatctggaagttcacagttaccctggtgaatttttcaatgtccaggatgtgatcatcagttttacaatcttatacacatgaattttaattttcaacacaggtagagtcacagtaattagattagtcaaactgatgaataaatcagaatttgaacatattaatttaaaaagaaaagagacattttaaagacagtagcattcttatacaaacatttcttgaatgtcttcattacatcagcaggcaaatcaaaatctggcaggcttggtaagcacagaagcagaacaaacctgccatcatctctcacttttgcttcatcattaaattttcaatctaggctcttatatacttactcttccttcttcaatcatggtgaatccatgatggacttatttaaaaaatgcaaaagcgtactgtttttttttcctatgcaagattcttcaaatgcaggcagaaaacctaaaccctttacactgcctaaaagtctttgcatatctagacttcatttcaccctgagaaaatttaatctgagatacctaaattgaatatcagtagtttaacttataaaaacaccattattgaaattcctttcagaaaaatatttttattgtgactctgaaactgtctagctcatattcctacattccacatagaaaa

SEQ ID NO: 39403 - DNA, 1339 bp, Bovine  19866880501943
tcctgggtggaacttggggatgccagtttttagaggtgaactctgttctctgactctgtgtgttagtcagtcttacaatcaagattattctacccagtactaacacgttttctagttcttgggtgatcagatataaataataaaggttcaagtgatagccaatgtctgtttctgacatctaagtttacacctactttgccctgacagtgaaatttgcttgtatgaattaccataatttggaaatattcttaattgtgttgaaatttactttcactctaatgataaagaaatggtttcttaagcaaattaatagagaaaaaccattgtgaacagaatgcttaaactttataactaattcaaagatgaaattactttcaagaaaacttgaatgctttacaagcatcatttacatttatatgtaatacctatatgtaataggctaattacagttgtttttctttattcattgagcctatttcccaaagcattctcttaaactgtgctctcatattctatcatctagcttccctgataaaacgagtagtttttaaaaatatacaatactttaggattcttccctaaatctgcttccacccaatcaatgaggtttgccaaaagtgaattcaccagccaagaagcaacatcaccaaattaaaatgtctaaagcccaatgctgtaagcttcaacatgaaagaaatttcaagttttatagccttgtttgaaaagaacaaataagtactgagagaatactatttaagccagaggctaagagcttccacattggccatagcacagtgaggggagccatagccatgtaaagcaatcctttggaggaaccttatgcctttagcgataaaggagcaaacagaagaatgactttcttgaagggtctcgttgtctgactattggtatttccatttcttatttcatactgcaaacactaatgtatttttgtcttgataattactggtgctgaaaggcatctcttctgaatattgtgtggctgtgttcctccctcaaaatatgattctgtttcagtgagaaattttccttacttatctactttgtatgagattgtttgaagaaagaacttgaaaaaacatgtctttagtttttgtcctagtaattagtgtgatgcctttagtttttgtgttttaactctacaatgtaattatatatgacattactcattggtgtatagattcaccgaatgaatttttctactaaaaatggttattcatactaatctttctttgctcacatttttctatttattctacaaggaaaatagttgcaagccaaagacagatgggaaatagaagggcatctgggacaatca

SEQ ID NO: 39404 - DNA, 939 bp, Bovine  19866880695686
tggttgacacacatctttaattttcagaattatttgtatgtgttatctttgtctccgtgagcattttaatgaaaaaggtactgacatctttaaaatacaaactacaatttctgtttaaaactcttattagagctcctaaatacaataagaattctcacatgacctgaccttgcttattcattattcctatccaagtcaaaccaataccagcctcttaatttgcattgctgtgttgttcatttttgatctgtaccattgtgtcagtcattatgtaatggttctcatggctattaagttcacagaacagaacaaaagaatgacctcatggccatttcttatttttctcacactcttagttttgtccgataggcttcagaactatatgcccttgacatactttaataccaaggtaaattttaatgagcaattaatcatttttgctcagctctccatttgccctgcacattaattttatgtcaagaatttgtccatagtatataaaatctcatttttcttttctctttcattatttttggacttgatcaaaatctaaagttatacaatagcctgatagttaagataagcagtcctagaaaaaattttaaaacacaagctaaaaacttaattcaacagcttggcttgtctgacatcatgctgttagcaataaacttttccttctaagtgatttgtttttacttactaaattcaacaaatcagacagattgactagcattgaagtatagtagcaaaaaaaaaaaaaaaagcattctaggcagatataatttgaaatcatgcctctgtcatttcgttaaacctctattatctacaagcttcaccttcctcatgtatcatggaattgttatgaggtaaacttaattatgtgtgccaagttcctgacatagtattgcatcctcttccttcttttcaatacagagctag

SEQ ID NO: 39405 - DNA, 1680 bp, Bovine  19866880770888
tgtaacagccgttctatgttctcactgcttgtgcatcacactctctattaaagaattcatgaaactgcctgtggacatctctcaatcattagcctttacatgtctcaaggttgaaaccatgtcctccattccatcaactctaaacatttctaacccttgtttcaacgttggaaatattctcaaaacttctggtgtgttaagatcaacctgtccttattattttaaataaataggttcaatctctgccctacctgaaaaaggaaagtcagcatctccctggaaggacttttgtggtcagggtggagcatgtctgttttcttaggatctctttttctgatactctctttctgttgagtttgccatctcttttctatctttctcctccagttcaagcaacccaattgcagcactacaccctactgggccctgctctgaccactttattccccaaagcatactgtttcagaactatgtgcagtcacttcaccaaataattgggggaaagaatactatatggcatcaaatgttaacatttgaatattttataaaactaattcacagttcctggatcattcccactacttccatagaaattccaccaatcatcctttctagtgaggtccaacctcctgccttaacgttgtatgccctttctttcttgatcatttcctatcattctgctgtcacaattgtcaccaaggtattttatgaaacaaaaatctccatctagttattctaaaatcatcttccatatgattttattaccccaataacacatgttatgagtatctaattatcagacactgtgctaggctcaaggaatgccataataaataaaatgatacacatcacaatgacttgataaccttgtaaagtcctgttcatttttgataattatagtaactggcatatagtagaagtatagtaaaaggcagtataggaaataagaaatgggatcctcttttcatatggttaaaattaatatggattttatctggaatcatatgaaatataactgaaggcaaaatagtgtggttaataaacttcacaaatctcatcctaacatgtaattcactgattcttttattcaccaatcctcctagacaaaaatgcaacctcatgaatatacagtagcttcagaattagagatattttcagtagtgaattatacattaatacaatggaactacagaaaagaatatctttgagaagcattttaaacatcttattaaccaattaactgaaatcattttaaaaattattttttgagattaaaggcatagataaacctgcctcataagaagatcatgaaagatggccatataaagcttaatctgatatttatattatctaataatatgtaaatcattacttgaaagcctttatatttttgaaaaaaagaccttattgaaaatgaattgcatattaaataagctgaatgggtttaggaaatttaataatttcagatatggttatatctttgagaaacgacatgtaactttccattttgtatatttcatgagttttcattattactgtcatcatactaattggctttttagtagctggcactctttataataattcgggatttttactcaaaactgcaggtatgctttgtccttgctgtttttgatcaccgaaggaatatggcatcaagctttcctaactctcctttat

SEQ ID NO: 39406 - DNA, 1670 bp, Bovine  19866880782398
aggtcattctattgatgtaaccagtggctgccaggtggattaagatatttattaatttgcttttgacagatgaacaatcacaacagccaatgagaatattgtgggaaaacatatccttgctccagtgaatgggtccttgaaattgcttttcgaatttgttgttcaaatacattagttctgttctaaaaggctgatatgaaatatgttatcaaaaaagaaataatttcttaaccaccttcactcacaagtgcatagataataagatggtaggaagtgtagaggaaaccatgttttgtcctttgggattcttcatgagtcagtgcttttctagcagtgtaagttttaagaattaactttttatatgtattacactaacaacattaacccaaatttgaaaggaagaaaatcaaccaataaacctggtaagcccaacagaccaggcagtttacctgtttccttcacgctttggaactaggtgtatataatacattttaatgcaaagagtataatgtagactcatttttgtagtctgcctttacaaaatggctcataagcacacttggattagaattatgttaacaatttgaatatacatggagaaagacagataaaatagcaaaaatgtataggaaggtgtaataatgagtgattttccctcatttttttcaaatatgctctaataatgttacatttaattgtcaataactatatactaacagctaacatatgtttagtttatcatagcactagacaatatttttaatgttttacataaaatatcttgtttaattcttacatttttgaagatgcagaaagtgagtcacagagaaacaaagtaatttgatttgaggtcatatatctaagagcaattttccttaagtgggataaataatagaatgtattaagttaatcaattgcatgttaatagttgaattttaataaatcatgatatatacagattttcctttctgtggatattagatgatcttctactctaaattatgatgagataggcacctgttgtgtcaaggtctgcatattatttggtgagtggtttttctgcatgtcacagacaatactctccaaaattaattcacctgaagattggcagaacctgtatagggttaaacacaggtttaatccctgggtcgggaagattccctggagaagggaatggtgacccactccagtattcttgcctggagaatcccatgggcagaggagcccagtaagctacagtgcatgggagtgtagagagagtcaggcatgactgaagtgactgagcatgagcatgtatagggttaataataataatgaataccatttattgagtatttacactgttacagccactgaaacacaatggcataggaatttttactacctttatttaactgaggaaggatatgaagctcagagaatttaagtaactagctcaaggtcatacagctagttagtgatgcagccaagcagaggaaaatcttttaagaggttttttttttgggggggggaccatttttttaaagttttattgaatttgttacaatattggttctgctttatgttttctttttctttttttggccacaaggcatatgagattttagctccccaaccagggattgaacccatatcccttgcatggaaggtgaggtcttaaacacggaggc

SEQ ID NO: 39407 - DNA, 795 bp, Bovine  19866880820778
ttttcttgcctgggaaatcccatggacagaggagcctgctgggtactgtccatgggggtcacaaagagttggacatgactgagtgagccctgatgcatagactgtagataatatactatattattaatatatagcagaactatggataatgaatattttggaatttgtacataatagtgttttaaataaagtaaaaaaaaagtcagttcataattaaaacaattaccaaaagaaaatcaaaatattaaaaaattttagcttcatctctatatgagaagaatatgctaattttttcttacactcattaacttttaaatcctggatcaagaatttaaagcctgcctttaaaatttctcacaaagaagatttagagagttttagaagtgaacagacgttacttcttgtgatttattcacctcccaaactgaaatcttccaaacctttttgtatccctgagttaaagtttctgatgacttaatttttcaggaaaagtagggcaaagtttgatcacaggacgttttcagaaatcaaatgaggtcagagatcactgaacagattcataccatctgggaggccagagccaacagagacagttaaatcttgaaaatgcaatttaccagccgctttgaaagttctctgagggtcacttacagctttagggatttccgtattaattttatcccaagttaaatgaagttactattattttaaattttaaaatatgtgcttgttttggaggatacaaaatatgggaaaagagaaagatgaataatgataacgtttttgctccatgaa

SEQ ID NO: 39408 - DNA, 1135 bp, Bovine  19866880862776
gtggaaggcaccttaaagacctagtccactgcatgggaggttaggaggccctagattagaagccagtctcacattgtttttgaccatgttatactttcttcactatttatcctagattcgtttgatttatcattagttggaaaaaaacaaaagataatgtatttgggaatttatcatcttggctcaagatatgtgtgttcatttatgtcttttaaaattatttcctttgcaggtagttattggtggcagaaataaatatttaatcaatggagtaaatgcaaacaataccagagtatacgatctcttctgttctgttggccttaatgttaacaaccctcactttctcatcatgcaggtattttgtttgtggactttatatctttcataatagttttggcatctttttttaacttacaagagaaatacatctctttggatttttcattttttaatttgctgttaggctgatgtttgggcacctgttaataaatgtgggttagttatttgtacttacgtgttctggtatattgcatacatttgaattttgaagaatatctggaattaattttctttgacttatcttggagggccattgttctaaaaagtcaagagatgttcagtaattatgccaacatttatgtacatgcttacccattttagagttggagacttacacgtcattccctgtctcagaaataacagtcttggagttgtctttgtattatttatgtaacttatatcactagtaagaaagtagcaaaactctagaattataagctacccttgttctcaaatcttaaaaaagaaacatcttttcatgtaggtgggagaaataactgcccaaagattggtgtattaggatataacagctttagtacagataaacatgtatgcctttaggttattctttctgaatttattgttattacagtaagtttgtcattttattttcagggccgaattaccaaagtgatgaatatgaaacctccagaggtaagagcactctttaagcaccgtaaaaatactaattgtagatattgccttaatgttttaggtaatcaatttttaaacataatttttccattattaaaattttggggaacatttatttaagaatgattagggagaaaataat

SEQ ID NO: 39409 - DNA, 1028 bp, Bovine  19866880878088
ccagctgctcctcctgccatccctcctcttcttccccagcctctctgcacctttcttactgtattccaatcaccaacactagtgcccagttaggccctaattaaagatttgttgcctgcttgcctgagaaacagaaatagccatggagaacggacagttgtaaaattacaagaccctacgtcttgacctcccacttgttagtgtcttcggtggtctcatttgtgtcctgtcttctcgcagtctgcatggaggaggaacccacccatctgaaactgggtgtgtccattcagaacctgatgaaggtttaccgggatggcatgaaggtggctgtggatggcctggccttgaatttctacgaggggcagatcacctccttcctgggccacaatggagctggcaagaccaccaccatgtaagaagagggtgtggctggctgagaatcagccgcaggaagggtcttgcctatagtcagaaactcatacctaaggactgctgctgctactgctgctaagtcacttcagtcatgtccgactctgtgcgaccccatagacggcagcccaccaggcttccctgtccctgggattctccaggcaggaacactggagtgggttgccatttccttctccaatgcatgaaagtgaaaagtgaaagtgaagtcgctcagtcatgtccgactcttagcgaccccatggactgcagcccaccaggctcctctgtccatgggattttccaggcaagagtactggagtggggtgccattgccttctccatgcctaaggacattgtgttgcttacccaggcaagggcagagtgcataaggagttgatgagtataaaaatatcacctaatcacgagaatgttttccaaatgctggattttcctatcttcgggttaaaataggctggggaccttttgatgacctttcccatttggttctcaaaattctgcagtgttttagaacctgatgttgtgacagatctgagaaagggtttctttgggactggtttggtcaggattaggaggcaaga

SEQ ID NO: 39410 - DNA, 736 bp, Bovine  19866880890773
ttttggttttcctgtggattcctaaaaacgggcctgagcgttatagcaattttagctactatttctggttatcatataggagccctactgatgtgagcataaagtgaacctgaggtagacagtaccctcccttcacatctaaagctaaagcagcatggagttattgcccttccccagatgggtggacttggttaagccttagttggtcaggctctgctaaaatagtttcccttgaggagaagccttatgaagaaaaacagagagctcttgtcttatttcaaaatgattgctttttccctctccctgctggaagcacaaaaggatttttctcagatcttcacagtgagatgtgatagggcttctggaagcaaaactcaggaaagagtggaggcccccaagattggacccccttggatctagtccactctaagcctccaacaatttgtcagttacagcgtaataagtttctactgatacacgcttcagttttgggcttctgatgctgagctgcttctcacagtaagctgtgattatctgcctctgattgtctcttcagcttccagggctgcgttttacctacgagctcagttttctgatctaacaagagctgttgatttttagttcgttcagcttctttcttgttgtgaggaaggagtcatgacttccaagcttgtaacatgttggatcagaaaccaaaacttcaagtatcgcatctagaaatttctacccacaggaa

SEQ ID NO: 39411 - DNA, 1176 bp, Bovine  19866880942041
cattttatatttatataaatgtatattccttttatctgatgctcagtgaccacttctagtcagaaggaagactgcactgatactaattgttatctccctttcaaaggttagtaatgttgcagcctaatggcattaacaatgaaagttctgtgatcttacagcctgagggtatcagaagtggtgtatggtacaccagccttattaatatttttttaaaatttagagttaaaaaattccatgcaaaaaggttctagcatttgaaagcaaataggctcttatccattattaattcacataagaaaaacagctatgatggcaaaggccagatacttatatgaaggttataaatatgaatgaataattcatttttctattaattttgaatttatggcctaactgttgaactttattttttcttttcctaaaagggcatgtaccaagcaaagtactgcactgtcagcagtcaggacacaaagtaccacagtatgcaaaataagatttactagacacatatttacttatgtgtaacacaaaaactgtggaaatttctgaaagagacaggaataccagaccacttgacctgcctcatgagaaacctgtatgcaggtcaggaagcaacagttagaactggacatggaaaaacagactgattccaagtaggaaaaggagagagttggattgtgaagaaagctgagtgccgaagaactgatgcttttgaactgtggtgttgaagaagactcttgagagtcccttggactgcaaggagattcagccagtccattctaaaggagatcagtcctgggtgttctttggaaggactgatgctaaagctgaaactccaatacttaggccacctcatatgaagagttgactcattggaaaagactctgatgctgggagggattgggggcaggaggagaaggggacgacagaggatgagatggctggatggcatcactgactcaatggacgtgagtttgattgaactccgggagttggtgatggacagggaggcctggtgtgctgcaattcatgaggtcgtaaagagttggacatgactgagtgactgaactgaactgaactgaactgaagtaagtgaaaatcactcagttgtgtctgactctttgttatcccatcaactgtacagttcatggaattctccaggccagaatattg

SEQ ID NO: 39412 - DNA, 1328 bp, Bovine  19866880965020
ttataaatacgaaatagcaatcctctctcaagaattatattgctaatttttccctcctgtcatttgtatttttaagctaattatattattattatatatttgtgtgtttgtgtttgttagtcgctcactcatgtctgattctttgtgaccccatggactgtaggcccaccagggctcctctgtccatggaattctctaggcaagaatactggaatgggttgccattcccctctccaggggatcttccctgacccaggtatcgaactcagggtctgctgcattgaaggctgactcttcaccatctcagtcaccaggaaaccccattttatattattcaccatttattttggtattgaaaagttttcagatatttgtattcgaatgtttccatattcccaatttatttattcttttactttttctgagattagaaatccctcaaacaaaaataagatatatttttatccacactttattctattaaatttggttctcaggctttcctgtcagtgcaataatatctctggaacctctttgactgtatgatatgagaaagtgatctaaattgtgtttccaaaattttaatgaaatgtgccagcacatttcttacacaatctattttttcttcatactttaaaaggacatttctatgtcctcccagttgctaacagcaaagtttgaatttcattctaaattgtttcctgttacccagcatctttccaaaaactcccacccaatctgtaactaagtattcttgtttaaacttctcttgatctactcccatatcagttggcctaaatcatcatcatttctcatctgacagttgcaaaagcctcatcaattgtttcctgtcaatttcctgctattattcaaggagtttcccacagatccatcaaggtgatcttttaaaaatgtaagttaaatcatcttacctctcttcctcacttaaaactcttcaatgactttaaatttatcttggaatcaaaatctagattcagtaccaggatatacaaggaccacatgtgccatgtcttaatcctaacttccacagatatttttaaaaatttaacgatagaactgattcattcaacacatttccaatactttatcctcagaaattcaataaacacttttacatacatatattgtttaattcttacaaattcctatgagaaggatacttgcctcattttacagatatataaacaggttgagagataaaattcagttttgagtttatactgtataaggtccagctaactccaagggtaggcaagtaaggagagattaaaaacagttacccttttatttttttctgggctgtacca

SEQ ID NO: 39413 - DNA, 1938 bp, Bovine  19866881098949
agaacacaagagggaaattcactttcaagcaacaaaacacagatctcgcccaaacggacctggatctatgtcagaatcatttggatccatagcatcgtcttcagtaaaagggcgaagacagctctgcttgtccccaaagactcgtctgtttcgtcttgctggtaaggtgccatctggagacaaaaggaaggaactccacgttttatttgtaataaaaaaaaaattatctacatctttaaaagtctatacagtaaaagtaagaatgtcataaaacaatttgaagggaaaggcaaaaccctggtgagctaagagagcctacaagtggcacagcccagagggcatgcagtccctttggagagttacctgaggtctcggcatccactccactctcttcagccactttgagaaatatctgaaaaatgagaatgagaggattataataagcaccacagtatgagagcaactgtcatgattattacatgactgaacacactagcccctaaagacataacgtaaaagcttcatttattgataacactttgtcagagtcacttgggagagaagccatttatttataccagagaacatttccccagtggtgagagctatcaattcagaaagtcattttcaaattaaagttatgacatcaggacactgcataaggtggaatttgttctgaacctacagggaatgagccaagtggcttcaagtctttggcccgaaatctttgaacaagcaagcatgaaaataggctctccaagacaggatgatcaggagaagaggcgttccctgtcactagaaatgttatggcagggtttctaacaccagaaggcaacctgaactagacaggcgattcccaaactctgatctacagagatgctgcccaggaagcatgcaataaaagcacagacattaaggtcttacctccaggaattctgattcaaagaccctggagttgagccttgacatttttagaatattcgcagaagattctgctgcacaggctaacttggggactactgggacagacaacttttatatcccttccaaccctcaaggtttccctaaagagaggcactgcttacacagtaatagagtatgggctttggagctcaaaacccctgatctgaatccgctcagcatcccttcatgtcaattttctcatcttgttatgaggattaaatgagttacaatgactgaacacaacaaaacacacccaggttagcccaaggcataagtaggttttccataaatgttggacttttcctaggcatggccatgcctggtcataccaggatcaatcctcttatttctttcctaccatctcccactgaaatcttaaaggtctaactgggaccaacactgcccagatgccaatgacctaagggctcagtgcctacgtccatggtgatcctactcccagtggacatgcaggctgcctgtctggcgccaggactgcgggccctgctcagttctgacagtcggtcactgaacttacttcttccagagtagtctctgagatgccgtaactggagatgcctaggtctgagagccggtcgtcaatttcgtggaagagttccacaaaggctccctctctggcagcctcgtagggcagcacgtaggtcagctcatgcccaatgtcttccaccagccgggcctcagccacatgcttcctgatgaggttggagatcgcagagacatctgtagggaccacagcacagatatgatacggcttggccggctcagaggcccccttccttcaccctctgccagctcctcaaaagcccactgcctgcacaccacagctggcccagatactgaaatcattccacaggttcatctctggcccaagggttcctgggggcatggactgggtcttattcacctttgcatcaccaaagctgggcaccgtgcaggccctcagtttatggtgggtag

SEQ ID NO: 39414 - DNA, 942 bp, Bovine  19866881106286
aaaagatgaatcactataaatgctgcctaaacaagagacgaagcttcaaaatattggcaatctgaaaaaacatagagcttaacccatggacggaggaggctggtaggctgcagtccttggtgtcgctaagagtcggggacgactgaacgacatcattttcacttttcactttcatgtattggagaaggaaatggcaccccactccagtattcttgcctggagaatcccagggatgggggagcctggtgggctgctgtctatggggtcgcacagagtcggacacgactgaagtgacttagcagcagtagtagcaaccaaggggtggaaaacataccatgtatatgtgctatgtccttttaatcacaaatacattaagttgttaattcatcacacattatggtgtacatattctgtgcccaggattgtgtttggcactagagtaactcagtctaatagggaaaggtggtaagtgaactaactatattataagaatgatgaaagaagtaaactcccaggctaggtagagttactatagaaacacagaaaagactcaagaactgggaaaggcttcttgaaagagatattgcttgggaagcctgaaattcaggattttaaggatgattcagcaggaaaatccttggaaaagaatcaagagacctacattcctatatgaactttgtcattaatgaaacttgtgacttgaaaagccatgggaaatatgcatgaagggaagatacaggaaaagaaaggatgccataaacttaaagaatgcttgacacagcttggtggaaaagactgcaggccttgaggagagtggctacagccctatgaccagctatgcctgcaaattgctttatcctgggtttcctggacttgagaaaatgcagtgctggcaacttcagcatttttccttgcatgtcctctattttctataggcttttt

SEQ ID NO: 39415 - DNA, 1408 bp, Bovine  19866881120777
ccattcagttaagtccttcctttctatggggtgcatgagtgaggggtagaggacagaatattttctcctaatggtttcaagaggataatcatttctatttcatagtcagatgcagggatcatggagtgaggaagaaggctggttttcctataatcaggaattgaaggaaaatacttttaatattaaatattcaaaatgtctcaataagagaaaataccttctcgaaatctacggaactatacaccagtgagttggcagccatccagactgagctggaaattgcctactgccactgatggagatttaaaattttacaccctagtgttatgccacaatccttcctagacacacaggatgggctcccccaccactcctgctctcctgtgactctgaggcattgttgctcagctacttcatgcccaagtgcttcatacattcctttcagagtatcaaggaaagcagattcttggagactgtgttccactctgtggccaggctgggaaaagaagcacaactgttggtgatcacagtgttaaagtgttgcaggaagagactcttatctctgaggcaaagaagatgaaggcataacttggaaaaagaagtggcctcaagctcaaaactgcaaagtctacaaggccatctgatgctccttcttgagagcctgaagctaggttatactcatgcctcccctaggtgagaaagcacatatttccaaatgctagaagtgagttggaattcttgaggttccctctgacctatattttatgataattctttccagaatcaatccattaatcacatttctacatttttatcaaatatattactgcaagagtgcactgttatgtaccttgtttttcatttaacaatattatataggaatctctctcattcttttaaacaatagaatgccactttatagaaaacctattcctctattgatcgtacttagcttgtatttaatttttgtttttattcactcagtcagcaaatttttattgatttgctattaagtgcctaattcctgctaggtactctggctaataacaaacaaaacaaataaaagtttcagcacttcaagaactgagattcaagtcagggcaacagaaaaataaagtgaatcaataactaatgacataattacaaattgtgttaaatgtcataaagttaacaaagagggaaagagatagagaataatagatggacccatgttaaataaggtactcacaagagacttctgtgaagaagtaatatttgagatccaaaggacatggaagaatccatttgaaaagtagagcaaagagcctttcaagcaatgtggtagcatgtgcaaatgacctgtggcaggagtttgacatgtttaaaagaacaatgtcagtggtctaggggatgctgagagaggcagaga

SEQ ID NO: 39416 - DNA, 1274 bp, Bovine  19866881165071
aaactaagatcatggaatcctatcacttcatagcaaatagatggagaaacagtggaaacagtggcagactttgttttttgtgggggctccaaaatcactgcagatggtgattgcagccatgaaattaaaagacgcttattccttgaaagaaaagttatgaccaacctagactgcatattaaaaagcagaggcattactttgccaacaaaggtccgcctagtcaaggctatggtttttccagtagtcatgtatggttgtgagagttggattgtgaagaaagctgagagtcgaagaattgatgcttttgaactgtggtgttggagaagactcttgagagtcccttggactgcaaggagatccaaaaaatctattctaaaggaaatcagtcttgaatgttcattggaaggactgatgttgaagctgaaactccaaagctttggccacctgatgtaaagagctgactcattggaaaagactctgatgctgggaaagattgaaggcaggaggtgaaggggaagacagaggatgagatgattggatggcataactgactcagtgggcataagtttgggtaaactccgggagttggtgatggacagggaggcctggcgtgctgcagtccatgggattgcaaagagttggacatgactgagtgactgaactaaactgaactgaaggatagggaagcctggcatgctacagtccatggagtctcaaagagtcagatatgacttagcgaccaaacaacaattgatagttacatctactgtcagtttattgtgccattattatgtagacaattaataaatagcatttgattaaatgtgatatttttagatatgttataaatggctataatataggtttcttgaagaatcttgcttctgttggcatgtttgaagcaaaaaaaccattatacctggaaacttgattctaagtcctagtcagtttgaatttctcaatttttaatatatgaaatctgtaacccaagcttctaaggtttgaatttttaaaaatctaccatatacttcaaatttggttttatctagtgagaataaaatattgtgtacttctttagctgatagccatctgctacagaaacattcaaatgtcagctcatcagaatttaaaaggacttcctgaacagaagttcactgaaatttaagaaactttaatgaaacttctgttacaaaatgatgctgtcttggctttaggctaatcccctaaacacacctacaaattcatctcaccaaatgtctgccacagagaaggag

SEQ ID NO: 39417 - DNA, 1572 bp, Bovine  19866881214645
tatgatggctatttcttgttagtgacttttgactgtgaatttggaggaaatttgtcatgaaacttgggtttataatgttcctccaggaagaatgtgtgtttgcctctgccagttgcctgtggttactatcaacctcaaaataaattacctttttgaggtttttaggaaaacgctgcttgaatttactgtgcagacatacttgtttctggttacaaaatctcagctaggatttcctgctgactgtgtgtggggtattatttttctaaattaccttttcagtaagaatgtaaacatttgtgtacacagctttatgcagaggttttccattatacattcaaactttggcagagtctgttctttcctgtcatctgcaactcttggttcttctctaactgaagatcaaggataccagttctgagcaacttgtggtatcagagctcacttccctctctggatttctacttttatttatggattgatttggcctctaagaattttactcattacctcttaagttgagatacatttacctatatttacttatagctagtattattttgttggagaaggcaattgcaccccactccaatactcttgcctggaaaatcccatggacagaggagcctggtgggctgcagtccatggggtcgctaagagtcggacaagactgagcgacttcactttcacttttcactttcatgcattggagaaggaaatggcaacccactccagtgttcttgcctggagcatcccagggacgggggagcctggtgggctgccgtctatggggttgcacagagttggacacgactgaagtgacttagcagcagcagcagtattgttactcctagtgggacagtgtgtcccactaggacaagatgtctagttcacaatattgccagaaattagtgattacgctttaagatttttataatagcttctcattcttctatataagctttttcatttaacaatatattcatccattttcacatattaatatgtatagatttgcctgttttattggaatagtgacataatattaaatattatagataaaccatcatttatttaataagttccttactaatggatatgtcaattgttttcagggtttttgttgttgttgttattagaaaaatccatgtatatatgtttgtagacttgtatatatagattaaaactctagagttagaattactgggttaaaagatgtgatacttaaattttgatgtttatttctgatttgcttttcagagtttgcaaaactaagagagacagtgtgcctgaattctcattgccttgtctatattgggttttattgagagcattatttattaatttgaggaaatagtttgtttcttaactttatcccagaatttattccatggagacaaaatatattacagaaatatgcgtggaatggttttaatagatatttttcatgccaaatgaggaactgatttgaatcaatttttctcacatatgactgtgaaatacaatctgttcatggagatgccattagatttctcatctgactgtgagtgtcctaactgcttggagaatatacag

SEQ ID NO: 39418 - DNA, 1268 bp, Bovine  19866881292949
aacatgttcataaattcagatctcagatatcacttgagatccactgattgagaatcttttacaaagatttcccatgtgactcatctgtatattaaagttttaaacactccactagatgggtggttttcttcctcagttgcacaatagaatcatctggtgagcactattttaaaagaggccttatttccactccttagacaactggcataattttgggagggcaataaccaggcaggtaaaaaaggagggatgtaaatcagaaaaggtagatatgaatagcaatttattacttattgtgtataaatgtgttaaaatatttttaaaatatattctatgaaatttattttcctcagagaattatagtgatgattaaataagtaatacatgtgagcatattaataaattacacaaccctaaaccaatgttactgttaatgactgacatgatacaaaaccaaataaatcaatattcttaagatattaagcatggtatttccaaaataacaattaacatagtatgtctgtggttcaactaagtctgaaataacaaacttttaaaaatgcaaatagttcttccctgattcagaacctctctatcacaatctcaggaaataaaacacaggagtttgtatttttaataaactaccaatgtaactattgtgtgtcttctactccataacttataagcaggaagaggaatataaaaagctaatttcacaactaaaaccaaccagctactttcccttcctccaatgatctcttacttcatatgataatactgtatagactccttaacaattacatctcttctgtaatactccaggtatgcaaaagtaaaatggaaagaaccaattcaacaggcattgagttcatttcttcagggactttctgagtacccaagagctgaaaaattcctttttgtgatactcttggtgatgtacctggtgatcctcttagtgaacagcactttgatcatcctcactctcctggattcccacttttacatccctatgtacttctttctcagtaacctttcctttcttgatattttgtgcacatcctcctttatcccctcaacaatgacacactttctatcagaggaaaaaaaaaatctccttcactggatgtattgttctgatgtctgtctccttcaccatggcatccacagagtgtgtgatcctagcagtgatggcacgtgactgttacatagccatctgcatgcctttgaaataccctatcatcatgagcaaggcactttgtattcaaatg

SEQ ID NO: 39419 - DNA, 730 bp, Bovine  19866881307906
ggtggacttgtaaatattcataaaaaatagattggatttagtataggtaaacgtcttgagcaggtataacaggaagaactgctgttgttagggttggttggtggaatcttctttttgtacaaagaaatgttgccagcaattcttcttggaagactaatttagaataatttttatttgctatattttttattagttaatgagatctaggagtgtaataacctggtgagaatttgtctgcaaatggcaatcaaattagtcttattcatgaaactcacaaataagctataattcagcattttatgtctaggggaattaaaatgggggtcatgctgtttaagaggataagggaatttaactatacactggggaattgagggcagatttatgatgaagacatatcctaactggaagcttgattgtgatttaaattacaggtcaagctgtgcaatgtgttttctttttaggggaaaatcttcggggagataaagtgtgcttgtttaaagaagaaacagaaagtaaatgaaaaggcagattgcatcttcagcttttctcttaaaatttcaagctgctgtaagtcgaatcactcctgagttcctgatgatggctgttgcgaaatttctttcttttagtttctttgtgttattcttgccctttattccagagcagttattttacttgacagtaacaaaaagatgtagccagcatatctgccagcaaactaatatggaaa

SEQ ID NO: 39420 - DNA, 1357 bp, Bovine  19866881329542
gaactttcacttaatactccattgatggtaaatttgttactttactaggcagcctattctcccttagaccaactaactatatattatacactaaacataaatcatttctctttcactttagccacctgattctcactttgccttgcagacttacaccatactaaatccaatctccagaccacatgcctatactttaatttctgtgaagatgtgtagtatgtatggtggaaagaacaacactggactagaagtcaagagacttgggttactgtcgcagctctaccactaactagctttttcatctcaatatccctttctttttttctgatagctaaaattatagggtggtggtgataaactaaatgaatactgaacatccttgcatcttttttgtggggttttagcattgccaagtatcccaagaaatgttgagaggagtctttcatgtgttttaatggtgactttgtggtacagcagattgttgctcaccaatatttctgattctgaacagatggacagactatctttcccagccccttgcagttaataagggtttgtgactgaattccggacaaggaaatgtagatggagaaatgtgaggtaccactccaaatcctggtggccatttctaaaccttgaatgcttccctttctttatttctttctcacacatacatacactttctttatctcttgactatttattgagaacttaagaaaggacatcaaggccctcagagaagaagaacctgaagtaggacatactcacctggggacctaaatgaccacagagaacagaattctccatctgatgtgctctagattatgatataagtaagacataaatcttaattaagcctcaaataatgaagttgtttgctatagcagttagtctagcctttatctaaaaagaatgtataagaactaaaaagcccattttttccttactctgaaggcaatatagagttaataatttatacaccacttactcattttcagagagcccctcaattataattaagaaattgtcataatccctcatgaggaaagatgtacattccttctcattttagaatacagaattttgggcaatgaaaaatgaattgcagcataaaccaaaagcattaactattccatcagggtacggaattcatttgttacaaatcagaagatgaaactactatgttttatttgtataatgcccaaaagttcattagaaatgcacaaatcacagttttctctgtttactgtatttttaaaaatttactaaattaatgccacttctctttctattgtgccatgttcgaagatgaagcatgtgtctacagaaatagcataggcaagtttaaaacattaaa

SEQ ID NO: 39421 - DNA, 722 bp, Bovine  19866881332347
ttgtgcctggcaggccgcaccattatcctctcccgcaccacatggactgaggcggacatcctgggggacaggatcgccatcatttcccatgggaagctctgctgcgtgggctcctccctgttcctgaagaaccagctggggacaggctactacctgaccctggtcaagaaggatgtggagtcttccctcagctcatgcagaaatagcagtagcactgtgtcatacctgaaaaaggtgagttgcagtctcagtgcgtctggggaatcaggactctttagctatgactggtttgttcatacctgccccagtctgccaccttgaggccaccagctccctgctctgtgccctgtggagtcatgtacctcctacatggaaagctacagagacttctgttcccatcgtgttagctctgctgaatcccgtttcctttttctaatggagacacagtgagcgtaggaaaaggtccttagaggacttaatgttgttgaagaagagaggtttgccaagagttaagagccttggctgcagaatgccctgctgagtctgctcattacctttaaatcttctcgacttaaacttttaaactacaaaacagcaaatatttatcgaacactgatttcatgccaaacactcaatctagcagactctggacataaaagaaaatcatgataatagttgtagcattgttatcatttgtaggcctattttttttttttttttta

SEQ ID NO: 39422 - DNA, 1108 bp, Bovine  19866881370662
gctcagatgaagttgaaacatgcccaacaagaattaaagactaaacaaacagaaattaagaagatggatagtggctataggaaggatcaagaagcattagaagctgtgaaaaaacttaaagaaaaacttgaaactgaaatgaaaaggctaaattatgaaggtttgcctttaaagacatgatgttaaatcattaggaagtagtgattattaatagaaacttaaaggaaatagcaagtaggaaatttttttcacctcattaatgttaatgtgaattagtataaaaattatttataaatataatcagaaaaataccagagtataaaacagtcctttgaattgaaaggatgaaaatggttttatgtgttgaaaatatgtctacttgacacttaatataaattcaaatgttaagtatgcttttctttaatattatcaggagtttgcattttacttttagaaatgctttggaaatagagattactaatattttccttaaaacagtagaatatttgagtttttaaaacttggtttcaatttacttacggcttactgttcagaaaacaaggaggaaagccttctggaaaggcgaaggcagctatctcgtgatatcagtagactgaaagaaacagaagaagctctcttggccagatttcccaatcttcgatttgcctataggtaagagttaaatcttgaaattgaacatggtagtaactaggatatatttttgtgtgaaagttaccgtaagctgcttttccttaattgttttttcttttttccttaaatctttattgaatgtttcagagttgtagacaagggaaattcttgtgaaatttaaggttactaatgccactaatgtcaaaaccaaaatgagtggaatttaatcttaccccaaaaagtttctttaaggttattttatcattaatgttaaatagctgtgttaacattttataatttgttttattaatgctatatggtttttttcttggaatacttaatatatgtattacaaagattagaacattaaagttatttttgttaccttgaaaacattatgtatactgaaagatcttttgattttaaaacaatagtcttttaagggtacaatagaata

SEQ ID NO: 39423 - DNA, 1749 bp, Bovine  19866881778598
ctgtggcctgggtaaagatttgggagtcataagcacactgagaaatgttcttgaaaatgaatgatgccacctggcactatagttacaaaaaaaagagtgttgcaggtcacacttctatagtactccaacaattagcaaaaaaaagatggcaaaagtactgaaaaagagcagacaatggtaaagggagaaaatgatcaattatcagaaagtgacaacaaagaataaaaagaaaacagtatttatagaatgcctactatttaccaatctgggcactttaaatactttgccacatccagttttcaaaataactctgtgcatgctgttgctcagtcgtgtccaacgctttgagacccatggactgtagcccaccaggctcctctgtccatgagatttcccaggcaagaatactggaatgggttgccatgccctcctccaggggatcttcccgacacagggatcgaacccacatctcttgcatctcctgcattagcaggcggcttctttaccactagcaccaataggtaggttttattactcacaatttgtaggagaaaaccacttagaggctaagtacttgcccttggtcacatttccaagaagtggtgggactaagagttgaatctagatcagaatatcatgtctttccactaagtcattcctgagataggtgcttaatatctatgtattctgaatatgtgatgttgctttgttatccttgaacaatcatatttatttttttttcagttactatgatacaatcacatatagaaaagtaccaggcagcaaaatgtgaaatgttatacctcaagaaatatcagatttcccagagaaacacattgaagacagtagatacttgactttctcacttaccttggcacattctgtgacttaacctgcatgctggagttcaccctgagtaaacatcataaattttatttggtgaaggaggaagccctagtcataagtaatgattatatcgcactaaaagtgtagtcaagcatgatgtttcttggatgactagcaactgaaattattaatcatttaattgatgaattcacttcagagaaacttgtgaacagagctcacgcaaatattgtcctgaaggtttcaattcattttctctaatagaagaaaagcaaaccattatttgtcatcataataaaaacatatcatattccaagatgtcagtaacagcaaggtagacttttaatataaaatgctgtgatattatcaacaaagcaattttcaaccacgcatactgcaaatgcccgtgcatgagtgattttaaagtggatgacagaatgactaaatatgttagaaatatctctgcagcatcgtcaaaattcatatacttatccctgaagccattcttgagctcatctacatgccctaatccaatttcccaaggcactcagatatgcctctattttgaaaacactacatatatgcatagtacatatgtaaaatgggagaaagcattaatattgtagttttttaagtctctgcttaaaatatatataatacttattgtaaatatataggtgctttacatatacatatttatgtgcataatgttaaagtcctacattatatttctgacctaatttatttctgaaagagcctcctaatgagtttctagtcatattgccctcaaatgtaccaagtgcagggctgccaaaatttgttttcataaatgcaaatatgcccatgccaccctgtctactcaaaacccttcaacacttgcctttt

SEQ ID NO: 39424 - DNA, 782 bp, Bovine  19866881880740
aggagcagttgagattatgaattggagaattttaaagctacctaggttagttgttttccactctaatttgtcctgctaattagaagacttctcacaatgcacatactcatggaggaatcatctagccccgtgggcattctgttctgtttaaggaatgaaaaggtaagctgtagcttttctttgaactagacatcgtgaaataggatgagaagttattccctttcaaagcacattttattttttgctctatttgtaaaatataatttacatggcctaaccatttttatttgcacatgtgattattggatattaagtaaagggcttccctggtggctcagctggtaaagaatccgcctgcaatgcaggagacatgggttcgatcccttggtcaggaaaatcccctggagaagggtagggtacccactccagtattctggcctggagaactccatttactgcataatccatggggttgcaaagagttggacacaactgagtgatcttcactttcactttcaagtaaaggcatgcattatttaagcagcatattgtatgccaggatgccagcactgaccagatgcatctagaatttactgattttagttaataactatcaaaagttaaaaattaccaaaagaaatataaatgttgactatatgatagtattgtagaaaaaaatgccataacttttttgtttcaatttctctttaaagcagcctacatatttattatgagatgtgatatgttatattgtgggaagactggaatcaggaagtgattaa

SEQ ID NO: 39425 - DNA, 610 bp, Bovine  19866882165710
cttgcaggaggtggataatgaagttactgcataagctatagacacaaccttgtaagtcctttcttctatgggtgaccttccttcatttatatccaatgacaacagtgatatcacttgagatgtagagatggctgattctctaatggagctattataaagtggcaatcatgcaacaatgttcatgacataataaaaaatatataaggaaactgattcactctcattgtatttcttgttatgacttaaattatgttcatgggatgaaatacactaagcctggatgtgcaatgtattccacataatagtttaatcaagtatgtctgttctcagatgaaagatgcattgtcacatggtaaatttccaaaacccttttttgacccactaaggcaggtttcaatgagagttcctgtacaccaagacacctaaatcccagtgcctactttataacttggaagcttcaagatatgtatcaaatttagtatgtctcaaatagagcacttaatatatatttgggcaagttagtagtgatatactatgtttcattcttcatattggtgatttgagtctttctttttcctttgtcagtcttaactgtcaataatattgaact

SEQ ID NO: 39426 - DNA, 2311 bp, Bovine  19866880126345
tacatatacccaatggagtattactcagccattaaaaagaatacatttgaatcagttctaatgaggtggatgaaactggagcctattatacagagtgaagtaagccagaaggaaaaacacccaatacagtatactaacgcatatatatggaatttagaaagatggtaacgataaccctgtatacgagacagcaaaagagacactgacgtataaaacagtcttatggactttgtgggagagggagagggtgggaagaattgggagaatggcattgaaacatgtaaaatatcatgtatgaaacgagatgccagtccaggttcaatgcacgatactggatgcttggggctagtgcactgggacgacccagagggatggtatggggagggaggagggaggagggttcaggatggggaacacatgtatacctgtggtggattcattttgatgtttggcaaagctaatacaattatgtggagtttgaaaataaaataaaattaaaaaaaaaaaattgtaaattgacagtggggcttaaaagtccaaaatccacaagacagtctgtaaattcagcaaacattaaaattgcaatctggaatcaaacgactggaagttgttgtttttctgtcattcagtcatgtccagttcttcatgatcccatagactgcagcataccaggcttccctgtccttcaccatctccctgagtttgctcaaacttatatccattaagtcgttgatgccacccaaccatctcatgctctgtcgcccccttcttctcctaccctcaatctttcctagcatcagggtcttttccaatgagctggctcttcacatccaggtggtcaaagtattagagcttcagcatcagtccttccaatgaatattcaggctggaaactgaggtataatttctaagaggaaattgagaggcagaattcctgcaaggtacctctttataagaccttttaagacctttaactgattagatgaggcccatctttactatggagtgcaatctgctttactcaattgatttaaatattagtcgcatatggaggataacttcacagcaataactagactagtgtttgactaaagaactagccaccatagcctataagttgacacataaaattagccatcacagtggacatattcaatgtcaaaaataaatttttattaagtataagcaagatatacattcaagataagagttatattttaaagtctgcattagtgtaaggatgacagaaactctaaaatttcctaagtgcatatacttaaagttgaatcatgtctgaacataaaggaggattaattttaacgttttatctgtcccctccaacaataagaaagtcatatgtgaatctaaggttcaccactttgcctggtttaacacaataggccaagggaaggcatgatctgcagcatttgtaaagctaatagaaaaacactgccggggaaggtctcaaagccacagagtatggtaaagactaggttgtaatctaattagaaaatgataatagaagccaatggaaaacaggcctcatgcccaagaactacaattcccttgggaaataaatgattgatcacttggagacaggaaacagataggggaaagcgtgttcttgcctttgacctgaaacatagatcacgacttccaccctgagtgaaaccatttataagaaaccaaatgctttacattccagcagtctgtcatttacagggaagacaggtgaagtcctccagcagaacaccagtgactcttgctataaaatccctaacttacctaagaaatgttgctagatgcagaattgtactagtaaagtggtatttttctcaatttgaaaattttaaaatgacctagtttcttaggccctcctttagtcccaccacttcatgggaaatagatggggaaacagtgtcagactttttttttttctgggctccaaaatcactacagatggtgactgcagccatgaaattaaaagacgcttactccttggaaggaaagttatgaccaacctagatagcatattcaaaagcagagacattactttgccaacaaaggtccgtctagtcaaggctatggtttttcctgtggtcatgtatggatgtgagagttggactgtgaagaaggctgagcgctgaagaattgatgcttttgaactgtggtgttggagaagactcttgagagtcccttggactgcaaggagatccaaccagtccattctgaaggagagcagccctgggatttctttggaaggaatgatgctaaagctgaaactccagtactttggccacctcatgcgaaga

SEQ ID NO: 39427 - DNA, 1865 bp, Bovine  19866880169184
tagtctaactatgaggtggaagacaagaggaattcccaggaaagagttcattaacttcttggctctaatcgagcatctcattacaagtggtgtgttgggtaaatttgtgtagtgattttgaactgtcgtgttggagaagactcttgagagtgccttggactgcaaggagatccaaccagtccattctgaaggagatcagccctgggatttctttggaaggaatgatgctaaagtaattccagtactttggccacctcatgtgaagagttgactcattggaaaagactctgatgctgggagggattgggggcaggaggagaaggggacgacagaggatgagatggctggatggcatcactgactcgatggacatgagtctgggtgaactccgggagttggtgatggacagggaggcctggcgtgctgcgattcatggggtcgcaaagagtcggacacgactgagcaactgatctgatctgaaatgtaaaatgaagtcctcaacatacagatgagctggacaacaagattccaatttaattgagaacaaagaatgagaccaccagaacataatgatagtaccccaggattaaggaatttcccaggacaaaggtgctaaaactggaagatacgtgggaaaacaggaatgagtcagtcactataaatatcaggcaggaattatactgaatgttccataatactgagtaagcatccaggtgaggcagaagatctcctggagaaatctaggattttaggaatggggagaatttgtttaagtagaagaaaggtatttcaaggggaaaacacaacaagaatggaaaccaggcaaaattaagcctaatatgttaagaagacagcaggaagccctgctaatggggacaaccgatgtaggggtaggggaagtgtgatgcaagcgtggaaaggctgattgtggtcagatccaggaacttagattttattctattaacaataagaaccaatggattttgagcagggtcctgtcatgatctaaagaatgttttagttttagggtattaaaaaaagtcatatggaagataggacagactagaatctgagaaattagatattttactaattaaaacttcaggaaatgataacacgaattagtttgattgcagtagaagtaaaaagtagaacaaatatgagaaacatatcaaacaaatagttggcagaatcctataactgattaggaatagaagtggataaataaaacgggataccatcagattttctggagtcaaaatcactatgaaatcatggcaacttgggagcccattcccttttggggaaagttaatgctcttggatttctacctactccaggagatcttctgcctcacctggatgcttactcaatattatgtaacattcagtataattcctgcctgatatttatagttaatgctgtggatcacaataaactgtggaaaattctgaaagagattggaataccagaccacctgacctgactcttgagaaatttgcatgcaggtcaggaagcaacagttagaactggatatggaacgacagactggtttcaaataggaaaaggaatacatcaagtctgtatattgtcaccctgcttatttaacttatatgtagagtacatcatgagaaatgctgggttggaggaagcataagctggaataaagattgccaggagaaatatcaataacctcagatatgcagatgacaccacccttaaggcagaaagtgaagaggaactaaaaagcctcttgatgagagtgaaagaggagagtgaaaagtttggcttaaagctcaacattcagaaaccgaagatcatggcatctggtcccatcacttcatgggaaatagatgggggaaaca

SEQ ID NO: 39428 - DNA, 2243 bp, Bovine  19866880408432
attgcaatcgcttccctccttttctaatttcaaaatctctcattaaaaatttatagtgggcagtcatccagctatttatgactatgtctagacaactgaaaaacagcagacggtggcagggtcgatccggggctttcacttgtcttggtgaccagttcagatcagggcagagttgatcagatcaattaagtggaaatcagatgttaatgccaccggagcaattgactgagggagaaaaactgatcatccactctgggagtggcaggggccactattacatatccactcttttgtttgcaagcatttgtcaacagtctcatgctgtttgtctgggctggcatcacagaatcccacagattgagcggcttaaacaaaggaaatgtattgtctcacaattctggaagctgcagattccagattaaggtgtgtcagggttagtttctagtgggaactctctccttggtttctgtacagctgacttctccctgtgtctcacatgatcttttctctctgcacaagtagaaagaaagatgtctctctgtatcttctttgtcttatcagataaggccccagtcttattagattagggtcccactcttgtggctttatttaagcttaattacctctctaaaggtcctatctctgaaaacagtcatacttggggctagggcttcacgtaagagttctgggtggacacaattcagtccccgtcagtccctgatgaagtagggcaaggcatgttgaaagctggctgttaaaataaggtgacacctcattgtttttagacaaggtgccttcattacttggtgacagtgagacctgttagtcacctttctttgggagggattattagctggcattcatagcttgctcagaaacagtcttgtcactgatattgttacagacaaaacacctggagacaggtagaaaacacttaggacatgggaagggaaagataagcaatgatgaattttgtggccactgcagaattcctgcttatataaacaaaagtgtcacctgatgtgaagaactgactcattaggaaagaccctgatactgggaaagattgaaggcaggaggaaaaggggatgacagaggatgagatggttggatggcatcactgactcaatggatgtgagcttgagcaagctccaggcaggagttggtggtggacagggaaacctggcgtgctgcagtccatggggttgcagacacaactgagctactgaactgactgaacagaatctgtgtcagtggatctaggctacagcaatgagagaatctatggttcagtgtccagattcttcctattacagagcatgcatttgtttgcttgtgggataatgggctgtgtgccattcttaatgacatggcagattggaggatggtggaagcacagggcttttttagcttgtgtgtgacaaggatacgggattcttgcattttagaaatggcagacttacaggatggaagaatactaacagtactttgtgggtttttttggagctttgcagccaaggagactcttacatacgattagtgcctagctgagattgacaccaggtgtgggcacctggacttagcaaggctggccagattctctctcctacagatgtggaactggaaccaaaagaaattggttaattgttgctgatgtctagacctaaatgtatataaacacaggagctatgaggaaattatatccaaatggacccagtgaaagctgtttggcagagatagaagattgaattagatatgcagaaaggaacagagatagattatggagaaggagagagagagggagagagctagagagatgagagatagaaaagcagagactgaggagtaatggttcagttccttatggattcaaaaattaaatgtgattcgcatggccttgtctgcaggtaggtagataggagaaattcatagaacagcaggaagactattgttgtgagttttggaaatctccaaatgatttttaattatgttacagtttagactcttgtctaatctttattttactaaacaatactgccttctagaacacatatgaagctatagactctgttgtttaatcctgaaagtgtattttagcataaaaaatattaacatttataatgaaatcctttcaaaatatctcaagatgtttctatataaatcccagaaatactttttaaaaatatctttatttttttctttctggtctactgttctcacatgccacagctgttcccatgcat

SEQ ID NO: 39429 - DNA, 3672 bp, Bovine  19866880594650
atcttgggttgccccacgggcatggcttagtttcattgagttagacaaggctgtggtcctagtgtgattagattgactagttttatgtgagtatgatttcagtgtgtttgccctctgatgctcttacaacacctactgtcttacttgggtttctcttaccttgggcgtagggtatctcttcatggctgctccagcaaaatgcagccattgctccttatcttggacgaggggtatctcctcactgctgcccttcctgaccttcaacgtgggatagttcctctagacccttctgcgcccgcgcccacgcagccacagctcttttggatgtgggggtcggtcctcccggccaccacccctggccttgggcttaggggcatggggtagcttctcccggccgcggttgcagccaccttggtcgccggttttgaaattagtacacacaaaaatgtaccttcaaactgctataaatatgctgtgtcagtccacattctgtccctatagatgtttgtttctttaccctccaccatttgttttataaataagtatgtttttccccaaaagatgtatctatattcactgctttcattgtttcatcatggtgtttggtcagtccaattatgactttccatgacatataatcaaatgataaaacactttttatatatgttgtatgcatcccaagtacagtcccatccttatgtggagcaatttattattgagttttcctcttgcactttctccctttgctttgatagactcacataaaagttttcagtaactttgtagcaatcaacaattaatcaaattgtagcttttcactacaacaggaaagctgagtaataaaaagtccatgtaactttatgggcaccaataacctctgaattaggcaggatgaagtagtgataatcctaatcagattgcttatttccaagtataaacagtttcctgagaggatcttgagtcatatcttcctggatctgacatggatggatggtagaagggaagcaggtaggtgagaaggaaatgcaattatgagatttatttctatgaaagaaaataaatgatgaaagaatgaagttttctatgccttctatagtctcaaaaaccttttgtctagctatctggaaaccttgtattaaactcagctgtccctccttcctacctgtgtgcagtgcaggcctggatgtgtgtttatgacatgtaaggggcagtatttgaagaaagtccgttgtgtgattgcccactgagctcttgttggctctgtgtgtggccagatcaacctctcatcaaaagagcctttgtcacaaatcccagtgatttcaatcatgaggttatttcccttattttaaatacaagtgtaaacataatttgaaaagtttcttctaaccttttagaagtggtatgagggctgatgtgagatagggttggacagtatttgtatatagaaaaagaatatcgatttgactttttaaattctaagacttttattacaaaaggctgctataacccatggtaattatattccaataattcatatagttattctgccttgatctaatatgcttccctgtttttcataaaagtctagattagccttgaagggcatatttatgaaaaatgtctgattgatacccataaacatgttttgttaaaaattgatttgagtaactcactccccatgtttattttttccccttagaccgtacaggtctataatttaaaactcaccttacctagcgttacttcttgagtcaagtcatacaagagaatggctccaggtgcgagaatcattaactaaggatattaaagccataaataagatcttccagaatgtgttttacccatgaagagtgtttcgtattgccaccaattagcgctaagaaaattaaacatcatttacaaacaagattaaagacatttctccttccacaaccaattaagaaaatcagagggaaatgttttgattcatgctcatcatatatatgtaaatatatcacataatggctcatatttagcaaatatgaaataccaaaatacaaatgaaaaatattttggcatctgtccggcccttgagctggctagcactaagtgtgatctgaaagtgtttgagtactgctgttaaacatttaatgacaggaataaattaattagagatatttttatcagaatcacagtgaacttttaaaaacatagagagggaggggcctgtcctggtcactgccatgcaacaaaagatgagaagaaaataattatcaaatagtggataaaactgaagacataaaatcaagaagattcaatcaaagacatgttctttgatcagcgacagaacaaggatatggactcacaagttctgagcaggaagaaaggagctttaaacctgctggcacccatatcaagaatccacgggtaagagaggtcaaaaagaacccatgctttagcttggaccagcaccagctcatgatgctatacaggaggctggggaagagctaaaataatatgcacattctccccaagactaccgcacatgtgaagttacatacctgcagaaagagtacaagagcacacagagaaacctagttcaataactgcatcttcagtattccattggaccggaactggatcttcagcatcagcatggcatggtaaccccaacccactaagacaagattcatactgacttgaaaatgaacgagatcaggtggagacaactacaaatgatgagacaggaataaattaggcagagacagaaaaacaacccctaatcaacaggataatacaaatgaaaattccaaagcaaatgatggaattaacactgagaaggacaataatgaggcactgggttagtatacccattttcctctgcaagaaatatattgatacccacccttgtggctcagctggtaaagaatctgcctgcgttgtgggagacctggtttgatccctgggtttggaagagcccctgaagaagggaaaggctacccactctggtattctggcctggagaattctgtggatagtccgtggggtctcaagagtcagacaggactgagtgacttccatatggagcatgtgtgcaactttcatggctagtttattaatttgagagtgtatgtatacattgtgtattttgagaaaacatgaaactatggtagcaagcccaaacacatgccatactgaattgcagtgatattaaaatatacactgttagcttcagagtcactgacgtgtgattcaatatgcggtttgccagaatttcaagataatttgcctggttatgtaagtacactaactgttcatcaagggtattaagaatgccccatcatgttaccatttataactggatactaatgagagacaagcaaactctacataaagagttaagtgattaaactcagtctacagcttgccagctaactgaatttgggcgaggtgagtagccatctcatttttttttttcatctgtaaaattgatcatgttatatgaatgccttaaagatgaggatataataaaagaatggataaaatactcctgtcttctgcttcaaatctcacaagaaggaaaataagaaagatgatataaattcacatcagtgcttgaaaacaaggaacgcatcattggtataccagagatactgacacatcctgagatgagacgctaataggctcatatta

SEQ ID NO: 39430 - DNA, 908 bp, Bovine  19866880606859
tgctgctaaactcgggggagaaagagctcccctcctctgagaaggagttgttctcaccagcggtaggctcattcgaaagcatctcaactatgtgcaccaagtgtgtgtgtgtgtatatatgtatgacacacatacccaagagttatatatgttctaattcatatatctctatttttctcctttgaattcgcttaccatctcatagggctgttatagaaaaacaaactgttcttatcatctctaagcttctttaaagatggagtgttcttttattatactgtttaagataagaatcaatttggtatttcctagtcatctgagcactttacacaaaagtcttgtaaattatccttttgctttatgaacttttaagatctctagacaattccagaaactttgaattatgttcttcggtatgactttcactgctgcgaaaagaaagactgaatcattaaatattggcccaagagggttggttcttgaagccagacagtttcaaggaggatttctaacctgatacagtattagtcttctagatttctatatgatttgttctctgagggtaaagcaaagcatcatacttttttgatattcagttaaagaataaaataaaataccttataatcttaattggaaatgccaaggatttgattgaatttctaactcagggtgctattttctattattaagaatgagttgtgctactgttaatgcagcagaaaagaactcatcttcaaaatatcctgggacccatgaaatgcaaaacagaagtgagccacagcctatggtctgggtgtctgccagcaactctcacatctgctgtttggagtgccagcatttggcatgtgatttggagaccctttcttcagaacaagttctgtttggcgaacttccttcctacctttcca

SEQ ID NO: 39431 - DNA, 1556 bp, Bovine  19866880759413
tgatgcctaattgggcttcctccataggtaatctgaatagaagaatgtatgcagacaaaaaaaggaagagaaaatgaacatcatacttgactcatcaatgtccataatggtaagtattttgggattggtctacaatcaagaatctttaaagaccctctccccacatcttccttcatggcatgcagtgtaacctcagtatgagcatcatccagagtaccttaaattttctgaatgaaggagctatgcctgcaaatatgcctggccagacaattgctgctgcctcaaagcctcaaacaccatcttcttcagaaaaagtcatcaacaaaaacgcaactatacatcacatattgatatttggaaatccttcagattttgaattttgaagctgttactccggagtttcctaatttctgctgtctcttgacagaaaatgtttcctggtcttttcttcttgcttcaaatacagtttctttaagactcctggtttcagtggctgagagaggcaaaggagttgtcactaccgtttatttgcatcatcttagaagagacctaatcccttagtcaagacttgttagactccaatcttagcacaaataaagggaaaacatagagaaaaaaaaaaaaaacaaaaacgtgaatatttggcaagtgttaactgtatgcatatacttaaatacatatacacatgtatgtgggtgttcatttatgtataggcataaaaatgcattaagctactttgaaagttttgcaatctatcattacccagtaacagcggggaagtaagtgggattgagtgggtagtgaatggggatttttaagatttattttatgtacagcagtatagtaattttttcaaaaagtatattcatgtgttgtttttaaatttttcatttttaaagagtagcacttacttacttctcccaattgctcattttccacttacttggaacccaactctgtgtgaccattcgatacaaacaacacacacaaatctcagcagtgacttactaattgttaaattcagtaaccccacttgaattttatttgtacatgatctcctgtagcacctgacactgttaagcatatgctgctctttgaaactgttgctttatgcgtccttaagttctgtggcttcactctctacttctctgtttatcccttattctcttcaatttaatgcaatgttcctcatttgttttttaattgaaagaatccatacaagttcttttaagccgtggattctttttgagtacttttaaacaatatttagagattcaacttccaaccttccaagcagaaaactcagaaatgggcatcgtagtctatcgtaattttctggactgaatttctaattataagatggcacactccaaatcaatttacagtgtataaattaagctctacatgtaaaacattgatcacaaaactgctctcctcacaactttctcccaatgccagctttcatatctcatttatatcatagattcatcatcaaaaagggaaatattagtaataataagttcttctaatggttcatgtaaggaaatttacaacat

SEQ ID NO: 39432 - DNA, 4233 bp, Bovine  19866880768664
ctggatgaaaacgaaatggcagcgtttttagaaaaggaatatataattgctctgtttcttaaactcaaatattcaaataaatactagaatctatggtctttttaaagttgtttcaaggctgcaaaaagaaacacaatacaatgtgaataagggattatgttatatagtcatccacataggcaaattgactggtaaatatagtatagtatgattatcataatgtagattacagacagtataaatttagggaatttcctgcattagagaactaagcctgtacattaagtgagttgcatcagatacttcatatggtttctacaggcaaaagagaggtctgtaaacagatgtcttgagatgacagggaaaagggggaagttccactttgcattgaattccaagggaacatatatttaatggtttattttatggaataacaatatctcttctctcatcttccccaactcaaaccactcccacaaatttattggcaatctttggttttgtgatgctactgacctggcatcacagatagcaaagacagatgagaattaaatgacagtgaaccaaagaaaacttgtgaagatttgagtaaataagcttggataaggcagagtaactcataaaataaaactcttaaggaaaaataatatacatgtatatgtatatgcatacatatatatcacatataaatgcatgatactaattctgaaagaatagcaatatatgtgtgtgtatatatataatagcaatatacatatgtatatatatatacacatacacacatatatatattttttattttaacattaaaaaccaatgagatacgcaattataacagagaaaatgataggcagtccacaatgacatttcagaatcttaatagacaaggatattgtttgactattgtgcttccaaaacttagaaataaggagttttttattgattaagtgtaaaatgtcaccaagtcttaagaataaaagattttgaataagaagactttctctgaaggaatgactaaaactctcaagcattttcagagaattatacttgtttctatacaatggatagacatgtggcttaaacaaacccctggagggaatcttgctaagtgttgtagtagtggagaagatctggcccctgtatgtttacatgatagaatttacttaatatatttacataggagctttccaggtggcccagtggtaaagaactcacctgccaatgcatgaaaagtacatttgatccctacatcaggaagatctcctggagaggaaaatggcaaccattccagtattcttgcctggaaaatttcatggacagaggagcctggcaggctacagtccacggggtcgtaaagagtgggacatgactgagcaactaacacaacacaacaaccccagcctccagcatccccaactcatcacacccctgagaggtcctgacagagcagactcctgatgtacagtgaaaacatcatccatctagcactacatgtatcactctacttacatgaattcatttattcctgggctgagggacttctgtcctcctgaatcccagctttctcactttccacttggtggtccccaaagatgtatccatcagacaaggagaggagacacacagagaggggagggtgatgtgacttgtggctggccacaagtgcagggcatcaaagatgctggcaactccaagagtgggaggaatcctggaccagattcacctgagttcccaggaggaacctgccctgcaacctctgagcctggaattccagcctccaggctgtgagaggataaactgctgtgttcagcccctagtttgtggtcatgtgtttcagccgccctaggtgaccagcccagctggatggacgtgggggaagatgggcggaaagcaggtacagccaggtccgggggatgggttgtggggtctgccctggaacattcttacagctactccacgggttcaaagattttcataacaaaatgttaggggaaaaaaaatgaaatgttagaaaaataaaaatctgtctcttcccacttaaatctgaataaacatttaaaggttaacaagtcaaagaacagcaaaactctgtgcgggctgtgcggggaatcatggccatccaaggtgtccccccgctccccacccccggctccacctcacctctgcctccctctcctgcccccagccctgcctgacccccactgggtcacccgtccttgtaaggcttcagcaggagcaccttattgccctccaagagtgaggctggacattcgtagtgatggagggccgggcaacccgcagcagccaccccgagagccctggagcagtacaactccaaggcagcagaacctccccatgtctggactctgcctgctgtcggtgcccaggacagggcctgacacagactacagtcagcatctgtccattcaagtggacaagcgaacaacagcatcggccaccacccgacagtctcctctgtcccggggacgccgtggtggacatgcggcctctcacagccatttagatgagtccctgtctcaggcagacgaaatatctcttcgctcttttcatgtcaatactggtgctattcaaccagaagaaatatgaccgaacaccagctggaggctggcctcctgcccaccgctcagcggagccactgggcctctgccaagggcggccctggctcctgtcccctcccctttgcgatacagcctggaaggaggacacaagcctctgtttggacttcagcaccaaaacctcctgccgagctatctcaagccagtcactttgcctctctggcccccatcttcagcgtgagatgggagcagcgcggccagccatgggggcatcaagagagccgcgaggtcgtgtggatgaagtgccatagagcgcctgcagtcggtcagacgtttctgttgttattctgatgaccacctggtgttagatgttttctcctggaacaaaggccatgtggggggttgctattgttcagtttgtaagtcgtgtccagctctttgggaccccatggactgcagcttgccagacttccctgtcctcctttatctcccagaatttgctcagactcatgtccatcgaatcagtgataccatccaaccatctcatcccctatcatccccttctcctcctgcgttcaatctttcccagcatcagggtcttttccaatgagtcgacactgcatcaggtggccaaagtattggagctttagcttcagcataagtccttccaatgaatattcaggactggtttcctataggatggaagggtttgatctccttgcagtccaagcgactttcaagagtgttttctaacaacacactttgaaagcatcaattctttggcactcagccttctttatggcccagctctcacatctgtggggggtgaaggaggggaaatacctgtcgagagacaggccacgcccacggagacagaaccaggtcctacttccaggccctgagtaaggagcaagatgctgggagggggcctgcacccttgagaagaagagggtgggaggagggctgggcagaggaggaagtccaggggagtatagctcagacacaggagagatataaccacaagccagagacacctggagccaccagcagctggaagaggcaagaagggtccttccctggagcctccagaatgaaggagtatggcccagcccacaccttgatttcagacttccagcttccggaatggaaagagaatgcattcctgctgtttccggtctgcagtgctttgtcacagcaggcccaggaaacaagtacaacaccccaaacctgcccctcctacagcgtcccccacttgagaaatgactactctttcctggttgcttaggccgataggagaaccttctcaccttcccatgttcttgtcttcccattcacatccagttcatcggcacgtgctggcatctcggggcaagtgcatttgaccaggaagaggactcagccggacgcacctcctcagccccacctctgctgcccagatttgcagtggcctcagctggcctcctgcttgtactcacgcattcattcattcattacaggaattggctcacgtgcttctggaggctgggaacccacaacctgccatctgccacccagcagcccaggtcagtggatcgagtaaatcagtccgagttctaagccctaaaaccagagcagctgatggtgtaaccccaatccaagggcaggaggagcggcaacg

SEQ ID NO: 39433 - DNA, 1136 bp, Bovine  19866880777984
attattagtagtattcctaaaacctctttttaagtaatagatgttcacatcattaaaaatagaaaatatatataagcatgttaataaaaagaaaataagagctacctaagtgccaatatagaattatcctcttaatattttggtgtctgtctttttgaatttccccagacatctgtgctttttgaaaataataaaagacacatttcccttaatatttctcatattatgtggtctttccttctctatctctatgaaagccaagagaataatgaagttttaatggaggtgtatatttagctttatttatctttcaatcaatgctaaatctagattcctaatttaatttctcaggtccttagatttaatgcatttctatcacatttgattatgtgttaaaaataaatacagaacactgcaaaggaccaaatataataaacacctatctatttactactcaaaatgcataaatattaacccttttctaaatgcttcagatttaaaattattatttaaagctataaaaaaagaaatattgttatgaaattcaaggccctcatgtcaccttcccactcccatccttctctcttcctccctccctccacagagacgatctctgtcataaagtttactctgtaaagttcccatgtaacagcacataaacttctgaaggacagcagctacagactttgaccactggtgtattttaatggtaactgcaatatttgtagtcaaatatgtgttgaatgaatattcatccataaaccatattctaacacatatatagttttatctaatatgtaatacgtgtttgtgtagatgtaatatatataatggtatctattttatgtagtgatatttttgtgtatttttcaactctgtatagatggcatcatactccagatatgtagcaaattctttaggttacttttttcacttagatattaagtatcatataaatggagaaggcaatggcaacccattctctgtcctcttgcctggaaaatccaatggacggaggagtctggtaggcagcagtccatggggtcgctaggagttggatgcgactagcgatttccctttcccttttcactttcatgctttggagaaggaaatggcaacccactccagtgttcttg

SEQ ID NO: 39434 - DNA, 3162 bp, Bovine  19866880791854
tactactgaacacagtcttaagcttgtagccatgtagcatttgtctaaattcttgagggaaatctggatactgcttcatatgccttcttagtccatgcttttggtaattcccaccaactgattcacactggcactgctattggccatctctgccttagaggcttttttcatgcagctttttgaagtactgcctcttaactataacttcagtaaaattggccctctgatttccttagtgggaaatataaccttcgcacccattaaaagacagtaaaatcaaatggtgctgtaatagcaataatatgtacccttaaaaataatttactaaataataatctgccagaatgtatctcttttaagactgaaaaaataagtttctccttccctttggcccataaaatcttaagtttaagcagtataattgtagggccacgccttcactctgaacaactctagctcttgaaggctgtggaaacctttgcctaggtgtgacttatctcagtcatgtgttgtgtaaggaaaatgatttccatatgtccctgctatttcacagccaaaactttactgcacaggttgggcaaatgcttcccatagggttcattcgcctggtttcaagtcatgagtagaaatgctttgtattggagaaaagaatttgactgtcattacagtgtgtatacacacacacacacacacacacacacacacaagcacactcatgtgtgcatgtatcctctttgtcttgcaatgatttaaagtggttttcagtcattaaccagttatatgtgttttaaggaaaaggccatcatcagtgtttaaatcagtgttgcatcagagacaaatattaaagggaaaatagctataaaaatttattttgatatgtgtcttagaaaacctcagcggtccaaatatgttgtttgccttcctgtatttccagcccccccagagcaacagcccattccaaagccaagcaattttgaaaatttaaaacatattttattaatagctcaaatacaggaagaacacaacagcccttcctggtgaggtaattggacttgatgatttgaattaagaatatgctaacatctggtagtaccccaaacacagcctattagaaatgaaataggctaatctctgaagtcattgtcatatttttttgttttttgtttttttaatttttatttatttattttattttattttttaactttacagtattgtattggttttgccatatatcaacatgaatccgccacaggtatacatgtgttccccatcctgaaccctcctccctcctccatccccgtaccatccctctgggtcgtcccagtgcaccatagtcatatttttaatatatgttttagaaacaagaagtctactcctccaacagaaatctatataattaaaaaaagtttgattataatgctgtacccaaacttacagagatggcagtcaggcacacgggcttctgaagagtcccatggccagtcatgaagtgaaaacagaaaatgtctttcttctgatgttatgtcaacatgtttcaaacaggtcagaaccaaagtactatatattttgcagcatgatagaatttgtgttaaagtacacagataagtagttagatgcaaagttaaacccagccaggaacttgaaacagttccttcatcatgttgttattaagacattgtcagatcttgaaaggagttaaattatattgttgcaacttaaaatgtttacctttacatgcacacaccaaaaaggaaaaaaaaaaaagaaagaaagaaatgaaaaagaaaacaatatacaaaatttctttcatttcaattatcacgaaaggcctcagcaggggttttcatttgataaatgcaaaaagacaacctaataacagcttgctttgttccaaaattaggaaaggaaaaaggtgggaatgagcatgtcacagagttcttagaaaaaggacagtttgttttcaggactgaaaattagagataatttgttgtccagagcatggaaaattactagtaagtttatagaaattattcctaaaagtggcttcagacatcactgtgcccactgctggttgtttttttacctcactcagcaaatcttctttaaaaggtgaaggctttctattttaggtttctcaagaacaaccatatctcaacaatgttcttcccagagaatgtgcctgaagcttctgttctttacctttctatcatggaaaaattcatcttttatctagctaagagaacacctctcagttgcaaaataaaataaatcaacattcatttgtacagcagagatttttgggggtaatttttcatctttgtatggtatcaaaatttcagaaaaaagtgcaagaaaaggaaaaaggaactcttgtatattattcaccaattgtttatattttgcttgttttgctttctaattctctctcctctttcttcatagacacacacacagaaatacacacacaagcatgctatattattttgggggaaacattttagagtaagttagagacatgtgtctccaggtccaaaacaacataacatcgtttttccatttcccatatttgtgactctcttctccaaaactaagaaacttgcttctattatccttaatataaatactgatttgctcaagtttagaacatatggaacagtctcagaattgttaattgtattactgcaaaacacagactcactagttagtgtttgcatttgtttatagttttttgatgtataaatccatacagtggtgtgaaaaaattttaagtatacaatttcatgagttttgacaaatgtatattatttatctatcctaccactaagatatagaagttttctatccctttgctccttgctaatcaatccccactccaaagcaaatttacctaaaacaaataagataaatgaaagaatgaaggtaagactagagaaaagtaagacaagaaatgacaaacaacagagaaaaatcatcaaaaccaacagctgaatctttgaataccacaataaaattgataaatccttaccaagactgatcattattagaaaaaaaaaaagaggagacatgagcataaatcttaaagatagtaaaagattgcaaggagatatcatgaataatgttattcaattttgttttaattggggtatagtgctttccaat

SEQ ID NO: 39435 - DNA, 1702 bp, Bovine  19866880821707
catatttgaatttcacattattttcataggtcataagatatttctttttcttttgatttttccaaacaacattttttaaaaaatatttttagctcaaggatggtacagaagtaagcagtaaaaatggttctttcaacctaatcaaatgtatgagtgatatttcccatatttccaatcacattacttattaagacattaagcaacttttgattctaaagttgacatattaaaatctctgaattaagggaagttagggagaaaatgtccttcagccacaatggactgacaaaaatctatggaaaacaatgatgatgactttgatgctgacaagaaaaatatatcatcattatatggaattaacttgaggcctctgtcagttatcaaccacttttacttcatagaaataattaggtagttttctcaaaaagaacaaggggaataacacatataaatgttctctgcctactctacagttttctttatccaggtttccctagaaaaaacaatttttccttctgtgccgcaaaagaggaatagaaaatattaattctttttcagccactgtaaggatatctgtcccctgtaaggataatcagtggacaatgcattgtcatttccattttcttctgaatcactaaaatatggatgaaatgatactaaaatatgaaaattaaagctaccaagaagagctttagagtcatgattacaattaatcagatattcctataaatcagaatgtacatcaaaatggccaatttggaacacttaaaaatggataacaatctcaaagaactttcaagctgaaatggtcatctcggaggaatgactttcttaaaatgatgcttccagctcagatggtgactcgcaggtgaggcagcctaactgtttgtgctattttgtctgacagagaaagcagtggctttagttttgtgtgctttcaattcacttgagtaaaaaaggcacacaaataaacacatgtttacctttgcaactaaatagaaatgattttccttttctgctttatagagtttagtaaaaataagttggggacttcacaactgcagctttcctcagctttctagaacagctttatcttcttcaatgtcttttaataggtttacagcatcaaagctagcaatgtttaataaagccaataaataactgcattataaacttgaatgtttatgttgcaaaaaaggtaacaaattcacccttggtgggaggaaacattttacagtacatgcctgaaagaaaggagatgaaaagcaactatctcttaacagttttaaggctagttgaattactaccattttctcaatcacatgaagcagtaagaatttataataaaagagtattgtctctgtgaaatgaattgcagattttgatcactgcctctagcttaaccacatattccctatctctacagatagcgtgcagtaaaatgagaaaatattgtagattctgaagaaaatgcatactaattttgacaaatatatatgggttacaaaataaaatttgattagtttccaagtctctaggcaaataaattggaaaatacataaacatgaagatacactgaagtttaagaacaagtgggatgagttgattcaaaggacgatgtattaaaacagtgacacaagaagaaggtgcccaggagagtagggatcaagaaggtccaaaatacatgaatgcagaggactga

SEQ ID NO: 39436 - DNA, 1564 bp, Bovine  19866880885687
cgatggaaagtttagacatattaagttttccaagtgaagaatctgcttccaactgtacttcaaacagtgataaaatcactataataatatctttgtactataaaacatgctgaatgcggcttttagccattatctgcgttgttttactttgctcaaataaattaaaactcagccattgatctgagataaaaattaccattttaatatgcacttaatatttggtataattttagaaagcagtacagttagacttttgatctcaaatgagcaggtgataaaagtgtcatgtaagatttgcttatattttacaatttcattaaaagaggattaacttttcagagaaaatatgagaaaaaaactaattaaaattaagagcaccaataaatttaccttagcagtgtcacataacattttgcaaatgcaacagaattgtggtagcaaagtgaatcattctaggaagtcttaaaacaaatataggaaaatccattcttacacaagtcagagcaatcactctgatttgtcaggcacacagggaaacagtgaaagagaaacaaggagttgcctctaccagtagattctaaaatgactaggagtgcccatattgctaaagtaaagtgaaaacatgctttaatttcctttgacagttttgcccaaaccataaatcagacctattcctttcaatgtttctcaaaaaagtagggctgaaaaccagtagctcaagacacaagatattttagagacacaaagttgagaaatttcaggtttgaacagaatcttagaaacaagattatctttttgaacatactcatactaacactgacagtgacctattcggcctaagacacaaaattatttggcgagatttaaattggaacccagccacattggtttccacgtgtgttcctttatgggttacttgctggaagtttctgatgtacatgcttgttatctgtatagccccattcctctctttgtctgtctgtctctccctctgttttcattttattattattaatattattacatctggagactcctatgattctagaaagtctagtcccactctttgatttgggagtagaacgcgacttgcccaaaccattttgtttatttcatcctatcagccatggtgatacattcagagacaaacacatgtttcagtttctgcacatcaaaggcaactattagcaaggtgaaaagacagccttcagaatgggagaaaataatagcaaatgaagcaactgacaaacaactaatctcaaaattatacaagcaactcctacagctcaactccagaaaaataaacgacccaatcaaaaaatgggccaaagaactaaatagacatttctccaaagaagacatacagatggctaacaaacacatgaaaagatgctcaacatcactcattatcagagaaatgcaaatcaaaaccactatgaggtaccatctcacgccagtcagaatggctgcgatccaaaagtctacaaataataaatgctggagagggtgtggagaaaagggaaccctcttacactgttggtgggaatgcaaactagtacagcca

SEQ ID NO: 39437 - DNA, 1883 bp, Bovine  19866880887660
ctattgtttgcagctattgtattactcctgatctcatcacttattctctcctttgtctactagaatcagctgaggtgtttgtgtgtgatttttaaatagttttgttagtcttctttttgttgttgttttatttttatttttttcatgacagcaccttgtagggcttgaccaggccctcatcagtgaaactcagagtcctaaccactggactgccggggaattcccatctgaggaattttttttaactgatgctcaggccactaacccagaccaattaaattggaatttttggaggtaaggtccaggcatctgatttcaacatgttgtcaaacttgaaagccaattacctagatgatttgtcctctccaattctgtaaggccaagtggaaaacatggtctgaaagatataccagaaaagatcagtgaagggggggcaacatcttctctaagcccaagttaaagggatctttctgctcccttttgtgtgtctcttctcacaatatgcagaaatccaaagagccaatattaggtgctgacctagataaaagaagcaatgacaaaggccactgaaatctacctctggaccagaactttcagtaaaaaggctaggagtgccttctggctaagtagattcattccagcttctcagaggtaggaggttctagaggcatttgagcacagagtgctatctcataatagataatgtccttttctttgcagatttctctatgcctctattctccagggatctagcatacaaattaggatgggcatatggatatctggtcctgatcatctccatcacaactgaccatgagaccattcccacatcccttgtccatgcttgcttccctcgtgggtaaaccagtcattttgttcctgaagacacaaggtttctgtggttaccatgctgttagcagcatagctcttctcttccaatgcacacatcatgtcttcacaccagattcagtttgccaacatctttgcatgcatgtaccaatttattctaataggaataagtattatcatgcttactttcatgcctgcctatcattttctttttcctttttgataatagtaaaataaggaccccagattaattttctatcttagtgttttatctcctaaaatttttacccatgacctaggttacttagacttttgccgatctgccttatagttattttccataatcactaataagttctgcatattaaaattgtagactgttcaacattgccatcatgttgaaatacatctctatatgtcaatatagccagctgagtaaacattaaagcataattgaatttttcagcaatgacattttaattaagaaatgttcttgggcttttaagagttcaatatatttctttgtaagaatttgccccctcagaatttgcttgaaaaatatactttggcctgctactgaaatcacttaccactgttttatcccagtagtatggataaagcatatcagttagagtcaatgtaacctagagcatgaataaaaattttaggagataaaacacaaagatagaaaattaatctggggtccttattttactattatcaaaaaggaaaaagaaaatgataggcaggcataaaagtaagcatgataatacttattcctattagaataaattggtaaaggcattgatacctttagaattttgttggtcaatatttaatacaaaacagtaagcacaaaaatggaggccatgaagtaaaccaatactgcatactttacaagatcattttagttactttagctgtctagatctagaagtttaacttatatgtgtctaacagcaggtgaatctatttttagcctgagataaaatagcatctttttcctctaattatgctctttgggaggaaaaaaa

SEQ ID NO: 39438 - DNA, 2296 bp, Bovine  19866880895563
attggagtttcagtttcagcatcagtccttccaatgaataatcaggactgatttcctttaggatggactggttggatctctttgtagtccaagggattctcaagaaacttctcccacactgcagttcaaaagcatcaattctttggcactcagctttctttatagtccaactcttatatccatacatgactactgaaaaaaccataactttgactagacagatcagtggccttcctttataaattacagggaggaaaaggaagaggaaggacccagtactgccatttgaagatcaaagacttctcatcccattcacttagtgcctatattagtgactccttaattaggttctagaaaactttagggcccaaagggcctatgagttaaaaataaagaagagtaatgaactaaaggatgaaggttaagataaagcaggcatgtcttagaagattttccacaggtggaacaaaggaagagcaggaatgattaacaagctctgtttttttgttattttacttccttcagtgaattcaagacttcatcacatgtatcatttgcttgaatgaacttagtagatttatgctgtgggtcctcatatacctgttaccaatttcagagttgcagctctagacagcttgacaggctcctccctttcagagcactgtcataaagcaagagtagttagcgtgaggctcttcagcagaagaaatgcacatgtaagagcttgcatttgtaggctttaatgaagaatggaagaacagaggtgacttcacaagactattttcccagcttattcccagctgtttatcacaataatttctgcctaagtttttattcaagcagggaggaaaaagtgaactgcagagctatgtcttcccctgttaaaaaatcagcattttctcttcacagtaataatggaaaatgagccatctagagagaacactcaaaataatctatttgctgttttttttttttaatttggtttgttttagtctatcttttatgatttctccacaatctatgttaaaagaaaatccaaacttgactgctaggaaactaatttacttcagtagatttcctttttataattgcttaatgaatattgatgaaatgtattgagaatcactcatttccttctattacttatcaattgaacttgctgtcttcaagttctattgacagtgtatgtccctcgagtttaaaggagatgtactgaaatatcatagtatttgggtgtttgttttttgttcttttagttttccctttttttttcttttgggtagtacaaaatcttcaactacatgccccaaaagatggatcactctaaaactatccagaatggtttgtaaatagcatcttaaggaatcggtctgcattgtgggagctatctgcaggtcagaaagagctttataaagatgaagggctgtgaggatcatactgctctgttctaccgttcagagatgtgtttattaagcacaaattcatggtcttatggaatatagggctgcaccaggccttagagattctctgcccttcattttatagaagatgggcccgtgacctagtaagggaaggtgactctgccagtactcatggtgaaattagcaaaaaaacaaaaacaaaaacaaaagccagaacaaagacccctgtctttgggagaaactatttgtggcaagtataactgacaaaatatttctatctaaaatatataaagaattctaggaaatcaattttaaaaaagtaaaacaagttcattaaaaatcagaacaagatacatttattcttcagatggaccttctgctatctcagaaacttaaggagagaggcttatgccagtataggttggttttctttgaaaagttaggtcagaaaagaacccattcaggtgactagagccacctgattatcaagaactcatcttcttttctgttcaatacactttgttcttacagtacaaactacctccctttcttcaggctttaagtctgagttccagaattcaaaaaaaaaaaacaaaaaaacaaaaaaaccagaagggaagttccagggactaaaataaaagatgtgcaaacatgctaagtcatttcagactctgtgtgaccctatggaccatagcccaccaggctcctctgtccatgggattctccaggcaagaatactggagtggattgccatgtcctcctccaggggatctccccaacccaaggatctagttcacatcttttctgtctccttcattggcaggtgggttctttacaattagtgccacctgggaagcccaaaataaaaaacacac

SEQ ID NO: 39439 - DNA, 936 bp, Bovine  19866881028017
atttggaaggttttgcctggcaagtggaatctgctattgaggaaaggagcccatatgttatgtgggaaagaatgtggatgagacttaaaagaacatatttgtgtaattacccaatcatataatacagattcagccttcactgtagggtgcctctatctccatctctatatcaaaggaagcagttcaagtagatgtttttaagtgtctgattcaactctaaatttcagtgatactgagtaggaaaaaaattgtaattttttgagggattaatattagaggttaaaaatatatatatttctaatggtagaatgtctctaacatagaccagtatcatccaggaatgctttaaaatttccttcatttctgaaaaaaaaaaaaaaaatgatgtaaaatcctatgttttagagtttaaattagttcttcttgaatgaagataatgaatttgatgaatggcttctagtatttcagaaaccagtataatatttttaatgaagtgacaaaaaattactttatttttggtgaaagatactaggaaacaaaaccaaccatcaataaaaatatcatgatgaaaattcctttaaagaaagaacattttagcataaaaattaggaagcacataattgtagggtaaaaagccaataatttatgctgaattctttatgaaagaactcattcattttcctaatttatttcatttggccattaactgtgaaaacattatctcggaccagcacagatcagaggattggctttcaaaagccggtggattagatgacctctcaatttctgtctcttaatcccatcatttccttaaatctgtttaattatcctgcaaaatagattcacagcggtggcttttgcaatttcttcttgatttgagcaatttccctgtcccttagtttaagtttattctatttgaccgaacattgtcattga

SEQ ID NO: 39440 - DNA, 1302 bp, Bovine  19866881095550
ggtccagtgtcggcgatccaatgctccgaccttcaggtgaactttaatatatccatatttcaactagggaatttcaaatgaagcttgctcttggcttggctttgtgtttccaagcggctcatagctctttgtctgaaagcactgggtatagcaatgaactcacaatggtatctcaataaatgctggcagaactaaagaagaagccaggagcttctccagttgacattctatcagagtgagcaatattgcctaaaatgctaccccttcgaacacgttcaaggactcacagctgggatgctactgcctgaaaaaagtacaatcacaaatatcaattttcattagttcttgaactgacatcttggtggctgagtagattagaccagtgtcaacttacagtgattttcataatccacaattattttttttcaagcaggatttttaagagattaaactgagatgaaactatacagagtagcataaatccataaaacaattatttttatcagaataagcagtccatttagggtacaaggaggacaaaagccaagatgagctaaatatccaaacatgaactaactttctaaagttctagtctcagtatatagtcttgctgctgctgctgctgctaagtcgcttcagtcgtgtccgactctgtgcgaccccatagacggcagcccaccaggcttccccgtccctgggattctccaggcaagaatactgggaggtggggttgccatttccttctccaatgcatgaagatgaaaagtgaaagtgaagtagctcagtcctgtctgactctgagcgaccccatggactgcagcctactgggctcctctgtccacgggattttccaggcaagagtactggagtggggtgccatcgccttctccgatatattaagctagaaggttgttaaagaaaatactacagttaacagaacattttgaagagttttacaaatctttatcttcataactggacacagtaaacttggcagaaatgaattaagtagacagtttctttcaaacccatgcatttgcaaagagcctcagtacagaaagtatttctggaaaccagtttcaggcacatggagttatgaaaaagacagagcttattttggcacatgggatcctgaggacatgagagaagtggaagttagggctgaactaaactgatgggtaacttagatttattgactccatcagcaggtatttgctagatgtgtgcgtgcatgctcagtcacttcagtcatgtccagttttttgtgaccccatggacgatagcctgctaggctcctctgtc

SEQ ID NO: 39441 - DNA, 989 bp, Bovine  19866881203233
tttcctgaaaatttaaagtctggcacaatactgcactaaaagtccatttatcttgtctatttttataaagcctcactgcagcatctggcacaatgcccacttccagtaataaaggtccccaaggacacttggcaagagagacttttctcccaagaccctgaaaatgatcctgagcttcctaacacacgagttaaaagcttgactaagatttgtaatattatcttctgtgttatttttttaaagtcggaagtgggtgaaaattctgtggaggtgaagggaccacaaagacggcaggtctctgagctccacctctgcattgactaaaatcaggggcttactgagagctcaagatttctctgttattatgaaacataatggctaaagactgtctacatggggcagcgcaatgattcactcttgtttaatcaactacaacctgtgttaagctctatcctcatctcaatataaaccaggttaatctttccactttcctgcaggaaactgccatggcgcttgtttattcgactcccctgatcttgagtaaatccttcccttctcttccctcctcccccaccaatcattttgggggaaagatttccagcacttccaatctaagactgattgggctttcctgttgatgtcaagttgaagcattccactgaaaaagcaacctcaagacttgacttttctcgtggctctgagctgagcaagtgattacaccaagcgtatccctctttcattctaggagagagaaatagtctatgaagaattgtttgcttggaatgtttttctgaggaactaaacacttgtgtcaaagacactacagacgtgctccatccagtttgatatgatgttttcccttttgtgaccacagtttcacttaccagatccttcttttagcatggggtacactaatgggaaagtcacttcatcagttctgtgacattcaaatcaatgggctattttgcctcagtgatttacctcataaa

SEQ ID NO: 39442 - DNA, 719 bp, Bovine  19866881208780
cgaagtaggtggtattcatggtacgttccggtgaggaatcagtctcagaaagattgaacacctcccagaggcccacctccaaatatcatcacatccagaactaagtctcaacacatgaattctgaagggacacaaacatttggtctccagcacccaggatcacatagcaattaaataatagactcaggaaaagaataggtgagcatctaaccctaggtcctatgcttactctgctctggtgggaatcatttccttttccaaagaaatccccacacaacatctgcaccacactggaaatatttcctcatttctaaagccttattttccccctctttttatacttaatactatgtttgaggtgggcaatcaataaacatttagcaaataagtgaggaaaaaagaaaccttgtacacaggtatatgtgcattcattctatgtcttctttgtacaaactgcaaaacttaatagtaagagcctgtgaatataaataatattcataaccaaaaaagagcttagcagttcaggaattgtgacctctgaaaggctgtgtcccctcaaagggcacggtgtgctaatcagcaaaatgaaatctgtggattctgaacaaattgaacatatgcatgaaaaatgtttctaatttttatattattaagattttataagatatgtaatgattctttggcatactttgttacaatgctcattataaaatctgcaa

SEQ ID NO: 39443 - DNA, 848 bp, Bovine  19866881237466
tgcattctaggtggaagtttaggatggaggcttacagggtgaatttggcagttgtctttgttttatttagcctgcagaaagtttatgtaaacaaggagatattatggttgatcaaatcataactagattaacatctaatatcttacctagcagctttattgacttgtgtgtcctgtctggccttgaaaagcagttgagtttttgaatcccatgagcatctctttttgtaagtagaaatggaaaaagaacaatgacattgaaagagaatggacaggaacaatcttgaagcatagattacaatatttagtcatgatgcaatgaatagtccagaagtattttcaaaatgtttgagcttagtgcatattactatgcacaacatgatcaaacagaccccaaactaattccaaaactcatgatgtgtgttttacaagttgagtacagagtaaatattataacttgcatgtataccttgcatgaacaaaacagatggaattgtgtctttggttatgtctcagaaaagtttcaaactcttctaaggtaattaatttaaaaaaggaaaataaacttgaaatattcctaatgcaacaaagcaaaaaaatctaatctgtaatatttttccaaatgttggaagttaagtcttaacaaacccagcatcataaaactgaccccaaactatttctatggttcataatttgtgttccatgagtatggagtaaatgttaaaacctgcaggttatatctcaggtgaagtcgaacccatggtggtttggaacttttccacaagatcactttttacggaggggggaagtttaaggaatatatgaaagatatatgagggctagaaaatt

SEQ ID NO: 39444 - DNA, 1844 bp, Bovine  19866881269678
ttttgggtcatgttcaatttaaacacactcccatactctataacacatttgcaacatcaaaggataggaagcaggagagataatcaaatgtaatacttgaatagccaagttcaaatccttttaccgtttactacttataagcatttaggaagcccctgccaggtactaatttttacattaaacctttcctctgctatcctattttatccttttaacaaccttacaggatggctacactttgagcacttatttaacaaagaaagttaagaacccaagtcagagtcagcagctgaactttaaataagtcatttgttcctgtgaaatttaattttgtatttataaagcaaatatttttattatagcttggtagtttgttgttttgctttgtttgttctatttgttgtgagacatcattaaatgagatgtcagtgtgaacttgatgaactgttaaatacagatatcactataaaaacttgcatgaatccatgaatagaccctctcgatatttctctatagctaccctcggtggagaggtagaataaggtatattatgattatggactttttgaatttaggttgatttagaatcattagagaaggaaatggcaagccactccagtgttcttgcctggagaatcccagggacgggggagcctggtgggctgccgtctatggggttgcacagagtcagacacgaccgaagcgacttagcagcagcaggctcctctgcccttgggattctccaggtaacaatactggagggggttgccatcccctcctccagggcatcttcgcaacccagggatccaactcatgtctcttacatctcctgcattggtaggtgggttctttatcattagtgctacctgggaagcctgtgttgaaagatctcctggagaaagcaatggctacccactcgaatattcttgcctagagaattccatggaccctggagcctggtgggctatcgtccctgggctcacaaagagtcagacatgactgagtgactaacactaatcggctatcctccaatataaaacaaggaggttttttttttttgtttttgtttttaaagagctaaattgtcttgctgtgccttccacagccagctggagggcatacctttaaaggtgggagaaggaggtttccatgagattttcagaaagggaaagtggcatccacagagagcatcccaaactggttaagtgggagatgatgggtccccagtcccttccccaggactgacttcccctccccttccccttccctcttcactgcctgcctccaggaaatcacccctccatggccaaccactctgacccatgtcacggtactgttgggcagttatgtctctgcatctgtgaacgtcttgctggctcctctccctcgccgccggtccgtagctgagagtgttagattgagaaggggagcacgtccctgaacctgcactcctgctggcttcacttgctcaccgggaggtctgcgcccacgtgtgtgttgtttcagaggttcagggagaccttgattctcaaaatgcagactttttgtaattcactagttttattttactagtcccttgggacttcagtactaaaggacttcttgctgcttttttattcaaaggagtacataaaatgcagatatacaggttaaagaataataataaaataaagcatccatatattcagcattcagcttgagaaatagagcacttccaggacccagaagcccaggtggatttatccccaacacgttgtaccactgcttcctgagtttcatgctaattccttccttactgtttttttttttttttaaagaaggttttaacaggtgtgtatgcattc

SEQ ID NO: 39445 - DNA, 1844 bp, Bovine  19866881412060
aagaaaaagaggagcatgttacgactactcaatcatggtgatactttactttctatcatagttttctatcaccctggaaaatgggcagacagtactgccttcattctacaaggtgaaataatggagacttgggacagtaagagtgacatgaggaagataagccaattagtgctttatccaacctaaaccagagtgggagggagatttgactccaagggaccacagggcactgccactcagaagaaagttctgctgaaaccagacagccttgtgcctgtgccagacttagttaactccacccaagctttccctcccactagacttaattagtcatggctggtaccatgcacatttaagaatcatgtgtgtggaattcattacaatacaagatacactagctcagagatgcactgcttccctcagaaaggggaaagcattcccacaaatagcagagccttaagttgcagatgatggaaacccaagagcagggaggagccaggaatgaggaggtaggagcctcagtgagtgggttggatgtttacttgaactccttgcctcactccatccattttattactaaccggtgcaggacagtgatttttacctgcgcgatatttcccttggagatttagttcattgggcagctaataagttttgggggatctgagtgcccctgaagcttagacagattttgttagaaaaagattcatcttgcataattttacaatgtaaattaagcttaactttcagtatggtggctcagaacttttagtactgggagattgctggtctgatgtgaagaactgaatttactgtgtgctcagctgtgtgggggctttgcagcatgctgaaatgcctaaattgtttgtgactcaggaaaagaataagcccagaatcggaaccccaatatatatataccccatatatataaatctgaattctccattttccaaaatgtgttggacctccatttagaaactgaggaatcaaggtaggaacctaaatatataggaattccactgcatctataaataaggaacagagaaaatgaagttgtgtctttgaaaatatctagtctgtttttggagagctaaataaatggagcaaaaatgatgtattggcttatagaattctggagacctttaggagcccataggagatatagtgcgttttctcaggttaagtctctaccagttacaaagcatctaaaacctcactgctgtaggaacagaaccaaagtctagaaattgggacctacaatccaagatcgaaagaaatgatatcagtactaagtaacctggttgagtctagaaacattttactcattaattcttctttggcttccctcaatgttagaggaacaacattcttaaggcaaaacacctttgtgtaggtgaaataattaggtactaaacacattataattacaactcccacatatctggcttctgagtaagcaagtgaaacagaatggaatactaaaagatagttagtcagtgattgggatttcagctgaaaccctctattcagttcagttcgcttagtcatgttcgattctttgcaaccccatgaaccacagcatgccaggcctccctgtccatcaccaactcctggagttcacccaaattcatgtccattgatttggtgatgccatccaaccctctattaggacagctttgaataactttccaaagcataggtttcagggagtcctgtttaactgctaatccaaccatctgggtcactctggctattggtacctaggaaggaaatcacaggggagctaccagctatagggtagaggagaattaggggaaaatgacctggttagtctggggggaaat

SEQ ID NO: 39446 - DNA, 1095 bp, Bovine  19866881423062
taaagcactacataaaaacactcttttccaatgatgatgaaaacatacaataaaccaaggatagattacattataaaaatcacatcaaaagaccttcaatcaaagctagtgataaaatattcaggcacagaaaataggaaaggaccacaggttgttgttgatcaaaacgcaagagacagagggggaataaagaaacaaataaagtactgttgcatggctgccaagcataaataagagatcctcagattctgagagcaaatgagagggcctgggaaaccacaggcgtttgagcaccttgttctttttaaagcagtttacaagacaaaacaaggaaacaaatgtaaaaccttaactacagagaaagaaaaatcagaatatcacagagctagctaaagagtgacatagactttattttccgctagtagcagacttaaaagactgccagtcttattgaggataaggatagggaattaattaaaagctgatggagctggtcagatggaagaaggagaatttttttatgactctggctgagacatctgtctgtcactcattagtcccaggatggattgggcagacctggctggtttatctgtttcttcagtcacagccttcctgaggctgctgaattaaagaattacagaaatttgattttcaaacaagtttttataagcttcaggcctcctttgctagaacttataaagaactgtttaagaaatagtttgcaactccaagttaagcaaggttaatatcaaataatgacagccaataattgttctagaaaagttcttaaactagaagcccatggacaatgtggttttcaagaagaccaatccctcacccccgcaaaaaaatcatatgtataattttgtgtatggagtgaagtctgccataaaaaaattagtgtaaactgagtgacttcaaccgcagaaatttgcattctcacaatttgggaggctgaaagtaagtgctcgatcaagggtcaaggtgtaggcagcactgacctcctttgaggcctctctccttggtttacagatacgtatcctcttgctgcttcttcacggggtcttttctctctgtggatgtatacttgtt

SEQ ID NO: 39447 - DNA, 1706 bp, Bovine  19866881854671
tgtactctaatctcttttaaattttagtcttatctcttacatttaagaactgaatgtcagttttggatctatgaacagtacaggtggatcctctatgtagtttggtcaccccagtgcatagtttcttctctttcttctgtatttatgaccaaagcacaggctcactttgtacccttatactgacaatttataaccagctcataaatgccccttatcttctgatttatggtggactgcctcccaccccccgacccccagccacttgctgtccctgacttctttctcctggttcccattcattgctcttctcaggcgaccagtggaaattcgttagcttatgtacctgttgatagaggaaagtcagcatttaaataatgcttatattatctccaagctcttgatgccagcatactgaaggatggaagataactacttgtgatagtttggcctgagaactgcttcaaacatcactgaactttgttgacaatttcaggtaacactcgccagaggaaaaataaaaggcaaaatgagttttggtaatgaaattaattgagggaaagctagtctaactgtcaaaagagaagaaccttgagaagaaaggcagcctctaaaggtcaatacacagcgtgctgtaatctttaccatctgtgttcaggctggtgaaattctgagactgtcatatgcagtctttttttctgaaaataacagacaaggaggaaaaaagacttgcccaacagggaacctggatgtacttagctggatagaaaacgaaaacactatatggtataaacttaggatgacccttaattttccttccccttgacctacatgggtccacagatagtttcagaaaagtagtaccgtggcgaattgaaataattccatcaccaatgaaatgtaatgttatatttacaagggtggaacaccagggcagcttgacaatgtgaacattctccatcgtctaactctgttctttgctgaaggttagaaaggctttctccattttttttctaatagaaaaaaaaaattaaaaagtaagtagaaaatggacttggtttctctttatataaagctttgacagatatattagaaatctgaaatgttgggactctgtatatagtgatgtgaatttctcctgttagaacaaaatgtagaggtttgatacagaattttgataagatttaccaaatataccaagtgtcataaataattccctacactcccttgtctatgaatatgtagtgcttttgcacaaatgagaaatgattgaaaaagaaaaaattaaattctatataatacttatacatgtggatatataagtttatatatttgaatgcatatatgtatttatatcaatacatgtatttgcatacatatatgtatatgtaaaaattacaaaacattgtacactattatttattagttatattattatgcatcaactataactgactttattgaaattttatgtattttgattaattaataaaatattaaatacttttcctcccattattatatataaagtcaaatgtgttcaatattgttcttagagtatcaattttctttttctaaaaatctaatcctttagagatttttaggtctagcttttccagggtatcacgtctgtttattatctcatccaaagacctcattttaatgcagatacctccgtttatccccacaacatccagaattcataaata

SEQ ID NO: 39448 - DNA, 1163 bp, Bovine  19866881884283
aatgcatcatgcaaaacgctgtgtggaagaagcacaagctggaatcaaattgctcacagaaatatcaataacctcagatatgcagatgacaccaccccttatggcagaaaatgaagaggaactgaagagcctcttgatgaaagtgaaagaggaaagtgacaaagctggcttaaaactcagcattcaaaaaactgagatcatggcatccagtcctatcacttcatggcaaatagataggggaacaatggaaacagtgacagactttgttttcttgggctccaaaattactgcagaaggtgactgcagcaatgaaattcaaagacaactgctgcttggaagaaaagctatgacaaacttagacagcatatttaaaagcagagacattactttgctgacaaaggtctgtctagtcaaagctatgatttttccagtagctatgtagagatgtgagagctcaactataaagaaatttgagtgtcaaagaattgatgcttttgaactgtggttttggagaagactcttgagagtcctttgggctgcaaggagatccaaccagtcaatcctaaaggaaatcagtcctgagtatttattggaaggactgatgctgaaactgaagctccaatactttggccacctgatgtgaagaaccgagtcattggaaaataccttgatgcttggaaagtttgaaggaaggaggaaaaggagacaacagaggatgagatgtttggatggcatcaccaacttgatggatatgtgtttgagcacgctgttagttggtgatggacagggaatcctagcatgctgcagttcatgaagtcacaaatggtcagacatgacggagcaactgaactgaactgattgtcatatacagcatactagggctatactagaatctcagatctctagagaggtaaaacgctcattactaccaagcaataacttgtgcactactgtcttacgaatgctgcaaacagtcttaatacattttggaagtgaggaaaaaaatgcacttggtgaagtggtgattatttagaaatccaacatcttcagtcccaaaagaaagacattagggtctttgtccttgacttgtctttttccttttgcaatcactctttaccactctcatttgatctgtcagtttcagtgattgcatctaggcagca

SEQ ID NO: 39449 - DNA, 1172 bp, Bovine  19866880017175
ttatgaccacctagatagcatattcaaagcagagacattactttgccacaaaggtccgtctagtccaggctatggtttttcctgtggtcatgtatggatgtgagagttggactgtgaagaaagctgaatgccaaagaattgatgcttttgaactgtggtgttggagaagactcctgagagtcccttggactgcaaggagatccaactagtcccttctgaaggagatcagccctggcatttctttggaaggaatgatgctaaagctgaaactccagtactttggccacctcatgtgaagagttgactcattggaaaatactctcatgctgggagggattgggggcaggaggagaaggggacgacaaaggatgagagagctggatggcatcactgactcgatggatgtgagtctgggtgaactcctggagttggtgatggacagggaggcctggcgtgctgctattcatggggtcgcaaagaatcggatatgactgagcaactgaactgaactgaactgagaagggtaggatgggggtaagggaagggaggctcaggagggaaaggatatatatataattatgattgattcacattgttttatagtagaaactaaaaattttaaaaaatgaatgagcctgtttatatatggataaaattaaaattgcaaagctttttcttttaaaattcccaggaatgctaaaaaaaaggctccaggatatccatatagatctttcattttgaaatgttgcctgaaaaaatatattctatgttcttaaatttttgtaatcatcattcactttgcaacagaggtcaaattcaatggctctgccaatagacaagacctccacagctctggcttctaagcccagttcattactgaatcattatatgaccttgcacatcgcacttcacctttcagaacttcaatttttttgcttgtcctatatggataatattgtcaagccaattcacaaggtagttgataggaatgtttaattaagtgagatttaaagcaattttaaaatgttatatatgttatatataatatatacagaaccactagatttaatgcaagtctttaacatagatttcaaaaggaacaattcatgtttacatctgcatgggatgacagtcaaggcaaataaacactttctttctatagcaggcactca

SEQ ID NO: 39450 - DNA, 1383 bp, Bovine  19866880071660
ggtgtatctgcatatctgaggttattgatatttctccgggcaatcttgattccagcttatgcttcttccagtccagtgtttctcatgatgtactctgcatataagttaaataagcagggtgacaatatacagccttgacgtactccttttcctatttggaaccagtctgttgttccatgtcctgttctaactgttgcttcctgacctgcatacagatttctcaagaggcagatcaggtggtctggtattcccatctctttcagaattttccacagtttattgtgatccacacagtcaaaggctttggcatagtcaataaagcagaaatagatgtttttctggaactctcttgctttttccatgatccaacagatgttggcaaagaagggccaaaaaaggcagcagatggaaaacacctcatggcagtggtggtggtttagccgctaagtcgcatccaattcttgtgaccccatggactgtagcccgccaggctcctctgtccatgggattctctaggcaagaatactagagtgggttgccatgtccttctccagaggatcttcctgacccagggatcgaacccaggtctcctgcattgcagacagatattttactgattgagctacaagggaagcccccaaaggcctcatgcatctccctaacttttagtctccccttctcataatctcattaaagtggtagaaatggattttaaaattcccaattctttgtcaaaaacaaagagttccatcagtggttgagagatctaaacttgtttatgaaagattcagtggacaaagactgaagagcatagaaacagaccatgctgcacaggaagacaggacttaatatagcagaaagtggatggcaataaaaaaggaagttcatctgcccggaaagactctttagaaacatagtggctgatctgatggaggatgggagtaagaagtgggacagaaaaaaatgcaggttatataaaacctttaaataatgaggagaggcataaaaatcgtgatacagttataaaaaaaagttgaacagtagtggaaaaaaatattcattgattacagaagaaagtcaatagatgatgtctaaagttaagaaaacaactagtgatgacatgtacatattatttatagatttggaggtaaccagagaagaactaaatacagatagagttcagaatgttctggaaggaggaagacagggaatggcatgtaggtctgttgcttctcactataggaagtcttttttgcattaattatttttgagaaaccatatgaatatataattttagtaaaagctcctttttttttttttttttggctccacttagtttgctggctatagaaatttccttctttgtatgattaggttcattag

SEQ ID NO: 39451 - DNA, 1110 bp, Bovine  19866880425799
actgcaggagatccaaccagtctatcctaaaggaaatcagtcttgggtgttcattggaaggactgatgttgaaactgaaactccaatactttggccacgtgatgtgaagagctgactcatttgaaaagaccctgatgttgggaaagattgagggcaggaggagaaggggatggcagaggatgagatggttagatggcatcactgactcaatggacatgagtttgggtaaacgccgggagttggtgatagacagggaggcctggcgtgttgcagttcatggggtcacaaagaattggacatgactgaacgactgaattgaactaaactgaatgaatcaggataaagctaaaatacacagtatctaaaataatgaatggattgatatgaaaatttagtttccttataagttactttccaaatagtagaaactttcattgcatctgttttttacctgtttaatgctcttggttctataatgctcaattctgattgtctaaattagcacagtaaaaatatgtttggaatgaaacccaaacatatgaacatgatgtcattgacaaaatgagtctagattaaaataaactgagtttatatgttatccttttgcaaacaattgcacagaaactagttgaagaatccagcattaatttacctaatatactctttattgataacataattttcctatggctagaggaaccccaaaaggttaaaacaaatgcctgtttacggattccaatttttttttttacttttaagatgaaaaaaatgaaggagaaaaggaaaggaaaaatagcttagccttttggtaaggaatcttagcatgaaattccctatttttttttaatcaggagacttggttaacttttagatttttttttcttttatatatgctaaattcatccttccttaatttggaagatagttccttgttctttcaataacagagacagaaaacaatgagctcacattatctgcataatcttcagatgtaggaatgctcttcttccttctcaatcatacaccatcaaagaaaaatggcagtgagtcctttagaacctttaactgcttaatctatcctttccaacatttccaggcagacacactaaa

SEQ ID NO: 39452 - DNA, 2703 bp, Bovine  19866880502484
atgatacccccttatggcagaaagcaaagaagaactaaagagcctcttgatgaaagtgaaagaggagagtgaaaaagctggcttaaaactcaacattcaaaaaactaagatcatggcatccagtcccatcacttcatggcaaatagatggggaaaaaaatgaaaacagtgacagactttactttcctgggctccaaaatcactgcagatggtgactgcagccatgaaattaaaacacttgctccttggaagaaaagctatggcaaacctagacagcgtattaaaaagcagagacatcactttgctcacaaaggtctgtaaagtcaaagctacggtttttcagtagtcatgtacggatgttaagagttggactacaaagaaagctgagcgccgaagaattgatgctgtggactttgatgcttttgaactgtggtgttggagaagactcttgagagtcccttggactgcaaggagatcaaaccagtcaatcctaaaggaaatcagtcctgaatattcattggaaagattgatgctgaagctaaagcttcaatactttggccacctgatgtaaagagctgactcactggaaaagaccctgatgctggggaagactgagggcaggaggagaaggggtgacagaggatgagatggttggatggcatcaccaagtcaattgacatgagtttgagtaagctccaggagatggtgaaggacagggaggcctgacatgctgcagtccatcaggttgcaaagagtcagacatgactgaatgactgaacaataacaataaaaagtcagaaaagtagaaaaatagctgttgggttgataaacaagggaaatgaatgagtaggtgttttagcaaaagcggattcaggttggaagttagataaatggtcagagattgagcattatttctgaattgcagcctttagtactgcatcacaatgggcatttcagggtcattgaagcagccaaaagagtctggcttctgcaaatattttaactgccaaatttgaagcatctcccaagcagtacaagtgtagatgaggaagtgaaattgttggaaaattctgatgaaacatattttcttcctcctaaagctcaaaaacaattcattggtctaaaattggacttccagaaatagcaaatgcaatgcaattcaaacaataattataatctgagctaacatttattgaacccttccatgtaccaggaatcaagctgttttaaaggtaccatctcattcagtacttcccgtgaaaggagagaaaacgttgtaggtggccataaactatgattccagcctgcttgccctatccacatttatatatgaaattcaacactcctagtaagcaagacaattttaaaaagtcaggtgtgtagggcaaattctacccttcattagttgtcaccacaccagggaagaacgggtagaggtatcattaccacctcacacaggagaggccaaatgaatccatggcattaaaaagaactcaaagaaatgtcaaacgtgaaaaggacttcagtgcataaaagttaaatgaggcaatctaatagaacacatgctcttaaaaccttcagcctcccatttttattctgtaatgtaaacataatattactacctggagggtggatgagaaacaactgaggtcagtttagttctcaggaggagtgaaatagaagaacatcactcatatttataattaaccagattatttctgtaataactatgagagacactcaaaatgcaatggcttgctgaagtttcttcttataactaaaaataaaaaaataaaataagaacatctgcaaaggtatacctggtagttctctaattaatgatcaaaagtgcactgacttcacaatttcacatttttatgtaaagtcttatttgattgtaattagcccagactacagaacataattaggactaatgattccttaatgcaatcagaatcccagaagaacaatatcaacagacttttattggtattagtgatgcaaacttgtaaaatatagagccaattaacctataacaatgcttccaaaataaaaaataaaaataaattatgggtgcattacaaaacagcttcatgaatataccaggaacataaaaactgagttaatagtcaaacctcacaggatcagtctttcttaagtgctaaagatagtcacaattgtgaagaatgttaaaatatgctactcttaatgagattaagcatttaaaggctttccaagatactgcaggttctgtggtgtcaacacagctcccgagagttatgaatttcacaatttctagatcatgtaacaaaattcaattatagtggccataagttttgaaaaactaagtgtaggggaaaaagtaaaggggaggggaacttagtaaacatttttgctttgcgaccctcagagcataacaagcaagtgtaatgtcttgtccattacatcctaagtctgtaagattcatttttcagcctcatgaaatggttttgaacccctctggagaggaaaaaaaattgttttacagatatatatatatctgtattgagacattcctgttgcaatttctgaaaagtcagtaaatagaatttgtcttaacacagtaggactctccagtgaaatttctccaatggaattttgtaatccacccttaaaaagtgggactatttcacataattagattggaaatccaactgttctccat

SEQ ID NO: 39453 - DNA, 1053 bp, Bovine  19866880513152
tgcttcatcagcctctcctcacagtctgcaacatgcacatgacaacctgtatttgtctctggaggacgtgtctaatggtcacaaccctcaagctatctcgtgcttttctttggctcagaactaaaagccagaggagaaagacgatagttttctgtgttctgattgcaaattctggttgcctctgttacactgatattggctcttgtcagaagccaataactcattactcagggacttgcggagtattttacccctgtgagcagtgagctttcataaaactcagaactattcttatttcctcaatcaaattaggtcctacaaaaataggtgtctcatttcatgcaggttagcagcaaatgacagtcctataaaagcagcctttgagctgcttcagtttttaaagtttaatatgtttgttatcactttttatacagtacaatttctttgactatcactattacctatttaaagtacaaaataaggtttccattgctctcaatctcttctctctctgactctctctctccctttctttctacctatctttacctatctctataatttataaaattatataataagccccctaaattaatcactcaacttcaatattgatcactcaatttcaatattgatcgctcagcttcaataattatgtacatgacagttttactcatttcttctctagttcttatcccttctcctgtaagtaagtaactttaatgtatatcccacacttcatctcatttcatctctaaatatttttatatatcttcctgagaaatatgactaattacaacaaaaacagaaagccacattattttttatactttctaggaggatggttttcaaaaacttaaaaacatgattctcatacgaagtgtcaaaaattaattaactcgttaataattaaagcagcatgattgtaaggttcagggattagagaggacagaaaactattagcaaggttggaatagcaattgttttatttgaaagagactgcatttatgctcccactgtaaacaaccaaagagcaaaatatgtaaaacagtt

SEQ ID NO: 39454 - DNA, 1433 bp, Bovine  19866880525726
tatgtgtggactctaaaaatggatataaatgaacttatttaccaaacagaaacaaacttacccacatagaaaacaaacttatggctaccaaaagggaaaggtgggaaggagggataaattaaaaatttgggagtaagagatacacaccactatacataaaacagataaacagtaagaaccctctgtatagcacagggactactactcaatattttgtaatacttatatgggaaaagaatatgaaaaagaatatacatataactgaatcactttgctgaacacctgaaacttaacacaacattgcaaatcaaatatattctaataaaaaataaattttaaaaactacaaaaaaatagtcatctctcatctatcattgcatatccctcctcctttccttaccttttcttctaagccctcatcaccaaccaatacactccgtttaacttctggactgtgtttattaatctgttcatgaagatcaaggatttgtctcttttattctcaacttttttctaagaacacctggcacatagcaaggtctcatcaaggatcagaagaatgaagcaacctctcagaactagtactgaggaatttttaaagagatcactagttatcatagcttcagagaccataatgtgctcatctccaggaagcaagcagacagcaatagtatatgtttacttaagacaacaaacagcatcactccttatctggtatttttgctgacatgatccttctttcttggctgacagaagccaaacactaaatatagatcaatggatctcatcacaatgatgacaggcattcgatagccttgctggatcaatgaccccacagcctgtacctcaccagactctctcttagtagagaaaacatagcaacataatacatcactcacttattattcatcaatccattgtttttccacagccaagacacacttagaaatgcctctgatttggctgaggttgactaacacctaatctatgtatgccggaaaaacaatagataaagcaaagagcttaaatgactggcactacaatctaaatagggaggatggtttctaggtttctaaaataaggtatatttatctgggtctccatggaaatctgttcaaattccagattatactggacctgagttgttgggtttgataatatactccaaaaatgcagctaatttcaactgcaattgagtttttaattcaaataaaatataataaaccacacataagtaggtatagatgctaagcgggctaacttgtttcagtcatgtctgactctttgcaacgctatggaccgtagccttccaggctcctctgtccacagaattctccaggcaagaatattggagtgggtagccacgcccccctccaggggatcctcctgacccagggattgaatcaatgtctctggcacctcctacattggtag

SEQ ID NO: 39455 - DNA, 1725 bp, Bovine  19866880541009
tctgtggtgacctaaatgggaagaaaattccacaaataggagatatatgtacaggtacagctgattcactttgctgtacagtagaaattaacagaacactgtgaagcaactatatgccaatgaaaattaataaaaataagtaaataaaacagtactagttgtgtttcatacctaatacactagattgctgacgtttaaagtttctttctggtttcttgtaaaaatttctatatttataagaaaatttcagagtaaaaaaatcaagaataaaagcataattaaagaaaaattagattaatggctctaaagtaagactgcctgaatatgagctgtgagtacaaataagaaatagttgattagttttgaggacttaattcaagtcttatgagtttaaaaacttctggattattagattaatactatggcaactgaaagtaatggacactaggagcactatcattattgttataaaccctcacttaatgtaaccctaaatatgtaagcatttcatataaaaataggaaatagctattctaaactttgcgtatattaaaattagaaaagagttcaatacagataggtggcaatgcaattaatacagagcttaatgtatttcttagtgattagaaaacaattattgatcaccaaactttggaaagctttaaatcaaagtttttactacaaaatagtttctggaaaaaattcaagaggagctagatgaaaggttttgaaactaatatttatttttctaactttgcttgctaatttgtggatttgctgctgctaagtcgttcagtcatgtccgactctgtgcgaccccatagatggcagcccaccaggctctgccgtccctgagaatctccaggcaagaacactggagtgggttgccattgtcttctctattgtgtgaaagtgaaaagtgaaagtgaagttgctcagtcacgtccaactcatagcgaccccatggactgcagccttccaggctcctccatccatgggattttctaggcaagagtactggagtggcttgccaccctaatttaattagactaatgccttttgtgtggactggcttgtagaaaaggctgcctgccaaactgaatttgtgtactgttgtatctcctaacagaagtaaagatattaagaagaggtagaaaaaatacaaaaggaactatacaaaaaagatcttcaggtcccagttaaagacaaaaaagatcttcatgtcccagttaatcatgatgctgtgaccactcacctagggccagacattcctcaatgcaaaatcaagtgggccttaggaaacatcactatgaagaaagataatggaggtgatggaattccagttgagctatttcaaatcctgaaagatgatgctgtgaaagtgctgcactcaatttgccagcaaatttggaaaactcagcagtggccacaggactggaaaaggtcagttttcattccaatcccaaagaaaggcaatgccaaagaatgttcaaactaatgcataaatgcactcatctcacacgctagcacagtaatgctcaaaattctccaagccaggtttcaatagtacataaactgtgaacttccagatgttagctggatttagaaaagtcagaggaatgagagatcaaattgcaagcattcattggatcatagaaaaagcaagagaattccagaagagcatcttcttctgcattattgattatgccaaagtctttgactggg

SEQ ID NO: 39456 - DNA, 1834 bp, Bovine  19866880601917
atattgtttccctaacctatacaggtcacaaaggaataaaataactgctttcaccaaaacccaacataataacttgtactctccagaatgctagagttcaaaaatattaccataaatattataactcaagggtgttactttaatgaacttaattatggaaaacaccaaatgcaataatgtgctaacaaaacagcaatttgaaacagatgggcaattacaacagcttactacagatggcatagcagtacaatatatttgtcaagtttggttctgatcagaaaagtaaattgaagacacttttctactggtacaataataacatgaatatgttgaagacagaaatccatttttacaaataattttggaaaatgatgaattgtgctttccatgtaatgaaaaacactgatttttaaaaacaccattataaaaaagtacagaaaaaataaaaacaaagttattggattggaaaaaattcattccagtctttctgtgtcatcttaaggaaaaacttgaatgaactttttggccaaccaaatatttaatctttaaattcaatctatttgccaaaataggatgtaaaattcaaaactaagtattccacgttgaaatgcaggaccacttcatattaaaagaacccaaatatgaggggtataaaaatggataagacattaactccagagaattaggtcagttaaggaagagcacagaattctgatagccagtacagacaagacatcatctactcctgtagaaaaatgaaaagactggtgacaatataaaggaggggaagaagaaagaaaccatacctcccaattataacctttgcacttcccaatattccttgccttgaggcatgggggtaaaactgtgagtgaccaggaaggcaagactgagacgagagaagattatgtagtgggaagtaatggttttaagaatcatataatttatactagtgacttaacaaatgttttaaatcatgattttttggagggggagggtaatgttctccttgcatccagtgattttcaaacctgcattggaagagttttcaaaacaaacacgtgtctttgaagctacctcaccccaaaagaagttttgatgcagttgctctggggtacagccctagtattgagatattataaaatattcactggaaggactgatgctgaagctgaagctccaatactttggccacctgatgcaaagagccgactctggaaaagaccccgatgctgggaaagattgaaggcaggaagagaagggggcaacagagaatgaaatggttggatggcatcaccaactcaatggaaatgagtttgaacaaactctgggagacagtgaaggacagggaggcagagttgcacaggacttaatgactgaacaacaacaagaaaatccctgcagatgatgcaaatgtgaataggaagcattcagaagtatgcagccaagttcagcattatgttggttacgtatccaacatttagccttgctctaagactctaagcccattgtgatggtcctttctccttgacagtgatagggttttaggtgcagacttataacgaatcctgtcatggagactgacacaaagggtttctgtgactgggaaaggtttcctagatcctaagaaagaggtttccacagagatgatcctctttctgtttctggactgttttgtaccatgataaacaatgccttatgtttgcttttctatggaatagttaattttcttggaatttaaaagtgtcacatttttcatttgcttagtttactttggtctatagctttttcttcttacacaatacataagtcattcgtgataatttttcacatg

SEQ ID NO: 39457 - DNA, 1588 bp, Bovine  19866880669007
ataatgaaaacctgattcagtggtgatggacttgaagcctttgttgtctggcaatgtcttggaagctatggtgagttggctgggctcctaggtttcagagacagcaaatagtaagaatctctgcatcaaaaaggagtcccacaaagcatatttaaagaaaggtgaattggcaaccttaaactcagcaaacacactcatccccagaggcttgcgagacatgacaatcccataattggtgttctctgaagaaagtcatgtttactttagaataacaatagaagcttagctggcagactcgaggggcttaaagatatttgggagggcagcactgtacataattatatccttgtaaagaaaatagataatccctccaggaatggagtattctcattcatccaaaatctggcctgtttgtcaaccttcatcttgcaatgacagcagggggagggaagttacaaatgggtctcatgccagtgccagtaagtaacagtccttccttccggcttctcttcaaactgctgaaatagagccacctcaacacaaagtccaagaattgccagccttggggagaggtcaaaccacagacacacattgtaactttgggattttcagaatttaaatcataccagaaagtcctcagaaaacaaaatcccctgactttggtggtttaaaatttctggagtgccatttgatggaataaacttggtggggtccaagtcagttcttctgtgtactagctattctgtgacttagggcaggtggcttaacctccatgaagtcgtcaatctctgcttcctccctcatgactttaataaaggcctgaaataggtaataaatggtaatcagctgggaagatcccctggagtaggaaatggcaacctgctccagtattcttgcctgggaaatcccatggacagaggagcctggcgggctatagtccatggggttgcaaagagtcggacatgactgcaactgagcacacacacacaagctccttgaaaagttataatgtctattgaatagcagattaatttcaaacctgaatccttcttgctgtgttcaaatccattttcttttctctttctttccatcctttaaaaaataagtatttgcataccatgtgaatggatattcagaggaaattcagaatggggagatccatagagacagaaaacagaatcatggttgctctgtgttggggggcagggaggatggggacacggtgggagattaagggtggcggatttcttcttgaggtgatgaaaatgttttaaactcagccgtggtggcaaatgattgcatatatctttgaacatactaaaaactgttggatggggcactttaaatgggtaaattgtatggtatgtgaattatatctcaataaagccttttttttttttttggtaaaaaaaaaataataataattatttgtatttcatgaaagagatttctttagaaagatgttttaagttgaaagcattagcccaatcgatattttttctgtttatataggatatataggctttaactaacatagcataatgattaagagcaagtattatggagccatgctccgggggattaaatc

SEQ ID NO: 39458 - DNA, 1142 bp, Bovine  19866880693845
ctcatcgtttgttgtccccttctgctcctgccttcaatttttcccagcatcagggtcttttccaatgagtcagttcttcgcattgggtggcaggactactttttgaaatcacttaagcttaatatattctagaacctcgtgacacattaacgttttctcttttttaccaacagaattgtaagaagataagacatcatgctttcctgatgtcctgaattccagggagtattgctaatgagcatagcagcagaaactcttgggggtttgtcaataaaacttctttataatagttttactgtcttattttatcatatcttggcttagtagggctaaatctaaggtcatgagtgacctaaaagaattctagtctttgaagggtttgctcagaacttcccagtattcacagtaggcaagaacaaaactggcttctaggaccaaatccaaaaggaaaatcccataattggcaagaaattacttttcacatatttcctatcatgcagtgggagctctgggcccaccatgctactgtctcttaatcactacaacaaacaaatctttcctactctaaaatgcattggttctcaaatatcacttactccaaagtctatcagggagttagagagaacagaacaaaagaacgagccatcagaaatggcctttcttctatctagtagaagaaaagagaaaagaatttcagtctacaaactttattcctattttggctaatttatacatgctcctgacatcacaaaaggcagaagaggagaggaacagtttatcttttcaactaagggaaaacaaaaaagataattattatttatatgtagtttgaggcaaaagagaaagaaaataaaaaatgctacaaaatatccctagagactttttgcacaaagatgttatgtgtgacacacacagacacacacacagagtagtctttcttctacagataaatgtgccaggaagcagttctaaggctgtattgcgctctaacacttttccttgttaaaatacaaggccaggcacagcacaaaatgactttttaaaatatgaactcttggtgtgagtccttccataacaaagcttaggtgtctaagacaaagttaaagtgaaacatagagccccaagtgatgttttataaccag

SEQ ID NO: 39459 - DNA, 2606 bp, Bovine  19866880742499
agtctttgatacctatcgttcttttgattcttccttgaatttacatccctatgcttgtaatgcccatctttggttgcactttgtctatttgttttactttagagactttagcatattaatcatagttgtcttaaattcccatagttgtgataatgccaaaatttcactctatctgagtctgaatggtgtgcttcctatgtcttttagactgtattttatattttagtacaccttttgtttcctttcttttgtggaaagctagacttaatgtactgagtgtaaggaatggagataactagatttttagtgtgaagttttatacttacctagctaggagttaggtcatatttgctgatgctctaggtgttaaagtctaaaattttcctctggtgtccttgtttttcctcttccttctttttctaggggagattccttagataaatctccctaaatctaggacatgcaattctttctgttttaatctccttttattatgcaagagacttattgatgatatgtcagattttgaggagaggaggagtgttttctagtcctgtgattatatctcaatcttttattgaacttgtatcccggcaacatagtcttcacaaacattcctcagtccttcttccagaggtaaaacaggaaggctagagggtagagttgaagtttttccttccaataggctaattaggcttggtaaaatcccagctggttaggctttggtaaattagtttcctttgaggacaggcttttaaaaaaaattctctgggtgtatttcaaaatggctaggattcccatttcctgctgggagcatgaagagatttttatcttcactatgataacctggtaggacttctggaagtgaaacttatgaaaatgtagatagaatatctactaggactctccccaagtgccccagagattttaacggaaaagcttgtccatactcaaccaccagaaatttgtcaatttcagttcaagttttcctaccctggtactgactccagtggcagtttctgcttctggtctgctcttccaatagtaatttgtggtaccctgtatctgtctttgtctcttcaatgtttggagctgtcatctgccctgtgactacaattttctgatggatctaagatttttagtttgtccagtcctgttgtgaggactgaagtgatgccttccaagctgtttacatgctgaaatgggagccagaagtcaccctgttctcttttgagtgtgtgtgtgctctgtcaatcagtcatgtccaactcttgtggccccagggactgtaacccaccaggctcctgtgcccatgaagttttccagtcaagaatactagagtggggtgccatttcctactccaggggatcttcctgatcctgggatcaaaccatatctcttgcatctcctgcattggcaggcaaattctttaccaatagtgccacctgggaagccctctcttttgagtactatgcagtgtatcagactgaagcaacctttttaaaaccattattccatgaaattgattgtattcattccatttagtcattgaagcattataaattgactcacagactagggaaatatggtgttacttgacttactaggaaaatacagagttcagtggggacatttctgttttctctctcttccactgtaatcaacagaaatatcctggagagctgtgtggttgagttattgacaatattgtcttatttgtatcaaaggtgtatcaatcctgatccacaggatttttgccaaaaaggctcaaatccatttctaaaaagcatacatttttctttctgtgggtctggttcatttaagaaaatatcatcatttatatgtgacggttgacctctaggatgaactttgtttcccttaataggtacaagttttccttaagtacagatacctttcactcttttgttccacctttagatgagttttattttggtgttctctgtgatactgttgggacaaatgtcattttgcttcccctgttttgattatggcaacgtctggttgtcctggcatttagaataggaggacctcatctttacttccataatgcatgctcctgcttgtgccttgctggaatgtcattttcttcatctaggacaacacagagctttaagtaatgtcctttagtagctctctcattgatttctttaacttttgataatcacatcaagcaattttctcttcaaagttacgtgtgcaatgtgataggcagttgtattactcatggtgccactctgctccctcctcattgatttgcctcttgggtttaaagatcttttgtttttaactgtctcattacatatcctgttttgccttttagtttgacaggactttctctgaggtttcattattacattttaaaatagctgtcctatagcctattaaccattccttttctcaaatatcaatgatactgttattgagctttttataaagccttgacttaatgaaatgaagttgttttctctattgagttttttttttaatgattcactttgtttcttttactttattttttttaagtagaaggaatctgagttaggaatttgatctgtagactagacaatcgttcatagaataggaaa

SEQ ID NO: 39460 - DNA, 1071 bp, Bovine  19866880780723
ctggtgctctgtgacaacttggagggatggggtggggagggaggtaggagaggcttccagaggaggggacacatgtttaactatgaccgcttcatgttaatgtatggcagaggccatcacaatattgtaattatcctccaattaaaactttaaaaaatttgaggaaaaaaaaagcaatgtggtttgtgcagcgtacagcccactctatactttcccagatatcacatgctgatgttattttattacttcagttgtttttgttatttataaatatgataatacttaacatcatatttttaaaatttgccttcctgtgtgtacaaactagatagataagcttcaaatggtaaaattcgcaagcagaaacattaattgcattgttggcattgcagagttgcacataacttctgtttagcccttagctttctttcatattttgttcttttgaagtataaacgtttccttagctgagtagagccccagtccagaagtggctaggggctacttacatttaaggagataacatttaaatttaaaaaatgaaattaagtgcatatgaattccaggaaatttgctgtataccatccactgacatcttactagctgttggcaagcatttaatcaatgtttattggcattcttttcagatttaaataggacataaaattttatgacgtgtaaagtattttcaataactgcttcgttattttccatagatagtgtaatagtatacaagaggaaatattgatgaagtacccaatttgcattattttttgaaagagtaagatagtttaaattgtgtatgatgacaaaatgctagtctacttttaaatcagactgtagatttgtagctatctggtttctcattttatttctattttgtctatatcttttctcattttggatacatagtacaggtcagaaaaataagaaacatagctgtttgttctattattataaagagagatggtggcttataatattaaattctagttccttagtgttataaaacaaaggatgccacaggacataggatatagcataggtgtggctgaaacattaattttatgt

SEQ ID NO: 39461 - DNA, 1646 bp, Bovine  19866880785007
tagggatgcagaaggccaatagcatttagtactttatagtgggaaaggacctgaattctgatcctggtggccatgaatcagtggtttcattctctagtgatggcatcgcacttctttgaattagaactcagggctcctaattaaatggataattagtgttatccagcctgttatagtcagcattattatgaggttgtcaaaataaatttcgtagaaatgactagaaaaatagcactcaaaattgaggctggtagtagcaatctcatacaagaagcaatttggataaaccatcaattagttgcatgaggaacgtttcaaatatactttgactttttccagatgatgaaagtacccattctcaaactttggagcagaacttttgaatttacatgaactctgtaggatggtagtattatcattccccactttattcctattcttctagttcttcttggtaaatggacatatatttgctgctacagtgtttttagatattctttagcttatggagatagcatatgttactaggctctttcatgtgggaatgacaaaggctgatggatgtctggttttgtctatggcctcccaaagccagctcttgtctaattgagtcagtgagtcagcttccatttattgagctctcagctgggagtagggtagaactaggcattttaaccagaattgagcatctgctcagtacttaagtagcctgagcctccagactctggctagcctaatggactctccactgtgtctctgccattgaacagtgattactatacagattggggcatatttggtttcagttcagtctgttcccacagatgaggcctgagtatgatcacatcgtataaattttttaaggtgcggcatctgtgtaacctgagccataagtaaaagttggccctccgtctgttctgtcgccctggaggactctttgttttccaaaggagatagtccatcttgtgaactgaccatcattagagtcataaaaattcaaatgtgccttgagcgatttctttactttggcataaagtctcaagtacaatatccaaaagcttaacatcctttcactgaaatacagtggtttaggtttgggtggaagaaatttctggaacactaattgtaatttcaaagcagtgttaccagttaccagttgtagtctgcagaaactcgaatctgtacgccattcatttttatggactctgaaaaatttttttttcaattgtaaaattagtttgattataaatatatttagtcacagattacttggaaaatgaaacagagcacagagattattctcccataatctctttaatttgattgtgaagaactctgggtctagaaacaaaatctacttgttgaaggtcacaccacaacctaagtcacctgatttctggaataacctttctgttacattgtgtcccactcacataatcttattttagaaaagatcaaagtctgggtctctttcatgtacatttctccactctttcagcaagttggaaatagaaaagtaaagaggaactaaatccagtctcccctttcctctgtttgaattacttgctaaagtgtaatcattacattctatctattcttatctttgtctgcataagacctgttcattgagcctgtgcttatgtttt

SEQ ID NO: 39462 - DNA, 1312 bp, Bovine  19866880793693
taagttccttctactcggggccaactggtactgtgtgaggccaaagaattgatgttgctgatgtgcagttaaaaaccagtcatatctgctttgcaaagtaccttagagatcaaaggtttagttcagaattcatacagctggtctctttatgtatttaaagaatttacggtaaatttaatcttactccatgcctgattttttttattaaatttctactgcctgagagtaagaacattaacttttttatgtgcaagaaaacatgtagtttttatattcttttctgctgcctcttatggatgaaatgctctcacttttgtcctacttttatattcacatcctttgtacacaacactctaagtaatttctatagaatttaaaatctgaaaaaaaatgatttaaaaaacacattctaaaactaattgatactgaaaaaattaagaaacctacagttttataggaactctgaggactgattctgtgactggatttcctgacacggcacatctgtttctctgagagtttcctttctaaggaacatgggaagctattattaacacatgggaagaatctatacagagtagattatgttagtcatatcaaatccaattcccttctggagtgaggctgatttagctaggtgattttctaaattaagttatgacaactggctattacaggctgaaacttactcagttaaagatcagagcaaacaatagctcttgaaatttccgtttatacatcagctctatcaaggtgacccaatatattccagctatttgagagtcaccttaaattgcacacaattctactgctaagtctttggtttcagaaaagggcagagtttcccaagtcaggactcaggttcaccagtgggtggtcctcatttccacaccagtaggatgactgatctcccccttcactccccatcatagtcttccggggtccctctgataaaaatcaatacaaacaggtggacttcattgaaggataaaaaaccactaagacagcaagattacaatctactgataaaaactaaaatggtttcactctagagcctgttcaaacatacaaagaaatgactgcaggcaaccatatgcaaatgttcaatcagaaactaaagatctggatactctagcgtgaaagctgagaacccagaaatgtattcctttactatctaatagaagatacaaggggaaaaaaaaaaaaaaacagaagacaaagaataggaaaccttttatgtaatgtcttaaaaacaaagtagagatactaacagtcaatatttcaaataagaggaaaattactagaaatcttc

SEQ ID NO: 39463 - DNA, 750 bp, Bovine  19866880794932
ccccccccacccatatcaccagcaaatatttttccctgagggaatgaggagtggagggtgggaagggatgtttttttttttttcctttgagaaatatagttattcactaaaccaggagcaataattttctcttatgacttgcatggctcttagttacaaaactatcttcccttcaggaatgttaatatgaatttcaaagtctactgcaagctgtgtaaatgtaataggattatgcttctcttgttcaggaccagaattcaaatagatatgaacctccaggcctccctaaactctcaggttactaaggtcaaggtattcatttctatttagcccagaagctattttggggttgtatcagaaggaggttaagtttacatttttatttgcatttctaaaggaaacagaaacctcagcattcctctagcagcagcaagaggagaatgagccctcacttacagaaaaggctctaaaaactaatagaagagcaacaaaactcagacaaacctctgctctggatttgaatacagttgactcttgaataagaagggtttgaaatgcatggctccacttatatgcagatacttttcaataagcataaaggtagctctccatattcatgggtttcatatccaaggattcaaccaactgtggatcaagtcttcatttgtgactggttgaatccacagattaggtattggttgatcagggatacagaggatcattttatataaggaactgagcattagggat

SEQ ID NO: 39464 - DNA, 1530 bp, Bovine  19866880796620
acaagaaatgggagcatcacaggctcttgactcagtcaagttaggacactgtgaccctccatagagagggagggcaatagctgagcgagttctgtgctgtaactgcttcccacacccattgctacatgtagaccacggcgagaactcagacaccacacaatcccgtgggcaagggatgaggcacgcttgttccgtggggggctgaggggcaaagtgttcacatatctcattcacaaccatggttctgttcagcttctgaacacagtgcaccgtccgatgctgcaacccgtgctgggcggtcacacacgctgcagcccgaggcctggcggggcccagagcaggaggagcgagtacacagtggtgccagtcggaaacctcccactggaagaggtctctgtgccagtcacagactcggaagcagcttctttccttcggaggtctgttgtgctcatcacagttagacaggtggctcgtccacccctcagagtggaaacaccacagggcacgactctggcttccgcctggcccacaatttcctgtacaccttccccaggggcctgcgggcagaaaagacaaaggggtcaattactccaagatcccaggccacaatccacacagaaacaggtcaatctgtacaccttgagacacaagcagtgtgaaattgtgaaatacgagaaaaaaaaaaaaaacttagtggttaagaaagtggattctactctacatcagttggcccttcttgaaacctgcaatccatctcttacagcaatgtcaacttggatgagttacctcaactgcctaagtctcagttccccacctacaggaacagataattaaagtgctgacttgtagagtttttctgaggatcaataataaaatgtgattccaagtaacaatatacgtgtaataaatgattggtatcattataattattatgtctcaaagccctatatatctaactcaatattaatactttcaagttaggcagagtttcatctaaaagaatagccccaaatccaggattttaataaactaggatttttcatgtttccaattcttcagctcacaacctaagtatacgctcagaagaaaaagacatttaaaaaaataacttgcaaaagcatcctaaatatatatttgctttctaaatactgtcctcagttttggtttttacttacagaatgaaaaagaaaaatgtgatacaggggtaaaagtgaagttaattaaaaaacagcagcactgaactgtctgtggaaattctgcccctacaatccctgaaatatactggctgggtaaagcttccaagggcatccctggtggcacagtggtgaagaatcctccaatgtaggagacataggatgtgtgggtttggtccctgggtcaagaagatcctctggaagaggaagcatggcaacccactccagtattctggcctggaaaattgcaaggacagaaaagtctggtgggctacagtctatgaggtcgcagagtcagacatgacctagcagctaaacaacaataacttccaacata

SEQ ID NO: 39465 - DNA, 860 bp, Bovine  19866880814667
caacttcacagcagttagtatatcatccagtaaaagtaggaagagctcagtaggtatttcttgaacaaatgaatagaaacctctgcatctagtttcaccattcagtttcaggcatttattttcactttggaacagtttttctcttcattgcagttattcacatacacctgcacttcattaatgaacagttaagatctccattcagagtcgaagatcgtattttggggggaaaaaaaaaaaacatgttgagaccggtgcatttacaatctttagttaggtctctctctaaactgtcacctggattacattttcctcgaacaccaagccaagaggtaatgaggtttctcttggcagtgcagtttctgaaacaaagttgttccttccaaatctctctctccagtctttttgaatatctgaatgcaagtaggacattgaagacatatcaactttttgtccagctcttccttcatgaaagtttcataactttctcaccaacttattgtagtcattagctttcttctctgctcgaggtttgggcttcttgccagattctgtgtttaagatggaagagtcatttagatcttaatcataaggtctctgtgtatttaagaatggttagatgactctttatgtcttctgccattttctcaatactggagcagagaatcagtttccatgttagaaaaaactgaaaaaagaatagctgaatcatgataccccttctaattctaagagtctctgtgtttcagtgtggaataaataattgtagttcattttattctttcaagatctgcttttctaagacttaaatgttctttctgacttgatgaaatgtttctggagttgtcctagttatttta

SEQ ID NO: 39466 - DNA, 1546 bp, Bovine  19866880821852
ataaggtatctgggcattcttggcctccgttggctgcttcttggatgataatcctatatcgagactgttttattgtagcatttcctgaagtaaaggaaaaataaaataatagtgcccttttatgtggaggcaaagaaaagtccagggatagagagcaatttaataaagaaaaaaaagaaaaaagaagaacctatggaaagactacctgggaaatgagaataataagaaaagaccagagattaatactcaaccttacttctatgagaaagaaacatcacacttactaactgtgatttcaaatctgtatgttctaatatgggaagattgtttcccactgataatatattttaattaatcagaatctatattatattttgcatatacttcagcataatctgaaaggcccttgaaatactctttgatctcaaagcaacagctcagggggttaacattttactattagcaattctctccctcaggtggggtacttccttctttaggctactttttactatgcaaacacttattaaaattaatacattactaacatatttattaatgggaattagtttattagatttcttattcctcacaacctgaggtaatatgtgtacaattggaatttagagaagaggcagtaaaattacaacagaacaaacattatcttcctggttattttgctgacccacagaagtagtaataggcacctggataaaaagacagcctgatgttcactctaatgtgtggggcattcatttcataatctttagatgccttctaatcaacaactacttccaaaatcaatgacagtgcttagcaactatttcaattgccatgtgtaagatactgtgctcgatacacagatacaaagtcttgaatttgcaatgaaatggaaagaagaaggggcagacagacacacacctagtcatttgggctttgcagagtgagatgcgtcagacactggcacagtattaggagagtacagaagaaagcatagtcctgtggggaaaccaaagacagttcctagagaaggtggattttattctggcattggagggataagtagaaaaacaatttttttttccaaaaagcaaaacaaaaataccagatgatattgcttatatgtggactctaaaatatgacacaaagggacctctgtgaaacagacagactcacagacatagaaaacaggtttgtggtggtcaaggtggggtggcgggggagaaaaatcaggattttgggattagcagatgtatataggatggataaacaagaaggtcctcatatagcacacagaactatactcaatattctgtgataaaccataatgggaaaaatatatttttaaaaagaatatatatatatatatgaatcactttgcagaagaaattaacataactgtatttcaataaaaaaaaaagaaaaacataaagtctgaagccattgcaggtcaaagaaccagtgtgagaaaagacacaaagctgtaagagtgcatggacttcacagagaaagagaacagaactgcattcaggagggtgtatgtgtg

SEQ ID NO: 39467 - DNA, 1523 bp, Bovine  19866880828209
tatagagcacagtggattagttatatatacatatatctatttttttcagattcttttccattttagattattataaaatattgattatagttctctgtgctatacagtagatacttgttggttatctattttatatattgtcctgagtgaatgaaataatgccatttgtagcaacgtgaatggacctagagattatcttgtgaagtaactcagataaagacagatatcatatgatatttggaatccttaatcatatttaaataacagtctgcatagaatttttcaaactcactctcattttgatgtagattactgagtcatcttggtcccctttatgtggttcacattttccaagaaataggctattgggaaacttgaatgttagtgctacctaaatgtgttaaagccagatgttttaagaatattttcatcattttcacacccaggacaccaaatgctttcttggatgtttaggtttgcacttgcccactgtccttcctggctttattttattttgttttgaaacaacttcagatagcatcgcacatttgcatcccttttccccaaaatgttgcacggtttgaacagaagcagatccctcacagtcactaatgagcttgttatggctgagaataaagtgagattattttggcttgggtttgataattgtggtcagcagtctcttaagttgatgtctggtgttatttgctttagcaggcagcagcttggaggagtagaaagccctcaaaaacagaattcatgtccagtgtctgggatttgcactggactatttctctgtgacttgtaaaatcaaagggatacagaaattaaagctactttcttagaaatggagaaaaagcaacatggaaattaaatctgagattatgttatttttaagttagtaattgtcaggagctaaatgtcctgaaaaaggcagaatagtactaaataaggaaatgaatttagtgaactcactaaggaaagaacttgtaagtaaccagctatctttgcctttccacacagatcagtaataattatcctcccatgttagcccaggtgttcctcctagttcctgtctcattatgagccaatgaccattgcattttatattcatctttttgatctctgtcatcagcagttttctctacatcctgttctagtttctcgtttggaggttgaaagtaaattacatcacccatctaaccaacctctttcccaaccaaccacttaagttgtcaaaagccaaggactggaattctttttcatgtttttactttataatgcctaatagagtacctggcacatagtaagccattaataaaggaaatgcatggctagctgtttctgcttttttcacaaagttggaagaaaaaaaaatctgccacgttttcatgctgttgtttttttgttgagaaagataagaaataaataggtagaatattaagagtatcaaaatatagacttatgctccattgtattttattggcaaaaggaagcaaattggaaagactttgtatgtattt

SEQ ID NO: 39468 - DNA, 1396 bp, Bovine  19866880858052
attatatgaatcaatacactgccagggacacagcaggtaagggatatggagacttagcagcaaacattggcctaacaagtgaaaaacccttcaccagtacaatttctaatcaatctttcaactgctcaaaggaatctgtatttatacagtttagaacatctcatgcctctctcagttgggaggctctgaacaatcacaggtggctggaaaaacctattcaggcaggctagaggacttccgaaggagtttgtaggttgaaacactatcacacccaggaactttattaactggagctataagtcaactcttttttcagagcgaggtagtgggggacagtccccccccccttgtaaagtcagaggtgtaggtgaaagcacaaagcagaaagtaggcaggctctggtttgggggtagatgctcgagaatttccagggggactcctgaggctcaatcccgcctttgcgtatgccgagcctccttcctcatgacctttgccatgggcagagttcctcaccctggctcctggcagtgatagacttccagttgagctattccagatcctgaaagattatgctgtcaaagtgctgcactcaatatgcaatatgccgggagatggctcccagcactccgctttgttttttaattgaagtatagttgatttacaatgttgtgctaatttctgttgtatagcaaagtgactcagttgcacacatatatccctttgttttttatattctttcctgtaatagtttatcctgggaaattggatatagtttgctctatgctatagagtgggatgttgttgtttatccgttctaaatgtaatagtttgcatctgctaatccacactctcagttcattcctcttcctccccacttctcccttggtaatgacaagtctgtttcatcttgagtgcatctgtgctcagaaaaacataggaacttcagaaattcaatttgaaagttgaagcttttagaagaggatgtttttaaccatcaggagaatagcactgtccattagatatcacatttacttttcttgctgtggttgagatgagaggtgagaaaagagatgtgtgggcttagagtgtggccttctgactacatggcagcacttagagaagtgtcctgtcacacggttcaaatttgagtgacaagtagatgatcattcaattaacattaaaagggagaaaagtgccttttaagtagttcatggaaaaattaagtggaaaggagctttttaaaaaattttaacttctccctctaaatattgactgttaattgaaaaaattactgttagttatgcagcatgttctgtagtatacctgggaggattagcatttaaaactgcagatctgtaggaaaaaatcagaatcctactgggctttgcaattagtg

SEQ ID NO: 39469 - DNA, 1809 bp, Bovine  19866880905492
agttgtccttccttattctaatgcaggcactgcttctaaccctttcattctgttcttatcagcattcacagcatgaaatgtgattcttctattacttaattccttcctttcctctcactcatttccactcctattttcccatctcctttcatttcaccctcacatatttttcactttgcagttttccttatcttcatatgctcgacatgagagagccaaatcgaaccccacagttaaaaatagtttctgacattatttgcgattcctaagatgtagcctcacaaattaccttttctcatctgatttccatctcacatgctgacagtgctccaatcttggtttctgattatcccattacatagtcctttcccttacatttagaggaaacttgcaagtaatggttctgtttggatagcactgcctagtcatcatttacaattttatggaactggaaaggccaggagaggaaagacatggggctcaagttcttgtttaaaagggaaagcattaaataactattttggtaatagttagaatcactactcatcatcgtgctacactggagccactttgtgattgagagtaacataccacattaccaagtcgtgtctgactctcttgctgtagcccaccaggcccctctgtctatgggatttcccaggcaggaattctggagtgagtttttattccctcctcaaggggatcttcctgacccagggattgaacctgcatctcctacattgcaggtagattctttactgctgaacactgggaaatcatactaaaacatattagtatcataggacaggataactgtttttcttaccaagggggaatgctgtgttctctgttgaggagtaatgcatttaaaattcattcttaaaaaggcaaatgcaattgcctacacaatgttataatatttcaggaaaaactcatcacaaataaatgcgtaggaattaacctaacaattcatttactgcattcattgtttttactatataatctgcatgtattcagtctgtcatcatgcacaccatttatcatgtgtgtgtgtttgtcttgtgtatgtgtgtgtctgtgttttagctatgttctgaaaacatcctataaatagctaaattcatgtaaagccacaatgcccagaaggctggatgattacctgttagcattgatcgtttgggtatagaaaaagaaatgtctaatacaaataataccatttttcttatgcattctaagaacctcttatattcaagagtaaattttccttacatatattcatttcagttgacctcgtaaagtacattggagagtacagtataccatgtaattgagagccggacctctaatagatgctatgtgagatctttgggggaatgaaaagataatggaattcctattcttggtgggagataatagtcattattatccttttttctcttctgcaaaggcacactatcgtattctagttgatggtccccatatgtttttttaggtacattagtaatttcaaagaagccaaatatatcttgctttgagggaatgcagtttagctcttggggccagactatagctcctggattatgttcagcagactttactaaaagataggctgtttttccatgacttgaatagttccacataattttcttctcctttcctgttcttgacaggtgcatgaggcagtcccatgttacagtgagtgcaatcagtattcctgggttgtagagcactggtctccatgcaaaatccacaatgagctgaggtccccgcgctgtggaggaggaacgcaatctaggaaaatcaggtgtg

SEQ ID NO: 39470 - DNA, 1891 bp, Bovine  19866880960917
ctggaaaattgcatggacagaggaacctggtgtgctgtagtccatgtggtcgctcagtccatgaactgagccgctaagcatgaacatgagagttgggtactacctgtaggtggtagtagagagtcatttagttatcaaatctaattcaggatcttcagtgattaattattcaatcataaaattgaaatattccccagtacttttaatctttgtgcttctaatcaactctgggatttttcagttcatctaaagtcagtattcgttaatattttgaaatagcctcttgatgaagttacaggcatatgataatataaattatcccaagcctgaggtcatgaacttgtctttttccttaaagggcttccatttttaagattaggagttttttttatttaatagtgatttagaattataaacttcttctatatctggggcatttacaaagaaacctgacttaaattttaaaagtgcttggcagaatattccattgtcagctttactggccaagatattaagatgctgtatttgataatctgcaaaaaaaagagaggtgaatattcatttgattttgtcaaaaagaagagcaagaataattactaataagtgaagtatctgggacatttttggtagaaatccaatttctgttcacataggagactttgaaaaaaagctgagtagtatgcctgtgaatcagtatattcagatcctggaggcagggtattgagagagcatgagaaattttctttctgggaaattatgctggtctccactagttggtttacatactcatcatttcctttccggacctgcgcccccctgccccccccccaccccgcccttcagtcaggggaaggatttaaattgccacatttttctagttctctcaagcccgtgagtcactaaaacatacacattaattatataacctctctacattttgaattaatggatttaaaaacaattccggggaacataagtctttctgtaggctacctcatcagcataaacaaactcagagcagacatctgcttagagaacactcactagtgcagagaaaagaccgtggagtagggcttatttgaaatgggcatgttcatgtgttgcatataaatatgacattgattacacatatcacacacacataatgattgtccgtgatctttttgagacaggtcagggggaaagcaatgcagttttgcacacattataatcattttttattgagtgtagttattttctgaacatttagaggaaacattttatggtttgcattttattcatctttccttttcggtcttagcattcaaacaaggtgtttagcctgatgatgtcaactgatactggtttcaaagcatgagtacattctcacaaagaaaatggcaactccaagtattcactaccgtatgtaaacacttaagagttaatgaagtaggaaatggaaacccactccagtattcttgcctggaaaattccatggacagagagcctggagggctacagcctatggggttgcggagggttggacgtgactgagtgcacacacacagagttattgaaaactagaacttcgtcatggggtattttgcatacctggaccaaatgggcttatgaattttgtcttgccatttactatatctgacttttacttggaggcagttatacacagggcaagccacatccttgcaaacactgctatgtaagatgattctgagagaacttaaagggctatcattactaaaattaaaagaacctaaaaaaattatgcatattaagtttatgtttattaaacttattatgttaattaagtttattaagttttgttctctactattatcttttctctatttcgtatggaatattatttcctgatcccctacctgaggctcaagga

SEQ ID NO: 39471 - DNA, 938 bp, Bovine  19866880994757
atttcctgccttgcctcatatatcataatgctcaaatgaattagggagtttcagtcatagaaggtgttttagacatcatcttggtcagcccttaaatgtgtacagcaacttgcatgaagtcacttgtgtgttgaagtccagtccaggttgccaggaaaaattgttcattccaaagcggggagtagcctacaattaagactggttgaagccttactctggctttgactgactagggaatctacccttttctgtggcctcagtatttcccatcattggtggacggagatgattttatgaaatttgcaagcttgaactgagggttataagtaaaacagtgtccatgtcaagtgttattcaaaatctgggcgtatcaggcacttactatattacagttcatatcagttgtttaccaattttcaattcttctgtgttgattgaaaactgaagcaaattgcctgagttggggcagcatatgatgtggcatcaacatcagaacatctgttcccagctgtctctgaggagggtgggggctgtggggttgctatggtgaaaaggattctgccagacccacctgcagcaaaggacttgctctttttctgaacccattgagtttgacgacacttggcaaaagcctccttgagtgtttatggcttcaatttgatttctgtactgcatggctttcctgattatccttttctgggctttcatgagtcagagtgacaacttcagcactgaatatcagacaaggctccattgggggctggttatgcatgtctaccacttgaattcatagaggaaatgagttgtagttcacactgtcaggaaatcacatttctgaaaaatgcaggctttttttcccctgggttttaaggggattgcaccttttccctcttgtgcagagtcgacgggtgcatgcccccatcagctgccactggtgc

SEQ ID NO: 39472 - DNA, 1259 bp, Bovine  19866880995772
gcaattcatttctgagtgttagacaagaggcccagtttcgggccctggaaggggtcccccttcctgcaacacatgtacatgaatttctacaattttattccaaaccagattaaaagcaaatctccccatttactatacttagattaaacatgatgtgagatcttgaaagtgcttactcactctaaaattctaatttgtcagtgaacttgatattggaacttagctccacatcttctatccacagctctctcccaaagtgaaagtaaagtaaatgaaaattggaatagccattcaccagctttacaatgatttgtgtaataaatcgatcttgccacaaaatagtctctttaggtaaatctggtgggggaataacagtgcctgcaaatgattttattatttgtttataacttcaaaatcctttaccaggttttaaagataattcatggcttattaccttagggtcatttcatgacagcaaaggtggttttcctgacataaaaatgccacacagtaactaaatgaatacaaaaaggtgcctccacaaaaagaaatgaagttcagatcctacagcctgcattctgcagggaaaatgggcaagaaaggaaattgaactgacaaggtgatgtaagttgtaggtgaaagactgttacttcataactgagcaaaaggttctgacccctcacaatacctcaagtgaggtgcttagcatctctccttcaaaaagctattttccagcagagttttggaaatagcatttcaaagctaccccagtgtgaaacctgggacgagctaaaagcatgtgatgaaaatgccaagaatggactttaagaagctttgttgcttcctttaaatataaaaagaaaacacaacaaaaacagcaataatcccctaatcctgtctgtgtgggagcctgagctctcctgtaagcagatttctctctttgtcatcttcctcctgtaatcaccacccaatccccccacccccttaaaaaggcaaacagaaagggaccatggcaccatgcacactctcattgtcaagagaaagcacagaattctaaagactttcttttagcccagacacatagaggatgtgggctccaagataaatcacagcaaacatttgttgatcaattcttctatgccaagctcataggaaccttccatacccatcaccccttttatcctcccaacagcattagttccctcatattacaggttgagtaaaccaagggagacaagtaagtgactcgaggtcatgga

SEQ ID NO: 39473 - DNA, 2992 bp, Bovine  19866881154517
acctggaacctaggagaatctgtttgggaaagaaatagcagtttcaaagaatctgtaaattgtttcagcagaaggagactgatgcctttttattgagtccatcttttactggtgtgtattttttcatgagtccctgttgtgccactttcagttctcctggatggaagatttgctcccctgttagtgtaagaaagttaacgtattgctaagtgctgtgcgtagtgatagaaatctattaataatgcatacatggagtttgactggcaaagtcatctgccgaagagcaaagagctttgcacttgagagtagcttaccataatcaatagtcccactctattcaataaaaaattactagagcgtaaaacacataaagctcgatcagttctctttattttggttgtctgttcagcaaaaaatgacaacttacttcttttctaaatgcatttacaattttaaaaggactacagacattatcataaattagtcatgctgcagtacacggatttttaatatacgcacatttaatttgaatatattgtgctagggtttcaattccaagagtgtttgcaaagctatatgtgcttagtcaaaacacgaccattcactaatgcaattattctttcaatctgtcattgttagatcactgaagattctattccatgttgctttgctttagatctaagcctttagaaggaggaaagaaatccacactctgtaagcaattctaagccttctgaaagtgacaaagcatgcattctaaagggcgagggttgctataaaactctgatggtcttgccatactactgctattaaaatcagtttatgtcaccttagtaggatgaaagtctttttaaaatagtcactaaatgtacgtacttttctaatttgactttgctaatttagaatgtctctattccttgcttcagagcaatgcattcattccttaccccttctagccttcccccataaatttggagaatagtttgagtacaggtttcctagggttagacaatagtactctcaggaagacaagctggctacccagaggataagatttccaggccttggggagctttttctaatccagaaattgtctcctctatttctttgtggaaatgtgtatgcccaccactagagatttctttctttggtttgatcttgatttcttcttgtaaattgcatataccttttcagaatgatgaaatatttaataataactcttaatatatggagcttcccaggtggcacagatggtaaagaattcgcctgtcatttcaggagacacaagagacctgagttcgatccctgggtcgggaagattccctggagtaggaaatggcaacccactccagtattcttgcctggaaaattctatgagtagaggagccaggaaggctacagtccatggggtggcaaagagttggacatgactgagcaagcacacatgtgtaacttaatagtatcctgtgaatacatttattgaccgtttcctaagagtagacttaaattatgggggacatatgaagaaattggctagtgagttccaggtgtgggagacagcttcagaaagcagagtatagcagtgaaattcaggttttattcatttacctgatatctgagttcttgtcccatttcctgggctgtttcaggtaagaattcagtgccaagaaattgtgctactagtacttggggcaaagtaatttggaatcattcttttttatttatttattttatatggctacacctggtctcacttgtggcatacagaatctttggtcatggcacacaaactcttagttgaggcatgaggaagccagttccctgaacaggggttgaacctggaacccctgcattgggagtacagatgtttagccactggaccacaaggcaggttcctgaaattgttccccactcctctctttctctcccactagtgcttagttgctcagtcgtgtccgactctttgcgatcccatgggactctagcctgccagactcctctgtccttgggatttttcaggcaagaatattggagcaggttgccatttccttctccaggggatcttcctgacccaggaatcaaacctgcatctcctgtgtctcctgctttgaaggcagattctttacccactgagccattggggaagtcttctcctacccacatctaatcatcagaaggctgtctccaccttcacagaatatccagagtctgatcacttcttgtattcactgtgagtgccccacctgaagccttagcagcatgtttcctagagtaacaaatgcctctaaatttatctccctttttccactgccctgtagtatgtccttcagtcagtggccaggatgactctttcaccctcctcaaaacttgacagtggtttcctagcacatttggaataacactcatagtcctccctctgtagcctggcccctgcctgcctctccctctttctccctcctaccttgacctgcttgttccaaccacactggctcctgagctttcctgcaaagcgcaaagcactcgccttccctgggaccttggagcatactctcctctagaatgcttcttgtccacctcttcttgtgcccactgctttattttattcagcattctgcaggctttcctgatacagcattgaactagctctcctcatccatctctctctgatggacatgttatctgatgccgaattctgttttggttcatttctgtctgtctaccaccctagaaggtcatctcttcagggtcaggggctttgtcttgatcattgttattcttttctattatctgaatccatccttgacatataattagagttcaagaattacttcttaaaagaaaaaaggaataaatgcatggttgattaagtgatttgcttactattgggcaggcttatttctgttcctagagagtcctacttttaattcctttctgccatccatctcgcatacataccttagcatgacgaaatattcttaacacaagttatttc

SEQ ID NO: 39474 - DNA, 790 bp, Bovine  19866881168781
catgggattttctaggcaagagtactggagtggggtgccattgccttctccataagggctcttaagacaggggattccaaggttctgacaactaggcagagtttagataaggagtggatgaggaatcatggcatccttgcttctgagaaggaacaggctggaaaggggccagagaagggtgctctaaggcaggggtccccaccctctaggatctaatgcttgatgaggtggagctgatgtaaataatagaaataaaatgcacaatgaatgcaacgtgctcgaattctccctaaactatactctctactttgtccacggaaaaatgtccctggtgccagaaggttggcaaccctgatctaaggcatggaggtcagctcttactgagactaagggcagaactgcattctactccaattatttcatcatacactgatgcaatctttcttaagagcacccttccttgtagataatcaggaaaggtgcaattgccaattaaagctatctcagatttggccattttaattagcctccttcctatttaaaataattattttcaggtaaatgtgcagtttctcttccagccacttccccctctcccctccaggaaggaatctaggtgcccaatagctatcaggggtctcagatctgtatgaaggtccttcagaagtgccccgagtcactgccagtgtctacagtgacagtggcccttgtccaccgggtggctgctcacccactaagggaagtcccctttcagggtgaaaatcacacgaacgctcccctctcagcctga

SEQ ID NO: 39475 - DNA, 1286 bp, Bovine  19866881247105
cctgcagctcttgcactggcagacagattgttcaccactgtgtcacctgggaagccccgtgtctaaatatgcaatcttaatgaagactattgcacaatgactcgtttattctatttgtgcatagtggtaaataatccaaagtcacagtggatatgaacctgtggctaaaattatacactatgttgaaacaaatggtgaacgcaagcccccaattttcccaaatctataccccctttgatgaactactcaaaccaaaacacacagacacagacacacacacacacacacacacacacacatgataatggggaatgtagttttacaattaacagacacagccaaggggatcatttctaagttgctattctatatcacaaatgattataatgaatttttttttctaaactctcttttaggttatgtatccactacttttagaattcaaatattcctctttatagataacaattccactcttactatcccctccttcacagtcacctcatgaatacagaagacatgaacaatagtaaaaacatttatggtttgaagcaacaacatgaaatgtggaatggcaggtctaggagacaggcagtttcctctttgtgactttatgcccgtggaattctcctgtcataatctgacacaaaaagtaactgtgaaagggggctaatatttatgcagcatctcccttgtgcaaggcactgtcctcataagatggtcctagacacaggcgtgacccatcttgttttgtagatgaggtgtcagtggctctggaaggaagacttgctcagggtcacaaaacttgctcacaggcctgagtagggaagcaaatgaaaactttctgactccagaaattctggtttctccattaactatattgtgtctaattccaagagatagatagttctttttaaaggaagtaccaggttggccaaaaagttcattcagttttttacacccaatcttacagaaaaacctgaacaaactttttgaccaatcaaataaataaaacagctgccagtgagcaagactccctggacgagaagctagtgccctcctaaaatttgcattcatatttgtaaatgagaccaggctcactgcgcttgagggaaaataaaccttttcaagcatattataggaagtaatagagattctagcagataatcacgctgaaagaccagttccaatcactcttttttcagtctcaatctattttcttgttgaatctacactgtatactacatgtaaacacagacacacacacacacacacacacacacacc

SEQ ID NO: 39476 - DNA, 1103 bp, Bovine  19866881266894
ttttttgtgttgccctcctgaacttatctgttatatttaaatactcagagtttgaagagaaaatctctcctccttgcattgtctcctttggcaattgctacacaaacatcacagattgtgaagtccagggaataatgttcttttttttttttgtcccagtatcatatagagaaatagttgagcaactcgagaactatagatattcattagaaaaactcatcaaagaaatcagtggtgatttgagttttgccgaggagaaatgcacatagattgaacagaaaataaaatcagaataatcaccaagctaacatggatgataatgttataaacactggtcaagtgagtacaactaaaatgtgtatatttcctggccattaattagcatttaaccactaacattcaaaagatacccattaagttccaactaggagtagttggtaattgataggatggtgactttttagaaatttactttttttagatgttataacatttgaagtataaattttagttatttcatgttgataattcacagtttaagtacacaagatcatactcttaaaaattcattcctaatgatgttagaaagtaaagtaagttaaagattttaacaaggtgccagaacatttaaattgtttttgttgttgttttttggtccttcagaagattctaacagaagcattgttgttggaaagtaataagtaagctaattttctatatgaaaatttattcctctggagtctgaatatccccagaggataatgcacatagtctagacagcccataaatttttcaagagaactatgcaggcatgtgtttatgattattttaattacaaagagaattcttgtgaaaagaatacatttatgtattacttattctggcttattcatataaatactatatatgcaagcaagtgatatggttagttgaatcattttcacatttctgtttctgcacacactagtaacaagtaattaaatgatttattttgaatcttaacttgagatccataaactagtgatggttacagttgactctctctcttttttttttcttgtggtaagaacacttactgttcatggggttctcaaggcaagaat

SEQ ID NO: 39477 - DNA, 2472 bp, Bovine  19866881269611
tgatacctatttcttgctgactttgcagatgatctcctgggcaatatggagttaatactgagagatctggttagtctctgttaataagttaaattggaacaagtgaacctagaagttgaggttatggcagtgcttatggcaccccacttcagtactcttgcctggaaaatcccatggacggaggagcctggtaggctgcagcccaggggtcgctaagagtcggacacgactgagcgacttcactttgacttttcactttcatgcattggaggaggaaatggcaacccactccagtgttcttgcctggagaacctcagggacgggggagcctggtgggctgctgtctatggggtcgcgcagagtcggacacgactgaagcgccttagcagcagcagcagcagcagctttgttgttactgttgttgaggctcagctgtagctatttgctgacttcaagttttagggaaaacttaggggttcttatattcactgtttacatttctccttgatttttctttcaacaaaacagactttagtactacaatatgtacaaaggttacatctcttgattgtaaagaagattttcaatattctcagaatgttaaggtgactggattgatccattcaacatctgttctgctatcaacatcattttagttttgaactgtgggcagcagcgaagaaaatcagatagaatgctgagcagtgcactcaaggtagacccacctcaaagctacctccctcaggaacacatccttaaatacaggcacagaatggcttctttttgacttttaaaacagcagatttcagatatttagctgttttgtccattaaaagaaagagattgattctaccccagatgttcccatgttaccatctgtatcgccatcttttcataaaataattatgctcacctcaaaagaattagaaaagatctttaccttagaattacttcaagttcttttaattaaatatttaactttatgaaaaatttctctacattttcctttttttccttatttcatgatcagttggtgccaaagccctggtctgatggtaatttttattcttcacttttagtacctgccagttcaaagcattatatttattatgtatctttctctgtcatccattaagtgttcttctcctgagacgtggaaaaaaagtgttgttcttatttattgttataatcctcatcatacccaggcagccccttgtacatgtctgatatacagtcagtgttcagtaataagttgctaaaggttgtgccatgcatgtgatccaggagaagctgatttaaaaaaaaaaaacaaaaactcagtgcatggttgagtgagaataaaatttgggcaaaccaagacttttttttacctaaaatgtcccaatctttactgtagagagagcacctagctccacaatgacacacacttaaaaaagtctcatttcaccaattatctctgctttatggatccagtgattacctaggggatatcttgagggccatccctaattacttagttttcctttttaaaggcattcctatttttctagcttaaacaatttcaacagctctggggtagacaataataagtgtcttagaaataaattataggctaaaggcattgtcgagccatttgcatttaagactcatttactgaaattatcaggctgggttataaaagactgtggctgaggcacctgctgcttaagactttcaaatctattttgacttagaaatgatttctaacataacaggaatcttttactactaacaatagttctgttaacctgttatcaaagataaagttcttgtatctaagacttttgttgttcagctgctcactcaagtccaactctttgcaaccccatggactgcaggaagccaggcttttctgtacttcactatcttctggagtttgctcagattcaatgtccattgaattggtgatgtcatccaaccatctcatcctcagtcgtccccttctcctcctgccttcaactttcctagcctcagggtcttttccaatgagtcagctctttgcatcagatggccaaaatattggagcttcagcttcagcatcagtccttccaatgaatattcagggttgatttcctttaggattgactggtttgatctccttcctatccaagggactctcaaaagttttctccagcaccacagttcaaaagcatcaattcttaggcactcagccatctttacggtccaactctcatgtctgtacatgattactggaaaatccttagctttgactacatagagtgaggtatttaacacagcagaaagaaaccacatacttttgccttcctgcagaagggacagtatatgacagaaaggtggagttctgttcctaccactcctaattctcaaactctggccaactctctggtttgacaaagaattagtcttagaagctgcagttcttcatgcagctgacctctgaggctgtcataa

SEQ ID NO: 39478 - DNA, 1244 bp, Bovine  19866881291791
ttcatttaaaggactgatcagaatgtttcccatataaataatacttcttatagcttatacacattgttaataattggttaactgcatgcttagtggtaaattcattacaaatgcattttaagctggagtcatgctaagcgcttttttaaagaatttgtggatccagaacacttcagactttacagttggaaggaggatggtaatatgacaatttcaaacctgcagactcataattaaattctgaaacacttgtgcagactgaaaaatttgagtactgtgccatcttatgagcaactttaccttgaaagtctgggtttggagatgatataaatatcattgtacttctcataaagaattgtttattctatgtttatattttagaacctgctaagtttaatttgtattggtattattttaatcatctaatctaccattaacacagtttgcatttaataagtactttttcttctttatgttgccagtaaaatgacttggtctctacaactgtttttatcttctaatgttttactaggctatttattcccttgtactaactacccatatttattgggtataaagaccctcacatttccctaactttcagcagcaattccataaacccagttatctctaattcctctaaaccatgactttgtcatgacccctgtgttggctgttatgtatgtagcatcacctgctcttcctttttttcatcttataggttaaatttctatattaacactctgtatctccacctgcaatctaataagagcaataaattttcttatgtcttggaagaactatcaatcaaattgcctaccctctttgccaaggtatagatggcataatttcccagccagtcattaagactttagtctcctaggttttcagtattaagttgaatgaaccaactgtagtaatttcagaagaatctccttgctagtcagacttaaaaactgctagtcagacttaaaaactggttttcattttatgatatggtatcactatttttttcttctatcattaaaatgatttatatccttcctttctccctacctttctctctgtttctctctcatctctttctctctttcactggccctttggcttaaattcagttcagttcagttcagttcagtcgctcagtcgtgtccgactctttgcgaccccatgaattgcagcacgccaggcctccctgtccatcaccaactcccagagttcactcagagtcacgtccatgagca

SEQ ID NO: 39479 - DNA, 1024 bp, Bovine  19866881332809
aatagcattcatattttaaaatgtgttttcatctacgaaaaagctttggagttgaaccatcagttttcacctaaccagtctattctgtaataagtcttatcaagaactctgtttacgcttttgcatagtgacttgactatggcaaggttaaagtatgtgcacatagggttagaacaatttacctggtctgtggaggtcttaaactttggcacaaattgtaattaagtgtattaatctgtttttcatattgattccaagtctgttattcaataacagattctgggcaagtgaaacctgaacccttctgagcaaaaactcttctgcttctatgccaataaagtatcatctcttgattatgatttcgtttatagcctttccatagctccttcaaatggtattctagatgggctataaagcagttaataagaataaattaaaatttgtacttagcactaaaatgtaaattaattgtatgttttctcccaaatctaaccattttaaacatctggtatatattttagtgcttcattcgctctaatggtgatgattttagaaagttgttaaaactgcttttcacttccgcatcatggcagtgcaagggatgtcagcactgaagcatctcttacaaaatcattagaaaaacaaccagtcctccttggtttatcataaagtaaaatagagcagaacattatcatctgcccactgccaaccagacaatgaaaccactggcctgaccgtgaagaaagcttaaagttttcaagaatcaagggcattaagtacagaaaattaatcttttcactgccatgttttattcttttgaatatcaattttcaccagctgtgatagcttgtgtagcatctgttagaaagtagggaaaaaatgcacagagattgtacttaagtacagcaatagttttatttattttttgcttatgactaaagccgacagaatcatgggaaattcatgacttgcaaatgatataaattacataaagattgaaaatgctcataacttacttttaatt

SEQ ID NO: 39480 - DNA, 1273 bp, Bovine  19866881359033
aatttttttttttcttaagtggccacacttacttatttagttattgtcatgaaaactttcaattgcatgtggaaaagaatcttaaaaaagattacagcagtagattgacctgaaacttgatagttgactataatatattaatatatgtttggctctctgtaaaattaaaaaaatctggagaagggaatggcagtccacttcagtattcttgcctggagaattccatggatagagaaacctggcgggctacagttcgtggggtctcaaagagtcgggcatgactgaatgactaacacacacacacaataaaaatcgcgtttcatgctgtatatgattctgataagatgttgaagtagctgtaagctgaaacttagaatctgagcaaaataacaaagtgttaataataaaagtggtgctaataacaattactatttgtggaaaagtttctctgtgccaggcacagtgctgaatactttacatacattatcctatttacttatcagagcaactcaaagaaataggtatcagtatcttcctttcctagatgaagatgcaaagttggaaactaagcaatttgctgtaggtcacacatagagagtgtggaaggcagcctcaggtctcttgtactttaatgttaccaccatgagctttctgagttatctcactaataaatgacagggctcggatcttctaattcaggatactattgtgttttggactatagtatactttgctacaaaagtatattatttttgagagttcacataagcagtctttattgggcgaatatggatctatttacatacatctgatgatgcaaatgagctaagctagttggcattcagcccgcagtgagtgaaattgcccagctatcattaaatcagttgatttacgagataagaaaaataatatggttcaataaaagtgtgtcttatgtaccatctttttctaatgtttaattacttttcctctctttgattaatatcctttccgaggtctcatactggcttcatcttgatgaatatgcaatgattttgtcccagtatgcctacatcagtgttgaaggaaaaatattgacctatgtgtcaaagaatctttcccttttattcttattcttaattaaaaccatttaacctgccctcagacccactgtgcctcattggagactgctgagcattcaaaccctttggattagccccacagtgtgaccacagagctcatgctggttggcaggttaatgatggatgcgtctcatttcccaagagaaggaaaa

SEQ ID NO: 39481 - DNA, 1059 bp, Bovine  19866881392555
caaggactatcctggcattggctggagaaggtgagtaataagaaaggtttctagtccctaaatctacgtaaacaatttgctttccaagcatttctctctccctagttgatctatgttgggttcccatgattaacattacttgttttagtaaaaaatctacctgccaatgcagaaaatgcaagagacgtgggtttgatccctgggtctggaagatcccctggagttggaaatggcaacccattccaatattcttgcctggaaaattccatggaaagaggattcttgtgggttacagtccaggggtctcaaagagtcggacacaactgagtgactgagcacacatgatatatcatagcactcatgcaaattcaggtcatggcaggcagatgggggttagttgttacacatttttagggaagaagacaagacttcattggtaaacatccagcttctgatagctcatgcagttgggaacataattggaatatgcctggtagaatgagttcaaaattaggaatcaagagatgtgacttcttgacctggagccgccactaacactggcaaagtacctgatctgcatgtcctcatttcctgctctgtcaggctggcacattgtgagagggaaaaagatgaaggctgtgaaaatggcactgaagaagctaaaatgtgctatgggaatgtaaacgggtgacttgaggacaaattagaggagcggctgtttctatcacttagagcaatggtctccatccccagacacacatgccatttcatttcttttaggccctcccttggctctgtctgccatcagctcagtgaggacaacagagcaatatggccacttgctttgaggagctccttttaagataagattctgtcctgtgatcataagaaatggggtcaggttcaagagaaatgaagattttcatgttctcaaagtgcagtggcttcctccttttgtctgttatttttatggaaggagaaaaaagtcaatagtgtttaatggggggaaaataacaagaataacaaaatcaaggtcacaaatcttctcaagcattggcc

SEQ ID NO: 39482 - DNA, 901 bp, Bovine  19866881421825
ctaagttcaaattccttccttcctttctgtcttccatcatccatctatccttttatctatctgcctgtctccccatccagctatcaaccaagcagtagaggagaaagaaaaaggaattaagcatttgcttagaaagaaatttggaatttaactaattctaatatatcagtaggatttggtggctgtaaagtgctcacttgtagtaggttcagcatggaatgcattattaaagaaacagtgctttcaatgagtatcaattttttcaaaacctaacaactggctttattcaagaaacccaggagatttgaagggatgtgtataatcttactacagaacgatcacgttactaagatatgaacattatatctgaaaggaaagacatgatcaacaattattcttttctttcagtaagaagaaagccaggtaggtgtatgtctaaacttccttttccttccttaatgaaactgctattgatttttcatgctactgaatcattgcctagaagcaatttcttttagctgcaggttctcacatttaatttggatgtatgcttaagggagagtttatcaatacaatctccagaggaacaccaaaaggtttatattataaagaaacaatgaaagcaattttatcaattttgttaaacacaaagatgatcaaagaattactaaagaatggtatttagaaagaaatttcaatgtgaatctgggtcatatcaacatagtcatcactctgaatgttctcagtgggcaaaaatattaaaaatttccatgagcaaaacataaacttgatactattagaggaaagggcaaatatattcattcaccaaaagctggccttcaagttgactttgcgacccaaaattaatatctccccatgttctttagcaccatcccttatt

SEQ ID NO: 39483 - DNA, 1741 bp, Bovine  19866881486630
tagtcaaagctgtagattttccagtagtcatgtatggatgtaagagtcggaacataaagaagactgagtgctgaagacttgatacttttgaaccatggtgctgcagaagaatctcgagagtcccttggactgcaaaggagatcacacctgtcattcctaaaggaaatcaaccctgaatactcattggatggactgatgctaaagctgaagctccaatactttggccacctaatgtgaagagctgactcattggaaaagaccctgattctgggaaagattgagggcaggaggagaaggggatgacagaggatgaaatggttggatggcatcactgactcagtggacatgagtgtgagcaaactcagggaaatagtcaagggcagggaaacctagcatgcagcatttcatggggtcacaaagagttggacacaacttagggactgaacaataacaagtgctttcctggcagttccctaatcacagtagactcctgattttctctgcactgggatatgtatccatctctacatgtccggtgatagaacagaagtgacgctgatgttaccgtagcaataacttggagcatagtatctaactctgggtagatgtattgattagttggttaatttctgtatttatatcatttatgtatttatatctctttctctttgacaacagagtttctgacttctcttattaaaaggcagtgctgataaatagaaatctagtattagaaaaccagaacaagtggaggaaaagaaaacatgctaaatattagtgtggttaatgtagtttctgtgattaatgagcagatttggccttacagtcaaactatagcaaagagaatcatgagaagtcaccagtccctctggtaatgttaggtcagcttcagacttttccaggatttctgtcccaatttttctaaaaacttctcactgacttggactgttcagcataataaagtgttacaataatcaagatatttagaaaactcacatgtatggtattctgctgtcagacctatgtggatcagcatcctaggaaaaaaaagataagcaagtgttcttgaaacatgtagaacaaatatcatatattagcacatgtgtgtggaatctagaaaaatgtataaatgatcttatttgcaaagcagaaacagaggcacagatatagagaacaaatgtttggatacaaaggagatgtgggaggaattgggagattgggactgacacatatccactactgatactctgtataaaatagataactaatgagaaccgactgtatggcacagggaactctactctacgctctgtggtgacctgaagtggaaagaagaccaaaggtgagggaatataggtgtatgtatgactgattgatttactgtatagtagaaacgaactcaacatcgcaaaggaaccatacttcagtaaacattaaaaaaataaaatataggaaaaagagaacacggaacatgtgtggccttaaacagcaaggagagagaaactttagttcccccaatcaggtgaatgataacaattcctctgtacaccaaaggataaaaacagagtcttatttgaggaaagaatgttcctcggatggccagcctctgttgtcagcatgttgtcaccgttttgtggaggtggacagtgaagggggtgagtggcagaaaggacctcagagcctcagctgctaggtgggaaaacgtggacgctctcccactgctggggtgtgtgtcatggac

SEQ ID NO: 39484 - DNA, 1010 bp, Bovine  19866881802305
gagatcagcccctgggatttctttggaaggaatgatgctgaagctgaaactccagtactttggccacctcatgagaagagttgactcattggaaaagactctgatgctgggagggattgggggcaagaggagaaggggacgacagaggatgagatggttggatggcatcactgactcaatggacatgagtctgggtgaactccaggagttggtgatggacagggaggcctggcatgctgcgattcatggggtcacaaagagttgtacacgactgagcgactgatctgatctgatctgatctgatagtataattgatgcacttttactgtacatctgaaatacaacattgtaaatcaactatattccagtaaaaatgaaaaaagaatattctagttcaaagtcaaatctgctactcacctccctgtgtgactcagtttcctcagatgtcattggagataataatctcataagatatttatgaagaatcaatgaaataaagcaactaaaagaaaccagggtgtaataactggtcaatcaatataaatattatcactgctattatttctagcacatctgtggaaatttttaaaagatttactttataggttattaattctgtgcatgacagtattttatgtagctctagagatttttaaatgagcctaggaagcaaattttggcatctctactcaacacttctctgcaaaataaaaaaattaaaactactaaaaagcatgaagtgttttaaatcaaagttgtcttataaactctctgaaaagattaaatgaaaactgaatcaatttttgagaactttaagacactaaattttcaggcaaatataaaaacttcagataaatgttttttcatcaaatatagctgcctgtgtcaaatttcctctactattagtgtcatacctatcacctaaaatactgcactaaagttgacatcccactgtttaacgttggtgacatttatttttaagaaggaaaaataagaaggaaaaacaaaaa

SEQ ID NO: 39485 - DNA, 1036 bp, Bovine  19866881840807
ctcattaatctcaactatatcaatctggccccattatgagggtcaaagataggttaattctaataagtggatgaataccagttcataaacaggcatgcgtttaacagatattatcttagcaagaaagcaataattagaacaattacttagtgaggtgatttcaggggaaaaaatgtcataaatacagctcctgttttctccctctggattatcaggaggatgaaaagtaagctatgttcttaaaattgacatttgaaagaggaatgcagagtaaattattttctctttgggaaaacattttttaaaaataataggcaaaatattttcactaagggagcaataatttcactcaaatcctcgtacagtgaaaatagaaaaatatgggaatttgacatcagattactttggttttgatcccataacttcactacttgactttgggtaagtaatttaattttaacaggtctctgtttctttttccatgaagtggggtgacatttcacaaagttgttttaaggattgtacaagaaaacatgtgaaagcttcaaacacaatccttcatgtactgcaattattcagtcagtgttctttatttcccctgaatgatgaactctaatcaaatctttgactggtctccctttccaaaaaatagctgttgtaattttgaagatgagcaaaataactgttcactcataccaaatggtttttctttttgctttacttggatccctactaagatcttgctttcttttctttcatatatcttaacagatttaaaagcactgtttatacttatattgtcaagagtaatcattcattttgaagtaaggcaatgtcccattgtttttattggtgcctgttggggggaaagttagaattttatcaagtctacttaaatcttacatttcttgcatttcccaagaggaattctagcttcatctaaagttatctctaatgattctcatgttaacgtgtttttcctcaaaacagaatcttattcctgaatgtcctgttcttttctcctgcatggtaacca

SEQ ID NO: 39486 - DNA, 1197 bp, Bovine  19866882017717
tcgatctgcactaaatctctttagaagctccagaatagcttaactgtccagaaggcagttaagctttgggattggcaatgtagttagaaagaaactggggaacttgtcctaaaactgcatatgtcaaggacaatgcttttacagatattatgtttctttggcttatttcggagggctattgatgattttgaggaggtgagaggttaagtcctctaaggtcccttttgataaacacttaactgtcagtcaattgactgttggacattagggctaatggaaggtaaggagagacatggtatgctggtgaggaatgggggcatttccctggaggctactcagtggcataactggaggctcaggagtgtgagtgaggccatttgtcagagcatgcacgcagcttcagcacctgctgctttgaaagacagttgatcttaatccatatcaataaattcttccagtctcagagacatgtctaaaatgcttcatttaggctttgaatcaatgggtttcagtcaacctttctctatttcagccccccgggagacattttctctagaaataaatcatgagtaagtcacaaagcacttaccagcttcagaacacttaggtaatcatctccttgaaaatagtgaacacaggatattgctacgcctattgacttgtagagctagaagggagctttagagctaatttagtttaattcatcaatttcactgaaaagctgtactccaaagaccctaggtagtttctccaagttcattcagcaagtccaaggcagagtaagacctgagccttgtcacaggtggctggctcatttccacgtgtccctcttggcattccttcaatggaagagggcaaccgacagaacagatgaggtcttctggactgtttatgaattacagtgacctcagtggaggcaaccagtgacacaacagatcaaagatatctaccaaagttgaagactcagtttaaccctttaaacaaaatccaaattctgttcctacttcattgctacttcaaaacccctttaagccccatcccagatctccccaactaagcagaaggtaatgagaccaaatatctgctcactttaaacaactatacttttatttgtaacattcatgctgtgggaggtagtttaactttgccatcaaagatccatctagtcaaagctatggttttgccagtagtcatgta

SEQ ID NO: 39487 - DNA, 719 bp, Bovine  19866882159134
aatggatattcttctaaaaggttaaggacagcatcacctgcttgaagctaaagaataaaatgcacaacctacctgtgagctgtcgccttctacttcgagttgtttcacaattcgcggagcagggtgtaaacttggaccaagcagtgaaggtgcagtcattgcgacatgggactgtacattcttgcgtgaggggaggcatgctgttcatctgcttgaggcattccgtcatttctgctgattggttattatcagagatgcatgagacagctaaaaaaaaaaaaaaaaaaaaggatacttttgttgctattttaattaaatcaagctgctgctgattcttggacgaaatagcagaattccctaatgtttgaaaaattttgttatcactgtgattgcaaaaggtgttcaacatagctaaccttatttctctctggaaattaaatgtttattgttgccagtggaggtatttgataatttaattggtttcattattaatccaaaccctgcactgacagcaaccaaaataattgttcagtaattttctgtatgtcctgcttgtgagcatttgatctctagagatggtataaaactagaaaacagaatctacaacagaacaatacaaagatgaaaaaggaccaaaccatgaaaaaaatcatttgcatctttcatagatttgattttttgttaacttgctaaatagcacttatgtttaaatggtccta

SEQ ID NO: 39488 - DNA, 940 bp, Bovine  19866880232474
atgctgggaaagattgaaggcaggaggagaaggggacgacagaggatgaaatggttggatggcatcaccaactagatggacatgagtttgagcaacctccaggagttagtgatggacagggaagccttgtgtgctgcagtccatggggtctcaaagagtcatacatgactgagtgactgaactgaactgatctcctgcattgtaggcagattctttaccatctgagccaccaggaaagcccttgtgttgatggctgtcagaggaatgactgtggaaggcagtcaggcagaggccatggtatgcgggtgtaagctggaaagaagacccatgctcctgcttccggccttgagtggggctttccttctggctggacttgggttcatctttgtctgagaacatggctatctggaagtgcccacagggatccagggtggaaactttgttggcagccaccagcaggaagggaggtttctgtcttagaaggtgaagttttgtttttctgggtagcctagagtgaaaagacatttatgagctcctcatggtccaggagggcccctcgcgccagcggtgagcaaacatgggcgctgcaggttgataaatgcacggtcttttgttgggcacacctggctcaaacatcacacgggatgggagtgactccgtcagtccctactccctgcatagcagcacggagtgatttcagacattctcctttgggctctgacagctgtgtcagcttctggccacactcagaggcgaaaggcatgtcaaaagtgagttttcaacctgcagcctgccgccttcctgcccatccgagtcttgctgccccagccacacatctgtcctctctgcttgcctttgcgctggcatccaaggtccagcccgttgcctgtttctgataggccctaaacaaagaataaccttgtatgtcatacaccctttt

SEQ ID NO: 39489 - DNA, 2554 bp, Bovine  19866880380366
tttttcagggcaagtctgtacatatataacttagacgaaccttcaagtgcctctcttcctccttcctgtcagactgcctacctgcctgtggtagcctttaataaagccccagctgtgagcaggacttctgcttggtgctaaggacataaagacacaggacccagctttgcacgtcatggagcttccagccaggtgtggatctgtgcttgtgaatcagtgcagagagtgggtggagatccatgccagggtgagtaagcaggacctgtgagtagaatgtactggaaaggctcctgaggctggctgtatcagggaaggcttcctggaagaggtaacacccaagaagaatcttgaaggaacaggaagagttgggaagtccaggaggctggggatttcaggcagaaagaacagctggaggggtgctcggctgaacgcaggggatgaagtgatcattgacacaaagagccctttgtctctgctgatacagctcctacagcacagggacgatctacccgcagtgcatactcccggaggtttatgatgatgaaatgtctcctccttggcgcagactgccatgcctaagtggaataagcttatcagagcacactgaggtttatgtgaaaacccccgggatccaagaagttagagtcacacgcactagagtaatagcaaatgagatttgcggggtccagaaaaaacactagagtgtgctaaacaccaatgggaagaacccagaaaggagagagagtgaagacacccgacaaaaaggagacaaaggatgcagcaaaatctctgctcccagatgggaggacagactggccttggatggggaggagggggcgctggcatagctttggtgagtgggcttctataactgcacctggggagctggaggagctgcattctggtagcttctgttttctttgggaagcaggagactgaaacattgtcagagaatatgggagagtatagcttgaagtctggagaaagtagggattggtgagaatattctccaggcaagaatactagagttggtagccaactctagtatttccttctccagtggatcttcccaacccagggatcgagcccagtctcctgcattgcaggcagattctttaccagcctagccacaggggaagcccataggcacttagtaactagttttttaaatgaataaatggaacatctttcatttcctatagtattctttctttaacagccttttctaatcttcctgatttacagtcagtgcatttgttttaaggcaaagtttcattgctgttatctctctgcctctttctactcctttccatcaatagaaatgcccaaaaccttatctctgaatttagtgttcatggagctaatattccagttgaaactgacaattacttgttaactctattctactaagtagctgtcttcaaattactaattttcttggttgatttgtgagctttgttattatacattatttaatttctctagctgtgggagaaatgaggatagttaaccaccattcatcgtttctcagcttttacagaatacttagatatttggttcttcatacttcatatgccttttttttggcatctgcaatgtaactttatccttcttgtcctgttatttagatttttatattactattgctttatgatagataggatgtttagatctatttcattgattaggaaggagatgccagagagattgaatgattttgccatggtcagataattaatttgtcaagacttttaggtaaggatatagccacagtttaatagatgtgtgtgactgattaagatatatttttgtaagaacaagtgacagtaaatttgttaatgctgtttgaagctattcttttaacagctgatatttgcaaaattttatatgtatttgttaaataccttttttctgatgggtatatttttttgttatagaaatcatttcagactgggacaaatgcacgtctagatgaacgcatttttgctatgtgtcaagtgaaaaatcagcccttggtttaccttatgctcacaactcatcccagtttgtatagagttgacaatctctcagatgaggtaagattgattcatttttttattcacttttacttgaacatttataaggctaattgtattgcatccattgaagaaatgaagaaaggtgttttctttcttaaagcttttcattttattcttatataaagaaattttggctttgggaagctcctgaaaatagtacttttatttaagttattaaagtaataaactttactgtttgtttcagatgaatctttagagagatctaaataaatgaagacattgtcaaattgactcgagcaacctatgatttatttatttaaacaggttgatctgaaaggagtatccagtgtgaaattacacttgaatgcccaggtcaatgtttactgtaataataatcttgaattgaaaagaaaatatttgtccaagttataacattattttcctttgtgggaagttttctagagttaaagctgcaaccatgaaaatgttaaaccataatctttctataatacatt

SEQ ID NO: 39490 - DNA, 1078 bp, Bovine  19866880412320
ctgtctttagaagcgaactggttttccatcatgtagggagcttttctgcccagaggagtgaggacagagagttattttgtaaaggaagaggctggggaggctgtggcgagaagaagcatcgggaagcttaggtgagcggctcagctcttctctccccaccccatccagtgtggggtccccatgcgagtgtgtggctggggaaggaagggcgtgccagatggggcctgagctgaatttaggtgtgggcctctgaatgagcagtgtgatgtttggcctaggctcctgagggtggcaggcccagctgaggcaccagctctgtttagtcagaggactgggcctaggggcagaggcctgcgtgctggtggcctgcctactcattggcaatagagtagttggaggtaccgtgggagaggcaaaggtcctctctgctctgtacccctctcatccccttctctaattttattctttctctcttgcttaagaaactgatgtcatgaagacatgatgtggcccagtaggccagaccccaatgtgaccctgtccagaccccaggtccagacatccctcccccactgctcaggtgtatctcaagggccgggtaccattgcttgtgaattctgggcatctcagacaggcagttttcctgccgacctggttatgccatctaacaaattcatttgggggcgagctcggagatgaggttcagaggagtgtgagaattgtctttttaactgtccccaggatgcctggagcaggcttggaggattcttactaatctaatccctgtcagaaaaagaacgataaaacaattcaggctttagaagccaaatccccttcctgcgctcacactcctcctagctttctcccggactattttccctcctttgtgatgaagtcgtggttcagctcctccataagggtttcagtggatttcatgtttcactcttccatttttcatatttaaatttgctttactctctggtttgacttttccactgacccttgaagaattggcgtattttaaggagggggaagagatctcattataggaaatgagaaaaatgggggcagagtttta

SEQ ID NO: 39491 - DNA, 828 bp, Bovine  19866880476068
ctgggatgtgaaagcccgaggatggtgcccctggcacccctgtggcccagggccactgtcagccgccccacgtgaccctgagcaaacaactcacttcaacctctggtttttcccatctgtaaagaaaagggaataatgaccctcctgcttccaagttttcatgtctagtatctcataattccaggagacagacaggcagggctggtaaggggcacaaagactgtaattattactgctacagataaaattaggtaagtaaataatactccctggactgtaaaagaaactaagtggctgcaaggatcatcccattcttcacaattttcattaaagcaggataggttgggcccctcaaaaggaaaaaccagagtctcagaatattcttgccactgagctccccatggaaggaggcatacaaggcattcactgactaggcaggggtgctgattgcctccagggtgctgacagtgcgtctcacaggcagcaacagtgagaaaggctcagaaacagcccccgaagaggtaaagagagggaacaacaggctcctcttcagctgagcatcagagaagatataaaaagggctgagtggcaggatgagggccaggacaattctctcctcctgctgtgaggtgggagctgtgaccctggagtcccaatagccccacctgcctctcggctgcccctgccggaaactccacggggcccgagcccagacagcaggagcccaggtaagccgccccaggtgccagaagtgaccttggctgcaggaagtcctgtctcctgcctgcagctaattgcagtcgctgcagaggagccgacctaattaca

SEQ ID NO: 39492 - DNA, 1519 bp, Bovine  19866880505701
gggcttggctccagaacccagcccagccggccagtcttgctcgggctcacccagagtggcaggaagccatggggcagaaatgatcagaaccttctcctggtgtggccttgctgctccttcctggacatgcttttcagcccacaagccactcttgtggcaagtagtgaccgggacggtgggtggtcagcagttccacacaggacacagcccctggggtaccatgtgtgaatagttgtgtctgccactgggaaccccagagtggaggccccaactctgcagagtaagttaaccaggcaggacttgctagaggaggagggggaggaagagaatgcccatgggactcccacaaaattacctccagagggcccttccccagggcaccttcccttgggcctccctgctccttctcacaatgcaaagagtcggggactgggccaagggaattgttccagagagtgtttcagcctctctgtgttcccagcacaagttactatttttctgcccaaagcagaggaaaaaagtctccttcactgtagcaatgggagtggcctccattatgtgtgggaaatccccccgggtacgaagggaggaagatcagcaagagacgtgcagcagggaaagtaaaaatgcagacaggcctgggatgggaagtttgcagagcgctaatcccgcctgcaccaagggactgattttaacaaggcaggctgtttgcgaggcgctgcgggttgactcacatgcactgttgtggcaggctcttctgctttgttctgcgttcagaattctctcatttcagactttcttatccaaaaatgactgtgccgtgaaaaccattcccattttggacagctcctggattgaagggacatttctttacacatcacttctctgcagtgcgctgccaatcaaagaggcagggtagaaagggtgatttcaggctaactccctatctgcatctgcctctgcttctcgctgagctggggtgaggaccctggggaagaagctgtgctcctgggtggaggaaaaggctgggtaattgggctctgcagctacaaaaacccagcagcccacaggggagcccaggcaggtccctccctacaacgctatctctaacggctctagccggatttggacaatagctataatagcaggcattattgagcacaggcactgtgccaggcactttacatgcaccatttcatcctcacagcaactctgaggagggcacctttatcccctcttacagacaaagaaactgagacttggaggacttaggaagtgagtcaggggtctcatgactgaccacggatggagctggttcccagcacagtcctgactcccaaatgcccatccttccaccctcctgcctcatgggcagtacatccatctgctctgtcctgtagcttggactgagaggcactgggtgcagggagctgggctgggaagagctggtgagtacagagcaagaaacccaggtctgctgggtctccccactttcctggtaagccagtcccagcatgtt

SEQ ID NO: 39493 - DNA, 950 bp, Bovine  19866880521640
ctgagatgaaaggaatggaaggtacacatttgttgcatagttttacaaatctccagatagaatattttaaaaaaacttttttggtaatataacttacatttatgatttaggtagaaagaagtatgtgtgtgtgtgtgtgtgtgcatgctcagtcccttcagtcgtgtctgactccgtgtgaagctgtggactgtagccctccaggctccatggggttctccaggcaagaatactggagtgagtttccatgcccttctccaggggatcttcctgatctagggatcgaacccacatctcttacatctcctgcactggcagacaggttctttaccactagcgccacctgggaagccccagaatggactatattgctaggcaaaatattttcattgatgaaaaaaattattttccatagtgaaataaagggtaagacttaaaggagataattttaaagaagggttaagaaaattttaaaaataaaaattttattagctcaattttgttgaaatgttagaatagtatttgaggaagatgtttttggtttagtatatgacctagggtaattgcagtttcctctgtttttctgtgataacttgcccatgtaatagccggaatgatgtatgtgtgcttcagccattcaaggatttagtcaattaagattttataacatgtattgagctcataaaatgaaactcattttttttgcagtcttttctttgaagaacagtgacaccttgtgaaaagataatataatagcaagaaaatagtacttgcacagctcaagaggaattatctgatccatttaacagtaatactcagaattttaaaagtaaatgtcttctttatttagaggacagactggtagactatttgtaaaattatataacaaatcatttatgactgatattttataccattacagctcagattgtttagttcctttataataa

SEQ ID NO: 39494 - DNA, 792 bp, Bovine  19866880527611
ggagtggaggactgtggttgctgcgttattgctctatctgcacaggcaggcacatactcagaactcagcagatacttgctgagtgactggtcccacccatttcctcatccttcttctcctttaccccagtttcttcccttatttaatgtttatcctgctatagcagctgtgtttctgaaaccacctcagaccctctcttgtacaaggtggggtacaaatagatacatgagaaaaagaagacagaacaataacgaatccatgggtacatcagtcaaccgtgcggcttatgtaatgtggctctgctgacctttctcactccctcccagaggcagccccggagggaacaggcgcagaaggcggtggttctgaagttcagctttgtccttaggaggccctcctaccaggctgctcccagagattatgttacctccagacccagctgaagggttgcctagcaacactcacaggactcttcacctctaaatccctcgtttgtgtcttacgtgtacacagagcggtgtgagcctgacccagcgcaccatcctcctccacagctccccacctaaaacaggctgctctgcctgtgtcattggaaatgtcttctatgcctggcctgtgacttccagcctggacctgtgagctcccgtcaagcatgagcatggaggagggcaagcagatcacgctttgagaaccagagccaccatctcagatgagcacaagccagaaaaaaagcaagggagaaagaggagagatgagctgtgagcccacacatgtcctatcaagaccccatca

SEQ ID NO: 39495 - DNA, 1222 bp, Bovine  19866880541583
actgttctgggtcccgccggctctggttctgggtggacaggtgggctcgaggctggcaggcagaggggagagaagtcagggacaactctgggggcctggtgtctggccaggacctgccctcagtcctgtgccaggctgaagtcaccaagtgtgagacccatcactgggcacaggggtgatgaggcggaaggaaggtctcgggaggccaggcagccattgttggctggcttacctggattaggcttttcatgtggagggaagaaagagatctgctttgtcgcagccgaggcatcaggctggaaacacggttggtgttcctggcaatccccggcactctccagagcttatttgttgccttcccgagacacgtccaaggtgctctctgttatgataacaagtggtgacacagagttagcttgaaatgggataaacaaacagactaaaaataactggatttggggtggcttggcaccaaatccagcttgcaggctgtcgctgctcagccaagggtgaaggcagggatcatcaaaggcaccacgaccctcagagccctgggggagctggggtagggtgtggctgagtccctctcccgtccccactcccgccaccatggagctgtgggctgcctgagggtggaggtgccagatggtgatgagaccccggcgggaggggtatggtgggcccggatgtgagcgaggcggtttatgtctgtttggaggaagctgggccaatgtttggacatctttatggtttggggagtttcttggcctcacccagaggagccacggttgcatcagaattggaggtcctgtccttggtggctcatgcagtgggagaaaagagccaagggagccactctggagtctgtggaaagatggggaagtatgactgctttctaatcccaggctgctgctccagaccaccttgtgcttcatgaagggatttgcgtgatgcgttggaagactgctctgggcgaggcggaggaggaggatgggagtcatacctgtgcggggttgcatacccaggatggatgtacatcttgcagaagacctggcctgaggaaaggcccatcacagggcacagaggaagagagttctggtgcaggacccacctcctctgccgtcactacctgtccatcagtgatgatgctcttagagatcacaggcttgcttcaccactgaccccaggattccctccagcaaacaaacgtccacccggcagt

SEQ ID NO: 39496 - DNA, 3166 bp, Bovine  19866880542766
agcagacagattgataaattagacccatgaaacgtacaaacttctcttctcaaaacacaccatcaggaaagtgaaagtcagtctataggatggaagaaaacatgtatcctaccctgtaagtaacattctataaatgttatagaattctacttaaagaatacataagtaacattcgcaaattcataagaaaaagacagctcactagaaaaatgtccaaggaaggcctgaaaagatatttcataaaagaggatatccacatggccaaaaaggacatgaaatagtgtttagctttattagtcatcaaagaaacacaaattaaaaccacagtgagataacactatatttaccagaatgactgaggtagaataagcaaacaaacccagaaaatacccaagtgttgacaaggatattgaatactggaaatcacatacactttgtgtaactgtgtctgctgctaagtcacttcagtcgtttccgactctgtgtgaccccatagacagcagcccaccaggctcccccgtccctggggttctccaggcaagaacactggagtggattgccatttccttctccaatgcatgaaagtgaaaagtgaaagtgaagtcgctcagtcatgcctgactcttagcgaccccgtggactgcagcctaccaggttcctccgcccatgggattttctaggcaagagtactggagtggggtgccattgccttctctggtaactgtgtctaccaaggttaaaatatgccttccattctaggtgtatgcccaagaaaagcatgcatgtaaacctcaaaagacatgtattagaatgtcataacaacaccatttgtaacagctctgaactggaaaccacggacatacccatcaagagtatgaaggataaatgaattatggtataaattcacagagtggaatactatatattgcgattaaaatgaacagcctacttctatttccaacaatatggaatgagggtcataaacataaagttgtacttcaataaaaagttaaagcaggaataaaaacaaaaaactagaccaaacaacctaaaaactgatgctccaatgggaggtattcctggggttttgtattaatagtgagagcctccacgtttagaacaggttggatggcaaggccactgagctagttgggcccccagtcaactgaaggggccagcgtggccacctggccagcctctgagccacagttctgggacgtgacaggggaaaaaccttgataatgtcacaaactaaaaacaaggacagagtcttctcacccacaaaagttacagctttgagaattcctttgtttttaatcaatttttactcaggcaacgtagaaatacaattgccttcgtttacaacattacaggtgatagaatatcacagatttcctttaaaatagcgtgaggtgggagtggctgggggaccatggttaaaacatgattgctcattatctgatggttgttgagcctgagccgcagatacttggaaccttgctgtggtgttctctgcatttttgtttctgcttaaagtttttttactataaaaagcaaacacaacacatcattattgaaaaggcttaagtcactatagatctctaagcttctggtatttattcctcttttccctgccgcagctaactgtcaccagtttaggtctgtcttaggaggaaacagatggcatgttctaactaggatgatttgaggaggttttagtagagagaccctatgtaaagtcatgtcaagggaaggcccaaagcatcacacagtaccccagggaaagctttctcacctttaggcccaaggaaccgaacctgggagaagagagccaagcaacttgaaaggggccgggagctttggttgtggtcagtttttggagacactgtaggtagaaactgggagaataaatactctggtctccttctcctccattcctttgatcttgtattggtgctcagcactggctggaaggcaaggtcacccgctggtgcctcccagggcatggggtaggctggagcgtggtggagagtggatctgcaggggcacgtggaagatatccagtgtaggtctaaccatatgttttccagtgtgtttgtgtatgtatatttatgaatccagtgggttttcattgttgtctttttttttttaatatccttgggatcatatcacatgcctcattcagcaacttgtggttttcactcatcagtgtgctggtgttctttccatggcagtacttcaagatctacctcattctgccttgtgcctgatagtattccacaatgtggacgtagaatagtttatcttaccgttaacccttgacaaaaacttaagttgcttccttcttgagactttgttgtcttaaccctggagactctctggccatcttgggaacatctggaaagtggccacatgtaaaatgtcgtttgtttccatggagtctcatgattggttgaaggatttttgtgttgtaggatatacttgaactattcaaacagctctgacttttggccgctgagactgctggggagaaagataaggaaagtcatgaggactggatcaagagttggaagatggagtgtgagttccaggtttgcccctgccttgctgtgtgaccttgggcaagttgcttaacctctctgatctttggttttacctctgtaaactgcagatgatattccaacctgcttcacctgccccctgtagtagttgtgaaggtgttgggaaacaaagggtgagaaagagcttgaggtggaatccggtgacagttccctatcagaagacagggcttgtgcttctgttcgccaggcctctccctgcaggcaagatcatggcagaatttccaagaagggtgctgtttccctgctcccgtcaccccaaccacagccatggctcagatttggcttccctgagtattatccaaccttgtgctttttggttgttttttttccatggggctaatttgctatgggacttggactccttttttcctagaagcctgtatgtctcttgggattggaagacatggtccaaagaccagtagccagtccttctctcttctctgactttagatcagagaggctgcaggtgtcacagtcaccactccacaagggcaggagacaagctagaggatagatctgtgtccatacttataccagagcatcag

SEQ ID NO: 39497 - DNA, 1215 bp, Bovine  19866880591980
atcttaatggtctgctaataactgaacagagtattccttaaattcctgaaagccctaagtctcccagccttgccaaggggctctgtatgttggggcatgtatttaatgcctcagaagtttacaaccctgccttaacatttatttggtgctcgcacagaatctcaagattagttcgaggtgacacatcaggcccttctgtgtgctttcctcatatcttcactgggatccctaagactgttaataatttctcagttttatagataaccagggactttcatacatattattttcagtgatctcaatagctaccctggaaggtgtgtgttaatactattttacaaatgtagctgaaccacgtagaggttaaccagcttgcccaaattctcacatgtagtgagacagtagtaaagctagggcttgaacctaaatctgtgtaagtctgcatcctttccacagcacagaattcccttaggcttacaaacaaagatcactattgaagcatgtttaataatcattatggcttctggagaacaatcaggggattcagatccctcaactcatctcttccccaatctttacccaagccctatacttaacataatgctctacaatccgtgaccaaactctgggatgttggtgtggaatgtactgccataccaacacattcacagaagtggtgccaagtggacactgcacatttaagacactgattaggatattccatcacctccacctcctctgacatcacattatgttgagtgttaacccttttcatcaccaagaagcaatttgctatttaccgtaaatgaagataaaagtgcctctttaatgtttttttattgtagaataaaatacacatatagaaccacacaaatacatagcctaatggattgttccaaagctaacagccctgtaactaccacctaagtcaagagttagaaccttgccaactatcccagaaacctctccatatgctccatcccaaccacaactccctccccttcccccaaattaaccattgtccctgtatttatagtgatcactttcctgcatttctccatagaaactcatgtgtgcattcctagaatactttttttattaaaagctttttcaaaatttgatatgccttttaagtctcctattcatttttttcttcctttccttaaagtttatttgttgaagaaaccgggcaacttgacttgtagaatttcatca

SEQ ID NO: 39498 - DNA, 2057 bp, Bovine  19866880661103
caggaggggtggctgttggaatgaagtagctgatggaaagagggtcaagggatggaggggcataacacagcagagctgtggtcgtaggagaatctcactagggagtagctgggtggaaagggattagctcccatttccaggatcaactgtgttgactcacttttagtgacattgtgaaacaagtaatgatcaaccctcctcccccacccctaccccagccgatgattctgtgtagaacccatatattcagaggtgttacagctatggggaatctcttgcctgacccagaagcatttctatataaatactcctcatctcacctcaggatagctacagcctttttaaagaaggagaccagactctgggctgaaagtgggaacataacacagcctgaagctttaccctaagtcagctcccatctcccactccttgcccccgcaccacccccaccaagctgtgttggaatggggacagaaggagaagcaggcagaggctggcagtctgctccttgtatggggagagactgtgtgctcagaacagagataggggtggggtggccccaggctgttggaaattttagcaaaaggtgggattgtatgaacaattctcaagattccccagacaccttgcccacccctagggataagagagaatgaatcaagtgaagattctggaacctcctctgagttcataaggaaatgcttggggtggagaatagccttttcctccttgagttgggaataatacttcttcccacacctcccccagcaagatcaaattatttaatggggattcaattatgtgcttataaaccatttaacagtgtccgctgtgtagttagtagtgatgtcatgtcatgtctgactctttgtgaccccatggtctgtagcctgccaggctcctctgtccatggaattctccaggaaagggtactggagtggttagccattcccttctccagggactcttcccaacccaggtatccaacctgggtctcccgcattgcaggcagattctttactgtctgagccaccaaggaaaccccttttatgtgtatataaataaaaatccagggctaaggtgatattaacaataaataatccaccaattatcggaatgagctcctctttctcttgtttgagtttatcctctccactctttgaaaatcaggaaaaagcagaaagaaaaactttttttaatcataaatcttcttgttttcagaccagaagggacaccctttgaagatggtaagtcattctcaatatgttttctatagtgttaagaagcttctttttagtagaaaattataacaccaatctatctagttaaggctattttctattaatagatcggattaaaactaaataatgctactgagaatttatagtttacaaagaactttcttcccatgtcagcttgatcactttcattgctagttcttctgttacttttgtattggctcttgaactctaggcctacgtggtggggtctacattgagaatagttttaaatttaaatgacctcatagcatgctaaaggtgtccttgaggtaaacatcagaggagtatttatcatgcatttttaactttatatatgttgatcagtgctcttaattgtgtgtaactgccagtagattgacttaacagctatcttttgacacctgtaaatagttagcattctacagaatcttttgcatcttaaattcagtatttaaccaagagccagaaaaatggaaaacttgttctaatgtgtacttagagttgaacttattaaattgattttaaccagatacttaaagttttccctaatacagcatgaatttttaaaatgtgttaaatagatttgtcttagtttatcacagtggctccagaattaacccatcaaggttatttacacaaataatgattgcagaagtatttttaaggagaaaacctgaatgttcagtaggagaaatggttaagcaaattattaaatatctagactgtagagtattatgtacctattaaagaataaggtagatctgattgtatgtctgaggagacaaaaaagttgtagaa

SEQ ID NO: 39499 - DNA, 1432 bp, Bovine  19866880707587
ccctcccttggtaggcaaactgctagctacgacctcgagttaatacctggggccctcaggtgaagtccttcactggggtgtgatagttaatcccccaagggacaccctaggtccagaggagagaaacagtagagtggtcatgcctaggcatggcccaaaccaaagacagacaattgattccttgggaagggcaggggcaggccatacaaagccaagctgcctaggggtgagctccatcatgcagggcagcctgatgcaggggacgcttgtgatggacagagtctcttgaggctcaggacaccacctccatgaggaatcttggtgccaaaggctgtgggcagaggatggtgtcagtgtaggggcccagatgatgcagcaagaacaagcggcagctcccacttactgagcccttccgagtgcctggcaatgtgctgactactttgcatatctttcttctttgcatcttccccaaacccagtgaggtaggttctgttattatctccactttaccaggaaggaaactgagtctaagggaggaatgtgatggtggtcgcgaagctggcacgtgtacagacagaattggagcccagacagtctggctccagagcttgattggtttgtgttctcattatcttggtttgaccctttcaatccagtcttggttgcaggaagttaagagaccccccccacccccagcacattcctcacagattgtgagttgagttggggcctccaagtagactttgacctgtaagccaaaatattaccaaggaaaataaacaacagctatttcaggtaacaggtactgggctatggaattgggaggagaaaaaaagctatcaggatttcctcaaagtccatatttgcatgttcagcagaacaagcatcaccaggaagctgctctgtggccagtgttgcccctggagactgggcaggagcaggaacggtccttcctctctgacccgcaggcctcctggtagcccagggcttgcctcttactcagccctgacctggctctggctgaggccctgggaggtggggctcaggctcttccagtactctgaggagcactgctgcccttttcaggccccttgttgaggcagaacctgcttgtccgcacaccctgcccaaaggcatgcagagtggaagcagtagactagcaactctgttctacatgcttccaaagtgggcatctgaaaggctggcgaggctgggacatgggagcatttgtatttcaagtgactgctgcccatgaatcaccaatttcattctgtgctctcagctctgtgaagacatcatttccacccagtctcacatggagctggcggccagagcctcttagtggggctataaatagcagatcatcaactcacctcttctgagctcatcacaggctcctgggtttactgcgtgtcttcctgctgcctgcacg

SEQ ID NO: 39500 - DNA, 4177 bp, Bovine  19866880730020
cctcaggcaaatggctgagggagaggccagctctgggagcgcctagagggcagccgcccgtggggcagggcctcacggtccccaggaacaacggcaccatatgccctgttcagtgggcgctccgctgggccatgctctatcatggggaaggagaaacgcatggaattccttctccatcaagcccttccaaagccctcggggccaggccatgagtggacacaccctcgtgctttggtttccttgtgagcacttgctcgctcagggggaaacttcttttcccaacgtcctatctgtggcccccccaaccccaaagcaacctccaagcccagccgcaggagcactggcagtgcctcatctgtcccagctgcttgtcctcacctgggccccacaaagggctgctgtaggacttggtggcagccctagacactatgtgacttgctttggtaccaactttcccagtgaacatcacaagttaaaggagagttcatatcacagagagaagagaaaccactacagggagtcctccaggtctcagacccaactccaagcccacgtccctccctggaagactcagcatccaccagccttccaggggtggtggccagtcagtggtaacctctgcctgcaggaagccccaactgctggtcatctgtctcacttcaatctaggagacaactgaaagggggcgccaaggggctcaaggcagggtcttgcagaaatctaattaacgtctgcttctagccagagagggcccttgcttgcaaaaggtcaagtttcttgaagactctatttgccaatataatttaattgttaagactaacaccctaacatttaattagggtgtcagtgtgaaaaaattaaaatgagattacgattaaatgctaattacacagaagatgaaatgtggcaaagatttcacaacccggataatttgcatatcttattagcaagtagcaagacaactgatataagaacataaactcaggtagtgggtgcttctgtgctgtccttcagcaccctccccactccgctggctggggcaaggttattccctctggggccccctattcaggacccggcaggggtaaactggacccacagcagactggtgactgtctcaaagttctcccaacgctggcaagccctacgtggtacaacacctaatgccctgttactctgaatgccatgaggaaccagccgccagggaaagcctgtcatcttgccccttccagagcccagtgtcactgtgtgcccctccaaaaaggcactggtgagtctgaaatctcctgctcttcccttttcctgagctatagttcaaatgctgcctcgtgggatcaccctgatcactgcaactcagggtggccagccacccaacagagccactttccagcccatggtcctgtctcacttccgagtacgtatactcctgaaaattaactggtgtatgcatgttccttgcttcttgtcatctctcttgccacacccgtcctgttctctgcaacattctcagggcttggcagggggactggcacagagtaggtgctcaataaatagtaactgagagaatgattaaatggatgagtgaataaaagggcccctctggggagttacctgataagtctgatgaccccagctggctccttggcagtgctttttgaacccccacgaactggagaaacacctcatggatacatccagagctgaaacaacccaagtacgtggaccgaatggcgcaagaggcagccctggtctgtaggtgcagacagagtgccaagccacaccagcaagggagaggtggctctgtcctaggaacaggcttggtgctgagaactcaagagcaggaaaggatcacatgctcaactcaggtaaggagattcaggagagaaaaagagtctggtcccaagagagttgcaagcttcatctggtatgactggatgccactggcccctttgggcagaggactgatggaagcacaggaacggcaccactatcttacaggtaccagtcaacacttaaaagaacacagtatgcccagcaccgatccaatggatgtccttgaattaactgttagtccctattccaactctgtgaggtggatgctgttatcatccctattctacattagagaaacctgggactcaggttagtttaataacctacacaaggtcctacatgttagaagtggcaaaggatcccagacagacaactctggagccatccagcactcctctgcaacctcgcccctcttggccaccggctcactgccagtgcccttgcattaacccaaagccaaatcaaggggtttccccaaaggctggaatatgcaaatcagatggtgacctctgcaagttccaagttctccagcggctttccactgtcttcttactgccctcaggatgagccatgactgcattagtagtcagtctccctcccgagcacgtctcacacttggcacaggggaggaccccactgggacacttctccctgccaaagtgggggcagtctgtttcacccttaggtgttactccagcccacagctgctctaggaaggcttccctgatgccaggctgggttctgggcttcctctggactcccacagcccctctactggtatcccttggtttcctgccaggccttccccactagaaggtaagctcagtgaggtctggccaggctacaggctgcaacagtgcacgcagggcctgacacatgctaggtgctaactaaggctgaatgattgaagagcctcccgtggatctgccaccatctttctgggtagctgcccgaggatacagctggggactctgtcccttccaaaggaacccctgaatactcatacaaaacctgtccacaaacagggcaacctaaacatctttctgtcttgaatcgccaaaggttaggcttccaaaaaacggctcagtctcctaaaatgcctctgaattatttatgaaaactaaataaataataaaacggacactgatgaactggaggccttgccatggcaaggaagttggaagctggaaaacaagcaattttctaagaatgtgaatgtttactatttttctcttttggcagaagttgacaaattgtctttaaaggtctgcagcctagcaaccaagttctgctgagctgcttgggagacgttaattgtagcttcttcaaacagtatgaagaatgtttaaaggtctaaaactctaacctggtaaccaatgtgagtgcgagaggtgccaacacagctctgaagacagctagagaccctgctctgcccagacacggggaaacggcatggggctcgccttctagttcctctttccaagactgagaccacaagcactgaaaagtctatctatctttctgagcctatcttcccaaggagaaccaaaaatgagctatgccagaaagcatgccatgtctaaagtctgacatgatctccaaaagcagatgaagacgatgacaacagacaactctcaactctgctatcctcagcattcctgtacacgatcatgagatttatgaatagtgtttggacatttcatcctgggaccttggtttctgcttccttttctcgagagtaaagtattatatatcagtgtatttcagcctaagaggcaccaaggggaagttccgttacttaaggaaaagctccagcacttatcataattacagaacacaattatctgtgtaattatttgtttaatgtccatctcctctaataatcaagctgagagaggcagagactatatgtcctgcttatcactgtgcctatttgtggcacagtgcctggcacacagcaggtacttaagacatgtttgtgaaactagtgagtgaatgaatgaatgaatgaaccccaggatttgcctaaatcctgtacgactaaactctgaaacttcctctcttgcctagcagggagagtgaaggcagagggctggcccaaaggattcttccaggcagaactcaggaaccagtcttggttgttgtcccaaagccagtgaaaatggctttggccaggacagcctctccttgccttctatccacatcagaaggccccgcgcaaagctaggagtggcccctctctctaatctcccaaaggatgtctgacagtctgtcttggaagagccatgtaaaatcactaccaaatgcctcatttaaatttctggtattctagcacctcatctca

SEQ ID NO: 39501 - DNA, 2054 bp, Bovine  19866880771915
tcagccccgagtactaaggcctgcagtcccctctcaatcaggctgagggaagccacccactggttaagggccagaatgagaagctgggcctcaaggcctcggccctgtccagggtcctgactcctggtcagagcattctgttccagcctgaggcctcttcctctggtgtgcagggcactccttgatttgcaccctcaaagtgcacatatcatctcaggggcagccctgccagtctcgtctaaacccattccctgcccttttcataactggtggcttctctatgggccagtgctgctgtcatgctaaatactcctgatgctcaaatccccatttatcaatgtccatcttcaaagatgagaagatgaagagaactccgagtcctgtggctctgcatgcagccaccaagaagggactcctgcaccacacacatcaacttgcatgtactgaagctgggaacttgaaccagactgggagcagaccgtgtgtacagcctgaaaaccagcccccaggcttcttactctgggactgagcgagagggactccagaagccctttcaccagggtgtcggaagcccttagctcccagcaccagcagattaggaaggcctttctctccagcctgtgcatagaaagagaagggacagcccaatgaagagatttagcgcgagcattatctgccgccaaaccctcgctttcatctccgccttctctagagccaaatcatttggaagctttcatcgatggtttcctctctgccccacgaaaacttggaatttatgccggcttatggctcagcctcctcgcttaggggacgagggaaacctcacaggctgctctcccgcctgctgtgggaggaaaagcttgtccttggcaacagttcaagacagggaagacttcctcagccctccaggagcctaggacttgagggcgtcagaggctccccctgcccctgcagagacttctgggcttgaacccagggctgtgcacagccagtccccattcagcacccgtgcaatggttcgattctatttttaggtggagaaaggttcaaaggccctgcgcaggaaaatccaagagggaggggaattctcagcgccatgcaaatcacactttcccctcagcctctgcttgacacctgtttccccttagccagctggcctatcctgggtattgatagcagcctggtccccaggatctccacccagagcagaggcccctcctcctcctgctgcttaaagtgagagctaggggaaagaactaagccagccccaggggctccccggaacttcccctccattctccaatctgaatagcccatgaaggcagtgaggaggtgagattctcagaggcgggttcctcagtttcaaaacagcaggatgactactgcctttcaggaccagggagacacaaaaagtggctagggttttactaatccagcccaagtagtaactgcgagccgttgtagctctcaagatgagggtgggggtagagaaaggtagtcccagggactcccagggccctagcacactctgcctcctacttcccaacgcacaagaacacagcctgtccacacactgagcagggctactgttagttgctcagatgtgtcgactccttgcgaccccatacactgaagccccccaggctcctctgcccatggaattccccaggcaagaatactggagtggattgccatttccctctccaggggatcttctcgacccagggacagaaccctattaagaacctcaagaacaacatcttgccatgcccacctcactcccagtttttattccagtccttactgcattcctagagatatctccttctgtctccacccctccactgtagggccaagggaggacagctggttaagggatgggaacaggatgcttcagaactcaaaacggtgtccccacctccaatccccacaaaagatgagtcccagggtaggccagctccgtggggagtcctttttcaaatgcaaggttctgtggaagacacccctagggacggctaaggacagcagctccggatcaccactgctgcgaggag

SEQ ID NO: 39502 - DNA, 1895 bp, Bovine  19866880791112
cagggagaatgaacgatgaggcgtgggagataagaccaacacccatgtcatggacgaagactgagatcacaagatgaggacctgcctgggagatggggcccagaaaacctgggaagccccactcctctgagccctcttcattcctgtttccaaggtggctcccctgctcctcctggacctggaagagcattcagggctggccctcagctgaggagcagaaacaggacaccctgggatgaacagaggcaggctggattcaagtagagtgctcaggggtgctgatggggcaactactccagccctggggcagcacgggcaatccccccatgggtgactgagcatggaggccgtgcactggtgaaccactgttagattgctccagccctcaatctggacactgctcccattcgttcattcaaccatttatggagcatctaccatgtgctaggcaaggcaccagataccggggcagctatggttgggacaggctgaaccgctgtcctctgagcccagcccggccggcagcctgacctagcccttgtgcttctgccttgcagacactcatcactgccatggggcagacagcctacaccgtggcctccgtgctcatcctattcttcgtcctgatgtacatctttgccatcctgggcttctgcctgtttggacttccagaagggggtgacatgaataactgggggaacctggctttggccttcttcactctcttcagcttggccacggtacccatgtttgggaacagtggtgggggtgggggtcaggcaggggccttgaaaggggactggcagctggtgcaagtgtgtggacatgctgggcctcacttggggtctttcccacactcagacacttagctggggttggggggaagctgaggaatggtctcccaggacaaggcacaggctagcaccctggccaagagtccatcactgactctaatcttgtgactccctacagcattcctatttgccccatggggtggtaaaacttttcaaaagttctcaaaagataattcatcctaattgaagtgtaatttaggaggaaaacccacatcacaaagccttttggggaataggctgtcacaaatccatgcagaataagtctgcaaaacctgtctcaaagtctagattctactgggttctggcaagattgaggtcttttccaaaggagggcctggcagaggggcagtgtctcttggggaaagctggaaggccttttggagaagagcccttagggcacattggacataagtgcccacacccagtggtgccctgcatctctgccagcctgtatgcactggagtcggtggattagggggtgtgatgtggaggggctgatgtggaagaagagccagcctgctcctcagtagggccagggctcccctagggcaggtgagcaggaggcctgcccccctgagccttggcacttgccctgcctgagtaggtcgatggctggacagacctgcaggagcagctggatgcccggaatttgattctgagccgttcattcaccatcatctttatcttgcttgcctcctttgtcttcctcagcatgtttgtgggtgtgatgatcatccacactgaggtgaggtggcgcttgtaaggattggtggggcgggggcgggtggtgttggttaagtgtggcaggtggatcatctctgagccgtctcgctctggaattggaagggaggggaccaggtgggcccatctctatgccggcgcaacccttctccctgagcccccctcatgatggtggccagcaggacaggtacttgggaggtcattgcagctgcagcgggcagcttgagttgggggctggccctgtgagggggtcctcctgctgaggggcctgagtggcagtgggagactggggaagagggg

SEQ ID NO: 39503 - DNA, 1076 bp, Bovine  19866880822417
gaagaacagaacagggcccatgtccacttcttgtttgaaatgattttaaagaatttttttagatttacccaaagaacatcctagtttttaaaaacttgtacttgattaaatattccttggtaccacccaaggatctgtaacttccctggtggtgaaaaacagtctttaaataaaaataatctcacatggcaaaaaaagttttctaataaagtttctctttaaaataggaaagaagacatggttatacaggtgctgtgaactgatcccagaaagaatttagagtttatctttttgaggtattggttgttagggaaaatattcacctgtaacaatgtggatagtattaacttactcagtgttatattatgtggcctcaggaacagtttcatacaatacagtcaagtacttattaagcattgtataagatctggtctcttacttttttttttttggtctctttttgatgtgaaaataaaattagaagattttagagcaagaaggattttgagatgatttggtgacgtctctgcattttgttggttgaggagacagacccagagagtgacctgccctgtgtggcgctagctaggagcagcaccaggacagaaacccttatctcctaatctttccacagccccgttctgcccatccttatactgagatttcagctgtctttgaaatttagattttctgctctaggtctagatttcgaatagctattagtacatatttcctctgtttttcaacaaacatcatttcgaaattagtatcctcattttcccccttgaccacttgtaagaattggctttacttgttccctgttaaactgatttgacagtaaattgaaatctgtctttaacagtggtaataatttaggagcttctttcaacatgaggcacaaaccatgatctgaaatagaagttctacttggtcaaagactaaatgaaacgtgtcccctttgcaggcgttccagaagtagagagagagatagaagtcgagaacgaagaagatctcgaagtcgggacaggagacgttcaaggagtagaagccgaggccgaagatcccgatcttccagt

SEQ ID NO: 39504 - DNA, 1327 bp, Bovine  19866880826326
acaaatccaaggactctgacacaaagcctcaaataagagcagactcataaaggaaaaacaaaattccgtttacaatcctgtggggattgtaaacaaaccattaaacaatctgcacatcgttctttcatctctgcccagcattgccaaccctggaaaccccgcaatgttcatactgtaatatctggtggccctaaggaagcatttcaggggatttcgctttgtatgggcctcagcattcagctgaggaaaacggacatcccttcacttttcctcaggtgccagatttgataagccattgagccaaccagaggggagttttaaatccaaattatttggggctttagagatttaagaagcaaaacaaactactgcttccgacacaatctcatcaatagctgttcgtagaacaaaatggagaaaaaacataaaagtgcataccagccctcagcctgtaaatttaactaccgggctgaaagacttggccgaaagttaaatccaggcgacgctctcacgtgatcggtcctaatggcgtcatagggacacgtggttctagatacttcgtcccctccccctcggaggtggattgttgacaacgccgccggcggtcacgtgatcttacgtcatcctacctcctttccctgaaatctctggccccggatgtgtccctctctccccacccggctgagcctaaactagtgaaagagggggagacgggttggtgtttcagtttcggtccttcttaatcacaacctccagtctgagcatagggaacaataattggtcgattcgttcaaggagacaaaagggataaggtccctgctgaagggctcccataactagctctcctacgtcccgttcccttctcccccacccctcactgcatggtaccggcggagggcggagggatctggaggcggcggagggagacgtcattgcagggttgtttgtgcaacctcggcggcggcggtgacccacagtgattcggccgccgcgccggggggtgggggggggctgcgcgggactcttttctttcagactgaccgcggggctgctggggagcatgtcgaccccggcccggaggaggcttatgcgggatttcaagcggtaagcgccttcattttcgcctgaatgacgactcctccccaaagctacggggctagggtggggatccgggacaccttcccctcttgaccctaagagggctgctgtgggcccagggggacagacggtagcccagttctagccccgttttagcactctcttctccttggttgttcacttgtcctacgtaagaaattttgatacttcctcaccaccaccctacccc

SEQ ID NO: 39505 - DNA, 1024 bp, Bovine  19866880865834
cgctgccgaattctgtgtggcattcctctgagcctgttggctggcagcagggcgatgaggtagctgggttccttggttgcgggggctgggggtgtgggctgggtgtttaattagcccctttaccagcctgtgaatgaagcagctcctccccgggctgagcctgccagctctcccaggcggtggtgggtaagtgggctggagtggagcctgggttccagattgcactgtggaagtctggagaggcacagggaggagggcggtgacaggttaaagctcttcctcctgccctccctagacagtttgagatgcagccacagtgacaggcagagagggtggggctgagaagggagggtagcgcagtgatgaggaccaagggctctggggtcagcctggggcattctagtcccgtttctaccatgtagtagctgtgtgatcttgggcagataacttgccccctctgtgcctcaggtttctccttcgtaaaatcctacaccacgtggtcattgtgaagcacgtgcctggtcctaggaaggactcaataaatgaccataattgttatctttatgctcaatatttataattatttttaataaaagcacggcattcacagttttagaaaattaggtgtagggagaaggatgcctgctgcttctgtctgaccaacacgatccaggtcaggagccactggccacgtgatggccgctgagcccttgagatgtggctggtccaagttgggatgtacgtgaggcacacccagacttcccaatacttggtgtaaataaagtatctcagtaataatttaaaactattgattatatgttgaaatggtattctctgtgtctttgggttaatcagatatattattaaacttaatttcacatgtatcttttttttttttaaatgtggctggtaggaactgtacaactacatatgtggcttgtattggtggcctgcattgcattttgggttggacagctctgcctttctctgagcagggcaggccttgaagcccttggtctctcgt

SEQ ID NO: 39506 - DNA, 789 bp, Bovine  19866880892167
taacacgacactagtgcaacaaaaggactagattttacttctatctacttttaatacactgtatttaaacttaagtagacctacgtgactagtggctacctattggccagcacagctccaaaatatcttgattcgaccctttcccctcgtctgttcttcatttcactatcaaaaatacatttcatcataaagagcttaaattgctcttttgcttttttatgtgtgtaatgcttatgttttaacttttggctgaggtatagaggccagatggaggtaactggttttagacccagtacaagaaaacgtggctggctccttgagtaaagggaaaagagcggtgttttctatggacactcttgcagttgacagttgcctggtcgttaagctggagatgcagctagagaggccgtggtgaaatgtatccttgctggcagcgaggaggttgcctggcaaggttgcttggagcctgaagaaaggggtgattgcccacgtcaactcctctggcccacttttgggagtctatgagtttggactgctttgctccttttcttggcttctggaaagccacagatgaaatttgtgtcttacaaagctttgtgcgctcagtcgcttctttgcaaccctatggacagtagtccaccaggcccctctgtccatgggatttcccaggcaagaatatggaacaggttgccatttcctactcaagagcatcttccgacccagggatcaaacctgcgtctcctgcagctccctcactggcaggtggattctttcatcatgagccaccag

SEQ ID NO: 39507 - DNA, 3748 bp, Bovine  19866880916919
aaaaggtaggctcaccaagtctcatctgtgctacgaggttagttatgatagaaaggcactggttaaattaaacagggtctttctgttcaatggaatactctatataccccaccattaaaaatcatgaagcaaaatattttactgacaggaaaaaatgttcaccatgtatgaagtagaaaaaaagtgactgagaaaagtgtccacaatatgactcaaaatatatatatataaacatatgtacatacataggaaattccctcatagctcagttggtaaagaatctgcctgaaatacaggagacccaggttcaattcctgggtgggaaagatcccctggagaaggaaatggcaacccactcccatattcttgcctggagaatcccatggacagaggagcctggtgggctacagtccatgtggtcgcaagagtcggccacaacttagtgactaaaccaccaccatgtacatacatgtatactcacaaaatacgtgttcacgcatattgcttcgtaagtgggcaaaagacagatttttcttcttggtactttactgtgttttccaagttacaaaacatactatgcgatcaggaaaaaaaaaagtatttattaataagctaaacagaccacacaaacctaacagggtgctatcgttcccgtaagagagagtggcctggttaatctctgtgggatatgaggaatccacaaacgttaaacccttctatttaaagcttacagttttaaacaaataagaagatggaagagactcattttcaagcttacataacagaatcatagatgaagacatttagaattacaatggccctctcttctacacatctgtatccacagctgaatggtcagaaagctggcatctctcaatgcagaagtgtgtcttctctgtgcagagttctaatttacaaagttaagtttttagaggctctctgcagacgttctatctgaatgtgactttctcctccaagttagaagttgacccccaatctacaactgacttaggacaagtaactggtcaatcaactaatgctttcaggacagggcatgcagaaccatgtagcaatttacaggtcaaattcctatcagtagccacctaccctctcctttaaaatatgcaaagaacatatcgcctctttgaagccctccaaaacaaacaccattccttaaatataacaaagaaacagactcaattttgaacagttaagttgttcattcaaaggtctaggatgttcctaaatagaatagcatccatatcttgaattattccacaatccttcaaaacacagacttgggttagaaaagagctgtggccttagagtaagtaggaagcagggccttggaaggacggctcattgctgcttcctctgtgagtctgagcagcttccttcctaccactcctcaacttggcttcctaatacccaaactcacaaggctgctgggaagcttcaatgaaaccacctacgttatttcccaggtcacccaacaatgagctactaatgcctagaaaacactcactggttcgtaaaatactttgtgactctccaaactgtcagaaagaaaactgacttggctgcatttcaggtaaataatgcaatattagaattacctatcaatattaagaaagaccttaaagtaacatttttatatcaaaaaatgtttacattaaaaatatatcaaatttttagggctgggcggggattggctggaggggcggtaattcagcggtttcaaaataaataaataaataaaataaaataaaaacatatcaaatttttaaaacttttctatctggaagaccaccaagttacgatttaaaaaaaaaaaaagaaagaaagaaaagaaagtcagccaagagggctgaaccagtggctacagaaaaggaaagggatctgagattaaaagaactgtctggaaacagaaatgagtgcctaattgataacaggtaaaaggccttcagcagtgtgacatctgtagtcttggaagaacctgccatggtccctcaggacaccaagatttataaaagtctgggtgtgtgtggctgaactgtggagccaaaatatcaagtgccaaccccagccattcctcattggaggtgatttactagagatgccacaagtggcctgtttctttctccaacacttttaaactgcctgcagaacaaaggcacacatcagtgctgttctgctgggaagggcgccatggccctaaagagcatcccatcatacacagcaacttaggcgccaataagttggtcaccgttcagaaacatctgtgtctaggagtaaggaatgagaagtccctggtgagagttttaggtaataacccgtagaagacaaaaagataaaaaacactatgttcccctgaggctaagggcactgaccagggtcacctatatgagcccaatcaaggggcttcatggattcaaaatacctagacgatacagggaggacactgtgggagaagttcacaagcgcaccccaagccttggccctcaaggtacttacttacacgtgagacgcacagagacaaagctaagtcgtcgcattcttctgttacatgatctaagctgcacttacatcctaattctgccactggttctctgtcagcttcacccctaggcctcatttgcttcatccctttcagtgctaatgttcacaggttgaatatcaaacaaggctgaaagaaaatcacaaacaaataagaccatgcaagggctgaattacaaacagaaagaacagacaggagactaacatttgtggctacaaagacgtatataaggcacgtgggcttcacttcctctgcaggctggcctgcacccccccaccctatctgaatcatccttctgatggccatgaatgactccaggctgcttcatttgtgataatctttcagaactcaccttacttggagtgttggcagagcggattccactctcccttttaaaacaccgtcttcctttggattctgtgtacaacactggcctgactgtcttcctatttcactatgaagtctttctcagtgatctgcaagcacctcctcttctatccaaccccttaatggattgagttctgagtcctcccctcttctcacactacagtttctgcctgggtgacctcatctattatattggcttggttccatacacatctatgtctccccagttatctacaacccagacataaagctaccttcttggaggtgatttagggatgtctcatagcaacttacacttaacaatatccaaaccagaaaccttgatccccgcacccaaatcctgttcctttgccacacttacccaactatagtaaatgtcacttctgaccactcacttcctcaggtccttaacctgaaagtcattcttaaaatcccctgctcttcttcctcaccacccatcaccattcctccctactcagggaaacttgggttttctcttgatatttttatgccctgcaagagttgtgtatggcatcattggttcccgctcatgtaaagaatggaaagcagctccagcctccagacctttctgcttccctccatcactccccagtccaccatctcctgctgtgtccaccaagcgaagatgcctcacctggacgaatgcaacagcctccttgctgttcccctcgtgtgactcttgccgccttctgcgtccacttcaccctctaggtccccacagtctgcccactgtccattacactgcaccctcacccttcctgtcgcctttctgtgcggccacca

SEQ ID NO: 39508 - DNA, 2013 bp, Bovine  19866881139959
atgaaggagatgtgggctcgatcactgggtcaggaagatcccctggagtaggaaatggcaacctatggccatggaatggctgttccgcagacagaagggcctgggggctacagaccatggggtcacaaagagtcagacaggactgagcaccatgcaagagcatttcaggagactagttcctccctttgatcaggagaaaagagaggcttcccatgcttggtgactttactggtgacacagagggctggcggccaaaccagggttataatcctagcttcagtgtcgcttctctccccgtgtttcttgttctttcctggcaagacttgctgagcgattcaggtaatgcgcagcatgcagggtcccgctgtaaagaccctgtgaggctgtgtgggggaggcccgggagcaggggtagggaaccctcctgtctgcttggtgcctgtaatatatttgaattatctccacagatgagccctgatttagcaaacagtctagagtaaacctcagctcgaagacaaatccaattgacactgggcttgagtggttcaaaggttattggcacaaaactgtcggctttgtttagctgagggactgtatttatgacgggtgatacggcagtgccatccataactcgcctgcagcaaggctgacgtggggccagagacaggctatttacactgagcctggagtttagtttctctgctgggaaatgcaaaagccattcaactcttggccaagttgctttatgggttgccgtcttaggcctggtgtcataatttgggtcatcagttaaccttgttggggatggacagcatcctcaagagaattgtttcctgggtgtgtgcagcgaggggagctggggtaggagaggtcgctggggatgtttgcaaggacctgggtttcactttgacccctaatttaaggcccacatacacaggagtagctactctgagtccctgggttcttgattactttctgtgtctcctggatgctgtggttaatttaggaaaaaaggactgtggctaagtgttgcactgaacagatgcttttgtctgcagtgtcagacaagcaggggtttacgcaccaacttctttggaaagaaataatcccaggaatatgcaaactggatggaaggagccgtggccagagctgcatgggtggctttttggaaaagagatactctgtattaagatcctgaacgtgtgcttctcttgtgacccattcattctgctgctgggaatccatcctgaggagatcaacctcgatgtggacaaagattcatgtacctaggtgttcactgcagtgttatttataacagcacaaacgggtaaatcaacttcaacaataggggatttctttggcactctttctttggctgcactgggtctttgttgtggcacacgggggcttccctgcttgcggtgggcgggacttctcttgttgcagtgcaaaggcttcccactgagatgcgagggcttctcttgtcagagagcccggctcagtagttgcagcaaatgggctcagttgccctgcagcatgtagcacctaaattccctgaccaggactcgaacccatgctccctgcattggaaggtggattctcaaccactggaacaccagggaagtccggtttggcatattaataaaatgtaattctgtgcattgattcaaattgatgtgtgtaaagaatttttaatgatttgtcaaaatgattctaggtagaggaagggaatattttataaattgtagtgtgttttccgttgtgtaaaacagtctgcaaagaaggggggaaatatatgagaatcgtgggaagttagctcaggtgacgactgtggttttaaagtctcatctcttcatggaatatgttttaagtttctattggggatgtgtatcacttttcatcctcagtgacaattcctcaaggaataaacaaaaatccaagttctcacttctttagcgattctactcttttccagatctcagtttccctgggcgtaaaaggaccctggcctgct

SEQ ID NO: 39509 - DNA, 1616 bp, Bovine  19866881165194
cagatggtcagggtggtgtcggcaatgttcgcagcatctctgccaggctagtgagatcagagcacggcttgagccgtggggggttctcaagtgtccgtaacacagaacatctcaacctgtgtttggggagaaatccactagccaggatccctgggccgagcggagcagaaaggggcaccttggaggggcgagggagaagggtgaggtgcccaaagtgctgaaaagtcagttctctggaattccagaaaccagcttgccatcaggattttccagtgcacggctaaaacttgtctctcagcccagttccatctgtcagctaaggacttgcgtggagacatggacatctccctgaaaggtcctggcggagggccccttctgatagcaggcagctgtgggtaccgtgtccttaaccagaatagctgggagtgtgtggagggtccctggggatgagaacttgagaatatctctgccaggaagaacgctcaagggcacatggagagcaggggagctgatgagtgaagacagggctgccattacctcctccctgtctgctgtctccagtcttgtgtcacctgctttgcaaatcaagccatctttctaaacccagctctgatttgtcactcctcctctgacatggctctgtaaaacccgggagtaaaaccaagtcccctgagtatggcattgaagacctttccccaacgtggcttcaacctattttcctgcttttatgcctgtaatcttcccgctctggctaaactatgtcctgtcccttctctatccttgaacacactataaatcctcagttcccttgggctggaatgcccttcatctcctttgcctcacttaatccctaactgtttgtggaacacctgcttcagaccgggtatgagtcaactgataaactcctattcaaccctcaaaacccgaatgtcttgtggtctaatatacctgcaccagcatggtctcccaggtcactcgttctcccctgctgatgatgtcctgtgtctcttattcttagagtattatatctgcttttctcactgtgccttggtaactttcctctatattcctggcacaaggcttaattctctgtaaatagctgttcagtgttttcatacagagaggagccattagtgaatgccaacaaagcaagtgggaggacctagtccctggggttgtaaggacctggaatgatgaaagcaagaagtgtcagctcatgtttaccaggcttgtaccacgtaccaggcactgtactgaatgcttcccatgcgttagcccattgaatcctcccacaatccaagagatgggtggcgttaccccttcctcttacagatgaggacactgaggcatgagaaagtcaatcacttgttcacggtcacacagcctgtaagcagctgagctaggatttgaaccttacacagaggctctcaagctccccacgcctgcttcctgcgtggcccccagccctgcgaaggcctggggagaggcaatatgatcaaagatgactgagggggtagaagtcttacctcttagaatggcacatgggatctggggaggaatccttttaagggatgaaagcagttttttaaaaagacattaatctcctcactcacttc

SEQ ID NO: 39510 - DNA, 1569 bp, Bovine  19866881169587
attattgggtgccagcggctccttcccggtcgctgagtgggggaggtcacggggtgttactgacaggtgttactaacctcagtttttctaaactggaacaagaatgagctcaatgggctggagattttctgtcaagcatgatacaactgtgagggctgaagccctctgagctgcctggagtgccccgccaggtcctgaaccactgcccctctctccccgtgaggccagtgcccctctcctcagcctcctctccgaggtggagacgtcctcctgttttgtgtgtctgagacttgtccacaacagggtgaaacgctgagccgtgctcaggctatcccagttccttccatgtcaccggtcctcatgccaggtcagttgtcctcacgtcaggtgtagtggctcaccaggtggccccaggcaggggagtccaggcccagaaggggttggggtggcctgtgcttgtactcaggactcacctgggggccagggtcaggcctctgcctgtgctcctcgtggagggccccaggtctttgtgtagcaagactctcgtcgtgctgctctgtttatgctcctctctctagaaagatcttgaccacaagagtttcactgaactggtggagaagtttaagaagactttgcggcacactgaccccatggtcttggatgattttggcactagcctgcccttcattgacatctacttgtccaccctggacaaccaggatgctaccatctacaagtcagtcccagcccccctgaccctggcccacgggtcctggtggggtgctggctgatgtgcagggaaggcagagccaggtccttcctggggggtgtgtaggggctgggctgctgtatgggcaggcctgttgctggtggggggagcactgcccactggccctcctcagtttaaaaaactgacctgtttttaaacattgcttcctttgattctccaagagcacctcaccaagcccttctcagtggggcagaggcaagacctctggctgcaagtcagaagctgaagctcctgacctggttctgttactgcttcctgtgtgactctggccaagtctttgtccctttcccgcctgtcacaggaaggactgacactaggaaagcagtgtgtgtaaagctcggggctgtgctcagtgtgagttagctggggtcacactggccactactgcaggaagaagaggggcacaattagcctgatgtctcagcaaaagccccctggagggctttgtacactggagggggtctaggaatgcccagcgttggcccaagagtggatctggcagtgtccaggccgccctcaggcagtcacctcaactcagagcccaggagtctgctgtctccaacctaacatgggcagtgagagaacttcctcccagagcccagggagcctggccgacctggccttcccacccagcccagtctggttctcaggtccatgctctttcctgccccacacctgccaggtatggtggacatgcaggtgcgagcgtgcagtgggcagggccaggtggagcggagctcactgtgagtaaggccctcctcctccactcccaggcttca

SEQ ID NO: 39511 - DNA, 978 bp, Bovine  19866881179506
ctcctcagcgggctgtgctagtgagcatcaggtttaataggggattaggaggaggaattaaagttgcccaaggggtacatgcagagacttcaaacaccttttggaaaacaaattaacgtggttttcagaaagccttttccaagggcggcagagggtttcctcgggcttccccgctttcttttgaaatgtatttttaacacttgtgtaaacagtttgggcctgtgacacggggcttcctgggctcccttcattagctggtgtctctggaagaagaattcagctcattatctgggcgttttgatcttcctggcggtggccgttgcttctgggcccggcctgggcccacccttctctctttcctgtcgcctggtggtgtggaacccataggcatgtgtcctggcttgtttccacatctgcccactgaagcgtggcttcccagatgcgccttcagttcctggagaacgtcccgtctccttggcagagggcagtggtggggagggtggaggctggccttccctcgggttcatctgtgacattggcagaatcggcctttgccaccccggctcccctggcccctctgtttatttcctgttgccctctcctcgggcacatctgcagtggaatgcatgacctctgaaggtacagagttccccatcactggaggtattcaagcagtgtcctggcctaagtcttgaggaaatctgtgccctcctatggagtggacctaagtgggcgttaaagttccccacaaatctgggattctgtgatttacattttacaagcagagtctgagccagaccacgtgaaccttggcagccaccaggatccctgtgatagaagatacaacgccttactccagagagtcagcaccagtgacccttatcctgctgcccttgcctggggcaaaggagagggtgctctgtcctccagaggttccaggcttctgtacagtcatgaggacacctgtacagggactcg

SEQ ID NO: 39512 - DNA, 1277 bp, Bovine  19866881250875
ttagcacttcagtgtcctgagttcaccagcagattaagctcaggcaggcccactatcctatcttaccactatctccagtaccaagcacagtgatagggaatcctgccgtgactgactgttacactgctgtccccacatgaagtcctcagtatttatgcttagagataagcatgtaagagtgggtactaaataagaaagaggaacaggggcagagggtaagaaacatatatcaactgaaagagggaaattaatgataacttcaaaagcaaagcagcactgcactaagtatttcttgagggactgtacaaagcaattcaagtctagaaaaccaaacctcaggctccctccaggaagaaagaatatgggctttttactcagcagcctggaaggccttttagagaccaagctgtggaatcttgtttcattgagctttaaaataaggcttttttaaaaaaaataaggcttttttaaaaataaggctgcctctttccatgatctggtagataaacctgaagccctatgattttgattttcactcatctctaaaaaaggtgaaatgtgtgtgaaaacagggtatatggatggtgtaaacttcaggtagacataagggatatgatttgcctcagcagagaaaaaagactataaagcagaatcacaattaaaggtacactgttgaaaaatccaaagtgtataattcatacctgccattattacatcaacataaaaaaaataggcattttaaacatttcgaccaacaaaagagggcatgatttataaacacataaatatccatgcatacttttacaatgatggctactagaaaaatgagaactttaaaaatgccaatctagacaagattccctttcattctaattgcctctttcctacatgttgttaataccaagaatcttaagaggctgctgaggtcaatgttgcattcatgccagcctcctttccaagcctgtaactaatgatgaaagtgtgatgaatcttctgccttagctttgatgctaggaaaaaaaagaaaaagttagtagccgtgttagtctaatgaatcaaattcataagtaaaaatacagcagtgatacaaattttatgtcctacccagatggtatgtaggtagactcaaaaattattaagattttactatatacagaagatagagcaaaacactgaccataccatccatttggaagccagagtttttgttttgtcacctgtgatctgttaatgctcacaattcacaatgataacagaaatacttaaaaaataacttt

SEQ ID NO: 39513 - DNA, 2992 bp, Bovine  19866881273838
tatctggctgctcctggtcgtaattgtggcatgtaaagtcttagttgctgcggcatgtgggatctattcccccaaccagagatgaagttaggtcctctgctttgggagcactgagttccagccactggaccaccagggaagtcccggtgtgtattacgttaatttacttctcatacagctcatttttaatagagggccaactccatgcaaaacagtattctaagaaccaggtcacaaaacagacagaagtaaagttgtttatcccaggaaagacaacaagatacttacttaaaagaagatttctaaagactagtttagaagggctctatattttccttccccgctaacaccaaaaaatcagtacaattctctccttactcaataattaacaagctggaaaataaatttactatgactgttacccatgtaaacagttacctaaaaaaaagaaatagagttaaaaccaatccttctctactttcaggagtcaactttttaagatgggagtcagcatcattagatccttctgtgcacaatcgtcatacacatgaacatacacagtggtaggtgcatgttgaatcggtatgtttgtacatagtatgtacacattcaagctttaattgtacacttaacaatgcctccctggtcccagctcagggctcaccagataactgttctttcttgactcttcggatactacagtagagagttcactgaaagcaatgcaggcctcatttcttaagagagttagaataactactactgtaactactacatttctagaaagtttgaactgaatgaaatccaagaagacagaaccagactgtgaagactagcaaataattttttaaaatagttcactgactacaagggaatcaactaagagcttctatatattttaacaatgactaaataagaattctcttttttcaaatatttgtttggctgttccaggtcttagttgtggcattcgagaactaattccctgcccagggatcgaaccgggcacgtggagttgagagcatggaatcttagccacgggaccacctaaatctgaattcctaaagcatatgctaaaacttgccatccctgaagttgttttactgtgcatttaacccccgaagtcttttcgtgagctattctttacaaacaattcattttccttctcctgaatgtagcagtcattattgccaacataaagaactacaactatttttagtaacttcagagcgtattcatttttaaacatggagaaactcgtcctttcaagaaatccaagttccgctctcttctcaagagcaaacacataattctcagaggtttatttcatgctatttggcttgtaacaaccatacagaatcatacgcgatttcataattctaaataaaagtacatttgtgagcgacttcactcagaaaatctattcagcaaaggctaaaacaaatgccagtagccatgcactctgccccaccacggaaagttttgatactagaacagaacataaataacggcctcctttgtcttctttctcctccttaattgtgccccactgcgcagtttccccggtgccggaatccttatttgacaagagacgtgtagaaatatattacctgttgtgcccgaaagcgtatttattagtgtatcagcaataacaactttgcaggagatatacgcccacactagagaaagggctgtgtagcctccgataatcaaaattgatagcccgccgtcgtgcacccggagttctgcaagctgcacaagtcacaggctactccatctagatgtccatctcgaagtcggcaagcattaattcaaagtggcggggagagaagtgattctgacctcccgaagaaaagaaagggtgacccctccccccgccgcaagaggaatttccccccaataatggcttcaagcccagggaagagcaggctacaaaccggggcccctcctctcgctccgagctaggccagagccccttctcaggcgcgggttggagacctcttctcaccagctagctaggccttcattctggccctctccttgccttctccatgagcacccgccgcccagactctgtccccggcccttctgacaaacccccgcgcgtctacttacctcagccgctactagcccggcccctcagcgtgcccaggggctgcccatcggctggaaacctcacgctggcgcagctcctttcccagcccgacgcctctatactgcgctgagagcccgagacggacggaaaagcagggagggcgttggcggcgaagtggacgctggtttccagctcccaccgcagccaccgctcacagatctgccccggacgcaggaggaagaggccaccacagccccgtagagcgaggtgcggcgtgcgcgagctcgcgagtaccgcgcacgcacacgcacgacgcgagacccaatctcccgccgaggaccagcacgcaaacctggggaagagtagcccagggagcctggctgcgcttgcgcggcaagaagacggcaggaggcggggcttaggctggagctacttaggctctggtgcagatcgcgctctcaaaaggctaaaaacttcgtggatttcatggcacttcagtgatactggatctattactgaccccatttttcaaattagaggactaataaatggtggagctaggatttgcacccagcatcctttggcaaaaagattgccttattgttctaggcgctgcccaaagtacattgacaggacaagcctaaaagttacttatggatgggcggggtgaggtctccacttggaaatattaataaaatggggaatattcaaataatgaggtgtttgagctctcagttttaggatcatgtaataatgaagtctcattttgtgaggctaactttaaaggttaataatgtttttatgtccatgatctcctctgaattaccatattcttcattccaccatcacaggaaggaataagacagctagttcgcttacaagatctccatttatgta

SEQ ID NO: 39514 - DNA, 726 bp, Bovine  19866881377799
atactgggcatggttcattgtgtagtaaaaggtccccagcttccagtgagaaagcgccacagcctcctatatactgaagctcctacacctttccttctgacctttggctgaagttccctgcgctatccatccacactctggggacttcccaggaaggaaggaatgagatgggctgggcagacccctctgctcagtataagaatgcccaggttggacaggctggcttgtcctccctttgttccactgtctcagggcagagcaccagcaccacatcagggggtcacagcccacaccccacactgtggctcttacagggcacacaccaaaccctttccagacaccactgccctatgaggccccagtgacaccctggaccttccattggtcccatggctgcctgagagaaaggatgccaggacaggaggcatcctgtgcattatattcctgggtgggttagctcaggggccacagatgggggcctgggaaacctcggagaaccagccgagggggcttcaggagagacctgcaggtcagccagtctgtgggccctggaccagtttgtgggccctggccagcacacagcggcggccgcagagaagtcattaacaatcctcccccggggttcggaagccaggcctggccggtcccaccagcgcggcttctcccggcgtcaccaccgcaggcggccaacaggtggcaggagagcttcggggagcgctcacctga

SEQ ID NO: 39515 - DNA, 1234 bp, Bovine  19866881379033
caatgtgttccccatcaacatttgaattatgggcataggccctgaaatgttagttttgtgctaagataaatattggaatcatattcactctgcttttttgaagtagtcaacatcacgatttgtgattgaagagcgaaggcaccacttgctttgttaagtaacaaaagcctaaccagcaaggctcttggggagagggatcacaaaggccttctagagctttctcactgcctttgtgacctttttatgtgctgacaacagaccagcacagcttctctgctggcactgggcaaatctcctgagcctctgagccgagccctgggaggataacagtgttcacgggggacccagcacctgccaccctcagccccagtgaggcaaggtgaagcccagcaccatcacacacccagctggggtttcctgataactttacatgtagttccagaaagagagagaaagagaaggaagaaagggagggagataaggaagggactatacacatgcccctgggaaacgggcccttctttgattccgaagggggccatgttggctgaaaaagcacaggtcctgtgttcacacacccctactcctccataggtggttgacctgaaggcctgcctttgtgggctgatgaaagtgaggggaaagctcagaaacgcagtaccttctgctctgccgtacacgatctgcatgagggccatatctggggaaagctacagggctcaaatccaggccacccacagtcagcagcccgcccctggttctggccactcttttcattctggtcatttcgagctcaaaatcatgcctgagtggggccaggaagcttttgtctctgcaggtaagggcactgtgggggtgacaattcaaagaccctggcagcactttgctgtgccccctcctctgcatgaattctcacagttgtcacacaccagtgctatgagggaatcagggcaggcggtagccccattttacagatgtggaaactgaggctgagagaggcctacccaagactgggtagctggtgagggagagctcctcatggaccctccagagcctgcgtatcctatctgttcaaagggtctgggtctatgaatcgcattactggaaacctccctctgtgctctggggactatagaaaactggatcaaggggtctgtcatcagcaccatatcttgggacctcagttcccacaaccatacagtaagtgggcatcctcatttaccgataatcactg

SEQ ID NO: 39516 - DNA, 1000 bp, Bovine  19866881386574
ttggagtgcttagactcagggtggggtcagcatttgtaaaggagttttgcttttctttctcttcgtgtagacacaaggagggagaggtctcgaagtgacatgtaaatgtattctgaggtgtttggcaactgcagggtgactgcattgaaagaacaaaatgtcagttagaaatgtgggtgtgagccttccataaagatacattttaataggcactgtcatgtggggacaagtgggaagcttacaaaatcaggaaattttatgctttgggagcaggtgccgagggtgaagctttggaacccaggcaccaactacccaagatgccagcaggtggagccctccagggcaggagccaggtggtcccggcagcatcagaggcctccccccgccacgggggaaggctgtctgatttctcactcatggatactggacctctggtgttcagcacagaaacaaacttgtatcagaaatagataaagagtggggatggggtggctgacctagtttggtacctttgagtgaatgaagagttctgggtgcaggagatacagagtttccacttggtgatggaatgcacttttgattcatgagctttgtgagaaagaactgtagttctctgcattcctggaggagctcctataccttgtctatggtttattgggtgggcctgcctgcagggcattcgattttgttagagggactcttaggaactggctgttgcccagccaggtttaacccacaaaaatggctcttttgttagtacatggttcagtctaacagctggtccaactagactatctctcgcagggcagggtccaagctctattcatgctatatcttgttcatcacattttggttaatgtaactgctgccattaaaagatttcaggcactggggtggtgagaggccttcagaatggcctaggctgtggcagcagcggcagtggggggaggtttctgtgcgtctagccgcagtagcaccatatgtgagtttggggtttgta

SEQ ID NO: 39517 - DNA, 723 bp, Bovine  19866881875548
taaatgtaaaccaaaaggacagactaaagggaaaaggtaaaattaatcaagatgaatttcaggatacttaatgcagcattgagaaaaaacaaggaattatttcatcagcattcagcccaaaacatttcatatgctgtacaagcacaatgacttatcaatatcagtatcactttaccaactttatgtagaattagaattaaatgaacacagaaatccaagcaaaatgctattagaaacatgcactactcaaagttttaaatactctactatatatatactgaatatacaatggaaacctttgaaagcattttcttcaaaaaaacagaaatgtgccaaaataaatgctttctaatatttaagtactccatactaacttctgcagccccaattagtttcgcacgattgggaacagctttaaattacctacctttgatggtttaagtctcggaagcccagttctataaatcttgaagggcctttctccacagaagttaaataatgtcaacagtttagtaacagttttgatagggaataatttaacaaagcacaatatttgagctaaaaacatgcaatatttacaaaagataaatgtccttgaagctgcaatatcttaatttatctagtattgtaagaaaatactagttcctaaggagaaaaaatttaaattgtacaattaaaaaaacacagtcccctaccctttcaaatgcaaaggtaggccaaaat

SEQ ID NO: 39518 - DNA, 1431 bp, Bovine  19866880359182
aatgcaaagaaaatatgtaagctaaaacattatttctaagacctgaggcttatagctctttgaatatatttaagtataaaaagaatagagtctcatgtgtacatgcagcactctaatagacaaaacacccccactgaaatgccccactatatgaaattggtggcatttctcatagctggcctctgcttcagagaaaaaaattggtaagttatcatacctttttttcctctaaatcatagattagcctgacatccttctataccaaaaagtggttactaaatactggcactctgtaaaactgcttaagaatcactattttcaaccctgaaaccccagaaacagaagcctgaaagcagtaggagagagaataagaccttcttagtcatcttagaaagtgaagtcgctcagtcatgtctgactctttgcgaccccatggactgtagcctaccaggctcctctgtccatgggattttccagccaagagtactggagtggtttgtcatttccttctccagaggatctcccccaaccagggattgaacccaagtctcctgcattgtaggcagactcttttactgtctgagccaccagggaagtcatcttaatcagaaattatcttatatgttgttaatgtggatattgtcattgtagatatggtcttgaggtctccaacactttgttccttaccttttattaggtcctctaaaagatatgatttatcctacataaacaagctgaattttcccctctatacatataagcattttctcactagacaaccaaatatactgtgccaatactgttcctttgcaatatcaattgatgctacttatttttaacaagacacataaattggccagatgagattttatacaagagaaccaaactttattgcaccttcgctggtttttacagtctctcatcaatgttgttcactcagtcagtgagccagctatggaaacaaccaagtatttattgaatgtgagtctgcaaattctctcttataatgtgctgcttccttcccttcttcctaaacttcattatgagttatcacattataatgaacagtttcattataatgatagtactcttctactaataccatctccatgtaccaccattcctaacccgtcttctcttcttttcctgtgtttgacttaaaaataaataaatgaactgaagacaacatatattatcaaagaaagtgaaagtcactcagtcctgtcgaactctttgtgaccagtggaattctccagggcagaacactggagtgggtaacctatcccttctccaggggatcttcctgacccaggaatcgaaccgaggtctcctgaattgcaggcagattctttaccaactgagctttcagggaagccctatattatcaaaactctaccaaaaatgttcaaggagagatagagcttaccagat

SEQ ID NO: 39519 - DNA, 1525 bp, Bovine  19866880400982
tttaaagagcttggaaaaactagtacatataaagaactcaatatataccagtaccattctcattaaaaaaaagagagggagacaaagtattagggcaaaaggttaattccatttgaaggtgttgagtctgaggtcttgttaagacagtcaggtgaagacatccaaaagtgaagtgggaagcagagcaggagctccgggaaaacactgcagtggaaggcccactgctcatcagcaggaagctgagagctggagccagggaagcagagaaggctgcctgagcacacagtgggagtggtgaaacgagggccaagaacaggtcgtttggtaacgcctacaacttgctggtggcgagagcaagatgcaacagccaggagacagaaaagactaggaaagggtgtcggggccaggaagtcaagtacagagcatgattcttaggaagtggcgctagtggtaaagaatccacctgtcagtgcaggagacgcaagagaatcgggtttgatccttgggtggggaagatccactagaggaggaaatggcaacccactctagtattcttgcctgggaatttccatgaactgaggactctggcaggctatatccatagggttgcaaagagtcatacatgactgagtgcatgtgcgtgcgcacacacacacacaaacaaatctaatcacttaccttgtggaatagacgaaggttaaaagcataaagctcagttgaatagaacatactgaaaaaaaaaagattataaatctaaattagcactgcaaaaacagtatctgcagcctacttattggtatgcttagttttatctgaaagttatgggaactcaagtacaaaaacaaataaataagccaaacaaacacacattgctaaactgacagaatcatttaaactagtaggacttgatctgttcttaatgaaagatactcccagagataagctctgatatttgctactcaaggtagatctaagaccttctttgatttaaaatttggttatttaatttgttcagtttaggaaaaactggtttatccaatgaatattagcaaagagcacaaatgcagtagcatgtaacatatattttggaataactcatgttgattttaataacaaaagattctttgatattacaattaccaaaagttgtctttggtattacagggtatggaacaaaagcttagtttttgagcctagcagttatttgcattgtatagtctgctgcttcttaaaatgaaatgatattactttgggtttattttattaataatagaaaaaagtgacctaaatagtcacattttaaccaatgcagccaattactatactcagaaaacaacagtaccatatattataaatcccagttttaattcacaataaagggtaaaatgaacttcaagttaaaattttttaaatgggcaagaaaggggtcactttaacatttgaatttgatagctgtctcggcttctttcatcaactattatgaatcagacataaataaacaaaggagattaagtcataagtggat

SEQ ID NO: 39520 - DNA, 1645 bp, Bovine  19866880440331
attattatgctcagttctagctatttctttttaaaaattatttatgagtacatgacacattactgtgtttatttgtggctatttcttttgattatatataattgtttccaccctgccattaggttataaattcctcccaagatatgtacagtgtgaaatttttctgtgttctacaaagacctaagcttctttggggtagaatggatatataatgcctacataatacattgcattatcatcactaataatcaacagtaattgctctaatgatgcattacatttttataacatctctagctgccagaaatttcagagatcattttatctttttcataatctgttgtgaagacaaacagaagacaataaaatgtcttcattttacaagcgggcattgtgaatttccgagacctttgggggctaattagagtcctgccaaaaccactggagagaagccaggaggcagatggctgagaacaggcaatcaaggaaaggcaagcttttcccaggtctgttctccaggctcggggtgtctgagttgggacagttctaggagacgaggtcagccagagagcaccatgatttctgcatggcccttggtctcagttactacccagaggttacttcatcaacacacagtggaactttctgccaagaatttcagctgaaacacgcttcccttctcttgtagggttctgtctccacaattctttatcttgggcatttctcataggcaaagatttgggtttttatgtcaagaggtattttcatatcctgtctgactcagggggaaaaaactgtccatcttgccagagtcatttgaatatttgtagagggactaaactcctcagagaggtgcaaaggtcttcctatctgattcggcatctccttatacactgtctccatgccctgcttcgttgcttcttcagagcactaaccatccctgacaggcatctcaggtccaactgtcctctgtttccctcagcagatttccagctccaaaagggcaggaatgacatcttgggtgatggccaaccctcaaaacagcctgggacatatggtagtcacccaatatttgttgttatgcaaactacagtcagctcttttgttctctaaaatgccatcattttgttctcttaaaatgacatcagggacttccctggtgctccagtggcttagactccacactcccaatgtaagagacctgggtttgatccttgatcaagtaactggagtccacatgtaactaagacccgatgcagccaaataaataaatattaacaaacaaacaaacatatcaaaccacagaagagaatctataaaacaccttactcagggctctaggaagccctcctaatcccctcaccctacctgatgctggggttagtagtctaaatgttagcagagtgccaaaatctgttactgaacacagggtcccgctgctcaccactcaaaagtcaataaagaagccaggtgagtgaaaagaaaggtttgctttattttcgacaccagcaacagtggaggtgggaggaggtgctgatgcctgtccagagaccaactgccccctgacaatctggggacaagagcttttatagatagagggagggggcgacaaagaagaaacagcccagtcggctctgacagtctt

SEQ ID NO: 39521 - DNA, 2808 bp, Bovine  19866880566884
tcccagcttcttactgcttattggttggaggctgctcttactttctagaggcctccaaaagtcccttgccatatggatctttcagcaggtagcttacttgcaacatggcagtttgttttttcaaggccaatggagaatctctctagtgtgtgctagtaaggttagtaaggtggagattgtgtatatatatatatatatatatatatatatatatatatatatatggcttcccaggtggctcagtggtaaagaatctgcctgccaatgcaggagatccaggatacatgaggttgatccctggatcaggaagatcccctggaggcagaaatggcaacccatttcagtattcttgcctggagaattccttggacagaggagcctggcaggccatagtccatggggtcgcaatgagtcggacacaactgggtgactgagtacatgagcgcacacacacacacacacacacgcacacacacatacaagtcaggaaacaaacagatccaacctacactcaagggaggaaagttatacaggaattgcacactcaggttatttcaaaattttgcctgctacagttttcaacttgattacacatcacatttgcctggggagttgctaaaaaacattgatgtgtaggatttacttcagacaaattaaataagagtatttggagggttggaaacagacttaagtttttataaaactttccaggtaatttaattatacaaacaaatattgtcacaaggataatgtatgcctattaagtaattctggaagtagctgaccctcctcttttgcttgtcagaatgattgaaacattaaaaaattttttaaaaagctcttttcagtaggtggtacatatggtaagaatttttatacaagctcaatagtggctagcagtgggctaatatccttaggaggactactggtttaaatatgtttagtatgacacatttttgtctacaaattaacattagcaacttggagtgtaacggaaaaataataaaatgattgttggtagatttaaaaggaagagatagtagtacgaatccagttctttccagtcttctagctctacttgcttcccatcaaatgtggcttatagattttggcatgcaatgtatataccatgttcttcctaaacaactatgacgaaagcattgccaaccactaatctggactgccctcattttccttgacatttggaattcctccgtaaagaaaaggaagactcaaccatcctgaacttgcccaacagtaacctgtgaaacagtatttccaaacctgttgtttttttccattatgccatgctactttgcgataaactgtgcaaagagtacgttgggtcaggtaaggaacccggttggaattaaagagagattacaaggagcaaatggcaggtgggaatggccgtagtagagctgttctcttcattcccacatcagctggttctttcaggtcagtgagtcctagaactgtaaggctgtggctaggacctacagtctctgtagaaatctgtcacagatgccctccagataaccctatcattcatgcaccagcaatcccctacttgggcctctttttcctaacaaatgaattcatgggagagaaaaatcaaagctacaaaggaaaatcaatttaatgcatgaaagatgaaattatgtagaaaaatatcaccccttcatgcttaacgaatcaaagaaaatgtgtttgccagcatgaagcaattttatcagaaaatagcccaggtgaaagagttaaagggaagggcattaccaagcccaactctgtcacacatgacaaattgacagaagacagacattgcagacagactaaattgtgttcagaggtttgtaaaactgtagggttttacatatagagtacttttcatgaatctcttctcagtgcaccaaaattaacacgtggatgatttctaattaactgttccagtcaacttaatttttgaaatgaagagcaaaggtgtaaactcagaaaacaaccccatttacaatgacaaaaaaagaagaaagaagaaaatatctaggaataaatttaaccaagaaggtgaaagacctgtacaccgaaaactgcaagacactgttgaaaaaaactggaggtgacacaaagaaatgggaagatatgctgtgcttgtaaaatggaagaactaacattgttaaaatgtctatattacgtagagcaatctacagattcaacgtaagctccatcaacgtctcaatgacattattcacagaaatagaacaacaacaacaacaaaacccccaatttacatggaacttcaaaagaccctgagccaaaacaaccctgagaaaaaagaacaaagttagaggtttcacaatgttatatattcacagtatattagaaagctatagtaatcaaagcagtgtggtatttggccaaaaaacagacacatagacaaatgggccagaactgacagccctaaaataaatccagacatacgtggacaattaatttacaacaaaagggaaaagaacatgcaatggagaaaggatcagttcagtcagttcagtcactcagtcgtgtccgactctttgcaacctcatgaatggcagcacaccaggactccctgtccatcaccatctcccggagttcattcaaactcatgtccatcgagtcggtgatgccacccagccatctcatcctctgtcgcccccttttcctcctgcccccaatccctcccagcatcagaatcttttccaatgagtccactcttcgcaggagaggtcaaagtactggagttacagctttagcatcatcccttccaaagaa

SEQ ID NO: 39522 - DNA, 969 bp, Bovine  19866880581927
agatagctcttgtaacttcagtgatagagaacacaagaggatattgaaaggaatcttgaccctttttgtacaggagctaaggatgaagacgcgaagttgggaagctggctccaggtttgaatccaattatccaaagcatggtagaagcaactcttcggatatgtatccgctagtaggaagcagggacatgaacttgctggagaagctgctggaggggaaaagaaagttgtagagaaaaaaatattttccaagctccctcatatgtcaccctggggcactgtgagaagcctgtgagagattttactgctcctgtcagcacctccgtggggcctcttcctcatcctgtgcttccatttctccttggggcagctgattttaggctgaaaatgaccgtcgtgggagttcagccaagtagaagttgcatccaagtcatgccagtcccaccctgacaggcctgtgggtgagtcaggctttccctggtactcagggaaccttctgtgaatccagagaaaatccctcaggaagtcacgcctaaccataaaggctgccgggccagcgtgcatctatcccaggggaggaaaaacactatctcccccgggatgaataagggtctgttccctcaccgcagtgtgtctgaagtgccacccagcgccattcctcagtggtgaagtgacccactttccgctgggctgcaggcgagctggagactctgcctctctttaggagacttaggccacacggtctggttcctctgttccttgattgaagtcactcccatgacctcccacaacatgaagcagtgcagacgtctcagaggagctgatacagctcacattcagcgcccctgccatctccgcctgctcgaggcaagcctggatagatacaggctccgtatctaagggactggtcagcatctcaggcaaaaaggatgaaaaaaagacctaggaatagccaaaaggaaagatcatt

SEQ ID NO: 39523 - DNA, 2781 bp, Bovine  19866880658206
ggggatcttccctccaggggccaacccggtctccttcttgtagccgattctttaccactgagccccagggaagcccatgtatttggatggcattcagcaaatcttgttttaaggtttggacagcttttatccgtttctatgtctaagtagttggcagagatatcctgtgaaaccagacagctgaacttgtcacttgtcttgtcttccaggaaagttctgagagcagtgattttcatccatcaactttagaatttcgtcagtttctggaaggagctgaacagaggaagcaagcgaacctaagcagttccctgtctttgctggggtttctgtttattgtgagttcatgcctgatgtttagtttaaagtgaaagaaatatcattcttatgttcttatacaacaactcaaacatgaaacgaaatgtcattaacatcctcccaaaggcctcagccatcatggaagctatgtccttcttttattatctagccccactgcctatctagatggagcttccttggtttattacaatatggcaaggcgcccaaagatacctgggacctttgagtgggcttggagtatcttgaagatgtccacagtagaaagctgaattgcccaaggaaagtctggaggtattccaggagggaacccttagtcaagttgctgcttgctgaggtagggaaattcttctctattgctgcctgggtgaggttcgttcttgctccaaggggataggagatgactcagcccagcgaaggggtcccatgcagtcctctgccaagaggccccgcatttctgtctatctcgacctttcaatcttgctcctaatgagccacgtgataaattgccaagaagcaggtttttgaaacccacctgagatcttctccagtgttttctctctgactcaagggaaatttcagagaaacaacaataacaaaaactttagctttgagagactatgtatccctttcctgatggtcgccaaccccaacaggtagctaccttaagtctattcaatcttaatggatgtaaggttggggaaattaaagccaggaaagtcagtaggctctttcctctgcttttcatttgttcctaaccatctctgatgtgacgaataacagctcacaattggctagaagaggttaaggcgagaatagagaggatccgtggagtacggacaagataaaagagttaatgctctgaaaaagactgtgtcctcacatttttggactgtccgtgactttgttggattgtccgtaactttgttcaccttctcaggctggataattgacagctcttgggacaaatgacagtttcccttccttcctgaagtctagctttaaaaaaaatctgagattgtttccatggattttgaaacctctagtgcagctcaatggatattttgtacctgaaaggcaattattacttctaacatatgtaccactggtttacttctttttaagaggttaattctcggagaaggcaatggtaacccactccagtactcttgcctggaaaatcccatggacagaggagcctgataagctgcagtccatggggtcgctaagagttggacacgactgagcaacttcactttcacttttcactttcatgccttggagaaggaaatggcaacccactccagtattcttgcctggagaatccaagggatgggggagcctggtgggctgccgtctatggggtcgcacagagtcggacacgactgaagcgacttagcagcagcagcagcagcaagaggttaattctaattgtcctattttctttgaatattattgtgaatataaaacaaagttattctcatttccattatttattaatttaattttgaaaaagcaataaaataaagttgatataaaatagtgaagaccaacctggttttggacacctgtttggaatagatctgggtgatccttaataacgtcaagacacagcataaaattatcttataaaatagcacctccacttacaaaaagacataaaagcatacttacatttatatgtcactttaatcttcaaaataaatttataccaattgaaattttacaaggcaccaacagtttatgtaaaatcaaccacaaaatgataaaatgtgacaatttcaaagatttgaggataattggtctaaagaatataaacacctattttattacttttttcccctagcttttccaattgcactctactgttgttattctcattagatattaaaaataatgaggcacagaactttaatgtgagtgccaaaattctcaaagatctatccagttctggcaaaacaaacctcaaggctcccagctctacatatttctgtcccataattctggttctgggttcagcttcataccacattatcttttccccagcaaataggtcatttccatacagagtcatttatgaacaaatttgcttttaccaagtaaattgagttatgtgattttttttttcaggtcgattgcatgctgactatgccacatgacaagttttgatcagtttctcattttgtaaaattattctgaagtagttagtaaagtattgacgtgaggatgtggtggtggtggtggtttagtctctatttgtgtccgactccttgcgaccccatggagccctcaaggctgctctgtctgtgggatttctcaggcaagaatactggagtgggttgtcgttttcttctccagatgatgatatagtacacggtaaatagtggctccttcaaggtctgaagaaatgaatcttcccggaaatgtgacctagtttatccccagcta

SEQ ID NO: 39524 - DNA, 1616 bp, Bovine  19866880737128
atagagtcgggtggaaatagattagtgaagcatataagcaagagtgagtttgaggtcaaggttatcagtaactgagaagagcatggggttgccacaggtggaaggttgtgctcttagagtcgtgggtgaaggaaaagagaattaggattgtcatcagatttggaagtgatggagaaagaaagttcggggttttagggaactgaaagtgatgacaaatctatatggtttgtaggtgagtgagaatctctggcagcagttgtcaaaaaggggaggatgagatttagtttcagaaacattctgttaaatgttcataatttggtaaggaagagtagatatgggatagatagttctttagggagtttgagattctcagatgatcaagattatgaaagagaaagcatcaaaaggagaaatcattcctggagactttgtggataatgctgtaaaagtttcagagtagaataattaatctcatgattcctattcattcattcattcacccacctattcagcaagtatttattaagtccccctttatgttttaggcactgtgttttatgctattagatcagtaagaaacagtttctattcttaaggaatttatgattagcaaaaaggtacagatatgggggactggaatgcaaaagtaggaagtcaagaaacacctggagtaacaggcaaatttggccttggagtacaaaatgaagcagggcaaaggctaatagagttttgccaagagaatgcactggtcatagcaaaccctgtcttccaacaacacaagagaagactctacacatggacatcaccagatagtcaacaccgcaatcagattgattacattctttgcagccaaacacggagaagctctacacagtcagcaaaaataagactgggagctgactgtggctcagatcatgaactctttattgccaaattcagacttaaattgaagaaaatagggaagaccacaagaccattcaagtatgacctaaatcaatcccttacaattatagagtggaagtgagaaatagatttaagggactagatctgatagacagagtgcctgatgaactatggactgaggttcatgacattgtacaggaagcagtgatcaagacaatccccaagaaaaataaattaaaaaaggcaaaatggttgtctggggaggccttacaaatagctgagaaaaaagagaagtgaaaggtaaaggagaaaaggaaaaatatacctattgtaatgcagaggttccaaagaacagcaaggagagataagaaagccttcctcagtgatcaatgcaaagaacatttcatgcaaagatgagcacaataaagaacagaaatggtatggaccttacagaagcagaagatataagaagtggtgacaataatacacagaactatacaaaaaagttcttcatgaaccaaatacccacaatggtgtgatcgctcacctagagccaaatatcctggaatgcgaagtcaagtggaccttagaaagcatcactaccaacaaagctagtagaggtaatggaattccacttgagctatttcaaatcctaaaagataatgctgtgaaagtgctgcactcaatatgccagcaaataggaaaacagcagg

SEQ ID NO: 39525 - DNA, 1938 bp, Bovine  19866880758070
attttaacgaggaagcgaacgtgttgtgtaattccctgggtccagtgattcactccgcctgggagaaggatggtcggggagcgaggtctgcagagtcacgttcccatcaatcagtaaataagataagaggcaggaattttaaacacaactattagcaggcgactcccaacgcatcaacaaaccgcaactcattatgttaagcggtctctgcgggggaggaaggggggaggttggcgaggaaaaggaggaggcggcaacttgagggttttttacttgcatttttaaggagtgcgctgaactttaaagaacgctgcccaggtctaacaggcaactgaaattgggaccatttgtcccttcaaaactattacccctccctcaagtagagtatggcccaaagggaaggacgctcaaggcggattctattgatttctggaagactgggataggcagcattcaggatcctgaaggaatttgaagcaaaatcagggttcagtcacttaggtctccgtgaaacggcctcctttgtgtctgacaaatttctgtgcgtgatcttgagacttgtttgtaagttttaactggttactcaagacaatgaagttcttaaagtaacagacagtatttaacctttgcctagcatcaggaggctgctgtgtttttttaatgagaaaccacacaaaactgcctagatactctccaaaatctcagtcttcaatagccctcttgctgctcaggaagggatagccagtctgtctacataggacacattacatggtgattttgtgactcaggcccaccagggaggagggcaaggccacttatataatttgtgacctaatatgtgagtcgtagggtcatcgtaaagcagttctgtcaacagtcaatgagtcctggaaatcacagcaagaggacagaggggaatccaccttgagataacctgcagcccattaaaatgttggtaattaaagtctttatttaccagatcacatacagctttaactggattataaaagtcttcttgcagggtgaaccaaaagctgtgtccacacagctaacccttcactcacaaacgttcactcatccttgtggaatgactttaatttctctttttttcctgcacgtattttccacatcattgaaaaatataacattcttgagcagatgttctgaagcctccttcctgagtcagagtgcctggaagaattaggccaactgttgcctggtgtctaactgcttatctgtgacccacccaactccatgtccctccaaccacgccacgtagacaaagtggcccgcatctgtatctgaggggctgtttgcatcgcgggagaaggttgctgctgctgctaagtcgcttcagtcgtgtccgactctgtacgaccccacagacggcagcccaccaggctcccccatccctgggattctctaggcaagaatactggagtgggttgccacttccttctccaacaggagaaggtaaacaaccccaaagaaagtagtccagaaaaaataaaagcagatgaaacttttttttttaatttggaaacagtcgccttgtaatattaatagactttagtcacttgggagattagcacttgtgctgtgtaattggcaactttctctcatgcaattaacctctgccagaattaattgtgtgtgtgtgtgtgttgctaaagctttgtgtgtgcatacggagggtcttgaggctaaactatactatttggatacacacgagttggaagtttttctctctattggttgttaggtaaaacatccagaagctgaaactgagtcatagcgattaagacatgaagtagatgaaagcagatggaagctttacttcacaaacaatactgttttaaaaacaagtcacctacctcccgcctaacactgaccacagttctgaagacaggatttgggggccactacccgtctctctat

SEQ ID NO: 39526 - DNA, 1453 bp, Bovine  19866880811755
tgtataatatcatatatgaaatgagtcgccagttcagggttcaatgcaggatacaggaagcttggggctgatgcagtgggacgaacccagagggatggtacagggagggaggtggaaggggggttcaagatggggagcacatgtatacccatggcggattcatgttattgtatggcaaaaccaatacaatattgtaaagtaattagcctccaattaaaataaataaatttatatttttttaaaaaagataaatcaattgaagatactcaaactgaaacataggggaaaaaaagattagaagaaatagagctgagcataaaaagaaatgtggtattagtaaaaatgttgaatttatatgtaattggaatcctagaaggagacaaaaatggaaaaagagaaaatggaacagaaacaatatttgaaaagataatatccaataatttttcaaagttggtaaaaatatcaactcacagattcaagagttttatcaaacctcaagcagggtaaatacaaagaaaaccacactgagacacagcatggtcacactgctgaaaatcaacaacaagaagagaaatttaaaatcagctgaagaaaaaaaaaatacaacgtttaaaggaatgacagtaaaactgagagctgacttttcaacagaaaccaggaaatatagaagaaaagaaaatgacatcttgaagctgctgaaaagaaaagaaaattagctaccaacctcaaagtgtatagccagtgaaaatatccttcaaacatgaagatataataaagatgtttttagataaacaaaagttgagagaatgtatttccagcaaaccttcactagaagaaatactaaaggaagttttcccaattggaggaaaattatttcaactgaaacacaggatatcaggaaagaataaagagacctggaaagagtacatgagtatttctaataaataaataaatatatatatatatgtgtgtgtgtgtatacaaataaacaatgacagtttaaaataaaagtaataataatgtcctgtacaggccaaaacatatggtaaaagtaaaatatgtgaaaacaaagtggacaagaaggaagtaaatggagtcaaagtacggaaataaacttacatctttcagaaagtgatgaagttactaatttaatgcagactgtaataagtcaagaatgtgcattttaatatttagggtaaccatagaaaaaatttgtaaacaatctaattaaatggtcaatagaaaactaaaagtggaataaagaaaaatttcattaattccaaagtggggaagaaaggagggatgaaggaatagagaagagatgggaccaacaaaaggaatagtaaagtgaaaacttgtactctactttgttaataatcacatgaactgggtaatgaactaaacatagaagactgtatgaagtggataagccctagtcatacactattaataa

SEQ ID NO: 39527 - DNA, 2107 bp, Bovine  19866880822450
ctgctgcccccactaagcctcttcgttacttttaaaattcctaatacttgttttgattggggaatttgtagtgggtatgtgactggattcttcaagttcacacacacacacacagattagtgaacaataccaagagttagaacaagaacccattggtttatacgtcattgagttctttgcttttcctattttttgttccttccttcttaaagttaataaaattggcctgtagcaggttttttcttttctttgacttaacagtccaataaaagtaaatcagagacagaaatctcagcagagaaatcagcctttttttgtacagtatgccactgacctctgatggtggaagtttagcataaaccaggagagacccagccaagaaaattcagcttcccttcaacactctgcttacctggttaatgtttcttaggtttacaaacttgacctattacctctgtagtgtgtgacatgggagcctcttctattaatactctgagtatttaaagtacatttgagagtacattctgtatcctcaattatcagttcacagaatagcatcagggttaaaaattccaactctggagtcagatggacttgagttttcattctgtttaataactttataacttttgtcagtgtcctcatttgtaaaatgaagacagtagtaatacctatctcatagggtcatttggagaattaaataatatgtacataaagccctcagcgtaatacctagtatacagtaagtgctctggaaaggttagctactgtaaaatatttgttatatcgcagtagtttatattatttctaaagctaattatggaagagagagaatcaccgtttctagttttgtaatacattctttttgacacttctctgtcacagttgctaggaatggggagttcattcatcaaaccaagagtcctttgtccacagtgacctaagctttctgtgacttttggaagcttcaaagttagaagaaaaatgttgaaaaagcttagaaaaagaaagcagtaatgggaaaccttttcaaaataagacagtttggtaggttgacaactagagtaatggaagcaaagaatgtctctagagtgacagaagaaaccataaagaaaggaaaagggagaaaacaaacatttaaatgtttgtactgggtgctttggtccttatcagtacattttctatgagatgtctcattcagcctcaggccacaacccagggagggaggggggggtcgcctgaagagtaggagaaggggagagccaaggcagggaggaagggaagatgaaccttatttttttttcagtttttgtgttttatttatttttttaattaatttattttaactggaggctaattactttacaatattgtggtgggttttgccctacattgacatgaatcagccatgggtgtacacgtgttccccatcctgaaccccctcccacctccctccccatcgcatccctctgggtcatcccagtgcaccagccctgagtgccctgcctcatgcatcgaacctggactggcgatctgtttcacattaatgggaagtctccttactattcagagatggggcgcttaagccagagttctgcttaacttgtttagtgccacagagctggggacagacgaggtctcctaaaaccggtgaagacaaaacactggtaccgaggttaacaaaggaaagttttcgcatggaaccttccccctgtaaaaacagtgggctcagatgggactatctcagaggaccctttctgctccacattctgtaattctgctagtaaaaccttctgacatgttttcctttgtgggtactgcaaaggcaggcaaaataaatattacggggaaaacactgattgaaagctttgtgagagaataaaaagaccagttgggaggcaaaggaaataaacatctcgagggaagccaaagtaatcaaaagaattataagaacgagataaaaaggaaatcaatattaaaaagagataaggtagaatcggaaaataaatagtaatgccgttccttttcaagaatgtgagcaggcacaatagagatgatgatcactgaaaataattacagtcgttactacttagtataatgtacagga

SEQ ID NO: 39528 - DNA, 1889 bp, Bovine  19866880835841
ctcttattctcctatccccatattgcctttccctcttccctctccccactggtaaccactagctaatttcaaaaacaagagtgttacttatttcaatgacacaaattgtaaaaacaaataaaatatgctcttttcagaaccaaaataggcatttccaatttccttaaacattttagaaacagcagtatataatctgatcatcatttttattttaagttatatatcttcagctttctagccaaccgtgggtacatccagaataaatacagatccttcctgtcttagtccagatttgttttagactctgtgctaccactttggagctaccttcccaacactgtttgtggactatcactttcccctataaaaagacaaagcgatattaccctgattttacctgctttattttacatatgctgtgtggtcatttactttacacttttataatttgctcctctgtttttctcctatagcaatggtaatcgctattcttgcgctgattgctggtatcattggaattaccatcggaagtgtcagcctttttttcatactgcaaatggtgaggactcagttttatttttaagttctggtataaatagctccaggagggtttaactctacggcttcaactaaactcaaaaggaaaacaaaccgcatgaaactccatctttttcaactggacacagagaagtcactgagttactctagcagaattttttatttggcatttgcctatgaagaatccccaaataccaatctacctgttttccaatgaaacatcctccaaggcttctaacttggtttagtatattttgatggatgtggatgaaagtcaaatgtctaattatagtatctagtttaatttgcatatgaaaaatctttaaaataacatgatatatttattaatgctgaaaatatttgcttttctattctatttcttgggacagatttgtcaaattccacctatgacttttcagccatgaatgatgtttttcatcactaaagatacttttgagtctgtatgacagcattccaaagaacatcacctttgctatataacctcctgtttaaggtagttcagacacaacatttgtgtgtgtgattataatgctagtaatttggaattataatcctaggtcattaagtgcctagtcacaaaagagtggtgcaattgagttcgcattcgccctctatttttatctttgtgatctccataccacagccattctatatatgtatatattctttataaaatgcttgttttcgagagctcacaaaactgcaatgttagggctataacaacaagattgatagtaaatctacatagagttcccttgcccttttctattttaactatttttgttaggtgactttgataatcattcaaatctatgattgtttagcattactccatgacaatttatcttctctaaataatattttcttaataaaagttaagtaatgagagaatctgctctaatatgagagattttgtaaagacttgaatgggagataactcctcttgtttgcagtttaaatgttggggacaaagtcatgccctggtctttgggcacagatgacaaatttagttgtcttctctcttggctgatgatctaaatctgaaaaagacaatgacatacttggttggcaaaattcagagaacatcttgcatacgaatatagtagaattgggtcatggttatcaattcagcttttcattacagcagggaactatgacacagtcaatgtttggggtaatagttcacctatggaaataacaaatattattttgaaataaaactttaaagcaaagtttgtaggttatctatgaaataatagctttttccacaaaagaactctacaacgtgaattttaattgaaagaaaacaa

SEQ ID NO: 39529 - DNA, 889 bp, Bovine  19866880903430
taaataaaaggcaatttccactgtgagaagaaaagccaaataatcagttagaaaagaattgtcttaatgaactgctaagcccaaattagacttcctgatataaactaaaataaaatgcccacagcttgtgataaatgaatgaatgactcctgcacatattaagcaaaagattatctagcctgtctatgagctttaaaaaaaaaaaaaaaaaggtaagatttcccaaccagaggccagaggaaatgggtttgggggataggcagattcacacaatgctgaagtgtgatggtcctctaagatttccttcaaatatattttagattaagtaccagggagtcattagatctatttaaagttcacagccacaggtattaaacatatcaggataagaaacaatctgccctcaccctgtagagcaaattgaaggaattaaaacagtctgcctagtggtagtcataatctaataggttaaaatatttcttccctagcttctttatgctcattctttctctcttattcagctttccccctaattagagtatactccacattgattttgaaaccaagtcagcatggttgcattttttatttttttaatttctatttttggctgtgccatgtggcgtatgggatcttagttcccaatcaggggttgaacccacatgccttcagcagtgaaagcctggagtcttaaccactgggccacaagggaagtccttgcatggttaccttttagttagcatattagtttagttttagattttatatcctccctactgtcccttaatgcctcccatctactcagaaagtagcctgtacatcctctatcataacaatgcataaaaattgcctttttacctgtttttccctgtctacatttgatacatat

SEQ ID NO: 39530 - DNA, 892 bp, Bovine  19866880987194
actacaaatgagtgataagtgtacagtcacaaaaccttagtctccaggattcagaaatttcttttaagttatttaaaccaatttccaaaactttattaaaaatagaaactaggactggacagattaaagcatttaattgagaatacagggtaatctttttatatattcaactacatgtcaaatttgcatatcttattgcatttatcagagaaggcaatggcaccccactccagtactcttggctggaaaaacccatggatggaggagcctggtgggctacagtccatggggccgctaggagtcagacaccactgaacgacttcactttcacttttcgctttcctgcattggagaaggaaatggcaacccactccagtgttcttgcctggagaatcccagggacaggggagcctggtgggctgccctctatggggtcgcacagagtcggacacgactgaagcgacttagcagcattgcatttatagagttattcagaagtttctttttgtaagcaaagtcattaagtctttttctcaggatactctgcccactgacataattaaatattccagtggaacacatttcatgtctgtgccctgaatgagttaacacttaagactttcagacaagttatcataaatgagtcatttatacatgtgtagtatcccacttctttaataggaaaaaacttttgtgttgatttatgggtcaaaggatgaatgtgtatgccattttatatattatatctattccacttctttatctatgtatatgtacatatgtgtatgtatgtatgtaggtatgtatgaaaggcatttctaagcacaagatttattagtatgattaaaacatcatctttaatgtaacacataccttgcctgttcagcaatga

SEQ ID NO: 39531 - DNA, 1169 bp, Bovine  19866881002545
tttgctcaaatcttaactcttgaaaaagtgtgtctcctctattcaatacatactgatagaatactggctatggggatacaaagatgattaagagcctgtgcagggcagataacaatttacagcagtacgattttctattgagtagaacacgatgttcttgataatctgcagcagatccgtgcgcaagacccacaggctgtgttgaggacagcggaaggcgtaactactggtgattattcgaaatatttcttaaggagaaagaaaagtacagcagtctgtacattttaatattcagtggttgagaaaaagatacagcccatggcctctcttatctatcgattactcatgactctaatttacatggtgatgggcagtttgcttatatttagcatgtaaattcagagaaaatatcgtttaactctgtaccaaagagaagtagaaggaatttagaaatgattcatatagctaacgtgtagacaaaaaaaaaattacactaacgggctcttttgcttagacaacaaaacataagagacgtcaactgggataactaaaccatcttcaacacattggcgtcacacctataagcggcggcagtgaaagtgttaaggcctgcacaggcctctatactgcagtaggcggcgcaaaacctgggcaagttttctgggagtgccgcggctccctgccatgcagagcagacgaagcgccggtggaccgtgagccgttaagaacccctggaagacagcgctcgcgtcatgccgggaagccgacgcacaaacctacgtctccaagctctccctcgaggccccgcccattccttacccaagagctctctggggcctcggaggaggcgtggcccagggcaaggaggggagaatgcgcatgcgcacttggagcctagtcatgtagccaactatcaatctcgcgagtgttgatagtcggtggcgtaggtagtagacctgaatgctggagagatagatgatatctaccagaggaagaggaggcagctaagccagttcccagtctctgtccctcttttgctttcctttcttttttccccaaccctccgccctcctgtgaatcagcccgccttccctgacctcagtacccgagtggccccgcccactctcgtcgacgtattcccgccgtgggtaaagcgccggtcgaacccg

SEQ ID NO: 39532 - DNA, 1795 bp, Bovine  19866881080727
gagtaaaactaaagaaggttgtttaaaaaacagtttctttatgttttcagaattgcttctaaaccaagtgaaatcatagcaggttctataaaaattgttcttgcaaatgaataccccaaaatgcaaaattgtcttgaaaatactagtattagcaatacaaaaacacaattatagacccaactgacacattctcaaatatccaagagaatgggcaatagaaacacatcatgattttattcttatttcctttttactgaggatgcaatagttattcttgtttaaattcctttcaacaaatagttcgtgagtatccgagtgtttcaaccttggatagaagacctaacaccagctggattaagctgcctgtagaggaccatggtactgtgaagtgtgcataggtggaacctgggcatccttcttggatgcccacctcgtcatcccagagatcatacgtggagtagcacagttacagaattttaaattataaggttccatttttttgctattgcaactttagaaaaagttaaattcttattaacctcattattttttaaaaagttagatttgtgttcatttaatcatttttaaatttactaattgtagtattttcatgccctataaaaaacactgaagttcttatcatactcattttctctgtgccaacacggatatgtgtatgatgcttgctcttttgctagatgacattgatgagatgaggatctactatatcttgaatgaaggcagcaaggcaactaaagacatcttctacttctcggcagaagacaatggtaagtcagtattgagaccatacctggcagtcttggttaactaaagtcagtatgagatggaaaagaattaaatcatgtacatagtaatcacaatcagtaatgtcatactatcaccaaatgaattcctttggttttatttgtagtcttctgccaaagcatccttgacaaatcactttttaggaagggaaagcaatgaaaattttcaataattaatttgaagtattttacctgaccaaggttatgtgtgacatcctataggcaagtagatttcctcttcaagaggatctgagaatgtagctggtagtttgtcttactctaaaactaaaacaaacctacagaaggggaggttgggatgaattgaaagactagcattgacatatatgcactaccatgtgtaaaatagagagctggtaggaagctgctgcatagcacagggagctcagctacacgctctatgatgacccagatgagtaggatgggggtggggatgagaaggaggttaaagagggagcagatatatgtatatgtatagctgattcactttgctgtacagcagaaactaacacaatattgtaaagcaactatactccactaaataaaataaaagaaaaaatgaaaataaataaatctaaaaatcgatcattagatgttgttaggcattttagcctcagtactgaatcttagtgactccttgatcttagaagtgtaatattcctagatggggtgaatgaccggcccacaggaaagctttcatttaaaaacatgcctatttatgctgtgcctctgtgcatgtactctgtctttaaagtagcatactgggcagcaactagttaaccgaaggcactttctttactcagccaaggatgtactgattatgtggtcaagagcaatcattttgcagtaagacaggataattgcagaaattatgtccatgtaccacttgccactctataacctttttcagtataaatcattactcattctcagtaaataacatgaattttctg

SEQ ID NO: 39533 - DNA, 2015 bp, Bovine  19866881275829
tgcccatagtggcggagctgctagggccaggggacccaggagctgagtcagaggagttgctgctccgagaacatttccagcttctggtgaggatccttgagggatccgagaacacggcgcccaggcccagcctcgcagctccgatgatgctggaggtccatcagttcctgcggacagccttgacgcccaacgtcctggctgcggaggacaaggagtctaatgccgatgacctggtcttcaacattctcaatgctcccatcaccacgccgggacaccagggctacgtggtcagcactgacgaccccctgggccttccaatgtccttcttcagccagcgggagctgcgggaactgaaaattgcttatcagctccctacggagaaattggatgcggagcacctcttccaactggagatggaggtggtggatgcagatggtgccacctcagacccctttgcctttatggtggtcgtgaaacccctgaacaccctggccccggtggctagctatgaccagggactactactttttgaaggtcagtcaaggcccctctccagcgccaacagccttcagatcagtgatagtgctcacctgggagaggtgaaagtggctgccatcaggggcttgagacatgggcagctggtcgtgcttggggcgccagcagggtgcaagcatttcacgccaacggacctggcagcagggcgagtggcgtaccaacatgatggcagcaacacctacagcgacatcgtcttccagatggaggatgggcaccaccaggtggaattcctcttccctctcgccatcatccctgttgatgatgaaccaccaatggtcactgccaacaccaggctcttggtgacaggaggtcaggcagtccagatctccccctttgtcctgagtgcaatggatattgactctgaggactcacccatccactttgtgctggaggaccagcctctggaaggagaagaggaagaaagagcaggggatctggctcccggttcctccagctcaaggcagcatctgagggagatgctactgcggcagtcagaaccacctttggggtcctgaagatgaaggctggtattacgtgggaaaggaaggactttatgagaaggtggtgactgagtggcttcgacaagacatagtggaagggagactcttctaccgccatcttggaccccttggccctcaatccataatggcccagataactttccatgtgcaggatgaccatgacccacccaatctatccaagcaacatttcttcaccatcagagtccaaccagtggatttgcagagtccagagctgtttgcaggaactaccctagaaatgactgtgcagcaataccaattcactcacttccagaagaaattcctccaatatattgaccaggactcagatgaccagcacctgtggtacaccctgctgatgcctcctactgacacagatgacaaccaccaagtccgggctggagacattgtgctcactgattcaccagacacacccactgtgcacttcacccaggcccaggtaaatcaccatgaagttgcctaccagcccctctgggagaagctgggaattgtaccacggattgtgcagctcacctaccaggtggaggatgctgcaggcaacagtgtacctggcacattcacattattcctgaggcctgtggacaaccagcctccccaagtcaccaacagaggctttactgtcttataaggagagagtttcagcctgagcagtaatgagctgcatgtttcagaccctgacacagacatcgaccagattgtcttcatattagtttggggtccccaacatggacatttgcagtacttaaaaaaaatgtgtggtcccaggggaatatttcatgcaagctgatattgttaatgggagtatctcttatcggaaccacagaaaccaggcgactagtgataccttccatctggaggtaagtgacaaggtgcatcacaaacccatcactgtccaaatgtctgtgcatcctgtagcagctg

SEQ ID NO: 39534 - DNA, 732 bp, Bovine  19866881281333
gaggggtgaccgggcaccatgcaaccctgggctgcctgcctcggaccagccggtctggatactctccttcccgggcggctcaaagggattgtcctccagggcccgagacggtgaccattgccgggtcagttctgctcgtgtgagacactgcgctccagcggtccattcatccaggcaaaggtctttctgagagtggggagaaatcccatacctcttccttaccgctgacaagagtgcattttccagccaaaattgagtctcacttcggacatgaaagatgctagtcggagctattttacaaatatgattttctagctgtctgcctgataaagcagcttattccagatcctgtgattccttgcttacaaaataacccagacatttctccttctcagttatggggggaagagcactagcatccagactgctgaattcgaacagcttttgtttctagtcagtgggtttcacataccacacaactggatggaccggatggcttttattttcttagagcgtgatttccatatctgatcaacagtgactgcctgtgagtttattagatatgctttttcctaattactttctttgtagaaaaatatatcggtagccagaggggaggatgtcaagagaaacagtaacagagaaaataccacagttacttggatcaattttctgtgaattaacctatttaacatctgtaatggaatttggctttcacatctgcgatgccta

SEQ ID NO: 39535 - DNA, 1665 bp, Bovine  19866881303852
tataattagttaagatttggacatatatttcaagccatataattgaaacaatccaaacagattaaatgtcttttctttttctagaaatgttgaaacattgatgctattgttgaagaaattaacaagggaatatgttaccatcagtgcagttgcagccatttggggaccatgaggtgaaccagtcttacaatgaatcctatgcagaaagacagaatgtaaaaaaaaaagatcctggatacataattgagtagctcagtcatgatttacccctctggcagttttaattacactagtcagtgaatcctcttttgtagtttaaacacatcgagacaaatgttctgctacattttactgaaagtaaagatgtaaagtatgaccaacaaccccagcaacattcttaacacagtataaaaatgttctactgccttaaacagataagaaaaattgccataataccgtagaattcgagaaaattgatgacgatgactgggctttccctcttgaagggactgtagctacaggacaccccataaccatattcatttgtattttagactattccattccaaactccaagcaatgaactagtagaaaacatacctatttattttgctttaaatcatagtgaaaatagtgttatttctaaataaacatttaatgatgttggtgacatttcacttaatgtttaatttcttctgctaactctaataaggcaactggtaattgatataatagaatcttctaggaaagtaaaataagagaaagaagttatttaggcttccctggtggctcagatggtaaagagtctgcctgcaaggcagggttcaataactgggtcgggaagatcccctggaggagtgcatggcaacccacttgagtattcttgcctggagatttccatggacagaggaacctatagtccacagggtcacaaggagttggacatgactgaagctatgtagcacacacacacacagtggaattaatgagtaagatactcatgttgtctagtgacctctggccatgaggggcccaggggagacatgataaaacagccaagataagcacagattttggtggccctgttgattttgttcactgtagtttttgtaaagcagttggctgaacccaaatttctcaaagaagattgcatttttttctagtgggatgtggcccaagaaagcagttcaaaatggttagtatggatctagaaaagaaagggtattttagtattctcatgtctctaatttaattccaaaatgtgagtctcttacccccagcacaggctaaatgctttctgtagcctatcgaaggggtgtaggagggaattcaacctgccagagctacacagatttatccctcataatagctaccaatgcgccgcagtaaaattttacgtttcagctaaattactaatgactttcaggcccgtgccagaaattttagggtaggcttataaagagagaggagagaatgtacagtcaagagttcttagcagtggggtgtgtgtgtgtgtgtgtgtccgtgtgcgcagatgtgtgtgtttctcatttgggattatgggacacgtgctcatcattttttgccatcttgattaaatgtaattaggttctggcaagccaccctttcctctcttggatgctggggctctttcgtgttttcaca

SEQ ID NO: 39536 - DNA, 951 bp, Bovine  19866881366592
catagttcatcaggcactctctctatcagacctagtcccttaaatctgtttctcacttccactgtataatcataaaggatttgatttaggtcatacctggatggtctaatggttttccctactttcttcaatttaagtctgaatttggcaataaggaattcatgatcagagccacagccagctcccggtcttgtttttgctgactgtatagagcttctccatctttggctgcaaagaatataatcaatctgactttggtattgaccatctggtgatgtccatgtgtagagtattctcttgtgttgttagaagagggtttttgctatactaaaaaactaaacttatagagaaaaatactcatagaattgaatttggtaggcaaataagttataataacttcatccaatgaaatacaatagcctgtcatttgaagtagaaactgtatgtcaaaatttataaacattaaagtaactgtactataaaaattttttgacgaagcttatcttaacgtataaaatgcatttgcaaagctgtatttgctttctctcttgctgtatagtttcaatcagattttagaaatatttcagcttttaagaaaactacttttcaaattaacctcctagtcctatattggcattgtatgctttctttaataaatctcattttttagaaatggtgggaaatcttttatcaaaatatccagtgatttggaagcaagaaaacttcagattttgcaataactacaaagggaaatttatccctacaaaagctgggagatgaacaaattaaataatgagaactcaaacagtgtacaagatttaattttaaaattctgtaaacgcctttggaatgacttgcagaaaaaatcttttgatcaaatttcattttttgtaattggattatatttttttcctggaatgggaaggaaattgaaaggacctcattttgctt

SEQ ID NO: 39537 - DNA, 891 bp, Bovine  19866881428861
ttggattattctttaatgggactttttaaagcgcattttaatagcctccatatttcagcagatatacattgaaaggcatttggaacacctcccagttgcaaaatttttgatcttctaatttcttagaattctgacaacctaccaggtaacagttagtatgatattatgctgacacattccagagttggcagttgttagatttgccagtgcagtttgttgcccagatcccatgggccagagatttactgacttttcctcttacctacctcttcatagaccctccccccacctcttttgttttaagctgaatacaccatgggtgtgtttttaggtacaccatgactatcagactataaatgtctgacctagtgtaaaatcagaattagctacagaaattttatattggaaaattttcactattatgtgtaatttaaagaatcagagataacacatatagagcaaatatatctgttgtcttcacccagagtcatgccattctcagaactttcccaagttcatagatgaattgtaggtgatctgcaaacgctctgaaaagctaaatctagcagagtaagcccgctgtggacaccactcagatttcttctttcccaaagaagaacatcaagcatggaaaggagtagagaagaatgaaatttaaaaacaattataaaataattatcagttcagttcagtcatccagtcacgtccgactctttgtgaccccatggacagcagcacgccattcctccctgtccatcatcaactccctgagcttactgaaactcatgtccatagagtcatgatgccatccaacccctcatcctctgtcctctccttttccttctgcctttaatctttcccagcatcagggtcttttcaaatggagtcagt

SEQ ID NO: 39538 - DNA, 1157 bp, Bovine  19866881669526
caggttctcccagactgcctttaacagagatgccctggccttggaacacctttaccctggacatgtgggcttcctgattaccagcaggtctctcaagacagaggattgggacagttcccacaggctccagaagtataaagtaaccagaggaccagtgcatggcttcattatcaacactggccttggaaatgagagcacgcaagtttttacacaaggttagtacacagtgtcccctgatgcctttgtcctgctctttaagtagataagatctcccagctctgcatgaaattgtcctgacctcagtcctttagcagaaagattctaattctaatgaaatacagtggaatgagaaattaacaaacaaagcaacaaatccattatcagccgtttcctcagcctgctctttaaactggagctctcagacattcaatcaggtttgtagttacacattaaaactgccaagtacaggtggacagcttctgcttctgaaatattataagattacaatgatgttgaaaagatcagtttaagtttgaatgttaagtaaaaaatgacatacctaggaatcattgcatagtttaccagtaagtctggatttctgaagatagtggtttggtgtcttgatttcagatataaaaattacactgcacattttattgtactatacaaattcaatttctatatctagaaaatgcatagaactaagtttgcctagggtcacttgcaatgcaggagacacaggagacatgggtttatccctgggtaacgaaaatcccctggagaaggaaatggcaacccagtattctgcctgggaaatcccatgggcagagaggcttggcaggctatagtccatagcaaagaggctgacaggactgagcagcttaacacgcacgcaggcacagaagtttgcctaactatgggagtatatgttttaatgatcatttttcttttatatttgttgttactactaatggtgagctaaaggctggtcctgctggcttcccaagtgatgatactggtacctttgactgctcttcacatagtcataaaactttttcatgtagctctatgcatgagatgtgaagagatacatggaattttacacatccgatatgcataaagctggatgcaattttagagtaaaactaaagaaggtt

SEQ ID NO: 39539 - DNA, 1401 bp, Bovine  19866881721533
ttagcatgaacactgctttggaaaaagttttagtgttcgagagtgattctggacagaatggtctctcattctgtgcaccagtcttcctgaaagacattctagccttatgggtttaatttaatgcctcttggtcaatcagcacaatgttagatacagtgttgccaaggaaagaaaattcagtgatgatttttagctgtgttgccggtgaaaatcttacatcgattgagcctcactttctttgttgagtctttgaatatggctgtggaatatggatttaataaaaagtgacctattacacaattttctgttttagtccgttggtaatgaggaatggattggccgtgatgatgtcaacggtgacacaactgcacaaaccttcattgagtagcttggagatcttcatgaatactagccgggaagtgaggttttttaaaacattgccaaggtccatgagaacaaaaccttcacgaacacaggaaccagtactgtcatcctctgtacttccatgtcaaccaagattatgtctatattgcattaagggcaaatctgccttgttcttttagaagtcgtgatgggtttcaaatcagaatgccaccagtaggaatcaagaggatgccttcagaaatcccgcatcattgtcttattctcttgtattgtgggaaagcctctgcagatacctagataatctaagaaaagcttttaaagcatagtacatgctctaggaggctttgttcttataattattattattgttgttgttttagtcactaagtcatttccgactcttttgtgaccctacagactgtagctagtcaggcttctctgtccgtgggattctccaggcaagaacagaggagtgggttgccatttccttttccaggggatcttcctgacccagggatagaacccatgtctcctacattggcaggcagattctttaccactaaaccaccagggaaaccctgtaaatgttattaccatttatcataaaatgcctcagcacatatgtatatcttaaggtttaagatcttgatcaatttttgcagatctgccttgagagtattttcctaaaatatgtttaaaacatggtagatggtaatttctttaaaccctagaaggttttatctgcaaaataagcatccatatttaggaaatctcttaagtttcgatagaaagaatatttccttctttgtccaaaatgagagtggtgccatcttcattatgacttctgaccgaacctgctgtttggtaatgaacatgcgtaggaggtttgacggaagtcttaacctgaaactctctgctctctgctttctaccacacgtgcttcttaacttcatgtcaccttgcaggtatttaggctgtttattttgccgtgatgcgagaaactttaagagctagaaa

SEQ ID NO: 39540 - DNA, 1294 bp, Bovine  19866880138216
atttttgcttgttataaactgtggatcatgtaccagtgatatatcggtatataatttcagtgactagataaaagttattggttaacacatgttccaaaaaatcacttttatatggggaaatagatttcaaatgaaaaaaatatatgtaaattatcaggtaaatataaaaaaatgatcttaattcattactgggagccaaagcaagaccaatataaatttaggatgccatagttaacagtgttaaatcttataagagaacaatcccaaaacagctgtttcaatatggttccaagacggctgacacttaaatgtcaccatacatttgcaatgtatgtgtaatctttaacagcagagaatttaaagtttattttataaacaagatcaaatgtaaaaacaaataaaagaagcttaaggaaaggaagaaagtagtcaaggttatgatgaaaagattttaaataatgaaagtcatcattaatttgaaggaaagtagttcttaagtagagcatgtaaagtaaaatatgtcaacatatttcaaatttattttaatagacacatatatatattatatctgcatataaatatctatacaaaattatatctatatatttacatataatctgtggaataaagggaaagataatgatccaaactcattttataagtctgatcaaatctaagaatgcttcaagaaaaagccatccaatgtctttcaacacatagattgtaaaaacattgatcagggtcatactaacagtatttggcaatatattatatttataatatctaaactataaaactgacagaaaaaagttatggacatattctagaggcaataacccagagaaattgatttcaacattatagacttttaaaaatatggccccttttctacaagatttttgtgctttcattctacttcatttcccctttctcgtcatagttcatgccattgcttagaactgtgtcatgactttatttccctcttgtgaaaattatgtaccagtcctgggtagatttttggtgttccctgtccttcatcgtttcttttggaaaataagctagacttctgctaccaggtcatgaggttaggggggatggcgggggtgggaaggctacagacaaactggcctttctgctccctgcacaggcattatagatgggctcacagcaagttcagcctagagagctatgatcaccctgctctcacactgagaacaaagtcaccttcgcagtatgcagagaacttctgccgctctctctgtccctctctgtggggagaaacctcactagtgag

SEQ ID NO: 39541 - DNA, 1825 bp, Bovine  19866880210235
ggaggcctggcgtgctgcgattcatggggtcgcaaagagtcgcacatgactgagcgattgaactgaactgaactgaactgaactgaatgcccctgaaaatcctacatttgaagtaaggtatatgtgaacacggaaggcacaagaggcattacaatataatgttatacagcaacaaaatctaatacaatttgaaacttcatatggagagcaatcatatcagggagtaggaaggtaatagttgctctttactaaattctagcaacagcattgggaatacattgcacattcaatactaggggtctctggaatgggaaaaaaaaaaagaaattcatcagctggaattggtgaaagaagaggaattgaagattggggtcttagaaggattgaggcattttgggaaaataagaaaataacttataacatctaattgacccaaaccatctggagtggcgaaattttcttcagttacatggagaatgtagtcacagaggacactgaagaaattacaagggcactacttcccaaaggttaccttgaaaacaatttccttaggaacctgagtggattcccagaagcagttcaaccttaaaattttttctcccaaatgatatttcttatcacttcctactcttaattttttatttaaaatttttgtactgtccagcgctttatcctttcattttttggaaactgtcacttcatataaaaattcatccaagttttgttcttcttcttattattacctttattattaacagtggaaagactggcagttttaaattttaggaaagttaaagatgcatacattcttaattagcagatgatgagtttgctaatccgattatgcaactaaaatatagacaatattggtgatgacatattaaattgttatgcatttaagtatgctttagagaaatctagaatataaaaatacattataaaatggcaggatgctgttccttaatacttaagtatttccaaatcctaaaataaatgcattaagccattggcttcattttcacagtcacaactctctgatggccatgtttatactgtagtttaatttatttcttctctttcctaaatatattcaatttttattatcaatcatacctcaacaaagcttgtaaaattttttaagcaaccaagaaatacacataatttttaaaaaatatttaaaaattattagaataccatacattgaatgggttgttatcagagtattttgtaaaatgcctaaaattactttaaaatgttcaattatttccctcatgctgtttgcatttaacacttggaacacttgttttattctcgcacgcttaatgagttcttcatcatgtcccttctgaaagaagtaagcctaccaacagggacttgcccttgtgaggatctttcaggtttctgtaaggtggataattcttgccttccagtctcctaatagagcactgtgtaatgcatgtctcccctataaagctcctccctcctcctcccaacttcctttacagctttattctttgaaagaagaagccattcaaaaatgttacctccttgcttgggcctttagagcaacgagtcatttctattgtatctcttgtgactgatgtgagagaagtgtaagaaattgaatcacagtctttcaagagcagaaggatttgcctgccacaagagggctaaatgataaccgtcaagtcctcttactgagcaattgcatttccattccataagtaggtaaaggctttttaaactgtatttttttaataacttattttcctttaagtcagttcatttttatcaataagagttcaaccatgccggggtccagccc

SEQ ID NO: 39542 - DNA, 1135 bp, Bovine  19866880441777
caaatgcatgcattatcattgggccatggcaagcattattagtctattaatataagtatgtcaaaattgacaagtagaaagataagttctatcaattattatgccttttctttgtgtcaccacaaaactaagtcaaacaggagtgcttgtgttctgggatgctaggagagcattcatgtttatttaaatatgatttcaatctttaggtgtttataagaatcatacttgaatacatttcatgataggaatttatatttacatcttcagtgtgacacagataagattgtttgatgcatgaaacagcaataattcgcaacccatgtcctaaaaataattctaatacaaatatgcaaataacacagaggacataatttaaaagataaccctgtggaaaatcataatttacttgaacaagatcaaatgaatcttttataatcacataaaattcactggataaatgaaaagaaaaaataattaattcagcaccagagcttacatgatgttagaaatgaatgcaataagtgaacacactctatgaactagtcaaataactagaaaaatatttaaaactatagtagaaacaaactcaccaatttctttgtcaactctctcaaaattggttcctggcctaataaatctgaagtttctttttgagcaatgtacataatattcatagacatatttttagagtaaaacaaaaacttcaaatatagtagtatttttctaagggctgctttaaaatcattaataatgacagtatgaaaactcaaggatataatacaaagtacactgtaatggaaaacactgaatatagaattgtcttttaaaactaaggtaaagagggcttagttctgaagaagaataaaaatctagcaatttttctcttaaattcatcaatttatacagtatatgtgtgtgctttgtgctcagtcatgtctgactctttgcaaccccgtggactgcacttcacttggctcctctgtccaaggaattttgctggcaagaaaactggaatgagttgccatttccttctacaggggatattcccaacccagggatcaaacccatgtctcccacgtctcctgcattggcaggcagattctttatctctgagccatgggaaaaccaactaagt

SEQ ID NO: 39543 - DNA, 1063 bp, Bovine  19866880556821
tattaatatttatagaagatgtctgaagatcattgcttttgaaaagaagagagatgcttccttttgtgttgacatcagaaaaaaaatctctgtaacttcagaaaataagcatatttctatgtctagaattcctttttaaactgttttaagagaagaaaagtaattattaaaatacaaaccagtgagtcatccaaataaatccctgggactcaaacagtgtgttggaagaatgaaagaaaaacgtttatttcaaagcgttaccagtactttgtatctctaatagtggaaactaaaggtacatgactctttgtttgatacaatacgttcatcaccctttggttattaaaggaaaggcattgtctgcaacaaaaagtttgagataaaaaggagttgggctactttgcataaaatcataaaatggtgggtataatattattagaaccttaaatgattattggacttcctataggtatagaaaatattgttcaggtccttgagactcaaaagggaagaaagcttaaaggtgtattgggcaaagagtctatcttgcaacagaagaaagagacagggagtaaaaaatgttaaataaaatagctaaattttaatattttaatttcaacaggttaataacggtttttaatttttttattttaaaatccccttttttccccttttattaaacacaagtacctcctcttcagtaccaaattggtaccccatcctctttttaccctcccacattaaagctttgctgctgctgctgctaagttgcttcagtcatgtccgactctgtgcgaccccatagacagcagcccaccaggctcccctgtccctgggattctccaggcaagagtactggagtgggttgccatggccttctccacattaaagctttaggtaagcactatttttacctctatttgtttcagggctgccttgggaaatgaaaaatgatcatgtctttcctggagaaaaagaacagaagcaggaagataatactggcaaggttactacagtttaaccatggggataacttagtttttcacatactaggtgtaaatat

SEQ ID NO: 39544 - DNA, 1108 bp, Bovine  19866880796326
ctgagcatgatagagtctgagaaaaattgtgtttatgttctaattaaaaattatagtacagactgaatctctgaacaataaaaatctcagaaagcccccaaaatttgcttgagaaggccaacagttctcaggatcttactttttttaatgagtcagtattattaacttctgggagacttagaatttagtgtagaaatgcatttaaaaaatctataatattagtattgtttgtgttaagtttagaaatcatgtatattttctacttaaggatgtgtgatctatgttgaatctgacattttatcaaattgattaatcttataattccaattttaataagtgtaatttataaattaatatagatttttctaatcttatattcattactgttacatttaatagaatttatagcttagtttaccatactaaatttatgttatttaagtattcagaaaggttttatttgttaattagacaattggaatacttaaaaagaaattgaatatattaaagttacggatgctgtttaaaattttgaaggtatttaattaactaggtttgtaaatgggactaaacactgtttaaagacccattaaaataggtggtaaaattttattagacttagaaatataattttattatggagaacttaaaagcttaaggaagaactagttctgggatttgtaaatttaataaattgaatattagtttttgaaagctaagtaaacactaaatgatattcttaacatcaaaatatcatttgagattattaataaaatgaattttatagtgttacttaatttttagtgttttggggtaacacatgagatggtagctttgccttctggctagtatttacctctagttgctagtatgtacgcccattccatcaatgaaaaaaggcttccctgataactcagttatatgagaataccagaccaccatagtgttacttaattttgtagtgttttggggtaaaacatgacatggtagctttaccttctggctagtttttccctctagttgctagtatgtactcccattccatcaatgaaaaaaggcttccttgataactcagttatctgggaataccagaccacctgaactgcct

SEQ ID NO: 39545 - DNA, 1204 bp, Bovine  19866880810065
ctaaaatatatctaatgattatgcccacagtatttaaaaaaatggaagtacatttttcttttgattagcttctagtatatatgttggctatgctaaaccagattaaaatgggttctctttaggataaaatatttacttaggctttattgaaagaataatttaatatttggtatatttgtgtatgtgtatgaaacattcaacatggtgcttctactctacagtggggactagtccagatgtttctcaacaaagggattcatgttcaatgagccctctttcattgcctgtttatttctacaaatgttttcacttttcagaggtttaagaatgctgaagtatgaaatcagtggaatatttgttccaactggttttggacaaaataccattgttttaagaaatcagatgattaagcatgtttttcatgtcccttttctaaatcaagcatactacattagattatgatatgcatattagaactatgtcactaaaacactcaacttctctactgaagtatgattgcaattacgatttaacatttttctacagtattatcatacacattataatgcagtaagttttcttatcatcctatatgtttttccttcccatgcatttaaaaagtgttggcagctgagatgctcataatatctgaaggaccacatgacaaagcagcattccaacatcagactcaacaaagtgtagcaaaagggaagagataaaaacctaaggagaaagtgaaatagttttctattgaagtatgttagattgcagagtggtatcatgggaaatagcatacgttcttttactggaatcattttaaatctttcttagaatatttaagcatatattgtctggaataatctcaaattggaacagagagagacaagatgacctagaattcctttccttctctagtttctaataccttatgattctgtacatagcaaaagtatattaaagtccgaagtacagttttagacggcattaaattgtttgtatagttttacagttgtgtacagaaatgtcaagttgtggtgtataggcagtaatactgcagaagagcaccctgaaatttacaaatggattatgttaatgtattactaatgcaagtatctgctgaactgaacctttcatattcatgcaacccaatgtggtcctctaaaaacaaggtactgaaatttgtactctgttttgtgttcagtgt

SEQ ID NO: 39546 - DNA, 1216 bp, Bovine  19866880822488
cctgcatgtccatccctgccctgcatataggttcatcagtaccctcctttctatattccatatatatgcgttagcaaatgagtcttgtttttctctttctgacttacttcattttgtatgataggctctagactcattcacctcataacaactgactcaaatatgtttctttttatggctgagtaatacttcatttcatatatgtatcacagcttctttattcattcatctgttgatggacatctaggctgcttccatgtcctagctattgtaaaaagtgctgcaatgaacattggggtacatgggtcttttatagttatggttttctcaagatttcttatatgtcaagtagtgggacattgggtcatatagtagttttatttctatttttttaaggaatctccatactgtcctccgtagtggctgtatcaatttgcattccaccaacggtataagaggattcccttggaaagcagctatgctcaccaccataccatcaacatgttaactgacctttgtagatgaatttggaatggtcctaggatgagtgtcaaagcaaactttaaattaacctgaatattttattttacaggtataaagaaaatagaagacagcacatataaattttaaataataagtataaatcataaatcatgaataaacatcattttggttattatctttttatttttctgtattttaaaagtttatctttgtaagaaaaaaacattcaaaaaattttctcaaaatatttacttgttaatttagggaagtatttttatgcaatacatgttgataccaaaggaaccctggctaaaattctccatgtaattatcaggcaaaaaaaataatgaccttggttaaagtgaaaagtattaacatattaaataaatccatttcaaagattctggtcaataagtagaagtttcaaggcacctctgtctaatgccacaggagatgtcaatcaggagaagtatgtattgaatttttgtatatttcaagagattaaggttattgaagttgtagcagtaaaactgggatgagcaaataagctgatttagtcttaccattagatgaaagaaactaatttagtatgaatagactctgtggattgaagtgtaatggaaggaaaatatttgggaaactttattttttaaagtaggttggagcgagagtatattaatgaagtcaaagaaaaaagaaatcgtcagtctta

SEQ ID NO: 39547 - DNA, 947 bp, Bovine  19866880835139
ttctttgggatagtatatcataaagtccccagatgtgatttttcattggaccagaggaggataatgtcaattagttaataaactcagctttatagaccacttggagataattatcctagaatgtgaaaatgtagtacatgctttcacaatatataatagtttatatataaataatcccaactctggtttctgttttgtgttctatttgcttattaatttctgaatctgcagttcctagacctagaaagtactcagtcaatgttagtaattgaatagatacttgcctatgagtatatttttggaagctacaacagttaactggtatactcagacccaaatggtatctctctttacttccttgttttgcttgtcataaccatttgtattaaaagccaattttttggggggggctggtggcagcgtttcaaactgaagagccctgcttggtgagatagttttaacacttcgtttcttgagcaaattttggaatacttcccagtactaccttgaaaacaggtgggacagggaaaagatgagtctgtcaacagggctctattactacttcagtttctgtcaaacagtccactggcacgtttacttttccttcttagctattcaagatccaaacatcaggctgttgcctgatgaactgctcccctgtcagtgtaggcagcagtctggacagaacaccagtacctcagcagcctactcagatgagaagcacacagcaatattccatgtaggaggaataattagtggcgaccatttgaaagggtcaaacttaatccacatggaagtagaatgagcttcccattgtgtctgaatccccagtttaaagtcaagttcacttttttaaagaatgcttactgttgtctgattgagtttggttgtatgacggaaacataaatctggcatataagaacagcatgctaaatatacagaaacca

SEQ ID NO: 39548 - DNA, 1883 bp, Bovine  19866880853370
ttgcattaaaatgtgataattccaaaatccctgttaccttttgtatcctagtaatttttaatttattgcttattattttttttaagtttgtggtttgtaaagtaaataaaagttaccattattagcttgattaatctttaagtagtaaagcatttgaatcaatatattatgtaattctagcctatgtgtatctgtgtttgtgtgtccatttattaaactgggaaccactaactatcaagtaggttctaacattcatcaacatctttctctccgtattgtttataatgcaaacacactgtcaatgtctgtttcaaaataaaaaccactaaaagatcaagataaggttttggaacacttgacttaatttattcttgttcctattaataccagataatgttttaaacaaaaacataattttttgtgtgtgtattttgttaggacattcccttggtttcaaagaaaattattctttattcctttatacccttgattatgcttatcttttgattataagaaaacagtgctaaaaacaaaaactctaaaattccaatctaagaacataaaatcaaaaaaaatcttcaaagccaacattttgtgaagcagatttgaaaacaaactatcatccctatggaaccattaaacatgtctctttttttttttcatgcttaaagagcaaagataatctctttcttggtaagcactattgagagtaatgactgtctggcaacttatttcattagaaaatctgtaatttgtttttctttatttttacagatgcccaagaagctttaatgaactatagcacttagatgtgctgatatgagaaattaaggtttatattgattccaaacatatgagacatttttattttcattttagtaggtaaagatttctttttctcctccttttatgccatctcatttagtggccaaacttctacccagatcaccattctttgtaaattaacactagtagatataggtacttagctacattattatctttcgtgttcactggattggctgtacttgctggttttgcctcagttagaaggcagtggcaccccattccagtactcgtgcctggaaaattccatggacggaggagcccggtaggctgcagttcatggggtctctaagagtcggacacgactgagcgacttcactttcacttttcactttcatgcactggagaaggaaatggaaacccactccagtattcttgcttggagaatcccaggaatggcagaacctggcgggctgctgtctatggggtcgcacagaggtcagacactactacagcgacttagcagcatacaaccacagacatgaaagtgtttcctattctggaacatcacttttccatttcataattttaaaccctctatatcagcttgcttttaaatttgaaaatagtgattatttctcacataatgtgtctgttcatgtgtacatatttttatttttaaaaattttttttcattttataatttttatgagctatgacagtggaggcaaatggaattcttagaacattacttaaaaatagatttttaaagacaaaggtcccatctcatttttatatacacacatgtgtacatatttttgcaaacataggcttctctggtggctcgggcagtagagaatcagcctgcaatgccggagacctggattcgatccctgggttaggaagatcccctggaggagggcatggcaacccactccaatattcttgcctggagaattccatggccaggggagcctggtgggctatagtgcatggggtcgcaaagagtcagacatgaatgagcaacaaagcatagcatatacaaatacaaatgcatatgcaatcaagaatttatattcaacttatatacttacata

SEQ ID NO: 39549 - DNA, 2597 bp, Bovine  19866880877450
tgaaaaaaaagaatggagtctacctttccactttgcattcagtatctttcatttcagatatcgtcaataaccatttggttaatggattaatagataccttaaaactcttaattataatcaaataataagaaaaataacttacatggaattagaaaataaaattttggaataatatgttactggaatgctactataatatctaaattaacatttataaaaattacttaattttattataattgaaaacaatggataaaatattattaaataagatttttagttgcaatcattatatcttaactccttgactcttcacagctttactttaaatagttatagtgacacaaaatattataaatggaataaatttttttccacaaatattgcattttgtcttaagtcctgttccaggtatactgactttcagagtttattcttttttctttccttatgtagttcctcagctttatatatttcagaatgtcagtagatgtaaaatcatgacaaatactttcaatctaaatatttatatttcataaatattttgtaattgcctcccattatttactaaaaaattctagctaaataaggctttggatattcctttaggctatatgttttcaaatactggaggtaagaggcagttagaacagcaaaactaatttattcatttagtttatttaaaatgtacatattgcccaaagccagtagcacaatgtacagaacataaattacaacacttaaactgaatgtagcacccgaatagaagaatcacatgcaggaatggtgtatgtggaaagagtaggcaaaaaaaagaataacagtaaaagactattctgatataatgctcactttatcaagaaattggttaaattctagtgatagtttatctgctgaagttcagcactggacagtagatatgaatttttagcaaaaagaagtgcagttgatcttactgtgtaaggtgcttaaaaaatatggcgaaataggaaatactcatctatcaaattatatatatatatgaattaaaagaagtaattttcataaatagatttctaattataaagaataatgttaaatataatttattaaattatttaaataaaagattcaataaaaattggctgtttttagaaagagaattccatggagattttgctagctaatttttcccatgaaatctgcagtatttctcagagtatttactttctattcctttatattatatgtgtaattcctactgaaacattactttcaaatttctaatatgaagatgacatcacagacatccttaacaaaacaaactagcaattttttaagggtttttgacataaactttgtcaaaagttgaatgatgttccccaaacaatatgtcaaaccttcatatttgtgacctatgaaagttatgtgaacaaaaagtgtttatctctgtaattagttaaaaattttgagacaatgagataatcttaaattatgtgaatgaactcttaaatccaacgacatgtgttttcataaaagagaagcagactgagattataggagaggacatattgactcaggagaacatgatatgaagcaagaggtagagaccagcatcatgcaactaccagctaagaactccaaggatttcctgctgctatcagaagcagtgagaaaaaaaaaaaaacaagaaacaaactctcctccaaagcctctggtggggttatggccaatggacacattctgtttagacttctcagctctagaatgtgaaggaagacatctgctgtattaaaccatcagatttgtggtaatttcattacagtagccatttactcttttttatttgttatttaagttgctcatgtggatgaaaaattggaaagacttccaatttatccttaactgcatttccaaatcagtggaatactaaaacattttaatacatttaattcattgcttatgtactcctctcatctattcccattccctgtgcttattagaacagtctaatgaaattaaatagcacttatgattatttaagaacatcttttcatagtaaaatataaaagagacagattgaatgtaaagtgatggaaataaattccaggcagtcaaaaattaagataaaattttatagctatgttaacctcaaaaaaagtaaattgtaaggtctgaagacattagaataaagataacattgtaataacaagaagaaggaaactgaacttgaatgcacctagcaaaagagtctaaatatacatggaataatagttgaaagaattataagaaaacatgacaatcatccttagaaattttagaacactgcagtaaaaagttaatgtttagtaaggtctgtaccacggcttccctggtggctcagttagtaatgaatccgccagcaatgaaggagaccacctgcaatgcagtagacttggtttcgatccctggattgggaagatcccctggagaaggaaatggaaacccactccaatattcttgcctgggaaatcccatcaacagaggagtctgaagggctacagtccatgggatcaaaagagtcagagatgactttagagactaaaccaccaccacaaagtctgtatcaagcagagaga

SEQ ID NO: 39550 - DNA, 3449 bp, Bovine  19866880958532
actctgcttctgtacatcccccaaaatgcactactccccatctttggtttgtaaagatgtctcctaccttattctctgaatcagaaagttctgatctaggccagttatgcaaagtttgcattgggtccttttctgattgttatcacatcctgcttgtgctaccatattcattcaaattttcccattgttgtcataattctcattactttgtgttctgcagtaacatgaaatttggtatcaacgtgctctactctagcgtcatgaaatggagggtgatcacctctcagtgaggctttttagaataatatataaaattagagagtgctactctttgttttcgttcaaagcaatgactgccttcattaaaattatgacagctaggtatttagagcttgtaaagtattcaaaggagataaggttcagaaatataaccccagataaattgactggacatatcacaaaattaacattccagatatttcttgatagaaaaattatttttgaagcaatctgtcagatatatatatgttcttgacctccaaattttcctcttctttagaattacttaacctgacattcctcctgtttagaggagacactgatcttctaaggctttgtcattttgttcttgaccgtctccagtgcagttcttcttgcctgttcagcttttccctcctcagtgattttcccttaatcaactcaaatattaatctttgctatgctaaagaaagaaagaaagaaaaagataacaaaaaaagcaaatccttcctttggaactatcttatccacaatgtcatgccctatttctttactttcaggataaaactcattgactgaaatagttactgtcaatatctctatttctacttaattccccagagcattaagcccggtccctatctctgcgagtacatagaaagagcttttgctacaattgctaatgaattcctcatcaataaattcaatcccttggttttgtgctcatcctacttaatcctgctacagtatttggcactgttaaatacactcttctttaaatcttctctttcactttagagaatttaatttttatgattctttttttttctttgactttaattttttaacttttagtttagattatgtgtttctgtctccttcaaaactttatatttcccatagatatattttgatatttaggtattcttttactatgcatccttccaactaggtaatctcatttattccaaagacttcattatcaatagaaaattttagagtaaaattaactgggaatagtctcactacatttactcacttgtatagtcccagtaactactttgagactattaaatgaaatattttatttaataaataatatgttgcttgaatttaaaatctctatagctccgtacttatatggaggtatgctgctgctggaggtatgggtaagtactattacgtctctattttcatgttccagaagtagctcaaagttaataatgaaatcatgtttttcctaaaattttttccttgtcctgaatatcacatgtcatgttgcatattaaaatttatttacatactacttaccaagccttgtacttttcatcagacacagctaatggcactttgcatattaatttatttatatactacttaccaagccttgtactttgtatcagacacagcttatggatagacaaaaaaaagtctattctaatggaatttacagtgtattgaagtagacctaagataaacagatacctaaaggatttagtatttatgagtatcaagaaatatataaagcagagatcagggatatcatatatacaaaggaaattgatttatataaaactcttaagtagaggcttaaatgaattaagggaatttcttttaactcccacataagccctgaggtgagaatttgcctatttgcatttgatgaatatcaaaggagtcaatgggacaggaacaaaaaaatctaaagagaaagtaagggaagttgaagtcagaaaggtaacataaaggagagttcctatagggctttataaatcatgggagtaagttatcaaggatgacagtgaaatttttgatctccccacctgggaaattaagtaggatttacattaatgatatggaggagtttgttggagaataaagttttgtgttacttatcaaatgctcagtttagaacacattaagtatgatgtgtataatatatatatatatatatatatatacacacacacacacacacacacaaaatattatacctatctatactggtcttaagtaaagtaatagtgatgtttttacattaagaataattttcaaagtcctcagtaaatatgtggtatttaaaaacattaaaatacataatactccaaaaggaatgtgaagaaataaaagatagacaagtctgagtacacagtcttagatttctccaaaattgagcagtggtaacaaatgtgaggcgccaataaaagagaatgaaataaatttaattaaatgtaatttgtttatttttgtttttattttcattattctaggaggtggatcaaaaaagatactgctgtgggttatgtctgagtgttctgcctatgttttcctctaagagatttatactgtctgaccttatatttaggtttttaattcattttgagttgagtttatttttctgtatggtggtaggtagtgttctaatttcattctttacaaagctgtaagatacttatgaaagaaatcaaagacaacacaaacatatggaaagatataccatcttctttgattggatgaatcaatattatcaaaatgattatactactcaaagtaatctacagaatcagtacaatccctatcaaatgcttaaggacatttttgataaaattaaaacaaaatttttaaatttgtttaaaattaaaacaaattttccataaaattcatatggaaacataaaagaccacaaatagccaaagcaatcttgagaaatacaaagctatagtcatcaagacagtatagtactggcataaaaacaaaaatatagatcaatgaaacagggcagaaagcccaggagataagcccatgcccccaagctcaccccatctatgacaaaggaggcaagaatatacgatgaagaaaagacagtctcttcagtaagtggtgctaagaaaacaggacagttattaacattatcgaaacatagtttttccccatctttggctagtggcagtttcttcaagttggcttcagaaacctttaaacttgaactctatatagtctttttttttttaagctttcatgaaaggaagtattttgtctaggctcatttcctaccccaattctggaatcagatatttcttccaaagccctttgttgtaaatgtattacaagaccacaatcagctacttggattcctctggttccattgttttgccatgttcaatggatacttttgggaggataaaagttgt

SEQ ID NO: 39551 - DNA, 1158 bp, Bovine  19866881004002
aactaatagggctgaacatgcagcacaatgatgcggatgataaaggaatctcaaggacatgcagagaactagggtaacatgatttagaagtgaggcagttatttcaaataaacatctatttaagtacataggaaaaacgctgatctgttgggaaaagcaagtttggaccagtaaggaaatttacatctatttttggagaaacttatatttttatggaaattactgttgaagattctgataatgtaccctgaggtcattctgtatatacttgttgattagcaattggctgacagtttgatatttaaaaacgcaaatctctgaactgttaaaaaaaaaagagatggcttattaaatctaaaactgcctgaaaggataacactaaaacataatcaagaaagccacctcctctggtgttgaaatagcaatggaaacaattactttaatcatcaattgtttatttaatggctgctcttagctcagttccgtgttaggtgctatgggctggaaaggaagttaagctattgctgtaatttctaagcaaacacattaaatgctttcagaactagatagagaagaatgaatttctaattgtgaagtaaatacagtatgcactaggacctaaagggacagatgattttatgttatagaaactatgtgaatatacgcctttattcctttgcaacccgatacattcaggtctaaattccaagccctccactaacatactgtgagatttttctgcaaactattctttttctttgcaattaagttttcttaactggaaaatgagaatacatagaacccacagagttgttaaaaagaggacataagagaaaatactttgaagtgtagcacatagtaggttttcaaagatattctcagtttatattgaataaaaatcttcccataatggcaagtgaggagggcacagaagcccactccagtgttcttgtctggagaatcccatggacagaggagcctggcaggctacagtcctgctgctgctgagtcacttcagttgtgtccgactctgtgcgaccccatagatggcagcccactaggctcccctgtgcctgggattctccaggcaagaacagtggagtgggttgccatttccttctccaatgcagaaagtaaaaggaaaggaagtcactcagt

SEQ ID NO: 39552 - DNA, 1040 bp, Bovine  19866881051909
catctagagagaatgcaaccccgactgacactgtgattggagatttctgactttcagaactctaagaaaataaatttgtgctgttttaagtcattaaatttgagataatttgttacagtagcaccaggaaactaatgtaatatgcaaagttggtcatgccctgaattacttaggagtcttttttctaggagtcttatattttggctgctgtgattgtcataattttgtgggcgattaattatggaactcatttgtcatatagtgtttgatgtggctgagctttcaatctgaaaatttaaattttaacttctgagggatatttttaacttgctgcttatataagctattttattttttatcatccatgtgtaaaactcagtgatataatgcagttacaggatgcaacattatttgaaatgtgaaaccaaataaattagataaaaatgattcatgtttgttattatgaaagcaagagatcagagtattatacagtaataccagcaaaacatttgctacttttgataggctaagaatttaattttcagcaaaagtacattcccgagtttcacttttgttttgtaataaaatctcaatttcaggagatactgaaatgtaaacaggaaataggtgtcagcctcaggtcagacctacattacacagtatatttacttgcaccaagtatttcacaattgttatctttaaactaaataatcatctcttggatttcttcttaggattagacacgacttttgtatgtgcaatacttttatatttcctttaagggatactaaatacaagtaaggagacatgtgccaaaagtgacggatgttggaaacaatcttgagctaggaagcagcatgaggaaattgaaatatttgaaagataggttatatcagatgatattggatgaagagagagaaaaggaatatattatattttagttagctatctccagtctctccccattttctgtccaatcaaatgcttggtatctttggaagaaaacaaaagaaacaggcaacaatagcaacatcaaaaag

SEQ ID NO: 39553 - DNA, 809 bp, Bovine  19866881090770
cttccagcatgacaagacaatcttcaggataccatgctgcttagatggctgaagccactgcttcacactgttcagaatttcaccctttgacacactacactatctttaaaatctggaaatttagtcttaaaatggtcttggctttcttcaaattagttcaagttatgtcttttgcctttcttaactttaacggtagccagagtatttcatatctcagcagcatgattctcaatttaatagctaagaagatacatgactggcaaataacatatttcctcatccttctttctttttttttattttattttatttaactttacaatattgtattggttttgccataaatcaacatgaatctgccacaggtatacatgtgttcttaatattaaaaaaaaatacaactaaataaatatttgataccaatgaaaagacagtaacagaggttatatttatacttttccctgtaacaaacaaaaacaaacaataaaacagacaaaaacatttaattcaatggttttcaagacaatggacatcaaacaacagaagacattgaacacttggacactggaaagagatgaggtaagccctaacagtctatcttgggacagttttaaaaatgacaacaggaaaagaaatctaagtagaacccagaaattataatatttgaagagacagagtcaagagtgcagcgaaccaaagtagacagagttgcaggatatagtttcatttactaaaaagtggtacagagaaagaaatctgcaaatctgcagacattcagcagaatgtatgtcttaagtactcagcagaat

SEQ ID NO: 39554 - DNA, 767 bp, Bovine  19866881164689
atgatatttattttgctggctctcatatagtttacaccccatagttgagtcaagatgttaaaagaataaaatgctcagagaactctaagaaatcttattaattttgtaatggtgttgaaagcttaccaaaggtttttgttctctaaagctactgttttgagcaaatcagaggggatttctttttaactgctaaaaacaagcagggctttctctggtttgctgtttataaaatggcaaatgtggagtctatggaggtcttgtggaagcttttctgactagttgtgattttttagatacatacacctgtgttcacacacacgcacacatatacgtattgcacacatatgtgtacacatatacatgtatatgagatgcacatatatgtaaacacaaacatgtgtatgtgtttatatatgtatatgaaagtaaaaaagaaagtgttagtcactcagttgtgtccaacactttgtgaccccgcagattgtagcccaccctccaggatcctctggctatggaattattccaggcaagaatactggagtgggttgccattcccttctccaggagatcttcccaacccagggatcgaacctgggtttcccatggggcaccagggaagaacttcagcggtcaatgcaaagaaatagaggaaaacaacagaatgggaaagactagagatctcctcaagaaaattagagataccaagggaatatttcatacaaagatggacttggtaaaggacagaaatggtatggacctaacagaag

SEQ ID NO: 39555 - DNA, 856 bp, Bovine  19866881293769
ccgaaaaaatgccttgtcagtaatgatcaattctcagggatatttaaaggaaatattattgaaatactgttcatagggcacactcattaacgaatgcaggagactgtacctaatagataacaatggattattaaaatcctcaaaatgttatacacaaagtaagttataaaaacattccctgtcttttcatactgcatggttactaaacaactaataaaatatacacttcttaaaaaaaaactctgcatttaactggataaatatctaaactcaatttaaacttttaattttttattatgtaaaaatccgttttcatcaatttcctgaaagttttaatatagacaggattacagattaaaacattcttagaaatgtatcatttatttacaaagattatagaccctcccttaacttagaaaataatgattggaaaacactgggcctagataaattgctttctaagccatcatgattaagtcatttctggtgggcaggtatcaaagctggtcattttcctctgctcttttttcaaatagcctaaaatccaaacattccggacaacagtagtgattggtgtatgtttttcactctttcttgtgataaaatcttattttattaatgataattgatctctatcaggattttaactaatagccttgcccagttactttacaaagaataataataaaggaaaacatttaacaagttaaactcctaaattatttattttacaaaaattgaatagtcctatattccttaccaggatgtttgtttgcttaaatattttccctaaacaccagttttattggtaaatggtgtttcttaacattaacatattattttccctcatagtaga

SEQ ID NO: 39556 - DNA, 807 bp, Bovine  19866881542650
agattttgaccttccatggcacaaaggcaaagatgaatgcaaaaaagctccactgctgttaaacattataacaatacaatctgtaggacctcaaaaaagaaacaaagaaagaaaaacagaaaagagggaaactgtttatcagctcagggaggatcaaagcaaatatagttttggtctgaaagaaagaaaaaccaaaagactaaaagaaaaaaaaaaaagaaatgcttttaaattgaaggtcaaggaagatactaagaatatggatataaagtgattggtaatcctgcatgatgttgtctgatactgtctcccatatatagttatactgttatttaaaatgctttctttattttgaaagccagaataattatcattccctaaataaaaacccatggacaggatatttttcagtttagttttaaaaagtatattctgatgggaaatagaacaagatttagccaataaaaagaaatagcaagtacaagaatattattaatttaattatattttgagcctaaattaagtatttgtgtgtggggggtggggggatattatttttaaaaagctagaaaaaacccacctggttccttaagctccatattgagcaaacaacgtttgtgtagtaagattacaaccagaaaaactctttagtttagttttaagtaaaagatattgtcacctctcttttaacttttattaaggaattgcactagaactagatcttcattagcacctcactgctttgccctaagcatctgcgtctcctatatagtctaatctaaagtggcttaattctcttttcaaatg

SEQ ID NO: 39557 - DNA, 2013 bp, Bovine  19866880382604
atttctcataacgacatctttaaaaccgtctcctctacctatttaatatccacaagccagaggggttgcaacccacctttggcctcaagaattgccctgtggtaggtaatcaaaaatgaattcaaaacagggccaacactccagaagccagtttcaagggctaaattgtcctcacattttcagcaaaatcccatgaaaagtttttcttgaccttggtagctgcttttctccacatctaatttgaaagcaatgtttaaagattagaaagagagattagggaaacaatcccatttaccattgcaacaaaaagaataaaacacctaggaataaacctacctaaggaggcaaaagacttgtactcagaaaactataaaacagtgatgaaatcagagatgacacaaacgaatagagatctaccgtgttcttggcctgaaagactccatactgtgaaatgactacatgccccaagaaagccacagactcgctgcaatccctgtcagactaccaaggacatcttcacagaactagaacgaaacattccacccttggaaacacagaagactccaattcacaaattactagagaaatgagaactacagtgaggtatcagcgggagaggaggatggaatgaattgggagattggaattgacatatatataatacagtgtataaatagataactaatgagaacctgctctgtagcacagggagctctactcagagctctgtggtgacctaaatgggaagaaagtgcaaaaaaaaaaaaatggatatgtgtatgactgattcactttgtcatgcagcagaaactaacacaacattgtcaagcaaccatactccaataaaaactgaagaaagcaaggacctgggtgatgattccccgctgtgacacataaccgcccctgttctggagaggcaaggaagacccccgaggtggcaggtacctgggcggcgtcccaggcctggtaccgcagggtccctgtgctgatatagtcactcaggtagaagatgaagaggctgatgattagcagcggggctcacgccgccccacatggccttccagtaccagttcagggcgcgtccagtcatggccttgagggtcgctttcaaatctgtttggagagcggggagaagaaagtctggattagtccgtgctgttggaggcaggcggtccaggccatggagccctctgtgctcaggaagcttttgtgctgggcactactggtgcttgaacacgaccatggggagaggggtcctgggggaggggagaagggcacaggctgccaccaagagggcagagcgaccgcccacaggtgagtggacatcagaggacatgcctctggtgccagcctccaggtagaggctgctgctgtagacaggagggcagcgcccagcaccagcaggcacagagggcctggtgagacgcccatgaagccgtcctcagccccggggggccccgagggcagccctgccccgtccctcccgccctgcagcccaccactgtggtgtccgtgtctgcggcccctctctttgtttctcatagcttgacccttgcctgaatttagacatagcctgacagtgtctgtcttacagtagactggagaggcttctccgggattctggaaactatacgtggagaaagtgctgggagtcgtggccttcgtgggtgcgtttcccgtgcagccctacctgctcagcccatacaggtagcacacggcaaccgtctccgccaggacgatgagcagcagggacagcgtggcagcgtagtcgttgaagatgtcgaaccagtagctgccagcctccatggtgaacagcatgccgatgggcgcagttggcgaggcacaccagacctgggaccacaggaccccctgctcacccgcctgttcccccagcttcccgtggggccaaggcggtgggaaggtgtgtcaacaggacttcctgacgctcattcacgggaggggtctggcagaggacacccgacccagtgtagaaggtaaaacggggcactgatg

SEQ ID NO: 39558 - DNA, 2644 bp, Bovine  19866880415255
atgaagcgagtttggggattatttggtagacatttacagtggcactaaacccactaggaaagccagtgctgcaaagaagactcagtcaaaccgccgtgctggcggggtcctactatagcgtctcatctccatgcaaaggccacacgaggcagaaccgtgcccacgatggcttccaggctggagccgggctcagtcactccactcagacaaacctggagaactttaacactgaatttcactgttttacacaaactctgctagatacagatggatctgaagatgcacaactaataaattaatttcattttatcatactcctgaaagatgtcaatgcaggaggcccagggttcgatccctgggtcgggaagatcccctggaggaagaaatggcagcccactctgtattcttgcctgggaaagcccatggacagaggtgcctggtgggctacagcccatgggattgcaaagcctctgacaggacttagtgactaaatcacaacaacaaatccaattaactaagaactcttccattcttctctctttcctattggaattggaatgggaaagtgaaagggaaaagaacttaaaaaaaaaaaaaattaggcaaatcttagatgccatgtgctctgggacacgcgaagcacgtgagccatgcatgtgccccctctgccctgagcaggcgctcacgcggcctttcctggacaaggctgtctcgatgcaggacagcagcggtggcctccttcttggggagtggccagtggtggggcatgatagcaactaagacttcatggaagtttctaacttgattctatctggaaaacatgaaaaagctaaaactgacttcaccttttgactcccgtgctcaagctgtaaatcttgcagtgctctctccagctttgacttctcatccaatgcatctgttgcctaaaatcaagagcaaacggaaaacatgcaatattcagtctgtaaggaatgctttcaataattttaggtatttctcagttacctgtgattcaatggtcttcagtcttgacttcaatttctcattctcttcttgaagtcttataatttcctttgtgagtaaattcaagttttactatgttagccaaagtacttttcatccttgaaattgtttcactcatactttgaatttttaaattacatagaaactccagagtctggatgctctggctactggtaatatcccagcttcacccagtccgccagcctcaacatttaggagtcatctctggctctaagacttctagttccttccttcacagtctctcagacttttttcagccttctattctcagccttttcccaaagtcccctcctctgccatctctcacctagctgatcctgaaactcttgttctgttcttggcctccacagcatggcacctgccacttatcctctaagcacaatcaccaccactccataccctgtgtccagcccctaagggtccctatgagcagaggcccacggccctcgctcgttaccagctccaccacgagcatcgcctgtcagcgcagtctcaccacactctagcacacacaccactgcccggaggagagcctgcactctgctccaaggcacgccagcctcgggcctgccttggactgctgcccactctgtcccctgctggcctttctcttctgacaattcactgtgtctttgcctttcagcccagcttgggcagcaccgtacccaacagccagtcctccacgactctcatccacatggcactgtgtcttctctgccaccctgtggtacaaaggttagcagtctcctgtctccatttctagaatgttagttatcccttctaaacaagaccgtaaggtcttgaaggcaaaaggccaggtattacttttctttttatgtaacaacatctagcataatgttgaaaacacaagagtcatgaaaaatagttgtatattggtaattattttttataaacctcttactaagtaccattaaggacaactactttgacggactaattacgctcagtggacagggccggaccttccaccccatgtccacctagagctgcgcaggcagccagcacacaccctgagagctgcatttctcacagtgacggcaacattaccttgttcaggagttctgccgctccaccttcatgaagtggagccagttttggcttcatgctgtctatgatggactgaaatgaagcaaaccaaactgaagtcaccaccaaataaagcacgtgtaatcactgagcccctgtactttctaagtgggagacactgtgcaaacctacccatgggatgtcagctagacttttactggtttgcttctctaccacgtgccagtgctgaggacagagcctggcccacagtgcccaaccaaaggtagatcaaaatgaaagccatcctccttgtatcttaaacaaacagacagatggaagagacgggtgggagggatggtagtcaaagccagagcagacaaagatcctaggacctagggactgaggttctaatactgtgggagctggaagcaacatttctgcacaaaccccccaaaattgcaataatgatgaggatttaggtaaactacattgcaggtgactaacttgacacaactcaatacatacattctactaaagcacaagacttcatgcc

SEQ ID NO: 39559 - DNA, 1255 bp, Bovine  19866880420940
tgtgatgaagtgaagaacgggtcagaacaggaatcagcagactgcttccttcactgagaaagtcttgctaccaaaaatacgggcggttttactgggatgtgtgcttagtgacacgggcgaaggacctgctaagcttcctcaccttgtcctaagcgctgagagaccgttcccagacccagcctcaggcctgtggactccgaacggcagcggtgtcttactctgctgacctgcgcggctcagtccctgtgcagacgttgcgcatttgccgagcgtcctgtgctctactctttggtgctcttactgtaaccctgtgctgccggatgacaacctgggggaagggagggcccctcggggcctgagaaccaaagtggcatcggagatgtactcctgggccccgtgtggtccccgtgccctgggcttcccccgcttctaacgaacctgctctgtttccaacagacgtgcctcttggcagaagcagaaaggagcttcctgctggttcctcagaagggttcctattgagactcatatctaaatacaggacagaggtcacagaagggagataatcaggtctttattttagctggctgggccagcatggcttgtcctgtgacccagctgccatgggcagcgttccagagcctccacatggcagttgcacaggatgcctgggagacgaaaggaccctggacacaaatgttctgcacagaagctgttacaaattccacttaaaaaaaaatgaggaagcccagccttcctggagcaatcaggatgcttatttatagtggccggcggcccctgccaggaattccatatagatgggagaggggcccccacctccccaccccgccccgtcctgctcagcagggaggaacagaaactcacgaccccaggctctacgtcatgtttttgccttcctgctctttttagggaactaaaaatacctaccatttgcatggtaaatacaatgctttctttacgtgacacaggtcaggctgggagctggtgtttgggaagcacacggagaaagtctgaacatgggctgggaagcagcaaggctctgatacacaggccactgttcaaggccagctgtcgctctcagcccaccctcttcctgcccctccctggagagctgctgtcgctggccttcctgtgcaagaaccaaaatgcccttcttctcccgctccgagagctggtgaggtcgccatgccaccaaggcacctggagcgagagcaggtggtcgtggtgtctgtggatg

SEQ ID NO: 39560 - DNA, 1357 bp, Bovine  19866880527537
gaacagtactactcgataagaatcccatttcagaactcacagaagcagcagcagctactgagatgggggttcaaagcacacatgattgatgcaggctaacttttgggggaagacttagtggagggggtgaacttgagctgtgcaagaaagggattgtgaaacagcagtagaatcgaaggcctttgtagagctgtaaattgcacgtggttggtggccttactcattgctgagtgttctaaactaccgccacctaacaggaagtctggggttgaatcaggggatggaacctaatcatatcccatccaagacctaccctgagggggaccggaacatctcttttacaacttcctactgtagattccagcccatcaccagtgtgctgggacctgcagagaaagttactgccacaccctctatctcctggcacacacaagaaatagcgttgcttatcgaaaccatgttttttccttacagccctcagatgcttttttgacaaagtgatttgaagaaacaccaacccagaaaacagatatttagccattcaagtcattcttatctgacagtttaacctagaaaatatgttgcttaaaagacatattccttctagtactttaatgcatcttataattagtaaaattaattaatatagccagccaagttgaacagtaaaggaagcccttgctgatgtggctttttttttttcccccctcatttggtattttgagtcaaagtaccggcacaatattgagagttctgaaggaaaagggtaaaagaaaaagagaaatctgattttcttgggtatgcgtgggaaatcatttttcctattgtcttcatttcacatacttccatgattaacattttctaagttatcgtctgttgccctccaagaataacagaaacaaaagtaaacaagatgaagtagggttttcaccatcttaccggcatgttacaaatggtttacattctgctgagccccacatggccagcacggtggcccagcgcgagcttgatgcggtcaggtaaacctgtgatcacgtctccatttgaagattgctctgagttcccccagaccccacaggactggagtaaatgactctcccccctcctcgtccatgaccacttctcgacagtctccattgcttgccatctgtcctcacccttcggggtctttcaagtccactctgacagtttatttgcttcgttacatgctttttgtcaataatctcagctggaacaaacaccacagagctttccgtcatgccgtggcattttctatcttaccaaggaggtttagaacccacaccctaaacattaaatcacccttgtagggcagcgttccaaagaggtgttcaggcga

SEQ ID NO: 39561 - DNA, 2130 bp, Bovine  19866880533008
ttttttttttttttttttttcaatgtcatagtgtttatttaaatcctgagattaaaaataagacattcccaaatggtgcagcagatgctatacggactatgttttgggatacaaaagttcctcacccccactgggcaggtggagagttggcatttgatgtgcttctggtaattatttggcagataaaaaagagatgggttcccagacccactaccctgtaaggctgcgagcattgaggattggtcaattaaagtgcaattctgatttggaagccacccaactgaggcttcactgttgctctgcagccatgggggaacaggagcatctctggacagcccttgtcctcaggctctgaggaagtctttttatcagaaatgcctccccaaatttaaagatgtactgtgttattttgaaaaagtgcttaagagagaaaaggctttcttttaaagacagactttttgaggcgattaagatcagcaatgtttaaagaattcttctatcatattcttagtttagtctaaatcatgtctcctagtcaaaaggagtatcataagcaagttggtttatatttgttttgtacggctaaaacatggccctagagattatgatcatgaaagacttcaatatatactgtattacagtatgtaagatatactgcattagcactattttagccaaaagccacagaaatctaaactcctatagctaaaaggagagtatataggtttatatatcttgaaccacttgactctgcatatcaaaattaagggacatatatcatattattgacattttctttgtcatctgtctctcctgtttccatctttcagctcttcttccttctacatgtaggttcaattctaagcctttctatctaagaaaaaaagaagcaggtttccccctcatcagtctccaaagagcaattatctggaaggcttatacttctttaggccatgtgtccattcttaacccaatcactgtaactagagacatggagtcctctgattgactggccttaatctcatgtgcatatttataactgagagctacaccaagaccacgtggaatgtgaaaacattgattctgagtagaaacagcattttcctgttaccagaagagtggagaatagcaaaagagatcagcactacaaattagcagaagcaggtaggttgaggctgtttctgtgtttctttttcaatctgttttgggagttgtgtgcacattcatgattggttcatgcatcatgaatggagatgcataatacccaaagaaccttatggcaaaagataattgctatttctatacctctcaactaggtttttaccttgtttgctgaggtactttatggaatttctcttaagacatactttattattttacccttcctaactcctcctccatcctatgtcaccatgcacaaaactgcttttgtggctaagtttgcacagctggttgaacaggctattagtaggtcagattaggtgttgataaaaatctatttgtgtgggatttgatctagtgtgttaaaaaaattagttctaagtttctttggaggtaacctctttctagagttaaaaaaaacaaaacaacaacaaaaaagaagcctaactgcaaaatctttcatcatatatcacacttatatctcagaatctagttcttcttcttcactctgtttctatggcatgatgcatgcccctgccaaagtccgaattatcagtggtatggagaaagagactaaatcagatttattgtagcatgtggataaagcacctccaaatcaggcagaaactgtcaatatcattgacctcaggggagatatgtgggttttgttacagtgtagctgtaggcccttcagccagcagcaaagcatcaaaacagcagcagagagggattatctcatgaccagaatgtaaagtgtcatctctgtacagatttaggaagagctgtaacggtatgaggccaaagaatctgaaattcttagccttggctctttctctgcatgtctgggagttcttgtttaaccactgaacctctttttgcatcactttacacttttatatatatatatatatatatatatatatatatatatgatgataatagttctcatggaatctggactagatattg

SEQ ID NO: 39562 - DNA, 2003 bp, Bovine  19866880536645
acctgggttcgattcctcaatcggaagatcccctagagaaggaaatagcaacccactccggtattcctgcctggagaatcctatgaacagaggagcctggcaggctatagtccatggggttgcaagagttggacatgacttagcgactaaaccaccaccaccaccattcatgttaggcaggcctatcaaaagcataatctcagtccaggaaaaactctggcagctaccgcatttactagctgtttttctatatgggagatctttgatcagctggcaagtcttctggaaatgacacacacaggtcctgtttctctctctctctctgtgtctctgtccccaagatcaaaaccccaggtgcgccgcctcctacctgtgtccgatgccagatgacagacgccctggagtggcccagcttgttcctgcagggccctttatcataatggatcaggaggaagtcgtcctgcagagggagagaaagaacagaggtggatgggatggcacgctccactcagtgcgtcctgcctgctcctgaggtttgcagcagactgtcatattccctctttcctttcctaatatttagaactagagttcctatctcacatatccgattgagaagaaagaaaaccgactgactgattctggctggccatcccagactcctctctgctgagtgctccagagtctgagttcaagtgcggtgagaattctttacaggaaaggagctgcttatctttttgaattaatacaaagactaattaatacaaaaaattacttaatacaaaaatgaatacaaaaaactaattaatacaaaaatacaaaaaataattaatacaaaaatacaaagactacactttttcaataaatggtaaagaccatgttgtttatacctgtgcattccccagaataaaaatgtagaattattaaaacaaagaattaattaatacaaaaactaatacaaaaaactaattaatacaaaaattactacaaagactaaaccttttcaataaatggtgcagacagtgtcgtctatacctgtgcattccccagaataaaaatgtagaattattaaagaaagttattccaaataatggagggggaaatggcaacccacttcagtattcttgcctggagaatcccagggacagagcagcctggtgggctgccgtctatggggtcgcacagagtcggacacgacctgagtgcttagcaatagcagcaagagagtataaaaggaacgtgggtggtttatttttggtttttaataagcaaaaactatttggctttaactgtggaaagcaagcactcagaaaacacatagctccgtgtctgaaaccactagatgcaactaaactgacttaaaaatacaaataatacttatgaaatatgtgtgaacataggacagtcctctgcagctgtaagaaaattctaagaaacttcaaaaaatatacaatgaagattttttggttttctgagtaatcaatctccatgtgatttttaaaaatttttattcatttatttatttaggctgtactaggtattcatggagaaggtaatggcaccccactccagtactcttgcctggaaaatcccatggacggaggagcctggtaggctgcagtccatggggtctcgaagagtcggacacgactaagtgacttcaccttcacttttcactttcatgcgttggagaaggaagtggcaacccactccactgttcttgcctggagaatcccagggacgggggagcctggtgggctgctgtctatggggtcgcacagagtcggacacgacttaagcgacttagcagcagcaggtcttcattgctgtgcgtgggcttttctcttgttgcagtgagcaggggctacttgttgtttgcaggcttcttgttgaggtggcttctcttgttgtggagcacgggctgtaggcacgcaggcttcagtagtgtggcacacaggcttagttgctttgcaacatgtgaaatctttttggaccaggaatcgaac

SEQ ID NO: 39563 - DNA, 1523 bp, Bovine  19866880599434
gggaggcgtcttttcgggtcttgagacctgtattggcaggggctcggccagcctcccacgggaagagtgagacggcagggtcagatgaccgcaggtgggcacctgcgtgaagacaggtggcccgtgggacaccaggctccctggatgcctccaaattgtttgtgtagatttattagattatttatgtatattatctgattaaacaactgcgtttcagtattcatttccagtatgtcttatcttttagaaccatttgtcctattagataaacttttggatcctgtagtcaatacttacaaaaacataattttgagtgaaattttgttacatttgtaaataagtttaggaagaattgataatgttacatgtcaggcttttatatttgggaacatactatatctgattactctgcttaccatagggctttaagtttttggtgttgcatgtttctttttacatttttatctacctttatattcctcaggttattgtgaatgacatatttttccctaacaaattttctaaacaattgttggtagtatgaaagaaaatacgtgttttaagctgactaccttaccgacttttaaaaataaattcctttaggactactaggtccataatcaaattatttgtgaagcactgacagaattatatcctcctttctggtatttctcatttgtttctctcaccttattgctttggtgggaacttccacagtgatgttaaataatagtggtgtttctggttcctgattgtagttagacatccaccctccaacctttcaaagtccccaaaggacaaaaaagatattattaatttgaaatctgttttattctaaaactttactaaagtggaaaagtgctatgcctgtgatgaagagtgctgatccttgacagtagtgggagtttggttgaactcagtcatgtctgaaaaagggccacgtgctgaatgatatcccagtttagtaacatcagtaatctggtgtgtgtgtgtgtgtgtgtgtgtgtgtgtgtgtgtatttaagtgttgagtctttctgaggaggatcagcctctcaggtgaacttgatgaatcttctgaagtatatataacagcaggggaaggagagggtgggacgatttgagagagtagcactgagatatgtacactagggtgagtgaaacagaaagctagcgggaagcatatgtgtagcacagggaactcagcttgctgctctgtgatgacctagagggctggaatggggtcggggaggctcaggagcgaggggatcaatgtatacttacagcacaaaccaatacaacattgtatagcaattatactccaatttaaaaatttaaaaaaaaaaaagaatatagagaagagaggaggttgtgaagtcactgcctaccatcctgaatctgcctgtccatctagaagagctctgcccacagactccaagtggtcagcattcctgcaggaccacctgctgttaagatcagattccaagcctaaggccctaaatacttttggtttcatggggtatt

SEQ ID NO: 39564 - DNA, 653 bp, Bovine  19866880685144
tggcacgccgcccatggagtacgacggcaacttcacggactacttctgtgagaaaagccacgtcaggcagtttgcgggccacttcctcccacccctgtactggctcgtgttcatcgtgggcggcgtgggcaacagcctcgtcatcctggtctactggtactgcacgagagtgaagaccatgaccgacatgttccttctcaacttggccatcgctgaccttctctttctcgccacgctgcccttctgggccattgccgccgcggaccagtggaaattccagacctttatgtgcaaggtggtcaacagtatgtataagatgaacttctacagctgcgtgctgctcatcatgtgcatcagcgtggacaggtacatcgccatcgcacaggccatgagggcgcagatgtggaggcagaaaaggctcctgtacagcaagatggtctgctttaccatctgggtgacggcggccgcgctctgcctcccagaactcctgtacagccaagtcaaggaggaacacggcattgctatctgcaccatggtctactccagcgacgacagtaccaaactcaagtcggctgtcttgaccctgaaggtcatcctgggcttcttcctcccctttgtggtcaggcttgctgctacaccatcatcatccacac

SEQ ID NO: 39565 - DNA, 2849 bp, Bovine  19866880733519
ggctcatattcctgtcttatctttttgccttctcatacttttcaagggggtcattgaggcaagaatatggaatgggttgccattttctgctccaccggatcacgtttagtcagaactcttcacaataacccctttgtcttggatggcgctgcacagcatggcctatagcttcactgagttatgcaaatccctttatcatgacaaggctgtgattcattatggggaaacagacaaatagactggcattaaaaacaagaacttcttaagaatttgttctatttgtgtactatagcaagtatattgtgtcaattttaggctgagaaatgtttataagaatattaaagggtatgaatagcattaaaaggtagaatagaataaaagaataaagattttggagagtcagttataattttgatatttatagttgcttgacctgctagaattatttgtaaaattaaacaaaatgacctttaagaactgtaatcgagtcttagttaattcaattttagccaggaatctttggataaagttttctatttgagagttcttctcatcctatgaagatgaattaaaagcaaaatgtgcagattttcaccttaaaattttccaaaaggatgtcagaagaatatatgaaaattttcatgataaattttctttgatcctgacataaaaaagaatatgaggtatttttttaaaaaagaaaatgttggggagagaagggaaacattttgcttcattaatcaaactttgaaataatctacttcacaagaatgttttactaggagggagattcaagagggaggggacggatatataccgatggctgattcatgttaatatatggcagaaaccagcacaacattgtaaagcaattatcctccaattgaaaaataaggaaatttaaaaaggaatgttttgcaaaggcagaatctttgttttcaaaagacagttgaaaacagaggctaaaattgaaacaaaaagcttgtcaaaagtatttttagaggttcccaaacattttcagaagttgaagagtcttgaaatttgtccaggctatgaattctagatgcaaagatccttctagaaaatacggattactgatgatcctaaatgtgctggttttgtgtacaatgtacctgctatttggatatgcagagacaaccaggtatctttttttgaaacattttgtaaccacacaattctagtatgcctcttattttgtttgtcaagagatttctgggtctcacgcagataacaacttagtgaatctgaaggaaagaaaaaacatgtatggaatggaaaatcactagaatgttctgtaattgtcactgataatggaaaacacatggtgaacctgtgagtgatttagggatcacaagcatgcagtgttttgttcacaccttcagctgtgttttcagaaagtacctatgacactgcataatatagcagattgctggtcataagcacaaaggtagacggccacttgtgttattcagtgtttagcccaagataaaatgtgtgacatatacgggatagtgaaactgctttgatacacatttctccaaaatgcttagacaaatggaatagcatccttgatgtgttagaaaggctgcttgaccaaaagaaagtgaactaatacaccttacagttaacagtgctatcacaggaaaacttggtaacaatcaatagttgcttgtggaaaaataactgatatactggacccgttgaagaagtcatcttgaaagtacaagtatttctgactaggtacagctgtggagatcctgctgccctttctctccataggtgtgcctgtgatgacagctgaggtgcaggtggaatctgagatagttttttaaaaaatgtttagtgacatttggattacttatggcaccttattagattcaagacttaagaacaaccctttctcaagtgcttgtatgaaacaagcatgggaaaatattagatatttaaaatgaaagtgaagaaaataattgtcatctcttgtcttcacttgggtttcccacaaggcagagcctaggctcaagatttatgtgccagaacttcatcagtgtgtgtgattgcaggcagcagaggtgagggatggggtagtaggcagggaaatagtaagtgcattgtggccactaccacaggagctggatgctatgagatgcttctcaagattgtccatctcgaggggtggaggcagacacatttctctgtcagcttctgttttccattggacatcaagttgcctgcactcccagccttcatgtacacggtgctgagtgtcagtggaggagtcctggggtaggtgaggagaggcattgtaccagcccagaccaggcaccatcaggctacacctgttcaaagctgactggagccccagcagaaaaggctgagaggagtggaagtgactcccaagaggcgtccaaatagtcagcttttaagaacactcttcagaaggcatcctcttgaagctgtgcactaatagtgagattgcattagcaaccagtgatggtatctttaattccaggagttaaagaggagacaaactgttactttagttgattaccattagagataaggaaaggaaagcttagaaagtccacagcaaacatcactgtgagcactttccccacactggcatggtaagcccaagaccttggtcctcagccaccttcagcaatgaccacaggagctgctgaatgttgacagcgcagagacgtgattatctctgcaccacgatgtcagactttaaagatgagaacactcacttgtaagtgatacagttgaaattagtaattagtaatttaaagtaaggtttcagattgtatgtaaatcccagcagtttt

SEQ ID NO: 39566 - DNA, 774 bp, Bovine  19866880776866
tgagtttcgggaggtggttaatgattttcttctccctctcaaggggcagcattttcaattcctaggaggacaccttcactgttagatgtgttccagctttgagatttatgcctcttaaatatcagatgactgaaaacaacccattcctggttgacagatcagaaagttctctctaccacttgcgtgtgtgatgtgtggctgttgataaaagtgaatattttggcagggtgaacaagtaacaaccggagtagggaccatcctgtttctgttcttctcacagcctcaagcacgcaacacagtccagccctccttggcctgaatcgagcttgaccatttggaatatcttgattgataggaaaatcagaaaggggccctattcttgcacccggggctgagagtaaacacacagcagatagctcagctggacaggctactttgtattaacaggcctcattgctgtgccttttgctaggcttattgactcctatcttagggcctctagaaaaacatgtaaagatactagtgtgtattgttttccttcagtagatatgagcatgagaaggtcagcacatctgtgcatgcctctgtgtgtgtgtatgtatagtggtaaacccagggtaaatgtatgttcctaggtgaaatgtatttggagaggaagatcagcttatgaggtattactaaagaaaaaatgattaattttcagtcactttctgaatatcttttgttttgttaggtacattgcctttgacttccataaggaatgtaaaaatatga

SEQ ID NO: 39567 - DNA, 1244 bp, Bovine  19866880806998
gggaacaggaaaacacaggaaagtttcaggaacaggacacgtgtgaactggcacataacttcatctcaggtgcagaagaagtgtgtccagaggcctcacacatccaagcggaactgccccctcgtcttgaacggctgttaatttttaacatagaggtgtgtggttttaggatgggcccaagccgtcaatcacagagggctcctccgaggcagcgtttgcggcctaataggaaaaacaccagatgtgggtgccagctggggatgctggtgaatgtttaccagccagctctgcaaggcggggtggggtagggaaggcccgaggagaggtcccggagcaggggctcggcccggaggcgtgcactggctctccagacccccacactctgctccggatcccccggcaccccgactggttccccgcaggtctgctcagctcaggggcagccccatcccctccacgcctgacactgctcccagcctgctccccaccaccacggagcagggtgtggcgccagcgaccccgctgtaggcaggccgaggagcgggcagctgtgacgtctggcatcagtgacacgaggcgcgaatcccagctccaccgcttcatagcggcgtggcctcggggaagtgctgtgttggcttcccctctgcgaagtgggcctgaggtcgcgctgcagttgtcaggcccctagaagagcgccaccggcttcacggcccaggaggcggggagggcggcagaaggcgagaccgaccccttagagggcgctcgcgggtgccaggccccacagcgggccctgccgtggcgagcgggccctgcgggcgtgtcctggctccgggcgctcctcagggccccgcgtcctgtctccgcaggcgtggccagcgtggtggtgtccttcttcctctgcatgtactacaacgtggtcaacgcctgggccttctggtacctcttccactccttccaggtgagcggccgcgggcggcagcagggcccagggggcgggggcgaggggcgccggcctcaagggcgccgcgccaggccaggggcagccaggcaccccggaccgagcagagggcttccaagccagggatctgtggacccctgctgttgtgtgcaatgtgtgcgtacattttgggggagcaggcccccagatctcatcaggcgctgtgctgaaggatgtgaccccctccattaatatcaagacccgctgcctgctgggccgggggaacctgtagggacagctgatgggg

SEQ ID NO: 39568 - DNA, 2370 bp, Bovine  19866880823044
agttcagttcagttcagtcgctcagtcgtgtccaactcttcacaaccccatgaatggcagcacgccaggcctccctgtccatcaccaactcctggagttcattcagactcacgtccatcgagtcagtgatgccatccagccatctcatcctctgtcgtccccttctcctccttctcccaacccctcccagcatcagagtcttttaaggagccctcaaacaagtgtgataaactaaaagattataatagcaataatgccagccacagtggcagtgcctgtgtgtgccacatcctggcacaagcagaggcctccatctgtcatcctctcctccccttcctgaccaccgtccttggcgcacacggagcaggaagccctgaactgtcacaggtgaggagacaaaggtctagggaggtcagatgcctctgtctgggccccactgatgctcaggtgggaagcagaaactggggttcaggtctcagaactcctaatgccaggtgctttcgcctggtggatggcatgtccttggtgctggcaaacatgcctctctgcagaaccacctgtggaatctaacaccagcgagcctggggcctcaccagaggcactgagtcagtgccggccctgttggtctgggctccctggagcttgtgacagcaaccagatggggggccttcgggccccttgtgccccttccaccccctcagcagggggaggaggacaggacagagagcaggactgagcacgtggagccgggagaggatgtcagattaggagcctgttagctgaacctctgtggctggcccggctgccctgcccacctctgctgcccttctacctctagagcttcttccagttaatcaaagagatgcttctgaataaaagaaaaactactggggggaatattttgtttcattttgtgtcacctttaagatttgtgtaaatgcgtatttctcttgtatgtgctaagctttgtgaattcatgtgagttgaaaacctttgcacatttgatttgaaggttgttgtgaggtttagtcacagctgtcataaactgacttaaagtgtctcccagttctcagaactcagccacatagctcattaaactcatcagtgttgtctctttaattcttactgtttcacatgaagtaaaacagccaccacctcaaagtggagatattttgttctttgacttttttaatacatgtctggacagaaattagcagcgagttcagtgtcctgtattgcattctccagaagggatagaagacaagattttcttatgaaaaggaagtgttctttcccttacaactgccctttcctggatggtaattcaaatttaaggtttctcacattctttgggggaatagataagatataaataataaacaaataagcatctagttcatttcagtgattccttgaagaagagtgagtttaagagttacatacttcagtggtgaaaatcacactgggatgtgtatctttctgtctgtctttaattaacttagtaccctgagttgcaagttaatgaggcaaagctgtgctaggaggatgactaaatgcactcttccattatccttattgttcctgtacttgacccctttccatatttttctgcagtgactggtactatgcaaggagcccctttctgaagccaaagctgagctctgacatcgtgggccaactttacgagctgactgacgtccagtttgacctggcatcgcggggctatgacctggatgctgcctggccaacgtttgccaggtactttgaagaattaactgcttggttgaaaagaggggaaagaggtgttcgattttgaagcttgccatcagtccgctcaaagcagttttgctaatgcagtaaatgaccttatgcttgctcattttacagacttggttgcatcgtgactagcgataacatctgaaggctccagccttaaacttaaccgagttggttaggcggtatgagtcagtggagatgcatatgcaaaacccagggttttcagatgtgttaaggaactcagtgtgggagcgaagtggaagcaagtgggcttttcccagttgtgttctcctagatacagttattatcatggacgccagtgagagggatagaaagctcatcgcataagggttgttggaaagtttgctttgctgtgttttcttttcctacaccagcacagcgcccacacaactgcattcacacaacacccatttcaggagtgaggtgctgaggaaacaggcgcagagagcggaggaacttgcccagtgccacacagctggcaagaacagggccagggcaccagactcgagttcaactcaagcccagcactcttcttttttttttttttttgctttctgtaaaaaaggtgtgttt

SEQ ID NO: 39569 - DNA, 1484 bp, Bovine  19866881061278
acccactacacctgcagtcttcattttcctcctgaaagccatggaagaaagtggaagcagttcctggctctgaaactgaacatcttggggctgatattgcctctgttggtcatgattgtctgctatggacatataaagattataaagattatgctcagaacttggaataagaaggccaacataatacgtctgatttttgtcatcatgatcaccttctttctcttttggacgccctgcaatctgactgtgtttgtttctgctttccaagattccctgtgtgagcactgcagccagctggacttggccattgaagtgacagaggcaattgcctatgcacactgctgcatgaaccccatagtctatgtccttttctgcaggaggtaccgcagggttctatggtacttgctctatcagctgactaagtgtcgctgcttcctctacgaggaggcaggagagggtcaactccatgtccattacacaggcaaggaagaacgctgttctgtgtacagactcaggcccctcaggtccatcagggacaaagaaaccataagctgctaacatgctgacggggaggaggcagcttgggtctcccagccagattctgacacctgacctggaattgtagccacatggggttgagggagctccaaggtgttctagacaaaatcaccattacggttggatttttctcaatgaacttctctgtggtggaaaatgagatatatagatgagatggtggaaatgaataaatgaagtgggacatcccagaagactgggtcaaaggatgacagagaaaggcttggtaccaaagagaagttcagattgttgaacagtagcatttgtaaaccagtcactgagcatctgctaccctcacccccaagaccagtgatcttggagatagagatttccatagctgcctccactccgagcagagaagccaagcaggagccggcagccacctctcacctccctacccccactcctagggcagcatttaggctcctggaaaccctgagaaatctagaactcctgatggaagaacttgacacctaataggaagtaggattggggaactgcttttggcagtgaagctaagaaagcccttggatggaatgtttatagtcactaaaatcaacaaatacaggcagcgggctagacacagacaaaatgtatacactgctgtacttcttgaaattgccgtggaacggaagtagtcattacttccttttaccattcctgtcttctgaatagttttcagagtctcccttccctgtcagttgagggatgcagcagtaatttctgacagattcactgcagaaatcattaccaggcagaaggagacaggggttgatttttcttcctctggacctccatccagaccttgtagctgtatggattcagagttctggctgccaccttgggaccgatcagcaggacagtgaccctggtgtgccagggtttgaggctggcagggagggcaacat

SEQ ID NO: 39570 - DNA, 1101 bp, Bovine  19866881093269
ttcttgtgacattttgaattcgtactaattgttatagctttctgaaaagctggtggaaaatgcattaatacttaaaaagaaaccaattgatgaactttctttccttcttaggtgcaaaggagcagccacaagagagacagatacaatggatacctttgtggattctgcttggtactacttcagatatactgaccctcagaatactcagaggtacagaaagccctgctgaattcatgagcatgtgttggtctgggtcttccatgaagcaaacatcaagatagaattcaatgggcaagagatttatgggggcaggtgcctctggggaataaagaggtgagggagcgggagtcggcaggcaagccctggactaggatataggtctgacaccgatgaaagaaaaggatgaaggcaggaggattgggttgaagagcttcagaccgcagcacagcttgaaaattcttgagcaggccggatgggaaatgctgagagtcccaagtcaggaggcaatgcctgctctggtccgctcctcccaggagggcacaggctgccatcaaccccggtgggtccagagatgaaagagctggaagccatgggtcaactgtgctctttgaaacaggctcttatagtgagtgtgctcaattattaaattagattcttcagagccaagtaaatcccaggtataggaaaaatgaaaaagagtaaggaagagctttggtaataccctctttggccctgcagtgaactgcacttgtgcagtcacaaatatgtaaagttattaacttaaatgaaagtaatgatgcaagtgtacagggagggtagaagagagagagtcagtgagctgagggcatgacctcttagcatatacagtcactagataatttccaatactgataaatgaacaaagcatataaacatatttttaaataattgccaggaaaaaagcatctgaaagggttaaaagtggctaagtgacaggtaggaggtgtggggggagggtagtgaaggaatgggactagacaccactgttctacattataaacgtttcaggactgttttttcagctatgtgcatgtgcttctttgacaaaaataaatgagggaa

SEQ ID NO: 39571 - DNA, 1336 bp, Bovine  19866881115400
cagttggttacaaaggtggctgtcaccaaaccctctcccacctagggaatgtgttgattggtgagcttttaaaggacagggtgattgtaaatgactttgaaggagcctcagatagaaacggtgatgaccaaaggaaccaaacccacatggctgggtgggctattttaacctcaggatcagcattgtcagagaacctccagcggtgatgggcaagttctacttgagtgctctccaatctcgtacccactcgccacacgtggccactgagtactcgaatgaggctagagccgctgagaggctgatttcaactaccttacgccgagatggagaccaatcttaaatcaagaatggatgcttttgaactgtggtgctggagaaggttcttgagagtgccctggacagcaaaagattaaaccagtcaatcctaaaaggacatcggaccctgaatattcattggaaggactgatgctgaagctccaatactctggccacctgatgcgaagagctgactcactggaaaagaccctgatgttgggcaagattgaaggcaggaaaagggggtgacagaggatgagatggttggatggcatcactgactcaatggacatgagtttgagcaaactctgggagacagtggacgacagggaagcctggtgtgctgcagtccatggggtggcaaagtcagatacgacttacccactgaacaacaacaacaaaacaaaattttagctagtgttaaaccaatttacacttaaatttgtaaatagcccttgtggctagggactgctgtactggccagcatagcttctggatgatgtttcttgttttgggtaagggggcaccagaaagattctgcaggctccacggctcagctggggagctcttggttacctctgaggcgggggagatggggcagaagaagctggtttcccatgtgttgaatgccctttggtgctaagtgctctgaatacacaaaactgccctcatcccctcaggcagacgccaatggttctgatttgaaccctggatcgagggtggcaaagacagtgccctttgccccaaggggtatcaaaataccccttgatttctgggctctgcctcttctcagaggcccttcagctcaggcccgtgcaggctcactgccccccttgaggtctggggcccaccaggtggcccaggcttacttgttcaagcagctctcgtagttgaaggtggccttgaagccatagatggagaaggtgacaatgctggcaaagatggaggtggagctgttgatgatggacacgatgatggcgtgcttttggcagttgttggagggctcgttgtagctggcaaa

SEQ ID NO: 39572 - DNA, 2613 bp, Bovine  19866881243305
cataattacaaaaataagtcgaatggctttgtatttttttttactggggcatctcagcagtgttttaataattcctgaatagcagatggccataacaagcagaggcagagcgagacccaggatattcattctcagagcatggaatcgcttccaggcattttcattatcctctgggtaaagaggacatgcagaaagtctgtccagcctcctcttgggtctcatgaaagaaaaattcagggagggctgctagccctgccaggacccaggtgaagatgctggtaacaataccaaaagtgacttgtccgggctcgaagggcaaacacggcatggacgatggcaagataccggtctatggtcaagaggatgatgaaaaagatctcactgtacaagcccatgtaatagagcccggagagcaacttacacatgcggtggccaaacacccactcgttccacctaacatagtgaatccagaatggcagcgtgaataggaagagcacgtcagaaatggccaggttgagcaggtagatgttggtcatgatccggagccgcttgtactttgtgagtatcaccaccaccaccacgttgcccagcaggccggtcacaaacaccagggagtacagcgggggcaggaactgggccgccagctccttgacgttgctcttctcgcacggcagtgccgcctcatagtcgtagggtgtggtcccagcaacttcacccacagtttcaatcccatcagctgaggtcgccatttcccttgtccctgtgatagaagaaggcaaaagtaaccccacagttaacgatgatcgctccttgagacccacaccagtcagtttattcacttacccactaaaaccacacggaataaatagcctatacattcttcagcatatatttccaaaggtgtatcagatatgccatggggcggggagaaatgttaggagtgaaagatgcaatgttttgagagtcagcatgatccatcatgggaaaagaaacaaacattgtggatggtagtgaagagcggagatgttgatcctgaaagcatttggaagaagaaatacaaaacaggaagagataggttgggtaatgttaacaataatcttataataattatattatcactgtatttaaaatttttgttttatgttttatggtttatatatgaccttcaaaatcatccatttaaaaaccaaatgctaataatagtgattattatccttagaaataactacccatttccatggctccataacataaaatgcaaaatttaaaaatacagtaatggggaaattgaacctcaaagaaatttaataaggagtctaaaatcctttagtaagcaatttcaaaagttcaggctagatcttcagtatctatgctgaattctctcatcactggattcaagtacagtgatttttaacttataataattattataattagctgttgtagtagttattaactgttgtaacaattgtaagcagcgtccccttttcctgttcctgacaatgctgacataagccagtcatgtgcctacaacagaccccttagagtttctccctcataaagaggctgagcatgtaccaatgggactacttcttagattttggattttttagaccaggatccctagggtcagtgcctgcttttcttagaattacagccttggctggagaagaaggaaaaagagacaagggagtagtccatgaaaggcagctaacccctaccctgcttcctcaggagtcctgctaaccttctcttttctgtgaaagcacaagtgtgaggtcatgaacatacgtcagcaggtatttctcaaggcagggcttagaaatgcagtaattggagccgatggcaaggattgtctttgctttcctaagaaaatactgggaccctaaagtcagcacctgttggggttctgtgtggtccaagtgactgtagagaggagagacataggagcggttcctggccattctgcttgccagtgagaagactcagacaagcccttaactctgagcctcgtttattcatctccaaaataaggatcatggtagccacccatttgatgtggtgagcatcaaatcagagagtctacatgagatcatattttaaactagaaaaagaaaaaactgtatggtagaaagcagaagtgaaagaaaggcaatgagaagtggtttcacatgaaatcgggaaaaagtagaggctcttggatagaacttgatctattttcatagctctggcctggtccatcatctactaatcagtgacacattcaggctttcgaggttaaaaatggaattgagtagcaactgacttatatgatcttaccagctttttaaaaattcccaatggcataatacacagcagctgagaaaaagtacccatcatttggtctgttatgcattttcggtcatgagagtatctctctaaaccttaatgtttaaggcaagagtggaaagagcctctactcatcattaattatttatattttctttccttttctcacagactgatctgaaaacaagtcaaactttaaaaaagaatttcactgaagtgttttccaacttgaagatcatctttaattcatgtgtcatttccataaatcctacatgatgagtgtaa

SEQ ID NO: 39573 - DNA, 2187 bp, Bovine  19866881280974
gactcccaacatgaccgccaaaaaaaataaaaataaaaaaacaaagtctcctaggaaagtcaggtgttacactattatgtaaggtaacacttggtccttggaagaaacgctatggcaaagctagacagtgtattaaaaagcagagacataacttcactgccaaaatccatatagtcaaaactatgactttcccagcagacatgtatggatgtgagagttggaccgtaaggaaggctgagtactgaaaaattgatgcctttaaactgtggtgctggagaagactcttgagagtcccttggacagcaagatcaaaccagtcaatcctaaaggaaatcatacctgaataatcattagaaggactgatgctgaagctccagtagcttggccacctgatgtaaaaagccaactcattggaaaagaccctgatgatgggaaagattgaaggctggaagagaaggaggtgacagaggatgagatggttggatgacatcatcaactcaatggacatgagtttgagcaaacttctgggagataatgaaggacagggaaacatggcgtgctgcatggggtggcaaagaatccgacaagacttaagagactgaacaaccagtgtgggttttagtcctggctcatcttttcctgtaggtggcgcgagtggcaaagacccctgcctgccaatgcaagagatgcaggttccatccctggattgggaagatccctgggatgaaggcatggcaacccgctctagtattcttgtctggagaatccccatggacagaggagcctggcacactacatttcatgaggttgcaaagaatcagatacgactgagtgacttagcacgcatgcacacacacgtggattaaaattagacaaatatcaatgaaaataaaatgtgcgcctctaatagcaaatgttacacaaatcagtacaatgatgtctgttatgctaatttttatttttacaatagatttataatggtctatatattctgtagctgagctatagaacagccatggcttatcttagagtttaaaaattcataaacatgtgctgcttttgtttaggttctagactggggaggagaatgccccaaccacatccgtcaaagataagcatgtcgttgttcagttgttaagtggtgtttgactctttgctgccccatggactgcaatgcgccaggcttccctgtcctttactgtctcccagagtttgctcagtttgatgtccattgagtcagtgatgccatctgaccatctcatcctcttgttaactttcttctttctctgaaaccttggctcactgagaatagagaagtgggtgaagcccatttcgtgaagttgagtcacgatgggcccatctgtataacctttgctgggcctctctgattggccagtgaaggagaaaagggtgaattcctgagcctcagtgaccccagttctcccaccagtcacttgctttgtcttaagcagtctgtagtttctacttttgcattctcctttcattcctacaggccatgcaggacgcgctggcaggccttccggaatggtacgggattaaaggcatgcaggcccactggattggcaactgtgtgggctgccatctggacttcatgttaaaggtgattgagcaggagcatctgcagcagttaatgctcacaaccccccttctgcctctttaggcctctttttagaaaagtgggtgcctgtattcatcacataaatcctggaggaaagtatagcgcctttcccaggacaaataacattgacagttattgattcgtggacagaggagccaggaactggggaaagcctctttctgggcatgctctgacatcctttgatggggacccccaagtaggcctgggggtaggccctggggaagcctcctgaaagaggaactgcggccctcttctctctccccctgtctgcccctgcctgggaccatctcaggcccccacatgcctgccggtgcctaggactgaggaggggtgggaacaggggatgtgggctggggagcacggcagcccagagtgcagactgagaactgaaacgaccctgcttcttgtcaggttgatgggcaagtcacaggagaaaagctgagcgcctacacagccacccccgaggccgtttatggcgcctcccacgtggccatctctcccagccacaggttcttgcacgggcacag

SEQ ID NO: 39574 - DNA, 1373 bp, Bovine  19866881599937
ctccttcacaggtgctttgtcgcttaggtgtgaccagaccagacatcctccacgttgtctctctctctgtcgttcactaacgtcacacgcagccgacgcgctccccggggtgctgagatggcagcagcgtctgtgggccttggtgactcgatttatcgaggccaggacgtctgggaaggcgcccaggcctcagctgttgagcgacaaggacaaagccgaggccaggaggctgtgggagtacaagaactcggtcatctctcaggtcagaacccttcccgggacactggttgattctgtgactgagccctcgtggtctgtgtggcctgcctgccctgggcggggcacaccgggtcttcctcctgtcttcatcctgctgctttgggtatttatttccccacggcggagcaacggtgcgcaagctctaagggcaagggacgctcttgagaaatggctccccctagtggtgatctgaggaggctgcccgctttccaggaggctgcccgctttccatgtttccatatttaacacatcctacccactccagtgttcttgcctggagaatcccagggacggaggggcctggtgggcttccatctatggggtcacacagagtcggacacgactgaagcgacttagcagcagcagcagcagcagcagcagcagcagggcttccctcggagaaggcaatggcaccccactccagtacttttgcctggaaaatcccatggacagaggagcctggtaggctgcagtccatggggtcgctaagagtcagacacgactgagcgacttcactttcacttttcactttcacacaatggagaaggcaatggcaacccactccagtgttcttgcctggagaatcccagggatgggggagcctggtgggctgctgtctatggggttgtacagagcccgacacgactgaagccacttagtagcagcagtaatcatgacaaaaaagcggaaagttacctcccagatgaagggacaagataaacccccccccccccaaaattaaatgaagtagagataggcaacttccagaaaaagaactcagaataatagtgaagatgatccaggatctaaggaaaaggatggaggcaaagattgagaagatgcaagaaatgtttaccaaagatctagaagaactaaagaacaaacagagatgaataatacactagaaggaatccatagtagagtaattgaggcagaagaacagataaatgacctggaggacagaatggtggaaatcactgccacaaaacagaatatagaaaaaagaataagaaatgaagacagcctaagagacctctgggacaacattaaatgcaacaacattcgcattacaggagaatgttgggtcccagaag

SEQ ID NO: 39575 - DNA, 633 bp, Bovine  19866881627820
gacttgttttttccaatttctcctaattaagggaaagagaattatgatgtcagtggtagacaagaaactgaaacaccaggttgaaacagagtatctgcaactccgggatgattctgagagcaggaacctgggttgacctcctcctgtagaggatctcacggcctccctgagacatagctcagtcatggctttgtctttatgaagttgctggggtctgagcaccttagagtcttgacaatattgcatcaccctccacctacttctgttccagctcgggagacaccgccagtgggtcatgctagaggaggcgtcattgcttcagctgtatggagtacagcctagacaggcaggccactgaatattccagagtggcaggaagttagggaaggaaggaaggaaacctccccaccaccagacccaagcgggtgggggtactgagggtggggtacctgcgccttgctgagaagcttccagatcaagtcttccttgccatccacacttcgggccacgacagcatgagaagggacctgggccaggtggcactccttgaacgcatccactggcgcccgactgttgttcaggcagagaagctcatactggtccctgtcagcccttctctggcaagttctctgg

SEQ ID NO: 39576 - DNA, 721 bp, Bovine  19866881659903
ttctctcttctctaaggcaggactggacctggccggaccaccagctcacgactacccttccttctgctccctgacctgtggcctgctgggcccatagcacagggtcggggccacctaggagaggccggaggggcaggaagccttgctttcttagaagtggtcatgggctgtggtctgggatctggctcagagttgcatcactgggttccattctcacttgaatctttggttgtcttgacccccactgaggtctgcagtttaaatcctgctgtccatgggatggtggccaacgtcccaaagtatcactgaatcccttgtcctacccagtggaaggactggccactggcctagggggttcctgccctgctccccatgggtgtcgtggcaggaagaggctgggtgggccgagaagagtaactccaccccagcccctgcctttgagagacgggcactgtgtgtccacacagaaggaatctgagcacgtgtcctttcaggagggtgccatccaggcccaagtgggcagcatgtgagtgactgagacagatcaggggcggggctggggatacagggccaggatacaggcctcttgtgaaagagacacacagcttcagagctggctgctgggagctgtggaggggaggagcagagcgctgcgttctgcacccagcgctggtgtttggggggctgggggcggtgcgtctcagaaaacctctcagtggtg

SEQ ID NO: 39577 - DNA, 672 bp, Bovine  19866881863461
tcccttttctcagtgaatgcgatgtgatttgatcatttctctgactgaaaaagatagagtctcccttcgaaagctaatgctgagtgcccgcgctggcagtccttttgtgatttgggcatttgcaaagaagacattttgtatttcttcgccttgaacaggaattcccagcaccagcttggaggactccgccttggcccaaaccctgggcctgtcctacttccgaagtcattgaagagacgccagatggcacagagaaactgagcggctccgcggaggttggtggggcctaagaatttacttctaaactcacggtcttcacgtgagcttcatgatgcgttttcccctcgatgcaagttacaacctaccatttaccactgcagtcatctccacacctaacagtcttgcagcctcgtttcgaaatctatgaaaccaaaataatgttcttttattactattatcatttacttttattcatttattggccgcacaggatctgaattgcagcatgtgaacccctagctgcgacacgtgggatctaactccctgaccagaggttgaacccaggtcccctgtattgggagcatggagccttagccactggaccaccagggaagcccacaataatgttctttttcaagcatctagaagcttctcaactccaagttgaacctg

SEQ ID NO: 39578 - DNA, 1334 bp, Bovine  19866881911510
tcctgggtactcagcaccacgccggctgggtctactagaaaataactaaaacatatttgtataaacactctcataccaaagccagccaagcgatcttcccaacccagggatcgaacccaggtctcccatgctgcaggcaggttctttcccagctgagccacaagggaagcccaagaatactggggtgggtagcaggggatcttcccccacccagtaatcaaaccagggtcttctgcattgcaggcggattcttctctgagctatcagagaagccctcccactaaggacagtcctcttataacacaggtctatgtcagaaacattattaaagccggtaaattaaaggacagacaggaaatgtacagttcaggtatatttgattaccaaggaccaaaaggaagtttgaacagaacaggcaagacagactctatctcaaaacaattgcagcatcaaggtcacttcacccaacagatgtgaaaaaggaggtgggagtattgtaacagatgcaatgggcaacaccatgtctccccaaggccggaagagggcttcctttgacgtagcaactatgacccgctcctcagtccctgtgctgcatcacgactcccggagttgttcattagaaatgaacgtgcttgatcttcatttttagcaaacaactcagaaataaactgaataagaatctccgaagaaaggattggatattgtgcattaaaaacatttacaaatcccttcttcaaatggctaatatatgcaaatagtacatagtttatagggtataatagggtattacttgaaaaatctgctttactttctcccccgaaccacccagatgtctgcactggagccaaacacagttacaagttcctgtgggtctgtcatttttaacaatacattcagataattttatgaacccccaaattttacaacatatagtgtggtggtgaggagcatagactttgccagaaaagtttgctagccttagttcctaggcaagttactagctatgtaattttaagtaaataacctaatttctcagagcctgtattttttcatccacaaagtggagatggcagcaccactaacaggctgctctacagttcaatgagattgtgtataatgcatacaaagcgcttggcagagggtatgggacgaaaaatacgatgaatactaaacagtattaaattaaccacagttactccctaaaatcaaaaagtgaaggggaaatacagtagattcaccacaggctaaaaatcacgaccttaaaaaacatgggcttaagggatttccctggcagtccagtgggttaagactccatgtttccaatgcaggggaca

SEQ ID NO: 39579 - DNA, 943 bp, Bovine  19866880382724
aattctgcaaataattccactgagttcaagtgaaatctgtttgtgcccctcgcactaagcatgactatattagatgaccttttacatgggtcttctggactcaattcatatactatcttactcaaggcaatgcctgattatgtaacatggtctttactgaaaaggtgttagtataattttagcaattacactacttaattaaactaacactactccctttctttcctccgacctttacaaaatgaactctactttttctttcttataaattctgaagttcaacatatgcaatttttatattctatcaatgtccaaatctaatttaattagcacagaaatacttgttcacaccaaagtattataatagacactctgagaaattaggttctgttggctcctattcatttaaaatgatcaacaaggcttttagaaggattaagagaaatgatgtatgtaaatcatctagcactgtgtctggcacaggctggtgttcagtaaacacaatacgcctaccccctttaaaagaaaggaagaaagaaaatgatcaacatgggtgtgtatgtgagtgtagggaacatcttctattataaagaaaagcaatactgagcctttacattttactctgatggaaacatatcagtgtatcatgattcatggagaaaacagttccagaaagtagagagagagaggtggatcctgagtaacagctctgatttatttcaaggaaaccttggacttactctgggcatctttctctccaaattcaactgattaataggtgtggttaatgctacctcttaaatctctcttgaaactgtcacttgtattccatcttctttattatatgtttgtgtgtttgtttactgtctgtctttcccaacagattacaggcagaaatgtaatggcagatatcatattctgccactcaatacactcatacaca

SEQ ID NO: 39580 - DNA, 1377 bp, Bovine  19866880665854
atcttttgaataccagattcaaggagataaaaaaaaaggtatccaataaatctcttatattacattttttaaatcttataatttgctggttcctttactgttttacatggcaaataataatagtggggtaacatttccccaagtttacataaaacagaatttgagtctaaatatataccaacctgaaaactaaagattgtattaaatctggcaaaatttaggtaaacttaagaatcccaggggaaaaaaattcatatagtggacatgttttgatattttagatactgttttattagtgctgtgaatgtcagatctggctctttccatacggcagctactttaaatacacaggttataaacatttggcctcatgggtaaatatgaaagatctaggagtgaaagattataccctaaatctcatggtggccacaggcacatttattagctatctgtctgtcagtctacctacctatgtagtcagcctctatctatcatctatctatctacctacctatgtttttatctgcaaaattcttgtttctcactgcagcaggtttgggtttaagtactggtgctgttaaaatatcttacaacttgagctagagcagtgtgaactgaatacactggacacatacagaagttgtccaaattctctactcttggaagccaattatcagtgagagcttccctggtagctcagctggtaaagaatccgcctgcaatacaggagacctgggttccatccctggattgggaagatcccctggagaagggaacagctatccactctagtattttggcctggagaattccatggactgtaaggtccatggcgtagcaaagagactcgactgagcgactgtcacttcacttagcagagagaaggaaaagaaaaggtgcctagataagccactagcattaagtatccggctttgatggattgctaataagttttgcagtttatagcaaaactgcccccacactcattttttcggatgttgtaagttacttggctgccctgcattgattggcttattttgatttaactggtttgtcaatttctcactatgtgaattcaagcaggtaaaatgtaaaccagaaaataaggatatgcttgccttgtcttatgaaatgaaagtaacaggattgggccatgccaaaatcatgcctctttttctagactcattttaagttgtgaagtggcatgatgcaatgtgaatgtctggacaagcatcccttttgtagttctcaagggggttatgtcctggatttgttcctttgcaaactctttgcagtttacatagctgtagagacttaatgccttggcaggggcacaggttttatctgtgggttttcgcctctttgaatggcaggcag

SEQ ID NO: 39581 - DNA, 3103 bp, Bovine  19866880712329
ctggaatgttctacgatttgtgttttgaaaactatataataattatcacagattataatttaaggattcacctcaagccttcacaaaaaagaagtatatctactttttcatagtccattttcctgctgagttacattttattaaactgttgacaagaagctactcaattacagaaatcttgtactggttttattcacaattaaattatccaaataaaacttctttgactgaaacgaacagcactcagaaaacatgctggaaaggaactacttaaaaaatattcattttgtcaagctttggcagttgaggaagagggacaaaattgaggaaaagggaaaggttaatctatctatgtggtatttttaacttggcagtatcaaataaatggcaggggtattataagaaatgtcagctgtgctaatgctttcaaagccttagcacttttaaatgatcatcagtattcagttcaaacacattggactcatgagcactgatgaagacacatcctaatatttttttcttctaggtttaaaccatcacaaaggaggaagttttgaatcaaagtgtttattctttgtatctgacaagcatgttagaagtctgaactactaacttattgctatttccaaatatgggcctgacattatgccagagtgcatatagaaccctagcagcagcagactgccatcttaatattataattttaatgtattccccatatagccagaagttaaaactccacaacataccttattctcataaaagttatgaatttctttcaataaaagccacagcttcttagtctggttagtttaactacagacagctcttacaccaattcctgattatacgaagggtctaaataacagaaaaaatttacacagtattttgaaggagtctatttatatgcttcattaaggagccaaatctcaatgaaatattcaatattcagggaccagtgatatcaccacataacttgaatacaagaggaaacaaattcacattttaaaataccatagattatgaaatttaaaaaaatgtttctgctttcagagcatagagaaaatacttgattaagccaaatgtcacaatgccaactaataggtttggtggcttggtggaaatgcattaaaagtttctatcgcttatgtcttatttaataaacaaaagcaaagcctatgaatacaaaggataaataatccaaaactagtagtcaaatcatgtaagagacaacaaccaaacaaaaaaactggataagagttttgacagcctaaatcctgggttcaaattatgtcaacatcttattctcaagtgctgattattcaggtttgacacgtcacttaggcatacggaggagttagtgaaatcgagtctgaggattcatgtgaacaaaattttatcagacccaaagattctaactatgtcctgacttcagcaggctaaaaactaaaaacacattctttttttaatataaagtttcacaccctcacatttctaattccatgagacatgacacaatgttatttgatcagggcacattaaagacttattaaaggaatgaaaaggattggaatgtttttaaaacatctgtttgataatgttaactatccccttgatgcactcttaaattctatgttttattaaaatgacagtgccagagactcctagaatggctacagaactaattttttaagctttgctgatgaaaattaatttcagactaatccaagagttgataaacattatttaaaacatacaggtatgtcccattccaagaaattgatatacacaaaaccccttgcttacagaatagccaaaggagggacggacttgttaatattaatcacaaaaaaacctttttcactttgtaaagtgattcacttgggcatttgttgaaacagaatttggaatacaaaatcttgattagtgaattttctaggaaacatctagttcaagatttgaggtcacctacatctagatttggtatattaagggaaagaaagaaaatgggtatgcatgaagagtcaaagcaaatgacaaaaatcacaacagtacacgctaataaatgaagaaatcaagagacagtttcattaattaatatattttctgcattatagttaacatatgtactttcttcgtgtcaccttattttccgttacgtattgatattttgttatattcagacatgagtacatttcaacagtcttttgcaataaatatcataaaataatagagattcgcataataaatattctttacaataaaaaagtttaacagacttttgtcttaaaaatagtcagaattcaactttgtgatttatacataaaatatacaaaaagcaccacaatttgtggttaaggcaatgaaacagaaaagattagaactacccagctgttaactaacgaagtggccaaaaaccattaaggagccaagatcacttcaggcagcatagttctgtgacatctatagattgatcagatataaatatcaacttcagttatccaagtgccctcaatgacaagagtaatttggtgaaaagcaaggagttcggaagggcgggagtcgagtccttcacaaatatgaaagcttgaataaggatgagcaagatacaaccaaatatatctccaatgtgaagacttacattgtaaagcagacctaaaattacacagaaaaaaacaaaacaaaaccctggcgtctctaaaataagatacaccaaaactgaggggatagactgttgaggagcaaggagagggcagtggttaaaggggaattttaacgttgtaacaaaaacagatctcccatgctacttaagtgtctaatgctatgaagatagccctagttggagacagatttaatatatagcttatttaagcaattaaactgctgcttctttaaacaccaatttccctgttcccagagtacccaatcaaaaacagctctaaatcactgtagcctgggtgtacatgtgtggatatgttcacgtgtacaactttggaaagttgcttgcagaacaaaaaggctacacaaaagcccactggctctcaataccctctcgagtggatggcagaggctcttgtcataagggggagccagatgcatttca

SEQ ID NO: 39582 - DNA, 1229 bp, Bovine  19866880762859
tccatatgcagaaaaattctagagctagaaatagatatcagaatatactttatgtgtctcaaccatatatgaaagtaaataggtcactagttaaaaagttaaaaatcagaagtctgtgtcatagttcagacctaccctatcagaagatatctccaggggaggagcttgatagtcttaatttcaaaaagcttcttgggtgagtttatcaggcaattttgtaattgcttttttagcttgatgtcttcatcttgagaatagagaaacaaaggcctggcttaaatgttcatgatagctagcatagcaccaggactccagatacagggctttcttcatttcttagcagcaagcctggtacctttatgttgcacattagcgtttaccatttcttttaaccagaaagtgtttccttcataattaatatatttgaccataatttaggaaatggaatgtttttctgcatatattatttacacttagctatcaggaataagtagcaaatgacttcattgccatgattatttttcatatgttattattaaagttaacaacttcatttgaaaactgagattgtgtgcttcctctggccaggtttatatggtaataatagaacaaattgcttttgatcagtttgtaaaggtaatagtaacctggcatctagatttaagaacttacgcgatggcacttagcattattctagttacatcagaattatagtgattaaaaagcagatttaaatgttctgttttgtactgataaaaagattggtgttaaagtcagatagctgaatcatactaggtatgccagtaactaacagtaaaacctagagactgttttgaactgggcaatttgggaaaacatactaaagcttatcattcactagcaagtatttcaagagcttgttttgataagataatcatagaatcatacttcaaatgatagaaacttggaggtcatctattggatcttctttagaatgagaaagccaggttcacagaggttacttacctaaagtcacgatctcgttgccaaactaaaataagctttattttaaaaactgcatgctgcatatgtacctgtggtaacagattggaagaaaggagaggttggttgggggaacaagaccagagtttaaaccaaaatttcaggttaatttgtaagttataaaatttaacaaatttgtgaaagcacaatagcagtagtatagtagtgaatactaatagtagtccaag

SEQ ID NO: 39583 - DNA, 1689 bp, Bovine  19866880812161
taacaggctaacttgtgagattataagtagggcgaaatcccatatcctgaatagttattgacacatatcaattatcttctttcttggtaaaagctgacatttcagacactgagacttaactaccagaaaatttattattagcatgacatgttaccaaagacaattttacaaagacttagccaataactttacaaaaataaaaagccttctgattcctgtgaacttttctgtgtgtgtgcaagtccagtgataatttcattgtctgtctgaagtactaacagtactaaatccagagctcggcgccatgcctcaatttttggtgtaacaacgtcataaactcttggaattggttccagcttatctgaaatgcctaaatttaaaattacactattaagtttactatattcattcaagatgtaagatgaaggagagccagagtctgcagcattttgtagatgacactgaatggatgtggcggcttcagagtctgatgagtaaacggcagtgttacgcaggagagttgagaggtacctgtgccatccatctgccaggcatttaagcaccgtaggtctatacagtgctgcagatgaggccagccaagaggaagtgttatgcagccaccctgaacagtcttgatttcctttattcacagactgtcccgcgagactctgaagatgggtaagacacaaaatttcaactgcgccacctccaaggaagaccttttgctctttcagagcataatacagacgagaggcacaagtccagaacctgtcttctttagtttgcatctgggcaatgactgggctagtcagcactactgtaaccaaattaattccttctgtttttaacacgactgccattctgctgatcccatctatagtgtcagagggaatgcttctccacgtggtcacagagaccccactgcccacacagttttcattcatgtgtgtgaggtaggccacctgcacggctcccgaagcctctgcgaaagcctgcagcacactgtcttgcaccgatccaattaccagccgcttactatcggtgcatttttcagctaagtgttcagacacatttcctcgtgccaggacaaggttcacgttgaacttgattaacacctgtaatacatgatctgtccacagttcttctgagctgtcttgttgaaccttcacgctttctgacactgttttaatatttgcaggcttattaaatcccagatggcggtaattctcagtgaggtcaccctcaacaagaactacacggaccggctgattctgcaattccttgaccagagtagcagtggacattgacacaacagtgatgtatcctggacagacacaagacaaagtgtcaggtaagcccggtaagcagcaggtgaagattcttgaaatgtcaaaggggaatagcccggtatggctgcctcgttgcctgcctgcattctgatgctgcagccgtactgcttcgtccactagcctcatgctgctggggtctccgtgactcaaacccacctccaactctgccagatcgctacagctgtaagtctttggagcagctgcactaagttgttctagaaatccacctggcttgcttatccaatgatgatctgtcctactaaaatgtctactgtgggtcaggactgactttcggcagtgggtgtctgcaagcaggttgtttttcagagtttgaggagtt

SEQ ID NO: 39584 - DNA, 1393 bp, Bovine  19866880823469
agagtaacaatttaataaacttaaacccctacctttatagccaggaaattcagtccactctcattggccaaagcctttgcgatcattgttttagagcatccaggtggcccatacaaaagaactcctttgggtggctgaatacccatttgggtgaaagactcaggatgtttcaagggccattccacagcctgtttcagtttcagcttgacattttccagtcctcctatatctgaccaggatacctgcaaaacaaacaaaaaatttaaaacatatgtatacaagaaaggaaacagaactatttaaaaatcaataatttccttaaaaaattctcaacaagattaagaactaggagtttataaaatgtgagctgcgtattatagaaatactaaagaaaaccaaaatgttacttcttgcaagtcttacttgtataagtaactgtttaaacaactgaatatactgttaagtctatattctattctacatgcctttaaaaactagctttcatctgtttgaaaatagtttgaatcagtgattcaaggtcaaatctacatatctaatttcttatatttcttttcctgaaagcaaaattactttcaaatacacttctgtaggtccttatggaacatataaacttttctgcctttggtatattaataagaattctcaaaattttgttcttcccaaaatgttccccaaacaagagagctctttatgtttatgtacttaataaatatgcattacatatcatataaagtccacaggaaatagacgagacataaatccagatcctaaagaacttaacaaatatcagtaacacacacataaataaccatagtacaatgcaaagtttactaaccacaatgacaaagaaacagaaaaatcctttgggcgttcccaggaagaaaagattatttccagctggaaggtaaatctgagagccaactcttgaaacagggatgagatccataaatatgaaaataggaaaatggttaggtagaagccaaaaaattatgaaaggctcagaaggaaacatgaagaatatgagagaaaaaaagacttgagagggaaatcaaaaaagaaaagaaagttcttctttctaaaaaaggaaaagcaacttcaagccatctagtggagaacgctgaagactagatggagctcaagaatctctttattcataagaattctttgaaggtttttaatctagaaagcaatattctttgatctgtgcttcagaaagacttctctgacaagattcactgggagaggagagtgtcttcagagagaacaattaaagatctatcacaaacattctttaaaaaaaaaagtaaagcgaaaattaaagttgcttaggcctgtacaattctttgtgcatggactatacagtccatggaat

SEQ ID NO: 39585 - DNA, 2710 bp, Bovine  19866880881217
acccaaattatgggccagacttcactaactgcttgagctttgactggtcacatagtctgtcctcatctgtgaaattagggaatgtactaaatgattctggataaagtcttctagttttacataaaacatcagaattaattcacttcaccagtcccaggttttaacaaactttcctaaaaatacagcttttagtttcaaattctcgatgtcaaattatttactcacctggcttaccaaccctattaaaatgtagagttttttaaaaaaggacaattgattagagcacagtttgtatgccgacaaaggctgaagatctatggcttggtggactagggcaaggcccatggaagagaggaacttaagaaaataatgaagggatagagccaggtctgactgtgacttgaggaaagggggcagaaagggtgggcaacccagctatatttatctcttttttggaaggtacaaaaactctaaataacacaccattaaaactgaaaaaaaattcccaatcactgtcccttttccctcaactttcaatcacccctcaatttactgcaatctagtagcgagccacaggaccccactctcttctaaggacctcatgaccttccaggtactaagcacttgatatccctgtggtctctatactgctgctggcttcactatttacttcctgtgtgatcttggtgaagttctgtaactaaatttctgcactaagtttcttcacctatacaatgaagataaacatataaaggatgctgtaagaaattattaacaagtgttaaggcacttcaaacaatggctgacacactaaatactcaactggtggtaactaataatatattatttctaattactttctccctggaatctaccctcattttagtcaccacttttttgggttctcttccccctctcttgccattcttcagtctcctaccacttttcccaacaattcaacctctgagtggtgatctgtcctcaggatcccttctttcctcattagcatgttaaaaccccctgatcattcacaaatacaacacaaatgtattataatctcacctgttacactgctgcacttccctgtgcaccctgagctctatgctgctgctgctgctaagttgcttcagtcgtgtccatccgactctgtgcgaccccatagatggcagcccaccaggctcccctgtccctgggattctccaggcaggaacactggagtgggttgccatgcccttctccaatacatgaaagtgaaaagtgcaagtgaagttgctcagtcgtgtctgactcttcacgaccccatggactgcagcccaccaggctcctccgtccatgggattttccaggcaagagtactgaagtggggtgtcattgccttctccagtgagctctatgaggagagtccaattctctcttacttgctgaggtagcctcggcacccagtgcagtgcctgactcaagaaatgaatgaatgaataaactttgctcattctaagtgatttcattcatttcaatggcttcagtcatcatctaactgttaagaacttgctgacccacgtatccaaccaaaactctcatctccaaaacctgcaatttaaagtcctgaagctaagacaatgtgaagaataaaaagtgatagaaggtggaggacagagtgtggaggacagagtgggcaggaagaaaaatctctacagtccagacaagagtaatcaaaacagttatgatgtttaaaaaaatcttttaaagttgaaactctgaataaatcttgaaaaagagctaactgggtttgataaagagtaacaaaaaaagcagtcaagaataactcttagaaataacttccatttagaaagactgattttgttttcgcaattgttttaattagaaagaaaacctttcctcaagttttctacttttatagccttggcaaggcaactcagaaaattttccattagtgaagtaaatggtatatatcacttagagcttaaccagaatttaaactaccacctgttttcctaaaacaaaccattcaactccagtcatttcaaatgaacagcaaacgtaatactaagatacccaaatcactgaccaaaaaaaattccacttcttacataatatccataatatttatgcagtaggaaaaattccaacatcacaaatataactatcactatatttcagagttataaaccagaggggaaaattcaatgcaatatgaaatattatactgcataattactgcctatttatccagttacagtaataagtaaagataggctcccttataaaatgctaattagagtgacaatcgtgattcatacatcaattttatttttttgctctaccgcaggcctacagtggactcacttgtgagacgaagtggggatgggagggaagagattgtgactctgattgtgtttgacaggagagctctcacattcagcaagaacatctgtcaaggaggcacccctccccgcccccaaaagccatatctaagtctagtctgcatatttctattgatgggcaagactttaactgatccagattcagtaaaaatcagtactctagaagagaatggaatgtgctatatttccctgagatttcttgtactagagtaacaaatacttcataaaatcaagaatactgtcaaaattcaaataaacatctaccagagaaatgcataaatacacacaaaacattttttttccaaaaa

SEQ ID NO: 39586 - DNA, 853 bp, Bovine  19866880904278
tgaagtggaaaaaagagttgtagcttcactcttaacactgatggatggcattggttcagtaagtatagcaccagtattgatttctttagtaggggatattttcttaatagggagcaattgctcccttaatgtaggagcaaaaactatcaagtatgtctgagttttttgggatctctagggctgcagtccatggggtcgctaagagtcggacacgactgaacgacttcactttcactttccactttcatgcattggagaaggaaatggcaaccaactccagtgttcttgcctggagaatcccagggacgggggagcctggtgggctgccgtctatggggtcgcacagagtcggacacgactgaagtgacgcagcagcagcagcagcagcagcagggtaaaggaaaaaatattagctctaagaattagaggaccaagacccataaaataattttctccagtaatttcttagtaacagcaaggacagtataacctggcagtgtttttctagcatataaaattatttacattgataaatttttttttttaataaatggtgttaacctaaaaacctgaagtaaaaatcagtaaggaaaatttagcagttaaacttaaggggaatttactaagaaatttcatgagtaaatctcatataactcttgtaaaaattagtttggtgggagagctttaagttttgcaagtgaaaggacaaagtgagaatcatgggaaaggtacaacatttaaaaaaaaagtttactcatgttaccaaattctttgtatatagtgcatgcaatcttatattaataagaactatgtgctgattatgaaagggaagatcagtagaactaatagggaa

SEQ ID NO: 39587 - DNA, 2483 bp, Bovine  19866880931128
aaaataagcctatatggtttttccaaaaaggtgtaagaaagatagtcttccaatatattagtcagaacaaagccgaaaacagctctgtatacttcaaatggtaaaatcacctatttaaagtttaaaaatatggtcaaattgatctttcacatttgtaattcagtggtagtatttatactataacttgagcaaaattgttattagaagcatgggagtgaaatagcgtgtgagtacgtctaaattttttaaaaacttttatcatcctggctttacaaaagaagaagaattctcaggtgagtaaaatcactcattatcacatatcgtctatgtggtggaaacagatttgaactcatgttgaattaggaaaaatatatccctttttgtatacatacagacgatgccctaactgtccaagagccagctgcttccttaaaatataatgttttcttgtctaaataaatctctaacttggtggatctactttcttttcccaggtcagttcctttaacaccatcctaattctgaactcgtagattttccagggactccaagattttcacaaagaacagcaactgcagtgggagtggagcacccaggcggtctgcagcggtgtccatccatgtgactatttcctgcgccagcacagtgccataggtgggaaggcaaaaactctcattaaacagctataactaaagagaatcaaattcacacaattcacaatcagaactatacattaagtgagccatcaaagctgaaagcactggaagagaaaaattcatcacaaaggaagtactatcttttaaaaattagatttatctatgtatctaatctgaagtctattacctcccagcatctgctccatggtttcgtcatgaatccttggctggctcaaaagcctcaaattggtaacaatccaaatccattaacagtagaatggattaaaatttatggcatatttatactgtggaatattatgcaactactgacaataaaacagatgaatcttacgtaatgttgagcaaagacagaaaatcagaagaataattcattgtgatattcttgacacaaagttaaaagcaggcaaactaaacaatggaagagcaagaaagaaaagaaaggaaatgattaccatgaagttacaatggtgattgccctttggttgcaggaagaggattgcaattccataaggacacataggaggggtgggttgggggttcaggtgttggtaatgctccatttcttgagttgtttggtggttacacagaaagtcaatctttctccttttattaacacatacataggtgctatgctctttcatgaaagttattttatatttcacactgtaaattgcttaattttccaaactgcaggactgtcttcccataatttgattctacaaagctatggaaaggaaagaaaaagaagtacattactaaaaatattcccaaggcaaagataatgaactgtgtctctgttctctcccctagattctaagttgcatctgggcttttggttgcaattcttaacccacggtggacgttaaataaatatttgatgatgttgagtgcttaagtgatgatttatgtaaatatcaggacctgctgcacagcacatattctcgtggcatagttttaaattgaccagaggtatctcactctggtgtgtctgagatgaagtgtaaaatataagaaagtcccattaacttgtcaagttgacagagtttgggagtttatttagctgtggcaaagccacatatgtgcaaaatgagcatcctcctatatggtcagggtctgcaaataagcacatttaagaagggcaacttggaaatattcatcaaaagccttcacaattcatcaaaagcctcttagatattatgtttctaagaatcttaaaaagtggtcatggagtttgtatgccaacatttaactacaaggatgtttgggttagcgctgtttgccagagtcaaaaataggaagcaacagaagtgtccaatgatacggtagttgctaaacacattgtggttgccccttcaatggaattccatgcagctgttaaaactgacgtcacagagaataattttaaaacatgaaaatattcataatatactgttacttttaaaatcctgttacagagctctgtgaataattttagatagatgatagacggatgaatggatggatagatagatagaaccaaaccactcccaaatttagtagccaaaacaactagtgtattctgtttctttttcagtggttgcctgagatgacaggactaaagaagcaattcttgtgttactctcaatttggagaatactacatcccctggaggaggaaatggcacccactccagtattcttacctagaaaattccatggacagaggagcctggcagggctccacagggtctcaaagagctggacacgactgagcaaccgaatatgcatgcgtgcacacacacacacaggcaaccaactcatcttgctc

SEQ ID NO: 39588 - DNA, 713 bp, Bovine  19866880945005
tgtattgttagtaatttattaataagagcatcatttgccttcatataattaataagagttttaaaaggtagttctcatcttcgaagtcttctaaggagttgctcaaggatttctagtgttttctctgtccacagtctcactatcctgtagcaaatagaggcaattcagctttccattcttctctgcttcaaaagaccacttgaaaatttgatgacagtctcacacttctttaaaaagacatacagataattatcagttcattgatacagactttcaaattagagtttccagttagtactagagaattggtaatacatgcataaagagtcacctatgaagaacttgtttataactaagtactatatattatggttaagatatgccataggagtttaggggatgagaaatctggaacttgaccagagttttgaagaataaccaggatttgaagtggccatagaggtcggaagatactgtaagacatttttctaaaaagatacagttttttagatgaagagaaaatagttgacattttttgttaaaagctacaagatgtagctggttaaggaattcagaacataccaccctcaaatatgccaaagtgaagacaattgagagagagcaggaagggctctctgcctgaccctttctacctaaaagcagggcataaatttttctaccataaagaggagaatattatcaccagagatggg

SEQ ID NO: 39589 - DNA, 814 bp, Bovine  19866880961710
gaataggcaatcaactgacaggtcattgctgaatcaaggaattatacccttttctttggcatatcacagctcatgaaggctaacattttggtgactgtttcaggaaaagaaatactgtactgtatttcctctcttcccttcaatatctgttatacaaagcaaacaaacctgtttacagaacagccagccctttggttgagtaaatgacaggtaggaaattaagctgttaatacaggaggatgactaagtgaggaaatccgtcttttgtcaaccactcttacatttttatcattttcaagtagaatctgctttcggtttcagtgggggtgttagatgtatgtggcttaatggattttgtacttgaaattctggcttccctcttttgcttacaatccaacatcacagtagaaaataatgcaaatagtcttctaaatgattgataaacagtaatgatttaggcttatttattgagtcagagctccacacctgttctgtgtcataacaacttcctccaagaatgagtttttttttttttttaagccatcctttcttgcaatgccagaggcattaaaaatctctaaattgaataatactgaattaaatttgcttcttatttaaatctatttaaaggtaaccctttgcatactttctgggttttttagtacggattgttgattattacattgtatgtatacgtgtttatacataatttatatacatatatatatatgtatatgtatttcttttttataaattttgataagatattaatcttgacatttatcataacatgaagaacaatcctaacattatt

SEQ ID NO: 39590 - DNA, 832 bp, Bovine  19866880980642
gcaagagcagtggctccttccattattttctttgatgaacttgatgccttagcagttgaaaggggcaggtaagaaatataagactgccactaataactgtatattagcaactacagtgtagaggaactagcactttttatacagattttatttattaatattattaatacatttggcttaaaagaaaactttcaattcacttttttttcttatatccttaaaattatttcatattaccactttattacttctgaggtgagatggaacaaaaggttacaaatagcttaagttcaccttgatgcaagggaagaataagaagccagagaagtttgctgaattagggtgatctgccacatttatgtgccatcagagacatctgtttttggagcctaaaaaggaacaggatgggaaacattgttaaatatgaaccagatggtaggtggaatatatagcagagttctcataaaatgcctttgaaatatgtgtgagaaaccagacaagatactcggtagaaataacctggttttgtaggcattttggctcaggaggaattggcatatgtattagagctgttaataatttgcagcctctagatatcattttctttaatcgtcttcatcattttgtgagtccttccttagtgactcattcaaataaattctatgtagtttcctttgcacagaaaaattttggtcaagttagttgacgctttgaaaacaaaggtaaggctgactacgcaatgtaatgttaatagtacaaatagaaaattgcagttgtactttagctacactaagtcttaatcagtttggtttttatagccataagaatctca

SEQ ID NO: 39591 - DNA, 1563 bp, Bovine  19866881007171
cttcgaaaatttcctctcccacctctggcattttaatacctaaattaacaactcttctaacacactggcctcagttttctcctcttcatcctttactcagaaaaatctcttttctacctcaagctacccttgagcacagagaaactccaagatatcctcagcatttgacagtatggtatcaagacccttgaaggtggtatcgagaccaccttctaaggtcttgacttgaaacttctgttctcagctgtcctcctttgctatttccatactctctgtaagcctgtatctcatcctcattggaactttcaaccaattcttctggccagtcatttcggcaaatattcagactgctaccctatgattcctgacctctttcaaattcaccatttcttaagggtctcttattctctgccttaaatgaccctctaactagctctgaataatatgcttagtggctcccccaaagttccaggttcagtgtgagctgagctccctgcgctgctctttctttcatcagttcctactgaccacaagttagcctctccacctctagccgttccagaccgctctcaagaaccaatttcagtctcttaagcatcttaactttcaagagaagaccatcccccacttggtgtgcttctttgacttccctcttctccctcttggcgttccactgtgtcttttccttccttctcatcttttattctttcctctgggagaaccattcttgccaaggttaaagtgccctctttgcgctccctcttctatctcctcctccctcttccagaaggcctacaaaaaggcacagggttttccttattctaaaaattgtcctcagcttgttacttgccttgagttacttgcctattatatcgagacttctggaatagtctaaagctgttacttgcatgtacttaccacccactaaacccatgcaacctggttcttattacaatttcacctaaacaccacccaccaaatttagctgggagtatttgactgttactaattcctatcttgaaaatctcctttggctgctaacgcgtggtcaagaggaactgaagaagagcagtccagagagttgagctcagtctctcggtgcctgtccttctttgaccacccccctctattggtgccccacctgccctctaaatgtaggtacattcctcagggttcgaggctcagctggtaaagaatctgcctgcagtgtgggaggcctgggtttgatccctgggttgggaagatcccctggagaagggaaaggctacccactccagtattctggcctggagaattccatggactatatagtccatggggtcgcagagagtcggacatgactgagtgactttcactttcactttttcactttccttaaggttttagccctagcctgtttttaatttcattctttctcttgggaatctatgctacagattccctatcaccccaatatgggtgatgggccatcacccttctctaaaattctaggcttttttttttctcagtgagcttctggcaactcaccagcattgtaagagtttatcctaataggaatcataa

SEQ ID NO: 39592 - DNA, 1655 bp, Bovine  19866881038359
ttatgttatagtaatttagattcagtatttttactagacctacgtaagtgtaataatgacaaaacccattgtttaaataagagttttagctcttcctgttctgtgatggtatccttatcaaggcccaagcatttggtatgaatatgttgaaatgatgtgtaatcaacaaggatgcttaaagataaattcttagagatgtgaagcgaatgcttccttccactgtaaacaaaatgactgagtccatttcttgaagaaatcaagctctatttatattcactctcctgaaatggcacaggcagccttagaaggataagtttataataaatccctgcatttggaaaacattgttgctaagcatcctctaacattcaacagagtttatataattcatgtctctgctgcataattaacatctcatgttttctaaaaaagcatggtatgcttatctatgctgttaatttaaaatattataaattttgagggaattaataaaaggctatgcaactaattaattagaaaggcagcctaatcccaggacagatacaaacacagacattaaatgtcaagatgtgtcagagttgagcttttaaaacagcttgtctgcttgagataaaacgtttcaaaatgcagctgctctttgcttaaaaaggtgaactacaaaacattaggcttttggacaagtcaccacttatcaaaccacactctagctcaaaaattaattatacggaaaatataacatttgaaaatcagtttcacacccagcattcaacatcaaacactgtatctgctcagataaaacaagatacaagtgttgaaagcaacactacagtagtatttccaactttcttattcattacagacacaaagtttaaaaatatggataatattcaataacactagaatagaagagcagaaaagctgagagtatacacactgcaaaagatgcagtatcactctcacaaattctggaacagactgcaaatcttctgtcctctggaaaaccatgcacaaacatatatactacaaggattttgaccttttgtattaataaaccacaaataataaccttatgattaccaaagcaatcaggaacatagttcacttcagttttattaattctgaatcacttcaatgtatgcaatgactagatacccatgcaccacttttgttaaaaacagcagagtttccccaactaagaggccagctcagaaaaaaggaaaaccatcaggcagccaacacacaaaaaacgcaaagaacatgtatgtccgcaaggcataaacaagcagatgttctaggaaaaacacgtctatattcttctttgtattcttcattgttaaccctcaattatttccttaattgtggctttctagctttcagaattattttcattttacctgttactttaaattaatttgtattggagtacagccgctttacaatgttgttttagtttctgccgtagaacaaagtgaatcagctatatgtatacatatattccctcttttttgttatttccttcccatttagatcactgaagagaattcagtagagttccctgtgatatacagcaggttctcattagttatctgctttatacatagtagtctatacatgtcaatctcaattttctgattcattccacctcctctcccctc

SEQ ID NO: 39593 - DNA, 1894 bp, Bovine  19866881040854
aaaagcccctgatgaagggaaagattgagggcaggaggagaaggggatgacagaagatgagatgattggatggcatcatcaactcaaatggacatgaatttgagcaaactccaggagatggtgaaggacagggaagcctggcctgctgcagcccatgggtttgcagagtcagacatgactgagtgactgaacaacaacaatatgtttttgaagatctatgataataccatataactatcactcagttaaaacattgtttttactaaatacaataatatctcaaattgtacatggcacataatatttttgtaagtacctaggtgtacaaacttttggtatttcaacaaactcgtgagttaaggggggactgaattattcacctagttttataggtaaggaagtttgacatagggaggaaatatgattttccaatttcttgataaagttaggactagaacataacatccctgaccctgttagttcattctgtgacctttctgatgtggtggttggtggttgagtcgctaaattgtgtccgacttctagtgacccaaggacgaaagagcagataaaaccaaggagggtcttggaatgcaggaatggaaaaaccaggcccttatggtccttccctctcccatgttgtaactattaatggaacagtataacctgtctcccctcctaccccgtagggagaaggtatttgccctactcttccccacccagtatacatgcctcatccaatcagcaaatgacccgcaagacccctatcccactccttgtaccctgggtataaaagtggacttaggacccctgtttaatttcggttctcccttgagctggcccgctgttctaacagcatctcctactctaataaactttattctcctctcattctgcctcaggtctggaaattcttttccaacccgtgcccggaccacgacacgactttttacgacctcatggatatagcccgtcagggccctctgtccatgggatttcccaggtaaaaacagtggagtaggttgtcattcccttctccagggaatcttcctgacccaggaatcaaacctgagtctcctgcattgtaggcggattctgagccaccagagaagccccagcctttctgataaccattaagaaagaacaagtgggtgtgccacaccagccgatgatgaggcatccctgttctgctcatgacttgaactgtggtgaagtatccagttaaaaaaaaatcgctacttttatccttgagttttacatggagtctcatcataacttgtgctgtgctttatgaaagataatctgaccaatttcttaattgtgtttcattcccaaggtttagaaaaaatgtttttgcatttacaaggaatatgtatagcccaagtacacaaaagcaaatcttaagtgctttggattttgattattttagaatactagtttaccacaactcagctgtctgtagtgaacccttggcctctgattacattgtcccctcctactctagccctgctcaaatgattcagtggaaaggattctaattatgtaatctcattttggggaaaactgggaagagtaggtagaaacctaaatgatgcatgttagagctaggaaactggagccaggtctcatggtactctaattaaaacttttatttctgcagatttattctgtggtccttgctgaacagatctgccttgggtttctgctggtgagtttttcagcaggaatgcaggctttgtttctttgaatagttgagtgcagattagtggtatgccaatttcctgtggcctttcagagctgcaatttgagccctgtttgctcctggcccttgcacagcagaaaacaatggggacttcttttaggtttcacttcagggctctagaaacaggggaag

SEQ ID NO: 39594 - DNA, 1717 bp, Bovine  19866881083143
cacctgagtgtaggatacccctgggtgagccctgggttagggtagtgatggggtcagggacagactgaatttacatttcaagtactttcaggaattatttgcaagcactcaggaatataaaatggtatcacagctgagagctttatttaacattccatttagctctaatctctacttaatctccactgtttttatttggttactaggtatttagcacagccccgttttgtggaaggctggccaaaagcacacttcaaattaatggtagtcaaagcttgctctactgaatctatattggagcatgagcaagaggttcattggttctaagttgttttatagggcttttttgtttttgttttaacaatctgcctcagcagtatatacagtataaagttataaatacagcacccgtgctaaggaataaattccacatttggtcaaaaatcaaattgttaggataaaagtcctaactttagttaacattaagtcaaatatcagacgtgtcctcattcattcaacatgtatttattgagcacctactattaagtaaattaccagtcactgatgcacaatagcaaacatactaaatgaaagtctatcaatttgtgggtccatttttgtgaggagaaagagcacatcaacaaaataagttaaaatgtaatatattagatgacaataacagaggaggagcaaaataaagcagagaaggaaaaaaggcctagagagtaggccataggttaaatacaggtggccagggagagcttaccaaaaaggtgatactggatcaaagcctgaggtaagtgaattgtacagtttgttatccaaaagaagagcattccagaaggggaacaacaagagcaaatgatctgaacaaaagtaagcctttcttgtttaaaagcagtcaggaagtcagtatagccggagtgaagagagtggggggtgttccagtgtccagctgaagaaagtgggaggggtgattgatagcaaatgatagatcaagttaattgaggactgaggactgaccattggattattgacagagcagttcagtggaaggtcaaaaatctcatttgaatgagtttaagggagaatagaaggagaggaagtggagaaaggcaaataaagatagctattcccaggagtttcactggtggtgggttaaagcagatgtggagggacttcctggtggtccagtgactaagactgtgcgatcccaatgtgggtggcaggggcgggggaggcgtggttcgatccctggtccaggaactagatcccacatgccgcaactaagacccagcatagcaagctaaatacatacatgacacatacttcattaaaaaaattaagcaaatgggaggtgattatgcttttaaaatgagtaattataacatattgttatgctgatgggggaaattgattatgcatggggaagcaattacagcagcaaatcttgacttaggaaaaagcgaatggaatccagtgattaaataggaggtctactcttaggaacccaggtagtacaactgttgaaacagaaaggccagttaagcatgcgagtacaagtaaagggaatactgtagacttgatgatggtagcatactgaaagttcttctctaccatgtaagcaaactttcttcccagtatttgaataagatctacaatattcctgtcacgggtcagagtttgagcaagctccaggagtgggaggacagggaag

SEQ ID NO: 39595 - DNA, 1529 bp, Bovine  19866881146721
ctgcatgcaggcctgtggagctggcctggagctgctcacctcccaacagggacgctgaaatcgtaaggcaactgtcaccactaaactgccaaactacctctcagagattatctgtatcctccaaaagtggaagagtaacacatttctgacagtggcctaaacaaccaactcaagttctgtttgcttcccatcaccccaacctgtgggcccagagtgtgtactcaggtctgtggagaaactttgtcagtgattttaaatgcgggggaagaggaggcttatttatagggtgacctcagataatgagaaaagcggctctgcagcgctgagttcctttacctgatttaatcagcgcctgtcagggttgcttttctaaaagtttagagggaaactacacctgcgtcctggggacagtaatttatgggtgcaaggagatggccatgcagcagtttcttgcctgagtaggtgaactgcacggtgcagagctgactactgtgggggaacccgggctgccggagacgcccctccagccctttttcgggcaactacccgccgagtccacgctgaggcggcgctcccctctcccccggctcctgctgtttggaaccaagaaagcttgccttccagtgaggcctaaatgtgcttttcagcttctttgtatttcaagtgtactaaatagctttaaagaatccaccaaaagaaatgggctgcagtgctttaaaacgacgtcttaggtattttcaagaaagtggttttgttaaaagcatcgtctgtgtggaacacctgtgacctgttgagcttaattgggctgcagctggcgctgactgtggcgcgggcggcagggggacattgtgtgcactcggctccccgccccctcgcttttcttttcactttcagagtccgcgacctccttcccctgtgtgtctgagggattaggaacccagtagagagtggtgtcccgctgttcgcgaatagcctgccactggaggtgcttcaaggaggaggctacctgggagattatgtactactgcaaggcccagggccattctcccgggtccattgagacgcggtgaaaggtggctgaatggccgcgcctgaaaaatgtgactgaagggcacgcagcgggctcctggccgcggagcagcagatggagtctgactgtcacaggcacaaacggccaggggtgccccaaacggccaagaacgcagatcagagccgaaaacggggccagtcgaggaagggaattccagggaagccggtggcattgatttaaagttcttcacaattcacctcacagataaacttttacttgcagatgctagaggtgagaattttggagggccaatttcagatttaaggaatcgtacaatcccttggattgtatgcaaaataggctttatgatgcaacttcatctggaactgttaaagtgaaaactatctagactgccttgcagagtactgaatcaaaagaaaatgaggtctgtaaggacatgtaaaaagtctaatgatattagaagcaggggggaaaactc

SEQ ID NO: 39596 - DNA, 1204 bp, Bovine  19866881195619
ccagtcctaggctttgcgtcagaccctgtggctttcacatggccctgtacccgtctgtcctctcctgcgttatcgaaaaattctctctaatagcttgatgtgttttaacctcctgtccctcagttttactggaactttctagatggcaaggattttaaaaaatttaaacattacccagtagtcctttgctctcttttctactctgaggactgagactgactttaggcactccagaattccctggactcaaatgaatgaccatgctgaggcccatgaagaggttcgatgtgtattgttgaatgagctagaactttaaataaataagcatatacacttcagcatgaagtgcgcagagcagataagttgaacgtagcatcactgtggttccttctgtggacacctttcacattattcaaaggaagcaataaaggtaaaacacaatcatttcgttaggattaatttttattgtggaagtttttcttttcagctaatgaataacatgtcaacatttctagccaatttcagaactagctgtaatcttttaattaaaaaccatagatctgagagttcatacttgagtcatatttaatccttaaatccctttctttccctctgtctctttctctctttctaaaagctgtgaatcattttataaattaggattaagaactgtctggtaccattgttaatatcccttttggctgtgaggaaatggcacaaataatttcatcctaatattcattcagatttatgagccagtattcatcacaacaatcttaaaactcttgaaaggatagaaactgtatgacaaagtgagtcatagtctttgtgatgtgatgtctgcaagggtgggtgggagagactactgaatgaccagtctcattctgctttctgagctgaatcattttgcaaatagaaaacaattcatagatttatagatggtcataacataaataggaaatggaagagagtaacagagtcaaataatacctctatttaaaaaattactttttgaaacataacacttgatgaacagtctttattttgaattagaaatgaaattaatctactgcctaataatacatatattttgatacttgctgtatgtctttatatattttcattttttcctattggttatgtttcttttaaaaaattctctcatgtaatttgacctttatcttcatagctatttctagctttg

SEQ ID NO: 39597 - DNA, 874 bp, Bovine  19866881233949
gcagaagtctgaggagatttgtgctaacagattttgtgtcctgtatggatgttatataaaaaaggaaatacactgctcttttgcaggtttctgtgatctcctggtccacagctctaaaggcaaccctaaagagctaatggtcaggaaaatcaggctcagctctaagcctgtgcttaaccaggacttgtagtataaggcaaccagtgctgagacagtagaattccattgtgacctattgtccggagatgagaaaacacccatgttactgggttccagcgtcacaatgagagagctcactttacacgcctgcagcccctggggatgtgatttaatctgcaatattactgaatccctggaaaagtcagttgtggttctcatatggacttttactatatttatttcaaataaaagcaacaaaaattcataagacttttatagattgtcaaaagaagagctagtcaagtgtcagcgttgtataatcacattcttctcaaagtatgtatgtggcctttgaacactggaaaggcagcattacaatgagaggggtggagggggagtttgttgttttggaaagagtgagtagaggccagatcataaatggcaatgaaaactttcagctcagagatgcacagatgggctttctgctgaaatgactaacagctcttgtcagatcagcaagtagtaaccacaaaacacatgttctgtgtgtttaaattcacatttattaagttaaataattgctaatttacataacaaaaatttaattctcatatttttcagaattgatacaaggcttaacatagtcaagaactatagttagttgagtagcatatatctttattaaaagtaaacatcaaatgctatcatatccata

SEQ ID NO: 39598 - DNA, 774 bp, Bovine  19866881236806
ttgtaaagtaaaataaataaattaatttttaaaaaataaataaaagtttatattactagtaggtccttgtgctttaaaatactgtgacccattactggtacagactatctagatggtgttactgatctgagcagagaagtcagacccctccctaccctcaccctaaaccacccacacacacctccccagtcactgctctcaacaacaggtttttcattttctgagatgaagtccaaggaaggcactcctgtgctcggatgctccggggctttgttcagtaatcagctttgtggtttcaggaggcccaaaagtacttcagggctttccactccgagcactttgttcaggaagcttgagagacttgttgtggtttcagaaatgacacacttgaagttctggagttggcataaactactgctcctgctcaaaggtaggaagagcggcagccagaggggctggtagcctgaaaaccgaagctgtggttgtctccacagacaactgctcttcagcaagcttgcaattgctccacacccctttcatgtgggcaaagaaagaactttatcagacattaagtctctctcctcttgaaatatcggggtgagaggagaggaagttgggcagtaaatcggggcagaatttacaagagtgaaaatcacgtttttgttgcgttctcccctttcacacaggtgactccagctgctctagatgcttgtgtactggcccccagactacgacatgaggcccccaaagaggggaaggcagcactcgctgcag

SEQ ID NO: 39599 - DNA, 1577 bp, Bovine  19866881236983
ccatttccctctcccttgcgtgaaagtgaaaagtgaaagtgaagtcactcagttgcgtcggactggtagcgacccccatggactgaagcctaagtcttaggaagatgcttattttttgtaatcaccttaattatgcaaaaataattacagccaataattattgaccactttctatgtcccaggcacttgatgtgttagattaattctactactggaaattcctgtgggagatatactatctattcatgtctataagaggctttagtatttaggacttcaaggttttttacagatctttaaaaaaaaataggatagattcttacttgttggggatgctttaaacattgtgctactagaagacatagagtaaataaattgatcacccaaagtcctgatcagctcttcagttctacaagttgattataattagccctgagaaatcctctactgaaaaactttctatttcctgtcaaactgagaaatgtttccagtacattcatggattgaacaggctatatctgatcataatggttcacttttcccatgagttctttgagttatatttttagcacttttctgaaagccagagaaaaagtcatgcaaaaatcccaacaagccccaaagtactattttcaaaagggagttttttggccacaaatagtgaactactttccaagtgattgcttggaataaaacttagttaaagttaaatttaagatattctttttctctccaaacagattaagaacatttaaaaatgtctagataaactagaaatacttaattctgagaataattgcttcttttaaaaaacttgaatctttgaacataattttaataaagaaaaagacaaaggcacgtgtataaattcaagagtaaaatctaaaataatgaaagttcgcaacacactccaaagttttcttgagtgttctttaatataaaaatgtttctttaatttagtaagcatttccctagactttgagatgtgccagagtaatgttaggcactggttaaaaatggagatgaatacgatagggctctgctcttgagaagctttaattatacttctcattttatattactgggttaaattgtgtcatattctgccaattcacctctttattaaactaaaaaaggacaatttcacatggtttaatctaagagctactagattatattgcattgatgtattatcagaaggataagtaggcatcctcatgagaagtggagtggaagatgataagacgacttcctcttgcctatgctggtatgtgtgttagttgctaagtcatgtccgactctttgcgacaccatggactgtagcctgccaggctcctccatccatgggattttccaggcaagaatactggagtggattgccatttccttcttcaggggatcttcctgagcctcggattgaactcaggtctcccaaattgctggcagactctttaccatctgagccaccagggaagccctactgagatcatactgaatcctacagcctagaaaaacccctggaggttgccacagtgctctggcaaggggatggtgatagaaaacactatctatctgtg

SEQ ID NO: 39600 - DNA, 1325 bp, Bovine  19866881336921
taatctctgtaaatttctttctctttataataatagtccatgctatggcaaagagtcagatgtgacagagtgactttcactttcacttcactttcttaataaatgatttagcattttaaagcatttaataaggctgaagtatttagtatacttttgtttcttaataaaaatgtgggaaatacagaattttatttcattaacatttaaaccagacttgacgtctttaaaatatgcctcaaaatttagaagtatagaaatgtcatcacttacacaaataagaaaaaactaacacatgtatactccatctcagtcattcctgaaaacagactacacaacaaatttacatttttaagccaagaagactttaaaatataaagcggaggaaaggaaacttaatggcctcagaactaatgtcttctgtgtattgaaaggaaagttctagtgtaatagggcaagtattcttctgtcagcctctcagtttactttccactgatttttagagtgagaaagtaattcattctctgtactttattgaatcataaggctatattaaacaacttgaaatagcatataaaatgtcttatgtggacttcagtctttgagggacaaactaatcatcaaatttctttgtacaagtttacaggattgtactttttccatgttaatacataacattatgctgctttattttctattttaccatgttgtataagtggctcttagaaattttaaaggatttgtgcaattcagtatttgttcttgggtagctctgggaaatggaagtcaggataatgccagaggaaatcatctgcttttcttccagaaggaatacaagtatttgcagggaaaatacaagttcagatataagggctagagaaaaattcattgacacctcagtcccactttttgtaataatttttcttagggataccctaagactgagccattttaaaaatatatattttctctataagaaagggcaaatctgtcttattgaataatataaaatctaagagatttggaaaattcgaaaaattattaagaaaatttatcagtattttgattgcatttcaattacgaagtatatttatgaataatgtttaaatttttaaataattcaaaattgatgatcagtgcatgactttaaacatgagatttcctagctttgtggtgatgatagaatcgaagtcctaggcttgtgggaggcagatgcttgtgggaaagactggtacttattagcagtagtagaagtagtaataaaaataatgatttcttagaataatactccttacttaattgccatctatttaccaattttcttttaa

SEQ ID NO: 39601 - DNA, 976 bp, Bovine  19866881350393
tggaaaagatgagcttagacacaagatcagtggtaccaaactaggcccatgtattacagtcacatgtctctttcaagcatgttgaaagagatgttcaacatgaaccatttaacttattaatttggcttgacttaatttctctctactaggtttatggtgaaagtaatacggtaaagaaatatttctggggaatttcaatatttggaaataataaattgctatgtttttatttgctgtgacaaacaatcaatcaaaatgtttatcgagtgccgtatgttgtgaaatctacatcatagtctggaacggcaatctaagataactcacttggttgtcttgtagattcgtttattctgtaatgtaaagacctatcccttccttcaggtttagcatattgtaagcaatcgtgattggagcatgtcatatggggcacagaaataatcttactttctagagattaatataaaaagctgaatttccagtcaccatagtgaaggaacatagggttggcacaagggaaatagtttcaaatagaagagttcaaatatgacaaagtagaagagttgctacgttaagaaagtcagatggttgtctgtcaggtggcctcacaaggtgggatttactttcatgaattcataatgatgtgaacttgtagggtcagaaagttgactttatcactgagttgaaaatgtgttctttttggaacacattttggaagctgattcatcttagtcaatctcatagaaactgatgtaaaatcacaatgtcagtttattaatttggattaagaaataattggcagagagacccagattcaaattcatccatttaaagttgttcaacataatgatttttggtaaatttatgaaattgtacaaatatcatgatggtagttttagaacatttctccttaaaatatctttctagcccatgtgccagtgatccctgtttccatacttattgatcttcatccaccatt

SEQ ID NO: 39602 - DNA, 893 bp, Bovine  19866881428968
aaatcagtccctgatgctgaaaaggtgggggctgctgatctagaagacatttaataaaacctgcccccttttctgattgcctacaactcttaagtctgtggaaattctaaaatttttgcttaaaatagacattgttatttatttagaaagtttaatacagtgtaccatggctagaaatagacagctagtatatgatgttttcctgaaaaggaaaaacaatgtaaatatccatgagaaattgtaccataattttcagtttactatattaagatctaaaagaataaggcagaatggaaagtgaactcatttattcttcattttcatgcgaaaacaagattcgctatttcttctactgatttgacttttgagaaaataacaaagtaaaatgaaaaaaagtgtctggtaactcttggcaactgctagtgatttaaaaaagaagaaaaaagtgtagtactaaggcttaacttattcatttatctactttatttgccaaaatagctgaaccataatatgttccaagctcttgaaaaataatatcttattaatctttccaatgtttctgtgaactcatgataataaatataatgtttgattttactgagaaacaaacaaaataataacagaaactggtgagttaccccgtaagtgtctaataaattaacaaagaaacaagaatggaaagtctttactttccttttaagggcaatagtcactatattactatacttcccaagaaaagctggcaaggataagccattttattttcagtttcctttcgtaaacaatctttgtagttgacagaaatagaccaacctattctgtgaattttccataaacattcttttcattttcgtaagtataattctcatccttccgccctatttgaaatacta

SEQ ID NO: 39603 - DNA, 703 bp, Bovine  19866882123313
tgggagcgagggagatgaggatgcgggaggatgcgatgacgctgtgctgaaatgaaagcgatgacaaaagctcgcgaggcctgagcgccccggcgggtcccatcccgcgcccgcagaggcccccgggcggccgggccaccgcgcggcggggcgggcggccgggcgcgtcaatgggcccattcaggccggcgcggcgcgggggttgagaagttaaggggcgggaggtggcgcgccggggccgcggccgcgccatttgcatttcaataaaacccgcctgttgactcagtgcccggcgcttccgcagctcccaccagaatctgcctttgttggttttagctccggtcaagtccacttcttgcaacgggggagccgcgcgcattgagtttgtgtagtcaggcagaacactcgacaggaaggaaggaggaaggggtgctccgcgcggccattgtctgggcaaccgggcttaagcagccgagtgactatttaatctataaggtgcacttgaatcccttgcaaatcctctcagtgtggagtagggagcacccagacagggacagatggtgcagaacccctttgtttaaaaatatggaaatgcgttttctttcatttacctaaagtggccccgctcttttaactgttattattcccccgtgttgcatcgcccaggagagacccgaagatgctcttaggtcggtcagcccgg

SEQ ID NO: 39604 - DNA, 1412 bp, Bovine  19866880593591
ccatttctttccttggtcatacaagttgcgaaaaccaaattcaaaggaagtggaatattttctctcagtaacaagaataacaaaagattgtgaccatatttaatttgccagtcttccccatcttgatggatggagcatctgtcttttttaactgctagttctcaaaaacccagacattgcttgggactctccaaacctatgtctcattattataagagaccattattataagagacctatgtctcttattattgttcctgatatattccattactctacttattttttgcaccaataccatacattttacttgaattaatcccacttatttgtatatacacagaaaattgaaatcaagctcttagaaagatatctactaagattctcagtagctaagatatgggaacaatggaaatatccactgacagacaaatggatacagactgtgttatatacatataattgaatactattcagccttaaaaaagagataagccataccactttattggtccacaagggtggacctgaaagatattatgctaagtaaaataagtaagtgactggtgggcacatacactatgatctcctttataagggatatctaaaatagtcaaacttacaagtggttttgagaggatgggggagagaggcaaatggaaagttgagttcaagtttttactataaagttatagttatacaagataaatagattctagagatccgctgtacaacatagtgcttatagttggcaatatattattgaacactcaaaatttcatgaagtgggtatgcctcaaaaaaatggaaaaaggcacaagaaaaaaatttaagtggtgaaagcttatcaccttgattgtggagatgatattatgggtatttacatctgtccaaactgatcagattgtacacatttaacatgtgaagtttttgtatatcaattatacctcaataaagttgtaaaaatactctagttttataatatggtttagtatctgacagggctgtgtgtatatattttattgatctacatgaacatgattctacaagaaagactctttatttccaatctgtatcttattttgagaataatttgttgattgggggtgttaacgatgagaaaaagttttattttctaatttggcaagttctggattgtatatgccatcaaaattctgcttaccaacttatttttgagcctgtctcttagttttagttttcattttgcgcagcaaaaaaagcaaagcccaagttgtcaacattctattttccctggagttcttcttgtgcagttccaaaaattcattaggtttattttcaatcttctaagtaaccttacatgagagttttaccaaatacttcatcactacaaaacacatgtctccaatttctcatcctcctaaaacagttcc

SEQ ID NO: 39605 - DNA, 1654 bp, Bovine  19866880593895
tttaaaatgtttaaatctgtaattgctttttatctggaattatttatataatttggaagttgaaaattccagtggggatttatggagacaaagttaatagttatagttagaacactatcatacaaagctatgactaaggctttttgttttggggaggggagtatttggcaaagatttttggaaagttgtaaataacaggagatatttattagtctttgcagattcaagcaaagaacaaaatgctcagtgtgggaggcagtgatcttggttggtcctttcagctgagtctaaatccattgtttaaaatcactgttaggatcaatgccttaccaaacatatatttataatataaaatattcttgaagaaaaacatctgattcatttcatagcttcagaacaagtgaaaatttcagtaaatctttcgtatttcttcccctgtgttttctctgatatgtacaatatcaggagactgaacttctcattgagttaatactttaatggaaattacatataattaaaagaacatatactttttctagtggggataaaatgttttctttccctttaatacaaatgattataggaaaggagtgcgctagtgtatgtgcatgtatgtgtgtgtgtgaatgtgtaaaaggaaggtgaagcagcaggaggcaaagggcctaagaaaacagctgttatcaaagaaaaatgtcaaaaggtttagaaattatcaaccattttacccaaacagcaaaaatacatttatgcatttactatctattacctttcgtgtatctcttctttaccatttttataaataaggtattacagcttgaaattactgattgaaggaacacattactgaccattgaaattttaggaatttggttctcctatttcagtgcagtgtggtcactctaacaaatgcctcctatgtaggtttcagtggtcctttgagattagaaaaagctttggcagacaaacatcaaatgaaacatgatatccaggcagtcagaatcttgtctgaccttcattcccacatggtcatgataattattaaacaattagaccattgttttacaacaaagcattttcttaaaaaatgcaagtttactgtgtctctatattagtcaaactttaaactatttatcattgacattttgactttcatattttggtcagaatctagtctaccacagttttctttctctggctgtctctctctcttcctctccctctctaatggtagattacagttctcaaaattcttctagattgactaaaatcacaagcccaagatgtcagttcagataagtcagtcaatgttttactctttgatatgtattgttagtttgaagcaagtattttcactgaattttatgttctggggtattataaatcagaaacagtacaaagaaaatgacagcattacagggaaccaattatattagaaaaatagagaaattaatgtaagtttagattgcaacagatattaatatggtatgaagtaattaaattggctatattgcccacttggagtagcccacttcccactaaattttcatgattctgataatatgttcactctactgcatagtctgagaaatttgaatataagatgtgagaatcactaatttagataaacactttgatattgaaatactgagga

SEQ ID NO: 39606 - DNA, 2681 bp, Bovine  19866880602361
ccggtttcagtataataagcattcacaatatctaccatagggttgcagagagtcagacaggcccaaatgactgaacaacaacaattatttaaaactcttatcattagcttcacacttttttctgatatgttggccctgaattaatatcacatattgtttttggaaacttagatatttgattccatttcataaactttacatatgcacatttataattttcttcatgagaattgtcaagtaattcttgtaatagggaatagattgtaaagtattcaaaattttatgagttataaattttcattctgaaatttctagcaaaataatttacaggacacaaattttcatcttttttaagaaacttgaccagattagctaagtgtaccaatatctcaaatggtttcagaaaaaaaaatttgtgtccttccaaattactggaccaaataaagcaaaaaaagccatcattttttgtatctgtttctcatagcaaaattttacaagtgaacattactctttattataattttatcttttatattcatttacgactctagggaataactttcccatatacaaaactgcctataacaagattggcatgaattgctggctgctcctttcaattccaaatgactgagattttccaacagaatattataaaatgaaaattagtttacaataaaaattcaaccataaagagacctgaaaagtgctttttcatctttagaaaaaaatgtttcaagttagaaagttgaagttaaatatatttaactgtggcatttttttcccttccaaatgctgacattctaataaacatgctgtgtcagaaatcatcaaaagctaactactagttaagagttacaagacagatgcctaacactgttagttgaaattagtttgcaatctagtctcatttgtttatttctatttaatatatatgcttcctacattcttaatcatttagtaagaagacttcttaggcctaaaaaatgtgaataaaaatttataaaacattttgaaatatgcatctattttaccatgatgatttttacttgcaagtattttttctatcacagttaatgacatttttatcacatttgggacaatatgttagcattataacaaaacattcaccatgcaattacatttcataaagtccttgagttccacaccttgagtttaatttctcatctttcctaattctaagcattcactggtttacatgctcatagctcagttggtaaagaatcctcctgcagtgcaggagacccctgttcgattcctgggttggaaatatccactggagaagggataagctacccactccagtattcttgggcttccctagtagctcagctggtaaagaattcacctgcaatgtgatcgatccctaggttgagaagatcccctggagaagggaaaggctagctactccagtattctagcctggagaattccatggactgtatagtccatggggttgcaaagagttggacacggctgagcatttttcactttcacttttatgtatatataacttgaaaatttaaaaatagatgttaaaaataggaacgtaaaatgtaacttgctctttgaaagcagaaaataatgtattccattaaacatctgggtaattttcatgctttatgcaaattagttcaaaagtaacaaaagtagagaaaatgtgagtagatgactatttcaaagtgcaaatgaatgcagtttttttacacattaaggaatgtgtgcatacacttattttaaaaacctattacacaatctttaacagaaaacaggattttcatattttttgctacataactataggagatccaacaataaaatactttcacctggaaacaggatgaaaaatatgacctaaatcatttcaaacatacaaaataaagagcagtatgggatcaaagcagaaacaaaatccagatttaagaattctacatagtattttaatattgcagagaatataaataccattttattttccattttaatatttgatcctttcttcaccaaccatctctcactccaaaaggaaataactttgaggagttccactgatcactataactttactttgtaaaataagtgttaaattccttatatcctacattaagtcttatatatcgtttttattttattctataaatgtgaaaacaatgcagttatgatgcattttgaatgactttaaaactgatatccccaaatgatattcaacatgtacattctaaattatctacatcttaaccttatgtgatacatatgtatcacaaccagaataaccgcatacattagactatatcattataatcttaatgttcattttttattgatttagaacttaatgtttccaatattgacttttcttggggtaagttttcataaaaagaatattgccttgaaaatcagagaaggcaatggcaccccactccagtactctcgcctggaaaatcccatggacggaggagcctggtaggctgcagtccatggggtcgctgagggtcgaacacgactgagcgacttcttttcgcttttatgcattggagaaggaactggcaacacactccagtgttcttgcctggagaatcccagggacgggggagcctggtgggctgccgtcttctggggtcgcacagagtcggacacaatgaagagatttagcagcagca

SEQ ID NO: 39607 - DNA, 748 bp, Bovine  19866880823542
agccataaagcttttcgctgcaaaattacttttggccacatttgccataccattttctcttctttctgtccatgccaatctcttccttttgattcttagataactttccacattagagaaatattctaatttgtttcataaaaatgaattcccagaaaaatggaaatcatagaacacagaaataagcttactaaagtttactgcaataatttgagttggcacagacatcagtcattcttggtccttaaacagtgagatggggaatcaaccaagggattggatgagctccagtttccatggcagggcaaaagttgaaagtgatctggttatagagatgccaaggaatggggactacttaaacaccatgtctgtagcagtgcattactggccatactttttttctaatccatgatggacagaagcatttgtaaaattgaacggaaatcaattactaaaaaaaaatggtcatgcatttaaatgtaatggcaatgtcaaaatgctctaaacttttccaaatacttatattcatctgctgtgcttaatcccgaggtagaaatcagtacaatgtcctgcattagttcatgaaccacaacttgagtagtattggtctataaaacatattagtctgaatcagtgataagtagataagaaagctcttttaaaaaaagtgaacaaaaaaacaaaacaaaatttttgattttgtagtgcttgccaatttttcataacaacctccatccatggctgattt

SEQ ID NO: 39608 - DNA, 1412 bp, Bovine  19866880964065
agttggtgatggacagagaagcctggtgtgctgcaatcctagggtcacaaagagttgaacatgactgaatgactgaactgaactgaagtgatgaggtatctgaaatactgtcttttcccttattgtatcttcatttactgtatcaatccagttcataatcacttcattgatgatctatctcctagttcactttagtcaatgtttaagcagatgttaggttactagttataactatgtttctttatatagcaattgtcactcctcaaactgctacccctactcttgcttaaatagtgtttccactgatgagaagactatcatagtgaagagtcctcagcatcacaacaggatcttcagtgtttccattaataattatctaagtaatttacttaatatttccaagactaaaggtcttcaactttaaaatagcataagtgatatttcattcattcatttttcaaaccatctagtctttcaaacatacatacattcaataaatatctattgttcactgaagtccagagtctcaactataagtaagagataaaataaataacaataaaacttcatttacaaagaacactattctcaccattcgtatttttgtttatatttcaaagcaaatcaaacacagacaaatgagtttaaatatagtagttcaagaaaagtatattatcaaaatcagattttcttagatacccatttaaacctttatcctttgtccatctaaaaacagtatttttctgacatagcaattaaaatttttttcgtttattagataaaaacaataaaaatgtactcattatggtttctccagacttacttccctagaatagttttgtaggaaacattaaagaaaggatcatttgggggtgcttaattttcaggtgtgacaatgactaatacaatctttgttttaaacaaatttttcttgtccttgccaatgcatactttaattaaattgatatcaatgaaggtaatacagcataaaacattacagtggatttaatgttcactaacttaatgttcactatactatttagattgggataattaaacctggcatttttattaaagaaaaaacacatcaatttaagatttatctttaatgaatttatttggtagtaaaatctttatcattaaatatttaaaagagcttatgaatatattttattccctcaaatatactaatgaatttttaatactaaacaaatgttctgttttatttcttttttctcttcttgctctgtgtatgttttatttcatctttccaatactctttattaatgtttaaaattgatttcaacagactgtttataactcataagaaaccttaatgtggacatcttttcttttttttttctgtatagatgaaatagtaaatcctggcttcacagactttaagactaaag

SEQ ID NO: 39609 - DNA, 1294 bp, Bovine  19866881310321
atgaatctagattcctaactatgtaactgtttctcaagcattccttttagaaacatttttttggagttatagacaggaaaacattttgaaacaaatgccatcattttactcacagagcatctaaagcttctatgatacatgtccgtgtgaacttgaatttattctccttggcagctgagagtggaaataattttaatatatattacaaagttattcctcagagctcataaaacaaaggacagaagatttttttctaccagtcctttcatttataactttcaattttctgcatttctattatgattatgatgatcaattcttctataaagaataaaatgattattaaaccttctaaatgaaatctcaaaaattaacatgcctcttaaaaactcttaacttcacattatttgtttttcccaattcttcttgcatacatttcattgcagcctactcctaaaacacactttcagtaaaatgtattttttctaccatgaacttaattttaaaagtttgcatttaaaagaagacaaattaaatacagcagaatgttaatggtgattcttctttcttgttgatatttttgacctcttctcattcttttgttttctaagttctctataataaatatgtattactgttattatcatgaaattcaattattaaaatgaatctacgtcatcactataatgctcaacttgaataattgaataaacttgaaaatttttctgttccttactattttaagcattctttttccttaaataggttatattcaacttatctcttttacttcatgtcctctcatacaggcaccaagagtgagttaaatttgtcagttttttattagggagatatctatgcaaagtgaaataggacagagtcagtagaagttggatagctctgggacctcaaagcagatccaatcccaagtgaagagggtgggagagattgttgggtgcaagcatcctagactgtggagtactctaaagacaagccaggaaagtcattagggattatttggattctgtcttcctttttcttcccaaatgaaatgtacattaatatcccttccacactgtcattggggggttgcctggtggctcagtggtaaagaattcacctgcagtgcaggagacagagacccgggttcaatccctgggtcaggaagatcccctggaaaggaaatggcaacccactccagtattctttcttggaaaatcccactgagagagaagcttggtgggctacagtccttggggtcgcaaagagtcaggcacaaggagcaacaagacaa

SEQ ID NO: 39610 - DNA, 792 bp, Bovine  19866881449261
tgagccctttgcattttatttacattggaaacactcatattttgaatacattagaagtatttttaaacattacacaaattaaaatttgattttattaggaatgttgatgttatataactttaagtacaaaaaccttattttagtattttaaatctttccccaaactgaaaattttaaaatagtacaacttcatttagtagaagaataaaataaaacatttttaatatttaaaataaaaatatattttgtctctgctacttatttttaagatttaactgctcttttttccacaagagaaattcagcgagaagtcatgaaaagtcataccaaaaatcaatatctctttttaattaatcagtagaaaattagttaactgaatttggggaaaatactgttgagggtttttatcctctctctttgtcattgccatatttttaatgttacagatgaaattaagattttttatataaatgtttagttttgacagatttgttttatttagcacattttattcactctggtaaattttcctttcactctcctaacgtagtccatgcaaagccccataaataaagtggttgctattttcactggcataaaaaggtattgccttgaagtggttaatcaaggtttcaacataaaaccacatacacaaaattttcagaatgtgaaaaaatatgctgtcagaagtgaataaagaaagaagtattgtaaagggatgtttacttttatgtctactgcatacagagcaacatgtttgagtaaagttttgaaggtaaactgaattggaat

SEQ ID NO: 39611 - DNA, 1596 bp, Bovine  19866881674580
tcaggatttgaaatagctcacctggaatgcaatcacctccactagctttgttcatagtgatgctttctaaggcccacttcacttcacattccaggatgtctggctctaggtcgggtgatcacacccatcatgattatctgggtcatgaaaatcttttttgtacagttcttcggtgtattctttccacctcttcttagtatcttctgcttcttttaggtccataccatttctgtcctttatcgagcccatctttgcatgaaatgttcccttggtatctctaattttcttgaagagatctctagtctttcccattctgttgttttcctctatttctttgcactgatcactgaggaaggctttcttatctcttcttgctctttggaattctgcattcagatgcctatatctttccttttctcctttgctttttgcttctcttcttttcacagctatttgtaaggcctctccagacagccattttgctttattgcatttcttttctatgggaatggtcttgatccctgtctcctgtacaatgtcatattaggagataccaaatgaatgaatgttacctaggataggtcaattactgttaaatattttaatcaactgattgagaagtagagggaaatatgttgattaccttaacagatgaggaaaagtaaaggaaattgcctattctttgaataggattatgatactgtactttcttgaaatcagagctctcttttcacctataaaaatcagatttttctaaagaaaagaaaaaattgttaatgaaatgaccagcaaatctatattttaagtaactattttttcttttctcccatacacatatccgtgctccctctagctctaacagtctgaaataaagtattgaattggacaaatatttcttaaaataaaaatacctagaatgattaaatattttgggaaatatagaaactatataaaatatgttatatcttacaaaaacaaagcctatgtaacatattttagaactagattttctccagagaaataaggcccaagattcctttttattaggcaattaaaattgaaagtttttgaagcacatttctggattacagtgaagaagagaaagaagaaggttgaagctaagccaggtacagtgatttataaatatcctatcgtacttcagttttgcaacaaaatgaaaactaaggagacattacaccagaaattgttctgagaatatgagcctttgtgtctcaaagtaagtgaagtatgtattttcataagatttttagtgctctgttaggtatagagaatcagactgtttaaattgttttaaaatgtgggaaaacaagttcatatattttactttgtgacagatttcaaacatatttataaataaaaatatactaaatttgagtagaatatcatttttttctagaattctagttgataaacatgtggtttgataatgggaaagtatcataaaagagtcattagtaatattccaataagtttacatttgtataagaggacattatttagacactggaaagacttgactcatttcatttcattattccatattatatatctgtcaagaagacataagatataact

SEQ ID NO: 39612 - DNA, 1807 bp, Bovine  19866880384695
aacaaatgtcacacttttcctactcccatgaatatactcatacaatcctaaccctagactgtccctttcccattgttcttatttagaggaatgaatgaactacgtggccatcagatagtctactgattaaactttggttcagcattggactgcaagaatgacttcatcctaacagataataactgatacagctagttagggattactatgggcttgctttacagatggcaaaactgagcatcagcagaataaataactcatccaaggtcatagagcttgttgatgggctgatgacctctttgtgatacttatttaaatgaaaattgtctttctcaaaaagactgtgattttttaaaaaaatcttttgactgtgctactgggcatgtgggatcttagttccccgactagggattgaactggcaccccctgaaacggaaatgcaggatcttaaccactggatcaccagggaaatccccagactgtgatttttgacattcgtgattttgatatttttggatatctgatgatactctctacacagagttcacaagaggttacattggtcgttttctgatgctcacagtgacaagtgaggtagaaagagaggagaggaggggagatgctttgctcttgacccttggaaagtaaagacaaaagaagtgaaaaatggtccaggtcttaagatggaagatatttggataaattaagaaaacttcatctgaaactgtacataacagcaactcctgaaacaaatagtctctgttttaataagcaacacaaaaaagcagtgtgaagaactagacgtttaacaaacctcccatctgtaatgaaccttcactgtaaaaggcttatagtcattatcggttttacccactagaggtcagcaaatccgcataatactttgccttgaggtctgcatgcaagtgtcagatttacaatctggtgagaatagcatttttataaagcatatcagagttactgatccttgtactagaagcaaaacacaaaacattgtaaaggaatttcccctgcttattcctcactcatcttttagaaaaaaattccagatagaaaggcatcagatgggacaggaacctttttaacatcttttttaacactttttaacataagctttcttctttccgagcagattttgataaaaaggaattcaagtttgctccagtcccacaggataaatgaaaaaccactgacccgattcattccagaggctgtaagaagggagtggattttctccggggtgtagccaattcctgtcctgtttccatttctctccagctacattccagtccaaccactcacagaaatagaggaagcagtgggtgaacaaagggtttgagaatatcctagctgtgtttttagaatttcaggcacagtactagttttctgtatatccctcagtttacccaccttttccatgagctacctccataaaagctttattaaggacttatgaatgttttctgagaaggaatcttatggagacattttcatcagctcttacaatatttctgctcaacaagcatcacaaagtcataaaataggactggaccttaaccggcccaaagaaaggaatttggatttgtagttgtgctagtgctgggacttcccaggtggctctagtgacagagaatctgcctgaaatgcaggaaacatgggttcgatccctgggttgggaagatcccttggaagagggaatggatgcccactccagtattcttgcgtgggaaatccaatggacagaggagcctggcgggctacagtccatagggtcacacagagtcaggca

SEQ ID NO: 39613 - DNA, 789 bp, Bovine  19866880398502
gacagaggggtctggcgggctgcagtccatgaggtcgcagcaaagagctgaacacagcacagcacgcatggatatcataaccagaaaccaagatcagtggaattttagctggtagccacaagtcttgaagtttgattttaacagctccttaccccctgcagagagaaaggcaggatgagaaaactggctcttgactaagtagaggattctgaatgttactgaacagaagactgaatttgctgttccccttcttggttctcagaatcacacactgcccacctccccaacaaggagactccagcatcggggggtaaggataagagaaggtgagagaaaacaaggcagacagagcaagaaaaacatcagccatgttgccaaactaacaactaaatccatgacacgaaagaaggaaactaatagctaaccaagacagaatggaataaacaaaagatcacgtcaaaacagaataggcctcctccctttgacacaccaaccaaacaatataaaagaaatttaaactataactaccttacaactatatgagagcctttcattacgaaagttagaaaatgaatggtgactctccatgactgaaatttcagaggctgtttttaatccaaatgaatattttaaagtgtgtggacaatcaactgatttttcaacgaccttgaaactatgcgatgttatcaaagtgaggtttaaaataaataatatttacattttaatggttagttaaaagttaagtcttccagaaacataatcaacctatcaagcccacaaaaagaaaat

SEQ ID NO: 39614 - DNA, 1763 bp, Bovine  19866880489388
tggacagactcctctcccgagtagctgtgagaacacaagaattcagctacaaattcgcctgcagaaatgaatattttgttgctcttgtgcatggcgggtggggtgggagggaagcaactggactggaggcctaagtgaatctcagactgtgagtcttcaggtgaggctgtacaagtatgggaaaagtgtgtgtctgaggattgggggaggcggtatgtgtgtaaacatatctgtaagacagcccagtgccctccgaatctgtgagaatattcatccttatggtttgtcaggacaagcaggaaaggagtgagcacaaaccaaactaacatcaagatgtgcctttctgttggtgtggccctgccctgtctgcactgcacaaatgtgaagacgtgtggatttgttttgaatgattgtatacaattgtttaagaatccagacaaagaaaaacgttctcatatttccattaaaccttcttggcttgagacttctgtttattcttgccacctctgcttaatctcttctgcttctgttaggtccttgctctttctgtcctttattgtgcccatctttgtgtgaaatgttcccttggtatctccagttttcttgaagagatctctagtctttcccattctattgctttcctccatttctttgcattgttcacttaagaaggctttcttatctttccttactattctctggcttgagacttaggttcattagaaattatctgagtctgggatttcccttggtggtccagtggctaaaagtctagctcgaaatgcaggtagtctggttttgatccctggtcagggaactagatcccacattttgcaactaaagggcccacatgccacaactaagacccagtacagtcaaattaattaatttaaaacaattatctgagtctgggctctctcctgactccacactgtatatatataatcttgttatacctttgaggtatcacttacccaacaggaaacagatcccacagccaagtctctggaaagtactggcgaacctgagactcttccggctgaactggctggaatggagctggcttgaaagccattggacgagcttcattcactgctaaggagaccaggaataagggaaaaagcagaggtgtcactcaattgtgtcacgcaataagtcaaagtagagggaagacattcagagggaagcggaaaacatgcaagtcatagatgaggtggaaggaccactgaggaactgactagtcacaaggctattggggaaagtgacaggtggggatgtttgcccagagaatgaatagataagaacttcaggcgttcaaaagccctccccatagaaagagagtgaaatccttggggaaacgtgcctgcatctataacccacaatccattatcatcctggctagaggctcagagcaagaagaggaggcaaagagggagctttcagagttccatgattctaaatatttcagtgaatcagaggcagcttacctccagccatcgtatggctgtatcttaaattctggtgactgcaatctattggcctcttgattttggcattggacagtattttcaggcccatgttctgataggcaccaaagggaccagagaatgaagtgttagagggggtcctctcccttactacaagggctactgcttagaaatttcaccctcaaagggttgaaccaacacattctttgcctactaattgtgagacctataccaaccaccaagactggttcacttctattccagccagcatgaaag

SEQ ID NO: 39615 - DNA, 1290 bp, Bovine  19866880560622
cacagggaactatatccaatctcctgggataacccataatggaaaagaatattaaaaaaagaatgtatatatgtgtataactgagtcactcggctgtccagcagagattggcacaacattataaatcaactgtacttcagtagaaaaaaatgttttttaaaaaaggttgtaaggatggattttagtggacattatgttacagggatcataaaagaataaaacctagaggtcttcaagaaatggtgtcagctatctgttgtgaagaatggtttctggttccaaagccatggtggcctgtgtctcctcccacccaccccctggtcctttgcagacccccaactggaggaagagtcatcaggattctgggtaccatccaacatttgacaaactgaaggatgctccacaaagtacttacctggactcttgaactatgaaagaagcctctccttacagagagatgtaaggattggaccaaggctaaactcctctaacttctatgttgttgatgatttttattttttctcttctttagttaatagggaaaggaaatttggagatggaggggcagaaacacctgaagtccgggatgaaaagtgagtgttcatgaatctcttgggagacttaaactttaaatttccagttgagttggtttataatgcttttcagatctcctttgtggtagtttccttctacttttttgtatattcattctattaatttttgagagtttgatattgaaactccaactgaaaatcttcatttatctacttaaaaatacttgcaatatatagtggaactacatgtaacttcgttctgtgttttccaagtctcctgtaaatttacattacatttgtaatgtaaaattgtttttacattaattcaacaaacaaaaaagaaagaaagaaaaaaaaagagagacaagaaaaaactttaaacttctagaaaacagttcttatactagaagcaagagcaggagtagcaagaacagaacaataaccacagatcagaaaaatgaggaacaacttgcccgtggctggctcagggagaagtgcagacacaggttggatgtcattggtacacataagagcgtgtactcttatgcctgaagatcccctcttctctttcaggactgaaaggctccttctctctcccactggtcttcaactctagattagcccctgatccttccctggtggtctacgctgtttttcccaatggaggtgtcatagcagacaaaatccagttctcagtggagatgtgctttgacaatcaggtaaaaggcagttaagg

SEQ ID NO: 39616 - DNA, 2713 bp, Bovine  19866880570124
aacttgagttatgttgataatatttctcaaaaatcataaaatcattgctggaaaggactatgtgaacaactatggtttattttgtacccttaagtagataaataagtgcagattgttgttgctgtaaataacataataaaaaacaaggtcaagagtttggggctggggtcagaagactagatttttgatccagctcatattttcttatcctgtgactttgaaaaatcatttgactttttgttttctcatatgcaaaattggaagcagaatccttaccttggtcacctcgcatgattattaatcaaatgatattttgcaaaagaaatttgaacaagtaaatactgaagaaggaaaagtgtccccagtcttcaaagtcatccactttgaatttatctgtggttaagatcttaggctttcccttgtcacccagtaattgaatggagcctcttgatgttagcaggtgttcagaaaatgtgagtcatgactaagtacggatcataattgtatttgcactatcggttgcctacctttagtgtgggaaatcaagattattcttgtatgcatatgtggttcttagttgtcctaacaagggaacacaagctgttataaaggggtgggttttagttggtatttctggtataccagagctcatcctgcggggttaactaaaaccaacttcactgaacttggttccatgcttccacagtgcccaggtctgtctctgcttttcccccaccccaaagctccttttcccttgtccatcctcaggtaattggatcatgctgatctataaagggggtgatgaatatgacaaccactgtggcagggagcagcggcgggcagtggtgatgatctcctgcaatcgacacaccctagcggtgaggcacctcggggcctgggagcctagagaggagatgaaaggactgacctgaggtgggacagaatgtccagagggaatgagataactggggtggatgagagaaaaccagacatccagggacttccctggcagtccggtggttaagactccccacttccagtacaggggacatgagttcgacccctggttggggaactaagatcccacatgccatttggtagcagccaaaaaatttaaaaaaccagaagttcagtttttccctgagtcataggcgtccatcttccatcatacatggaaaataagttcttaaaccaggaggaagcaaatgtttaggggggttttgtgggtttgtgctccttttcagacaagcgtcagaagcaaacaccttaccacataaatgttgtgtctgtcctcttatcgtcaggacaactttaaccctgtgtctgaggagcgaggcaaagtccaagattgtttctacctctttgagatggacagcagcctggcgtgttccccagagatctcccaccttagcgtgggttctatcttacttgtcacgtgagtccttcttcctttatcagtccaagcctttttttttaactcatcaatcacttggaagtatatgggtccaaatagcgtgtgtgcatttgtatgctatattataattggaggggaaagaagtctgtgaatatcctctttaaactctgcaagtttaaaaaaatgagacttaatgttttatccccaataaatatatgcatttggagatagggttttttccctactggaagactagacagtttttattactctcccattattagattattagaacttttaaagaaattggactgtttatctaatggtgactgttctcaaccctaaatgagtcacacactgtcttgcttttttctgatccaaaggttttctcaggcaggcagcactctaactggttttctcaggctctaccggcccccttttttttttcaactgactactccttttttgtttttccatttttatggaacagagcttaggaaacaggtaacaatgagctttactgattctcagtttttgagtatggatgtctttctccctcacaggcttgcatcactggtcgcagtctatatcatcggggggttcctgtaccagcgactggtggtaggagccaaaggaatgggagcagtttcctcacttggccttctggcaggatcttggaaacctggtagcagtaagtaacagggcagctgggagacaaagcagatgaccaaccatccgtcctggtttgcccagaccgagggtttcctgagacacaggacttttgggtgctaaaaccaccccaacttccagcaaaccaagacaactggttgccccaatacagggtaataagcaacatagcaccttaatgtctgaccttccagactgactggaagaacggtactgttgctttgatttatgaatctgatccagctatttgggggcctacatgaggagagcgtgtttccccaaattcagtttaggccaatcactggagctttggggttttctcttcattatccctggagaaaactagttcttgccaccttctcagaccataaacactgtgcccacctgaaagttgctgatttcacacgatcacttttgttcttctctctataggatggctgtgactttgtatgccgctctaaaccccgaaatgtgcctgctgcctatcgtggtgtgggggatgatcagctgggggaggagtcagaagaaagggatgatcacttgttaccaatgtgattgcactttagatgtccagcttcttcagcccccaaaccaaagcgtcctccggcagat

SEQ ID NO: 39617 - DNA, 843 bp, Bovine  19866880584033
atcattgctaaacaatgctattaaggtgatgcctttaaatttgttctggtccctgagaagagtgaaatgtatgagttgtgatgctcctatggattcctcaagtcctggtgatataactttgagaaggacagcagaagcaaaagcttttgaaacctaacgataaattaggtgtttcttatggttaagaaaatagcatgtccaaaaaactccactatgtcactaaaaatgagggaaagttatttgggacagatttcagaatttgggggtgaaggaggaagcagaggaaacaataatattgccctagaaaagatacattctggtgaagattaaccaagggggaagttagagttagctgactctgggtgatggctactggagtgtttgagtgtctctgcctctgatcctacagggtggggtcgatgatgaggtaacgctctctgcctatatcaccatcgctctactggagatgccgctgcttgtcaccgtatgtaccgccactcccaacctgtacttccctctaatgtaaggatgaaactcgtggagctatgaatctctgaggaaaatgagttgttattttcacattatttaatattagtatatttcactggcgcataaaggacgatagatcccttgggaagctgcaaagaaaattaccctctggtcaggactgtggtgttgtgcaagcacattggggcattatatctgtggctagccaggggacagttcattagcctggttcagctagcctaaggtcttccttcattttcagtaagtcagaaacagaaaaacaaatttcatatattaatgcatatatgtggaatctagaaaagtggtacagatgaa

SEQ ID NO: 39618 - DNA, 2279 bp, Bovine  19866880628813
agaaatatgggtggagtcaatatttacaaagtcctcaaaggaaactgacatggtgtatgacatatagggtgccaggctcatacacaaagaaaattgtttcctggcaggccaaggatcttgggaatttgggcgggggaggcttctagaggagaggaattcctctgactttgtagttactgcaggtaataacacaagttttcagttcagtcgttcagtcgtgtccagctctttgtgacccagtggactgcagcatgccaggcttccctgtccatcagtaacttctggagcttgcgcaaactcatgtccgtagagtcagtgatgccatccaaccatctcattctctgttgttcccttctcctcctgccttcaatctttctcagcagaagagtcttttccagtgagtcagttctgcgcatcaggtggccaaaatattggagcttcagtttcagcatcagtccttccaatgaaaattcagtactgatttcctttaggattgactggtttgatctccttgcagtccaagggattcttgaaagtcttctccaacaccacagttcaagagcatcagttcttctgtgctcagccttctttatggtccaactctcacacccatatatgactactagaaaaaccatagctttgactagacggacctttgtcaacaaagaaatgtctctactttttaatatgcttttaatctgtttttaaatacgtcatagcttttctttcttccaaggagcaagagtcttttaatttcatggctgcagtcaccatctgcagtgattttagagcccaagaaaataaactctgtcactgttttcaaattctagaggttcttaaaagtttaaaccaaaatactaatttgaaaagatatatccaccttcatgttcacttcagcattatttacaatagctaaattatggattcaatctaaatgtccattgatagataaatggctaaagaatggcatattacttggctaaaagaaaaaatgaaatcttgccattttgacaacacgagtgaacttagatgtattatgctaagtgaaataaatcagacagagaaagacaaacactgtatgatcttatatgtgtgtgtttgttgttcagttgtgtccaactctttgtgaccccgtggacttaaccctacgaggctcctctgtccatgggtattctcctggcaaacccactggagtgggttgccaattccttctccagggcatcttcgtgacccaggaatcaaacccaggtctcccacattgcaggcagattccttattgtctgagccaccagggccaatccaacttgtatgaggaatctaaaaactcataaatacagagagcaaactggtggttgccagaagggtgggtggggggttgggtgaaacaggtgaaggaggttaagaggtacaaaactggttataaaataaatgtcatggggacgtaatacatagcataaggaacatagtcaataatactgtaataattttgtatggtaacagatggttatgagacttactgtggtgatcattttatatttaaatgccaaatcattattatgtatacctgaaactaacataatattgcacatcaattatacttcaattaaaaaaggaagattttcagcaatacttctgctttgtattaaatactaataaacgttctttgaaaggctgtactagaacagattaaaatttataaatcagtctgtttacccacatttgcattgaagtctagcaatattcatgactcatagatttattaatttatatcatgaattattttattttctagagtgggttgccatttcctcttccatgggattttcctgacccagggatcgaacccgtgtctccttcgtgtcctgcattagcagatgaattcttaccactgagtcacctgggaagctggcaaattttacctcaagtcctaataaataaccaaaattccttcttcttatttctctgactttggaaaagtatgaaaatctgttttatgtgtttgtgaaacagtaagcaattcaagtcaggtttgagtgaaaatgatctttctggctcatgttctctactggtatgtcctaaaacctttgcattattccatttctcctctatctctctgcttgagggaatatgctcactcagcactgacccatttttttcactgtcttctatattcccagaactgtgttcggtgaacaggtggcagacatgattaagatacaggtctggctttcaaagagctctgactgtacagaagatggggaaaaaacaattttttaagg

SEQ ID NO: 39619 - DNA, 1429 bp, Bovine  19866880629848
gcacttgagagcagactagtgacttggggcatttgcatatgaagtacagagtactttacttgtgctgggattagtttttcctctgtgcctcaaacctaggatggggggggagagggagatctcatgacacttatgatctcactgtttttcctgtagggtcaagaggactctagccggggttcagataattccagttacgatgaagcactctctccaacatctcctgggcctttatccgtgagagcagggcatggagaacgtgatctggggaatcccaacacagctcccacccaccccagaattacatggcatcaaccctgtgttcctatccagtaatcctagccgctggagcgtagaggaagtctatgagttcattgcttctctacaaggtatcaagggcctgtctgccagaacctgggtcatctgtattgctttgttttcctatggtttttttgaggccatcccacagggctttgtagatggaaatgtagaggcctaagtatggtatgatgaaggtcccccagagaaggaaatggcaatgtactccactgttcttgcctggagaatcccgtggacagaggagcctggtgggctatggtccatggggtcagatgggactgagcatgtatacacgcacgcacttgacaagggatagttttctccagaaaggaaaaccatcctacccttctcgctattttgtctgaattttgggcccttagagatggcatgaacgctgattttcttggcagtgtcaaagaaaacactgtattttgctctctcctttcccttcctcaagttatctgagttgaacagcttagttggtggaacaccttagttcttttatcttggctctttttttaaaaaaatagctagttgctctggtttcattttgcttccatatcttgacatcttgggccactgtatcactggatttaggacaagtacttttggtgctaccatgtagcttctcatacataccccaccgtttcctcctaggctgccaagagattgcagaagagtttcgttcccaggagatcgatggacaggccctcttattacttaaagaggaacatctcatgagtgccatgaacatcaagctgggtcctgccctcaagatctgtgctaagataaatgtcctcaaggagacctaaggtggccctcttgcacaaaccagcctaaggcagacactccccaccgtccaggttataacctggtgccagcagagactccatgaggaagacagagctgtgctgtcttctgcaggaggggatcaccgagacagggaagaaccgtgcaagaactggtcgctggtgctacatggtggcagctttgacgtttctctgggttttattttttaaatcttctcaattctcacctaccctaatccaatctttggaaagaggcagtctagagaactaggactgctcag

SEQ ID NO: 39620 - DNA, 1636 bp, Bovine  19866880657094
ttttgacagtttatttatttagtgtatctttctagtttgcgtaactgagaatttttcaagagtaagtttaattgtgtgacaatcaagtaccagtaacaagaatcaacaactctcttgagccagggtactgttttaaatgaggattttgcacaatggccatgccagaaaatattgttatcagcagattcttgctttctctggccctcctccaacaccaaaaacagactccaagcctgtttatacagataataataattctagatagatattaggagacttaccaactcattcagggggtgaaagctttcgtccaacaagacaatacgaaatttcactgaaacagaaatattttccgtgagtcccagaaaccttatgccaggtccgtaggttagtaagacaagctattaaggaaccagaattcctttgactgggaaacacgcaagagaggaagatctttcttttgggaagttgtcctgactacaggcctctgtacctgtctgctctggtttatagatgggtttgtctgtctggacaaagaccaggctctcttcgtttttaaccaacactgtggtccgcttcttgaattcttgggttggtcctttcacttggatggtaaggaacattacctcttgactggttggagatcttgggagctgaaatagaagagagaccctgaaaacccactcatttcccaagtttcctctccaagtccctctcctacttctccctaggggtcttgccccttttaatttcactggcccattctcatcggagaaagctgtcatggacagaaattcatggacaggatgacctctgtcacttgtgaatgggaagacagaacaaaaggtggaggaaaacataacagtgagtgaggtcataaatgagattcacatctccttgtagatcagccagaacagtttttaaaaaatatttttgctcaatttattgtttttaatttttatttatattggagtatagttgatcaacaattttgtgttagttttgggtgtacagcaaagtgattcagttattcatatacatgtatctattctttttcaagttctttttccatttaggttattgcaggatattgagcagacttccttatgctatacagtagatccttattggttatctattttaaatatggcagtgtgtacatgtcagtctcaaactcccaatctatccctctgccggtaagtctgtgagtctgtttctgttttgaaaatacgtttatttgtatgattttttttttaagattccacatgtaagcgatattatatgatatttgtcttcctctgtctgattttcttcacttacgctattagaaaggaaactgcaatattttattggctggatgctgtaaggattctatacaactctgaagagatactggctgtacattcatggtgatttccacagtttcacgcttagaaagagtatgggatgatgtgttctgtgttccagtcagcccaccactggggcttatgttgaacattggcctagtatgttttattagtcttttttccattttcattttaaggagaagtcacactttccctttgtctagtttttactgtttttttttgttttgttttgttttgttaagaggaattttcttcaatcattaagctca

SEQ ID NO: 39621 - DNA, 994 bp, Bovine  19866880665538
atccccaaaggtgctgtaagaaccatcactgtgcttatagttcaactgtctttggtaacctgaagaagaagaatgtttgcatagatttaggaaataacagagacactggagaaggaatcaggcttttccttaaaactcattgagaaatcacagggaagctactattttactacaaagtctccaagatttgagtgatgccatttaattctgtggttgtattgtgaaacatcttgttggatgtcacagcaaaggtaattgctaaatcttaattgaagggacgtagatttgagttcaatggaggagatatttaggaaatcaactaatgtttttcctttgggggtaatctctcaccactgatgaggtagctgatggctttggacttgatcttctcagtgagctgtcctgtctcatttagatagttcagaacgtagatgttaggggtgaaaaggaccatattctgttctccacaaccatagggcatccggagaagattctgaagattttgcattgcagagcctagtatatcacctgaggaatgaaatacagaaaaaaaatttagaggaactcagttgattgatgttagggtaggaaaataaatgactagctaagtgagaagccaaatcatgtataaaggggaggatcagaaagcataagaggtgaagaaaaacaagaatagaaagagaaatgtgggaacaataaagtagatgttcaaagatgggaaaaatagtaaaagaccaaaatggcaggatatacttttctgatgagtcacacatctggtaaaaaaggattagtttcatctctagtagaaagcaccattatctagccaatatcttgaaggtgagagcacaaagagatgactctccttactctttagagtatatcaaggtttaagatgtagcacagcatcgattcagcccctctttcccactaatacacagtgtggttcttggtgctttctctcagtccaatgcctagacacagggacttcattagg

SEQ ID NO: 39622 - DNA, 1625 bp, Bovine  19866880699018
aaaattttgatagtaaaaaaaccttcagtaagaggtattccaattggcctcattgaaaatttgaagaaatgggcaaactactattaggacatattaagtagtttcttgttattacactcagcacattcttttgttatttttcctattagcccaatattttatttcatttaatttatttatctatgtattattttcttttttagtatttatttggctgcattgggtcttagttgcgcatgagggaatctagtttcctgaccagggatcaaaccccagacccctgctttgggaggttggagtttagccactggaccaccagggaagtcccctaactcaatattttaaaaggtttcacttattaatgtcgtttgtcacacagcaattaatttttcctaatttgtattcatcagagaaaatatagctcttccttcagaaactgtgttcatcttggaaaatgcaatgttacaacagatacaattcttttttttaaatttaaatttatttattttaattggaggctaattacaatattgtattggttctgccacacatcaacatgaatccgccacgggtgtacacgtgttccccattccgaaccccccctcccacctccctccccgtaccatccctccgggtcatcccagtgcaccagccccaaggatcctgtgatacaattcttataaaaatttgatatttcatttagcctgtgcagtcttagtgcccgtatatgtaccacttatgttaagactttttgaaatattgaaactagtttgaaaattcttattattgggttcataaagctcttcaatatcagggattttggagtacatcatttatacctatatattcatatgtattatcttccttaccaaaaaaaaaaaaggtgcacatgaaagagctcaaaatgattaactcctagataaatataagtttaatagaacccaccccactctccttgctctgagttgcccgtggggcccttcctggcccctggggctcacagaactcaccgtggctgctgagagctcagcttcgggcctcatgagcagcacactttggtccacggcgcggagggcgcagagggactgaggggaagcggtgactcgaaggtgggcctgggaggccgggaaactttgtccggggctgaagttcaaacccacctgtggaattggggacaaagtcagaagaagaaatttcctgattgatccatggattcaccagcctttcctggctgttcctcaaatttggtgcaaaatcactttgactttgttgatgtttggcgccacgtgagtcttgaggcctttgattccctatgtgtcactctgatattcatcagttgagccattatagtgatatctatttttataagttattaaatttgagactccactgtccacctttgatacatgatgaggtgttcattaactgtggctagaatgcaaatggttctagacactcttgtatttttctttggctcttttgtagtcttaaaacttggttgcatatttcccaacacttcaccataaaagaagggaacaaggtactgtgaactgggtaagagataatgcatggggattttgtgctaggagtcaagtgacatggcttctttctttctttttttaaat

SEQ ID NO: 39623 - DNA, 1456 bp, Bovine  19866880740877
ttttattgcttctttgtagcaacgtagaaagcgctacagtagacttagagaagcttaatgtaacttctaacaaatctatttgctaagctaagccacttcagttgtgtccaactctgtgcgaccccatagatggcagcccagcaggcttccccgtccctgggattctccaggcaagaacactggagtgggttgccatttccttctccagtgcatgaaagtgaaaagtgaaagtgaagtcactcagtcgtgtctgaccctcagcgaccccatggactgcagctttccaggctcctccatccatgggattttctaggcaggagtactggagtggggtgccattgccttctccagacaaatctatgtatgtgtcaaaaaacaactttcaaaggagctcagtactcctcttaagaagaaaaaatagaatatttggttcatagaaagttagaggatataagggtaaacacaatgcattaaactcttactattatatctcacaacttcaagttctatttccttctccactgtgaagtctagatcaaatggaagccaagcagatgtctccacatccttagataacatcagaattttatacagatgaactcaagcttaactcaagcttaaacctggggagaaatcatcttgtgattttcagagacgagaagactttgataaagtttttttaagccagagttcttagaggtagtcatccatttattgcatctactatttcttatatctggtacatctactgggcttccctggtgactctgtggtaaagaaatcacctgccaaacaggagacttgttttcaatcccagggtcaggaagatcccctggagaaggaaatatcaaccccctccagtattcttgcctgggaactcccatggacagagaagcctggtgggaccaagttcatggggttgcagtgagtcagacaggacttagcgactaaataacgttactaatagtcattagccaaaccaggcttctaaaatgactttgtactgatacaacagaaaagcattattttagccttgaattctcacccatgatcacttccttattgtctctgtgctccagtgcaaggccatttttccatgtcagtccccgtggagtcagacattgctcctgtcgctaggctgctcatctatgccattttacctgatggagaagtggtaggggattctgcaagatatgaaattgaacactgtctggccaacaaggtgagtgtttcatatggtaaaattttcaacatttaaaactagaagttactatcactatcaattattttctacacttgcgcattggggtcaaaggggttaaatgaattctccagaaattttcagcaaggtaatggcagatcacactaagaagccacgtcaagagaaaaacaaatatcatatattaacacatatttttgaaatctaggaaaatggtacagatgaactatttgcagg

SEQ ID NO: 39624 - DNA, 744 bp, Bovine  19866880787138
actgcttctgcataaagtacctgcacatccctgctgaacactgggctaagcacgtgctctccatcatagaggaacgtgagacagcatggccaaataaggccaatattgttaaagtacagattagaaccatctctcagaggaggttatgatacatgtatcccctctatattcagtagtaatataaaaaaaaattaatacaattagtaagaggagattctttaataaagttgttttctcaaggcctttaagtttcttctcatttaccttttgttaaatagcggtgtcagcctcttcaggagagccaactctttctctgattctttacccttttctcccaccaggtcgcatgttttctcttctgtctgccaagattctctgactgccacagagaagagcagcagcagcagcaggccggtcctccaggagctgtggaggggggacatccttttgggacaaggagtgtgtgtttcggggaaagagggagaggatcggggaaagaaatagagcacatgaatgtgtaataaatgaataacactttttttttaaacctgttaatcttccacccaccacctattactttatactagccagttttcttcattatgatgatgctgggctttattttcttgtctctatttcaagtttttttccccattatctaatatacaggattggatgcttaagtcaggtttctttttcttttcaaaacttttattatcttttaaaaataatttcatttatttt

SEQ ID NO: 39625 - DNA, 1057 bp, Bovine  19866880804687
ttgttccctgtttggttttccctcctcagagatacagctgcaggacagagataatagggccaatcacagtagaggctgttgcactgtcttcataccagaaagtacaagtagaagagttactgtgagcaaaagggtgcggcaggctccctctcttttttaaacacattttcataagtttttgagacactggatttaattaaaaaaacaaaccaagaaacattatttataggtttgattgctttcatgctgttactctgccctacagtagtctccatgagagtctggatggaacttgctgctgggaactgttctgcagtgattatttggtcacaaggactgccatttggtctcagcctggagaggttgtacacttacttctcccacctcgggtcaggatggaaactgtgaaatttcccaggattacaaggtaccaaacattggctggcactggagtgacctcacagctggaactgggccctgggtcgtcatcttggttactggtccatctgcagctaatatacctaatccagaagtgcagtccattggaagggacactgaaatggacctcctgtgccaccagggttccagaagcgcgaagtctgtttaccttgtagtgggatatccttggcggcttgcttctcccacttgcagtcaaagctggcagagcttttctaactcctaaaatgttccctctaccagtatttctaaacatgttgcactttccttcacaggcatttggggtttttttggtgccctcctatctcctggaaagggaatggaagcagaagtgggacatgcagggctctgccatcttcggccctgggtgcaggctcctgccacacctgtccttgcttctggctcagggatgtgtcttcttgcccagcctatctccatggggagaggggcttaaacctctgatgcttccgcccttccatttaggccatgtgcccagaaacctggcctgatctttgtgtgacagggagcctgggccactgaagaggaacgtggctcccctggccacatgaggacggaatcaataagcagggggctttttagc

SEQ ID NO: 39626 - DNA, 1572 bp, Bovine  19866880823656
cccccaggagcctggccgcctcctccaggacccatggaccctgggatgctagtcccactgcctccaccagcttgactgaggttgagggactggcctgaggccccagaggaagcctgagccaccgcaagggcctggctagaggcctgggagaggctggagacaggggaggccccaggagggatggccttctgggcagagccttgcatttggggtccttgggcagaggcctgctggttcctgacggccaagttctgcacctgaaagataggaagcaaaaggcagattgagaaacttggggatcaagggcactaaagtgaaagactaccatgactgagtcagaagcagtgacaacagctacagatattccacggccccctcagctgtaccctcacctgtacacacagagaaggtcttcccagagaggggctctcaagtcatatctgattctcagtctccttcattctgtacaaaatctgtcatcaagttcagttattttattccttcaagatgtctcagactttccctttcttccccattcattcaacatctaccaactactgcactggatactgggaatgcagagatgaaagacacaagcccctgcttttaatgagtactttctactcgagaagacaagaaaaccaagttacaccatgcacagatatgcacccagtgctaggggagtgcagaggaggaagagtagtaactcagacaaagcgcatgagggaagacatgctaacacaggcgatgtctgagctgagaaccaacagggtttgaagacacaggtaacaacaatgcaagaccactgagccaagaaagagcaccgtgtttttggaaatgataaatatttcattatgtttggggaaggctggagggagtggcaagaaatgaagctatgcaggtaggctgaggctagaaagaggccagatcttgaagggcttggaatgttaaaatgagaaattcccagcaccgagcacagtgcctgacagacagcaagtggtccagtgtatcaacggagagaagggatgacaagctcttaatgaatcacaggaagccactgaagaatactcatcagaaagaccacgatcaactctattgtcaaaaccattctttgagcacagccactctggaaaacagtttggcattttgtcctaaagttgaaatattcacacatgctgtaacccaggagtcccacaagagaagtgctcactgtagacaatgggaggcatgtgtaagaatggtcacagcagcacgagtcatcctaacaaaagcctaaaaaccaaccaaatggccaccatcagaagagaggatgaatgaactctagtatattcacacagtggaatattacatggaaatcaaaacaaagtacaatgacatgcaacaatacagatggattttgacaataagtcatttaatgaaggtattccccaaaggattatatacaaggtaagtaccttatagatttaaatacaaatttatattttttatatatatatatccacatggtatctggaacttgcttctaaatatccacagagaagggaaagggccggagaaatgaccacatgtcaa

SEQ ID NO: 39627 - DNA, 1209 bp, Bovine  19866880839071
tttttccccaaaagagggtgaatacttaaactcactcaaagaagagagacggaagctccctggagggtcatttaattcctttttgctttataggtgacaaatgagaccctgaccttgaccttcacagttctgcaagacatcccagtaagggatctgaaacctgccatagtgaaagtctatgactattatgagacaggtgagtgagagcaacgttcacacagaaattaaattcttgatcagagatttatatttgaaagatgtgttgggccagttcattaaactaactgctctcatcagttcattttgtctccaccaagtctgattctcctgtctttatcttctacacaaacattgtagaaattacctattgtataattgtactattcctaatacaaagcacctgtaggatatctagttcttttttcttcagttaaaatcaactataggacaatatgaaatttaaataagtatgatatctaaactgctgcccttcaagagtttagggtaaaggaaagcataacataaagtataaagtatttgaagacacaaggcagtgagaacacatcaaatgaatgatgctggtgtttctgatacaattcttcccacaataaagattctctcactaacctatatcccatcgatgtttgctttccctctcactttgtttgactgtttttgtttttattcagatgagtttgcagttgctgagtacagtgctccttgcagcaaaggtaagcaaacctccttccagatggaatgagaaccactttgtctcccctcaaatctcctccataaaattctggctaaatatttttcatggatatcatactgctcaaggtgcaacttattgttaaaaaaaaaacctttattgaaaaggggcccctgatagtcaaatctcagacggttcatagaactgcaagttgaatcattttaagtaatgaatctcatttccactatactaactggatttcctctggcaatatgccacccagatctcagggaaggaatttccactgctccagaaacccatgtccatctgaactttctgtcctttccactatcacagatattggaaatgcttaaagaccatgtcaatgaaaactgctttgctggattccctgttccacagactcagatctccgtggaagaaagacaatttttaacatctctgaaggcttgttgaataaaccttttttttttttttttttc

SEQ ID NO: 39628 - DNA, 1267 bp, Bovine  19866880941444
cacagacacagaagttttcaaaagcaggagaggggaaatgtaaacaagactccttaacatatatcacagaatctaaaataaggagaactggaaattaagaaacagcctatttcatattatcctttgaaaaatatatccttatagtaaataatccaacagatcagcttgataaaattccccttaaccctatgggaacaacttctgtgtgattctaggtatactgatgtagatggacttcacataattcccacttgaaagagctaattgctattttacgctaagtcctcaaacacatctccatcagcctcattcctagatgggtctctaaatgaatactcaccagcagatgggctgtccccacccaagggaccacccgactgattctcattcagtcctgtggtgaggccagtctgcaggggcttctcagactctttcaataactgagaacagcccacctgttccagaaaaaggtgagttatattagcctaactcctttctatagctttccccaccacttctcaccaccatgtctttgcctcgatctcagagttaatggcaaagtcacgcagacagaaccattttcaatatagcaatctagagtctctaactggcttttttcagattagctgctggagaagggcctcctaccccagctccctatcttgtccttttccttcctaaactgcagggaacacacttggaagcaagagacctgtgttctaagtcctgcttctgcaactcatggtatccagaaaagtctctcaacttctccaccacaattttcttcactatgaaacaacctaattagagacttccctggtggtctagtggttgagactccaagctcccaatgcagggggcccaggttagtacctggtcagggaactaggatcccaaatgctgtacaatgcccgaatgctatacaaaggggcccaaaaacaaacaaataaaaaacaaccatgacagccttaaaggtcacttttttcctttgcttctcctctccccactattttcagttcctggtctacatagtctttcttcttcttttcccttccttcttcatagctaatcctacaaacaacagaactgaaccgttctctaataattaaatagttctgagccttctgagtctctggagtttgaaaagacagcccaacagaccaagtccccatgtgaaagccccaccttctggccctgccctcaccgggaaaggctctgctccttcctggataacgaagccttcaatgatgtgagtgaggatctgggg

SEQ ID NO: 39629 - DNA, 1726 bp, Bovine  19866880951948
tagtgttggagaagactcttgagagtcccttgggactgcaaggagatccaaccagtccattctgaaggagatcagcccagggatttctttggaaggaatgatgctaaagctgaaactccagtactttggccacctcatgcgaagagttgactcattggaaaagactctgatgctgggagggattgggggcaggaggagaagaggatgacagaggatgagatggctggatggcatcaccaactcaatggacatgagtttgggtgaactccaggagttggtgatggacacggaggcctggcgtgttgcaattcatggggtcgcaaagagtcggacacaactgagtgactgaactgaactgaactgaatcaccatctgcagtgactctggagccccaaaaaataaagtctgatactgtttccactgtttccccatctatttgccgtgaagtgatgggaccagatgccatgatcttagttttctgaatgttgagctttaagccaactttttcactctcctctttcactttcatcaagaggcttttgcttacacttaaacaatttgtttatataatacatttgaaaatcagttccaatacttttcttcatgaagaaacctttagttcccctatgtcctgaaagtcgctcatttctaactttttttctttccacctaaagcctgaaggactagagaaggaagtaatattcaactccctgctttgtccatcaggtaagactcattcatcataattaaaatgacattgactagagtataatatttgaagttcaaagtattttatataaacccttcctacactgtccctatgaggtaagacccgaagaaccatcaacccatttggtaagtgaggaaactgcttcttaaagaggccaagtaatttgatcaggggactattcttatcccatgaattctgagtctttatttcttaagcacctatgcaactatcaaaatgaccttctgactagtgtatgatgtggttataggttttaatagaaagtgggtagattcaaaacgaatattgccaaaggggatattttcttggatatttactaatacaacatgggatgcatatatataatacaattataatatacaatacaatacaagtagctgaattgctgaattcaagccactgcaacaccgagttttgcatagctaaccacattagagaatgaggctacggtacttcctgagaaaaggtttccatagcctgtaccatttgtcctgtcaatatttttttggtgtcgattctgacatcctatcagtcattccaaggaggaactaaagaagcttacagtaaaagatatagctttatccttgtggagaattccctagtttaaataaaaacatttatagaaacttagtacataagaaatttatcaatgcaatgtgttcttatctcaaactaatgtctaatcaacatcatttcttgcctttctcttcatactcacttccctttattttttgtcatgtcaagacttaatatattaataaatgaaatgtattctaaaaaacataattgccttattatttagccttgtttatacatttaagtgaacttactgcttactaccaaatccatcatagattttcctctatttctgagcttttcattttgatttctctctcatgtgtctagggataatcatcagagttttattaaaattaattttaattactcacataatgcaaaaaatactttctccttaaa

SEQ ID NO: 39630 - DNA, 1211 bp, Bovine  19866881096175
ctgaatcagacccttgcccgggagcattaagcctcctctccttgccacccctccagggagcacctgccttccccctccatacctggctgatgaaccaggcctcagcatccttccggttcttctcagcaatgacctcatattggcttctcatgtcactcaggatcttggctaggtcgatgcccggagcagaatccacctccacactgacctggccacccacctggcccttcagcacactcatttcctggaaagatacagcagagatgggcatgtcagggcccagagcctgctggccctgagccaggtcactccccagtaccccaggccatggcgggagaggctggttttcaggtgcagacctaggacccagcactgggggacagacagagtcaccaccatctgctgttagaactcttgagagccacaatccacactcagggtcaggtcaagagggccacaaatgtggccacagtcagaggatacaggctaaaaatgtccttatctggggaactgggctagggtggatgggatgcccagcatgaaacccacctcctcgtggttcttcttcaggtaggccagctcctccttcaggccttcaatctgcatctccaggtcagtcctggccagggtcagctcatccagcacccggcgcaggccattgatgtcagcctccacactcatgcgcaaagcttgctccgtctcaaacctttcagagaaaatagtcatagtcatgccagcatttcctctgcacctctgaagatctcccccacctcccctgggctcaaggtcccatgggggatggagagtgctttagaccagctagggttggtgagggaggcatccatttccctccatggctctgagcccccgaagggactgcctcccctcccctgctctggcttctgcagcccccaaagtagagacactcacttggtgcggaagtcatctgcagccagacgggcattgtcgatctgcaggactatcttggagttctcaatggtggcaccgagaatctgggaggcagaatgcaagaggttggcaccagctcagcatatgggcaatgcccacccactttcttcccagagaagcaaaggagtgtgtgtgtccccgggcccctggagaccaaagctccagcaaccccaggctgcctgctctctgggcagccttaaaatcagtccaggcctgagagctggaacaggacaaaattacta

SEQ ID NO: 39631 - DNA, 1583 bp, Bovine  19866881381052
ttaattaacagatatcaatggatatttatgattcagaaaacccagaaggaaagtatgatctaaaagagagaggcaggaatacaagtgagagccttgaagatggtgtgttgctagcatttaagacagaagaggccataaactaaggaacgcaggtctttagaagctgcaaaaggtgaggaaacaggtaagcctctagagttccagaaggaatttcattctgctgacaccttgatgttagcccagtaagacttctttctacagaactacaagatagtaaatttgtgtggtttttagccagccagcttcctacagaagcaataagaaactaatacaaaatcatacagagtaaaatatttctttggtgattattttcatttttcagttattttctgaattaaaaaatttaataataaaatgaatatattttactttagaaataaaatttaaaatatagaaacactataaaaaggattttaaaaattactaaaatgaacctagtattcttatttttaaaattagcttctccatctttggttgatggaagaaagttagtagccatttgctctgatgtaagaaatagctaaagtgtttagggcaatttaagagaaaaaaaataagaaatcctgaaaatacttacactctccttgtttaatggataacacatgggtttctgattgagcgatgcttcctcttgctttgatctgaagacagagggaaatacgtttattatcattttaaagggtagtcattaaacttacatatttataatatacaaataacatatttataatttacaaacaacaagaatcttactacttcaaccccaaagttacttttgtttactaaatttctcttccaatattttccaatttgtgtagtttaagtaataaacttcaaacaatatactttaaataacaaacatgtaattttacaatgttttagaattttcttactatttactacttatcttagatattgatattttaaatttacatattctttcaacatttattttaagcatctattatatgcaaagcaatatatagtgaagggaggtataaaatattggagaaggcaatggcaccccactccagtactcttgcttggaaaatcccatggacagaggagcctgttaggctgcaatccatggggtcgctaagagtcggacacgattgagtgacttcactttcacttttcgctttcatgcattgggagaaggaaatggcaacccactccagtgttcttgctggagaatcccagggacgggggagcctggtgggctgccgtctctggggtcgcacagagttggacatgactgaagtgacttagcatagcatagcattatctattgctgcctttatttaaaaaaaaaaaaaaacagaaaaaaattaaaagtacttacactctccatgtgtctggtactgaactaaataattttaagatttttctttttttctggcaataactctaagttgttattattcagttgctcagttgtgtctgactatttgcaaccccacgaactgcagcacaccgggcttccctgtccttcaccatctcacagagtttgctcaaactcacgt

SEQ ID NO: 39632 - DNA, 1564 bp, Bovine  19866881451003
tgaaggacagggaagcttggcatgctgcagtctatggggtcgcaaagagtcggacataatttagtgactgaacaacaacaacaactcagacgactcaagactcgccttcatcagtgcttagaagggactccgttctaagttcacagtcaatgggaaatgtcagatttcatctgctatccattccctacttccccaaaagtttgggaaggaggagttggtttagatctttggtcagaatgatagtcatcttctcacttcctgtggcaccatcctttcaggtagtcttaaacatgaagatgaggatgttaggtatttagatcatcatacacctggtttccctctgcaggagtggaggccaacaccactcgggatatatacatttcttcacaaatgggatccatgacctttgaagacaccaatgattattattaccccaatttccccttcagtggaaaggtatgttgaaactcatctctgctcagacaaaaaacgcttaaccaccctgtcaactccttcctgaacacatattaacttagcatttttctaagtactctgtatgtattcactttaatctgtacaacagtcctgagttagacattattattggccccatttgacagacaaaaaggctgagacacagagaggttagtgaggttaggtgattttcccaaggttatacagctcgtaagtggtaattatggtcggagctgggcagcctgcctctagagcgacagtccccaaccttttttgcttcagggaccacttgtggaagatgttggggggatggttttaggatgattcaagtgcattacatttattgtgcactttgtttctattattagtacatcagctctacttcagatcagcaggcgttagatcctggaggttggagacccctgctctagagtatgtgcttaattcctggcactgtgtgtccttaatctcacatgagatgtgcctaaaatactaatgtgacttcaatgaccctccgaatgccaggggttcacctcctcctgtgtcagtctttgaattttagagctgcaagttacctggtgagatcctcaagtctgagtttctgcatctaggcaaggttaatatcaaacttcctgccacagcgagccactgatggctccttaagcatcgtctttagagatttaaaaaattgaagtgtcttctctctgattcctagcattccacccctctctctagcttatcttcttcacttcccaagtaattgttgaacactatagtattgtacatattcagatctgttattccttggtcatctcttctttagaccaagagtagatccagactgtcttagagcctaaggattatacaatttaggagtggaagaggatgctctgtaggaaaatgaaagcaaaaaaatatacagagttttggcagtggggtatgaaaatgaggggccctgatgtggcgtgctgcgattcatgaggtcgcaaagagtcggacacgactgagcgactgatctgatctgatctgatgtttcctaagccatgtggcaaatctacttctttttgatcattcattgtttttttagcat

SEQ ID NO: 39633 - DNA, 912 bp, Bovine  19866881467671
cgaagctccttttgtggcaactaacatggattttgggtttccctggtaatgcagctggtaaagaatcctcctgcaatgcaggagaccctggttctatccctgggttgggaagttccccaggagaagggataggctacccactccagtattcttgggcttccctggtggctcagacagtaaagaatctgcctgcaatgcgggagacctgggttcaatccctgggttaggaagataccctggagaagggaaaggctaactactgcagtattcttgcctggagaattccatggacagaggagcctggcgggctacagtccatggggtcgcaaagagtcagacatgactgagtgactttcacctattaacaacatggacttatgggtctttcaagggctgtcatgcctaagtgggtcctctcacctgtctcttccaggacacagtggtagctctccacgccttgtccagatacggagcagccactttcaccagcgctaggaaggctgcacaggtgaccatccagtcttcagggacattttccacaaaattccaagtggaaaacagcaaccgcctgttactacagcaggtttcattgccagaggtgcctggagagtacagcatgtcagtcacaggagaaggatgtgtttacctccaggtgagattctgggcacagaagatccagagtcaccacggtcaatgaaaagttgtaactcagtgaacgatggcgcaaatgagagaaagggttgaggtatctgggaggagtcctggagaaggaaaaatcacagatttttctctgttccacagacatctttgaaatacaatattctcccgaaaaaagatgagttcccatttgctttggaggtgcagactctgccccaaacttgtgaggacccaaagcccacaccagcttccaga

SEQ ID NO: 39634 - DNA, 1841 bp, Bovine  19866881521342
caaaagtattgcagcttcagcatcagtcctttcaatgaatattcaaggttgattttctttaggatcgactggtttgatctcccttgcagtccaagggactctccaagagtcttctcccagcacccaccgtttgaaatcatcaattctttggcactcagccttctttatggtccaactttcacatccatacatgactactggaaaaaccatagctttgactatacagggtctctctcttggccaactcttttcctttcccttttcttaatgaaccgaggagcatcccacttacctgtcccttcctccaccacagtagccatgatattgatgtcttgtctgtaaaaatacccagtgaggttgaacatggacatggccacagaagttgaaatgcatcctgctttgtcaatctagtgaggcaatcagagagagagaggggggaagaaagagggtgaataacctaatctctacttctttttaaatttatttatttacttggctgcactggccttaggtgtgacataggagatctttcattgcagcgcacaggctatctgttgtgattatacaggctccagggcacacgggctctctagttgtggtgcagggtttcaatagttacagctcccaggcttagctgctgagcagcatgtggaatctctagttccctgatcagggattgaacccacatactctgcattggaaggcaaattcttaaccactggaccaccagggaagaccctaatctctacttctaactcatgatgtcctgtagaagaaaattatttcttatctctatacttcagtttctcaattttgtgtgtgtgtgtgccacatggcttatgggatcttagttccccaactggagattgaacctgggcctttggcaatgaaagcatggagttctaaccactggaccaccaggaaattcccagtttctccatctttaagatagaaaagtattccacaacatgaagcatacacccatacatgacttggaagttccaagatatgagaaggagaaaagaaccaccttcagaacaggaaaattgtatcttccaagggtttaggttaatctcttgatcccaaggcagattctaaaagagctttatctttgaggggataaaaagacttctgtgttctttaggaatgaggtactaatcacatgaaattatttctactctgggtgtttttaaccacttttctatattggtgcttacttactctttaggacataagaataaggttcctttcctacatcctgttttactcacctgtccagagactttcttgcatctgtcaggtaaatgttcccgttctggatccggataccggtaagtatatggcttttgacacactgatacgtgtgctactccttgcatgggctttccataggtgtacctaacccagaaaaacacgaggaatcagagaggggcaagtccacctgtgatccaggccctcctcccctaaacattttcctttcttccgcatgcccatctctgaaagcgctttgacagtcccacctttctccagctctcattcacatctctgctttactcaaagctttagagtattgccattgcacaataaataccacccaaaggacaacagtgtctttctttttccttactcctacttcccatgggattcaatactgtgctctgcacaaagtagactctaaaccaataatgccagctgagaaagcagaggcaagtaagcacaaaaatgcagttagataatgtgtccctgggatttccctggtggttcagtggttaagacttcactttcccatgcagaggatgcggattaaatccctggtccaggaactaagatcccacatgctt

SEQ ID NO: 39635 - DNA, 1084 bp, Bovine  19866882203397
gcaagaacactggagtgggttgccatttccttctccagtgcatcaaagtgaaaagtgaaagtgaagtcgctcagtcgtgcctgactctcagcaaccccatgacgtagcccaccaggctcctccgtccatggctcctccgtccatgggattttccaggcaagagtactggagtggggtgccattgccttctccggcgaaacagctagtatattacaagtgtggtctttaggcgggacttgtttcttcactgcctgttctttctgttactgctgctgctgggctggctactggagatgggagcataagatcctagtaacattaattctcaaggttggaaaagcctgactgagagaccatgtccagttctcatcagtgacaatggcagtgccaagaagtatgtgacctgccttaggtagatggatgagttagatgagattttctgtaacacgcttatctttacaaattctgaatctaagttatttttccactatgtctgcaaggtcaggtaaatgatctgttgatgattgactttcctgtaccaacctggtagagtgaaagtcacttcccttcaacacttctgttatttgtgtgcatgtgtgcgcgagtagctttattactttcagaatcaaccctactaagcatagcttcctctagaaacagttgcctatcccatgatagttacaataattctggtaaggacaggaaagaaattaagaaggaaaatagaaaagcaacaggaaagttctagagatgggaatgttcccatgtatttaaggtgtttgtgaagcactcctcatagacaaactagcaagatatcccaaagggtgagtctcttttaaataatacagccaccccaaaagaagatttttggaaagtataaactcacaggccgcacacggacacttgcacctcttcttccaagatggtgattatctttggcattcttacttgtacttcaaacttaggaagcactgttgattggagaaaaggaagttgatgattggttttcaacttttggggaattggcatttccagattctcaatagtaattccctgataatattttagggcccgaaaaggtagc

SEQ ID NO: 39636 - DNA, 1634 bp, Bovine  19866880367671
acgcctcacattccaaatgagtcagtgtcatcatcgcccttgctgtgtattcacagggctggaggaagggatctggctggaacatagaaggccccttaacacatgaatctggcccaaaatgcaccccaaatgcttcatcctttgcagctgtctgcacccacaggattctaagagctagaatgtctctccattggttgttcactactgacttccatgttcaacaaacattattgggtagcaggtaccttgctagacatgaagagtgtcgcaacttgaaggtcccagtcttttgggagagcacagcctggtgggcctgcaaggcaagtcaacgaacagctttgacttcgtgagatagattggatgggaggcaaacactgtttaggtctgcactgaacttagttggagggtgagtggtgggtgggaggagtctgtggcagtctcgggctggccacattcctctaagaaccagactgtaccccaaggatcactcgacagtacccaggtgtggcctttatcctcatgacacaagacagctaatagagctccagccatcgccttttcattttataatgtaagcatgaacagcgaactcagtgggcctcattctatttgatagtcttagtgtcttctttcatgcttgtctttatcagcatttattcgttcattcccccaaatttagtgtttcttcaatgccctattctgaatattctaaatgtggagctttatattgtactaggacttccctggtggctcagatggtaaagcatattgtgttattggatccatccattgtattggatccatcaactctcgtggtccattatcattgtagaaaagaatttctgtcatatttgaacccaatccactcccacctctcaactcacacagatgcacacagacacaaacatttgttgaattatactgagggaccatggagatttgaagctcaaagacatcataaagccatttgcagagtttttagcttgttgaaaatccagcttgaccatgggattagacagtaaagtgactgcagaggaggctgagtgacaggggaggggcctgaggtcccctacttcggccctggcacttccctcatctgatgacttgacatcagactcgattatggtcatgggctttgaaaagatctagtccaacttgaggatttacctacagatttatactctttttccattctgctactgtgtctctctgcttggtgagagtgagcatccagcctgaaaggttatattgtccaagtgctaaatgtgaatccaggcattcagcaaccctgagccaggcccttataaagttgtgtgatttgagataaggcccttcactgttgagcctgctttttataaaaacagagatggtgagaatccctgcctccaggtttttatgaacattaaatgcaaataagtctggcagagccatgcaataaaatgatggtttcctttctttccctttaaaggggttttctcttccaaaatacttgcatcctaggaaatggggatcctctgataaaagaggaagtaactcaaccacaaaatcttggtgccggcctggatttgaggaagcctccataactaacagctcaaatttccttctctcttggctgacagagttggaggccagag

SEQ ID NO: 39637 - DNA, 3128 bp, Bovine  19866880373347
atccttttgggactatgcactgcagcttaaaggttttgaaattgtcttaaaaatgtaaaatccaaaatgggtcttaagagtcacagacatgtctacactctctgtgcgtgctcggttgcttagtcatgtccagctctttggtaccccatgaactgcagcccatcaggctcctctgtccatagaattttccaggcaagaatactaagtgggttaccatttccctcctccaacatgctcactttactgaggggaaaatgtgatctcgaagacaggtcccccaaaccggtccagaatcacacagagttttgttcagtggacatttacaagagtatctatttctatttactctgcttccagctacaaacaacccttgggattatttgtgccttggttcttgtttccagatcataacactgtaggcttgctgggttgaatgctatttggagtgatttactggctgatcatttcaacgcaaaatggagatcatagatggagacttcctaaatgttcagtacacccccaccaaagtgcatttgaacaatcaaggttatcctaatattaattattcatgggcagagactgacaaatgaattctaattgcaaataagtgcaattgctttcgattgcataatttatgattccatttgttaaactaagacaacaggaattgatgaaaggcattaagtggccccaaattaaaggtaatttgggttcaaaagcttatatctatgtgggtgtagcttgaatttttcagcttgtctgagattcccctttcttcactggtgataaatacgccaggtaatctgtgttccactgggccccatgtctggctggagatgcatcagtctgggatttctggagagagacctgtggtcaagctcatgatgagagcatctcttgtccgtgggcagctcagtagccgctatctttccctgtggcttggggtctgtcctctggggcttggctgtatgaaagctgggcagggtagttttgtctgcattgcactctgacactctgctgaagagagtgcgaatgagagaccaaaatgggcagtagagagatccactggaaattgttttctaaaaaataagtaaaatacttttctttccattagacagacaatcccacggaccagcatctcacagaggttaagtgcaacccctgaaaaattgctcagtgcttttcctatatgttacatgagacagagactctactgaagaaggaatctttcacataataaatttcaagataactttgttaaagaaaaaaatggatcttagatttatggtgtgtgcaatgaggcatttggggtttaaaatatgcactgttagcatccattcctgggttttgacttcccttaatctgaagaaatagagctattactgggaaatatttgacttttgaatctcacaaatttgttctctaaaggcaaaatttcatctaagcacaagggaaggatttggaaacaatatgctttcatataactgtgtttactttaggctctgtgtttaattaatgaacaagataattgttttattgacttttgattacatatcgtggactgaagaagagaaacagtggacccgggctggagacagtcttgccacacctcgtgggactggtggctacacaggaagtctgttccctgccaggccaggggccgggtggttgctgagcagttctgtgacacccaggacaggccaagcagcatgagtccaccaggaagttggggagatacaagagaacccagcacagctagaactgaggaacagagtggagggtagacactcaaagggaaggctgtttgcaaatggagaactggaggcccgccctgatggctctctgtgcgtttctagagaaaggttacatatgccctacggcctggttgtttttacggcttgttttacggttgttttacggctgggtgaggatggattcagatgaaagaagagatgcctgagaatggaattaggagggagggtagccccccataaagttagccagcccagtcctggctaactgggctgtgctgggctctctggcttcagtgcctatgggggtgacactaagtccgccatccatggctggtgcctagagagttctgttcagttctagaaaatgcaatttcatgctaatccctggggagacaagacactaggcagggtcctaaggctcaggaaacagcctcatgagtgatagtttctatctgctgagctcctgtggtgccagacacttggcagtgttatcttacttagtgttcataaggcagggctgttcatagtcgtgactgttccttaagtggagggttggaatggctttgctcacagcttgtaagggtgaggctggacacagctctgtcttctggctttgaaaagtgaaagtggggaaggactgggaaggtggtggagcctgagctgcttattagtgagcttttacaacagggcaaggaggcgctgtctggaagtgtatgtgcttgagagggctacaggtgaagccatatgtcagctccaccacccgctagctggataaatttgaatgcatcatccgtcttctttgagcttcagtttctcccactctgaaagggattgggacaaatgcacctttgggagagctgttgtgaagaccagggaagataatttaaagtgcggacatggtgggtggtcaaaattgacacagcagatgttggtccctttccttgtccttttattttggatatggaccgttttaaaagtctttattgaatttgttataatattgccttatttatttctatttttaaattttatttattttttatcgaaggataattgctttacagaattttgctgttttctgtcacacctcaacatgaatcagccacaggcatacatatatcccctcccttttgaacctccctccctatgccacccttctaggttttatggtttgatcttttggccatgaggcatgtgggatcttagctccccacctagggatcaaacccacaccccttgcattgaaaagtgaagtcttaaccactggaccaccagggaagtcccacattccttgtctttaaagagttcttcctcaggccccttcagtaacatgggcattggaaggtgtataagagagggagctaaagaaggtcg

SEQ ID NO: 39638 - DNA, 1310 bp, Bovine  19866880403912
taaggacccttgcctaagtcagacctgaaaattgacatatatgccattggccagaattcaatcatattgaacaaaaccccctgctataaactaggagttttattattaaggaagaaggacattgattttgaaggaagctggaaacttctgccgtgctagtaataataaaattttagaataaatattttaatttagattatcaatttttatgtgtaatattaaaaaatcaacacacacacaaaaatacatctaaagttctaatcaacaaaatttttattaaaaacattgtcccaggggtcataaaactttggtatttttgcctgggctttactcctagttctttgtcttggtcaaatcactttctcttgctgggcctcagttcatatgtagaataagtagggttaaactaggatatctctaagatctttccatccctacctactgttatcaaatgtaataggtaaatctcaaggtcttaccagaatattaaagtgttatagagcaaaaatcttgcaatgagccacttttctcagaaatagacacagatttattactgtatatttatacttgggggcttccctgctggcttacatggtagagaatctgcctgcagtgcaggagacccaggttcaatcccttggttgggaaaattccctagagaaggaaatggcaatctattccagtattctcgccaggagaattccatggacagtggagcctggcagactacagtccatggggtcacaaagagttgacatgactgagtgactaacactttcattttcatttataccttgtcttcactcagaaaaaaattaaagattcatattgttctttatttgtgcaaaagcaatatgatgacaaaataagcagaataaacactgagaaagagattaagttatcaattttttttgagggggggctcagcttaaagtgaaagtgaaagtcactcagtcgtgtccaatgctctgcaaccccatgaactatacagtccatggaattttccaggccagaatactggagtgggtagcctttctcttctccaggggatcttcctaacccagcgatcgaacccaggtctcccacattgcaggtggattctttgccagctgagccacaagagaagcccaagaataccggagtgggtagcctctcccttcagcagatcttcccgacccaggaatcgaaccagggtctcctgcattgcaggagaatgctttatcaactgagctgtcatggaagccttactgagcttatttagagaaaatccaaagtttcaagtagagacaaaaattagtaaatattaggag

SEQ ID NO: 39639 - DNA, 938 bp, Bovine  19866880586729
ctgcctttgaagtgatactaagtagctatggtaagactgtaaagcatttaaagttccaaaaagggacagaatgtaacaattgttaagatatccaagtacaactacatttaaagatagaactgatggttcttgcatgaggtcatgatcaaccataaaaggttacttgaaaataagctcagcattaagtaaaatttaaaaacactgcacatagcacatagcaaactcaccctaaactgtgtataattttatgttccacttttatttaaatagggtgaaatttgaaatgttttgtggtgtaggatttgatgaatctctactcatattttataacataatgacttcattgacatcaatctgctcatgcaatcaatgtatttatataaaaagaatctcctaaaatactcttaattcttaagaattaatatgatgcaagaacacttatgtgaatgtcagagaaacccatagcaaataattttatagccttactagtggcttcaatttatttgctttagtgaaaaagcattggacttgggatagaaaacatagaattttgatcttggatatacattaactatatatgtaaccttgggaagacatttaacccatctacaaaataagaggtgttaaaacagatgaattacaagattctgacattctttgaatctcatcatcaattttgatagcctggtatttaaactctatttcagattattatcacttggtggaaaaaacatggatttctagtttaaagaagagcttaagaatccccttcagattaaaacaaaaccaaatcctttgatgtaaccatatggtgcccataaatcagtttatgctcctaaaacttccttaaaagctaataagcttttattggttaattataaaactgaatgaggtgagaaaagcacagaaccttgctaattccactaatgaatcaaatt

SEQ ID NO: 39640 - DNA, 877 bp, Bovine  19866880589897
cttgctgctcccctggaaactgctgtagggagcactcctctctccctcatctaatcattgctccctcaccaccccctaacccaggtccctgtggagacctgaatgcccctggctgaagctgggaaagcatttttcacacctttaaataaaatgtgcagattgagggtggaagggttattttccattacaatatgaagcattctggcccctttcccagagtttataatagcccttggaagaggccttctcccctgaagtatggtcccagaaaccagctagaaatgaactgggaagtctgaaccagacttgctggggagggagaagccacgcctatggaaatcttggaacattggccttgctactgcctccgtaccatcgtcatggaagtctgtgcacctctgcggaatccacccacgcctttaccctcgtcctcagagccccatgggatcaatgtgctaactgggggttaactctaggatcctggggatctcaaggacagctgaacacgacgatgagaaaggtctccatcgattgacccaatccttcttgttatcactgatacccgtaaaaaatttaattctcctacagactaactaaagtaaaaaaaaaaaaaatcccagtggattaacacgctataaatatttacgtcttgctcaccccatggtaagactgattgtgtgttgggcatcctttcacagtgtggcttaggaacccaggatcctgccatcaatcagggccttgccatcttctaccagatcctcttgttctgcctggagacaattagttctgtctgaaggacctggtagaggacttgaggagccagtcatggaagtggggcagtttactagatcagctccaccggccagcactcggtgac

SEQ ID NO: 39641 - DNA, 3755 bp, Bovine  19866880635137
ttcttggtcaccacagagcaccaagctgagctccctgcactactcagcagcttcccactggctatccgtcttatacatggcagtacacatacatcaatcccaatctcccagttcatcccacctgtccacctgtcctcatgtccgcctgtttgttctctatgtctgcgtctttattcctgccctgcaaataggttcatttgttccataattttttgagaaggcagttggctctagttttcatatgaagaaagagagacaaagcatattgggcattaaagagtatggtaggttcacactgtgatgcaaagtattagtgaatcttgggagaagagaaatgacatatactgttcatttactgttatgtctgcccactttactgattcttcaaattcctcctatatgctccatggaaacttaaaggcaggcacttttaccttcatttatatatgaggctaagaggagctaaggaatttatccaaggtcaacatctattaaacagcaacaccaggatttgaattcagagctagtataacttcagagcttctttggaagatataaggcttctgtatgctccagatttacttgggtttgtggcacttttaaagaaactacccatcagggagatacaataacctcaactaatcttatttacaggaaactggccactaagtcagagtagcttagagtcccagaaatgcagtattgtgaatattcaagaaatgatcaccaaagctactttaattttcagaattaaaaaattattcagttaacacttggggagggttggggattttggtttgtaaggaaaagggtgtgatggacagacaggacacaaaatatcccagaagtttcatctccttttttcaaagctaaccacaagggccagatgtcctcaaaacgagtttgttctcaacttctcagtagagcattaattgtgtctcgtttttagctttcatatctgacttgaatcacctttgcagagtgcccacaatgagccagaggccccataataattgaattcgtcaagcacattgttcattaatcttgaaagcaaccctaagaagcaaggcagcactcccatcgtcacaccatcagtatgaacgtctccttccagctgtattgctgcctccaaagggcagggacaagcatctgttgcaagaactcctaagagcgccttctaactgatctcgttgtttcaaagctctcaagcccttcgttgtgcacacgtcagccagataaatcaaatgtaaatcactttctaacagcaccctcgaaaaaacttcccatccctctcagtctaaattgcaaagtcctggacagagcctgtgaggtcctctgtggctgagccctgcttgtctccctaactgtatctcctgcctcttcccccttgctcacctttctccggaggcactgactttctttcacctccttaaacacacagaactcattccacattctagctcttaaacttgctgttccctctgcctggacttctggcagatctccagatagtaaactccttcacaccattcatctagaacttctgtgaccacgccagctgagtggcctccttgtctcccgactctaacccccattattttcttcacaaataattggattttgtctcatgtcattacagtaacaacacaagagaagacactttgtctgcttctttgttatattcccagagcttgcagcagcatctaacgtgcatttaatacatcatggctgaatgaatgtgtggccgaaggtaacctttgaacccaaattttcctgaagccaaagctcaagctttgaccatcaacatgctgcaattttacattgaaaaattgaattcatcttgaggtggatccagcctaggtgaggcatggtgcagagcacacaggatacctgtttcttctcttcatgtttataacttagctgtaataccagatgtttataacttagctatagtaccagactaatctgctcttgaaataacggatactatgaataaatggtgggtgaagggagtggcaccagagggcatcaaaaggctaaagagagtggtcagcgaggacccaggtgaccctcagaggctccctagtgcttagggacttgatagaaggctcgaatggcagatgcagtttagggatggggaagaaaggctctcaggttcttggatatgatgaagtcaggtgagcttgtccacgaagagtctcataaatgacatgtgttttagggctttccacactggacacatgtatcagattcttttgtttttggggaaaaaaaaataaaacccagtcacccattatgtataagtacaatctcatgagcaaaacaaggccagcaagggaagaagagaggaggaaagggagtggggtaccctgtttctgactcagggtggtggggggaggggcaggggcaaggggaacctggacccttggcatatggtgtcatgtatgattgcttctcttacccctgaaggtctcctctgtaagattcgcctggaattccatgcttgctcacagataaatcaccaacagggactcatgtgaggaggccacctctttggggcacacagagggcagagctgctctgtagcatcacgtctgtccaggaaggggcagcacagagttcaggccactggcagacacaccagccatccaagggtttctcaggaggacacagatgcccctcagaggggactctcaacacctctaaccatggctcccaacccagtgttgataaggagatcccagaggaccaggtcatcaactggtgaagatgacttaacgatgctcagaattaacatctgttcatccatccatccatccattccgttcattcattcaacaagcaggtcctctataccgtgccgattgcaggggctattgtaagggttagacagtttccttgagaaactcatggttgatccacagagaagaccatatggagttactgtctgaactctactcgtgctttaagctcagagttgaataaaatcctggcttggccacaaaaatcacaccaaaccaaagcaaaacacttcatgaagggaaaaactatgctttaccattttttttcccctctcaggctcttcccagaaaggtgataatggaagatttggtcccaacagagccacagacaaggaatttgcattttaaagtttgacagatatttataggccttttgatcttctttccctactctacacacccacccgcagtcttgcctacctcctccttccccagctcccatatttctacattgtaccaggtacagacttgagaaatgatggctccaggtccagaactttctaggatatgtgccctgggtgctatgctcacagtcatacagctcctatttattaataccaactctatagcaaatacttttctttatttctgactcccacaggctcactgcaagtttcattatttacctttttagtcattgttaagggaggaggaaaatgaggctcaaggagggtaagtaaccttgccccaaatcacagataagacataatgggggcacagtgaaaactcaggtctgtgtatcttcaaacctatgaccttttcacaaagccagtctgactccagtcaccaagcctggttgttgcaggctacttagctgaggtccctcttagaaaaagatgatcccgcattccagttttcttgctggtgttattctggaaatagcccaataaacgtcacaattcgatttactcgggaccaacttgcagctgtcttcctttgcaactcttactcagg

SEQ ID NO: 39642 - DNA, 2778 bp, Bovine  19866880638016
tgcatccgtagtctgtttctaaacatatgtctagatgtggttaccagctacatacaggctagttggataccattttgtgagatgtctaggatgaaattcttaacagttttgacgcatgtcacaaaatcatcttaggcaattaagcccaaataagatgaccatttgaagcataatgcacagattgatttgaagaggactcagaaaagctggtcccagagtggactctgccaacaggtatctacaggacctgggacaaatcacttttcccatctgaacttcagtttctgtatatgaagataaatatgataattacccagcttatttctggattctaaagtaataacaaatgtgatattttggaaaaaatgtaaatataagtaattttgagtgtcttattttggcaattattaaggaaatacagaatatcagacttcatattcattttcttgccaaagtcaagacttttatggagtaaaagttgaaaaatattagacacatatcagtctattttccaaaaccatgcaaagtaacttttcaatttaattattattcatgcccaagaaacacttgccttaattatccaagttgtgatctggctgtaatcagcagaatttttctccatagagttgccatttattggcctaggataggtctgttatgggtctcgacttggagataaatatgttacctccatcaagatatttaccctagaagagagttttgcttctctattcttcttctcagcaagggtctattgctgagaccttggcactttctttttgttcacttctcctgcatagcttcttgctgcaagagtcactccatttcttcatgttctttggcaaattttattaacagggcaaatcacagaaattctactttgccaaagtaatttttcagtataagaactgcctttccacatctcttttttttttttattttcaccacaaatgaatggttttcgatctaatcctttctaaagataacaaaaagctgctcagagaggttaagaagtggttatagtggcacagctaggctgggtggggcatggcctcagacccaagactctcctcttctccaagtcctgcatcttaccccggcagcacatgctgatgttgaaagagcttggccctcgctggattttaaacaggcattattacattaatatctttaagtaccttaattaggtcttacaggaaggaaaagaattatttggtcaccaaaacagcccgaggattccaacttgaaagagtgagtctgtttcagatcactagatagggtggtggctctgtttggccagaaaacttcaatataaacgatgagccatgtggagcaggggatgttcgcccaaagcccctggcccgggaggaaatgggaccgtatgtggtatgtggacccaacacctacttgcaaacactcccacggccaccagtgttggattcaattaaacattaaattcatcatctttagcaaggaaagagaacagcaaacagttgctctctcatggctaaacaccccttggatttgctggcctttgatttattggaagaaacctgctgggaagaacatactgtgtagctgattaatgtcagcttctgtcatcagtttccacttagattcttggccagccctgacatctcctccctgaaggatccagaagaatttgagggctgatccaagagctttactggcatgggatttgcagaatgtggtgtttgcaaaataaggaagatgaatggaagtggaatcccatgttctccactggacttgttgctttaattcatttctccagaggccccgctccatgccaggaccacaccagcaaggggaccggggaaagtgtgttcccaggctccagtacagatgtcttgcatttcctgtaccgctttatgtgctgcttcctcggagcttgtcaaactgggaagtggtccgaggaggaatgcggttcacatttaccgtcggaacctccctgggaaccctgggacaaagcctgtgggagagtgggcacgtgagaaggaggtgtctccagctgcccagccaagtccaggacctgcacatacatgacaggtttcgcagggtcctacagcatcgtttttttttttttccttttctcttttttctcaatgataagccatgattcaatgacattatacttagagcaagcagcattttctgtttttcttctgttggggtaaaaacccactctttgaattcttacaggtaagaatcagtgtgccaacgctctagaaagaggtggtagttttaataagactctaagccttctcctttctgaactcattcctgtgtacagaaaaaaaagagagagtaaagaaagattccgattgagaaataaaaatctgttctggttatctcttcgtgtttaacaaatcatcacgaaacctagtagcataaaataacaacacccattttattatatctcacagttttcaaaggtcaggaatttggggagagatgggttagacagtcctggcaaggggaagttagaggcaggagctgggaaagcaggagctggtccaaagccagtgggggcttactagagcatctctgtcgctctgtctctgtctctctctctcactttctctctccatccctcactccctcctttcttcccacctcctcctctctccatatagtctcagggcctttcagtgggcctttccacctgtataggctctgtaaagtcaaagtgcttacatggtgacccaaggcttcaagaggaagtatattattgggtccaattgtgctctttttcataag

SEQ ID NO: 39643 - DNA, 1056 bp, Bovine  19866880666578
acagattctggactgctgaaccacccaggggagcctgatactgttcctactgacacaaaataagtaataaagatacattgactactgtgattgcttaactgatgaatgatggagttgtcctgggtttttccctttattttcaaaaccacaactttattccatgtgccccagataccggccctgagagcagggccactccaatgtggtctgaggtcccagagactgtcatctatgtcccatcaatttcctggaataggagacactgtattctttcttgcccattctgatcagtaatatttgctttgtccctgccaaaagagttatgtttcaatcagctgcttttcttggttttggcaaatcctgttcgctatttctcaattataaactaatgattcagattgcagcattctccgatttaacatgagcacagcagattggatttgttaaatcaaagagggtgggaaagcaaagtcaatacttcagagtccgtgacaatctctgacttacgtttgtggtgccaaggataagtgtaaagagaaaggcagagggacctagaagaaaagggtttttaatccatttggagtagagtgggttagcttgagttgagtgagtaattacattttgtaaaaattctatggaatggtcattgcacttgtcaaagcagttttaaattttgcagtagtaacaaaaccctcaaatctcagggctttttacaacaaaggtgtgttgttctgctcagctggcttgttcaactcgagacagaaggggaccgtgaccttttgtatttgtggtagcaaagaagagagactggatacttctccgtgggctttttctctgcttcagctgagaaaggacagttgcgacttctgcccatatttctttggtcagaaatggtcacatggccctcttctgttgcaaggaggatgatacaactcccaatgtgggcttggaaggagaaaaggaccacgtattggtcaatactaacaatatcaatcacatccgcccttctactcatgcaatgattgcttcacttttgtttccacatggaaagcactt

SEQ ID NO: 39644 - DNA, 1405 bp, Bovine  19866880689253
ggaaaaaaaatggatggatcgctctggagtgtctaaaggaactggagctatgattaatgagggtcaactttaaaacccgagcacacacagataggattatttcacacagagagcggagtctgtctgacccaggctatcccaacatagtcccctgaggtacgtcgttcacaaatcttgttagtttcagggatgcactgacatcaaaaagagatacaaagaagatctcctttggccatgagcagatggtacttctaaaagtaccatgcaaatgcaacgatgatggccattaaaggaaatcagcaagtgtttctagaaagtcagggttgaagcgttctgctagggtatctttaacttaagcccatcatgcttttccaaatattagtcatggctagcacattttttggttggcttgttccttatttctttaggtaagagcttgagagttagctactggatggatttctctgtgatatgtaagaggcttagaagtggagccaggaaatcagagggagagggagacctgcttatactaggtatcttagacagggccccggtctgagttcattgaaggataaacagaccctcttcacacaaacggccttatctctgtgaataaacagcaaaggacagtagaccagggatagagcttctgaaacatgagagacccaaagtgtattcagcagaaaacctagaacaccgttccttcttccccttgacaaagcagctaaacacgtatttatgtttgttaacaattgtgttagagtgtgtatgaagaacatgggtgccttctctcatagagtttacattattaaagggcacagttattatatttaagcattcagaataatagacagccttgcattcattattcagtcattgagcaaatatttgttgagagtctacagcatgcttaagactgatctagacatggagattcaatgagggaaacacagataaggtcccggttcttgtgaaatttatgttctagtgggaggagatagaccatacaagtagtaacaaattgaagatgattttagttcttcaacagcaatggagaaactagagcagacagatctgattgagggcaaatgaaggtgtgcttcccaggtggcacattggtaaaggatatgcctgccgatttaggagacacaagagacttgggttgatccttgggtcagaaagatcccctggagaaagaaatggcaacccactcctatattcttgcctggaacattccatggacagaggagcttggcgggctgtagtccatggggtagtaaagagtcagaatcgactgaataaacacgaactgaaattgaaagttaagtcactcagtcgtgtccgactctttgcgaccccgtggactgtagctcaccaggctcctctgtccctgggattctccagg

SEQ ID NO: 39645 - DNA, 994 bp, Bovine  19866880693632
atttaacttatcttagagtgagactgctatggagacaagtgctaataaaagggactgggggatacgagtcgtctgtcccgcatccaagtagcctcattgaaagtgctttgtgccgtgtttcaagccttagagttaccgtgtgcagagcaggcatccttgggcaatgagagcagggcatccctcacctgggctccctgctaccctgtgcctggagcgctcttggctgcagctgcttcgttgagcttgaggaatccaaagctgtgtgcagggaccaggagcgatgcagatgaaatagcacaaaacagaaaggttaacacattctgtcagctcccactttacattcacagtgaaaacaacaatagaaacgttctcaagcataaaagaattttctactccaactgctccgagaagaaaaatgcctcacaaacagcatcttcactcagacatcaaactgcttggctgacagcattttaatcaaaaactccaaagaaagatgagtggaatttacaaagaaacaccgagagaaaataaatgaagacattcactgcacttctgtaggtgaagagtcagcagagccttatgcttctgccctggaggctcacagccctgtcatcggaccaattactctgagttcgtggatagtgacccaagcagcaccagggtcccttgggacatgtactgtcaccaggaagattccaactgagtggacttgtcggtcaaaaaaagtgtgaagtcagaaggggacagtgaccaagaagtgctggacctggaactgccaccctgattcctcaggtgcctttaatactatggagaatcacacaagtcctggattcccaatcataactaaggtaaatcactgttgagaaaattaatagtaatacaggttccatccctggaggaggaaatggcaactcattccagtactcttgcctgaaaaattccatggacagaggagcctggtgggctacagtccatggggtcacaaagagtcaga

SEQ ID NO: 39646 - DNA, 1106 bp, Bovine  19866880715107
tcttgagtaacctagcaagagaagagaaagtaagcatggaacattcaaacttttataaaaaccttctgagataaacacatagttgaattattactcattacctcatggaatgggaatccctcacaactgcaagcttttctgaaaataagttatatacaggttattaatataatcaggcaattttagatagactttaaaatcatgtatggatgtagaaagtttgactataaagaaagctgagtgctgaaaaattgatgcttttgaactgtggtgttgtagaagactcttgagaatcccttggactgcaaggagatccaaccagtccatcctaaaggaaatcagtccttgggtgttcattggaaggactgatgttgaagctgaaactccaatactttggccacctgatgcaaagagctgactcatttgaaaagaccctgatgctgggaaagactgagagcaggaggagaaggggacgacagaggatgagatggctggatggcatcaccgactcaatggacatgggcttgggtggactctgggagttggtgatggacagggaggtctggcatgctgaggttcatggggttgcaaagagtcggacacaactgagcgactgaactgaactgaaaattatcacctctaatctccttttctgaaaagtgtccttgcatagtataccagttatcaaccttctcactgaaatattattaaattactatcttataagatggccaaacttttgaacagaatcaagaaagggattttgtgaaacattaatctacacacgaggggaagttatgtggaaataattcaaccaaaggtatataaataggtcacacagcagaaaacactgagtacaaaaatataaccttacttcttaatattgttttctacagcattcagttgcctctcatgttctgtacggtgccattcacaaggacaacggtattcataatcatgtggttcacagtatcgatcagtttgacataatttgcatccattacgttcatgatcctttagatgaacctttacggagacacaaaaagtataattttcactgccttttagaattatcttctatatacattttttctttgccttaccta

SEQ ID NO: 39647 - DNA, 1289 bp, Bovine  19866880742947
attggcatctttattgtggttagagctatgttttgagtaataagaatagttgagtgatgcatttttccaatggtcacagaaggatatgaactcttaacactggcctcttcaagcagcataatcctgtccactttattacttgtcagtttatacctaagctgataattttttaaagcaatcttttccttatagattattttggttttatttaaacaggatgaattaaaccttgctgattctgaagtggataaccaaaagcgagggaaacggcattatgaagacaagcagaaagaacacttggatactttaaataaaaagaaacgagaactagatatgaaagaaaaagagctagaggttatccatgattttttaaaaccttttatttacaaccttagtcatgattattaaagtgcgttttccttaatgtcatatttccaaacagagacaagttgtctgatggatatctgttttctttggagtaatagctgtttcagtgaatcaacagagggaaagacttagggactctcaaaatgtggggacttcatagaccaacacgaagagtactttaggcaggactgccatagccccttattgtgcctccaggtgatttggaaaatggcactccctgctctgaaatagttccttacatgcctaacttggcaagtgcatagcagctttatgtcagaaaaatactccctgcctctgagttaactcaggagtgagttgggctacagtccagctcctccttactaataaccctggttgacagtggaaagcggaagccctatttttagaggaaagtaagttgaaggcaaccatggtttaacctaaaagaagtggattccagctttgtttttacatgtcttaggaaaatggtttcaactctgaaacccattgcctgatttgtttgacttaatatacgaatgtcatgaatggaaatgctatgtgtgcaagtgctttgggtttttaatattttacaaacagaagggtctttatgttttcagtaccatttggtatttagaatccctcttaaaagtcacagaaagctatgtctgacctcagcatctggggtgccagaccttcataacatctacttgaaatttgttttactagaaggttatggagctcctctaaattgttaaagttgtgtacactaatgcaattttcttttgaaaatttatgatgactctgaactgtattctcagtataaagcttagaaaaataacattgatattaagtgtaattaaaatacatttcttaaatataagttcagaattttactttgcata

SEQ ID NO: 39648 - DNA, 1118 bp, Bovine  19866880746750
ataagaatatactgaagtttgcaaactgtgctgttttgttttgagctttcaaaacgaatctatcaattatatttccttgatgagggcaatgttttataaaaaatgaatattgatgataataaagcatagaatgaatagaaggaaaggaaccaggacactgagacagttaaaataatcttggcctccagtaggtatgagatagtgagtaaatgaaaagaagcatcaagtggtagaaatgaagattggaatgaccatgagtaagatttcagatattcatgctctttcctaagatgcctctctttccactgtaaggctaatgatagatctaagactttaataaactcattattaacatcagcgattactattttccaaagcaggaaagcaaaggtgtactttggcatggggatgagttaaggaacgatttgggaattgtgaagaataaaaaaggaaaagcaaacaaatatgactcttggctaactataaatcgttcttattgagacagtttcagcaaaggcgaacttttggcagtattttatgtttgtcttcacagttgaaaataatgagattatattttcttgtaataatccgtcattctaatttttattagtttagactaaccttcccctgagttttaaatttttttatgtttttatgttcccaggctaggacagcaactttactgccaaagggaaagtaagtaggcaagtggaaaggagcagaatagcctgacctttgagaacatggcagtttggtgaccttagtatttgtttgttgttttttttttaaccattttcttttgaaggtttaatcagtggagtgaaaaatcttgttactctaattcacaaccagtactcgttaacaaactggctcattgctctgtgtgttcccatccaggtaagcggacataaggaatgatatctctagaacactgctgtcaagctacctatgtttagtatatacctatgtttcatctctattcctttggtattttttacttacctaccttccttaccagattgggaacccgcagagtcaggagttgtgtcacatagatacagtagacactcagtaaatacttacagaatgaagtaatgtcatatcaatgatagatatag

SEQ ID NO: 39649 - DNA, 1802 bp, Bovine  19866880775051
ccagtgcagcaaggaagcgggtgcttcaggaagcaggctttgtgcatgtggcttgtggacgttgggccactcgaggccctgctggtggagtggctctcggatgagcatgtctgaaaagtctttggtgaaagtgagtgaacgtcactgccggcagaagttggagagcatgggccttcgcaaacatgacgttggcgtatacccacatcttgatgtctccttagcctacacacatttatttggagaggctgtgggaccttgggcagcctacttcccttcctggcttggtgtcctccctgagaaacaaggaacttggatgagcctccctttcaaacccctccctccccaggggctccacgcaggtcggctggcctctgaccccaggagctttcaattgaaggagaactgtcaagtagccaaagtcctgggagctcagctgcagggcaatttccactagcgctcaactttcagagccctgggaccagaggatgagcagagcgtgataacatttgcaggcagagactgaagggctcccttcaggtcacgtgacttctcaatttttacacttcatcatctgctgtcccacctgccatcactcagtgagtctccgggttgtcgtgcgtgtcgaagttacctggagagctgttaaacgtgcaactctttgagccttccttgctcccaaggattcacattcaataaggtctaggctgtggccaggaaatggcacacttaacaactacccccctggatccgccttgtgctttgagcaccactgttctaattgctctgaatttggggttcatctcctgttcaggccaggaccccatctgaccttgcagcataacagggagcaaagcgaaaagaacatgccaggtattcaaccaaaattcaaggaggaactgaattgatgtgtaaggaaagcacgcatcagaggaaacgtcatcatcaccctgaactaccaaacaaagccatgcagagctttccaggcgaagcttgaggagccagcgtgtgggagaggagtgcagggcagactccaaaggtgggtccccttcgggccaccagaaacagtaggctgctggcaaatggaggctgcttcttcggcaaacacttctgtccagagggagtccctaagcccgtgctgtattttaagctgcgaccctcaaaatgtcaaaagagagattaaagtgtaaatgattgtcaattcgcttctgtcctcctggtcccgggctgagtgttacaggccttctggggacgcagggcagcaggggaggggaggggctggggacggtcttaaaatgtaaccgaatagaatgagctccactccgtcttggggggataaagcagttcacaggctgctactttttgtgacatagcttttatggggggagagccagaatattaagctcattgcttccagatgggaaggttggacaagacagaggggccttggctctgaaagcctggatgctgtggtgcgatagggatgtgacatattgaagtaatcgagatagaagatctggctttagccaaggctgtcagatagatactttttaaaacattacattgtttgtaacaaggtattgtgtatcctcccagaaaccctgccgcctgggtctctgggaaggcagtgagggaaaaagtgtgcttattttgcttgagttactaaagctccttttatatatgaggaatttggcatctcctggctgggagcggctgagccaacagtccgatgcacttgtaatgtagatcatgctagtgactcgctaagtaagtccaggtgcttgcataagaggcagagtcctaag

SEQ ID NO: 39650 - DNA, 1620 bp, Bovine  19866880824128
tttgggctaaaaaatactttcttttctttctactcagctttttaatattgaaatatagtcaacatccaatactatattatccataataatagtaatagtttcagcatagtgatttgacatatatatcatgaaatggttatcacaataatttgaatgaacatccatcatctcacatagctatggaatcaaagaaatggattttctttgtgtgtggtgaggactcaagatttactctcctaaaaacttttgtatttaatatagagcagtgttaattttacatattttgttgaagagaaagtcccaggtcatcacagttttaatatgcactttataactggaaatttaagtactgtttgacagtcttcattcatttcctcctccctttactccctgtctctggtaaccagaaatttgcttcatttttttctttgtttttgaagtgtaattggtctgtactatgttagttcctgttatacaacctagtgagttttttttctgtgcattttgaaatgatcaccacaaaaggtctagggtgctcaagggaggaggtgagatcagtgtcttcctactccactatcttgatcacacttttgtaatcattccactcagaaagcatgttgtataccttttcagctagatcctctagcatttttatcctaggaattttcaagagtcagtctgacatttcatcatctagactatctctggttctgctttcattgactctttccttattgttcacaggttacattttcttgattcttatttttctttttatcatatgcaggcatttgctgttaaaaacatgctaatgcaaacaatatttacttaagaaaagaacaaaatcctcctctgtctggcttttagagtgagaacctaagtcattctgatctgtcgctggtcgcaccagggctgtgtagtggctttagtttgaatcagttggctcgctgcaagtttgagttgttttgagggtgacctgggactttctcttcagcgagatttatgccctgcacctgccacagttctggagatctttttatggattacaactgacttaaccgctttctgaactttgtgaaaactctctttacagtctggcagtaagatttatggattgctaggggtttctttttggtctctagattaatccctgtggttttgtggcttagagagacttttttttttctctgctagtttgttcaagcctcctgagggcagccttattccccttgatgaagctttggaatgccatgtgtttttctcaggtgtcttgcattttctcaacatctggtgcctgagaaactgtagtgcctgcagtgaatttcctgtagttctctggtcctagttcttgcctttggagagtggcttctttgtgcttgtagaaggctctgtgggtgatctttctcagttctcctgccttgctctaagcctttggcatactgcatctgagcactcagtaaagacccattagaaagatttggccggtgaatttggtctctgtgcctggggtttctcagaatattaatctgtcgtgccagcccacatacagccttaaatttttgttaaaatttcagctggttctccttatccccaactattttttcctcatcactctgccag

SEQ ID NO: 39651 - DNA, 1665 bp, Bovine  19866880936614
caagttccgaaagtttcagagatgatcaaagtcttcctccaaaacctctagaaggcaccatggcatcgctccaagtgcaacagaagcagttctttgctggagaacaccgttaccttgcttgggtaccaggtgcaatggttggctttccctgagaggccatgttttacagaaaacaaggatctttacaaccacagcttgggacttccctggtggtccagaggttagaactttgccttccaatgtgggggtggtggtggtacaggtttgaaccctagttggggagctaagatccgacaaaccctggggccaaaataccaaaatataaaacagaaacaataccgtaacaaaattttaaagactttaaaaatagtccacatccaaaaaatctttttaaaaagcagggctcacgtccacatgtaagatgtgctcactgtgagccggggcaggaagcacacattcacatccccagggtcatgctctctcagggccattaaactcacttgagtctagaaccacccgaggttcacattattttctccctatctcctctccctatttaatttttaaaatagagcctagaaagttaaattcacataaagcagacacgaagtaggagcgtggtagagatgcgagtttgatccctgggtcaggaagatcccctggtaaaggaaatgacaatccaatccagtattcttgcctgggaaattccatggacaaaggagcctggtgggctacagaccatggggtcataggagtcaggcatgactgagcgactgagtatgcatacatgcactggactctacctagatgccagcagtatacctccttcctgccccccagggtgtgacaatcaaaataactccagatactgccaactgtcccctcaagagcaaaatcagcaagcagagtgaaaaacacctcagacacctatatgggagctggaagttcagaaagatcagaaagacagattgtactaatacttcatctgctgtcaggggctggggaaatttccccaaaacacatattcttttagaattcagtgctggcatttctggtgtcagacaagcaaaatttttcaaatgaggaaagataaaagcaaggttaaccttttgttgaaagtcaaagcatgcgtcacacaacttgcgtcttgagtctagtgtaaagattagtgattttctcagtgagtcggtcttctgtttgctaacattttcagtactagaataatacccagggccacacattcatacagtttcaaagatgtggcctacttcctgagggccgggggctcctgctggccacacccactactaatcaaagctgccaatcttgtggaaactctgatctgccacaaaatatcgggtttggtagtcttgcccctattcatcatttacagaccaatttcccataaaatctaagagtaatgatgcgatacaaggacaaagaaaaggtaaacgctgaccctacctctagcttgcttcattagtaagaactgtggtcaagggttttgcttaaataaagttaaactaatgcaatcaggccaccatagtagaatttaatgtgccagtaaaatcatatttaaatcctataatccaaagcaatcagaataatacaaccctgtctagttaattcagaaagtagtttactaagaatatctatctccaaatg

SEQ ID NO: 39652 - DNA, 1343 bp, Bovine  19866880974910
actaacccttgtgtcttgtgtaaagggtaggcaacaatttgattgacaaaactggagcagtattaccagcagaggacctttcagtggatgagtgaataacttcaagaaacctcaacatggacttcccaggtggcatgggtgttgggggggtgggcagggggaatccacctgccgagcaggagatactggtttgatccctggagaaggaaatgacaacccatttcagtattcttcccatgaacagagaagcctggcaggctacagtcactggagtcttttttggaactccaggctccacagaataaatcactatgcagacaaaggaatcaccagttgtagagaagtagtgaggaatttgcagcagaaagcaaactaggatatcttagggcaaagggaaagaagaaatgtagcaaagaaactgacctagatgctaaaggattctgaaaatataaaccacatatgaaagtttatgtgtgagtgcataaattcacacatttaagtatcaaagttgcacccaacctggtcatagagaagaaggaaaacaaggaattttaaaccactgggcaagggagaaaactaacatttcttgagtatctactatgcatgtgcaaatgagggttcttgacaagagtttttatcctgtcaacatctctgtaaggactgtattgcaatactgtgcacccagaatgttgcacagagtttgattctttggttcactaattatctaccaatcaagacagtgtaaacatagtttctctaagaaggaactatatggcttcttatggatctctgctagtccctacagacatctacgatattagctataagtagttttgtgtcgattgacttgcatttttgtctcaggcacaagctgtaagcatcttgtatttctgaatctgtagcacctagcagaggggctggcacagaaagcattccgtgaatgggtgctgattgctggtaatgaattcaggatcttagttcttccactctctggagaaagatcaaatccgtttggatggttccttgatcactagtctgctttagtcattttaaggtgccatggcgagatgtcttgctttctgaaggtgaaggggctcaatcacctgctgactgttcctgttgtgctggtagcacttagggtaaaacagcttaaataatattactgaagtcaactgcctttcatctgcagatcaacatggcaacttttatcaccttctcagccaggaaaagcttttatcgggctcagctaacagctcgtattagtctcttgcaaggacttgccacatagcctttaaactgagatgctgcagagtcagccccagaagtaatccaaaaatgtggaa

SEQ ID NO: 39653 - DNA, 1356 bp, Bovine  19866881010131
tccttcagctgtgctgcagctgcgggcactggtgacctagcagagtgagggagttgcagtgtcaacacacagcaggcgctgccagctcgcctctggctcctagaaggcagaacccaaatccaagatgcctagctgtctccagccttcatggaaatccaccagacaaagccacctgcagagagagggactgaaggctgggcgggaagactgaaggaagacacctgactgttcttcctgaagtcggcgctatagaggagaggagagcagctttttaaagcctttagagcttttaaagcgcagtcttgctggacagggactgcaaagcaggcaataattatacctgcctaatttgccctcttctttccttctttttttaatctcttttccactcatttgctttctctatttctccttcatattctccctttcataaaaatttcttgagtatctgtgccatgaagctctaggccttttaaagataattcagtcatccctgtcccttctccccaggcactcaggaactatcacaaatgtcccctttggggaaatgccaggaattcttacctgaaaaagctgagaagttgggggaggcttgagaaagacaaagtctgagactcttcctcatttgagagataagctaaatacacttgacaagtgttgaagctcagaaagcaaggtagtgagtttctcaacacatttcccaattaacaatttaacttaaccatttccctcatggtaaacttttactgagttgggatgagctctgtcttggagagagtctgtccctaacacatactcttgggtcaaatgtcacctggccttgctgttctgttctgaaaacagccatgtccaagctattctatacaccacataccttatacagaggtcagagatttgtagctactaaagatgctttgctttgctgcggtataaatctcattctgtaataagacagcatgattagaaatgtcctgagcaagctatagatttttctatttctttttttcaagcaaacatccagttctctttattgggatgcaaataaatctcctagcactacaaaagtacgagtcatatgagaggtttacaatggtccctagtactgtatgtaggaggattttaaataagacagctatcgataattaaaagcgaattagttcaatcaagttacagtatcatccttcagattaaagtgctctgatattaactaatgtggcagcaaacgtgatcctgagaaggaatcccactgccaatcatcttgcctcttaacttcaaaacaacaagaatgaacacagttcgtgtaataaccattctctcctcaagccctgcccacccccttggcttgtgacattgtct

SEQ ID NO: 39654 - DNA, 1859 bp, Bovine  19866881091166
catgactcacaattctctactttacagcctgtgccagtgtcttaattttcttatcagactgtcaacttcttgagttaatagattgcctcttctttaaattttatcacccctctcccaacgcttagaaaaatgactagcacaggtaaatatttgaaaaataaagcatttagtgactgaatgtacaaatgtaagaatgatggaatgcagggataaactgagtgggtgactttggattatttggggaagcctctatattgggaaagattttctccttttatctcttttgcctgccccaatgcccactagcacacactcttggtaacttaagtctgaaatcccaccagtagaagaccatgatttccatttattactttgatttgtgcaaaatgttgatgtcctaagaatcagaagcccacatttctcagagaaatgcttcatcatctacgacaagggtccccaacctcagggatctaatgtctgatgatctgaggtagagctgatgtagtaaaaatgaaataaagtacacaatatatgtaatgcacttgaatcatccgcaaaccatcccctccaccccatttcatataaaaattgtcttccatgaaactggaccctgatgccagaaaggtggttgtctatgatgaatcaaagttttgagaaggggaatttccccaaagcctagggacggttgcatacggaatggaatagcaagcctcataaaggccacagaagagaagcagaaggaaaaattgggccagtttggaggaattggccattaatacaagtctgtcttctttccaaccctgtggcttggtttacagccctcagagttccgcataggaaccttttcttctttatgtctcaccccttacctgtgacagctcagctgccctctggggagctaaggtttagggtctgctaggctgcccttgaaacagcacagcctgtcacacaccctactgcccctctggcccagggaagtcctcgttcccaacagggacatcatgtctcagagaggagaggaacagccgtgggacacgtggaaaggatggtatgttcaaaaagaaaactggccaacaacaccctctcaccccaaaggcaaggcatcactttagagagggctgagtgccaatttgttagaattgaataaatcagatttctaatgtttagtaacagatgttctggctacaagtcatgaaatcatttaatattgctttatgctccggttaaaaaaaaaaaaaaaaaaaaaagtcatctggctccacttggcccaggttacatatcttcctcaaagggtcaaaatgatttgatgcaactcttggatcaaaaggcctaatgctctctgtttgttacaggctgtggacggggtttgctcagaaaacagggcagatgctggcatcatgtatccaatggcctgagatgtgcccttgataacccccaaaacttgctctaattctgggtcttgaagaatctgaatgctctccagaaggctcactttttccatcctccacatatctcacacctggcagtgtgaacatcccaggaaggtaaaaataggttgaccagctatcctggatgtgactggcaaaatgccagagctttatctctatagccctgaaggggagcaaataactaggaatgatttggccttcttagaacaggctttgcagatgggtttggactcatctcctgagatggggagcaagggggaaatgtgcctgatgaagcctgataataaatcaggcttcaacatagataaacggtgaaattgccaagatgactcaaatgttgaaataaccaagttaatcaaaaagatctaaagaaaagtgtgataaataacaatacagtgattccttacccta

SEQ ID NO: 39655 - DNA, 1689 bp, Bovine  19866881170897
tggactccaagacagtttttctcaatggggacactgggagcattttcagaaagataacagaattctccggcaaatggcttagttttcctagcttcagtacatcaaatgtccagtctcccctgctcaaccttgagcagttacaatgaatatgtcccatgtatagtacttgcctccatgaaaaccatggctgtatttagccattccttatcaatggacatttgggttgtttgccaagttttataaagtattgacaatgctgcaactactaataacatcctttgtatatctctctttgcatacttggaggtgttctgaggcttactaacagtgaacattctggttcaaggcaatacatatcacatgacatttcataatacataattgaaactgatttagaagtaaaccatgtgaaacaaatcaagttcttagagaaatccacgtttaaaagagaatgaaccatgcagtagtggtatttttaatatgagtaagcattttatttagcaattgctgtgtaccaagcattatggtaaagaattcccccttgcaatgcaggagatgccggtcctatccctgggttgggaagatctcctggagaagaaaatggcaaccgactccagtgttcttgcaaggagaatcccatggacagaggagccctggcgggctgtagcccgtagggttgcaaagagtcagacaagacttcgagatcatgtgcacacacacacaaaaacacaagcattatggtaagcattttatatattttagtttatcttctaataatccccttaaaaaaattagtttttaaaacaaatgctgaaaaagagaaagaaaaaatcccttggtgttcatagtgaaattcctataaacagtctgggccccataaaggaaagcgtctccatcattggtgaggcagccatccacataaccactggcggttgaggtatgcacacatggcttcagcttcaccagcagcttggacccagggaattcctaagcattccagcatatcaagacactgaaaagaaaaagtaggtgcaacaaatctaagaacatttgcattgctgctttttacggtgtttaacttactgttatattacaaatactaatagctttttaggtgtgttttaaattatgatatttaagaaataattggaaatgtgaacactgaatactttacagcattaaggaatgattgctgaacttttatgtacattaataaatactgtattgagtcatgtttttattttttaagagccgtatcttttagagaaaggtactgacctgttaagagaaacaatattatgtgtgggatttgcttcaaaatattgtggaagtagggaagcgggtgggagtatacgtgaaacaaaattgcttgagttgataatttttaaagattagtgatgggttacttttgtatttatttaaaattttctgtaatgaaaagctaaaaattttgatgtcaattaaaaaataatctatatccaattaaatattaatttaaaatttattttttttaagtaatgaatattcaattttcactattcattgttatctcaagattttggaaatatctttaaattataataattaatcacattaacatttacatttgtaaaaccatagcaatccttttcacatgatgaccaacccaatatgagctctttcaaagaagttgcaagtacacaattttgg

SEQ ID NO: 39656 - DNA, 1248 bp, Bovine  19866881285735
aaatgcttctgtttgagaaaaggacctgaggatcagcaacaatgacctccggagtttctctacttattttcgctcttaatttcaagttccaagtctcttattagcaactgtctcttaattataagtttctgtgggattccacagctgggtatggaaatcaagtgggtattcaggtgtcagatttaattaatctgggtaagaaaactgtaattcagggttttcttgataatcaaaagatgtattacccaacctttcactacttctctttgctcttttcagtagagaagtacaaattgtcatttttgaactagaatctcacctaataatagctactgaaccctgacagtggctggggggtagacagtatgttgaacacttcataaacttgacctctagccccatgacaactgagcaagtgattagagtggccttcttgtacaagtcatacaaccagagctagaatttgaacctggaactgtaaggaagatatcagtgcacaactacccagagataggtggtccgaagatatttcagcagaaggaacaggagcagaagcaggaaggtttgagaggctgaatcagtcctttggtgctgaaagaagggatgagagagcaatcactttgccaggctcttgtttggaaaagcctgttagatttgccaaaaccacaatctcagaagtgagtttatgtgaatgatgggaaaatggattaagcattattaaaaacctcctctcccaagggccattagaaggtcaacagtgtgtcagcttctctcttgagctaggaaacttgcattctccaaggatcactgtgatgccttaaactgttcagttgacccaggagaggatggcctcttatacataaggggaacaccattagcaccatgaatcacagttttggagactcaaatacataacctcatgcaacctagttatgggtcatcgtcagtatcatcactcaggtgtgccaggaaatgagtgactcatatagaaaatcaagttctggcctggatctgagcagcctgccactgcccttcttaggttttgcctggattagtaatcctcactgggttctctaactgtagcctggcttctgcatggctgcttgatggcatttctgaagtgcaaacctcaacatctgatcttctccctaaaaccctcagcagctctccattgtctacaggatgtagccccagcttgctgacatggcacagtcctgcctattcataaactcactttctgccaacctg

SEQ ID NO: 39657 - DNA, 906 bp, Bovine  19866881318344
ttctaaggatttgatgtcaggatcctagtaggtcattgcaataccagtctacttaggaaagtgctatttccaaatgcttcttgttctagaggtgttcagaaatttgagtgtttgaaattctttagaaaggcatgagagaagtcagtggtaagtataagtccactgaaagtgctgcttctgaaagagttagctgtgtatgggctgagtggtgtccaactctctgcaaccccctggactgtagctctccatgcttctcttccatggaattttccaggctagaatactgaagtgggtttgcatttcctactccagggaatcttcccaacccagggatcaaacccgagtctcttgagtctcctgcagtggcaagtaggttctttaccactctaccacctgggaagcctggaagagttagctacttggcattaatgacagtagtggatatgacacctgtcatgttcactagtatgaaactgtcatctgatcagaatgttccctttccctccaattctcttgaagtatcacaactttcaggctgtggtccactctttgctggaagactggggggaaatgtatggaaatctctagcttatctctcagggtctgcaacagttaaatccattccaatttcaagcaaaataattccttatggtgggaggaaggttttagttctcagatcaggtagtcattagctaagctattgtccatctgctaacttcaaacttactgacttcttttgggaaatgaaaataaaacccagaaatttaaaaaagagacctgaataagtttcatgtgctgccaaccataaaagataccatttgaatttatgaataacgaataaaagggctttcaattggactcaattttcttggctgctaccaaacttccctatcaaacaaatatcca

SEQ ID NO: 39658 - DNA, 978 bp, Bovine  19866881329554
aattgttaatatgtaaaagaggaacactgaataataatgacaggaaaatctgataagatctaacaattataaacactatcttttaaataagcaaatcagaaataactactcagtagttccccacagaatctttagaatattattaaaacaataaaaattagtgggcattgagttattcagtcaacaaattgaagatttccaaataactcgtgcaattagaccccattagatgtgtggtttttttttttttttcagaatcgttaaaaaccgaatcagaaatggagttcattgttttgaaatagaatgggaaaagcctggtatgtacatactgtaagcaaaatttataacatttagtcatgtatgtttagcagatatcatatgtaaaacgtgtatataaaaaagaaatgaatcacatacaccagtgtacctgtgctatatgtaactcataataaattttaaatgtcttaaattgatattccttttgtagttaatgtttacaaaaacaatatggaaatggttttgatgtctatttctaaggaaaatactactacaaatagtctggtcattggatttcactgtatagtcagttctcaagaaacgaaggttgctgatagcacctgtggtgcttcctttccttttttcctttctttctttccttccttttctttctttattgtatttagttttcatgggaatttatagtgtcaagtgactctatattttctgtagacagaaatacagtgagctctgaattagctccaaaactgaaggcaggggaagaactgagcacttaaaatggaaaataatcccaaattcatttctgtttggctttgaaattggattgtatgactacatgtgactgagtgagagaatagatttgtcaataagttctagttgatgaacgataaagaattacataagctgttcaagggaataataaaaaagtagctaaagaattttaaaaccgtgtagaaacag

SEQ ID NO: 39659 - DNA, 763 bp, Bovine  19866881392295
ttattttttaatatgtgtgatttgagcatgtccgtataaggatgtatgtgatataaaatagtacttcctttatttgtccttgacttacccttttataactacaaaagtccagtcttctattgcctggttggcagattatcctacaagaagcaagttgttcttattaaaaccacatgctcctggggtgtagcatggagtgaggtgctttatatgtctatgaagatagtgctgtgagcttcagattttatcaatattaaaggcagctttgctgttttaataggtaagcagcaaagccttcaaacgggtaattctgcattttaaaagcagcagtacccatgtagtgatttcttatgtgtttttactcattccattgtaagctgtccatttccttgtttaaatcatttgccaggtgaaatctgtgtgatgatcatatcaaccagcatcacttcttctacattctgagttagtgtgcttttattggttgtatgccatatgtcaatttttctatttacttttttgtatttgttatgctataacttgattcataacttgtgtgtgttagaacttatctattttgtctttgatgtaaaactattaaggaaaaaaatgtatctcccatctgcactggctgataagtaagcttcttttcatctgtggtgaccacagtttcaaaagcatattttgtgtgatttttctttcctcccagtgggcaatagagactttcaaattcgacatggtgggaagcagccagtagccaagaaat

SEQ ID NO: 39660 - DNA, 1515 bp, Bovine  19866881531081
tcttctttaccgatgctgtcaaagtctgaactctgtttggtgttttgattgaacaattactcttcttgttcagaaatttcttgacttatctctggaataaaacacattcctttacattttaaaaaaaatgaccatttttcttttggggtggaaaaccactagagttgaaacaaactggctacttggagttataattccatgtgaagctatagttgatgaagacaaggttttctggcctgaaaaaatttttaaaaaggttgaaaaacaacttaccttcacatagagctgctgaaattcctcgagattcagtctcccgcttggacagtccttgagaaatcctttgtaccactgcttgagttcatgctcattaaactctgtgctcttcaccaggtcctccatcacttcaggggccagtttgctattctgtttccccattctgcctgaagaaaagcaaattaatgcaattagtgctgtgcctgtgatcatttcaagcttgattaggagccaagctagagttctgagcagtcccttggttggaagtccctctagcgtgtctgatcagtcttcccaaatctgtttccttctatttgatattctagaaaagagatgcatgaaaaagatttctcaaaaggctactgactttatcttccttcgtcatgtgtcatcttttacacacattgactcccacaaggaaagccaatcatctccttttatgctattcaggtaaagtatatggaaactgtttataatctcattttatgaattatgattccttagcacttactgcccagatacctaattctgcatttagtttgcagggttactaagtggggctattgacaagaacaataagaaggctttatcggcaaatcatcaaaaaatggctttgaaaacatgatcagcaatggtggttgttctaattctaaagtttctgctgttttttctttttcaaatggaaacagctcatttttactggtcacattagctctctatttctcttttcatcttcagagacttcctacaacattgccttcagtgttgacaacctctggggtggcttttttttttaagattggttagtgaatttcagttgatataatttcattattttattattactgctagtaagtaaaaataagtgcataaaataaaatataaaatatatcaatcatgggccaggttgtgtgaccaacatcactctcaagtgtaggtgggcagagcataggtttagagttatccctgatttggccagccatttatcttgtgtgctgcttagagaaatattaattatctgctttatcgtcaatttctttcccaataaagcacacattaaaaaaagaaaaactaaaaaactctttcagatttactgtgatggctaattaagaaataagtaggtaaacaaagaccaaaaattattccaaaatttaagcttttcccctttaatgttgttgttttgtaacaaaacggaagaaaacaaaacaaattaaccacagggtatttaaaaatcaagttaga

SEQ ID NO: 39661 - DNA, 1246 bp, Bovine  19866880369449
cattcctcagagtctctggtgtccgagcaggctgtagggccggagatgggaccagtggtttgtcccagttaaaaagcccaggagctgatctgcagccttgccacttggtgcccagacaaatgcagcagctgcgaagggtccccctgccccgagcctgcccacagcctgcccacctccaacccacccacccatccttcctcacttctgtctgtacagactcagtgttcaaaagtcactggtggccagactcctgccccacccatcccgttatcccacacctccgaggctgcatcagatcagttcatttcagttcagtcaatcagtcatgcctgactctttgtcaccccatggactgcagcatgtcaggcttccctgtccatcaccaactcctggagcctactcaaactcatgcatcagaacagctatgagcacgctgagctcgactccctagggcttagcctctcagcccatgctggtccatctccccttcctcaccagctgccactgcccagcctcagtttctccaacagcccctcctctgaaaagccttccctgccaccccccccccccgcctgccccctccccactccctatggcatgggttagaagtgcttcctgctgctgctgcttctgttgcagcacatacaccctgtactgtaaccatctgtgtataaagctgtaaccctgagagagcaggccctattgctcacatgtctcagggcctgggacagagtgggactggggagtatgcacaatggcaggagttgggacagtgaatcaagcttcacagtccagagctgtgagtaggtctccagactcacttccctggcatctagggcacactggacctgaatcccatgcctggctgctttccacatgccctttctataactgggagatcccaggcctgggaggcaagaggctcacagtatggatccagctctgtactagcttgctgtgtgatcccaagccgtgtctaactctctctgggacgcagttttcctgtcagcccagggggggctctggcccatttgagctctgcctccccagtacatgttctaacatcagccaagctgatgtccctcctcctctaatcaatggtgtcttgataatgtttagtaactggttctctggggagaaagaaaaaaaaaaaaaggctctgatctttgcttctgtcaatttccatggtattactataaatactgccactgggctgattccaagctactaacttggcatcatggaa

SEQ ID NO: 39662 - DNA, 4034 bp, Bovine  19866880455243
caccgaattagggcccaccttaattcagtatgatctcgttttaattggatcacatctgcaaagattctattgtccaattaagtcatgttcacaggttttgggtggacacaagtgggggccgctattcaacccagtacagggaggaaaaggaaagccaataagccctgagagcctggctgacattcggggttgtgaatttgggtggggttccagcatgaatttggagttgtaccagctcccaggacacacagatgagttcatccagagctgggggtggttgggtggacacagtggaaggtcaaggggccaagagaatctgccgtttaaacaactggcctcggagtccaggctagtgggtcaggaaaggggtcataatacaagaagattaagaacttggaggggagggtcccagtgtagtccaaaggggctctgtaggaacaagaacaggtggggtatcatctcagagtggctcctgtgaaatgtagaaagacagaaatggaggaaggctgacgtaggggtgggagtatatagctgtcctaagggtgatgctgatgggagtgacagaggatcccgcagacaacattaaacatagattctttatggcggaggatgcagaaacctctgcccagagccccctgcatgaggcagaagcagtgcagtgagctctaacatgcagagactgcatcctgggctccctaaagcctcatagcccataatgtggtccaggctggcagcatcggcttgagagaaatgcaaagtctcaggccccatcccagccccactgaaccagagtctgcttttcagcaagaccccagcgagttgtttgctctttttcgtccattaaaaaatattttattggagtataatcactttacaatgttgtgttagtttctgctaaaccacaaaatgagtcaactgtgtgtatatggtatgtcccctccctcttggacctccctcccaccccatcccacccatctaggtcatcacagagcaccgagctgagctccctgggctttgtagcagattctcactagctatctattttacacatggtaacagatacgtgggcttcccaggtggctcagtggtaaagcatccacctgccaatgcagaagacacaagagacatgggtttgatccctgggtcgggatgatcccctggagaaggaaatggcaacccactccagtatccttgcctgggaaatcccatggacagaggagtctgatgggctacagtccccgaggtcacagagtcagacatggctgagtaactgggcacacacacagtatatatgtgtccatcctaatcctaagtatacatctctccaaagaagacacacagatagccacagaggcacatgtaaagatgctcaacattactaattattagagaattgcaaatcaaaactgcaatgaggtatcaactcacactggtcagaatggccatcttcaaaaaatcaaacaatacatgccagagagggtgtggagaaaagggaacccctcttggactatggttggtgggaatggaaatttgagtcgtgtgctctccaagtctgagaattgctgctgaaagattacttagggggctgcacccacatagagcccagcatccaacctgagaacacgctcactcttcttgcccagacccgggcaccttggttcctcctgacccatccagctagggcctgcctcctcaccagggacgactagctggcccaaaacaggagctgcacggtcctgtttcacaagatcccgggagactggaaggcgggtttcccagagatactggccgcagtaggagtaagctgccaggattttgaaggcgctcagttaggtgcccaggcagacagggagggagctgtgagggccttggggagacactgtgctctggaggtcagtggatgccagcaacagggtgggaggaggtagcctggctaatacctgggggaaggtggtcgaaaagaggtgaggcggttgtccagttgctggtctgagtctctgcaagctgctcagtgaccaaggtggcgttatggttataggcacgtgcatttcagatttgttctttccacggatgtttgtggccagattatgacagtcgtgttgaatttgggctagggagccaggttagaacagatttcagccagcattaaaaatttgttttctaacttttggtacctctcagttattgagttcctaagattgtttggctggtaggagactggatagtggggcaggagggggaaggtaatgacatggccccttgcctttaagatgcttctagtctggctgggggcaaagagtccactcttgggagaccaaccaggcctaagacctgctgctctgtcatccgggtcaagtacatggtgccatcgcctgggtcacaagtatgcatcgaggacaaggcaccctccctcccagagaaggtgggcatcccaaataaggagaggcacacagtgggtcatcccagaacacaggctgacacccctggcaggagaaataatgaagggctctgggttagtttcctagggcagccataattaccacaaactgggagacaggaaaacagaaaccgactgtcccacagtcctggaggctagaggtcaagctgttggaaaaatatggttctttctgtctgctccaggcctctctccttggcttgtaggaggcagtcttcatgttcggctggagttctctctgtgtgcagggctgtgcacaaatttccgcttttcatgaaaacaccaatcatactgaattaggattcaccctcatgttaacctcattacccctatccgattctttgtgaccccatggactgtagccctccagtctcctctgtcctagaattctccaggcaagaatactagagtggacagccattccttttccaagggatcttcccaacccaggaatcgaacccaggtctcctgcattacaggcagattctttaccatctgagccaccagggaagccctgtagagaccctgtctctgaataaattctgaggtattgggggttaggaataacctgtcggttgttccccgcaggccttggtgacatggcggtctctaacaccataggaagcaacgtgtttgacatccttcgtgggactcggcataccgtgggggctgcagaccatggttgttaattatgggtccacggtaagttcgtctcacttccttagtgagatgatgctgggcacttgtgcttcacagggagcgagcatggtgttggccctgcagctaggagctccagggggggcgctgccccgtctcctccgcaggctggcagccgctttgtgcaaaggagtccagagcagcctgggggtgcctgcaagaggccgcccgtgtttgcctggaactcacaggtgcttcagctgtgaacacccacctgttgcttccagaggagggaaaggataagcccaagtgcagtgggctcccagaacagatgggcctctgagcagcccagaggttcagggcgtgtgtgtttatttctccaggtgaagatcaacagtcggggtctggtctactccgtggcattgctgctgggctccgtcgctctcaccgtgagtttttacaattctagaatggtagtttgacacacacgtggtttccttcaattctgcacagtctctgaattcttccccttggccgtgagggataaagctgaaaaaacgtataaattcacagatacccccagacacagtttgtgccaagaatgttggcatccaccactacacttttccctaagctggtgagaagtccccagaaggagggactttcctctcttcttcctgcctggtctgtctccctacaatgatgcaagtaggagacacgttccccccacccccagtctattggagctgccctgggggcatgatggtcagggctcggggatggtacatggtgacacggaggtctccttattccacaggccccgaactgtggtaaacaatgcctcggcttagtttattccatccttacaagcacctgatgattttctactttacagaagaaattaaggctcgggaattaagta

SEQ ID NO: 39663 - DNA, 1093 bp, Bovine  19866880522300
ggctgctgtccatggggtcgcacatagtcggacacaactgaagcgacttagcatagcatgctgccctcctttgcctggaaaacaatttttcctgcacgaccctgcagacatatcaggtacctggtgaaaccgttctcactctgtggcaggttgagtcgcctgtgtctaataggactttgtggctctctctctgacagctctcttttatttgtccttatattactagcatgtgtggtaccttccttggtgcatagtacatgctcagtaaagattttgctaagtattaaaaatcggtttttattgttttgtctttgtattaaaataggacttgcttaacatccagtttattgattttataaatcatttaaaaatagagtcagaatgcagttcatttattcattcaacaagtgtttattgagtgtctaccctgtgccagcaacgaacaaggtaacagttcagaatagcactattgatacaacttgaaaattgtctatagttacaatatcagaaagttgctgttctaccaagcactatactgatttaggagcttgggcttttaaatcagacatggattgaaattccacatccatgggttacagattgtgggggtcttcagcaaattattaaatacttaacctttaaaaagcaaagttttcttatctgttaaaaagagataattctacctatcatgaagttgggaggattaaatgaaataatgaaggtaacatgcctaacctaacactgtgccgaacaaatagtaagcattaataaatgatggttgttatttttgttttccctcattgaggaaaacttttttggtctgcataacatctcccctttatcttaaaaaggccatattctggggagagggatatggagggaggtcttcatgaccttgtttttctttaatctctctttgaaacagttgcggcttctaacagtgaccttcctaaacagattagattataatttgttctcttctgagtagcaattagacagtcttgtcagagtttcaagcaatttgtataaacaaccatacaagcatccccacctagtgatttttcaaaacaagaagagcaggtttgtcattatt

SEQ ID NO: 39664 - DNA, 1743 bp, Bovine  19866880685204
cggcctccctcccggaagcagtgcctggggccgtctggccaggacctgcagagggggcaacagagccgggaccacgaggtgtctcggggccctggctggtggggccagtcagtgcctcagccccgccgaagctcctccagctggtgggccaccttctccagctctgcctcgatggctgacaagctctccagctcctggtcctaggagagaacccccagagtcagccgggcactggagcgtggagcgcacagtcagcctggtggctcccagcttagctgtgtgaccttggatgggtggctttgcctcactgagcctcatctatttcatggggacagtgaagctgccctgctgcactgctctgagaagccggcgtgcaggagtgtgtgccctgaccccataccttccccagtggactcattcaggcccacctcctcctcaacggctctgggcagacatgtgggaaaccaagcctctggtgcctttcagagctgcttcgagtcccccaaccccaggctaaggctttgacagtggcttccagggtaaggccgtgcctgggtgtcctgtctgctgcaggcctccctacccgaggggcaggggaccaggacacaggcttgaggacgtgagcactgtctggacggggcctccatcctctgtccctgtcactgggtccccaagctctggctgccagggtggtccagggcagccggggaccctctgggactgacgcccacaagagcatgccctcagattcacagcaggagtcagccataccccagctttgaccgagaggggtgattttccaggagtccctgcctggggcccagtgagaagagacggacaatggttgccaatgaaatggggaccctagtggctcccatcttagagtaacaccccaggcaggagttctgtgattctgggctcattttttctaaaacctttgggctgagtcggggggccctgccctgtccagtcctcaggactcgggtccccatttctcctgcctgtagtccaaggtcccctctgcccgtggagaagggaagccagtcagtccctcagggcccctggctctccccagtttctgtgggtggggaaggcagtgatgaaaggtgccagccttggggaggggtgagaggcaagcagctgcttcctgaaggcctgtcccctcagcccctggggacacaggcagatgaactctcagcgccagctgccaaggaagagtcttctccccctcagactgctgagacccagtcccaggtccagagaatgggttggggacccgaggaaagggccgtattgtcttctgggtgggcagagaagagcactggggccacagcttcagacacatcccagcccccataaggccctgatgccccccggagaactaaagcctgaaccatggacccccccaaggcctcccccagctccaaggtgctgttgccagcccgccccaaagtcccatcccatcccctcccatggtatatgtcttcacacccctctgagtttcccaagtagcctgggcatagctagggtttcaaagctcatgtgcattctgatcatgataatgaggtgggcagagaggacttcttacccccatttcacaaatgagggaaccgatgaggctcagagaaggggagtgacctccccaaggtcacccagctaggaggaggtagaccccgggtcttctggcacatgcccatgcctccccaacccgtcaccaccagaccctccccactttgccatcag

SEQ ID NO: 39665 - DNA, 2566 bp, Bovine  19866880701408
tattgagcccatctttgcatgaaatgttccaatggtatctctgattttcttgaagagatctctagtctttcccattctgttgttttcctctatttctttgcattgatcactgaagaaggctttcttatctcttcttgctattctttggaactctgcattcagatgcttatctctttcctttgcttttcgcttctcttcttttcacagctatttgcgaagagttgactcattggaaaagactctgatgctgggagggattgggggcaggaggagaaggggatgacagaggatgagatggctggatggcatcactgactcgatggacgtgagtctgggtgaactctgggagttggtgatggacagggaggccctggcgtgctgcgattcatggggtcgcaaagagtcggacacgactgagcgactgaactgaactgaagagaagggaagtatgaagcctcagagcttcagctgaagcagcaaactactagctacagacatcagttacgccagaaagacacagaaatcaggcttctgacagcaagacaggtagcaatgaaggatcagtggctaaagctacaatcagtcatccactcagtaaatcttcaggatagctttcagccctcaactcctgcaccctcttcactgggttatgatgtctatcagcatgctttagctttccagaatgatgatatggacttcgctgatctaatttggtcacaacaagaaataaatagattgtcaaatgaagttttaagacttgaggctgatgtcagccattggagacattttgctcaaacttctacagcatgtggagcagatagttttaatctaaaggaaatctataaactgcaaaatactatcaaggaacttgaacagaatcgaaataaggaaattgatgaccatcaacttgaaatggcagtactgcaggaaattcatcagcagaaactggcagaaataagtggcaggcatcgaaaacaattaaaggattacgaggagatgattcatgataagcaaaaagctatccaagtcctagccactgaaaaagtagcatctaccaagaaaatcaaaggacttgagattagagtaaaatacctttaaaaaaaaattatcttcggtagaaaaggaaatggatgctttagttagagaacaagaccagataaatgaaacgaataaaagatttaaaaaaggtgagttgaagccttctactaagaagcatagtgatgctgtgacagaaaaggaaaaagttcttccacagagaacatccctggaagaagcatccagacaacaagagccattgtctgatgctgaaaattaaatgatgagattaagtagcttgaagcagaataaaaatctcattgaagagaacctgaagcttcaaaaacgagcccaagttttagaaaaagagaattcgttattaaatagagaaaaggaacttcaactatcacttgtcagattgagcaatgaatatgaacccattaaaagctcaactataggacacacgaacttggaggaaaactcaatgagagcactgctgaaaagaaattactgatccctgagttaggagagctagacaggcagaaacaaaaaacgacaatgtgtgtggttttgatgaaagatcagaaataaaaaaaaaaatgaaggagacatcatcatcagtaaactaaaacaagatctagaatgtgaaaaaaaagagcgttcatcaacttgaagatgataaaatgaacattactaaagagttggatcggcaaaaagaaaagttaattcattaaaaaatgcaaaaaggacagaagcagaattgtgtcaggcggaacagaggctattggaagaaaggaggaagtctgagcaagctattaaagagctgtcaagtacagagaacccagacagctctgcctattagctggagtgtgagggtttggttaaactcggtcaagagaaatactgttgagcagatgattgctgaccacaaagaaaccaaagaaattttgtctagtttagaagagcagaagcagttgaaacaacataagggagaaagacatttttttattgaaaaacttcaaggaggttcacagcttcaggaggagttaaatcagtatgctcaagccttaagaaaaatggaaaatttgcagcaaaccatagtggaaaaagccaaagtcttgcatccatgagagaagaaaataatcatctgaaagaagaattggaacaactgagggaagaacacagtcaaaccgcaaacaatgattaaccctaaaactgttccagaaatagaatctgaggactctccatggagcacagttgaagataatcttgaaattaaatctcatcaaaagaaatagaaagatctcagataccaacgagagcaaatgaatattaaacacaatcagctcttttccgcccaaggggaggaaatcgggaatttgcaaaatgcagcagaacaaatcaaaacccagttgcctgaagaatcccagtacatgccagtagaatgctgtgacatttttcgagtaacagaaagaagttcagagccttcacatagaaaacggaaggaaaagcagacgatctaaagccgaaa

SEQ ID NO: 39666 - DNA, 1188 bp, Bovine  19866880714873
ctataaaaatgacttgcttcatcaattaagtaattgaagctttgattctaataatattgaacacctaataattccacatcatgtccccatatatcttcctgcatgggtgaaaccaatctaacaaaatactataaacatcatgggttccaaaatctactctctgggtcccagataatatcaattgatactaggctccaagagaatagagagaaaaacacagaatgagtaactgctacttttctttgtcagtgtggtgttcaagagccagaagaaggacagaagccccaccaattcctgccccagcccagatgtgtggcgtgagttgatggaactttctctagccccctcgttacacaatcagcaaagtgacgtgatcagcagagagctgggtgctctgcccccactcccctctgctttttggtcaagtgagtcgcgatggtcagcaagcctgcccttcctgggcagttattacagttcagataatagacccacaggcgtcagccctgcatttatccgctcacaatggctcagttctgcaccacagcattattccaagcccactttgaaacaaacgcgccttgaaacacacacagatgcgtccccctgcccccacgtctgctggaatcttgaaaagacacctcagcgaaaccaagctgggctataatgagaaaggactgttcctgagcacgagccccatggccggcagaactttaatcaataaactcaaatgccaggtgagattgagatgcaggggcagagtgagatgccaggccctgcctggcttgcagagttccagctgatatagggcttctcccagatttggtcacaaacagatgcggaggacatgggtgacctgagatgtttcatgatgtcctgtttagatgaaaatgccatcttccgcctctctatctcctttcatgcctgaggtgtccaatggcaagccagtcttttacattattggaggcactgggtccctaaagcttctctctaaataccggaagtaggagatgcacttattgtcactaccatccatatcactgtccccatggtcatcaggtgtgctctgattagttttcacagttacggagggctcctgttggtttgccatttaaccctcacaataccccgattgaggtatatgaggcagagactcccacatttatagaataagaaacgagactcatacag

SEQ ID NO: 39667 - DNA, 1226 bp, Bovine  19866880750358
gctcgtcttggtttgcctggccccagacatcccaagtactaggataaaaagcctcaccacaggtgaggaaaatacatgttcagtgtcccaggcaaccccgctggccacttgggaagccacagtattatgcctgtcccatcaacttttcctttctgcccaaactatttaaggaagcagtcagaagtgaaaccttctggaaagttctgtagaaatggactagtgacttctatgattttgtgtgcgcgtgtgtccatctccctggatatcaaggatctgcctgcaatgcaggagacagaggatatgcgaattcaatccctgggttgggaagatgccctggagaaggaaatggcaacccactccagtattcttgcctggacagaagtctggggggtctacagaccatggggttgcaaagaatcaaacacgactgagcaattaaaccaccaccagtgcaaagaatcagacacgactgagcagttaaaccaccaccatttctctagatctgttaggaatccgtgaatagtttgcattgcttttattggcagtcccaagtctgttacatacattctgttgtgctttttgctgtctcggccttggtttacacagtggaaactttcagggaactcgcccgcagtggaacttcccctcttgagatgtttctttaatgtagtcgttgtttgcagttcaagactgccctgggaagcccccaggtgagactcagttcttcaatactagaccctacccttgaaatcttatatagcctttggccccagctactggggaaactcccttgtaccagactgtgtactagactctctgtgtaccaggcatgaggccgtcttcatggaagccattcctcgtgtctttaccacagccctacgaagcaggtgctaggcccccattttgcagcggagggaattgtgcccaaggatgaaactgggactgaagccaggctctcaactccatgttcaaagcaccttcatctgagcaggttgcttcttgtcttgcctccgtggtcctcatgtgcatggggcttcaagttagggctggtggggggcacagagagcggggtgtcgagcagaccatcatggcgtatacatgagaactttgaaactaccctccgagtatgtgaatattgttcagttgtgtccaactccttgcagtctgtccaactctatacagtccatggaattctccaggccagaatactggagtgggtagcctat

SEQ ID NO: 39668 - DNA, 1111 bp, Bovine  19866880760102
aggagcccattaccagaaagaagtggaccctcttctggagacctggaggagtgtcgatagaggtgattaatggagtagatagaacgacttagaagcagagattagagcggctaagtcactctggtttattaagcctctgtcaaagcagactgtgttgagaggaggcgcttgacatggtttggcagtgatttcacctggttgcaggaggctgtacctggggaatcctcagacccctgcaggaggggaagagcctcttaaaggaaaccttggctcatcaaacagcctcctcaggaaaatggaagccccatcacctgggctctttaaattagatggggcagcgtgctggagggtttataaaggaactggtagcagaatgaactggctgtgctgttgcatcttttctctaatttctgagtaattcttctatgggcctcagagggggcaaacccttgaaagaattgctttgaaacctctttggtcacttaaaaaccttgcttgtttttccttcactggcaaaaatcccaatgtagcgtggtgtgacaagtatctaaatggcttgagggctttgggtggcccgtatgcatttggaagaagaaaggaagaagtggaagggattggtatctaatttgtagaccacaggcactgggcaggcattgctgctgcttccacagcctctgagctccaagctcacagtgaatatttagacgcacacaatgaagtcagaagggccccgagagatcatggcggtgcacgtgttagagcacagagccgtgcgtctccatcgttaatgtgctcacggtcacctggggacttggttaaaatgcagacgcaggagatctgggggatgcctgaggctctgcattcctaacaagctcaggggagatatcagcattgctgctttggagtataataagtctcctacctacgaaacttcaagtttcaaacgttcaaagatgcaaacgtgtgttccataaacatcaggcatgagtgacattgcagcttgccctccgtctcctattgctgacgatccttcagctctaccatcttctccagctctaccatcttccacctcctctccctcctgccatcagaacctcttcctgcctgttca

SEQ ID NO: 39669 - DNA, 1050 bp, Bovine  19866880824160
cgccactcaccagccacaccatcaggtaggagaagacagcgatccacagcgtggcgatgacgaaggtgagcatgaagaacttctccccagcggggcttgctgcagttggggatggtgatgcacaggaggaagatgagcggccaggtgaacacccacttgactttgtcccctcttgcctctgcagaggggtggggtggagccagaagggggagaaacactaggttacacaccatcagtctacctgcaggtttactttccatgccaaacaagaaaatgctacgaatatgactcccagcaacggactccacagaacgccacgcctccggattgtcaacctggaagtgatcgcagcaaaacggttgagtgcttgttgactgaataaccactgtcagtccaaatccttcatttgacagggtgaggaaaatgagacccagagctggaaaaatttgtacaggacagctggaatgggatgttgagtatgaataggctttggagtcaaacgtgcattggaattcaaatgaccttgagcaatcccctcaactccacttcctcctctgataataacagatgtaagtgacaacccaatagttgatgcagggaatatttgctacgtgaagcaggcataatgctaagcattttgcattttagtagttttcttcatctgttaaaaggaaacaatgcctctttcttggctgttgcaaaaatgacatgatacaatgtatataaaacagccagcacaaagaacttggccaaaaaggtgctctagaaatctcagctcatttgctccaaggtcataaactccaccagtggcagatgcaagactaaaaagtggtgttctgctgacaggtatgacctcactgacccctaccaagggaatccacaaacaatttaactgaggagaagtggccactgagtacaagcatagtgtaattatccttaataggtggcttatccttaataagccactgggtattttgagcacatgcacgctccaaagcaggcttgtgggtaatgccaaagatttggtggaggaagggacctctgaaaatt

SEQ ID NO: 39670 - DNA, 1281 bp, Bovine  19866880848604
cttactatacggaataatggtaagtttacatctattaaaatgagttatttctgaggatttaaactgaagttttcatcagttctaaacttctttttattgtgggtttgtgatttgtaggaaaccaaaagataaacctgattatttcaaagtgagagaaaaaaaggaaaaattttgaaaatttaccacctaccctccaaggtacccaacaaagcagcaagtgagccaggcatgagtatagacaaaaagtgaacgatctgtagtgggcaagtgtggactggtgcccagagcagcactgcagaaacaggaaatggccagcgctgagcccactcaggcccctgctctgggcccggcagcagctgttacctgtaaccacccacagtgaagccctggctgcaaatgctggtgaccgacgagtccaggaggactgaacaggggaacacatacagagatatctgcaggtcccccaagagaggttctaaagaactctggatccacctcacaggtgttaggaatggaatgaaagagccacagatgaaagaatcaatctcacaagtgtcatatatatattcacccacagaattcaaggggagcgataagttcacaaaaagggagaagacgaaagccacagaccataatgaaggaattcaatcctggtaggctgatttaaatgcaaggttagcaaagggttcccctctgtccatgggatttcccaggaaagaatactggagtgggctgtcatttccttctccaggagatcttcctgacccagagcaaacctgcgtctccttcattggcaggaagattctctactactgatccatgagggaagcctttgaaatactgtgaattactggaattacagttattagcatacagattcaaattaacaacctcctttgaaaaaggccttctctaaaatgaagaatctactgtcctaattttcatgtttatctatatagaaaactagtattctaaaggataatcttatactcttatactcaacctactggaagaacttctgaaggtcacatcaatacagtgactatgaaaggctgtgaaaagcatacgctgagtttagtgcctgggatataaacaacacttagcacatgcttgtgactacttacttgaatagagaaaaagccactgtcatccatatttccagaaggctgctgttgaatttggagaaggtggttggggcgtacattgagggtggggagagaagggccaagtgtcattagtgtgtgtatttaaaataacatcttgtgcattcccatctacaaa

SEQ ID NO: 39671 - DNA, 859 bp, Bovine  19866880926257
atctatgcatttattgtagctaggaaactatatatatgtcgtaggtgaagaagtctcttttgtaactaaatattttttccatttcaagtttaaagaattgcttgattaattaggccttcatttgaaaaataatgctttcgtcactgagcaggattacttcctttattttattccagaagctaattagcacagagtaattactctgctatgaaaataggcaatctgaaaaataaacttggctctttgaattgggggcagaaaaatgaacccattgtactcagatagaaaacatctataaaagcagaagcaggaggctcctggcatctctggtctggattttcctttgccagccgagtgtagtcaaggggaaggtatgcagtgtcctgagagcctggccctagaggaaggctctaggtcagctgcagtgagagactgatgttaaaggcagatcagaatggtctcattcccattcttcctgtaacccatggtctcccgacctctgtgttcaccgtccataagcaccgaccttgtgagttttcctctgttcattacctgctcctcctcccctcatcccacctattaggactcgttcttgctcctccagatggtgcctagtggtaaagaaccagcctgccaacgcagaagacatgagacactccctgggtcgggaagatcccctggagaagggaatggcaacccactccagtattcttgcctggagaatcccatgaacacagaggagcctggtggactacagtccatgggcttgcaaagaggttggacacaacagcgatagggcacattgcttctccttgtcaatcttttccttttacacacccaatcagctgaaaagaataac

SEQ ID NO: 39672 - DNA, 1579 bp, Bovine  19866880962466
tgccaggttataaagagaggaagctaccagtcagattctgccacgtgtgaatgtacaatcactagtgagaaatgaggctctaacacactgtccttatgctgagcacaacttggagggaagttcaaggtagaattgataacatattcatgtgtcaggattcagtgaaccttatagtcaggatcagactatcagaacccatcctgagccaacagtcaggttaagaccatttggtgatcaggcagcatccttaaggatgcaggcttcactttctggtttccctggatggggatgaccttcaaaatatctcagcctatccacgcatctccaaggtcactgatttaatcaatgggagtccatttctaacacccagtatgttggtcatcaaattaggattctgtttaccagtatatccaagtcattatgcagattatcagagtccctgagttgatggggaagagaggcagctgaaggacctggggtttggccattaattatgctaactcgctaccccaggggtgggaattctagattagggcactggcatcctctagggcaggggtccccaacttcaggatctaatgcctgatgatctgaggtggagctaatgtaataataacagggaaaaaagtacacaataaatgtagtgcacttgaatcatcctaaaaccatccctgcccctctttcctggtctgtggaaaaatcgtcttccataacacacatgccggagaaggcaatggcaccccactctagtacttttgcctagaaaatcccatggatggaggagcctggtaggctgcagtccatggggtcgctagagtcaggcacgactgagtgacttcactttcacttttcactttcatgcactggagaaggaaatggcaacccaccccagtgttcttgactggagaatcccagggatgggaagcctggttggctgtagtctctggggtcgcacagagtcggacacgactgaagcgacacagcagcaccagcagcagcagcataacacacacacacactatctatactgaaagctctgagtaaattacacatcttttaaaaagtggtcgcaggacagactgaaaatacagaatgccacctttaacacttatagactgtgggactcagatttgtttaactgccctgtttccccatccatgaagtgaggataagatctaccttaaggcttgctggtagagcttaagaaatgttagctgctgttgttaagtgaaaagaaatgcttctgagcttttcttctgtctccactgatatgaacaagacacgtgccctttagaatcattctttagtgctccttctctgatagaaaagctataggcttcattatagctggagagatgggaacaagaatggcagggactgggggagtagaggaaagaaaatggcattccagcacctgctctttgatcagcactgttgtgggtgacagtgaacaagaatcctgagccccagggagaagtgggggctttcctggggaggagaggccttgaacaaaaattcaagaatgacatgagctgtgaacaggtgcaagaggcagtcagagcagtcaaggggctgatct

SEQ ID NO: 39673 - DNA, 1366 bp, Bovine  19866880966266
acacaagcctctgggtagtcccatggcttaacttgttgggtcatctgagaaatgtgtcctgaagacctactaagtgcccaacatgagctgcagtcatcttggggagctcttcctctgctgacagagcccagagcccagcagaacgacaaaggggtttgtcgatgatctgaccaccccctcagaattccatctacaggtgaggaagaggagacccaaaagaaagagactttctggctcacaggtggggtagacccagaaccagcatgctctggtcccaaagcatgcagctgctcacgtcaggcctcatgaatacattcccacaaataatcacatacaggaaacagatctcaatcactgtcaacgaagagaatgtttttatggcttgtggaaaatattgggttggccaaaaagtttgcttgggtttttaccataacgtgttatggaaaatacaatgtgatggtgaagctccaatactttggccacctgatttgaagagctaactcattggaaaagacgctgatgctggggaaaattgagggtaagaggtgaagggggcgactggatgagacagttggatggcatcactgactcaatggacatgagtttgagaaaactcagggagatagtgatggacagataagcctggagtgctatagtccatggggttgcaaagagtcagacatgacttagtgactgaacaacaacaataacatcatgtggaaaatctgaatgaactctggccaacccaatacattcatgccttaaaggttagagtggaaatatcaaccttctctttagaagtttgtgccttttgtatcttaattaagaaatcatttccaacctcagagtcataaagatgaattctatattctaccctaaaacgctttaattttgctttttgcagcaaaatcttgaattcctctgggatttattcttatataaggtgtgagggattctacatggattccttgttttcgcagcacctgagggctgcccccctccccatccccatctctctgccttgtcatgatgccccagcccagaactgggcccattactgcattcctcggttccatattccacattggcccatgtttattcctgtgcaaaacatcatactgtcttcattattttagctttataaaatatcttgctatctggcagggtgggaatattaaggaaaacactctttgtcactttgaaaggatagataaaggtatgactgcttagaatgataccctttaggggacgtccctggtggtccagtggttaagaagtcaccttccaatgcaggggttgtaggttccattcattgttggggaactaagatcccacacgtcacaggcaattcagcccatgcaccaca

SEQ ID NO: 39674 - DNA, 1727 bp, Bovine  19866880969236
tgcttcccaagttgctagatattctcagtacccaagataaaccttagagaggatgatctggtagtccatcttattcctaaaagattatagttcctaaactttatatgtgttagaataacctgagaaatttggtgatactgtagctccactgttactaaccagagtttcaaggttagtattttgtaggctgttttagggtgatggaaaatatagtcaaataagtactcaggggatactgatgctctgaggaacacattctaagaaacattgccaaggtaagagttcgtgtggaaaaagatgaattttttgtacatttacttcagcatatcttgaatgccttctgtaagacagacctgtactggggtattatggtgaaaaaggtaaaattgggtccatttcagggggcttaattttctagtaaggcataataaaaattaatatttatatcatactttaatttttatgtttccctatatactaatctaatacagtctttaataactatgtgaggtatttattacctttgttttgcagataagcaaagtaaaggtttaagtaatacactcattgtcacagtgatttaaattgtgctttaaacacacatctttcaactccaagccctgtattctttttaatgtattgtgttccttcttttgatcggagagcaatttttggttccttaacatgctgtggtaaatgttaataaagataaatgagcaatacacagctttgaatgaaaagaaaatcatccaaaagccaatacattaatattagcattagtagtattaatattagcattaatattgggtaacatttccattttagaaactacctgttaggaagctgcttgattatcatcaaatttaaattttgttgagcaaagaaaaacattctgcggtattttctttcttattttgtaaaggtatggccttccttaattagttaacagactcttgaacagtatcgtttatttattgtgtattattactcactgtccgactaggttctttaaaaggtgcttggcagtctttagtaagaatttgtctgagaaacgccccccattttttcttacttgcgttttttttctgtttttactgaagtgtagttggtttacagtatgttagtttcaggtgtacaacatagtgatgcagtatttttatagatggtactcctttaaagttactataaaatattggctgcgttccctatgtaaatgcccctgttttaaaaaaaatatcttttattaaagttagtttttgatattctcttttataagaaaatcagtacagttactttctaattctgtttttctgatctagacttctaaagcacaaggatcagttagctctgatcaaagtgatatctgcaaactgcaaaatatcattaaggtaaggtggattgctgaaacaatggctattatacatctaaaatttgcttattaaaagtatacgcctaaattaataaaagactcatttataaaagtgttttatagattatgatattctttttttgccatttttatatcttctctattctttatgacacttttaagagtataaaaatatctctttccaaagtcatttggttttgctgctaagtcgcttcagtcgtgtctgactctgtgcgacccccatagactgcagcccaccaggctcccctgtccctgggattctcaaggcaagaacactggagtgggttgccgtttccttctccaatgcacgaaagtg

SEQ ID NO: 39675 - DNA, 1632 bp, Bovine  19866880988423
ccgttgtgctgaggtcaacccgtacgtggagagggcagccctaattctctcctgtgtgtcttgggttgggcttgctggaagcctagagatacagtgactaagatctgaaattgggcccgggggagatccgatctggtcctcagggcctgactttgctctgttgtttctgtagaggtgacagaagaggtgtcctccaaggatgctgcagaaaaaagagacgattctaaagaggtggagaagagtgatgaagactcggacggagacaggcctcaggcctccccagggcttgggccggggcccaaggttgaggaggacaacccaggcccctggggaggaggaggaggcccctctccaacgcccaccccctagccagcctccccagcccgaaatacccaggcccacaggccaaggaggacagcgagggtccctcccagggtccagccagcagggagaagggcctgagtgcagagcaagggaggcagacagagagagaagaggaggaggagaagtgggaggaggcggaggctagagagaaggccgtcccggaggaagaaagcccgcccaccgcagcgtttaaacccccaccgagcctcggcaacaaggagacgcagaggggtgagactgtgtctgatgtctgagacttcagcagatgtgttggggagagggggatgggtgggaggggggtcccctgatccataatctcattccaccttctcaacaaccctgaaaggtaggtattattcccatctgccagatgggaaaccaaggctcagagaggttaagtaatttgcccatggtcacacagctgatttgtagtacacgcggagattccatcccaggtttgtctggttccaaaaccctgcatcttccactagtccacatagcccctctccacccccaggaggggagaggggctttgcagggtgagtgggtgggatttgggaaccgaacagcagcatgattggagggaacaggctggtctggggacgctgctagcttcagccagggcttaggaagaggtcctggctcctcctgagggcctgatcagggtctttccttcctccccagccgggcgatccctgggttggggcttctgggatgagagggctaaggaagaggtgacttggagctttagagggtcttgtaaagcatggcgtcaaggtgacctttccctccaaggggagtctgttgtgagaggctgagctggatctggcgtacagggtctgtggtcacaacagtggccacagagagacctaagggagtggcagggacccagaaaggtggcagccgctcccttattctcccgctcttatctaccagctgctccaggttggcccgaggatggagccgggaagatgggggctgaggaggccaagccccctgaggggaagggggagtgggcacactcccggcaggaggaagaggagatggcaagggcccctcaagtcctcttccgtggtgggaagagcggggagcccgagcaggaggagcagctctccaaggagtgggaggacgccaagcgatggagcaagatggaccagctggccaaggagctgacggccgagaagcggctggagggggaggaggaggaaaaggaggaccccgaccgctccatgaggctctccttccggg

SEQ ID NO: 39676 - DNA, 3231 bp, Bovine  19866881061899
ttataaatcaaaagtatttttgcacagttttaataaatacttaattgtctagtgagttagctatcatgcaagtggagagggatgactgtacttgggctcagtttaggattttatcaggagtcattcacaatttcagaaaattccatcatcaaatgtcaacacccactcatgggtggccagtccaagcatatcagcctgcactggcacccacagggcctggagacttcctgtgtgagggcaacagattacatcactcagcgttccagcatcttcctgcccaaacagttacacactagatgtattcttttatatgcattacttgtgccttttatgatatgctttcgggcattatgctgatttggtaaaatcgtatataggtaaattgttttacctctaactttcatttttgggagtgtggtgggcagtctctcagatacctgacattcaagctccccttggcatgtggcctgatcgtagggatctgctcctaacagaatatggcaaaagtgagggctgtcacgtccgagattcggttacaaacagactgtggcttccatctcggcacctccttgcccttgctgggaggggaagcagtccccagtgatgtgagctgttctatggacaagcctgaggcctgcccaccacctcatgcgggatcttgaaagcagattgttgcccaggggagccttgacgtaactgttttctggacggtgagtacacagatgagagatcctcagccagagggcttggctaagccactcccagatttgatccatagaaaaagagggcaataaaagtttgctgtcttaagctgctgagtatgagggaaatttgttacatggcgacagctaactaatacaaagatcacggttatcaaatccagttggctctagatgtccttagggggagaactattctagaatacatttcatactctgagatctgggcatgccacatgcatctgccctcttgatgtgacctgccctcattcagtcacttgaaagcgccttttggatggaaactgctcccctgtgggtgacacggtcctcagcagtaaactgtgtcacgggcttcactgccgtgtcactgtcacatggtatgcatgatgtcaccccaggcctcaggggtccctgtttcaggccctctgctttttctgcccacatcctcgctcccagctgcctaacctgagggctcgcagctggtctctctcttcccagctctgcagtgagctaggcaaccagaaactctgctccttgggaaactggctctaagtgaggatctgaaggcctctgatgagcacattcttaagcttaactgcatcaaccatatgatgcctgctttagttttttcaaggccgttctgccctcaaggtggtaccttggatgtgcttgataaccaaggcattgggtatgaggtttttgggacagggaagcaccgtggaggggaataggtcaactcgaccacagtgagtggccagcacaccccagggccggggtgccgtgggttctctggtcatagtgccagggacaggacagtggggcgggggagggtgtgttaactcacggcaatgagcacgatgacagacagggtgtagtacacggagtctcggcacacgggcccaccatgtcagacggaccacctgccgagcaaagggccgttagcgtcaccagctggggggtgtcccattgcccccagacccctgcagctgcagacacatgccctcggagctcatcttaactgtccaccaggaccacagtgtgtctggctgctccaggccaccttgctctcttggtcatatttggggacagaaggatagtgtgttcacattcataagtaatggcaaagctgccccctgctccttcacggtgaccacatggcatgtataccaggagaagccatgtggctgggggaggccagagacactcactcttctctcagcgctagaactttctgggggtgactggctgcctccctctacctccctggccagaaagagctttccatgagaccgactctctgaggccaagtctaatgtccccctgtggctccaaggatcaggaagatgtgataggaaatcaacaagccagcttcatgcacccatagggaggcagaagacaggccccaagtaagtccagagtctagttcatggtcagggttacaggaaacgcttcttaaatatttactgctgtcaaataaatgtcccacaacccacccccgagaccagccaagggggcagctgatgctctttctgctctcagacccatgggtggaaggaacacaggacacccctgttacacgcaaggaaaggggcttggaggggacacccccgctcaaagccacagggagttacaggcatggctaaggatgggccttggatctctcccacgctatccctatgtcatttcatgagaagagagacaccactgacctgccctgcgaataatccacaaactccgattatacacaggatgttgaacacagcagagcccacgatggttccgaccccaacatctccgtgggtgatgaacacgcctgggaagaaagaggcacaaacctcatgtgcaagcccaggcctgcccttcctcagaccctggccggttccgtgtcccccaccccatgaatggacaggacttgttcttactaccagggaacacctgagatgctggtgagaacaacaaaaccagaggtggaagagtcctcagggacccgctacaccaatcctcccattttgggaacagctttatcgataattcacatgctgtaaaattcacccatttaaaatatcactttagcattttctggtatagtcagaattatacaatcatcactgcaatctaattttagaacgttttcatcacctcaaaaaacacccatacctgtgagtaccctactccactccacaccccaggagtggagtaattcactttctctccacgtctcccattttacagatgagaaaactgacactcagagctgaaaaaacatgcccacaagagtctgggcacccaacctgggttcttcgtatatcccatgtctcaagccgatgggatttcttaccaataacagaggcaaacagctctggtgttgagcttcccgcagccatgaaggtggctccagccacatcttcgctcagatggagtttctgaaacagaagtgaccgcagaccctcaggctgtactgcaggtgcagtaagcatgcctactggccacttacggagagcgcggggcacag

SEQ ID NO: 39677 - DNA, 3005 bp, Bovine  19866881119039
tgtgtgtgtgtgtgtgtgtgtgtgtgcaaagtcgcttcagtcatgtccaaccttttgtgacccccatgtaaaccaaagcccaccaggctcctctgtccatgggattctccaggcaagaagactggagtgggttgtcatgcacaaggtaggtattcaggaaacgcctgctgagtcacgagtatttggccttccacttctcttctgatatgaacccaggagctgctaggatgggctctgcctggagggatgaccagaagatggtgtggctcactggtctcctttcccagttcctggctttccaaactgctgcctggatgctgagccatgatccttcctggtggagcgtgttggacaaagatgtgcttccataagatgttgatctttcttaaacctcctaattagtgtattcccttttgggaagagaaactgtgaattgaatttttcaaaaggaaaaaaaattgcctcaaaacatgccattctctcttcactttctatcctggttaaaaataaccccatattctaagccctgacgtttatgctgaaactatgaaagctagacgggcagtctggggagtaactgaaagagcttcaaatttctatcattccaacttctgtgttttagatatcacccatgtgccagaaaccaaaagcaaaaaaaaagaaaaggaaagtcgtgattccctccaatgctatggtttaaaataatgttgcaaagaattgcatatttttcaaggacaacagttgaaatggataggttttatagcatcactcccatgtcccaaacaggagtaaaaataattagattaaatcattggcttaactagcatgaaaatgagtctaaaatctgctctctcatttcagtacattccgaaagagattaagcaccatgaaaaataaaaatatgattggaaggtccagtggaagtattgttctctccaggagaaaccactgtggaattttatggttggaagaagttccagatgccacgtgacccagctgttctccactcaagaggggacatgggcttaccaaaatcacctgagaaacattttctaagccatccttgccatctccacctctctccctgcccttatgctgagcatccttgtcctgcccactgacaatgccttaacctcccattttcaagggaagagagaacatggatttccagacaggtcaagagctttcctagcatcactgctggttggcagcagcaggacaaagagcccaaacatacaaacagatactggccaggccatacgggacaacaaaacgttgactcatgtcctctgtaatagccaatccaggaagcccaaccataagccacagtgactggcccactagccagagtaatggtccagatggtcaagacatgatcagcgagggccagcctctctactgcttgtcctgatttccaactcaatccaactgaatccaacaagagcattttccagaaaggccaataaaatatctgaaggggatcagtcatcagactcctgttcgttacacagcaacgcaactctgaaccgctcaccagtgggcaccatgtagcactattaagttatgaaaaagacagacagctttttcataggcacacttttctcagcatgacttatttcatgtattaaacaaaaatagcatgttgtctgatcaatatgcagaaacaattattgtctggctgtatatacagaaaccagaagtttgtgccaagtcccagggacagagctctatatggtgagccctcatgggattgggccatgttgactggaggtccctgatgtaaccctggcacgtccactagatcctggcacataggaggtacccagattcgtttcctagggtttatgtatgaaagtaccacacgttaggtgacctaaaatgacagcaatttattcccctgtggttctgaaggctggaaatggggaaaaccaaggtgtggatggggttggttccttccagagactcagggaaatgtatttctgactctcttctggcttccagtgacagccagcaacccctggagttccttgacttatagacacatcactccagtctctgtttcatcatcatacagcttctcctctgggtgtttctgtgtcttcacatggccttcttgtaagggaccagtcattggatttagggcctgccccctattctgggatgaccccatcttgactaattatatctgcaaaggccctatttccaaatgagatcccagtcacaatgctgggcttccctggtggctcagatggtaaagaattcacctgcaatgcaggagaccagagtttgatccctgggttgggaagatcccctggagaatggaatggctacccactctagtattcttgcctgagaaatcccatggacagaggagcctggcaggctacagttcatggagtctcaaagagtaggacatgactgagtgaccaacactttcacagatgccagggtctaggacttcgatacctctttgaggggacacagctcaacaccataattgtttttattatttattgacttgattaacctttatctacagaacacagaagactactctgcattaatgagttcttaagaacaatataataatggttgttattcagtcttttatatgctcccaaaccatcttattcacatctgctgccccaaatgattaatatgtccccctcactctcccaagtgtaccagtttgatgataaactttagggctattctattcgttagaagttaagtgccctttagtaaatactcattatcaactagtcaagagagttcaagttaacccctgcctatgtgccaggaaagacttccaccatttccgacatagacattcagtacatccccttcctagacgtgctaaatcgcttcagtcatgtctgactctttgtgaccctatggactatagccatccaggctcctctgtccttgggattttccaggcaagaatattggagtgggttaccattcccttcttccaggggatcttcccaacccagggaatcaaa

SEQ ID NO: 39678 - DNA, 992 bp, Bovine  19866881179887
cccatgtactgtagcccaccaggttcctctgtctatggaattccccaggcaagaatactagagtgggttgccatttccttctccagggggccttcccaacccagggatcgaacccatgtctcctgcattacaggcggattgtttacccactgagccacctaggaagccccaaatgcttattataaacttccaggataaaagtccctcctctgtgaatataatttggctctaaaagtgatgggttttcctttaaaacaaacaaaaaaaatctgctttttaagataagtctcccaataaaacctagaaaacattattagctcccctagacattcagaaaatgttcccactttaaaacaagcagcatttaatgaaatatagattctttcacttttttcccctgtaatcaaacttctttaatagaattgctgctgtcagttcaagggcaggagtctgcttcaaggctcagctcagagatggagaattatagagggaataacttggcattcttgtgtccaggatcttgtttccaggagaaatggaactgtctgggatataagggcagatcaaacagacatttctgccatgaaaatgagtcagtttttgattctccaaaccaatgatttgtgagctggtgatttatcgaatcctgggcactctttgagaattagaaacaagtaaggttgcctttctgctataaggacatatcgtctgggctccagtggggagggggatggtgggttataaatgaccttgtccttggtgagaaatggcttctactggttcagctgcagcaccgtgctctgtgaccccgtgcatatgctggagggctgtggaggggagcaaatgccatcatggcctgagttctgccagcagagacagagtaaccggcagagccaccagctgctcatgacccatcaccctctgtacctacccaagtcttctggacacaccccgagcccatgaggtaggcgccacagccacaaatgtccctg

SEQ ID NO: 39679 - DNA, 1066 bp, Bovine  19866881199496
agtccttcctgctcaccacagccaagtgtaacagagcctcagcacctttgtacacagtgccctacaattaggtgcatatttcgcttactttcccaagtagatgaactgaaaactcctagatgtccaaccaatatttgctgaatggatgggtatggggggggaacagatggtgggataaagggatggagagatggagagctggctgcatggatggatgggtgagaatggctgagatttcactggtttccccgatagtttcattggggaaaaaaaaacctgaatatatcttagacagttgctctgtcaaaatgacatgaacagaaaaaagcaagcataacaaatgctgtcatcaggtgccactggtagagagctaagtctttgctttgaaccgcaacgcgtgcgttctaagctgcatcagttgtctgactcttggtgactctatgcactgtagcccaccaggacgccaggctcctctgtccctggggattctccaggcaagaatactggagcaggttgccaggccctcctccaggggctcttcctgacccagggattaaaccggcatcgcttatgtctcctgctttggtgggttctttaccgctagcaccacctaggaagcccttgaactgcagcatccccagggaaacgtacagtatccatctctgtcactgattgagattaagggggctggggctacggtgggtggggaaagaaatccccagtgtattccttcttgagcgctttctcctttagccagagatcgtcagattgtgaatttcagatgcaaagtcctttacttccttagtccctggaggtgggtgaagatgcacatttattaacccaggaaacaacccaaccctgggaaaatccgtgcaggaggggaatgtatctctgctacccctggggtctcctcttcttctgggctgtccctctccatcccccttacttctctttctgccttgaggaaacaggccctttcatcagccctgacacctcgtactgaatgttgttagtcaaggagttgggatggggtctggcattttgaagtcccatgtcttaactaggg

SEQ ID NO: 39680 - DNA, 3573 bp, Bovine  19866881200518
tgaaaaagcagcacccaagggaggggagggtgcagaggggacggagagagatggcagatttattcagaggtggcagaagtcacttccccccccacatctcattggccaaaacaggtcgaatggccagactggacacagtgggatggaaagtatgatcctcctgccagtgtgtgactggcacggaggggtggcggctgttttgaacaactgttgtcagctattgcactcctgattcccctctgtgctgctccaaggtgacacgcgtgtcaccacttaagcttcatcagggacactcagaggccagacgtgtatgtgtggcaggtggtggctgagaactggcagaaaagacattggctcgggggatataggaggcgaagggacaggacacaggatggaggtctgaccggcctccaggtgcagccttgcccctttatggctgaaattaactagctggctgggggacacgagctgtctttttcattaatctgcacccttgaagatggcagcagtgacaccttcatgtgatggcattttctcctggctgatatataacagaaagtcagttggccccatctgcagaagcagaatcatgagacagcagcggatggtgtggtctggcccctacaggaagtgactgcccggtactcagtctgagccacttggcctcgtttcggggcagccccacttcccttcttgcctatcccctagtccacactgacccctggcattagaaaggctggcctgttgaactcagttaagatttcttcttgtttttgagcagatctcccacccttggacctgtgatttggggccaactagttgaatgagataaatacacttgtgcttgggaacaaagcccacctcggtggtgaatgttgtgctgattggtgctgatgattatcaccactggattgggggacctttcaaaccaaggaggggagcagttctagatgagtcctcccaggcagtagagatctgtatgtattggagggcagagtgtcacacaaattgcctttgaggtccgcactgaagatttgctttggtgctcttgggtttgaccctttcaccaactgagccattatcctagaatgagatttcacctgtgtttcggccaaaacatattaagtccataaaaaggtaaggaatgattatgttaaagtcagggttggtatgaagaaggcaagctcttgatattttatcaggcagggggcattgtatcatggtgagtcttgtgcttttgtcaaggcaaacctcttttgagatcatgagctttggaaagactgacagttctaggtttttattctgtccctggcatcttctgacattagacaagtatcttaacatctctgtgcttcaattttctcgtctgcaaaatgggaacatctgtagcatggctgttggaggattgatgagtgaacacagtagggatgagaggcagtgctgcctggcacataggaagtactcagcctcggacctgtgatattgtgacctacaattagaaatatacacggttttcattcccattcctggcacagagctccctcagaattttctaagtaataagagccataactgtaacttgagacacgtaacaaagcctttcaaccacacctgagtttatgtcaatgtggtgactttgggaaagtacctaaggatgggggttggttgccaggaaaccaatcattctattggaatgttggaaatttcagttccactcccaacctctgggaaagggagaggagctggaggttgagtatctctgatggccaatgatttgatcaatcatgtctgtgaaatgaagcctccataaaaatccaaagggaccgggttcagagagcttcctggtttgtgaacacaatggagattggggagagtggtgtgctcagagagcagagaagctctggccccttcctgcatacgttgtcctgtgtgtctcttccatttggctgttcctgagttatatcttttaatacaaaccagtgatcttgtgagtaaatgggtttcctgagttctgcaacccactctagcagattaattgaacccaagtcatcagaacttccgatcccataggtgattggtcacaagcacgggtaacaacctagacttgtgattagtgtctgaagtggggtgggatctgacgctggctctgggtacatagtgtcagcattgagttagactgggaacttccctagaggtccattgattaagactctgcactttcaatgcaggggggtgtgagtttggtcagggaaactaagatttcacatgctgcatggctcagccaaaaaaaatatgttgttacatttttgaaaataaagaactgagttaaattgtaggacacccagtgggcgctggagaatagcttggtggtttggaaagcacagactctgggcttggtgtcagaacagaggtaactataatatcctagtgctgtctcctgacaaaatgaagtcatgtatgggggaaagctgtcacagtgtctgagtgtagtaagcactcaataaattctagcagttataattagctgtggggttgagtaacatgcagctcagacctcaaaaccatcacttcctgcagtgccgtgctcttgcaggactcctctaagaagttaattcattcttcttatctcatattggttattacctgtgcaggttttggcaaaaaaaaagtaaccgcagtttgtatctttctattttcagtaattcctctttcagcttccagaattgaggttggtctaggaaaaaatacatcatcagataattgaactccgagaaccttactgtaaatctttgactttgtttctttcttttttttttaatagatttttgaatcatagtggtgcatattttttagccttcttttttcacttaaacattttattatgagctttctctgtgttattaaacatttcaaagactttgcatccaatgaactgtgtgctgaatgacacttaggaaggctctgtaagacacggcgcctgacattggccaatgctgagcggacccacacgcacttaaccagaaatggaagtcagatggtcataagagctagaatgttagtgtgcactttgagggcaccaggagttttatctggctctgtggaaatggaacaccaggggaggttttgacagagaggggagaaagatccagggccacgtggccttggaggcaagagaagagggaagtggtttgtggggtgaagggaagtatcacactgtcaccaggccccagagagtggcctcagcctgtgtgtacagtgactgccaccttcaggggctttgcagcttcagaagatgtgtctgagagagaagacagtccaactcagcagcttcagagagccaggggcctctgcatagctacaacccctctttttggggtgactccagagggatcgggccccagtgcctcctgggcttcctgtcacaagaaaactatgggtttggattatcaacatttgtgtctggggctcccaccttctttccagctgtttctgcctccctctgccaccttccatgaaaaactgctctcaaaattctctagccagtaaacagattcatactaacgtgtaaagact

SEQ ID NO: 39681 - DNA, 1603 bp, Bovine  19866881256451
tcgttctgactctttccgactctttgtgaccccatggcactgtagcataccagacatccgtgtccttcattgtctcccagagtttgctcaaacgcattccattaagtcggtgatgacacccaaccatctcatcctctgctgcccccttctccttttgccttcagtctttcccagcatcagggtcttctccagagagccagctctttgcatcaggtggccaaagtactggagcttctgcttcagcatcagtccttccaatgaatattcagggttgatttcctttaggatggactggtttggtcccttgcagtccaagggactctcaagagccttctccagcaccacagtttgaaagcatcagttcttcaatgctcagctttttttatggtctaacttttacatttgtactggaaaagtcatagctttgactatacataagtctttctaaatgaaggctagactgtccagccccagattttattcccttattggggctataaaactaaccagggtagacctagttccacacttgaatgaaacccatacttttcctttgaagtttttgttctgcagcaagagaaatgggtgggttttagcaagcatgaagtctagagcaaggggaaatttccttataataagaaaataatcctattttccaactgacagccataacacaaagcagtacattgagaaggcaaaaaaattcagctctcacacaacgcttttaagtaggtcaaggaggttttgtgttatctgaggataagtgagtggaagacttttaaaaatcccctagtgtgttagtggtcaagaatactgaaactgaaactcaattaaagatttaagcaactgcagaaaaataatctcggaaacactttgtcaaactatttccaaagccaagaatgtgtaaaaactcaacaaaagatttagagctgccccaacaaaagccaggagcacacgcggagacgggaagtctggccacgcacgatgatgaagcatgcggcgttttccacttcaagcatgtaacctggttttaatctttttccagaaatgtttccaaattagaagaggaaaaaaaaaaaactttaaaagatattaataagtctaaactgtactctgacatcagacttgactttccagctcagactgataggctatgacatctgaataagaaccaggacatatagatttaataacacatctctaccccaccctccaaaatctcatatccacttttagatggcatggaactcttttttattcatggttgggaaaaaagcccgaacacacctaacatgacctttaaaacttcattctgataaaaaataagaaaatatccacagctagtatatcaaaacctttgaagaatttataggacatttaaagtcatagtatcaatatcattaagaatagaactggtcagatttttggttaggcactggcaggctactgcaaaggcagtgacattcctgataggaagcactatacctgtgcccagcccaggatctccatatgctacttacgtacagagagaccaccagtgcttagcgtggacaaaatgagaattcagacatgtacacaggaagaaaagccaaaacagacatat

SEQ ID NO: 39682 - DNA, 1663 bp, Bovine  19866881526683
tcctgttcctgctatgtcccgcaacatttactaaattaattgttaggagattatttccagagaaaaattgtacaagtaattgttttgtgaataataaaattcacaagagtaaattatttcaaccaacctgtaatgacacaagttttccttccagattttctgcttttttcttccattcagcaacaagctgtttgtgcttttctagttcagcagaatacatagctttttcctctaaagaggagaaaaaagttacattagcattttataattgtgtgataaaattatataattatattatataatatatatattatataatatatatataatataataattatataatataaaatataaaaagtgtgataaaattataattttaaaccacttgaaactttaataatacaacaaaaacattaatagctcaaatgtctcaacaagaaaattatatatgccttagtagtgatgttaaccggaattaaattaatgagatcagtttcctctgcttaaatctttctccagatcttgcaaactttccttcccttcagaactctattcaaatatcagtatttcctctttagcaaagctttctctatggcctcagccactatcacactatcttgtacatttaaaattcaaaactcttacatttaacccttacatttaaaattcaaaatttcaaccacaggagtaaccctgatatgtacatatgtacaaatgtaaaggtttgctcagttacaaaactatgactttcgttatttcagtagcatcacatcctctaagcacctcctccctactagcagttcattcattctcagtaattactgaatgtatgaactaacaaatggatgggtgaatgatctaaagggagtaaatctagggatgggaagtagatgtgaaaaagtgtatttggttatcagggtaccattcacagtaccaggtcctattactactatgtgtctagaaaagtactttccacccaaatgagaaaatgcagttaaagtatagatgaacagttaagaacaaattaaccaatagttcaaaggacagtaattattgatgattaactcttcaaagtggattcaacctccaactgacaaaggaccatatagtcaaagctatggtttttccaggagtcatgtacggatgtgagagcaggaccataaagaaggctgaatgctgaagaattgatgctttagaactgtggtgctagagaagactcctgagagtctcttggacaccagggaaatcaaagcagtcaatccgaaaggaaatcaaccctgaatattcattggaaggactgatgctgaagctgaagctccaatattttggccactgatgcaaatagctgactcactggaaaagaccctgaggctgggaaagactggaggcaggagaagggggtgacagaggatgagatggttggatggcatcaccaactcagtggacatgagtttgaatcaactccaggacatagtaaaggatagggaagcctcatgtgctgcagtctatggggtcacaaagagtcagacacgacttagcaactgaacaacaagtctatcataacacaggcagaaggtgagtgataattaatataaatttaatgtgttagtgttcttagtgttctataactttgcttccaaagaatcacaataccataagg

SEQ ID NO: 39683 - DNA, 1165 bp, Bovine  19866881674872
aggataacttacttaaagaaagggaagctgaagtcagaaacttaaagcaaaatctttcagaaatagaacgcctcaatgaaaatttaaaggaagttgcttttgatctcaaagtggaaaatgaaaagttgaatttagcatgtgaagatgttagacatcagttggaagagtctcttgcaggtaacagtctgattgctgtgggaaaaaatgccattgtggaggctctaaagctggagaaagaacaattagaagcagaattgtgtcaggctgaaaagaggttgttggaagaagcaagcaagtatgagcaaaccattgaagaactatcccatgcacgtcattcgagcacctctgcattacagttagaccatgaacgtttaattaaactcaatcaagagaaggactttgaaatagcagaacttaaaaagaatattgagcagatggcaactgatcataaggaaactaagaaaattttatcatctagtttagaagagcagaagcaattgacccaacttgtaaatgagaaagaaatttttattgaaaagcttaaagaaagaagttcagagcttcaggaggaattaaataaatatactcaggccctaagaaaaaatgaaattttaaggcaaaccatagaggaaaaagacagaagtcttggctccatgaaagaagaaaacagtcatctgaaagaagagctggaacgactgagggaacagcagagccgagctgcacctgtggctgaaccgaaaacccttgatagtattacagagctagaatctgagataaatcagctgaatataataaaggataatcttgaagaggaaataaagaatcatcaaaagataattgaagatcaaaaccagagtaaaatacaactgcttcaatctttacaggagcagaagaaagaaatggatgagtttagataccagcatgagcaaatgaacaccacacacacccagctctttttagagaaagatgagcaaattaagaatttgcaaaagacaattgaacaaatcaaaacccagttgcatgaagaaagaccggacgttcaaacagagaattctgatatttttcaagaaacaaaagttcaaggccttaatatagaaaatggaagtgagaagcacgatttatctaaagctgaaactgaaagattagtgaaaggaataaaagaacg

SEQ ID NO: 39684 - DNA, 918 bp, Bovine  19866881992901
gaaaactgaggtgctgctgtctcttgcctcttttctttttatcaggaaaaggcagcttagaaagcaggtcttcaaattcctcacaattgggggatttcctcacgtgggagaagttagacaacttccacctgagtgactgagtggcgagcgggcatggctgtgatggctgttgtcacggaggcgcaaagcaagcaaggaagaggggcgtctctggaaccccccggggtccccggcctggcggggaaggtcctgccaccctgccccgctggagagccaacgtcaccccacccccaggctcggcgggaaggacataccgcggtcaggaccgacgaggactctggcttcgacacgttgtggctgttgaagaagatggactcgcggtctgaaaagcaaagacgggaaggagccagagttagaagctcgaggcagacagcaactccaccacctgacaccagggggcagcaccaccccggccacaggccgtgatgccttagggctcagggtccagcagcagccacccgggccccctcccaccccgaagagacaggacaccacggagcgacacacgccgagtcagggctcctgtttccacttttcttcccatataaaaatgaatggcttgatgagcccacctcccctccactctcatcttacagtaccatacctggtttttccctgatacctaggccccctccccagagtgtgtccagcgtatcttacggacatggcgccagaaagaggggctgagtgagaaaggggaaatgctgcatatgggaacatcaaaggcccagagtaaagaggtcgactgatgccacttaatccagcatccccaacccctcctggttctgcccatggaatgccttttcaggcacatttaggctgccacagggcacatgaatgtttaaaacacaaaagctt

SEQ ID NO: 39685 - DNA, 1694 bp, Bovine  19866880111803
catgctatctgcttttgtgtactctggcactgtcttatttgaaattatccaagaatgaaaatatgagctaagctgtttgcttttttaaacaccgaacgtgtcaatcctgaaattccactgggcaggcttttactccccgcaaagataagagttcctgctgaccttgaattattcagatgtctagcaacacaataccctccaatgtattcactctgaacagatagaatttgagccaaattatctcacaatcaaagtcggtctgttataactcattaaataacatggaatttaaaagagtttttaggaaagctttaagatctggggctctgaaatccagcaacctgagtttgagtgttagcagtaacaagtgaagtatccttgggtaaggaaactccataactagagatgaagctgtatcttcaactacaaaatgaagataaagtacttcattaagatcttgtcagacctaaatatgccaatgcatgtggaatattttcaatagtagcttccttaatacatattagggcttccctgatagctcagttggtaaagaatctgtctgcaatgcaggagaccctggttaaattcctgggttgggaagatcccctggagaagggataggctacccactccagtattcttgggcttcccttgtggctcagctggtaaagaatctgcctgtgatgtgggagacctggatttgatccctgggttgggaagatcctctggagaagggcaaggctacccactccagtattcaggcctggagaattccatggactgtacagtacatgggattgcagagtggaacacgactgagcaacttacactttcattggaacaaagcaccacctgctggcctaagggaagtggacagtttaaaggggaaaaaggcctctggactcccaacttgctaaaggcaggcatagtttaagacagctgctcaaagggcacattttccaaagtgaccaaaaagatgctggaaaaggagggatatccaggagggcagatacgaaagtcttgttgggttacagcttggggaacactcccagtaagtggaacttgctgactcagggaacacttcctgtccctgtgtgccctgtggtcatttccctggtgatttcagaactgctgcggaccagcaattgctctgagcatccctttcccccccttgtcaaatggaagcatttatcctggttagccttcctccttttgctgctatattttgggcatgtgggacagaccactcctgtctgtagtctgcaggtctctggaccaagaggagccacacctaaggaccagcatctgacctagtatagatcacgataccctggactttaaacctagtgctgggacccagatgagaccttgggggatcttgggcggagatgagacttcttcagttgcaggcatgtggacaactgaggccatagagtggactgtggcagatttgactgacaactggccttggtcctccactcttccctctgtccaggctcttgtgatgtggctttgcagcccctctcctcaggacggggattcatccctcccaccccttggatcttgctgcccttgtgacttgctgtgtccaacagaatatcagaagtaacagtgtggcagcttcagctctgggccttgtgaggctttatgggccttttctccattggacctgccgcatagaaagccccagtgtt

SEQ ID NO: 39686 - DNA, 1278 bp, Bovine  19866880244416
caaagtctattaagtgacttacagactcttgcaaaagctaatcttgaagttacattctgggtatgtactggtgcaggccgctgtggcatgaagaccatatttggcttcccccacctgcaatgtgagaaattccttctactataataatattaagggaggctgtgtccagccaagcagggttcactttcttaaatcatagaggtttatcaggtcaggtaaggtttcatgatcatttaatcttacctttcatcacccattaaggtggagcctaaactatatacttctagatttatgtgtctgtaatttttgcatgtttctccaaaatgaggagtaagtttacaccccagataaagccaggtttctgaaatatagaagttgttgttgttgtttaaactgatgcaatatagtctcttgagcagatattatgaagcaattcagagattgtcacccttttataggatgaagactatcgaataaattgttctgcttcctgcagctcagctgcccctctgaggccagagtcttccttgagcccctgcccgtgtttctgcccacctcccccacgcagcttgggtctcttagctgctggggctttctgcatccatctcttggccataccgagagttcagagggctgccttcagagccagcagcagctgttgctgccagtcccgtgaccagaagctgaagactcccctccagccttctttagcttctccctcaccatgtaccccttggctggcactgcaagctggccagtgttcagggtaatttaatagtttcacctcggtcacagtttatgacatattgaacgttgaaacatttattctccagttaggtttcaggtttctagtactaagattagagcaagtcttaagcaaagagacagtatcccttttctaaaaaagatgtgccaagactctggcccgttttcctgagaggagacgattcttagcttagtgtgtactgcagccatcctccttgactgaaattgctgtcgctccagctcagctgcatattctggtcgcctcacattgcttgttctcagcgtcacaaatgtcccatggaaataaagagcagactcaactcactcgtttatccatcccaacttttgacaaataattactgaggatctgttaagagtagtggaagattactaacatcttatcgtctagtagaaagacaagtacacacataaatataaccaaggttttcatatgaaaagtgtcataagaaagatataaaacaaattctacagccacccagagatcttttccaa

SEQ ID NO: 39687 - DNA, 1861 bp, Bovine  19866880410516
tcaatccattatcagtgtttacattatcaaacatataataagagtttgacatggcagtatatctaaccggacactatcttgtaaagtcctttggatacataattacatcggaaaataaatatgcaaaagtaatataaatttattacacttacattatagattaataccaaaattactgtgatgtcaacaactaatttcttgtttccctcctcagtggttatgtctttgactatgactactacagagatgatttctacaatcggtatgtaaatttctcatccttgtttccctttgatttaaattatcttttaactcttctgtacctttcattcacagatattattgattaaatgatattttacagtaaaaaagtaagtttcagtaaaatataagatggacagattttcatcttgtgattgtacctactacaagtatagaagatcttgggcttttagactttggtggtgcttaagcctaaaatttggtttctgatatttggatgatattttaaagatttattaaccaatattattttccagatcttgaaattggaattcttgacttggaattcttcaagactgagagatttataaattcagacaatgagtccaaccttctaaaatacatctacttccacacaacacgcacattcagtaaaaattgcgcacacgtctcgctctgcacggtagtgtgggaccggaaaggaaaccacgcagagtgacgttaatagtcaataggagaaatagggttgtccgtgacctttaaaaaatttttgtcaaaacattaaaaactctatgttataaatgtatatattatacatgtatgcatatatacatacatatatagaaattcctcatgcatacatataggaaaatacagtgaaacggttatttagtatactaatttaaaattggaacattttaatgtaaaaatactaagagttaatgtacttttttcttgtaaaaatgacctatcaaaagtaatttgactagtactagccttcttcttttattatgatatgaggcaagcacctcttctacccctcagtgaattgttatgctactaatactgggtcagctttgacattttatcaatgttgtgaactacctctaagatttcctcaagatgattccttttctttgccaatttcacttcctctgggacatcttcttcccttttcagcacatcacaaccacttacctcatttatgtcagtatgttttattttactaaattcctctgtctccatctctagagtctcttgagtggaagagtgtccacatccttacaaacagctatttctcctataattccatttacatttaattttaattttactcccagtttccctcctcggttctctgctataccaattccctcttttgattacctattcttacaaaatcccacgtggactcatcaccaggaagcaaagagatctgtgtgtgaactaacaaatacacaatgacaaatccctgacagactttgaaagaggtgacctgatcgtcaggaacgtctgttaattaggtagagatttgtggactgaaaaaccagtagcaaagcttggactttatgaaattactcacagttaatatatgtggtaaaactgaaatttgactttttctgttggggggattggtgtcatttaacttaggattggcaaatgaaattctgatagtagaggtatgcgaaacaagaattatctgtgctaggtcaatggaccatacacacacatacaaaaacaaagtaaatattgtttaaaattctattcaaacaaacaaacaaatatgccaaggcataaaaatgcaaagcttgaaaaacagaacattttatatagggaagaaactacataatccctcata

SEQ ID NO: 39688 - DNA, 2610 bp, Bovine  19866880455128
aatggtccatcctgacacctgtctacagacactttaaagatagagtggtcgtcctaaaatgtctctgaaataactgaacagtgagtatcatcctcagacatacacaagggaatgttttaatatcctgttcttatgtaaatgccaggactaggttggttgaaggccattggagaggacacagagctggcttagaggatctgatctgggcaatctgtgaaagccatggacaatgatgctacctaggggtgggggcaatgtgctggcctgggattgaggcgacactcaaaagagggaaaaggtagaaggccaagacactgggagtcagcagtggtgtggaagtgaattcccaaatttactttaactgatctacagcctgaaatctcctttatgacaaagcagattactgatcaatttatcactgaaaatgaaaaagaatactctgaatcattccagtgattttatccatattttttcttctatcagtgacatccttatttcttaaagggaacagttgtgctcactgaaatccatctttacgtgactttgtttaaattttagaatacaaattcagatatatacccagcctctttatcagaggttaacagacacaggcaacaagcatattaaaaatttaatctataaataactgagatgcagaagccgccatggtggctcagtgggaaggaatgtgcctgttaacgcaggagacagtctgatccctgattcaggaagatcccacgtgctggggagcaactaagtctgcatgcggcaaccgctgagcctgggctctagagcctgggagtcgcagctgctgagctcgcgccacagctcctgaccgggcaccctggagcctgtgctcggcaacaagggggagggccccagtgagaagcctctgcaccccaacccggactagccctgctctccacaactagagaaacgcccagcaagcaacgcagatacagctcagccgaaaatacataaacatttaagagctgaaaacagtcacgttcaacttcttttctttttaaaaataataagcatcatgctttccctgtttcctcattctccctgcagcttttactagctggggccagcagccaggtgaaaacaacaggagtggagacacaaaatctagataatttgtaaattctacttagaagtaaagcttttttcactctagtttagaattatttaggaatactttaggggaaatttagcttatatttttattattatagtatttaaaaatatgttattatggaaaaaaatactggttgattgaatcagctctcaggtttgagtcacactaacgctaagcatcatttctctgtatgtaagaaaacactcccaaaaatcaaaatattctcgataaactctggaagacaggaagacgtgattgttctaaatcaccattgcaaaagctgccaagtctgcaaagtggaacgatcagtcaatcttgtggttagattcagtgccatgactctgtagaattcaaacatagctatttctggtcttagattttaatgggccatttggaacaatcactcaagatccatcactctgatgttaaagtctaagaatccttattgtcaatgctgacatttctctcagcagactagtgactccacctgaaatttagtctgccttgatgctatatttaaagtccagggtcatcaccatcactgactttctttgatcatcttaccttatctaaaaaagagtggttataaacaccagctatgtggggtgcttgtaaagcttaaataagataatgttttaaagtactaacacagtgctagaatctgctgctaagtcgcttcagtcgtgtccgactctgcgaccctatagatggcagcccaccaggcttccccgtccctgggattctccaggcaagaatactggagtgggttgccatttccttctccaatgcatgaaagtgaaaagtgaaagtgaagttgcttagtcgtgtcggactcttagcgaccccatggactgtagcccaccaggctcctccatccatgggattttccaggcgagagtactggagtggggtgccattgccctctccacctagaatctagacagtctcaataaactttagcttctatgttctgaaaaaatatattgactgtatatttgtatgcgtgatttttgtgctgagctagttttttatctagcatttttgtttagaatgacttttttccataaataaccatgacttcaaggtcagagtctatttaaaggttaaagactgcctgttttgattctgttcatttgtaaatttagggattcttacacaagttttcccttctttcaccaaatcttctgaaatttactatgctatatataaacaacatactctatagttccagtttaagtacttggcaagcattgcaattttaactataattctaagataggcaatgccaaaaaatgctcaaactaccacacaattacactcatctcacacgctagtaaagtaatgcttaaaattctccaagccaagcttcagcaatatgtgaaccgtgaactttcagaagttttagaaaaggtagaggaaccagagatcaaattgccaacatgctgctggatcaggaaaaagcaagagag

SEQ ID NO: 39689 - DNA, 1914 bp, Bovine  19866880482973
aacggataaacccattcccttgagggtactaaatcctctctgtaacagctagaagggtgatctgtgcaagaaacccttcacaggcgtttgctccctgagcgccagaagggctcctttgacggaggtcttacctgaagccatgcttcagggagggtccctgctgagcagggctgagctgtgaccgtggccgagtcaggtgggtgcctcgcggccctctggcttctgcctcagtttgtccttcgcttagccaggaatgaagatcctccaggaagggttttccgccttgctgtcactctacaacccttcacacttgtttgtgagttggggattctgcactgcgccccacggtgggacacggagcacacctctggagtttgcagtcagccgctgctgcgggggagctgcaagtgggtgaagcctgtcttctagagtgccaggccctccacctgcttgtctccccgattttccttttccccttgtcagtggcagcagctgcctctcattttcttcctgagatgcctctgtttggaacagcctgaggcctctttttcctgttaaaacttcctctcagcaaagaatttgaacattcatagaaagtagaatatatgtaactattgctgaaaacaattattaaggtgaatttgcattttcaagccataaatagtcttaaacttttaagacttaaaacttttcatggacaactgagcactgcccttagtagcaggattgtgcccgatcaccttcttcacagggttgacttccccacccatctgtgagtgtgagcttgtgtgctggactcagccaccagcgggggtctgacggaaggctgcacaattgtagttccatctgtggacgtgggtgttttgaactgtggtgttggagaagactcttgagagtcccttggactgcaaggagatccaatcagtccatcctaaaggagatcagccctgggtgttcattggagggactgatgctgaagctgaaactccaatactttggccacctgatgtgaagaactgactctttggaaaagaccctgatgctgggaaagattgagggaaggaggagaaggggatgacagaggatgagatggtcggatggcctcatcgactcgacggacatgggtttgggtgaactccaggagttggtgatggacagggaggccttggcgtgctgcaattcatggggtcgcaaagagtcggacatgactgagcgatgggacagaactgtggacgtgggggagccccaagtcttttggaagcaatggttggagattttgggggctagagaggcttggcaggatgctccagaaccttctatgatgtagacctcagcacaggacaccacagaccagctaagcgacagggtccttcccttgtgtagttttcagaccaaagtaaataggaggattctgtccaaggttctcgtgcataggacaggaagatatatagaaatgttttatttgcatttatgtttttaaaggtgtctaaaaaataatgtttgaattatgtcctgttcctccctttcagctccacgttgttcactggaattcagacaaataccccagctttgttgaggcagctcatgagccagatggactagctgtcttgggaatatttttacaggtgaaaaaaatccattgatttcgttttgaataactagtcagtcgtgttggataaagagtttcattgtggagtagatagtctaccactttttattcaataatagtaaacttgttctaggcttactgttttccttttgaagtgaatattcacattttatgttagtttatggtccatctaagggcccagaactaccctaggagggttgtcttatgattcatcttattgtccacggatcagttttatgtagctgcaataacaataatatcagaagtattacctaatagcagaa

SEQ ID NO: 39690 - DNA, 1016 bp, Bovine  19866880484171
ttgaaactgaaagccttttgagtgaagccatccatgaatttcacagtcttctggcttcttggggtatagcattacatgctatacagtgatttttgagccaaaatcactgcagatggtgactgcagccatgaaattaaaagacgcttactccttggaaggaaagctatgacaaacctagacagtatatttaaaaacagagataccactttgctgacaaaaacctgtatagtcaaagctatgatttttctagtaatcatgtacagatgtgacagttggaccattaagaaggctaagcaccaaagaattgatcaaaccagaaaagaccctgatgctggtaacgactgaaggcaaaataagaaaggggctgcggaggacgtgatggttagacaatattaccaactcaatggatgcgaatctgagcaaactgggagatagtggaggatagggaagcctggtgtgctgcagtccatgggatctcaaaaactcagacaaaacttagctactgaacagcaaaaccaaccatttttaaagtttagaaagaacagccccattcagggctacttattcgtctctcaacttcagttctctctgtttacccccaaacaaacagacaaaaagagcatccaagttcggcttttgctgtcaattttctgttccagtgaaagaaactttgatgtaaaaatcctctctggagtcataatttgcctttatgcattgtgttctgtttatgttatttttagatatattcaaaattctagttttacccttacgcttgggagaaagtattattaactttttaatgattttgtttgttaggctttaaggctgaaagcaccttttctttacagataaatagaaaaaagtctgtgtagaaaactagccttctctttagccttcctgaattatttttctaatgcattaaattccttcctgacaactgtaggcttcaaagcaagtcaaatgagattagttcattgtagttaatataaaaggcttatcttttaaaaaggtcaaaa

SEQ ID NO: 39691 - DNA, 1995 bp, Bovine  19866880491474
caatgagtcaactcttcacatgaggtggccaaagtactggagttgcagctttagcatcattccttccaaagaaatcccagggctgatctccttcagaatggactggttggatctccttgcagtccaagggactctcaagagtcttctccaacaccacagttcaaaagcatcaatccttctacgctcagctttcttcacagtccaactctcacatccatacatgaccactggaaaaaccatagccttgactagacagatctttgttggcaaaataatgtctctgcttttcaatatgctatctaggttggtcataagttttcttccaaggagtaagagccaattctaaaatatatttttaagtcttagtgtttcttaactgagtttttttctcctagtctcttaaacaaacattttcctctgattcctactttcatattttaaaactgagaacatgaagtattatgaaggcaagtaaattatgatgagttccaagtttaaatttataattaaaaatagttctttggtagagaaggaactaagaatatgaaagaatgatgtctcattatggtagaaatctgtaaatgccactgaaaagaaattccaaaagacagtagcagttctataatcttagtattccataggatacgtggatttcctgggacccatattttccctaaaataaggaaatatacatagtgaaaatcaagtgttatgtttattaaattggcataactctcacatcgcttcttaatgtccctgcttctccagaattgatattgtttagggtgacaagagaaagcttaattctagtgaagtgggacatggaaaatggtaatattagctcggacatttctgcagtaagacaattggaaattctgctgaatcaatttaaatggctggattatttcttccaaactggtctttctctccccttgtaaccagctgttttaccagcttcatcctttccaaggaggtctgtgtccacccccaccacagggttcccattttagggctttgcacttgctctcccctctgtctggatttctctgtgtccaggtctttccacaggctcagatatcaccttctcagagacaggtttcctgacctccaaactgaacatattgcccagctctcagtcactctattacttccttccatcttaggtctttcattatctttgttgcatcttgaaattattcattcttttccattctgaaatttatttgtttacttgcttgatacctataaccatctctatagtgacaccttgataacaatgggctattttattgtttttttatttcactatgttaactttaattataacatgcatggtaaattgtggtgttcaataaacagtttagagagaactattaagtggtcattttgaactttaattattgtatttttataaagacttggaagaatagaaccttcatcgggaactgctgctgctactgctaagtcgcttcagtcgtgtccgattgtgtgcgaccccatagacggcagcccaccaggctccccccatcactgggattctccaggcaagaacactggagtgggttgccatttccttctccaattcatgaaagggaaaagtgaaagtgaagtcgatcagttgtgtccgacctctatcgaccccatggactgcagcccaccaagcgcctccatccatgggattctccaggcaagagaactggagtgggggccactgccttctccatcatcaggaactacgcccacccaaatgcactggtctgaactcaggtgtgaatgagctttgctggaggtaaactcatgttcatattcggaactcagaaaacagagctttcccttttcagttctattaatggaggaacgaagggacccgtgtgtgtctgtcagtcactgctgggagagtgagaatgttggtctttataagtgtcaaatttttagataccttgtaagtgtcaaaacttaactcttgaaatgggtttaagttttacatacaaattt

SEQ ID NO: 39692 - DNA, 886 bp, Bovine  19866880595733
atctgttgcttgaggcaggacacctgtcctgtcagtctttgctccatccaaatggaaacatgggtgatctaggattaccctccccaatgccgatggtcaacgcactgaaaggtcacgtctattacggttggcgttgctctccctgctgagctgctttctgagtggacgtcatactcatctcatgcagaaggcatgttctccatgccagaacgctgctgctaatatttgatctaataaaagacaccctatcttttcttcaagcttcatgatgactagctgctgttagatgatcattcctttcttcctcatcattccaactttgtgttctaaggacttgaatccttcagcaaagttttatttgccacctctcatgttaaagtgattcttttaaaaacatggcaaccaaaataaacagctttatttgcagaagtaactttatgtgaatactcggtgtgcctttggaaggagccactggcctttactaatactatcagcttccccagcaaaccacacggtgctgtttgtgtaggattgtaagcggggaaaggaaggactggaaacacagtcttcaccaaaaaacaggatcgaaacgtgcagcaacagctggaaccagctgggagcaactgcacagtggaatcctgtccaactctgccgacggagatctgagcactcttgaagcctggaacaagaggaacaacagaccgctttgtaagaatgtcacacgtaaacccagccagctagcacccccagaaatcggcaacaggaggaattcatcttcttagatccaatcactgggtaaaatcagccctgtttgttctaggaggtccacgcacatgaacttcatgctaactggagcttggttctcagccactggggcccttaagga

SEQ ID NO: 39693 - DNA, 1494 bp, Bovine  19866880622652
actttgcatcctgacttcaaacgatgccagtgtttggccctttgatcagagtctggagtctgctgattggttgaatgcaaatgtttaatatccgtttatacatgtatgcatgctcagttgtgttcaactctgtgcaaccccatggactatagcctgccagtctcctctgtccatgggattctccaggcaagagtactggagtgggttgccattcccttctccaggggatcttcctgagccagggatcaaacacaggtctcctgcattgcaggcagatctttactgtctgagccaccagggaagccctaatatttgttaaatagtctacaactgtaatcataccaaagtttcccaaataccattatgaatacaagccattgctctttaacctattgattatattttgatgtaggttttcgtacaatacaaagtatcagtgagcaggcattttctgccattttctgttatatcttttatgtcctttgtctccttactattttccttggcaatcttcacttgccctaacatctgttctctgcaattaacttgatcatttctgttttaaatactttctgaagagaaaattctccataatggcagtggcattgttctgagaattgaactgaatgataagttaacctccccactgtccaataactagttaagtgaggtagtgaagttgaaagaaaattatatgccaaatgttcaaagaaatataaagtctagatatgagaatccttctgtgacacataatgggagttggaagaaaataaatattactaactttttgcagtgttctaaccccaaacactaacactgtttatggcctttttataatttttcatccacatcattttattaatgtcttaactgatcccactttatgatgcatttgctgctaacactttcctacagacttgtggtcatatcactttgtctagagcacaacttctaattatccttcttttgagtcctgtgttcatttatcttgcaagccatttttaaacacttattatgtgctgagaaactgttaggcactgtattttagggaaagtcaccaataaatatattctatatactgtgaaagatgtacccttgaactgcatggagaaaggaactttaccaaggagtccaggaaaaattgccctggagaaatgatagctaaactgaattttaaaccagtcaacctagatagcatattcaaaagcagagacattactttgccaacaagggttcgtctagtcaaggctatggtttttcctctggtcgtgtatggatgtgagagttggactgtgaaaaaggctgagcaccgaagaattgatgcttttgaactgtggtgttggagaagactcttgagagtcccttggactgcaaggagatccaaccagtccattcggaaggagatcagccctgggtattccttggaaggaatgatgctaaagctgaaactccagtactttggccacctcatgtgaagagttgactcattggaaa

SEQ ID NO: 39694 - DNA, 1733 bp, Bovine  19866880636708
catactttaaagaaatagtctttattctgacagaaatcttttttgaattgagattataataaataaatatagataatctgtatttctataaaagcaaaaaagttaaaagaaaatgtgagtaatggaagctatataacattttatggaaaagcagttctcatgagcaggaataatctatatttttgtcaccactaatcatgtttactgagtaattattcaaccatccactttttataagcaatgtgaatacatctggcttttacaaatcccttattacaactgggattcaattcaatccaaatttctaaataatataaacagaatcccagcagtgattgtttattataaatcaaatgttaccttcgattgataaactctggggccaaaattgcattatacttcagagtgaaagaaccacagcagaagattcacaatcatatgaaaaccaagagggcagtgactcactgctgcgtctacaaatgaacgcagctgctctactatgtgagtcttagaggctgacagcctctaatcctggtgaccggggctgagtaggataattaaatagtaaactcagaaatcccactaggggattaaaggcagaaagggagtctgaagggagcttgagagatgttacaagctggtacagttattctggtgggagttctgcttcagttgtctaactaccggcaagcatttaagttgggtgcaactgatgaccgacctatagctcacattaactccagtgattctcggtaagtcaggactccgctggccaaccgtcttctggccatgctacctggtcactcttacggcttctttcctgtctccatcccatttccttcctccttacttgtttttacctccaattcctcacagttcagctttataatccacactcattattctgtccatattcccatatctttatcttatgctccatctgtctttcaacattcctcaaataagtatgaccatgagacaaaaccctagctgtttatattatagtagttcacaaatatccagatccgtaggctttatttcatgccaaatggaaagatgaaaagagtagaaaaatcaatcattttctataaaatcattggatttactacaaaggtaatgctcagatgtttgatgtcctctcttataaaatgaagaaaaatagaaagcaatattataaaaccatcagaaaaggaaaaagaaaacaagattaatattaatttaaatttaccaaatccaaataacttgtgttcttacaaatattataaagtgactgccaaacttatgacattcatattttagtttatgacactgatggcatagataaaatatagtttttgatattgagttgaaaataatgtgctaatgtaaaatgacaattaaaaatgccattttctttatggatatttgatttgggacatggcttactgtatgtgatttctaaaaaactctcttcagagttaattgcatcgttttgtatctaattgctgctgtctctaacaaatatattagcgcagtaatggtttttacatctagacacacagatcatttgtgtttctagagtccacgtcatttaattgaaatcacaaataatgttcaaataagaggcagatctagtcttcttttggattcattaattcattgtttaccacagtaaacaatttgtttagtgtgataagatgcaacattatcaggagccatacagttcttctcgagggtcaccccagaagcatagt

SEQ ID NO: 39695 - DNA, 1743 bp, Bovine  19866880749361
ataaataaataataaatattaaaaaaaaaaaaaaaaagaacagaattcaccggagtacttcaaaatggttactcccccctcccagtggaagctctgtgggatttttctctggtattcactgtgagaacctagtagagctcctgttggtaaaacaaaagtatggggcagagtctcccctgactgtttccgcctggattttgaattctcagatttgtccactatgagcctccagctattcatcagttacagttcaggttttctaatgtcagggctggttttcatggaggcttctgctcatggatttctgctcagacaaattatagttctctgtatctgttagttcttccaatctgaggggcagtggtgtgccctgtgacttcatttttctgaaggaactagaggagctgtcgatgtttcagtttgttcaacattttgcttgtttttgggatggactagcaacttccaagctccctatatcttatattgggaatcagaagtcccctatagtgtttaattttcacagtgagaatccaaggagattggtattattatttagtagaagaagcaaaagatgttttgggtcttgctaagagtcttgaagatagtggagtcagaatctgaatccagatagcctgaccttggagtgactcaaaagcttatcctctttatcagaacacatttcttttacatactcagtgttctgttcaattgttgaaactttctagtgggggaggatttctctgccttctttacaaatgcattctagtgtgtgacatctttgggcttcccaagtagcgctcatgggaaagaacccacctgcaatgcaggaaacataagagatgcagattcagtccttgggttgggaagatccactgaagggggggcatggcaacccactccagtattcttgcctggagaattccatggacagaggagtctggtgggctacgtctgtagggtcgcaaagagttggacacaactgaagagagtgaatacgcaggcacatgggacatctttagaggccaagaagtgccttctgatgtttcatatgtatccctccatgtaactgaggccattctgttgtccacacttctggttcattggacactctctttataacatctttgcccatatccctttgaatcttagatccatccctctgagtccagaaggaaaagcaactcaaaaaataacacatacatgtgtccaggaccaaaaaagagtacagttatcacccaagtagaagtgcccagggagaacttacatcagattctctcataaagtaagttaactccattatctgcacaccaaattaccttcatgccatatgctattatgatttatttctctcttaccccaaactggatgactcagtcaagatcccagcggtgatttcaggacagaagagacttcctggccatcatgcctacttagaaggggtagtagacagcataccctgtaataagtacagttattacagagaaacttggctaattttactgcatgttcatcagccagcaagataatcttagcatgaaaataaaaaatttgatttatgagattgtgggtgaggtggctaggggagttgggatgttctcttaccagtgatttctctggtgtcaaaccttactgtcaaggctgcctatttattcttttagaccacaaaggacagtgtggtactgtgatattctcatttggtttctgacataagagaatcatgagaccagagtcacagacttaaca

SEQ ID NO: 39696 - DNA, 3534 bp, Bovine  19866880817931
ccagtagtcttgcctggagaatcccatggacagaggagcctggcgggctacagtccatggggtcacaaagcattggacatggctgagcgactaacacacatccacatggtataagggtgctacttctgggagggctctgtgtagctctccctcacgtactacgctacattacctctgcagaaaatttggctccatccactaagtgctcagagccacagtcatctgtgatgccccagtgaaaatggaactgccgcagcctgtagctttcagatagaggaccccctttcagcactagaagaaaaaggaaactgctattagtgttacagtcatgagctccagcttgtctttgcatttaatacaaattaacattaaattggggcgagtagaaatgaaaataaacagtagtctaaagtttccgtcttgttggtttttccccgtgtccacaatgatgggcttcagaggtgcggagcaccttcagatggtgcgtgagttacatggttctcagcacatgggctataattttatcttttcctgttttcaggaaaacatattggaagatgagtgaattctaggattagagctctttccttgattctgctttagtttataagttcattcattctttcaacagacagtaatggacagtatgcattaagatatctagcaatttatttttagtaacaaatcactctgcatgtatcttgtaactgatcaagatacaagagggtattctgacagctttactcagaatcctagccagggaccaaaagaaagttccagcaggatggtagagtcacttttaaaattctaacactgaaggatcattttgctttagagagtctgtccaaccatatgagtaataaaacacacatagtaccagacctaatccaatattaacaaaggacgtagcaccaagatgtctaaaacttaggctcagaaccttgaaggaaagtgctatgactaactttgccttttgacagtagagctgatttatgaaattgtcatttagtaaattattcagtaaacagttttgagatttttcctgtgagcgaggaagtatgttagattctgggagatgaagataattcagatactatgatttaatagggagaggggaagctagacaaaaatacttatgcacagaatgattccatgcaagatacacccaagaccagtttttttgtgttttttttttttggttctggtacccaagcacttcacgagctggtgatggacagggaggcctggcatgctatgattcatggggttgcaaagagtcggacatgactgagcgactgaactcaactgaactgaagcaattcattgttatggagccattttcctggccacaaaaaataaatatactcatccgggatctgtatttcttccctaatgcactcctccaacctcatctcaattagaaaatatttgcctttttcagtttttatattcatgatgattccagaattttgtgaaaaagtactgtttattcagagggtgtaaagttagcataaagatattggaaaccagaaaagatggaatagagtcactgagaaggagaagggctgaaaaaagaccgagctgggagtccccagaatcacctttaacacttggaaatattttaaaacttcaagatacctcagtagatggcatcaatgctacccgtgtgcacccactgcatatgggtgttcatgtttctgaaagccctgctgtttacatttccccagtaaagtcaaagacacaaattagaaggaccttttggctcacctgatctattatcactgtcctcaaagtttacatgaaaggaatgtcccacgttgacgatttctttggctgtggctggattgtaggagacactgaggggtttcagagagggatcacgcttggtttcactggttttgatgtcgataggagattggttatttccatttgcgatggggtacagcttgccccagtgttcaggacctaccaggacgaacatgattacaatcaaaactgatctaatgcttgagtccaagttttaggaatatagttttactagattaggatttattcaggtatctcaaatggtattccggttagcttaatggaaatcccaggtgtgagaatgccccttttctgtgccacactggcaagtagtgtctttgtcaacagaagtctcatagtctatgggatcagactgtacatattttgctgttagtaatagacctgtctatacatagggagggagagaggttgagaggcagagaggagaaaagaggcagaatacattttgtagacatcatgggccctaaggacgactgttgaaaacgtatgcaaatctggtgtaagtcaaaggcacttcaaaccattaatctatgactttaccattattttaagtgctcaatatctcttttcctggaaaagggaagaagccgttatttgatctacatgagcagaagaatgcttaccgttttcaccatcatatccccagtcaggacttgccatgatcttctacttagttttcttttcctgaaaacaaagacaatacctggaataactgactgtaactgagtgtgcgatagacaactgaaaccgcagttcgcagggtttttatagaaagtctctgcctttgtgcatgtgtgttagtcactcagcccactatttcatcatctttatctatcaggaagtatatgcatgttaaaaaaaaggtattgtttataaaagctcacaaaggtaaggtcaattccaattgctttattctcttatattgttaaagagaaatatcaaaatcttagcttctgcaaaaccaagccctgtcattctcatgttagtagaagatatggctgagttatcacacatgatgctttgaatttccagttaaaaaggactgtgcatttgagattcccagcttttacccttgctggacacttaagcaatactagcaacaggaattgagtcaggagaataatttgcatatttacaggcagatcagaaccaatatcatgatgttaatttaaaatcagataagagaaccactcatcatttgtaatacattgggtttgccgtttgtagtatattgtaaaatcttagggaaaaacgcaaacttttaggccaactcaatatattattgatgacagtacattttgaagacatacaagatgagagtcaagttcctcgtttttgagcagtattggaattcacaaatggagatttgttttatgtgtgagcacggttgtgtccaactctgcaacctcctggactatagtccattccccgcccttctgttgcctcacaggctgccagctgtgagctgtgtgcactcagtcatgcattcaacaaatcattgtgtgtgctcagtcatgtgtgactctatgcaaccctatggactgtagcccgccaggcacctctgtatggaattcttccaggcaagaatactggagtgggttgccatttccaactccaggggatcttcctggcccaggggttgaacctgtgtctcttgcatcttctacattggcaggtggattctttaccactgctgctgctgctaag

SEQ ID NO: 39697 - DNA, 1307 bp, Bovine  19866880824479
atatagattgtttctggttggtcagcttgtatgcaattttattgcccattttcttaatctctttcttcaacaaacacactgcttagaaaagcaggaaaaatactcacttcactgagaagctgtaaaatttgatcatctaatttctgcagtttcatctcattctgaagatcattttcatgattcactttctctggctcagaagagggacacacagacatgagcgatgtcaaaccggtgtctgtcggtgtgcttggaaactgatccaagggcactgtgtcgccgacggggggcgccactggcatcccgtcagtgatctgggacacggaggcaaaccagaaccctttacatttatatttattaaaatgtgaaaacaccctttacattagaataaacaaaacagtactatacctcatcttcacttatatttaggggagactcagaagaaactaaattatccaaaagaccttcgaagcactgtaggtgcgatgagtttatttctgccatatttattggctcaccaaatatgttcttacaatctaggattctgagctgtggcaaagtctggagcataactgctctgtatccttggaaacaaatcattcaaatgaaaactcaagcataaaaaaaaggttagttacgtttagaataaagtaaacttatcagctaccacatatatcacctgaatgataaaattagtcctggaatggaactaataaactaacaaaatctactcatcttctccagtgtgcaatcattaaatatagaacaaacaaaacattatgcccaaatccctctaaacaatcatcctgatgaaatcagaaagttaatatcatttctgcattgttcataaaactgccttaaaggtataaatgcacgaaacaagtggcaatgtattctagacaggaggccaaacatacctcttccttatctgtaatacaactagtacacatgtaaatcaggatgttaagaataacaatcagagatcaaaattttgctagtgagtctataagtattaactaccttaaacatttccactttctcctcttacatataactaggatgaaaatagtcaatctattgagtatttaagaatatgatcatcttccttaagtacaattaaataggagaaatctggcaaatgaacattaatttggtttttaggctaacaaaaatgctttaattaattttgctcaactgcaagtaaagtggtttggaaaaactccaaaagaaagaagtctagcaaattaacattagaaattttaaggaaagaaaagtaatttcagtaacaaataactctgggggagtgg

SEQ ID NO: 39698 - DNA, 975 bp, Bovine  19866880841980
tatttgcaatgggaggaaagtgtgaaaagcaagagtcaaaatatatcttttcttttttttttttttacagagccacgaaaatgcaagagatggcaacattttttcctgtacttaatttctaataactatcataggaagtgctgatgtaagtttggctaagtgtctgtttcccactggaatgtgatcacacaaaaataatgcaggatctcaagggctattcccacttttccaagggagaaagttgataagtactgcaatggttagggattgtttcaaacttgcgtaactgttacaggcaaagaaaagatcgtaatcatgtaggaagttcccgtgttcccgaatcctgaatgcagccacgtcttggcgcactggaggtaaaatagtttgtgaattgaaaaacctgtagacaaaataaaatgcttttctttttcaggtgtttgtaccctaactctcaaacgctgttaaagtctcaaaaatcaactcagaactcattaaacattttgatcctccaaaacaaacacaaaatctgagacatattgttgcaaatcacaatcaagctttgtataacttcaaacacactcaaaatgtaacgtttcaccttaacccaaagataaccaattttcccagtatatgtatcacgatctattgattcatacactcacctcttcgtaataccaaggatgaactgaccaccagtttcttcttttaaaggaaatactatcattcaaatatttgttaagatgacagtttgatcagacttcctgaaaagtaccctaaggggagtctttatttagtagctgatggaataaagcctctgctttttagttctctcttaaaaaaaaaaaaaaaaaacattatttgacttttttgagtgaatcaaaaacattgtaaggaataactctctaagggatttaataaaatgctaaacaaaacttagttcgcattttaatcctgaacaaaacaaaaagtagcaga

SEQ ID NO: 39699 - DNA, 990 bp, Bovine  19866880899313
atttcttttaggatggactggttggatctccttgcagtccaagggactctgaagagtcttctccaacaccacagtttgaaggcatcagttcttggtgttcagccttttgtattgtccaactctcacatccatacatgactactggaaaaaccgtagctttgactatgtggaactttgttggcaaagtgatgtctctgctttttaatatgctgtctaggttggtcatagcttttcttctaaggagcaagtgtcttaatttcatggctgcagtcaccataagcagtgattttggagcccaaaaaaatagtgtgtcactgtttccattgctttcccatctatttgctatgaggtgatgggaccagatgccatgaccttagtcttttcagcttttccgtctccgctttcaccctcatcaagaggctcttgcgttccctttaagcatatatatttgcgtgtgatgtgcatgtatgtatttttttaagctatgaggaacagagcggggtgggcagtactatgacgtatgcagtgaatctcttagagctgtattttctgtcaaaagttcactttttagatttctagtaaagcttcaatggcaacccactgcagtaatcttgcctggagagtcccatggagggaggaacctggtgggctgccgtctatggggttgcacagtgtcggacatttctgacgacttagcagcagcaataaagcttcactgctgtatagaagggaaggaaggaaggaagggggaggcagggagggagggaggaaaagaaacaaagaaagggagagagaaaatgtgaaagtatccttagagcagcaggggagcgctggctggctctgttgctgctcttttcagtctgccctgcttctgtcagactgggtcagagctgaatgccaggggcaagagggtgtccttggcaaaagcaagatagtgtaatagggatgctttgtgaaagctgcacttaaaatctcagagtatgtaatggg

SEQ ID NO: 39700 - DNA, 1442 bp, Bovine  19866880944088
cccccagagtggccaaaattgactggtaggatcaaatgctggcatgttggcaaagatgcagagtgctgaaactgtccaacgtgcttaggcagattcgatgcaatgtatctagaatattagaatgtctgggaatttcttataaaactagacataactgaggcagcagttcaactcctaagcattcaaaagaaatgaaattatgtgtctaggaagtacttgaataagaaccttttagcagttctactcatagtatcccaaaactagaaacagttcatcaataggacaatggatatataaagtggggtctattcacacaatggacactacttagtaataaaagagagcaaactattgagaagtgaaacaatgtgggcacattttagaaacattatgcttagtgaaagagaccttgtacaaaagagtagtgtgtgattgccttcatgtaaatagaagttgcctgaaatttaagttaggagtagagactgactttcctgaaatggcattctcttccttgttctggtgaaaatccatttttatttcaataaaaataaattcctaatgccataccctctagaaaccttcctgatactcgcagagttaattgagtcctcagtaacctgtgcagaaccttattcagacagtcacttcattgctgctgctacttttttaaaatgtccatttccaccccttgcaggctggatggtttcttctggtttgggatttctcatgcataacccagccttcatcatctggcagggcatagggatgagtgaggtgggtggaatagagggatgctggattacttgacaaaatctgacgcattatatcccacttctgggtatacgctgtccctccctccttgaatatccttcccctctcttttttccatctgtctggtcaacacatgctgtctctttaagacctgtgttgcatgtcatgactccgtcctggcacaaggtcccagcctgctctggacaccactggatttgcttctttcttagaccccactgtatgtgcttcctcacactttacttgctttattgtgattagcaatttcctttctttctggctcactgatttgtgaatttctcagggcctgttttctttggtgttgttccttagtgtggtgcttagcacgtgttaatgttaatgaatatttcttaaagaaagagagaaacatatcttcagactacctcaaactgggagtgctcttatcatttttaagtacattttattgttttgtgttctaaataacatgtgtgtggtgccctctgtgatttagagcaatattatacaaagcagaggaacaaatagttttcattataacttacacactaggtcgttcaggcagcaacctgcactgtcgaggcactgaggaggaacgacagcaggaggcttaaaaccacacgtcacagtcagcagggcagtgttcactctgttgt

SEQ ID NO: 39701 - DNA, 1160 bp, Bovine  19866880967619
aacatgcctctttttaagccctgcggctagaaggaaaaggaaattcactgaagttcccactggtattttctacagtagtggttcctcttcgaggttttgggtgtttagtgggactaactaaaaaatgggattaacacaagattgactatttttaattttgccaagtaaggatgttaaaaataacaacaaacattctactatcaatgataacaattattttataaagtgatagacttaagaaaaggtcagtttcctatttaaggacaattgtttcaatgaaaaatgcttatgtttatgaaaaattcactgccttgttcttattttctcatttctctgagaactactggaaactctgtcatgaaccctcagtaataagatcaaagatttttaaaactataactctagaagagctatacttgtctatgagctttcattaagtgagtttttgggtacccatgcctcaagtggagagctgtgcctcaatatctggtgtgaggattttgatgtcagtctactatccacctctttcacttttcctttcaagtttataataatcttggttggatattcctgaagaaattgagtgtttgagtctttagtcttcctgaatttttgtaagtaataaaaaaactgaatgcaacatatgtttgcttaaaatagagctatctgtcaactaaggcatatcatataagctgtatgataaagtaggcatcaatatatgttaattgctcaccagactttctccaatataaacatgaaaaaaacattttctattataaaataagaaaatttccataacaagcaaatttttatttatgatataaagtagtttgcaaaataaaaactgcaagaataagtgaccccatagagagtttctattatgaagaaccagattgaaaggagaacacagtttaaaatagagaattactcctacatcaattatttccaagacatcaaagtgccattgttgaatctcaactaaatttgaaaatcatcatcgtcataattgcaaattgactctgctttgaagaatgattttaatttcctttgatggaagcatgtcatgtagttttacttaaatctatcaaacgtgatagaaactattttgtcttaaaacattagatgttgggctaagagaaataggactgtggctggagatt

SEQ ID NO: 39702 - DNA, 1987 bp, Bovine  19866881009605
ttttagtttctaattcaataaatatcaatagatataatccacataaacaaaagctcataaacaaaacctctttgaacgtccttgagaatttgttagagtccaagaattttgagaacctccaaatcacaggaggatggatttcagagcaaatggaatcagcatctccagagctgcttagttagcagtcagccagcaggaaaggcccaactggtcgcacctcacctcacaccttaactggggatatttctttgagtgacacagccattcaccaccacgtggggcagtggatagcagagctttggaccgagagcaccgaccccaggctctcaggtccaactcttgatcagatctggaatccatagcctgagaccttggatcagttacttaagtctacacaaaacacataacatgggtgaacactgctatttacagcacaagagtgcagaggaaggctcggtgcttgataaatgttagctgctgttgtcaccacaatcacaacacactgagagcctctctcggccaccaagcaagacagccaccacgtagtctgcccgagaaaagcacccttgctctcaacgttcatcttcagggaccccaggagggctgggctgcacccagtggggcttcctgagcgcaaatgaacttggacaggagcagagtcctgggctcccgggcctctctgaggtcagacagtagccttgagtgcagtcgctgtggtatcactcccctaagtcataatcaggaaacgcggaacagcctgtttctcccacaaggcagtcatgacagggctatatcaaatgtcagacacaaacctggcacctggaaagcaaacccctccacttgtgtacctgccacgagtgggcagcacctctactgaatgagacaaaaccagcaggtggagaactgctgacctgccttcccttctgccagtccccacctcctcgtgtatcgaattctgcttttgagaagcttagtaactacggtccttccctttaataagatggggattttatttatttgaggggactgctgccgttccaggctgaacttttagctcgctataaagttaatgtgctattcaatgttcattccaggcaaggctgtggggctgtgtattctctgccacccccagaaggccattatctgtaattgcccattaccatgcgtaattatttctcctggcatggtctacaacctccaggactgcacgcgggtatagttaactgctccctcttaccaaatctgtgaaggaatctttactgaccctccatacactgaatggtatattccaaagccgacacaagacccttttacaggcaaactcatctcaaatcacgaacattcagatcccctccagatgtccctttcccactttcatggagtcttccctcccctcaaataacaagaaaataaagcacaatcaactcttcattatgtgggggctgataaccaaactgggaattatctagagtcctttatcctcccttcttttggatttggctgcttaattgtatcatgctttttaaagactactgggagaaggtggagatagtggaggggagagagagagagggtgaaacctaaaaattttaattcaatacgtgtgttcccacttctagcgttttttgaggaggaggaggaactatgtccaaatcagtgattacgatgggatttggggattccaggtgcatttaaagtattaattctagaactgacatttgctgacacagcccaaaatgtcaccttatatttacctcacttttcaacgttagctgggaaagaggagaggggtgggggactactggctgtacacgcagatgccgaaatacccagccacccctggcatttctgtgtcttttctgctgcatcactcaggtatgagggcatgagacgtactctaagctattataattttcacgcacgaaaagctaggaaggagccaccccatctctgtatggtcactaactacaactgcaccaagaccctc

SEQ ID NO: 39703 - DNA, 1682 bp, Bovine  19866881027849
tttgtggtctccattatattatatggtctccataatatttttgtgttacgaaatctgtgaacatttggtactgtaaacatgtgttatttaaagtaatttagtctattaatgtgacagccatatgattttgtcttagaattttttagtttaatttgcagttaaaaattgagacttaatatttcagttttgtgatctgtcttatatccatatcttatattcaagtgtgatactggacagtctaagaaaactttaggacatcatatatttaacttattagattttaagaattatttaattctcagaaaaattttatttgttaaaccagacaattaaagtacttaaaaacacgataaacaatatgttaaatttacaagtgtcatttacaacatttaattaatcagggacaatcatttttcaaagaattcttagacgtactttgtaaaatttgctctacttataatcctaataattaatgcctaacaattttcattttaaagctttcataaattaaacaactaaaaataacaaaatatatacccttaataatcttttctccagtcaaagcatagaaaaaacttatatcaccaggaaagaaactgcacgggttaggcttaagtgcattttaatgttttgacattctctctctctctgcttctttcctttagtcccactttctttttcttcttatcttcttcctcacacaatatacattatatccttactgataaaatatacatgtattttaaaaaattaagacatcattctacatgttctttatgtagttccaggctgtgtgcatttacatgaaaagagacaatgaaatcttgaacttaaggatcaaactcaatgtgctactttttgtgtggtgtaaagacattttgtacatttcttatatacatgtatcaaaaattatcccttataaatgtggaatgaataccttaataaataaatttaaacttagcctatagaaggataaaagtgaaaagtgaaagctgctcagtcctctccgactctttgagaccacatggattatacagtccatggaattctccaggccagaataggagggggtagcctttcccttctccaggggatcttccctgacccagggatggaacctaggtctcctgcattgcaggcggattctttagcagctgagccacaagggaagcccaagaatactggggtgggtagcctatcccttctccagtggatcttcctgacccaggaatcgaactggggtttcctgcattgcaggcagattcttttacaactgagctatggctgacttgcaagcttaaggcattgtggtttgggggttttgacggatgatttctgtgtgcatgaggctatatgcttgcactgcactctttcctccaagacctccattgatcacttcattattacagatggaagttgcttaaaatgctgcagtagctgtgtatgcaaagtttactaatcgtgcttcttcaggttaagtgatggcagattacatgaagaaggtgttattaaccatatggatacaaggcatgaatataattctccttatctaaaccaacagcaaaatatagttcaccctgcttcccatagaactgtagtctgagaaaagactagttgtttgcttctaaagacatgggagaaagggagcaactatgatattcttgcggcctttttctcaaaaa

SEQ ID NO: 39704 - DNA, 771 bp, Bovine  19866881042588
agtcggacacgagtgaagcgcttaacacgcacatgcttgctttgcagtgtgcctccttgagacatttttgctttcaaacctgggcaggagccagggccctttgcttctagcccttgctggacccgcagctggattcaactcctcggcaggaaaagaagagactgcttcaggaccgccatccctctgagagcaaggcgagagggcacctgacccaaaatgcggggtcccacatgcagctgaggaacacctggagggctacccgacagtttttctgtcttacagggaacatttcatctccacgtgtatgaaaataaatgaaaagagagagagagagaaaaaaaaaacattatgtagtgacgtttggagctgtgaagtagaacattctgaactgtgggaagaaagctcatataaccttcaaaccaacctcctttccactgcttggcaaagtgttaaagacattgtttttcttttccaaggacttttacaagtggattgatgtttgactaaatcagactctggactgtgctgccagtttccgctgcctactcattgtagggggtgtgcagtgattctaataaaaaagactgtctattgagaaataagtttacaaaaaccattttgaaaaattgatcatgcattagaaaaaagcctagtttaatgtattttttaaccacacagagagaaaggagtcccttttagtctagtggaggaggaaaccactctgagcatggacttcagaagtctggacatgaacctgagtttctgccttta

SEQ ID NO: 39705 - DNA, 768 bp, Bovine  19866881081459
tttccctctctcctagttaatcggcatagacccttattgggtccccattggagacaacattctcacaagtttcttcttaatcaggacaaactttaaaaagctagtggaacttgaattacttctgttaaaatgatcccatctgtaccgtaaatggtgagacttggaaaattaattacatatattcagatgtatttatatatcccagaaatacatattagatatgttttacattcaccaccctaacagatacagaaggtaaacaacccctaagaaatgatccctgggtttcatcactttatacaattttggcttagattaatgaaaattatagtttccatttctttacctttgatctacaaaagtataggaaagtaccaggtttagttcgtctccagaaaatggtttaggcaattacaattaacaaggagttgctactttaaagtagatcttatgtaagaaaactgctctttcatttttggtagctgcttatcaactaagatgagtcactagtaatgtttacttctttgtgaattgacaggaaaaccataaacaaatctcaaaggagacagatgaataaggtttcaaggacattactgctcctgcctgaaactttagccaactgaaagcctgaaaatatgcaactcagaatttcactgcttcctcaaattgcaggtggacaaacgtgaaagatatcaggactttagcctgactgctcacaaaacaacttaaagcatgacagtcagtatataacgaatcttgaaagcaaaa

SEQ ID NO: 39706 - DNA, 963 bp, Bovine  19866881083630
aatgaattcagaaatttgtgaattttccaagtgcactttgttatcaataaattattaagtatctaccaaatgccagttactatgagaaatgctgtggctgtgtggataagctaaatagatgtggtctcttctacatggaatttcctggcaacaagaattcagaagcaaaatgaataactgaaaatgatatattgcacagtttcaaataagtaaagctttgtgaaaagatataaggtgctattggaatacataggggatacctagtgtagcctgggtcaaggaagtctctctgaggaagagaggcccaagctgaagtctgcaggatgagcagactgctgtagaagctggctggaaagactcggtctccaggctgagcaatggcataaccaaggcctcagtgacatgagagagaatgtggaactgagagaaggccaagctgccacctcaggaacagaagttggggggcagggtagtgggacgagatgaggctggtgagttccacgggggtcaagtcagggagagtcttgggttttaatcctgaggcaggaagctatgcagtgtttgaagcatagcacttcagttcagttcagtgcagttcagtagctcagtcgtgcagactctttgagacctcatggactgcagcacgccaggcctccctgtccatcaccaactcccggcgtttactcagacccatgtccatcgagtcggtgatgccatccaaccatctcatcctctgttgttcccttctcctcctgccctcaatctttcccattaccagggtcttttcaaatgagtcagtttttcaatgaccttagaaatcgtcatccatactactgtgggaaggtatgtttggggagtgtcacggagcacatgaagctattcattatttccatttcaatttaagatgtgatgaatgtcttttctctgtttctttggcatcaaaaatgtgattttaatatagga

SEQ ID NO: 39707 - DNA, 925 bp, Bovine  19866881153334
attagctattatttatgtgaagaaataaggctctaagaacctaatttgcttacgatcctataggcagcatgcaaatacagctagaattctaaaatgtagtcctcttatcaaatcataacttgctgattctgttttcaataaaaagctagatgccagttcttacatctttaaatcttctggcttcaacagttaaagcaatacggaattcattttctaaatccatatactgttgatttaatgcatcaattttgtcttgatattcttttataacttgctcatgctttctctcttctttagcaatttctttagctaaggcttcctggaactcagcttcactaaaaaactcccttgtttcaatgtctttcctggaatgaaaaacaaaaatcaaaggatgctgtttacatggaaagaaaactttaaaggcctttaggtactaaatattctatattccctattgttaaagatcagctccttactttcaaacacaaaataagggacaggatggtatatgcagaaagaacaaaagtttatttgactgttcattcagtggtgacagggatatgccaagtcttaacttcactgagatagttcacagtcattttatggtttctaatatcctttgggtgtattcataggagtcaggttctgcttcactgcatcttctatgttgcttgactctttaatatacagtaaatacagtctaccgggcaaaactacagcccttggaccaaatctggcctggtgcccttcttgtggggaaataaacttttattggaacacagcacatccatttgcttacacactgtctatggttacttttgggctacaaagagacagttaggcatgacctgaaaagcctgaaatattttctatctggacctccacaggaaaaagtctgctgaatctgcttcaaaggaataaagta

SEQ ID NO: 39708 - DNA, 1451 bp, Bovine  19866881180534
atagcacatggaaatgtgtgtgttgttgagccagccttggtttagagaggacttagtgtcattaacacatgagtttagtggtaacatgatctagattttaagccagaggtgaaaatctggcttctttctttttgaatgacctaatttgttttatgttctgaattcactgggtccttttcagcgcttgagcacaacactacaggaagtggagtgggtctgagcagaaagacaataggtttagttttaggtacattgagtcctcttagctgcaattatattaaaaagaaaagcagaatgacttcacagagaaggtcaaggacatagatgtaaatcaacatgtaattttgtggttttgtatttcagagacccagagtccaagtttagttcagaaaatacctaccctaaaatttcgggggagggatgaacttatgtttttgcttcatgcaatatattctggcagatttataaacactggttgtagatggatggattaaaatcagcttttaagacaatcctaaattatggagaagagaaaattataatcgttagttttctttctctttctctctcccttttttatttttttacagataggacgtgagaaaggcgagttccagcttctccttgatgcactggacaaaattaagacgaaggtaaaaaatatcattttccctcgtagaacataaagtcaggttatatcgatttttttctttttacatttttcaagtgtgcttctttcacctaaaatctgttagtaaattgttcaatgaatatgctgctgctgctaagtcacgtcagtcgtgtccgactctgtgcgaccccatagacggcagcccaccaggatgccccgtccctgggattctccaggcaagaacactggagtgggttgccatttccttctccaatgcatgaaagtgaaaagtgaaagtgaagttgctcagtcatgtctgaccctcagggatcccatggactgcagccttccaggctcctccatccatgggattttccaggcaagagtactggagtggggtgccattgccttctccgaatgaatatgctaggcagacctataaaagcaaatgctgttgtgtttgtatatttttgtggtttgttggttttagagcagtttcacatacataagcttatttaaccctcatagtcaacctgtcagataattacatttttaatgaaatgtttgagagagaagttgagtggtgtttccctgcccaacacacacacacacacacacacactcttacacacttgcagaggcactaaatatttgggtcctagtgttcccctttctctcctggattgcacctgtatattttaaatcttaacagttaattcttctacttaacagactcactttaattctttgagactgttttagtcatcactttagttttaccactaggtaaagtattctgaggatgacatgtgataaaaat

SEQ ID NO: 39709 - DNA, 866 bp, Bovine  19866881204334
cacgtggtcgaagcaagaggagaattcagccaaggacaaaccagcctttctactaaaatatttgtacttattgatggaggtatgtttggggtagggtgggtcagatgagagggtcaggatggaggtagcacatgagccaggaaatccagtttatgtcagggataaaaatagaggagacagttcagaatagcaagtggactgcagagtggactgttactaaataaagatcgaacaggtgcccgcagctcttgggctagctggaatgagtgaccttgctggaaaggtgagcctcccccgccatgctccaagggggatctcagtctcatcacatttgcacaacaggaaaacgtcctcatctgagagccgggctggctgggaatcctgactccccgtcaggtgcccttctcactttgaaaggcctgctgactagcgtctgacatgagtgaccatctgtcgctgcctaagctttatcagggaagtgcatgccgttcccaggctctggccttcttgctggattccttaactgatgaagatcacatggcatctcagcggagtctctggaggtcacctggatccctgtgagtttcatgcaaacagccaccaatcctctacactctcagacaattacctagagacttgctgaaggagtcttcaaaagcatgcttttcaccaagaccctgccttcctctctaggaatccctggctggcaatggtggctttccgggatggtttcattttatacctggaaactgaccaatattaaaaagactgagagaggattctgataaaacatttagggtaattgggacctgctttgtaaagacttttttcccccttttaggctaaagattgtgttatccttagct

SEQ ID NO: 39710 - DNA, 1806 bp, Bovine  19866881249589
aaactaaatgctcactagaggaattataaattacgtattttaaaagaaaaaattaaaacaaaagggaaaaatgaaatagaaaaagaagatgttcttaggagtatcgtttataacaataaaaaaacagctaatctgaatgctcactagaggaattataagctatgatatagttagtttaaacttggttggatatcttcattgaaacattatacgtaagctaaataggcaagttgatggaagatatttttgaataccaactggtctgagtgaagcaggaggaaggggaggacccaaggccttcctgctggtgcccccacccaccctccactctgcacagggccccagaccacctctgaggcagccacagagcaccgtggagctggggcaaaaccaccactgcaccgtacctgttgtcactaaaataagtgtacagccacacaagcaaaacgtgtctgagataacgctacaaagtaatgataaatgagtagagaggagctcagccacatgatgcacacgcagatacatgcagctgcataaaatgcatgcaattaagacgattggaaagatggtaggtggggaacataactggtcttatcttgtgcttagtcactcagtcgtgtcctactctttgcgaccacatggactgtagcccccaggctcctctgtccatgggattctccaggcaagaatactggagtggttgccattcccttctccgggtctactcttacacggttgttttagacttaatggaaatgtattttatcaatgtctctgaggagccctaacgctttaggcaattaacgtggtttccctcagcattctcatctgtacaatgacaatcatggggttactgtgagcctcagatgggttgatttgtgtacagagcataaagcaatggcttgatagatattaaccaccattagtgatatcctcagtcccttacatgcaagtggtgtaagggactgatggctcagctggtaaagaatccgcctgccatgcgggagccctgggttcgacccctgggtggggaagatcccctggagcaaggcatggcaacccactccagtactctggccgggagagtcaagcacagcacactccagtgggcccttaaagagctggacatgacttggcgactgaacaacattcaggtgtaaaacttttgaggtaaagtgatagcaaaagagaagcgttcagatttagccagctgcccatctcccttctctttcgctaaatgcagtaaatgtcagccacgctctctatggaaggccaccgctgatctaagactctccaccactgcagaagcttctagatttccaagcacctctctttttaatacttgattaaaattgtttttccctctcaaacctctaatgcaattaacaaaatcagcacaacatgaaacttctttcttcttgggtgtatactgaatcacggaatttttgctttagattattttcatttaatctgatgttctacacacatacagaccagagaaggtactcgaaacaaggcttcgatatttaagtacattgactacatttttagtggaaagaggaagatctatatttatatgacatctgttatataaatacaatcagtaggatgttttatgtcttgttgtttttctaacttctgtttttcatctgtttgctaacattccccctccatcgtctcatccaagcctctaatttctgaggctgattcccttgctttaagcttacatcagaagcagtggcatcttaaatatagtatcagtatttattcttgtaccaacttgaattggttaatcagcaaaccata

SEQ ID NO: 39711 - DNA, 1391 bp, Bovine  19866881250879
attgtaatatttttaaattctatatctaatatcatatggatcccactatagtttttctcttaagtctctatttcaaaaacatattcatctttaagaatgtatctctacatctcttctaaaaaccaaaaattattttctcaaggtcatctggaatttcagcaaaggagaatacaggtgtaccttattttatgcataataaagatttttgaaaattaaacataagccacatacttcagtaaatggattgattcaatatgtataaaaattcaatatttaaatgctaaaagaaaaatttatactggtgatgattaccgccccaccctaatttgtacaaacaggcttatatatgttaagagttccttaaagtggtttctacctgcttggctctcacaaaatacatctctgacacagggaaatgtttttaataccacttgaaaaatcctgtatctaattaaaagtcctcatgcagttatgcacaggtaagatctgccatctgaatgaacactgaagcagtttccttttctaaaacaattgctccattttgagggagcaaggaaagggagactcttccctctctctcctccttttctaccgggaattataaataaccaatctagacatgattaaggagtgggtttcacagtcccccatggatttctaaggacttggtgcagtgtatacttgaaaatgtcttttccaggattttcactctcctgcttcttttcaaacccctggcataatcttctgcactttcctgtttctcctcttggagcttctaaaagaaagttgcattatttttactaaaggacattatattagattgctggggaatgaggacattagaaactttacttatgtaatgttccaattcaaaaaaaaatcataagaacactttctttcccacattggaatttgataagtgtgcaattattgctttaattggattacaattgcctctaggttagtttatgttcttcacatgatcaaaaacacataaaagacatgatttaaaatggaaatgcactgtattttggtgataggataattcagatattttcagatagcaaataattgcattacattccactttggcaagtgttattagtataagaaacaacttcatttaaggattctatttgcttttattgctaagcttcctatatactttcttatattcttgctctccaatattttatatggttagaatatagaaagttaattcaatgtaatacagctaactgatacaattaaacataagtaacacattagttttttttttttaaactaaaccattcagtacatcctactcttctaacttgtctcatgtaattcacaatttcttcctgctgcttaatcgcagacttcagcaagcacattttaggaggagagat

SEQ ID NO: 39712 - DNA, 731 bp, Bovine  19866881258441
ttcatcactgaaaacagccagactcagtctcagctccaggaacgaactgtgaccatgccacaggccaggctcatgagctaaaagaactaacgtctcggagaaagcggtctagtgaagaaagggtgtcgttctttcaaatgttcttcccacttctcttcattcactgtatccctgggtatcaccaaggcctcaatttaatttcctgtaaataatgtgcaacagacaaactaaggaaatatataaatttttcacatagtataatccatataaaatgactccaccatatcaggaaatataatatggttggttttctgcaatagagtcaagtaacaatttatttctctttctatattccagaaggtccttccacggttgttttgccaatactacatttgagttcccacccaaggaacaactgtcatcccagttctgcatttatagtcaaaattgcattaagttcccaaattaagcatgtttggtaaattgaggtgaaccaaaatcaacagcaagacgcaacttcaaataagctccaagctagcctccagactttacaggttagaggttcttctcaccttctctcctctgcctgcaattcgcacaacctctaccaggccagtagaaaaggctgctgactaagcttttccctgctcactaagcaacttacttgatttttctaaaactcaagtacttactaaaatgacacagcatgacaatgaattaagcatttgcta

SEQ ID NO: 39713 - DNA, 692 bp, Bovine  19866881260670
aacatgggtcaggcaaacgtgttctttccagccacggtaaccggatcgctggagtgaaatcaacccgcagaagcatccagagactcagccagccagacaggcagcgttgaaagcatctaccaagcaaggctgcaagcgccagcccgcggggcgcagctttcagttcggaggcgaagcgcaacggccgtgccccccccaaaaaaggtggggggccttggaggaggggggccgagagcgccggcctctgcacttcggctctaggttaggggggcctggcgctttgggagccgcgagggagccccccttccagggccaaggggcgggggccgtctcccccccatcccgacagctgtccagcccgcggaattcattggcttcccccagcccgcctcccgagcaccaccccggtctctttagccccccgccccaccctcgctgacctaataaggccatgtgggagtgaggggcccggcataaaaggggcgccggcgggccgcgcacggcgggagccgaggcagcgccgcgcaccgccatggccaaggagtggggctacgccgaccacaacggtgagtgtccggcggcccgctgccggggtgcgggggtcgggggcgctcccgccaagcccttccctaggaccccgcacggccggccggctcaccttatcgctttcatctctccctctcctggggcag

SEQ ID NO: 39714 - DNA, 873 bp, Bovine  19866881271994
agtaatactgagtgatccttttgtgcttatactgaatggtggcaagggtgagctactctgaaggatgaggtacccactccagccagacatgaatcaccaaagggaacactgcacagagctggctcccaaggatcaattattatattctggttgggttgactgtggactcactgatgtctagcaagtcagcaagtcccagaatgctgtttcaaccctcttactaggactccattctcattctcttcccttttatctagtttaagcacaacctatacatatggcttcattttagatgctgtgaagactgcctttcacaccagatttaaaccgctcgtactcatacttaatgaataaaacatggttatcaaaaatctatcaataattccactactgtaattatgaaaaatgtttctgtcattaaattgcaccacactctagattttattatcttattaatgtcatcagtaaagctcatttatcatctatacaatgaactagagtttcgtttcactatataatcaacaaaactggccctttacaaaagttagggtgactgtgaaatattaaattttctttctcatgtgccaattgaattgtcatttttattttttatatgtaatttaaattgagcatttattgaccacctgttgaatgtcgatccctacctaacagaagaatactacaaagtaattcaaaccagaattcaagttatagcctcaagcaaaaataaaataaataagaatgactttttccaatttgacttctagaataaaagcttccctttctatgcctgaagagtagaagagccaaggatataaatgtttgataacctgaaataaatctgtcaggaaagaaatctagctgctacttaca

SEQ ID NO: 39715 - DNA, 1404 bp, Bovine  19866881274143
ttgcatttttcacttaacaaaagatcaatatctttattatccgcttagagtgtgacaatgaccttttgaagcaatagctcaagtttcaaggaagcttaaacactaatgagaaaaggagaggacgacaggggagctattcgatcccagctttggttaatcaaaggagaagggattgtattcagctaagaagatcaggaaagtcagcttggattccaaagataactgaatcatattgttatgtaaagccaaatgagaattacacagctcctagacctggtcctgcatagattctgtgacagattttctagagtcggcggggaactatatatatatataaactttcaatatcaaaaagtggcgatttttaaagaacaagtatttctgatatcattagagaagaaagagagatgccagattaaatgaatttccaatagaatgtgaattttaaccagaagcccatttatgtatgataacaaaagaataaacacaatgatttaaaataagaaagtttagcacttggaaaagttgtaaggttgggaacattttttaataaaatactagttatccaatgccaaaccattttctttctttctttttttttttttttttggtcttaaaatgccgacaccaggatttgagagccggagcatttgaacaagcatcgtagtgacccaaagtggctagaaggaagggcatcaagtgataagtacaaacttaggagaaagagtagaagatcggaccagagtagcaaatccacgtgccctccaagggatcgtgatatagacgcagcagagtagagcatatgacacgattaatgccggaggagtccaagcttttctgtgctctctctagtctgcccatcctagctttttttaaaatttaaaatatagtttattttcatattgtgttatctccaagtctacagcaaaatgattcatacttttttttctattcttttccattataggttattgcaagatattgaatatagtcctttgtgctatacagtaaatcctggttgtttatctgttttaaatatgacaacttatatctgctaatcccctagtcctgatttattcctcccctcccctcccttctggagaccacagatttttctgtgagtttgtttctctatttgtattgggctggacaaaaagttcaggttttcccataagatgttactggaaaacctgagcaaacttcttgtctaacccaatacataagttcctctgtactgttcttcgatttcaaatataagtgatatcgtatgacatttgtctttctttatcgactttcagcacttagtctgataatctctaggtccatccatgttgctgcaagaggcattatttcattctttttatggtcaagtgtattgcattttgtgtgtgtgtgtgtgtgtgt

SEQ ID NO: 39716 - DNA, 1064 bp, Bovine  19866881317465
agtgggttgccgagcccttttccaggggatcttcctgacccagggatcgaactcaagtctcccgcattggcaggcgggttctttaccactagcgccaccttgtattcagctatgaagtggtatcgccagaattggagccaagcaggtccaagaatcattgccctatccccggagttgggggtgtgcccttccccacattgtggggggttcacacatctctgctcaatcccaggccccgaacactggcataaggactttcccattgccaacggagagcgccagtcacccgttgacatcgacaccaaggccgtcgttcaggatcctgctttgaagcctctggcccttgtctatggggaagcaacttcgcggagaatggtcaacaatggtcactcttttaacgtggagtatgacgactcccaggacaaagcaggtcagtgtttataaaataacttgtgtgtcagtagcagctcttttcccagcttaacaggcgcaggacccccccttaatgctacactctgatcatcttcgttggatttcagcctctgggaagcaggctaatttctttgcagtggcaggggctgtttctccctgtcggattccccgtttctaggtagggcattgaataactgtgctgtgcctgagaaaagtcaaaaaaaggcagggccccttggcgatagagatcagcaatgaggagacttgcaaaaactgaactttttaggattggtcttcaaggtagcatgcagaagagcgatgaaaacctgctactttaaaatcttgaaattctcagaaacactgtgtttgtgaatattttctcagccttgggccagtgtgataaaggtggctgtgtatctcggtatccacccagaagttcattccataaatgaagatgttttagagttggtggacatacctggtccctggctgacaaaaccaattagcataatgtatttgtagtcgtgctgtttacagaacactcttgactgctgcttctttttattgtttttttcttgcttagaagtcggagaacaatccccttcagacacagtagcagccttctacgccca

SEQ ID NO: 39717 - DNA, 566 bp, Bovine  19866881327162
tattgcaaagttccttgttctttcctgcctttataaaagtgagttcatatggagtcagattttaatgttcagaaagcatagactatactagcatcccattcctgtagtgaaaatggatcttcctgattacagtattaaaaaacgtgttgacgttttttcaaggccattctcttaatcatctcagacgtttggtagaacgcgcaggtgtgagccacagctctcagccgcgtttgtgtttcgtgaaggttgttcgattaccacggccgtgtgcctccgccgccccgcgcggtcatcccgctgaagcggccccgagcggcagtgacgaccacgcgcaggggaaaaggagttttctccatgaaaggaggatcgaggtctgctgtcaccggctcttcttcgtcgggctcgaaatgtaagtaatcttcttcgcttccccgtaaagaagggtgggggtgtggaccattgcatgaatgtctgtactcagtaaatgaatcaagaattatggcagggttgctacgtacgatgtatgagcgaaatatcaaaggataagaaacggtctctgctttcca

SEQ ID NO: 39718 - DNA, 1008 bp, Bovine  19866881339640
atggtgcatgaaggatcttagttccccaagcaggaatgaacctgtgcccctgcagtggaagtgcagtcttaatcactgcactgtcagggaggtccacaaatagaattaaatcatatgacctgatttgagtgtatgtggttcatagggtatcaggttgtttgccaattaaaatacctggggttgaagttggaacttcagcactggcctataaggacttcagtcaataataatgtatcaataataacaaacaaccaggtcctactatagagcacaggaaactatattcgattactgtgataaaccataatggaaaagaaaatgaaaagaatacacacacatatacacacatatataaatgaatcactgttatacagcagaaattaacacaacattgtaaatcaactacaagttttttaaaagcaccttaaaaaggattgtgatatttcaaactcccctttgacagcttttataacaaccaaactgaaagaaaagtttagttaaaaaaaaaaaaatccttgtatcacccaggacttgaaagcagcaataatctctgaaattcctccatgagtgagtgttgcctcaggcttattatcttaaggaacagttctagaagcagctctttgacctttccccaacaatatacctcaaaatatgttaggagaccaaaatggttattttagtgataagtaaatgtatctatagattctctggttgctcagtgtaaggaatccacctgccaatgaaggagacataggttccaggcctgggtcaagaagatcccctggagaaggaaatggcaacctattccagtattcttgcctggagaatcccatggacagaggagtctggtgggctatagtccatggggtcgcaaaaaagtcagacataactgagcgactaaacaacaacaaactgcaagaccttagtaatggcttcacttctgccttccaaatctcacatcaataggcttcgggtatatttggacacagaatcataaagggaagggat

SEQ ID NO: 39719 - DNA, 1112 bp, Bovine  19866881369626
ctctgaccttttgccttttttagtattgagacaatgaccctctagtgcatcttgcttttatcaagttttgatagtttgttttactttttatagatcggataatgcagtggaaaattgaagggatcagataaattgattgtgactccatgcttgtaagttccagatttgcagaaacttacaatgtattttataatgtgaaggataaaggctattttttttttttttaaatccaaaagctctggtttactttcctcagtgaaacagaaaccctccagctggcatctctgcctgctagctcagcagagaggacgggaggaaaaattgttctatttcctcacctccacatgacatcatccatggcaggatagtggcaaatggttgaagcatgttgcacagtgccctgtggtgctaatctctcttctcataaagcagagatatgcagtctatggtgtcacacagaggcaggattaagggtggagcaaacaaggaaagaacatgccttttttgttacataggtgtgcaaagagtcaccaggactttgactggcaaaagtcatgcgtttgccgttttgcacagagaactccgttttaagtttggctctgtgggatgcagtggggagtggagcagtggggctgttgagtgcctgccattcacaacttcacccagagccgcaggctgggacacgtgtgtgcttcaggtcagcacttgatggtcctcaccgccccttctcttgccctcggcccaagagcttcccctctgtactgatcgcttctctgccacgcagacctgctggttcttccccagctgcacacctcttatggggcgacacagctcacagagtgaagtcttagcatcaagggttttcgccttcaaaggctgcactttctgcctccaaccccctttccagcctcatttcctgccactcagtggcaagcacctgtcccccactcccagcgtctggactttccagacaacttgccaagttctaagcaagccctgttctttgctccttttgttcgggctcatgctttttttctttgccactagattccttttctccattcctttgtcctttaaggaccagcacaagcaacctcctctcagaatccttc

SEQ ID NO: 39720 - DNA, 3216 bp, Bovine  19866881421275
ataagactgaaaggtatcctgtgggatgtgacagagtgttgaggaaatgtagggtgtctgtgggttacattctaatcgggtcacggtgcatttgacattctattgcattctttcccttctcccctttccagtgaaatcagatgagttacagacaatcaagaaagaattaacccagatcaaaactaaaattgactccttgctagggcgcctggagaagattgagaagcagcagaaggcggaggctggtaagtgaaaaagagctgtggccacagacgtgttggaatcaaaccactcacaccctgtcagtcaccaagacagagcaggttcgggcacactggctgagtctaacagcgtttagcacagatacacaaacatcatctttaaacttagaactgcaatgatggaatctgattttttactttttaaagaagatgagccaagctgcctaaaattcatattttttaaaagaggaaaaggaaaagtattttggatgctaataagtaacagttggattatattaaaggtttatatctcaatatcaagtgacctttaagaaaatatatcagtaaatggaatattctatcagggctaagcttatattcatatttcattaaattaactgcagcaaaattgaacagatttcagaagccatgattgtaaagtcccactcttgaactgctgcaactccacaaaacttcagaactcagtttcaggatgtcagtatcaatgatatgcctggccacccaaggccatttcatttgacttaattctttagcttaatgtcctctctttgaaatatcggccctgaccctagttccatgctaatactctttatttatttatttgtaattggaggataattgctttacaatattgtgttggctttgccacacattaacatgaatcagccacaggtacacatgtgtcccctccatctggaacctccctcccaccccatcccacccctctagctagttacagaatgccaatttgagttccctggtctaatacccttttttacagcaaccgagagttgtaaaattatgcattttaaacagaactggcataaacttagagaagagctagtgcgtaaattgcaaattgcattctgctgggtctttgatgtctcagaagctccttgaaaatgagctgagggctgaaaggagacctgggagatggaggaactcatgactcctccaaacccggccctttctccaaataatgtggctccacctgtgtctattttatatgttgaaattcatcacaagatttccctggctgaaagagcttcacttttcaaaattaagcaagacagttttgaaacctgctcgtcaaatccagctttctcattttgcagatgagaaaaggaaggcccaaggaagtaaactgacttttccatgaccacatgaatggttcgtgacagacctagagtctcaaagccagctctggcgagggaaagcagtgcctcctctgaggtatcagcctcaggttccgctcagggtctgcctgcagtgagtctccctgggtagcaaccgatgatgagatccagcctgtctgttgcccgggtcactgggcagggcaccagcagtgaccttccggtgatgagtgacacggggttcagaaacgaagccggtgttgagggggtgtcgagcctagtggatgagagacgtgccctgtggttcaaatcctcacacgccacctagcctccgttttctcgtttaccaaatgagaacagcagtggctacctgaccttgtgagaagtgagtcaagtggcaaatgtaagttacttactagcccagaataaatgcttcacaattggagccatttagtgtccataggaatgtaagcatatatagacaaatacttcctacgacttccatgacaccagctttttaaatcaaaagccatatacctagattctcattaacttttattgagttggtgtggaggagagatgataaataaataatagacaaaatgagatcatttttattacaaatttcagtcacattttccattgagaaaagatatgctgcctatacttcttaatggagaaatttagatttcagaaagttttttatgcgctgtctatggcactaatctaaactgttgccagaactcaaatatcctgtgatgttgcctgaatcaatgtttccctttgaggaacttctgtgaaattcgttattatgtaaaacaacccttacagcaaaggactttgataaccaatttgcacttcagtttaaaggattatggagaactcatttaaatataaatcacctcaaagagaaaaatgtgatccttattccatcatattataacttccagtttcctgcaatgaaaaatgccttccacatatcttcttagaagatcatctataaacatgccactaaaattcaaagcttgcattttcttttcatgaaaggctgtcaccttatttttgtatgtttttcgactttcccagtcacaaggcagttatctttaagatgatgggcttaagcctttgatatttatgtctttcctacttgaacatgtaggaagaaaatggaattatttaatttgtcatttcattctctcagtaattgtctcctgaacaatattcatatttatggagttaagacgatcactttctaaattttctttatgaaaagaaatcagggttgcacggtgtctgtactacatggtagaaagtggagagaaatattttaaatctttttaagtgcccgatacctccttattgaatttaaggggatactcattttattgttcatttggttgcaggccagttattcagtagttaacattcactcttcactattgctcttttatagacctctcatttccaacttagtccatctgatgacaaaaatgtccagcttaggatagtgacagcaaagagatggagggttacaagcaggataaagccacacagcgtggaacttgtcctgagttcaaatgtcacaggatcatttttttcttttttgtatgaaatcctaagctatcaggagtaattgtaatgaggttataatgacatcattttggatttttttatgtgttaaattgctgctaataagatgtttgcatagtatcttgtctcttcctttgagatatgaacttcctcagaacaaggtcatgttttcactaatttttctaaatcttcaaacactgtgtgctgtgcatgaggcatgacttagcaagtcatttaacttctctaggtct

SEQ ID NO: 39721 - DNA, 2497 bp, Bovine  19866881484890
acttgttgggccatgtttgctgctaaggctccatatcccttacctactgtgtccctggcagtgtattgattaatataattggtgtataggaatgtaagtagtacctttaatgtttgtaacattggacccttgagttaatttttttcttgttatagcccaccacacctttgccctataggaatgcaattttatctaatgcctttggaaggtggcgcctgactttagaataatcacttttagagaaaaataagttttctgaagaaaggatcttgaaatgttaacagccctcttggccagaagatgatgtaattcacataaacttttgcatatgataagtttgcaggaagaaagcctggcttactgctaactctaccccttcccccattatcttctatgcacaacttaaggtataaaaactactttggaaaataaagtgcgggccttgttcaatgaaacttggtctccccatgttgttatttctctcaccttctggctgaattcccactttgagcgtggaggctcgtcaagcctactaattttgcctgggtttctaagatctgacgggggaggccttagtgtctcctctccttcgggagaatgggaggacacctgcagcctacataggtaatgtaaattccttgctttggaattttattagctttccacgtaaaccaagttattcagcctcttttctccactgaattttctcactgagctatccttatttgatcactctttatatctttaattctatcgtatcctgatcaccgaagcgatctcccctttgaattccctggatccaccggggctggaccccagtaaatctcaaagaaggacaatgccaaagaatgtttaaactaccacacaactgcacttatgtctcatgctagtgaaataatgctcaaaatcctccaagctaggctttaacggtacgtgaactgagaacttccagatgtacaaattatatttagaaaaggcagaggaatcagagatcaaattgccaccatttgttggatcatagaaaaagcaagagaattccaggaatacatatacttctgcttcattgactctgccaaagcccctttgactgtgtggatcacaacaaactggcaaattcttcaagagatgggtataccagcccacctgacctgcctcctgagaaatctgtatgcagttcaagaagaaacagttagaaatggacatggaacaacaaatttccaaactgggaaaggagtacattaaggctgtatattggtcaccctgcttatttaacttatacgcagagtacatcatgggaaatgatgggctggatgaagcacaagttggaatcaagattctcaggagaaatatcaataaccttatggcagaaagtgaagaggaactaaggagcctcttgatgaagccagctttttcatctcctctttcacttttaaaatccagcattcaaaaagctaagatcatggcatccagtcccatcacttcatagcaaatagatggggaaaaaatggaaacactgacagactttatttctttggtccccagaatcactgcagagggtgactgcagccatgaaattaaaagacgcttactcctagagaggaaagctatgataaacttagacagcatattaaaaagcagagacatcactttgccaacaaaggtccatctagtcaaagctatggtttttccagtagtcacgtacccatggtgagagttggaccataaagaagtctgagcaccaaagaactgatgcttttgaactgtagtgttggagaagactcttgagagtcccttggactgcaaggagatccaaccagtccatcctaaaagagatcagtcctgaatgttcattggaaggactgatgctgaagctgaaactctgatagtttggccacctgatgtgaagaactgacttatttgaaaagagcctgatgctgggaaagatttaaggtgggaggagaaggggatgacagaggatgagatgagatgtttggatggcatcacaagaatttcagaaaactctgggagatagtgaaggacaggcaagcctggcatgctgcagtccatggggtcacaatgagtgggacatgactgagtgactgaacaaaaaaatcataaaatagtacttgcgtactcacctgtaaagcgcagaaatgggcctcttatttccaggttttggtctgtatggttttggttctcctgccatattgatatctgaaaacataaaatagcactgattaagaaagtattaaaccatttgtgaaaataaatcttgaagttgcattatcttttttttttttttttgtctgtaaaatgttatatgacattcatttattcctaagtgttttctgagcacctactctaggccaggctctgtttgaggtatttcatgtaccaaatgtattagatccatgcccttgtgggacttgtcttctatggggagggagggcatagatagttaaccacaaacataacaaataggaaaacgatgtaacat

SEQ ID NO: 39722 - DNA, 1023 bp, Bovine  19866881548076
caagcccaccaaggctcctcccgtccatggggttttccaggcaagagtactggaggggggtcccattgccttctcccaaaaaagaaggttaaggtggttgaattttaagtttactgcctttataaggcaaaataaaaacaaataattatttattcgaacagaggtgtactccattttgtatatgaagatgtcacaagcaatgtggcacaaatattatatatatataaaagtatatgaaggagacattgcagttctgatggctgtgttttggccctagcctggtctgtcttcctcatttcatccgtgttatcttgcaaggaggtcattctttgaaggatggctgggcagggtgaccacatggtccctgacccagtaaaggggttacgccatctaggccatagaaagctcaaatctgtgaccttggagccttcagcttggtgttttaaccaactcaggtaagacatttgaaatacgtttatcaagcacataatattttactttctatattgagttccttattgctcctctaacaattttatccttttttcaattaccaagtccagaaagtaaaatgacttgtcagtaaaaattcttagaaatctcaattatacttaaaaaataaaaaaacatgtagcatgcagatcttttcagggtctctgcgctactctaacagcttcttttcagctgttccattctaagcatttatgtcagaaatttgccaattctgagaaaaaattttgtgctctaaccattcaggtcaatttaatgtgcagtattcattattgacacggattgtacatccacatatttgaaacattgaaagcccttgacagagcttttagctgcaataactttaagtgctttggaaatgaggtcacttttagttacaattcaagaatttctagttgatatcactactgaatagtgaaaataatagaaaggacattgaaagaaaagaagaaaaacgtaggcagtgaaatgactttatctgatcactctaattatatcccatagttgaaaagt

SEQ ID NO: 39723 - DNA, 1223 bp, Bovine  19866881564955
ctaatagtgtgcctaaaaatgatgcccaggccttcttctcttttcttatactcatcttccttaatttagtctcaaaacacccccaagtagttgaagctgactcttgcttatttgacatcaaaattcttgaaagcttgttcctccgcaggagggtttaacttttttcactctaagatatcttctctaactatttcacacggacagaaaagaaaacccatcttcttccatctattgccctgatttcctcctgctgctgggatcctggttatgaactttctgctcaggatcagttctaacatttttcccctgagaagacacctaaataacttcaaagatatgttttgcctttattcttttcctgtataaggaattactcgtaactctttctgccaagccttcagtgcgttttgtccacaatgcatataaacctattaacaatggctcactgtaccattcctttagaagacactttgggaaaggaacatcatggattacttatctttctttgtgagatgattgccaaaaatgtgagaattttaataatctcacaataatctcagctcctctcaccaagaagttctgatttctaaaaatgtgttcttctaattgtgttggacaaatttgcaaagattttgctttactaacttgactatggtttaaaaaaaaagagttactgaattttcagaattggaagagacggtaggttgagtttcactctctcatttttcgggtgattgccccgaggcccagagaaaggtgggcactgctagattctgcaggcttcaggaggatcaggttaggcctggacttcctgctccctgcccgctctctctgttcatcacactcttcagcatcactcctgatgtcagctcctctcgggggatcctctggcctcttcttgcacagacccatttgtatagtcaggatgatcatacaagacttttaagtatcaaaaaggtagtttttcttatatcttcaagactgaataatcctggtagacaggataattttctttatgctttagcatattttagcatatactagacactcaataaaaatccagtgtacaaaacaactctcatatgcgtattagtgtggtccattcttgcttactaagtaacacaagaagtacaaccttacagaatattttagagtaatgccttcaaaggaaacagaggttaatttaaacatggtccttagatttgatcttacttacttttaca

SEQ ID NO: 39724 - DNA, 733 bp, Bovine  19866881721675
cacacaacatatgccgctttactaaaatgtacatccgatgctaaacgtgtcacaaatagagtgaacagatgcagctctgctttttcagcatgagatcatacctggccaacactggaagttttgtaatccttgtctggggggaaacaacagaactattgatgaacagtgcagttctaaaacattattgaattgcactgtcattaaagtagtagtgagtatgatgtcttcacctgacctgacatccagtatagcactgttacaccattttatatttcagttgtgctttagagagtttcttaactcagtgtgtagattagtttatttcatgaacctgctaaatggcattttgacgtcctggggaaatgattcctccacaagagcttccctttcgtctccagcagccacttccagcctggaggagatgggtcagttgtcacgtttctgctctttcggtaactttgcgggcggtagctcacgagaagcgccttttgtgttgtggttcactgacttaggttgctctgtgaattcaacgtataaataaataatgtaggtcctgttttgtgattgaaatgaggggcaggcttagttgacccttctgattttcgagcccctagtggtatgaaaatggtccacggcgcctttcggcttcatcgtcctgtaccctttgaagtcagctataatgtgtgggcacccgtgacctgttctttgctggcagctcctcggctctaatgga

SEQ ID NO: 39725 - DNA, 1681 bp, Bovine  19866880402824
tgggtgcaggctgggggttgcagggagcagccgggcagccccaaagggtctgcagtccccgctgactcgtcttctggaaacgccgcgtctgcagtcaggaccgcagaggcgcctcagccccgctccccggcctgatgggccgtgactttctggttcgtaacacagaggcgcgcttctcatcaagaggctcatggtctccagatgactccaggcttcacagagcgagcccaaggccttcagttctttaaccccacacgagtattcccgcaacctgtgatgtcgtaaagcacagccgggggtgaggcagggtggacggtgggatggaggctggagagtgaggggacacgtgtgtacctatggctggttcctgctgatgtgtggcagagaccatcacgatactataaagcaattatcttccaattaaaaaaaaagaatagccccgggactggggtggctctgggtgctaacccccaggtggaccccgcgtggctgtctgggggaggggacgcagccccgcggctcccggctctactgtggtgcctgcgtgactggggacgagggaccgggcctccaggagactcaggctccctgtcactctgagtgaccgtaatacccagagttggggctgccgtcccctgagcctgctctgcgcctggcgccagactggacaccacaggggagtcgagtcgcctcgctcaccggctcaaggccgggcgcgggggcgctgtgcccatctttcaggggcagctccacggcaccaggtgggctgctggccctcggcagtgctggggagctgagaagtggcccgggggggcctggacaccaagcacgcaagcctccctctgggacacgagcctgcagaggctgctacacccgacatgtgtacacgcccatcttccccagagcaaaccagaaagcgcctcatgaactgctggggtgcatggctccccctgggttgtgtctcagggaacacaggcccgattggtaaccagttcgaacccgggcagagcccagccccaggctcccagtgggcgccaccccccagcggatgtggacgggcagggaccccgcaggcttcaaaaagttgctcttggaggcatttctgcttttccatttataaagcagagcgaggctataaatcagaaaagtatttataaggactcagagcggcaataacaggttggagtggccagtgcgtctctgtgactattccatcttccacgctaacttaaacacgagagaaaaaggctttccagcccagggcccgccacacggccgcggagatggagtgcgtttgtaataattcatagacttctcactttcatttttctgctgccccggaatcacattccactattaaaatgcactctgaccgctggccgagagggccctcctcgtgttcagacgcgtacagggaggcctgggggataggaggaggcgggagcgggcagggctgggccccgccgccacagccacaagccccccggctggggctggcggaagtcctcctggggccgccctgaggacccagcactggaccccgacaggacctccccatgcaaaaagaggcccacctgcgccagatggcggaaagggtgcccggtggggggagcaagcgtgacaggcttgagtctggaggggaaatgactcggggacaagggaggggacggcccggcatttg

SEQ ID NO: 39726 - DNA, 1275 bp, Bovine  19866880423415
tgcagaccttggtcagcaaagtgatgtctctgctttttaatacactgtgtaggtttgtcacagtttttcttccaagtatccttaagttttggttaaggatcctaataaaattctaccgaactgtgtgaatattggtgtacaaacaaacatgaaactgaattaatgccttgagaacactagatagcccttagagaagaaaaggaagttagaagactggcatctcagaaagaaagaccttacctcctgtgccttatctcagagttcctgggtatatgactataatctcagataaaatgaggaggtttacaaacttgcccaaggccacagggctaaaaaaaacaactcagcctgcaattaacacaaaaattctttgccctccagtcaggtttaagtgtatttatacttatgttttctcagttgcttaaatacctccccaggaagaccattcagggcccattgctgcaggcatgaaccaggaaggggcgtgggctctgatacagctcagtggcaccaatgccagaacacagcgaattctcacctctttgttgtgtcagcctccactgaggtcattttaatgccatagcttgtcttttcttccatgttccccaatgggtcatttacagagcctcctattaaaaatacgcacatttttccagtcaaaccccaccatgtacttttagttgagaaaaatgaaaaggagaatgtaaattttccagactagcatttctctaggacacatttacttatttttttttccctgtttgcctcactatttttccatattacactaagccctaaatgccagcagtattctggtatatgtcactattcacctgatgctttcctctggtggggatattctattcgcatgtacttgtgttatttccctgttggtatctcgatcagattccgcaaatgttaatgttgtctctttcacagtaacattcaaatcgcagaagtaagtattggtggttggaaacttcaaaagtattataatcatagagataatgttgcaggaaggtggaccccttccagggcccaaaactgggctcttgtctaacactcagaaatgaattgtcggaggagacacatgtgttgacaaaacaagagattttattgggaaaggggccccgagtggagagcagtagggtaagggaacacaggagaaccgctctgctgcatggctcgcagtctcgggttttatggtgatgggattagtttccgggtggtctttggccaatcattctaattcagagtctttcctggtggcgcacg

SEQ ID NO: 39727 - DNA, 910 bp, Bovine  19866880429502
tgttttgatcaactaaacctacacatttttcttaccttgggttaaatcacagttctgctttgctttcaacaagcttgcttatttataaatcagaactaatccaggtaaaatgatgacataaataaatgtcagtaggaaggagctaattgggtatgccacaagggtaggactagtactctgaaagtaacagcactttggaatatgaaagatgacgtcgatgcagaatttatactttagtccccttatccgccccccgcccccaatcacatttcttgtgcaagggtgcctattggccaaaggaaagttgagtgaatcaggccttaaattactgcacctagtaattgttgacatatgtgtactttacagtgctaatttatctcaccatggacccagtgtttacgaacacacaaaagcagatttatagtatgtgagattaagaacatttaaattctttatttttagatttttacgttagatacatttaaacatgcaaaatacattagaaaatgaccaaatctgcccacgtgaagtacagtgaactgtaaagttcctgaggaattgagaaagaaaatcatttcatttaaaggacattataccatatgtttgaaatactaagatgatttgaagatcttagatctaaggtcatgttaacagataagatcttgagggatcacaggattaagttatgttttgaataatgaggccatctcacatttactgagccctcatgcttcgcctggcactgtgctaagcctttcacatagattatctcatttagtcatcataacagccatgtgaactgggcactgttaatattccaagagaatagatgaagcactccaagtcaaaaaagctaactgacttccccagtgtcgtaagttaataggggaatccaggaatcagccccaca

SEQ ID NO: 39728 - DNA, 2284 bp, Bovine  19866880562320
gagtagcgctatgccagttacctgtcactaatggaaaactccatgggatgtttggaataaaagggagaatttgttggaattggtatatccataaatctattttaaacctagcttatcttatgtctgtgattcctctctatcttaaaaaaatggggggaatggtgaaataattgccaagccagctataatcagcagtctctaattagatgttagagaggaaagtatggcatcttccttattcttaacctttgaaagttagatgacaacagtgatctttccctttagcaagactactcttgatatcactgaatttgtatattaagacaagagatttagaaatcatttgttaaaagaatacatgtcatacctcactgcactgtttacattgatgacttcttcatgtgctacattcattatggtacagcctaatatttatattatgattattcttttctaagcattttaaatcatcttacttgatccttaaaacaagtctgtgaggtggtgatttgtaagtccaaatccagaagtcattgagttcttgggtttttttttttttttaaagaaaggtgcattttccaggttaagtgattaggttcaagtcacccaaaccagttagtgaaaagctagaagtagactgtggtcttttgaccctgagaaagctggtctatcagacttaaaggattgaaatgggcttatcagtcaatcaacatgtcagccaagtattttcttaagcctctgcagggtccttaacattgtcctaacccctgccacttgagatccagaaaaaacatttaacatgatcgctgcctacaaatatcttacttttcaaattattccctatgtaaagggcctgaatggaacataaagtggggaaagagtagaggaaggaaggaaaaggcaaaagatctcatttttggagaaaaagtaagaaaagagatgattaacagtaggtcctgtccactcctcaggtgtgaaatatacaaaaacttagacttaaaaataatgttgaaaaaaataataatagcagtaacaacaaaagctagggaatagtacagtatgccaggaaatggtacctggaatgtgcaatgagtctaaccacgggcattcctcagaggatacatctgcattctacttcttgggacttgggaatgtgaccttatttggggaaaggctcttcacagatgtatgtctgaaaacacggatcccactctgtttttgcttatactatgaccctgtgatttcagattatttttatttaaatatattaagattggtgtgtctgttgatcatacctaaaataaaaattgcagttggccaatcaaaagccttttctttatgaacatataatgaacaccctcacctttgatgagatgtgtcaatatctcaagatttcttttcagtctatcatgaagggcttgttttatactcctttttctgcatgttagcattttggattatagctgttgatatcctttgactctttcaataagacccattcagaattttttaaattaaagttttatactagaaatcctaggttttattcatccttcttctctcctttaaaaatatatctttattaacgctacatgtttcattgtatttgtcctttcactcataattttaatcaactgccttcaaccacatactacttaaagacatggtgctaaggactaaaaggaatgcaaagataaatcaggtatggactttgtcttttagagattttgatctgataagcatctttaagtacaaatatttgagaaaaatcttccaaacatagcagtaaaacaagttagagagttataagtaccataagtctttccaaatcaattactgggagagttagacaaccccacagagctcccaggcagcaatggccttcagtggagaagtcttgtgggatcagagagggatctatgtaagagaaagagtgtgcccaaaacactggtaatagacatctctgagggatcagatggaggaacatgttccatttttagcagcttcaaacggcccatttcctttcttgagcattgatgtctgctgctgaatggtttgttttctcattcattgactggcagatggataaagcctatgccatttcttgatgcacttgttctcccactcttcccccttgccatccacctcaagatcaccctgccttaacttctgcagtgtcagctgcaactctctctttctccacatccaagggataagctgctttcttcccagcaggtgtcattgcttataaaggaagctgacttgacaggcagaactctgttat

SEQ ID NO: 39729 - DNA, 1175 bp, Bovine  19866880579847
tgagatgaacctgggctcaagattacatagattagcattctaatatttaaaatagtagctgaaataattcacccaggaattctcatccagtatagtaacttaggtataggactaacttgaactgtttaactttcttgcttgtcagaaaatatctaaagccactacagattgtatgttaggtaataaaaattatcatctagccatagcttccacactctacaaaatctacccttagtctttgaaccattcatttgagtcacagcctctcctcgtatccaaatacttcaaaaattcaagtataattttaaacaccagagtgtgattatctccaaattaattatcctgtttgtttattgggagaacataataacttgttttcatagtgcgagaggagaggaaatcttttatctcaaaattgagacgtccataattacagcatatttcactttttttttatttgaggcagaccttttccagtctacccaacctagagaatgtgtatggggctctgtaactctgcaacaacaatgtttttgctacgtttctggattctggctttcagtgtggactatgcaggccaagctgcctctccaagagaagaacaatttggagagaaattcatctcatttattgtaaaacatgaaaatgcaattatgtaatttgcaattaaaatgaggctttcagtctttaaatttaaattgctgaatcacttagcttggtgcttacatattgccttatatattttgtatttcctgtgattatgtctcctcttcccagagatggcagaaaccccacattaaacttttcaaatcttccacagctatttctgtggtaccttatgcagagtaacggctattgcctattgacttaaactgggcacaaagcacttacattttaattgcattttttagattaaattgaatcttccaaccgaacactgaagacataaacacaatgctatttatcattctttattttgcaacagtctattttgaatgatctttataaaacgctaaacttccagcttcctactacatttaaaatattttaagtaaaaaggaagacaaaattatgccatgcctccaagtaaaagttgcagtcagcaatcctcagggttctgtcgccagcttcatctgaacttatcctctcctctgaaaccatttttcctaatcgga

SEQ ID NO: 39730 - DNA, 2044 bp, Bovine  19866880630384
gcagactgatgtgtgtgtgttagtcgtctgtccaactctttgagaccccatggactgtagcctgccaggctcctctgaccatggaattctccaggcaagaatactggagtgggctgccattcccttctccaggggatcttcctgacccaaggattgaacctgtgtctcctgcactgtgggcagattctttaccacatgagccacctgggaagccctgtacatacacataaatagatcaccacaattcactgagatggtgcttggatagtatggaagacctagagtaggagtgacttctctctatgtgtttctgtgtctaaactgcaataggtaggcctgttaagcactatttacaaggaaatataaatggttatcaggcccattgttgtatttctcccagatacaggatttcaatggacatgaatccataattataaaattttggtctttttgctggtcataagagatatgattttttgagaagtagaactgaaacagaaggaaaatgggcaggacaacctttaaaaaagtgacatggcccaaggacacgatgtaaactggttagaaccaaataggtccaagatggcaaatgagttgacttccactagaccttgaaactcagtatacactctgtgacacactcacaggaactatgacagttttcagctgaccataatggtcaaaaagtagatggggcctaattcctagaaatcccactcccttatcaaaataactggaatactcttctgactccagactatgaaacaacccagccctataaaaactgacaaccccataccctggcggtgctctcaccttctgagatgacccacaatctctttgtggagtgtatttctctctaaatgtatccaattcttacctatcgctttgtgtctcactcaattcttcctgctcagaacctgagcctcattaagtcctgagaccaggtgtaatgtcagctaaaagagcataggttcaagtcccaatctgagttagataatttcagaactctttttgtgcccttaaatagctgaaattcagtaacctatgattttgccttttgtgtgactaatatttttttttttacctctttgtctagaacttgttatttcctctgcaaggttggtgagaagccattctggtagaaccttagcaaatatctagtgagtatcactctgtgccagcttcagcacagtcactgggaattcatccatcaacgagtgagacaggttcccatcctccctgcagcttgctgtcttggaggaaaaaaaggaactgcttccctgaattacttgggtcctccttcaaagtttcaaggctctgctagagttgatattgctagagctttcagccattttaagattattctacaacaccctcaataatggtttaaaagggaagcattctgcttgtttttgtctatttaaattaagcgagcacttagcctgaggtactcctcctacctccaacagaatttaaaccaagcaaagaacttggtctagtgtatagatatttgtacctttgtagctgccaaaaaaaagagacccccaattaaatgctcaaaagcctttaattactttcctttgagactttaactttaaccctgtttattactcttaagccactccagagggcaatattttttattggtgacagattgcccaaactgttgccagtgacctaatctctctctccgcagacatgactgcattttactgagaagtgttctctgcaaggacaagaaggtgtgtgtctatattaaggcaacttctctgctctttgtttttccaaatctggatgtggttttgtacagatccattatgtagacattaccattttcacttgaaatctaagcactggatatagtgaaacactcatcgttgtatgcttaattctctgcatcagatcctccttgtgttagtagattggtatttggtatctgaagttaattgtaatgtgatttttggagcctaggaggaaaggtctgtttggggtggtagtggtgatttagtcgctaagttgtgtctgactctttaaaacccca

SEQ ID NO: 39731 - DNA, 1085 bp, Bovine  19866880718764
cccataaattgaacagttaattttctattactttattttcttttagggattaagaatgggcacatactttaaaattatttttaacagttgtttaaaagaaaactaatacaattatgtaaagtttaaaaataaaattagaaaaaaaaaaagaaaatatcctttatatggcaaataaagaaagagaagaaatgtatttttctcttatgactacttattaagtcctttatctcttctttgtaagggataggtgggatacctctcagatcccttactgagattctttagttctgaagacagagaagcagatttcattcattaccagcttatctctactctattaagaagcaaatgagtagatgcttctaggttactttatccataacaaatgcatgaatattgcctgtttctcccagagagtcacaaagataggagatggctttgaaaagaaaagtgctggtctctggggatcagaatccttgtacctgtcagaaagttaaatatgtctcagctgacagcagctgttcacttagactttcaaaacgaaaacccttctgatggattaaaaaaaaaaaaaaaacacctatatacacacacacagatattgcaaaatgtcaagggtgtgtgcaaatcaaggacatatatatggcttgctttagcaaaaatggagaaatggttataaaaaaaattagatttcctcccagcatcagcgtgttatttcagctatattagtctggtgaaactcaatattcccatatcagttttgactgaaagtgttagtcgctcagtcatgtcagactccttgtgaccccaaggactatagcccaccaggctactctgtccatggaattctccaggcatgaatattggagtaggttgccattcagaacccactccaggggatcttcctgacctaaggattgaacctgggtctctggcattgcaggcatttccttactgtctgagcctccagggttttgactgaggccatgccctcaactctggaagatgtgaagggtgtgaacagatagcaactcctggataagtggagtaagaggcagggtcttgggcgatttaatatacaatgg

SEQ ID NO: 39732 - DNA, 1894 bp, Bovine  19866880721721
ttttaaaaaatgttaattttgtcctttcaagatatttggaatagaaaactatgtcgagagaagatgaaatagtccttaataacactccagtatgagcacatatgcttttgaatgttttatgtatgtatgaatctatctacctacttattaatctaaaaaatactagaaatgtgctgtgaccaattggttttaaactgtgtattattcttagcatatcaccttgcatgaaatttgcttagtatatgaagtatttgttaatttagtctccctcagtaaaattggaatacatactagagctgctgaactagtgatatttaattatccacattaggtgtcatgatttcattctaacccttcaaaattctctctgtgaagaattgtattaagaaagacccttgctcttattattcaaaagtagcctctttaatcagggcaagatttttccagtggaagatacacacacactcatacaacatcctgaactcagaaggcaatgctaacaatattcttgaaccaccccatccccacaaatgcatactttaaaaatattagagtgatcacgtgattgattagtctaattattatgacaaagtttttatacatattttgtgcatacttgccccctcaaaagacttttttaaaaaaagttgattatgtctgaaatatatacaactaggaaagattaattaaagatgaataaacagacactgctcacaatgctagcaaacttctttgtcctagatacattttcaacctcccaaggtgttagatttacataaggtgttctgatttcctgtatttttcaaatatacttttaactagtcccctggataaaagaaaaagttggaatacaaatttattcttgtattctttcctttggctcatttgtctgatagctcttttgttcattctttaaatagctgtatgttaagctcttgctggaagctctgctcatgctagtcaatggcctatcaagataagtaagacacaaccctgccatttgaagtagaattgcaacccaagatcccattcctttgacagtaagctttggtggaagtgaaagtcattcagtcatgtccgactctttgtgaccccatggactatactgtccatggaattctccaggccagaatactggagtgagtagcctttcccttctccaggggatcaaacccaggtctcccgcattgcaggcagattcttcaccagctgagccacaagggaagcccttgtggaagacggtcctacagccatattctgtaaaactagttaacacagaatttaatggtcagaaagtcatatttctatagatttggaaagagatggggaaatttactcttcaaaccatgctcttttaggtcagatcctatacgtagaataccactctgctgtgtttattttccttgacttacctactttctctgatgagctactagctgtctttcagggtgatctgactagacctttcaagcaaggaggttttgaccaagataaccccttaaaatattccaacgctgtgatcaaagtcttgattccacttttattttaatccactcaaaagcaccatttctgtatattcagactatctcctttgtttctgtctgccttggataatctaggtcactcttccatttctgtattctgaggataccagattgaggccaaacatgaagaagtgtggcagctcctcctctttctcctcctttttaaacatgttttatctgacagctgattaaagattgggcatctagacaactctccataaagagttggtagaaaacaatgaatgctgctttgttcccaacctagaaaaacccctgtgtattcacaagtgctcctacggaagaattccagaagttcccctcacttacatcaaggcttttcatcacagtaa

SEQ ID NO: 39733 - DNA, 882 bp, Bovine  19866880774674
caaagaaaaaaagtacatttttttttaaaacagcacatcatttattcattctctctgctttagcttcctcatctgtgatattagagaaacagtagtccctgtcctccttactttacacactttctatgagcatgaaatgcagtggtatttctgtgagcaccatgtaaatggcaacaaattatatatatgttcactcttacccctgtcactgtcaagaggcggtactgaactacaggagcacacatgtgggcatcggcgaaggcctagtggctctacctacaacaaatgaagtggaggttctgaagatccccatatgcaaacaaggtcaaatggaattacgtgataaagaaaggatgggactttttcagacaactttaggtgatggtatctaaatcaattaatttgtatttactaagcacttgagtgaatgaaacctatttttaaacacataataaaactgacacaacataataagttttatgggagcagaggttgggccggtctttgcttaccattgtctctggttgtctagctttaagtaaatgaataacactgtgtttgctgttttgagagatatactgaaaagcaggacatagtccctccctgcctatctctcttcctcaaacatttattgagaagttattatatgataggcactctgcagactagggaaacaagcaaacaagaactagaccatcgcactgacaagctaacagcccggagagagatttacatgtagaaagatgagatgaatatgatacaatgtgacaagtgatataacaaagcaggaacaagtgctgtgggagacccaggggtagaacacttctctctgcccagatcagactagttccttctacgtaaaacatcggagaacaacacaag

SEQ ID NO: 39734 - DNA, 3039 bp, Bovine  19866880824818
acagaagcaggagaatcaatgtgctgcagaggacattacaaacatccaaacccaagatctgctgatgaatgacatgcttcagtgtagagtaagttgtaccgtagcaaccaacatcctcaagcactaactggcttaacatacagaaaggatttatatctcactcacattacctgtgtactgtggaatcagaagaggagagagaacactattcactagtcgccaaggggctcagagagtggtggagtcctgaagatatgggaacttgcacactagcactttggctcatatatcactggccaacacgaggttgcatgtccactgctgatgttataatagctagggaaatgcaatcctgccatcttcgagaagaggagagccagatttgttaagctattttaccaacccactacttatggaaatccagagacatttacagtggaccactctgatttatgtggcttttcctttcattttctttctttctctctcttccaggagatatatgtttgggtggtgggcctgcatatagtagtatagcttcctcaaaccttaaaaacatcttctgcatgccctgtcctccaaaacagcaataccaaaattactcattcatttcaaacacacaatcatccaaccacaaaaaaaatgatcaaaatgcagaatagtcacaatcttgtaatcttccaacctactttaagcattagtcacaatcaaaaggttagaatattactcagatgccttcaattttttaaatggatgatggatggctatgaagcaccggatattttatttgggataaaactttcaaaatcataagcaaattatcagcatcatttcagtcctgagcaaatgagaattttgtgacttgtaattccgtactttctaaaaatattaatctcaaattgttttcaatgacactgatcaatttttttatgaatactgattataggagtaaatttataatgaaaacataaaagaacctcattcttttattgattcatgatgaaacacattcacactgattagagggttgatcgtgttcctccagagacctaactcatttcctttacaacagttatgaattaaaattgtcatcaatgtttacaagtatggttcaacccaatcagaatgctgttttagaatgatttggtcaagtagaactaaaactacctacttaagtaataaatttatcatcagtcatttttgctaaagcctccttcacctactttaagagggttttgcctcaattgaggtaatctctgttattttcatctcttacagagaacttagatgtggttagctgcctttctcattagatgtcacataaaaaaaaatgataccaaatagcctattatgcatattgaggtacttttgctcttcaaactccattaagttcttataaacctcaattaagtaaaagaacagctaattagaacagtctgttttcaatagacttagaactttgcaaagaagatgactccaagaccttaggcctaactactccttctcccatgtatccaagccacggtattttagaccagacagtaaattcattcttatttattttaagtaaatcaaactagtcctgctgtgattcacttatatcatggggcctctgggagcttatttattctggaaacatcctctgtagttggagaaaatctagagcagacaagaacatgacttgcattcattaagatttaaattggatcaaacttgtaagtgaaagaggcaagaggaaaacaatcaaaaccacttatgactttagacacttcacttgaatgaaattccgtatagtaatctaatttaaacagtccataaattatcactattttattaataatggaaagtactaatagaaataagtacttagtaaatgcttgctgaagaaagtaaaaaatattcacacataaacaatggtacgattgaggcctagatagcatggtgtgtgtgtgatactcagttgctaagtccaactctttgtgaccccatgaactgtagccagccagactcttctatccatccatgggatttcccagacaagaatactggagtgggttgccctttcctcctccaggggatcttcccaacccagggatcaaacctgcatctcctacactgcaggcagatcctttaccaaagatagccagaaatatgtgtttaaaaaaaaaaacaaaactaattttaaaagcaatcaaaatgtgtggtaaagtgattctctaaacaaagatacatactttagatgaaaagtaattaaattctatgctgtgttgagtgatcaacttacccaggtggtgctagtggtaaagaacccgtggctaaccatatacagacttctttgtatatgggagagagggttaactttctatgattaaagttttaagatttcaagcaaagttcaactaaagagaaaagaaaaaatcagtcattgtttcagactatttatttttttaggcagcttgtgggatcttagttccctgaccaggcttcgaacgcgggccctcagcagtgaaagcgtggagtcttaaccaccagggaatccctgaacaatttatggataatctctattgctttcttcatagtcaaagactttggcatagtcaataaagcagaaatagatgtttttctggaactctcatgcttttttgatgatccagcgaatgttaccaacttgatctctggttcctctgccttttctaaaaccagcttgaacatcaggaagttcacagttcacgtattgctgaagcctggcttggagaattttaagcattaactttactagcatataagatgagtgcaattgtgaagtagtctgagcattctttggcattgcctttctttggcattggaatgaacactgaccttttccagtcctgtggctactgctgagtttcccaaatttgctggaatattaagtgcagcattttcacagcatcatcttcatctttcaggatttgaaatagctccactggaattccatcacctccactagctttgttcatagtgatacttcctaaggcccacttgacttcacattccagg

SEQ ID NO: 39735 - DNA, 1360 bp, Bovine  19866880959853
atttcagagctgtactcttttctttaggatcctggtttcaatttgaattaccaaaaactccaaaggaagtttgtgcagtaaataagcaaacacaggagctctttcccagcttagtgtttgtcgttaccgttgttctatgacttgggttaatcaattaacgaggcagtaactttatagccacccctgtcttctgaatactgtctaagcatctgtgacaactattcaggctctaaaagaggattgctactcaccaggagctcaaaatttaatggatgaacagacgaataagagcactggaaggtttgtggaatactaatgggaggcaaaactggaggagaatttctattgccggtagtgttattaaatctttcttttaaaattaaattcttgtcctaagaagtctgtataatgtttttttcttcttttgtttttatctgatacatatcagagtgagccaaaatcccatcatcactatccttaaaataaggctgttatctatgccacccacattatggattagcaaattttatgaagtcagccttagccagcttacattttttagtttcagtcttcactttcccaagcttctgttttcctcctgaacttcctatgaccattcaggaaatggccaagacttttctatatgccctgccctcaaggcatggttgacattgcaaaactgctgaataattgctcactgtgagtctcagaataaacttgtgacaaggacaacagaacctatagctttgaaataaatgaacctgggtattttgaatgccaaaagtctgaactttacatcatagaggaaaaatagatgaagagatccaaatgttcccagtcagctctgggagaacgcctaattgctaccatgtcaagcaccacctttgccaattctaggaagcctggtgggagtcacgttggcttgtagatggttcagtgaccattcaaggctgcaccaaatattaattatgctagaaaaactttctcatggctaccctgaaaagtagtctccaaaaaagttgatcgagacattgtccaaagaaagtagaattcatttgtacatggtttctgatgttagaacataattagtgcatgtgactttgaaatgggaggactcacctgtcccagagtgtaccattttttaaagctaaaaagaacatcatgcataggcagacagcatattagggaagatagaggaatggggctaaacttgctggataaaattaacaattgtgggatgttcacctatattcttttacttattaagtcaaattaccaaactgtaaggcttccccaatgggctcagtggataaggaatctgcctgaaatgcaggagacacaggagatgcagatttgatcc

SEQ ID NO: 39736 - DNA, 2854 bp, Bovine  19866880962894
catgcaattcaggagacccgggtttgatccctgggttgggaagatcccctggagaagaaaatggcaatccactccagtactcttgcctggaaaattccatggatggaggagcctggtaggctacagtccatggggtcgcaaagagtcggacacgacttaaagcaccttcacttcacttcccaagaaaaccaaaagcaatggtcctggtagatcaatttttgcaaaagaatttatttctttacatttctgctattatatctgatgttccagctagggtccaataacctgatgagtaatggatggagttgagtgtttcccaagatatttaaaacaactgagagaaggaaaggctcatagcagaatgattttagattatggcatcagccttactgggctcccgatgacgtctcggtccctaaataactgtatgatgttgtccaagttataaaatttcccgagtcacaatttcttgaatgtcaagtgggcatgtaagagtatctgctctcaccaggccttgtgaggattaagtatgacaatgtatcaaaatgcttgcctcatgttagttatttaataaagtctacatatttattttctctcttaaggaatattcccaactatgttgaggtacttcaaggaatgtctctaaaacatctcttttaccaaagcctctgtgtcaaaaattcctagttataatattctgccttcagatggagaaaaatcccttagagaagtaacaaggtccaaaggtgggcagatgctaacagtggagcacagcagacgaagtggaagtggtcaagctgtggctcgcaggtgactagctctctgttttaaacacaaagactgtctagttaactttatctggattcaaggtcataaccttgacagagagactgaattctccctggatccttgaaaaagagatttactcctttctggtcagttgtggggaggtggaaggtaggcgtagttcgagttaaataggcttctggagtgaaaacatggctgcccaagttcatgtctggctggaggtggagtgggtgtcattcccccccaaacattactattgctacacacacattaatacacactcacattctcttctttatttctcttatgttatcagaaaaattcttataaaatgacagaaaaattatggatgcttgttattttgcttaaacattacagatgagaggttttctttttcaagcaccatgaaaaataagttttttgaactaagttgccaagaatactgtgaaagtcttaaatatcaacaagacttcaaaagcaagtcccttgatcaaactggtacttatttactaggaaaaaattcaccaggctgggaagcacaacacagataaaccagtcctgaagtcactatcatgaatgaagtaggggctgtgaacgatttcagagctgtgtctttgaaatgttccttcttatggtaaccttagaaaattcacctcttatgatgaagaacacctctattttacatggttaatgatttattttactacataaaaaaatcaatatgaatgttcatgtaactatagatcacctaaatgtaatactatgttatgattcttggtgagaatagataaagtgggaaccccacattctgttgctgtttataattttttctgtttctttttagatattttatctctagttgcttcctcccaatggggcatccttctgttgttactaataatgtcagacttctctgctaaaatttccatcagtgatattgctctgactcttgagaagggaaacttagaaaaagtttcaaagattttatacaaagacattttatacagaatgggcaatcacaaatcttggctcactatttggtcagaggctccaaagtcagctgtttattccctcctttatatcaatttatttgtgaagatcattacaaaactgtcaaaaatagtatttttggattgcaagactgggggttacattggatgaatgggggtaataataagttatctaattttatcttggtatattaacggtatattttccttaagatatatgtgtcatttttggggggtgggtaccatgaaagcatttctagctatcttgtgactacagaaaagaccacatctcaggactcagcattttcagtaatagttgttgtttcagagaatgaatagaataatgatacatatatcaactttttcattgaaataacactgttttgttaagtgagttttaaattaacaaagtctagaaagtgccttaaaattacctagtgatattactccatttattgttgagaaaattgagatacagaatgattaacagatttgtccaaattgagacagcaacttactgcagtgcagacaccagaatccagactctagctgtgagccaattgctatttctagcctttctcacaattacaatttgatactaacattattattttcattattgaagctctacctgtgtttaccccaagaaaggaagaaactaataacatagtctcaaaaatcttaaattatttcaagatacaacctgccattaaaattctgagcaaggttctccaataaattgaaaaaaatccgttgaataacatctcccaagtagcctggggtaatgatgagccatggttttctaagcagaatcagtagctatctatcaaaggatgtatatcaaagttgtgttaaaccaatcaactttttcacgtgcactctaactagtaattattttggaaagaaccagaaattttcaaatattggttctctaccctgactgcatattaaattatctggggtgggggtgggggaaagtgcctgagttccacctaaactcaatgtatccgaatccctgaagaattcagactgcccaa

SEQ ID NO: 39737 - DNA, 1322 bp, Bovine  19866880998253
ttaaatccagtaagtcttggcaaggttgataatagggtcctttgttataaacaactcttccttcagatacatcaaaaatcatccccttcaggtattggaacacaaaaaatattattaatacttcattttcaaagaagaaatatgttatacttaggctaaattcattagtaatcaaagataaattaaaattaaatatcaggttcagaaacacaaaaaattaaacctaagggcaactctcagtatagttactgagtgttttattatatgcacaattctcttttaggtttcgttgtttttcttccacagcaacgcatcagcttctgaaaacgataacacgaaatgtatgcttctgtttacataagttatgttggtgatacggcacctctgttaggatgcaagtatgtttaaaaagcattatcaagatagtctcaattatgttcagaattacccaatgaaccatattgtacttcatgcacaatgcacaactgatgaatatgcaaaacaacaggaaaacgaaactcacctgggccattcaaatactgtgtaagagaacagtgtaatcggacaattataggttctgttcgaatcacttcccatgccacagcaatctcctcctgtgcaaatatttgcaagatgaattagtaatcttttagagttcttgatttttttccaaaataaaaaatatatgtttctaaaacttattttgaagaagtacttatcattaaggcctacaaattatctcaaaaacttacaggtctgtgaaattgaagtcaaagtacttttaatctttgccttcatttgaaaattcaaccgaaaacttaacaaataaggacatactatactactgatacaaactcataattttcagaaaatattaaaagaactgatggaagaaaacatatgcaacatctctgctttttcaaccagtcgtagcatttcttcataaatcactttaacaaagtcattatgtttctaatcgtattataagagaaactaaaattaaatttcttccaagaaaaaaagtgttttttaaatgcagcaatcgtataagtcgatactcacatcaagaaagctaacatcaatatgcagatcaatatctacatcatcaatggctccatattccctgaaagcaaagattaacattattgtttcattttcattaaaagacagtgtgtccgaggttattttaaattaaaatttagtcatgaattctcatccctgatgcccatagatagttcagaaatgactgttagttaataaattaactaactcaatttagttggattgtggtctcatgtgacctctgtataccatatatatac

SEQ ID NO: 39738 - DNA, 822 bp, Bovine  19866881007699
ttttctggttgatttactggaagttcttaaaaataagtttttctctgttttgatagtcttattttaattaaaaacaggcatatccactgtcacttctgctgcatcctaccacatctggaattgtgctttagagcagtctgagttttttaataaatgttttctaggaaaaaaagttgctgggaaagtctttagcctaattcctgcactaagtgatagtatttctcaccagaattttgcagatgagctagacaagacccaagaggttaaaagtcttctcaaaaagctcagagctactaagtggataaatgcagactgtagctaagctcgtgtctctccactagcacttggagatcttcccttatggatgacactgcatactgaggaagatggaatatttgggtttcttgatctgaggagtctgggggtgtgactgtgagtgtgtgtgtatgtgtgtgtgtgtgtgtgtgtgtgtgtggtagcagtggtggtggtagtttgatgcagaaggctacccagcctgccacgagccaggctactggttaggtgtcatttaaagcatctatctgcctcatgatgaccctggaaatgtattagaacagaagaattacccaaattccttaggcaaaaccaaatttcttattttctaggaaaaaagcatccaacaggtttcttggatatcaaatcactttgcaaaataatattttgatgacttaagtgtgaacaaatcagaaacacatgttttcagtttcctggggaataatgattgctttaaaattaacctaaaggtgccaggggagtttagattttattaagtctctaaca

SEQ ID NO: 39739 - DNA, 775 bp, Bovine  19866881339486
gagcacacagtaatgccgaagaaacacttgtagattgcaaagtgatatttaaagaaaaatgcagacctgataagcatttccatgttttgtatatttgcttttcaagaaaagatgttgaataggccatttgataggttagctgaatgcagctgtttagatatgtgttgggtctgctattgaatttttcattaaaaatatgtggttaacagcagccaacctgatttgcatgtgtgtgtttctgatttgttcaccgctatgcctcccgtctcctacatcttaatcacacccaggcgcccgccccattacattaccagaagggaagtgatggacatcctttgactctcttcatgaccccctgataatcctgtttcacacacaggctccctgctgtaggaaacacaaaagctgccactgtagttctttacttccagtcgatattctgacagacttgatctagcaaattagtatgctgtggtaggggcatgacaaaagacccttttgacacactctgaatcaataccaaggccgacagagagccatttcactgtagttctgttatttttccccttttgatgaccctttgctttttttttttttaccagcttatatgaccttgtcagatttaaaaacataatgttgggaaaagtcatccttgcacacacatgtgcatgagtgcatgtgcacacacacacgtacacacacaaagaccgctgagagcatgctggaatgcctaataaaagcataaaacagaaatgcagctggggaggaaattcaa

SEQ ID NO: 39740 - DNA, 769 bp, Bovine  19866881402605
attcaggctcatcatctcccctattcttagagattattccatcatggccaccaagacaaaaagagagggaaagggcatcaaaaatcatcaaaatcatgtgtcctgaaagaaatactcaacgtgacccagaatttttttatctaattgacttgatgtacaagaggacttctaccaaatacttagcaatcaaatgcagatggttataagaaatcagaaattgaatgttgcggctgtggtgatggcggtggtggtggtttgctgtttactttggtttccattcatgataaattccaacctcacctttgtattgcgaggccatttctctaaccttcaataaatccattatttatttaaacctcatgctaagaaaacagtggcttcagaaacaatcagtgttgctctactcataatatgcccaacaagctttttcactctaaggctgacattgatttaatcatcttgtgaaaaattatttatcacctgccaattgatttttgcaataacgggaatcatctggtattttgctatgcttatcaaattgcaaaggaatggaatgacaaatcacttattataatcattttcattatatttatgagatatttgttaaacactgtaatgcttgtgataatgtcaggagtaattactgcaaacatcttactgtactgagctcatgatgatcaattcttattacctaatatgtgaaacagtatttttgtcaaagaaggtaaaatctttgaaatgtttctataaagaattacttttatctcat

SEQ ID NO: 39741 - DNA, 1041 bp, Bovine  19866881407577
atttgagaactgaagcagatttcccatatatgagaagaacaaccaattggtaaatagaatataaatcctagaatctgctagagtattccacagacatgagaaatgtgagttaacttgggtgggagcctgttctgcaccaacacagatgcccactgcctgtcagtggtggttgtttgatcagtactcaatcataggctcccctttctctgtacattttctgtggaggaatcacttaacctctaaatgcctcagtttactcatctgcacaatgggaagaatctagtaactacctcaggtctttgtaaggcttaagtgtgttaatgtgcacataagtattttaaaaagtgactggaatttaggagttattaactatttctattattgctgtgtagatagtctgccttggttttgtccctcatttctattacaaaacatctgttcaaagttcacttggggaaaagaactccacatatccacaaatcaatattatatgtatcatccatggtattatattcaaagtgacgttaatcttatctacaatatcgtaaaacttttacacagagaataattgtatgtattacttacacaggatacaattttacaattgtttctactctctacttgtaattttagttgaatgctgaaatacaagtttatcttgccaggatatttatctttttttttttccagatcaattacagatataatcaatatatcctttctcccacacggctgtatttaacatccattcatttgtcattcatccagtcactcatttctttagtcttcagttactgagttctgaccctctaccaacatcgattctgattatttggatatcagttatagtttgatgttcacaaccagcagatgggtgaaagaaaacaaaaatatggtgtgtatgcacctagaagtatctcagcaggaaatcagtattttagtaaaaattacaagacttgtaagaaacacaaatgatgattatcatatatgcagaaagaataggtaaagtcctgatgatagcaccacctgagcaatttgaaa

SEQ ID NO: 39742 - DNA, 1706 bp, Bovine  19866881498945
tattcttgagtggagagtcccatggacagaggaacctggcaggctagagtccgtggggtcacaaagagtcggacacaactaagtgactcactttcactttctttcactttttttagttaaaagtatctttaatttctaatactatcaatttctttcaaaaaaaaaaaaaaaaaaaaacacaggaacaaaagggttacaagtgctctttcaccacagcagagcaggagtatagaattttaaggaagcagagacattaaaggtttgcaattaactggattctgcagctgtagatctgtaaatagttatactgtttgtttttatgccacacttcaaagaactcacaacaacactgtgtgtatgcaaaccaatttctgttgtgatgccctttttatataatgccattcatttcacgtttcccactgcaagattacaaagtgtgattacagtctgcccagatgcaatgacccagtctcaggattgcttctgtatctgaatatctttcagtagccccaatctcatgaatagcaaatgcagaatcaaggcaaatgcttgaaatatgaatgcaacctgaagtgtgaagcctgatatctgattgaatactgaatgctgtgttgggtttataataatccaaaataattccgtgccctgcctgcatttattcattgtgaaaagatcacatcaaattgaacttgaatacttttttaagagaagggaagcgacacaaattatctgatgcagttgcttcacttaaggactgaggtcttgagaaatgctccataaatttctttccagacatctgagtgaagtcttagaatagacagatcttgaaatccagccattgattttgaatatttacatgtgatctagttcatacgtataaagaacatatgtatgaaatatttgctttctataaacaggcattttttagggcactatgtatgtgttagaacacttagcaattcattctcccattttttaacggagcttattaagataacatcctcattaatgacaccacatatacacttacaatatattaaatacttgaccgtctatgttggtcctccttctctataaaaccacagcttgtttattatactgttatgatgttttataatactatctgatcaaaattagcagggactgttctggttataaaaaatatagctttctcttatccactgtcgagcaaatcacatgtataatacacatacatgaaactcaaccacaagtttttgagaaataaacttctattgctatttagttactgctttcaataattggacagttatattttgagaagaaatatattctgcgaagaaatatacacctccttctgacatctgaaactcaacagcttgcgtgtctgtctccgcatgcctactcagtgtgtgtttcatgctcagtgtgggagagatgcctgtgaatgggccaagattattcaaactcagtagtcaggaagaaatcttggcatttttgcaagactgtattcacggtagctatatatttctctaaaggacaataggactgagacgaatttaaaaattagatccgggtaagaaaggaaacccatctaaactaagagtgtagaagaagtacagtgtaaacagttgctgaaactctgccccccatttaaaactccttggttttgcttgaggaaagcacagatgctgcaagcagaggtgactgttgggggatctgacatt

SEQ ID NO: 39743 - DNA, 1926 bp, Bovine  19866881507185
ttgaatttgtattaaattaagggttattaacttgacagaaatacctcaaagcatcataaaataatttgtatctctctgtctattgtgaattcactctataagcaatcataaccgaaaaccatttttggttctaaggatcaagcttaacattttccactgagatttgctagagtaaaattttgctgttcatgtaagttgcttataaaaggatttagctctaagcccttttgaatgtctttagagattccttagagttctgaaaaagatccttggaggattttcttggctttccatttgtttgtatcaaaataagaatcagagaaatgacccttaattactcagccgtcaggcagtcagggcacatttcaacatgtctgtgatcagttgtagaatcagaaaaaatatctttgacatgccctctctgcctcaactgccataaaaacttgattttcccttctatttatccaagactcaggggcggcattactgagagagagttcaagagcagtaatacctttaaactttttctaggacagttagagattcagattatcattagcacatagcaacgtattggcattagatgcttaaaaggagttagaggaagaaaagactattgccaattgtgttgagtatagaattcttcataaaacaggaaatatttgtgttaaatcattaaagatgtatattttattagtagtaattctattgttttatttataagataagaggaattattgaaagtgcaactgtaagcaagagcactggagtgagtaaatataaataagtataagaagcatgcgggggacagaaactgactaaaacagttgaagtagaagctcatttgtaaaggattagtcaaaaatatttgatcatatagactgaaatcaaataggtacagtaattgaatattttgaattagagtgtgacaagaatattggtcgttctgtaggactttaaaagtatcatgcaaaatggagtaaggcagcagactagggctcttgtaatggtctgtgtatgaggtaatgtaggtctgaattggtctaggtacagtaagagcttgaatgggaagaaagcatcaaataagaaacaggttataaaagaattaataaaattcaggcagatacagatggttttaatttcaaccctcttaatactttagttaagccatgtagactgttcattattatgttaatttattttcagtatagatgagttttctctttcttaactatgttttgtgaatgtaatattctggaaccattcccaaatttcataagctattagcaaaaatcaacaaaaacgattacataatttactttgcctgaaatctttgtcttctttcaggaatgctgtaagctaattacattgacaatgcaaatattgattgtttaattgtgtgaataaaagcttcagttgctatagggcttgcaaagagataaaaattacatcactaaactcaaaagggtgataatgacttcaccctcttttacctctatgatgtacatatactacgttaggccttactgttaagagcatagcaaaaaataaataaacaaacaagcttatataatggtcttatataaagaaaccaaaattctttctcaaagaagtagaaggggtgcatatgttttgagggcaagaaacctatagttttgactttataagttccccaattacactgcagtaattatttataaatttttataaaataataattcacttataaactagataaactaacacctagtaaaaccatattatatttgtctattttaaattttaatcagagatacctctccaaagtcagtgaagagctggttgaaactagactaaaacacaaaacctcaatttcagacttcttaggagtacccagtattctggctacaatgtgaaagtaaataaaaaatttaaaataagtcaacc

SEQ ID NO: 39744 - DNA, 1447 bp, Bovine  19866881663796
cctgtttgaattaatacaaattccaaggtagtggttccagtttctataatgggattttactatatattatttcctttgcagaactcctggaaattgatgagattgtttatataaaggacttggagtaattttgctcaaagttctgaggaataactaagagatctttcatctcatgggacctttggggcatagggccctggctaaggctcatattctattagcctattaagttgtggatggttatctaaggaaaataggctggagaaacaaactcagagagacacacaggactaaaaggaggcaaaatcttaacataattaaggtttgtacttcatttcctttttcacaaacctacttccgtgatgagtcagtgctcatcttacaccctgggaactccatgcttagcacgggccatgacaactttactaacttccttacactaaaaaagcatgaaagttttctttcaattggagttttcctggtgactcaaatggtaaagaatctgcctgcaatgcaggacactcaggtttgatccctgggttattaagatcccctggagaaaggaatggctacccactccagtaatcttgcttggagaattccatggacagaggagcatggcaggctaccgtccatggggttgcaaaaagtcagacatgactaagcgactaacacaaggcttcaatgagaaaaatgtggaaaacttaaaaaaaaattgcttgggaataacttttacttctttattcttcattttgttggtctaattaaagtttatatgctaattcatttagactctaaaaattgcttaattaaaatttaactatttccactcttttctggaaggcagattgctagcctattgctacaaaattagtggtgcatcttgactgataagaattctcaatttcttagcagagttttgtccacaactactttagagacggaaaacttgaacatacgtatttaagagatacttaaatcaaacataagtttcctaattttgtttatatgattggtcatgcatgcgtaagctagaaatataaactagtgaataagttcaaaaatatccaggtaacgctagctgaaatgttcccaaactaagataatgatcttgatcataagtttagcttggcaggcgaagctccttatgtcccatttcttatttaaatatttgatttcttagaggattgcttagaacagggccactataacctgggggagagaaaacactcactcaaaatgtagttactagaacaaagacagacttctttgtaaagaaatcctattttgggtatgtttgagttgtcagtggttgaggtacgctagagtgaaggcattactgtgtttgatcttgtgattcactgtttagccaacagaaactatgtccctatcattgaagcattatagaaaaatagcattagattgagaaaacaagctatagaaaaat

SEQ ID NO: 39745 - DNA, 1011 bp, Bovine  19866881825116
tggagtgggttgccattttcctttctcccaatgcataaagtgaaaagtgaaagggaagtcgctcagtcgtgtccgactcttagcgaccccatggactgcaggcctaccaggctcctccatccatgggattttccaggcaagagtacactatacacacatattatatataatgtatatataatatataattaacatctctttacattatatacatatctttatatatgtgttataaggttcataattttcttaatgatgaaacacttttatctatgggaagtcccgtgttagttggtccacatgtgaatcagaagtttcaaaatgcgtgtgaattctccctgactctgccttcacctgatgggctaagtgaactgtcacaaagctaacagcattatttcagtcagcctggcaattgataccaatcatcacagctgacttttccacctagcaatctgtgccaattgttaccgcgagcgaagtgagccaattgcttgagaccaggttttattaatttatattaaaatttagccttagacagattggggaattaaaagggcaagccgaaaatgccacaaggaatctagaatattttgaagccagtgctttcattttaaaacagaaacctttattcagaatgattggaaatcaaaagcctattcgagtgcacatcatttctggcaattgtataattcataaatagacaaatggcttatgaaatgcgatgaaaaaaacatactcctaaggaggtatcatccatgccaagtttaccgctgagatcataaaccagtgacaataggggttaataatagaaatgttggtagtcctctacttataatagaacaaacagcgctactataattacaattttctttctccccctgttatatagaaatgaatcaatatccaagtagagaaaggataaaaatgtcttcaataatttaaactgctcttcaaaggaattggcttcttaggtctgcaaagtcaattgtatcattcaaaattattacaagg

SEQ ID NO: 39746 - DNA, 901 bp, Bovine  19866881851810
tatattgtttctgatgttgatttttttttaaataatattctcttcttgttttatggctatagtatctggaatctctctgcatatattaattagagcttgaaaatatctttcctaaattatctgttatctttgggattaatcactctatttattttgaacttacgtttttacaacgttgattttcctcaaattttgttcatcttagctctcttttttgttagggacttctgttcagtgacttttagttatctgtcctatatagaatggagacataggctaattcataaaggtaaatggtttacactctcttctctactatatatgtagctctgttttcaccaggctgttctctaaagggaagtggccacctgggagctctgtgtgtgaacaaacaatgtcacttcataagcttatgtttagggagtgctgacacagagaaagtccttttaatgctagaatgagtttcttctctgggttctaacaccctcatcataagtaccagcttttcccagacagatggttgaatttctttagaaaacagttgtccagttcctgcctgggggtatacacagggcagccagttggtttgggtcaaaggaggtggaagaaaggatagggagctgaccagagcagatgctctgaaactagtctttcaatgaatcactgccttctgcccactacccattcacgatttccattacttgctgaggaatactgtggatcttctgtgatcctgttggaaagatgtatttccaggtgatgggacaagacaaattttttgcatattctagacttcagattcctccagcttcttttatttaataagttgttctcatacactggatttttctagagtaaacttgccggcacttctcctaacaaaggctcctaccccatttct

SEQ ID NO: 39747 - DNA, 1471 bp, Bovine  19866881987113
cccctatagaatgcttcctgtttctgaaataccccttcctcttgcttgcagtgctctgtatccacataatcaactgtcaatgtcctacccattttcaaaattcagttcatttattaactcctttctgaagcctttaaagacaccacagatagcattattctttccctttcttatagaacattctaacttatgttgtgcatgttaagtcgcttcagtcatgtccaactatttgtgaccctatggactgtggttctaattaatactaaatgtatctttctcaagtcattccttattttgtattacatagtgtagtcatccaaaatatttgctcactggtcttgttcttttgtaggcatgatgtctgagaaagatgaaaaatgtgagcaaaacatatctgaggaaacaagctgaatactctagttgtcataattctttctctccctctctccctaagttatttccataatgcagcctctccacctcttcctgctgaatctaactttactctttcagttgctatgtctggaatttggacaagatggcagagtagaaggactttaagcttctctcataagcacagcaaaatcacaacttaactgctgaacaaccatggataaaaaaagacaagaacctatcaagaaagatatccacactgaagacataaataagaaactacaacaagatggtaggaggcgtacactcatgatataatcagttgttatgtcctgctttttcttttcttgtcaatcacactaaatttcacctaaatgtgtaggctatatttctctagaatctattgatgtcttctcaccaaggaatattctctggtttcttgcttttctttggtttataaaaacatttgctgaaggaaaatacacccacactaggtttttgtgtgttttgttttgctttgtaattttttaattgaaatataactgaaatataacattatatacattttaggtataaatataataattcagcatttatatgcattgaaaaatgatcaccataataaaatctagtgaacacacatcaccatacacagttaaaaacattttgtgtgtgtgtgtgtgtgaggagaactactgtgatttactctcttagcaacttggcaactcttctgttggtggtgtttttaaagttcctagataccatctccactaagacttcatcatccttggattctacttacaggagaagtcaaggcacggtagaatattctgtagtaatttgatgataggcaccagaagcgagcaccttcgtttttaggaaactttgctcctgaccaaataggattaaggctgtttaaaaatgtaattcttttggatttcccttttctttgatacatgtgccctatggtgcttattttgtctaggtgaaaaacatatgacttgctgtaggaaaaaaattacttagtttatgtctggtgtagttttttttttttttttaagggttagactttctcaat

SEQ ID NO: 39748 - DNA, 1374 bp, Bovine  19866880390222
ctgtccatcaccaactccccggagttcacccagactcacgtccattgagtcagtgatgccatccagccatctcatcctctgtcatccccttctcctcctgcccccaatccctcccagcatcaagagtcttttccagtgagtcacctctttgcatgaggtggccaaagtactggagtttcagctttagcatcattccttccaaagaaatcccagggctgatctccttcagaatggactggttggatctccttgcagtccaagggactctcaagagtcttctccaacaccacagttcaaaagcatcatttcttcggcgctcagccttcttcacagtccaactctcacatccatccatgaccactggaaaaaccatagccttgactagacagacctttgttggcaaagtaatgtctctgcttttgagtatgctgtctaggttggtcataactttccttccaaggagtaagcatcttttaatttcatggctgcagtcaccatcttcagtgatactttaaatgtgtttaaacatattttttctttatccacatgtgtaccctttccagtgctcttcattcttttgtgtccatcctactttccatctagaagcatcttatttctctgtaaagaactacttaaaattttttagtaaaggtggtaagcttcctcagctcttatttctctgaaaaatccctttgttttgtcttcaattttgaaggatttttttgtttttttgctttctgaatgatatgacatccccgcccccaacccccagcactttaaatacatctttctgttgtgttttgacttggatgattccttcttttttcaagtttttacttagaaataatttcaaactgacaaaagtttacaaaaatagtaatgtttccatagacctttcatggtgcttccacatatcacatacccgtaggacaaggatcaaaaccagaaaattgcatcagcacagtattacattgatattactcaatgtatcggtcgtccccctcttcccgttcaaccacacttgtcaccagtagcaatgacagtgatttattacaagaggggaacctggggaggattagggggagccctcccacccctttctgtggggtctgggtgcccgagtcagacgcagcttggctcctgggagtgcacccttaggtcggattcacaaccttgcccaggaagaggctgctccacgtgaagtcgtcgaagatcatgatgatgaagggccggttgaagcggagggtgagctgcccgggcgctgcgctcaggctgacccgggtcggggcatctgcctccaagcccttctcatcgacctgcagcgctgccttatggaccacctggtgggaacagacccggcgtggaggatgagca

SEQ ID NO: 39749 - DNA, 1835 bp, Bovine  19866880455457
ggcgggatgagaaaaaggagaggagcattcaggagtcagactccacagtgatatctaggtggctgcctgctgaagccagaggagtgagtgatccctgcctattgcatgtggagcagaagaaccacccagcttgaaccctgcctgaattcctgtctcacagaattatgaaaaataacaaattgagacttttttttgagtgccacattttatggtgttttattatacagcaatagatcattgaaacagaaatgctgataatcttgcaggttttgttttcctcttaagcttttaactttataaggaataattgcaaataattgacaaatgcaactgtacatatttaaacagtacactctgatgatttgacacacactgacgttgcagactgattaaccaagaccaagatagttatatatatatctatatatatctccagtgaagtcgctcagtcgtgtcagactctttgcgaccccgtggactgtagcctaccaggcttctccgtccatgggattctccaggcaagaatactggagtgggttaccatttccttctccaggggatcttcccgacccagggatcaaacctgggtctctggcattggaggcaggtgctttaacctctgagccaccagggaagccctatgtatatgtgtgtgtgtatatatatatatagccatatatatatatatatatctctcctcacatagttaactttttgtgtgtgtgatgagaatgctgacgaactctcagcaactttgagtattcactaccgtattattagctgtagtcaccatggtatacattagagcctcagaacttattcttataactttgtaccccttgacttacatcacatttctacctccttctaaattcttactgtgttttgtgcttgatgagctggtcctgctggagcttgactccctttcactctttaaaaatgtactttctttttccttttaaaagtgttgctgtatcccagctgtgacttatttatataccagtggaaacatctgagtcagcctgtgtataagtcacttaccttggatgttgcagcagactgcaacttgggccttccgtacatgaatggttttatacacgaatagggaatgatgctttaaagaggtggaggggttcactttatatttgccttttgtatgctatttaacatttaaatagcattttctggatataaaactaatatatactcactgtagaacatttataaaatgcagaaaatataaataaataagtagattggaagggatcacttctaatcttataccattctagtataagtaagtgtcatcagtttggtatatttcccttctcacctttttttctaaagattggacactcacacgtgaatgttcatttattttatacagttgaaattctgaatgcagttttgtgtccctctgtacatttttcttcacattataccataagtatttttcctgtttccttaaaaattctttacagatgtcaattttaacagctgcctcatattggattaccatgctttgcttaactaaccctccaacatataggatgctttcattgttttgccattatgaactctgtaatgaatttcctcacacataaatgaaactccggctctaagatggggagtacaaagtcagacggacacgactgagcgacttcgctttcacctttcactttgcattggagaaggatatggcagcccactccggtgttcttgcctggagaatcccagagatggctgagcctggtgggctgccatctatggggtcgcacagagtcggacacgactgaatcgacttagcagcagcagcagcaagaggtattaggaaa

SEQ ID NO: 39750 - DNA, 1791 bp, Bovine  19866880516219
accaacggagataaaaggacttggggcttaaactggagctcagcatccatactgggcgtcccttactgggtcctgggctggtggacggagacctcgttccctcttcattttgccagtaaatacgagggttcgatttatgcaaaaggtttgtacccactctgtaggggaaagggtcatctgtgacttctcaaacatccctagttataatcaaaattagaagatattctcaagccagtaaaactcttgagtggcttgtattaaaagccttggacagatcagaactggctgattaaataacactacctatgggataggatggcttccctggtggctcagtggtaaagaatctgcctgccaatgcaggagatgcaggtttgatccctgggtggggaagagcccctggagaagaaaatggcaacccactccagtattcttgcctggagaatcccgtgggcagaggaacctagcgggctccatggggctgcaaggggtcagacataacttagcaagtaaacaacagcaacgaagggacaggactctcctggatggagcagctgggaatcagaggctcagcgcactctgtaacgagccccacatggctagggagaagctgagctggactaggaacccctgcagtgtgtcctgggaatgtgaggttttgagtcatatgttattctatttactgcctctgtgaccttcactctcccagagattcctcctctgagaaactggggttgcagccaccttgtaaggaggtagcagtttgactgagtccttcacacacaggcaatgttgagcgcacaccatgtgccagacatcacagtggtcaagatctgtgagcgtgagggcaggggctactctcactctcctgtcccctctctctctttttttttttgtcatccataggatggtaagatcctgtgagggcagggccttgtctgaggcatccctagtatctagcacaggtgggggcacatggaacatgttcagtaatattttctgagcgacagaacctaaagctgaagggtggcgattcagtgtgatctcatgcagacccttccttttgctggcagtcctgccgtgatgactttgtcttccgcagagcccctctgtgtggcctggcagaacaggtggacgctggactgtgctactgctttgtctccagcttcctgtgtgaccttagggaggtcacgttcttgctgagcctccgtttagcctgttgtaaactggaggcttggagaagacctctcagcctgggctctagtgacctgttcatggatgggctctgtgttgcttattattgtttgtactgtgaattttggtagagggggaaggaggggctgtaaagacacctacctttgacaccttcggcagggcctcttgggtgatgcctgagaaatgtgtccggttgctgagcaagtctgcaatgcccatgtcctccatgatgcccccaaggtcgtaggctccagagatggagatctttgggatgtacaggtccacctggctgctcgggtaagcagatggggttagactttcctgggctgggcctggtcagccagactcccctttcccctgggatgccctgcctccctgatggacctgctctttggggacaggggaggggacagggcaggcagcagcatctgcctctccctgcaacacacaagcagcttcttctttgggcctctgaattggcaaagtcctttcttctcagctctttcttggagctgattccactcaatccagctaaatcctttccctgaaggagagaatccctaaagaagtccttgt

SEQ ID NO: 39751 - DNA, 1851 bp, Bovine  19866880608745
tgggtgatgccttagggggcaaaaggtgaaagtctaaacctaaaaatcaaaatgaaaaacctgtggttaacagtgaaacaacagaattcttttgactgttagccttgtgcatttattgacacttagccggcaaatatagtacagatagaagtgggtacaacttgaggaaggcttgttgtgagcctgcgtgttcttccaagtagttacacagctgaaaagagggagtttctttttttggcttggatatgtaatggatggtaatgctgtagtgaatttattgtggtattgacgacttctgtttctgatgttaaagatatacttctcagccatgtgagattgtggtagactgtggaccatttactgacagaagtgggctttatgaaagactgctgatggagttagaagaagcacttaattttatcaatgactgtaacatatctgtacattcaaaagaaagagattctactttaatttctaaacaggtaagcctatgtgaagtaagtacagagtataataaaaggctttgatacatttttaatgttgaaatgaattttcttttaatgaggctgttttatatacattttcgcttaaggccttaccttcttgtatctttggacatttttcattgagtgtatcatattgggttgagtttagtgttagctgaccgacatttctattaagtggagacctccctggtttaaggaggtgtcatgattgtttgaatataagaagtgagtcccagtttttttttcttagtcaaatgagttagttcctgatcaaaccctgagctgaaagaattcttctgttgtttctttgtatgtaattggacatgagcccatcatctccgagtagggcagctttgagaagcgattccttaggacagtggtcctcaaagtgtggatgctgctggacgagcagcatcagcttccctctggaacttgcttggcatgcacgtgagaggccccacccttgacctgctggatctgaagctctggggtgggagccagctgtctgagattggaagcccctcagtgaatcctgttgcctttaaaacttgagaaccattgtcccaggacaatttgtcagttgtcccagccagccgtgaatgttactaccgtgttggatcgaatccttaattctctcttgctgattttctctggagcagcaatgcccagactctgttcagcatctgtcttctcattaagtccacgttcaacccagtgggtctttcatttgcctgcagaactggcagttacagccccactgtgggtttacatttccagtctgagctagggttgtaagttgtggcactctggggcacagatacagttcaaggaaaatcatcttgcttttctttgatacctaaaataaaatgacatactctgctgcatgtgtacacacatttatatattctgctatgtagttcttgcatatttacctggaagtaaatgacttagttgtacttctgaccacagctctgaggttgctttattaaccgtatacagttgcctcttttaatttctgtcatttgattattttcactggggaaaacagaagggtggttctgggcatgtgtatgaaaaagtagagcttggaaagactgctgacccctctccctaaccttttaaggaatgaaccccagtgttgatattagtggggtaagtttattttgaaggggcagattgaagacaactgaaaccctagttggactccacgtgaagattctgcaggagtattgtttcgcattggagtctttacctttttttgtagatactctcagactgccgtgcggtcctggttgtcctgggaccctggtgtgccgataaagtagctggaatgatggtcagagag

SEQ ID NO: 39752 - DNA, 3849 bp, Bovine  19866880614041
tgtgtgtgtgtagttctaagagtaatggtcattaaaaagttcatagtggtgatccctgggtgtaatgagatttcaagaggtttgagatctatttctctgtgctttcctatattgttttaatttttttttatataaagggcatataattttcctcaacagataaagtcatcaggtctttcgcatgggcagggaagagcagactattatagaggaaatatttactgtgtgggaagtagacttgggggaaatgtggacctacggcaagaaggccacaagtgtgaatgagtccgttttaattcccagagcctgcatccctctttctatggcgtccaactcctgagcctgccatcgagaaggaaggaatgtcacacctcctgttttcaaatggcccgttcttggcaaagctggggccaaagtcatgcccgggaattttggacggtgggcttgagagagaaggctgagccgcccctcctgtccctgtctctggatccccaccttgcccctccgccctgctctgcatacgggcaccctggccggccaggcagaaccaagatggtgattttacagcactgttacgactctgttgctgtccagtaaacccacacggggccccacaaacgctcctcgagaaggccagacccttcttgagaaatggtttcctacacctttacaacgtgataggtgccgtggaaaaaaggggccgttggatttatggaaactatataaagtttatagagtcttggcaagccagaaggagaaaaagcctatgggatgggggtgggtacttggaaatggagaaggccctgaaagggcgtcagacctctgtgtccagacaccagacgcaatacctcgaagggcatgcggtggggggagggccgcggcccttctggaacagctgctgggggcgccctgcaggcagaccctatttggtcttcagggcgtccctgtgagggaggcacggttgcccccatcctgcagaggtgacgctgagacagaggtgctcggaaagttctgaccttgcccaaggtcacacagcgaatggtctgagggcgtgtggctctcaggtgggccttctggggcaggctcagttctcgcactccgtctcctgtgtaccgagtggcgtgtcttggtttcaggtacagaaaatatggtctccgtaccctgtttcgtgtcgggaccgtttgctatttgcgactgcgtttcttggtcccctggtgtcttctgtcaccacggtgctgtcctgtgactccactttgctctgaaagatgagttgtgcccgcatccccaccggccttggctggaaccggagtgaagccacccagaggttggctgtggatcggggtggggctaaaatgctgtctttgcctttcgggatcccctccgtgtcccagttctatgggggatcctcttagggcccccagaggagtcccccaaggagtctgaaattacctcctccaaacccgtcagcccgtgaaatttctaattcatttttccttgcttatgtgccttgcggcacccatgttttctctcctccttggctgtaattcttggagtgcagattccatgaatgcttaattcttcatctgtgattttgcccacagggttgggcatggttcccagcaagtagtaatcactgaataagtatcagctgggaggctggctggctggatgaatagatggatgagtggatggctggctggctggcctggtgggtgggtgggtggagggatggacggacagaccaactgatgggtggatgggtgaatggatggacagataggtgggtgggcgggcagaatgatagccgtatatatagactaacagacacccacttcctcatttgcacccttccgcgcagttaaactaacagcctacgcctggttctcttaggctttcactgaatgcacttctgtttcaggagacagactttgctctctctgaagccatatggagaaaccagcctgagtgtttgaatgtgtgtgtaaatactttacagtccccataaacttgtttaaagacaggtgggggtgaaggtataaactggggcagccttttgggagggccatttggaagtagctattaaatttttaaatgtgcctactactaagacacagcagctccacttggagtcatcaagcataaggaatatattcacacgtttgtgcacagagactcacgtaccagggtgcttgtgcccagtgctggctacagccctgctccatacagtgaaaaaccggaaactgcccatgttcatccacagcgagacagacacaaaactatgggagacccacactatgggaaaacctgcagcggcagaaagctctcccgtattctggaaagttctgagactctgtaactcatggcccttcctgcctcattgccatcagcttcttttcctttctccctcctctctccacccacaaaacacagtttgccggaaggacatctttcaacctgatgcctgttagccagtgaccttcccttacagaaaagaaggaacatgggagagaagcagttatgtgtataattactgtctgctggctcttcagttaaaaagattgaaaggcacaatattaaaatttgatttatgggcaccactatctacctaataatgaggctgggaggaaaaaaagaaccacagtcgttagagaaaaccgtagcctttttttttttctccgccaggagataaattgcctctcattttcttattgctaaagaaatgtgaaatggttttaagcatatgtgatatgttcttccaatatgttgaaatccagaacttagtaatttaggagtcatctggctccgacgtttccaggaagcttcctgagagacgtagcagcttcagcagcaggggctgctgccatggtccacggggctcccagacccagactaagccacaggtaccaccgctggtaacagaaacttcctccaggtcctggggcatcaagctggctgatgccacagaacctgagagagaaggggagaagcaccgactctagttccaagtcccaattttgtggcctattcgttctctgatccttggtttcttcatctgtaaaataggagcaatacccttacttattgcatgatgctgggcaagtgcccaggttttcccaccttgaaggtataatagtccctccctgagagggttgtaggaaggattaagtcagtgaatctgtgtaaagtgcatagttgggtacctgccatgtagcaagtgcgcagtagatattttttacaatcgtcatcatcaccactgcagatgcctttccgtagtttttggaagggttggaattcaaacccaagtcttccaattctagggtgctggctgatgaggggtggatagacagatgcttggctctgtctctctccaactgatgcccaaggcaagtcagagtacttctctgagccccatcctgtttatctctaagatatccatttctactttgcaaggtgatggtgtcagatttaaagattattggaaacaaagtgtccaggacataattagttctgggctgacagatggtaaaaacccttgaaaaggaaagatctttccttgaaacctatttggggagggggggaatgctgtcccccccggaggagagatctgtttctagttggtgccctcgcacctcactggggctgcacagaactcccctgccccaggagtggagaggggagggtgcaaaatattccctggctctaaaaataatagctgcaaagaggaaaacaaaggaacagccaatgtgccaggaactgtgtggagcttcacctgaagggtcacaggtcagtctcagagcagcctggggcaagctggccttatcttcagggggcagatcagatatggggaca

SEQ ID NO: 39753 - DNA, 1222 bp, Bovine  19866880690740
aggcagacccagcatgggctctcttggaccccggctggagggatcagctcacgcagaactgattactccttcctgagggttgtgtgtcagtactcatgatggccaggctgtttcgtgtggcttgtgctgcatgcaaggatgcttagcagggagaatcatctcttcctggagtctgtctagctctgggcagaagctgctgctgagggcctcctgacctggctccacctctgtgtacatcatttttactcttgggagggccattaaatagtgagccataattttctctttcaaaagagggggattttagaagatgaactatcagcttactccctcctattcagggaaagaacttgagcacaactcgaagtaacccctttacactcgagccccagaccctgtccttcttctataaaatctgcattttcagacagatgctgagggtgtgaaggctgcaaggcctccctgttacacatgcctcttcctagagctgtctttgtagaggctttctagccatctcttatgaacacttgtcatgttaggagagtaactctacctagttcaatttttggctggaagtatttccctggctcttggaaccctttagaagaaaactacttttccaagtaaatatttaactcttcaagtcccaagagaagaacagagctcacatcacttttagaatcacagggactcaaaatctttagcaaccaagattcctctggttcttttctaggaaagagaagaggcaaaaatctgtcagaaacgaaatctcactgtctcccacgatccgggccccactcctgtattggcggagatgactgatgtatgttatgggaaagaagtgattttacctggaagaagaggattatgttccaaatcagcccaagaaccaaagaggggttgccatctgctatttccgctgcatcaatgctaaccagctttacctggagagaagcaatgtacgagcttaaagacggggtccaagtaggttgcagcactttatttcctgatgcccttgtgggcctgtttctctttctcacctgtgctgtttggtgatgccacaggccacctcttggggaccccaacatgcaaaagtgtacataagtgtgtctcataaacaatacacagtacttcccattatcagacactattcttagagtattagctctgtttattttcacaacaaccccacaacacagattcttttattatctctgtattt

SEQ ID NO: 39754 - DNA, 1677 bp, Bovine  19866880753087
tgtgaccagccagcctcacggtgactgtgtctgttttatttgtgtcctaaagacgttcttgacgtcacccggcaagaccaagtgctgcgtctttccagatggagtagggctaatcctcctttgaaaatcctcaaagtgctaactctgggaccagaaaaatcaaactgcccttctccaagaaacagggaggcccagagcatttggaaagatcccccctctgtgaagaagactcggaactctgtgaagtcggaatcccagctgctcgtttcatctgaagatgttccgaccgaaggccagatggctgggacataaggggatgtgcctgttcaacattgttttgtatttgaggaataaatatttaaatctgaaaccaagtgaatcactttctactcaagtgggcagggatggaaaggggtgtgtgtgtgtgtgtgtgtgtgtgtgtgtgtgaggatgctccctccccctccaccacccatcctaaccataaccgggcgtgaagagctgtcccgttctgctggtgcaggatgtcagaagtggggtggcgctagctacctctgtttcagggttgccgtttttgttccatgtctgctttagctgcaagaagattcctaatgtgcatgttttgaaatggagaccccatccttttgtccttagcgtggtaaatggcaccctactccagtactcttgcctggaaaatcccatggacggaggggtctggtaggctgcagtccatggggtcggtaagagtccgacacaactgagcgacttcactttcacttttcactttcacgcattggagaaggaaatggcaacctactccagtgttcttgcctggagaatcccagggacagcggagcctggtgagctgccgtctatggggtcgcacagagttggacacgactgaagcaacttagcagcagcagcagcagcaaggacaacctgctccctccccacttggttttgtttcggtttcagcctgtatggcaactggactctgatataaatgtgagcagatggaaatgaaacccttttcttgactacaattaaagctctgaaaagatcataggtctttatggtttatttttgtctttatggaagaggttcctatgtagttttgttttgttttttttttctgcctttttgttttgtttgtttgtttgtttttataagagggggaaatttttctgcagtgcttggagggtgtggtcaaaaaatgcatcttatgtttgggggaggattgacagtttcataatcgtgtccttatctgatcccttcttagccttatgaggctgggtggaggtggctgctgtcattttgttatataaggacagctacctcgatggctttttgccatgtccagcgctgttctgactgccttattgcctgtgtcttatttaatcctgttcctgcctttgtgaacttgacattattgtcgctattttgcagaaagcgaagtgacattgtccatcaagtaagattgcatctgagactccatgtccagtgccgtttccacactgccaggctacctcccttaggaaggacccaccaggaggtctgggttccagtttctctccggtcaccagcaggcaatgtcacctgtgaacttcaccctcctcatttccgatgtgggaggctaatcaggtcctgcaacacatgaaaatcacctggggtattgca

SEQ ID NO: 39755 - DNA, 3950 bp, Bovine  19866880825210
tttctgcaaggtgctgagaccagcaccacgcggagacttcagtggcagatctcagagtgcctccgaatttttaaataaggcaacctccccgcttactggcaacacatagcatggtcttgcctccttctgctggatacagagttctctttaataatcagatttagcaaacccctaagcttcgccccttggttttctgtagccttcccactgtgccatccgcttcctggaagaagagcgtggtaagagcaagtgagtctggagcttccgagttctagaccgtacattgccaccttgcaattcaaccctccttctccaggcctcagggttgtttttttttttaagtttttgagccaatggcaacattcattgggtcccttacgacctgaacgtttaacgaggctgggcgattgcccccgcttgccaaggagcctggggtggaattaggagttttttagtacttttcactgggacaaaggagtgtgctgtccctgcccccacccgagggcagggtgtctgtaggagctgggtcttagatgaggaaatgcaagtgcgaaagctctgtcctgcagtgcgtgatggctttactgtgagaagtcacagggactccagggtcactccgctccagttatgcagcgggctttcggggagctcaccccatgggacggggcctcttcctccagctttccgctcaatcccaagacgctccactgagtcggtagggaggcgaaagccgagggaggcagtcaggggcgctgcgcccgcgctgcgcctcctttgcgggctgaaacccacaagtgtccacaacgcgcactaaacaatcagtaggctcctgttgaccggtgcaattggaataacaaatgcgacgcacgcaaattgcccgcctcgtgttgctaagcgattgtttgtcgccctgcaagcaccgctcagcatgggaggaccgggagcgtctggaggcggccggccagagcttaggtcggaaatgcagtaaacacgctcctgattttctctattatcacccaaacacgatttcacacaaagcaatcaccatacagaagtctatgaagatgtgtttgttgaagagtcagtcgccctggtaatagccttcatttttaaaatattaaagactagatcagctgattccacatgggtaaggtgtatttgcggttcaacatctctcaagatgcatttgcactgtggtcatcgttagattgattcacagagtgtggattaaattgcttctctgatttaaaaccgagtgcccaagtttggaatgtgcatctgggtatctcctcctgcccaaagatattttcatcatggggaaaactgttgtcccactacacacacacacgcacgattataaaaagaaaaacgcgtttgtggtccccaacttcttacggttcggttccaggaacttttcttatttctttcagtctcttgcccggtcacagagcagagttcacaattggatgcgtttaagtaggctttttcgtggcatgtgcaaaaagctggcgtgtccttttcaaaagcgtgtagccccctcgcagggcgaattagccgagtctgaagaattaggcacaacgggcagatgcggctgccgccttgggcgcagagtagagacccgcgcagtctgcacagagcttgtcagttttattgtttacatttagacttaaagaaaaaaaatccagagtctcgaaattagtgctcaaaaccagctccattaccctgcggctccctggaggacaccttccggagccccaggggattttccgtatgagattgggtggatggagttgaacacgaaggcaaatgccacccggctaagaagcagcgcttaggagggctgggactctgactttccagtcggatttaggaacgcttactagctgaattttgatagaggttttggaacattccatataaacccccctagcccctgaggatgaaattatcaaggtgttaggaaaactcgtaacattgggggagaagaagagggtatcgaaaagtaacgcgttcccaaggcatcagggaaaaaaaaaattccagttttccagggttggttacagaaattctctttcaggcgagctatttaccaaagtttgtttcaaagtgactgcaccgttgcttttgcaaatcacagaatgcaaatgatgataatttgttctcagtggaactttctcttgaaatgattagcaaagtcagtcatttgaaaattagagcgattgcacagacggttttcgaagccccgcgctaaccgatatcagcttctaaagttttcattcatgtaaacctcattaatgaggatcttttatttaaacgtcaaggggatttgaaatttagagtaaattatgaagcttgtatgtctagccaagtcatgggtcaaatgcatttgtgaaaaactgctaaaagagcatatggttttgaatttttctacaatgactagtgtttaaataaattgcttgtactgcttaacttcatgtgtaattttgacagaaattggcctatagccttttgatatgtaaacatttcagccttttatgcggtataaaaaagacacttgctttttaggatcagttcaggcagtcaccctgtaattcagaaagctggcacctaccattacattcttgctagatttcaactttcaagtggcagcctcggggagaaaaaaaaggaaggaaagaaaaaaaaacgaaaaaggatatttcaaaagcaatgtccatttgggattaaaagctgcaaatgaggtgagaacgtgccacttactatctgagagaaatggataaaccatagttattaaagaacattttctgtcatctttctttaagccagcctggctgaggggacacttaagtagagctgggactgactggcatgttattaaatgcttgtcttagtccaacacacaaataggtgttaaaaatctaggtatcacttcaggatgctaccaggaaaatgacttcatgtcacagaagccattaagatgcaaaaaaaaaaaaaaatcactcagtcttggtagagaatcagccttgggcacaaaatcgctggacatgaatgacagcactgggccagcacaggggtctttctaagtgaggggctgttcgtgggggatgcagagctgctgtagagcactatttagagactgccctgggctgccagggtacctgaaacacctttaagtctgcatacactcatttgttgctagtatatcgtctcctataaataagcattggaatgtggattggagggtgggttacccaagtgctagacggggtctacacattgacttccagatcgctgtggcagggcaaatgctactcttttcccctctgtgctaagggccctgcccgtatttgtcctacaagtcggctttgtcatgtacagactttctgagagacatcgccctttttgtgaatgtgaagttttggaggaattgcagaacaggaggctatggaagtgtttggtttgtatacatttgagccttagagcaaactgagattctctttataaagcttgtgccagggagaaatgcaattaagaaaaaagacctgccgagagaaagagagagagagagagagagaggaggaggaggtgttttatttacattttttaatgcattccaacacatcaaattgtggtcagcaaaccggaaaggaaaggacatatttcatgccataaagaaggcaccaagtgaatttttttttgtttgctttttctcctaagaagactacactcctgcctagcctttctgtccattttgaaatgaatatgggtataatttttttcgtttgctatagttttgaggattttttttaaaataattgatttgctaataaaatagttctgtaccatttagctacttaactttgagaaacttacccccaaagtgtgtttgtgatcaaagttagctagtcaagatttgtattttgggtaaaagaaggacacagtatttaaca

SEQ ID NO: 39756 - DNA, 1804 bp, Bovine  19866880863750
caacccacttatttaagacatgttcatggatcagacctgtcctcatcctatgtacagctggaaatgaatgactatactgaaatgtatgaatgaaatgtcctacttcagttgaaaaggacagagagtgaaaccctggttatattaagaaaaaaaaatcagggtgctaggtaactttaattttatgccatatctgatatgtgatgaggtacatgatatttcccccacccccagagaatgtaaccctttcccaaacaaggacctatgaccaggagctgaccattttgaccttctcagaacttgataaggactctgttacagttttatttaatttcagctctctgatttcaactagttttagaatgagaccaatccactctccccaccagtacattgggagccaagcactgcagaaccaccaagattgctctctactttcagccctgctctcagctgcatcttttttttaaattgaaatataattgctttacaatgttgtgttagtttctcttatacagcaaagtgattcagttatatatgtatatggatctctgtacatacatattctttaaattctttgccattatggtttattacaagatactatagttccctatattaagtgctataaagtagatcctgttgcttatctgttttatctattttatatatagtagtttgtatctgctagtgctaaattcctaatttatccctcccccacttccctctttggaaaccacgagtttgttttctgtggccgtgggtctgtttctgatttgtaaataagtccgtttatgtaacatttgagattacacatataagtggtatcacatggtatttgcctttctctgcctttgcttaatatgataatgtctaggtccattcctgttgctgcaaatagcattatgtcatttgtttatatggctgagtagtattccattgtatagatgtaccacgtcttctttatccattcatctgtctatggacacttaggttgcttctgtgtcttggcttctgtaaatagttcagccgcaccgtgcttaacagaagtccctgtgtgggaaaactagtatatgaacagaagtggtttttcgtgtttgaggcccttccggattcaatgtctcacaccagcccgacaatcagtaaagatttagctgctctttccttatcttaggtgggttcacttctcatccgtacccagactaggcagtggcccacaggtatgaggttgccgataatctccttgcttagaaagggcccatccttctccagagttcagttcattgagatgtctttgcagtcatagcttcgaaaatgaccttctctttaacttatctgacgttttcacatttcagcaggaacaacagtcatttgcccatctatacttccattcattctgaagtgctcttgctggtttgtttttgtgttttgagaggggactctacgtggcacttagacactgataatttcatggtgccctgtgtttcttggtaggaggattttgtggattctgacaaagaagcccctatagaatccaccttcgttcgcatcaaagaaaccccttcggaacaagagagtgccatcttccttctgaccgaggacggggagcgagcctacaccatcaaccatgaggccagccacccgcctccctccaaagtcttcgtctgtgacaagcctgaggacgctaaggagccctggctgggtggcgtttccagccaggagctgatggacagctcctccgagttcatgaaccagatcatcgagcaggttctccaagggatccccgggaagctcaacagcaccagtg

SEQ ID NO: 39757 - DNA, 1272 bp, Bovine  19866880943580
aaaagagaaaagcatgagaaatatagtgaatagcaaacgcagagcccaaaggcagaagtcagcccaaatacatgcagcagatgtaaatggatcaaactcatctattaaagcactgagattttttcctggtgaatttttcacaagtgaattctacgacgtttaagagatcaggctaaaatagaatgccacggaaatacagaaagtaaagatatagagaaagacagataaggcaaataaataccaatagaaagaaaccttgtgtcagaacagataaaacagtctcagagatgttatttaatggtgcctcagttaatacaaaaagcaaaaagcccaatcagctgtatgaaaaatctaaacttataaaatagacgaacgccgatatattagtcccagacttcacattacaagggaaattgtctgctaatgtatctatattggcctctagactctaagctcctgggaggaaacaagctgtgtcttattagtagtcactcaattcccagcacttagtccgggtctgacttagaggattcttaataaatgtttattgaataaaccagtggttctcgagcctggccgcacatcagaatcttctgggagtttttaaaaatactgagacctgggccccacccccagaccaattaaaaggaagcctctaggggtggagcctcaatatggtatattttttaaaagctccccaggtgattctgatgtttggccagagctgaggactgctggaataaataaacgacggaatgaccaaatgaatgagtgtctctttgatttacaaaagaattcgttgcaggatttcttttaaaagcacattcccagggtgcattttcaatgtaattcgattttaagaaatttgatttacacccaatattgccaggacagtctattttgtaaagtaaggaacatctgtgttatctatcaaatttttttttttttttatggatttgggaatattctgtttctccatttagaagtgagctggaggcttgagcaaaaaaaaaaaaaaaaaaaaaacctgtatcatttcctgtactctgaaaactgctttctcccactctggcatttaaagactatttcccagcaatattaagcatgcaattacttaacgagacactgaaagcagttttgagaagtataaaaacatcattgtctgggcttgctgctcctgacgttatgcgagtgacagatgaggaaccagactgagtccagccaaggcgtgcttgggtgctcccgtgtgccgggcgctttgtccagggatgg

SEQ ID NO: 39758 - DNA, 1904 bp, Bovine  19866881011655
ttcctactgtgtgccaggctcagtgctgctgctgctgctgctaagtcgcgtcagtcgtgtctgactctatgcgaccccagagacggcaggcccaccagggctcccccgtccctgggattctccaggcaagaacactggagtgggctgccatttccttctccaatgcatgaaagtaaaaagtgaaagtgaagtctctcagtcgtgtccgactcttagcgaccccatggactacagtctatcaggctcctccgtccacgggattttccaggcaagattactggagtggggtgccattgccttctctgaggctcagtgctagggatgaccaatacctaaccccttccccaaagagttcacagttcagagttttcttttttcacttcaggggtcccctttcaccctggattcttcagctttaagattctataattctatcattctaaaactctgttattttaagatttcatgattccatgactcccctcatgagccctggacatctgcctttattttggatcctcgattggactagttatctaaataagaatcttctcagttcatttatttgtgaatgtgtatcaagcgtcgatgaagaggtcacctctaagaaatttgtagattcagttcaaggtcaattgaagctaactgtattaaagcaagatcttatctctccccatgaaatattagccgctctctttgtaaagaaaaaaaaaaaaaaagaattaggccaaaatagttcacataaagaaaaaaaagacttcattgctgcatatacttccgtatatgctcatttggtggtttcttctcttaattacgaacaggaggcagagatctagggtcacgtagagggcatgctgtgtatggacttggccacaggcaaagtttacagagggtagcccccgagaagtggaaggaagcagagaccactgagtcagtggccctcctcactcaagggcccaccgggaggttgagggcagagaaaatatcccaagctctttccggcctcccagtctaatactcttccttccgcttctatcctgagtctgtccaggcaggtggttgatgaacagacatggcataaggatgtggaggcaccacagcctctctgtctcctctttttggtgttcagtcactccattgtatctgactctttgtgaccccatggactgcagcatgccaggcttccctgtccttcactatctgctgggagtttgctcaaattcatgtccgttgagttcactgagttggtgatgctatctaactatctcatcctctgccaccctcttctccttttgccttcaatctttcctagcatcagggtcttttccaatgagttggctctgtctcctgggcattgtctaacgctgagaggataggtcagtggcctcagcttggggtgacagtgtgacatggtagggagactttgggctagaattctgctgggttcagtacaaactccccacccaagtacaaacctcgggccagtcacttgcattccctgagtcttggtttcttcaactctaaattaagaatgttgaaattaatgacctcagaattaaatcactatgaatctctatttaccttcatggtggttatttttaaacactatgtaatatatctataatcctgaatgttttatagtcaaggctgaagtccattttgaccccttcctgggtccaatcttagtccctgtttcattttttcagaagaaatcacaataggatataataatcatattctctgaacaatatcataaaatatcatattctctgcatgcatgcttgtattttttaaaaattaatttattttaattggaggataactacgttaccatattgtgatggtttctgccatacatcgacatgaatcagccatggtgcacatgtcctcccatttctgaaccc

SEQ ID NO: 39759 - DNA, 1096 bp, Bovine  19866881076687
gcagacaccatccccaccaacttccggaactcagaaaatgctcagaagcagatcaataactatgtcagtcagaaaacccaggggaaaatcaacaacctagtcaagaatatagaccctggcactgtgatgcttcttatcaactatattttctttcgaggtaaggcttagagtatgttggcatgtagacttgagtcagattcaatggttgtccacttacttgctctgtgaccctgaagtcacatgtaattgctctctttgaatcctacttctcgtgtctgaaaaaggagtaccttgatacatagctgatagggtggttattaggattcaaagtgaaaatgaatgataaatgaatgcctcatatgtgcatttttatggttactgattatcctaagacaacattggttgtagaggttgaagtgtcatccttttccccatttcttagatcaggaaagtgaaattcagagcgagattaattaatttactcaaagctacaaagccagctaatgaaagtcaggagtagaatccacttctcttgacctgatggctatggttttcataactccaagtagatgcccaggatggtgaccgtgttgatggtcacactgtgaccatgatcacattggtaggtgccttggtcttctcaccatatgttatagactccacaagtctgagggtgaggtattgaaaaagaagatgaaagtatattccctaattcaagctgcatctaccacacgatacacacccagtcacagcacacacacacaaatgttggccaacataggtgagaatgagaagccaacatccctaggaccaggcaaggctgttggggctgtcaacaacatgatcctgaatatggaagttcagctctcccaaaatccacaaggagattgatggttatggggtaaaacaggagggctaatggtagactgtccaaagcagggaagaaaggaaaattaggaatttcccaaagtccctacgtcctctgtatgacagcaagaaccatagcgacagtgatgtgacggtgcctagcatccactcaacacttacctacccgcagtcactgagctgtgctgcccttccccaccgagtctcacag

SEQ ID NO: 39760 - DNA, 1382 bp, Bovine  19866881182095
ctttcaacacagaggctcggtagccggctccagaggcggccgcacggctccctgaaaggttcttttgttggctggtgaaattctccctggtcgggcacatggccttttcccgatcagtccttttaattaccgggagcaccttcagccccagcgaacagaggaaaagctgagcagccctctcgccacagctggttaaatagcagcccagcagggcttccacacagtcggctatgcttttgtcggcaatgcactgctcggtgtgcaggtcgtaagagatggactgcttccctgtgtccacaccacagttttcttctgatggattccagaaccccaccacaaagtcatcctcttcaacggctttgctcggatccagatagcacatcgcatcccaggagctgtagtcgaaatcctcaaaatcggatgagaatggcagactaccaagggaggactttttgggcattttccactcgtatgcagaatcggtggcagaaaaaggagaaagagagattttcttgacgaaagcccctgaccccatcagcatgttatctatgaacttgatgtgctcctgatcgtattccaggaagtcgtcctcatcgtccgcatcctccttgtgagccctccacatcaggtcctcctcctcctcttcctcctcctcgaagtcatcgtccagtttgccattagccaacatgcagtcttttgtctggaaaagggggaatggggaaggaggggagacatagctgctgtttttaaaagggtttgagactcaataaaagcaagggttatggataatttcaaatgacaaccacaaatactaaaaggcaactttcaaatcacggccatttgttttcaattaacataaaataagttatttaatcatataaacaaagtaaaacatgttctttgaatgttcgttttctaagttataaaatgacctttatctagtatgaagctttaagttaaggattttatacatggatataaagtttaaaattaaggctcacaaggcaaaacttcagctaagaattattactctggcaagatacacaatgaaagctctcatatgccgatcacagagctcttcgattttgctgacagtttaaaaaaaatttttttaagattttcaaattaacaaaattaaattccaggtgtagaaaaagcataacttctgcaattcagtaagagtataacatataaacagataaaattattttctttataacattaacatgtacagtggggcttcacgatgaaggtctgtccctactgccacttcaaatccaagcacatttgctacaatgtaaaaccaaactgccttgcttggaaactaaaagtgatcaccatgaagctatgaaattatgcttttcccttcagggtaacagatt

SEQ ID NO: 39761 - DNA, 1840 bp, Bovine  19866881212498
gcatagtacattagcatagcttaagacaaacatttccataagaaaaaggcattggttatttctagactcgagaatagctaacttcaggcgaagcccgggtgtcattatggcaacacaatattttaagagaaacctccctttaaatttgtatagagaaggaaaaaatattgctagtttgtttcctcctgccgcttaagagagataaaaatgtctgacacttgcaggctatttcctctatttggagacccctggccttcctgcctgttaccctctcactggtatcccacagcttgttgcccacaggtgtagctcttggaccctgaggggcagaagtgtgttttgggaggaggtgaccctgtggccggctcaccaagctggctggtggccgagagtccagccccacccctggccccactctcaactgaaattgaaatcttcacctgaaccttagaggagctggggacagacagcaggtctgcattgcccttgacacagaagctcatccctgcagggggattgtgacagtctggtctcctgggatgaccaggactgttctgaggctcccttggcccatcacccaccctcagcaccaccaacagtgagaacaaccagcacctcaatgtagggtgtgtgggaatccataggtggaggataaagagctgtgagactgggaggtgctgggcttgaggctgaggtcctgcgctgaggctcagggatttgcagtcctactccttgagtctcagtttcctcctttgcccccctgaccactcagggtggccatggagctgaaaccagagatgcagatggaccttctttacaccagggaaggctgagctcatgggagccacactccagcctctcctgggtcattctctcctctgggacacctcctgctgtgatactgtgcctgtcacaggagtgtagcccaggtcattgaacttgcctcctaggagcttctcttatgactttttcaaatgtcatgatggcctgattactttcctggagtggtttttaaaatagcaagtacaagtcaacagaactttccacttttatgcagcatgaacagaaaagttaatatgtagtcaacagaaagagtgtttgcaaaacttttgcaattcaaaaaccttgtccttcttgagctggcttggtggcaggcatggcacagagtgacctgcagactgagagcagagacaggatgcacaggggttaataggtcgatgccagacttcattatctctgaatttaatgtctgggcattttatgtaaatggagccatacaacatgagatcttgtgtgtctgccttctttcacttagcatgatgtcttcaaggttcatccacgttgtgtacatgtcagtggatgtgtatatgtgtcacttcattcctttatacggctggataatggtccattgagtataccatactctgcttattcattcgttagctgatggacagttgcctgtttcattttggggggtattatgaatatgctactctagccattcttgttcaggtatttttgcggacatatgttttcattttgctggggtgtacacctagggatggaattgctgggtcatatggtaactctacctttagctctttgaggaaacaacaagctgatttccacagcagctgcgccattttacatttcatcagcaatttataagggttcaaatatctccatattcttgacaacactggttatttctattattgctagttatttttaccattatggtagatgcaaggtggtatctcattgtggttttgatttacatttccctgaggatgaatgatggttcagtgcttcttggacttttgtgtatcttcctggaaaa

SEQ ID NO: 39762 - DNA, 1170 bp, Bovine  19866881213173
gcccacacagaggcacatggtacgggggcacagctggtgcagggagggtcttccccactgagggatcagggcagaagagggagaggacacagtccttgtactcacagagtcctcatctgtcacttctcctccagcccagtggaagacgccatttaatcctaaccatacttacgaatcagagttccacgtgagcgagaacgagagggtgaaggtacccatgatgacccttggcctggaaaccccttacttccgggacgaggagctgggctgcacgctggtggagctcacgtacaccagcaatgacagcgccctcttcatcctccccgatgagggcaaaatgcaggacctggaagccaagctgaccccggagacgctgacgcggtggcgaaactccctgcagcccaggtgactccccaggacccggagctgtgggttcacttgccctcttggtccttccccctcttcctggactcctgactcccagcagcagggcctcaggaatgtcagggggcgggacagtggtgggagaacctgtactgagatgactttgccctttgctaccttagggactttggggcaaaatttttccttccataggatgatgacattagaggaggggacggcaaggggagctgagggttcctctcacatcaacatgtattgagtcagtaggatcctcaacagaacacccaacgctcacgcagttctttctttggctccacctttcgacggtggagaggaagggatagaatcgggatcaggtgagggctctggtgagacaggctctgaggaccagcttgacactgtctttccatcatagccactcatttattcatttatccacttggcactggttgaattaattaatgaagatcgtgttatgtctaagggcatgatttagatcccgagtcggcaaataaaacactaaattcccaccttcatggtgcttaatttgtgactgggggagaccgataagaaataaataactaaataagtttgtactcagagagatgggaaatggtgaggtgagggaaaataaaggaaaaagagaaggaaaattggatccaggggtagtttgtgattataattaggatagcacttaggtgatgtgtgaggtgagggactgagtcatgtggatgttgtggggaaaagcattgctgaccaaaggaa

SEQ ID NO: 39763 - DNA, 874 bp, Bovine  19866881236302
cttgttaagcccataaaaattagtaccttatgagaaatatcatccctttaaaaacaccctgactaaatatttcataaatgcaatgcacaccaaattcctaccgtagattcactggatttacaaccatcaaactatattaaacttacaatatcaagatttatcacctattaaatggagtctcgttttagtaatatctcgcatttgatcccaaaggatctcaaataccttcgacccttcaccagggcactgtgccgtaattcataacgaggtaatcaaaaccctcattgtaaggctgccgccgtcacattcagggattagctcacctatcaaggaaaagtagccagagctgggagagaaggcagctgctttacagagagcagaagtggtaccaagatgcaggcctcggggaaaaaccctgcagagaaccacagatgtaaagtcagagggtccaagccagcttctggctcattggttttcaaacgttagttttggcagtacggccctttcttcccacgccccattgtaagaaagctcactaaacagaacagattctattgcaatggctccgccttctgcagggcacaggggagaccctgtttctactcctgtggcccctcaccttggctacactttgcaatcatctgggcaacatgttttttaaaacgcagatgcctgggcctcaccacagacattctgatttcagtgatgctaactcagattcactggtgtggctgaacccccccccccagtgtgtgaggaacccgaggaacccaagactctgtgagatttgcttaaggaaacacaggtttaaagctacaaggcagaaaaatacagcctgctcctcagtatgtttgcaaggatgtcattatctaca

SEQ ID NO: 39764 - DNA, 1023 bp, Bovine  19866881253716
actgtatggcatggggaactctagtcagtactctgtaatgacctgtatggaaaaggaatctaaaaaagagtggatagctaattcactttgctgtacggcataaactaacacaacattggaaatcaactatactccaataaaaattaattttaaaataccccccacttctttctctgtctctgtgtctctccgccgtttccttttccctcctcttgcaaaatacaaaaccagaaatgaactgaacacagaagtctgtaaacacgccggcttggctccttccaaggctctgggtttctggacacaatcttgaatcctaattaagccgttagagaaaagcttgttgctggcaacagggttggggagaaatagtttccatcacgcagtatctggaattagaattggctagaaggcccccgctcgctgctttcgatacctaatagacagaatctcaaatgttattaatctaagtgaaccatgcgagacacagggggagagtagtgaatagttatttggttttaagaaagaaaaccaggcaaagaacactctgtagtgtcctggagtccctgcaacaggccgttagatgagaaatatgtctgaggtatgtggcgcgggacttaatgaaactgcaagataaattgagaagctcaggccaaggtgaaaacacagaattcctgacacacttagcttggagcccctgtgccctgggggaccaggaaatgagcacagtgcgttcttgatggcagaaagggagagtgtttgatgcaattaccagtcaggaccgggcctgcccacttacacattcaaggctagttttgtgccagcacagaccaaggaagagcaaccattttgctaaaaaagaaaaaaaattttggtgaccatgcagggcttggttgccccatgaggttgctctttgactccctggtgtgactgactctccatctctcagcacctcctcagtgtttctctaacctccactcccttgaactagtgtagcaggcaaagttgtctcatgacccaccagcc

SEQ ID NO: 39765 - DNA, 774 bp, Bovine  19866881299031
ttttctctctctccttcctttttagaagtagtctcagaaagcatactaatcctcagtgtatcccaaaggaggatggagcaggctttacacctctgggagtttcacatcctagcacaaaattccagcagctctggtgaggaccttccaggtggaggaggccactgcgtaatttgtttggtggtcagccctggtgctctgatgccacccaagctgtgctttcctcctgttctcacgggcctgttttttcccctccccgtccctcctgtccccaggcatgtgggcgcactccttcgacctggaaagcaccagagaagaaaacttccatgtgaacgaggcaaccacagtgcaggtgcccatgatgttccagtcgaacaccatcaagtacctgaacgactcggtgctcccctgccagctggtacagctggactatacaggcaatgagactgtcttcttcgtgctcccagtcaaggggaagatggactcggtcatcaccgcgctgagccgggacaccattcagaggtggtccaagtccctaaccatgaggtaagcccttagccaactgagtttctgcagttcccagaaagtggggtgagtagaaaagggagccatctagctatccttctacccctacacttgccctccagggcttattgtttccctgtgtgctgggttctctgacctaaagtcacacttgtttatccacctgttgattgacactgggatgctctggggcgttccacaaagggaggtccttctcaatcaggaagttgatag

SEQ ID NO: 39766 - DNA, 1994 bp, Bovine  19866881329887
acctgcccgtacgtttgcctgctcacgtagccattaatctgcttcctagttgcatcagagtttgtgaagttggcagaaaaggcaaaaactccatacagctccctgatgttgtccaaaatgtgctgctgaggcttcagctgtgtgtccaggaacagagagttgcctagtttcagttccaatttggggctgggtaggtcaagggtgtggatgaggctctggaaaccccggtggatgtcggcttctggggtctcggtgaggttgaagccaaggccctccaggatctgagtccgggtattagcttgcacccccagagagagcagggccagggtgctggagaggctcactggggagaagaagatgtttcctggggtttctgctgccagctgcttgtacagacgcaaagcgaagctggtaagggtgggtgtgattttctggtaggcggggagggactctgagagctgaccacgcggggcttcaggcaccctcaggctcttatctccatgggcaggaaggggctgacagtggacagaggccaggatcccagctcccagcagccacagccatgctggccccatcctctgaaaacaagatggggaacacgtcatccttcttcataaacagcctcgtgtttacacagtaaacccacatccaggctggatcccacagagatgtcaagtggggcactgcagagggtgaggagggagtgagcaagctggctccagacactttcccccagggcttcagtcacagcaggagccccttctcagctttatgtacatattcatctataacattttgttgatttttctgaacgattaaccccccttccccctccccaaaataaaccccaacaacttccatggtctttaccctttgccttccttctccctgccttccttccttcttccttccttcccttctttcctttttctttctactttctagtcattctttcaatcattcattaactttcaaagactggggtgaccctcaacagtataggacaaaagtcaggacactgtgacaggagggatgctggcctcccctgcacttgggtgtgacctttaactagcatcttgcctactggaagggtaagatgctgcatgaacctcctggccaggctgtcccagaaggaggcatgccctctactcttctggtctccatgagctggagtgtggatgtgacaatcggcctcagagaccttatggatgagggcagctcatgaggcggggcaaagccacaggatgaatggggcccgggggttgggggagaggagagagatttactccatctctgttatctccagtagctcttgtcacttgcaggggctgaaacctctatcttaactgatggagagatttaggaaagacatctgctgaattgagtctcccacccacaaattcaaatgttgaagtcctaatcctcagcatatcagaaagtggtcttgttgggaaatagagtcattgagttgtaattagttaatatgaggttgtgtgcattcaggctaagttggctcaagtcatgtctgactctttgcaaccctacaggctgtggcccgctaggctcctctgtccatgggattctccaggcaagaatactagagtgggttgccatgtcctcctccaggggaatctttctgacccagggatcgaacctgcgtctcttatgtctctgaagctctaatctatatgaatggttgcatgggccctaatctatataactgatgtccttataaaaaggggaactgaacacagggacacacacagggagaaggagatgtaaggatgaaggcagagatcaatcagggtgatgattctacaagccaaggaacacctaagattataggagcaaagagagcagcctggagcagactcccaccttggagcctcaggacccagccttgctgacaccttgatcttggatttcttgtcctcagaactgtgagaatccgtttctgttgtgtaagccacccagtttgtgaaaggttgttaatg

SEQ ID NO: 39767 - DNA, 1906 bp, Bovine  19866881969667
aaggtgagtagaagcccgcaggacaaaccaccccatgttgtcttttttttttttaagaatttatttttaattcttatccaagtaatacatattcatagttttaaaagaaacaaatacaagaaggcttttaatggaaactagcaatctcctgtgtcttgcttcctggaagtaaccctttcaactcttcctatttcttctaatatttacctttgcatttctatataacatgcttatatttctttttatttttagaataccaagatacctgctggcttgctaccatggtcgagaaggatcttgctcttagcctaaccccactttgtttttccagcatggttagattttgttgtttggtgcatctctcttcatcgtgagcctacgaggtctgtttacttctgaaccaaatggtgtactatagttgcttgtcttttctcgtcaaatttttttctccttgatgatgatgatgatgatgatgattttggtgtggtaccttccttaataacttcctgagaaaagaacatgggaagtaaatttttgagattttgcataacttaaaatgtccttattctgcccttacccaggggtagctggatatagaattgtgggtggaaaataagaccctcccaccactcccacctccaacgtggttgttgagattcttaatgtcattctgattcccaggcctttagctgtgacctgggtttctccaccttcccaggaaacatttcagatcccttcattctctgtgttctgaacagtcccagtgacggtgtgcccttgatggtgtgcctcgttctgggctctcgtgggaaatttcttaagttttcttcaaattgttcacattttttctttctggaccacctgttgttccaatgttggacctcccaggctaatcctctaatagtttttctgtttctcatctcttaattttttatctgcttgcaaagacagttaacttctcagtgttcctggtgaatggtttttaatttccaagacattttgtggctgttctcttgtttctgttttatagggtcctgttcttgtttcttggctgcagaacttctctccctggatgttcatgatagtggggttttgaggaacttcttttctgctgttttgcttttatttcctctaagttccctttcttttggttagtttcagtctttcatgttacacgttttcttgagatatctagtgatcctgtggatctgttcttgtgtaagagtgatatttcaaaaaatggattggaaactctgtctgtcaactcgtggatttttctgtagggtcaccaggtgggcacctgaactcttcaggggagaaccacacatatcagtaggtcttatgcaggtcttttctcattgtgtttctttagagatatttccacttctctctgagcatacacagggctgctactagcctatgcagagccctcgtgcagtttcaaaagggcattccctctgagtggatgacttccagataggtgcccctctggggcagaagccacccgtgggcatgtggccaaactggcaggcgcattttttgcctctttctccagtgaaaggctcaaggaacagagcaagggctagagttaactcccagtttccccttagccttgcctctttgtgcagcacacagactgtagggccgtacccagacatgctggcgcacacctgagtgcccgcaccctgacctctgagcaggcgtctcatcaccatcagtatgtagacacagtgaatcggtcccgccgcactgtgcctggtgtccctgggttggacctcctctgcttcccctgaggagtggctgcagctcggtaccgcacctctcctctgcacatacgaggtgttgggattccttggccctgcccgtctgcctccactctgcccctgccataaatgggttggcatct

SEQ ID NO: 39768 - DNA, 766 bp, Bovine  19866880649321
cacattaaattcccattacaaatttccctctaggtgacaaaatcattgcaaatttaaaatgtggccctaagtaatttaaccatctcttgtattgccatagtgatacagacaaagcaagagatagctacttttcatactgtatttggatctgaatcctcttatgctcagagctgagaagaggggccatatgtttggcctggacaggcaggagctttggaaatcaaccattgtagttggcaggggtgtggatccctggactggtcagggcagagtgttcatataattgaaagtaattatgttaacaaaaaggggaagtgtaagggcacctcataattgcaaacagatgtgtgtaaataatggcagccagtctttcaggggccccacggactgatgcctcagcaggaatccatatccccagtgggacagtgaggcttcagcatctctgatggcccaaacatggcaagtcagagtgactgagctattttcagagaaaattgtacaccagacaatcagataaggagggtattatagtcaggaaaacactggttttagaaccagatcgtctgatttaaatagaagatatttacttaatggcacaagtatgtctcagcagctatataaacagtctgccttgcttttcttgcctctaaaatgggtagaataatatccatcttatggagttgttagtagaacttgtaaattataggtaagttgtctaacatataacaggcacacaacagttactagtccaaccaacatcatcata

SEQ ID NO: 39769 - DNA, 816 bp, Bovine  19866880754297
ttttctttccccatggacatattttaaatgtgtattatgttagatgactgctggaaaaaatgacaagtgtctgttttcattagactcccccaagtgcatggatctaactgacagcctttccgagacatggaggaacttccagcttcagggtttccatagaaacgtgtccccactgctaggatggcactctagctccagctcaagtcatcgttcacagaaacccacattccagacactctgttaagttatccaggaatttcaatatccaaaaggttaacaaatccaattttccaagtaggtaaaatgttctgctttgcaggctaagcttccacttcagagctccaagaattctttgttcaaattttgtttattccagtctggctctgtagcatactgattgtatattttaaagctaggaggtttaaattgtcctggttctctctccacctctctccaaaggaataacattgtacccttcctctcttctgggaggtattgcttaccactttaatcatctaagatgagcatagccacatcaataaactccaggttcacaagtttgcaggtaaagtggaatgaagagagaggaggcatggttaccacaagggcacttggcccaggaagtggctggtggcggctgcagcccagtccactctccactcaccatgccagtctgtggggctccagagtgatgcctttttctaagacaggtatacagcctaaccatatgtaacctacttagcacacattatttcacttaatcctcagagcctgatgacagagttcttattaatcctaaattatattgagcaaaat

SEQ ID NO: 39770 - DNA, 4185 bp, Bovine  19866880758468
acgggggagcctggtgggctgcctctctggggtcgcacagagtcggacacgactgaagcgactcagcagcagcaacagcagtgttgttccccaggtaccatagaaaggcctcatggtttcttttgcagaatacaccaaaaaagcctgtctactgtaaaccctaatccatgctctggaaacatggggaaaagagatcagaaaccaaactaaaatcagaaacttgcctttcttgttactcttccctccatttctgaaaacactgtaagtgttttgtgtattgtcaacacaatgctttgacatatacatatagtgaaataatcagcacgataagtttagttggcacattcactgccttacatagttacatcatgtgtgtatgtatgtgtaatgagaacttttaagatctactatctcagctacttcacatatatgatatagtattgctaactacagtcactatgctatatattacatgcgcagggcttatttttgactgcaagtttattcccgttgactctcttccctcacctccaaccccctccctttgtttctgacagctagcatcctccatctgtttctatgaatgtgtttttttagattccacatataagtgattaaagagtagttgtcgtctctgacttattttatttagcataatgccctcaagatacaaccgtgttgtcataaatggctagatttgtttcctttttatgctacatgtgtatatgtggcacatcttcctgatgccctcatccatcgatggacgcttaggtcacttctccatttgcttttgggtctctggactacggagtccctcggaccttttggtttaactcagtcatgcattcatttctacaaaggttcattgtgccaaactttctcctggtggtggtacaacaggaaaaactgcaagtctcctaccctcagaagtcacagtcgtgcagggctgtggattgtaagaacctactgtagcaataggtttattgtggcaaaatgagtcctatgccgaggcaagtgcaaggtgttacgggaggagatagaagggtcacctcacacggcctaaattattaagatactgctgtttggaaacataactttcattcttacacctttagcaattttttaacttcagaaattgggagcatctggaagggtgaaagatgattggaaaagagaccatcaccctccagtcagagttgggtgaaccgctgagctggctcagactacctctgctggtgctgctgctaagtcgcttcagtcgtgtccgactctgtgcaaccccatagatggcaggacagtcctaaatgggacgcagtctagaatcttgacgctaaatattttgcagggggatcaatcttgaaatgaaaaaaaaaaggccccatattttccattctcatccacacattctcatctcctccccaaaaatgccaatctccactttattcctcatggtcttagaatagccaggattatgtcaaccactgtgttcaggaatttcaaagactggatatcatttaatcctcctgacagtgctctgaaggagttatatcttcacttatagataaataaactgagataggtagcagtttgttaacttacctaaggccacactacttaaaaatgactgtacattcttttacaaaagcctaggaaccattgggctagcatgggttagtgtttgtgagcaaggggttttccctaataggtatgggggaaacaccaggacccctggggtattggtggtaataggcaggaaggtgtagtgacatggcagtactaaatttatttctatcaggagcaaatggaaccagacctgccatgcacatgagaggaaagaggggtggagaggacagtgaaagccaagaagatgagggggcttggagacatgtttgtggcaggagtccagactcaaccaatacctgcgtacaaccagacttggacacatctggggtgtctggttggaaggctgtccttctatctgttgaggtccactgaagacccattctaagctcacctgcctggtaaggagtctctgaacagacaaccaagccttcctagaaatttgttagaaaagttagatatgacactaacttgaacttcttatcctggcattggcacaggttgtagtccatagaccgtaagttgccagtgcccaagctttgtgagacagaatccagtgtctccttaccggtgatgcccctggttgatcactgcctgataatcgtactccctttctgcaaaatgttatcccatggtcaagattctttctttctgaacaagaggagaatcagccccttctgctttgccagagacactgcttttggggtcctctgttggttccttgatgtgaccctgaagacagagatttcttgtgcaactagatactttaaactctgacatgtttcccaataatcccattctaaatctttaatctggttgcgtagccaaagaatcacttaacagttgaaagtacttgcctggaaagactcacagtagggctttgggtctatgcctcacctagtgtcataaggatacaaagatcagagtgagacaaggagaaacagagtcatcattcttactcttaaatgggtgaacactcctgctgaactcccaggctattgatcctctacatgggcactggagaagtttcgtgaagtccttttccagggaaattttgagattccttgttatgcaaagaatgtagtcccaagccaagaatactgtccaggctacttagaattcaagcctttctattatcagctaatgttgttttaaaattcaaaaccatttttctagcctctgctcttctccagtctccttctgcttcctctgatgcggtgtcccccaaatacttgcttgttcctgactgtgtccttcaggcttcgagcctctaatcattgttcatgtggttctcactgcttgaaaggtcctatgtatttcttgaaatttcttgaaactttattccatttcttaaaattgccattccttcagagaccaggttttacagtaaaactgtcttttatgcctcccaggagaataaaagacatcaagtcttttattgtcataaatctctgcaacaagcctttattatcccccttcttatggtttgcttttgactctactgagcctttctcactagatcaggagcttctggagggcaggggcaatatgtaattttgtatcctgcaatgcagatcacagtgtcagccctgaacataataattcaatacatgtcttggggtggtaaccacaacctactacctggctcttgtcagacatcttcctagactgaagctgagagggtggtgagaaagataatgggctttagatttcgaaaggctctgcaatcctggtgcaagctcttactggtttcatgctacttatttctcagagccctcaatttcctcctgtgttggagcaggattataaatatgtgatgagagagaatgctagaatctagtgtctgaatactgaatccctgtcctgatgtgtccctccacatgggggaacgatgtatgcatggagtgttgcgggaaacacagttttgttttagaggctctagctccagatgctcacatggttcctactcccctgacctgattggcccttatgttgactaaacagggtggctgttatctcatttcaagatcagcatgtaaaggcattcttcagaggctcattgcatagacatctttctctaaatctccctactggtgacccttcactctcccaagaaaggggcagagggtagccatgggtcccatcatagatactggatgcagaagataagaccccccccacccctaacaagaaaaggagagtgttctgcagccagattctgtttaggatcttctcagttttcccagaaaagttcctaacccctgcccacaccagcctgtttgactaactgtatgacattttgttttctaccagtttcaaagcttccctttgttagtgaggtagtagctgtctatgtgtttgggggataaatcaattgttaaaacaatatcatcataacctaggttaggcagatatagagtggaaaacaacaaaataaaaagaaagaatgtactgaaattggtgtcaggttttgcctcttatcaaccgtagcacattttaggttcaactataaaatagagccaagactatctaccacctaggggaggtagagcatcaagtaagaca

SEQ ID NO: 39771 - DNA, 1429 bp, Bovine  19866881208065
ctttttcacaaccattggtcttttgttgtgactctggtctccctggacttgaaggctgcaagttctcctccctctgtcttagtctgtgccccaaccctctcctgaagattcaaagaccaaaaatggtcactaccttgccctggagatggaacctcagaatttatatggttgacgcctttcaagacaggacttagacagtttaatatttagacaggacttctctgaaagggcttccctggtagcccagatggtaaagaatttgccttaatgcaggagaccccagtttgaatcctgaatcaggaagattctctggagaagggagtggctacccattccagtattcttgcctggagaattccatggacagaggaccctggagggctatagtccattgggtcacaaagaatcagacacaactgaacgactaacactttcactttctctgaaaagggggtgcttgaaccgagttcttttagatatatgtctatggtcaacccactgtgtcctgaaacctccagagaacagtatccctgccactcaggaaaggcatcagtcaagtggaagatgctgggaaatgctccaagtgagctccaatactccagggaggtgtcaaggagctccctggacctagagctctcaacagtgagagcaggaagcaaggggtcttctgggctgtggcatttctgaaggatggtgtgaccctgttctcagaagccccaagatcctgtccataagtgattagaggaagcaggtctcttgtgtctacctccacatggggggatataaatataaatggcaccagtgttaggtggcagggggcaaaaccatcattcaactgctgattatgtggaaatcaagtgctattttctaatatgaaaaattacaggttgataatgtgaccccaatggaaacaaaatatagtggctgatcacatctgtcatttaaatccttgtgtcagcagggaatccccatgctgagggttaaaatatgatggcttgaaaggggagacattaaagcataaatataaggtatttgtgttttactttatggaaattcttgaccatttagctgtttggtaattgctaggcacagctgagtaaatatacagtgagtttcaagtctttcaatgttaagagaaaggaaccatatatataagtaaaacttttccttacaacaactcttgacaccgaggtttgccgttccttctagctgtgacttggaggtcagctagagtgttgtgaaatgtcagaactgccaagcattctctttaatttctaattcagaaatgttggccaaagtgatgagaaatagaacactagatctcactgagcactcttatttttttgttccctcaaccccctgatctttcctctctgagcagactgggcatctctacaaataaatgcatccacccctccttttctcccct

SEQ ID NO: 39772 - DNA, 1965 bp, Bovine  19866881230102
cttgccgttttgtgcctctggacctttgcacacaccgtgctttacgaccaggagtcaaacctcaccttccactcttctgaccaagtcttccctcatccttcagatgtcatgttaaatgtcactttcccagataggctttatctgtcccaatagaccaggccatatctcctgtgattggttctttctctataccagacttcttttgtataggttatcacaaggaaaaacaaagcagtcgtgaggaggccaagggatccaactggcatccaataaatacgcatacaatggttcaacttctaggagtcacggtcaaagtaaaccatagggggcaacttccaattaaagaagctaggatagacctttgggcaaacttatttttgtcttcttgttctgtgaatatgctcatactctaaggtgacagaatttaaaatattgtattttcaaccaaattctgctagattatatgcagctatagctatagatatattcttctgcctttaagataatttcccggcatggatctatttcaaattcctggctcttcttctttacctttgttctgagaatctgtgacctcttaccagttaactcagttcctctcccctggtcttctttctgaatggctctgaacacatatcttagactttgacatctgtcctgtctcagctggcttctgacctgccaccatcctttctctgctggtccttaaatataagtgttcaggccttactttgtattctggggaagagttaaaatctccagcaaagaaaaaaaaaaaaaacaccttatctttaggaggaatgaactttcgaatgtgaacgtgttaatcgctcagtcgtgtccgactctttgcgaccctatggaccatagtccgccagattcctctgtccatgtaatttttcagcaaaaaatactggagtcagatgccatgccctcttccagggcatcttcctgacccagggattgaacccacgtctattatgtctcctgcgttggcaggtgggttttttgggaataagtagctttatttctctacaatgaggcagacactttacttttgaatttaataaccagagctccaaacccacctagagcaagagagtcttgatgatgagttcagaggatggcacaggaagcttcaattccctttggcctaaattgaaaattaatctcaatgatgaaggatgggcctgggtctggagtttcaagtttgatgtctccgtctctgggtaaagacagatggtttgttcttaggatgccagcagattcatatcccaggcctgctcccatttcctgatgtctgtaacttcaaaagatgagaagcctcagccagtgtcatctctgaagcaacatatgctttctgagggaaattatggcagctgacatcagggactttactgctacctctgaggactggtagtgtgtatggaaatgtgcttaccttaccctgtaagaattgctacccaatggctcctttgggctttcacagctcattatcacctcgttagacaggactgcagggtcaaactctggcaccaaaaatccactacaggtaggtccttagtggcatgactatttgtgctctccttttcagaatcccatttacatgctaattaccttttgtgcatctaagcacgtttaagacacttacctgcatatagtagtccctctctccttcctccttgagctccacttctgttgcattactataccgctgagaagaaatcatactcatgggcctttgtagcccagaatgggaggccctcctgtttcaaaactcaagaagccatgttcactcatttagtttccagagttgaggagcgaggacagaactgcctgcattcctcaacataaaagagggttttttccctgcctgactcattttgcagggcaatatggaaatcggctgtctgacattcaatacggagatcaagtacttccgtctatccaaatgggctccaaagt

SEQ ID NO: 39773 - DNA, 1790 bp, Bovine  19866880538329
atgaaatctgttctgaagcatgtctccaaagttgtcaccgtgctcaactaattagtcaaacgtttccatctgcctcgcggctcaccacacttttcatattaattttttatgcaaatatgattctggggaagaatgatgtcaagcagaatggtaggtacctcactgcagccagaacaagatacatgcaatctgcaaaatctccagaaaggtcaagttgaactaagcatttttatttgggctcccctgaggcttaaaaataactttaattaaagtcatgaaaatgtctgagagatatatatataatatatataatggagatattgacataacccccccactataatcttaactgtataagaagctggccaaaaaaccaatcattcaaagcacagttcaattaatttctcattccttcttctttgattcaccctcattttttgcttagccatgtaattttattctttctgtctttatattatttgcttccttcttttttaaaaatctaagttatctttcaataacaaattccattgtatccgtgacctcgaggatgataaggcagtagattaaatcccgggagtagcttgaaatgtcagggatgacttgaaagaaagggtcaattgtctagtattaattcagtaataactggagaaacatgactcttattgcctccttccaggcagaactatctgggatctgatgaagttcaacaccactgcaggggaaaggaaagcaaatcttggatacgggccaattctgactccagtactgaccccatattcaaattctagctacagataggtctttgctgggatgaaaatgagacccagggttctgatcatttcttttcctctgtatcagggagctaatgctgcatacatagcatgccaacacttaatgcctcaaaacaacagtcatttattaaagatctgggggtctaccccatggctctgctggtctgggctgggctccaccacgtgtcaccactatgcggtcacctggtgggtcgcctatgaactcactggtctaggttggcctcgctttctgttcattcagctgcctacagagccgaccttgtttctggggagactcacaaagatggtatggcagaaactgttggctccctgcctcataccctaggatcccttcagttggtgggttccccgagcccacccccttgggtgagttgtactttgttgctgaggagtggccccagggaatcttctcaggggtgcccttgagctcctggagctggcagttgcaagagttacatcctccttttttgttcctgactactctgtgcagcttgcatgatctaagtgctcaaccaaggacagaactcagggctagcaacgaaagtacagagtcctactcaccagactggacaaggaattcccgagtgacagggaattcccgaattacaccctcctaaccgcttctacccaaagcatgaaaactgagctgccttactcaatggagataaactccggggcatcattaatacttcaggacagccctcggagtcaggatgaagcaggcagtttgccggaaattgaatctttgttgggtctcttcccagctccttcctgctctcctgactccctcctgggagcactccctcaagagactgttggctcacgtaccctcacctcaggggctgctccaaagagaccgtctaactccaactgcctacccagatcatagagcagccctgctcatctgtgggctggacatatggcttcttcccataagttcacatgaaggggaagtttcctagctgataagagttt

SEQ ID NO: 39774 - DNA, 1414 bp, Bovine  19866880625428
tggattgattaccttgacacttgaggaatggatgggagctagtgggcaaatgtagatattcttttagctcagagcatagggcttcagacatccaaataggagaaaagttaaataaaaaggcaggaatgcagacaggtgcatgttagtgttaatgggagagcacaggagtacttttctgaatgtttccattttcattatggcatggaaagtatggccatcatcggagagtaacgatgaggagagaggtgtagaagcttagagatgagagggtacagaatggttttctagaaagttgggagcataaatgaacgggataaatataagcaccacattgtggtaagatacacttgacgctaatgaccatgaatgaatgagacccatctgtatgctatatatttttctccagccacattcagctataggtgagaaggtacaggggagggtgctctagaatgttatataaatggaatcatgtagcatgaactctttttttgtctggcttctttccacaaaatactccacaaaatataagattcatcaatattggtgcatgtatcacttttatggcttttctttaattctggcctttcagttcttagcaagagctctagaggtcaagttcattgtcaatgtgtaaattaaacaattatacagatacaaggacagaaggacaagttaaaggtgagaaattccaaagaggttgaaactcaactagggtaaaccttgccatgagaaaagaaggaatccttcaaggtcaaccccagcagaatctccaggggtaaatcagagcacatgcttcacaccaaaaccaccaccgccaccaagaaatctaatttttttcaaagcaaccttcatgaattgcgcatatgctaatatttgagaaccattgctgtgaactctaaagagagtgtagacaaggggcttttattaatggagttgcccacaggctgcttaacaaaagctcaggttttgaaatttggctacagggattacgacctggaaggtctgggtttgatgtaacagtgagtttaagtcagcactttttccacctcttcattgaaagctgtctgccctagggtaaaaacgtttttgcatatgacttaagagagcattttttaacctgaaggattaaagaaaaagatgggccaaacaagaacagtactgacttcttttaaagcataaggtcaaagctgattattaaagccactctcaggggttccagggaggacagccttcaacaaagccacaggagccctctgttagcctctgtggtccgctgtgcttcaacaacaaaggccaacaaatacacccacaacggaaccactaggctctactgagccctatgacaataaaagagcaggagtctcaaatactgtcaaaattctttgtgaaacaccatggctgcccttctctg

SEQ ID NO: 39775 - DNA, 779 bp, Bovine  19866880703674
agtactttataaggctggagcattagatgcataattctcatttacttattagcttggaatgaaatgttttactgctgaagaagtatttatgcacatatattttgaaagtgaatactactgaatcttgaatagctctagaaatgtgaaatcagagaaatatttgctttaccattgtccaaaaatttagatggctactttgtgctcaaaaatacagcatagcattccaatgcagaatataggtgtttaaagagccaaataactgctgacaatggcaagattttgagttgaagttacttcgtaaacattcaaattcagtggaaagtcatattaaataaagtcacttggagtctgatgcttccttgtaaccccattatatgggcacagaaaggtcagtctcctttcaaagtgggatggcatctgagcagtattaactgcccacagaaccagggtctgtgcatcttgcaatcaacaataaactgaaaagttcagcacaactgcccaccttactgcataaaatatcaacacaaagatttacccaatctttgtatatcctcaaatcaatacaaagatttataaacaaatatttttgtatcttgaaatcaacactataggggaaaagttcctcagtgatcatccacttttaatgtctctctctcaaatatcattttgaatgtcaaggaaaggaataacgttgcttttaaaggacacacctagagctcattaaatcactttcagtgacaatccctttagacgtccttctccatactaacaggatacaa

SEQ ID NO: 39776 - DNA, 1499 bp, Bovine  19866880713577
aaaatctgcctgcagtgcggagacccaggtttgatccctgggtccggaagatcccctggagaagggaatggcagcccattccaggattcttgcctggagcatcccatggacagaccatgtagttgcaaagtgtcagacacgactgagcaaccaacacgttcgttttctttcatggggttagtggctctgctgcatgtggaatcatcctggaccagggattaaactgctgtcccctgcactgcaaggtggattcttaaccactggaccaccagggaagcctgactcctcttcttgatggaagatgcaggagagacacatgcaaagaccattgagggacttccctggttgtccagaggttaaggttctgaactcagcactcccaatgaggggtgtcttggatttgatccctagtcagggaactagatcccatatcccataactaagagtttgcatgctgcaactaaggatcccatatgctgcaactaagaccccgaaccaccaaataaataaattaattaaatattaaaaaccaaaccaacaaagagcgtggatgggggaagcacattcaattgtggccatttttataatcaaccacactgaggcccccaggggtccagtgctgggcctgaggtcacaaaagaataataatagatctggtctgggacatgggacccttgaccctcagaccaggactgggccttggttcatttcttggattttctatatatgctttgttttgtgtgcctcatctttctcagaaaggtggagagacacgatgatttctctgacttctccagctctcagtgtaaaggatgagcttggtggttgcccttgagtggggtgcaggggaaggggtagaaacatggccatggatgatctggaggggcccaggcagaattcctgaaagatgccccttttgcaaaggactgttggaaaaccagaaattaaggcacactcgaccaacataaggtatttaccatctagctcaaccttttaaaaaaaagttcttaaaagactgagtttggaaagaatagaatttttccttccaagtttttcaaatttacaatccacccactatcttttcctttcataaatatgatgtacatgaggggagtgatctaaatatcttcctagttccagaagcttgacagtattttcacattgatctcctgttagataaatcaagccttgcggatctgcaaaatgcaagaccaataaaaatcccagtggaaaagggctgctgcttctgcgttttcagttttggggccgtgaatctccgagatgacattcctgctgatggaaacgcctcagagcagctacctcgctactgtcaggccaaatttgtgtgttgagccagattgctggctcacaagcccttactggtgaccataaacagaaactgatagaaagaaaagtcttctaggggaaagcaccttctagaagatgacaatgatgacgaacatggagatgatgatgaagagctgagctggggagtgggg

SEQ ID NO: 39777 - DNA, 1112 bp, Bovine  19866880716706
cctgacatatgaaaaagcccaagctagcctgctagaggatgagagactgcacagggcctaaacaaagaggtctacagaggtgactgtgaacagctagcccccagccaagccaccagttgaccacaaacatgccaactaaggccagaggaactgcccaaataagccaagaatcctgtgctaaataaatatgctttgctacagagtagaacacaggagatgcttgtttgatactgcctgtaaatcaaacccagcaatgtacttagtatcataacagaggaagaaggaaagagttgtaaggagttagcttccttcttcctcaactacttttgatcttaacactacagtctaaagtaatgagtgctgtgtccttaaagacgcacctttctacaaaggagttaaaacattctgataaaggagaaagatcagtgtgtgtgtgtgtgtgtgtttcttaaacaatattaattccctctatgtaccttccctaggctgagttgcaaggctacccaagttggattgagcaacaagtcctcttcgtttctggatctggtgatgggtggtcactgatgctgccaggaaagtaactgtataggcattctgaccctgagaggtaatattctgtgaactgcctgatgtgcccaagttaacagtgttatccaacgagctattttctgctctaggcattagctttagatttgcagctctggtttagcgaagccagcctccttgtgtcctctgagcttcctctatttggtaagtctataaataaaagtcagtttctcccgcccacatttctctgtgttgccatcaaaatctagcagccaattgaacctttctcctagactcttgctttttgctataacagtgcatctccgactttaatgtacctaggaatcacctagggatcttgctaatctgcagattctgactcagtaggactgggatcgggaccaagaatttgcatttctaacaagtccccaggtgatgatgctgctcacagcaaaacgttttgaatattaagtggctacaggacaaatgaactcaatgctagtaaccaatggctggttgatggataaccagagttagagagtgcctgatctcagaatcttcctatt

SEQ ID NO: 39778 - DNA, 885 bp, Bovine  19866880818100
aatcgatgggtgggaagagagagaaaataagctgaatgcctttcaaaagacataatttaaaagaaaaaaaaaacagcttgagtaactgtctactgaaacatgtaattttttttccataagagacagtaaattataactgaaaattttaagtgacccgttcagactcttgaatattccataaatataggattaaagtcacagatgtgagcttctgttgagtaagatattttactctttaatttataggaaactttgtccaactaagaacagtctcccgcgtatctctgcattcttttgattttcatagatgcactagcagctgaatttcttgggggtaagggcagttttaaggtagcaaaaaaaagctattgttcagttgaattgcagtatcatttaggtatctttttgttccacgtagaaaaccccaatcatacaggctggtgtgatatcagaatttacttaatttggcttaagtatctgtaaagtccaggaggagagttggcttgattcagatgtccacaccatcatgagggctgtggaactttgcttctgcaattctggtggttctgtccttgttttgagactggcttcaagcagttcttccatctacttccttgttgagaaagagaagtgagacagacagagtaatagtcaatcttgacatttcactctggctccagtagactgattataaaaaggatcccagttctccacttctccctgaaaccatgccccttgcaatgtgagcctatagttcctcccatcatgaagtggagtctatatctctatttcttgaatttgggccggcttcctgatttgctttagacaacagaataggaataagtgacaaggttagttctgagcgtgagcctcatagaaacattg

SEQ ID NO: 39779 - DNA, 1157 bp, Bovine  19866880826536
cagttgtaactactggcatcctgaccaatggagttaaaaatcagagtaggcaagaaagaggcagaggctgaactgctacaagggaggaagacacatgtctctttaggaggctgtgggcatctgaggccagtgctgaaacttggtttgaaagctgcccaagctccgaggcctttaggtagtgagattaacaagcttagctgtataaatcaaacctacattattagaaaagtttgacatttgctaaattacctatgaaaacttaccctggttgttaagaagaacccaaaaaaagtatattcatttccaagctaaatgtcaagctcccttaaagatctaacacctacagatgagggaaggggcaggggaggaaatgccatcaaattaagggcaataaactttccagacatcttcatctccataactgctcagagatgtctcctggcatttcttactgggtaattctgtctttgtattatgtctgtctatgggcaactcattttttaaaggtatgctcacagagcagcatttaaaagctaaattcaaaccctggaagacagacgttacaaaagtgactcagagttattttatttacagacatcacccagaggtatactagcagggaaagccaccaaagcaatgattccaaaatactaaaccagcagttctagatctgtgagacttgggcaaatagcccaaacaactttttacaaaactagaatgaagaagcccccaccccatatgcttcaatgaatcaattattcattaccaaactgtaacatttatcaggaggaatatgggacaagcaaacatacttgaaatacatcactgaattacttcaggcaatatttccaagtcttacgataatctgtaagaaaatttgcctgctaaagtacgtcatataaaagtacatcagttttacataagaatgattattcatggacatttataaataacagctatactgtttatctacagccagaaaatgcatacatgtgtaatgatatacatgtacatacatatacagtgagtctgttttatgcaaatatatgaaaaggtgcctcaaaatacaaccaattttggcaccagccttagacttacatgagaacctccatttattccctaatgtatcagctaaggtagtgagaactgtgggttgg

SEQ ID NO: 39780 - DNA, 1867 bp, Bovine  19866880832869
catcatcaactcccggagttcactcaaactcatgtccattgagtcagtgatgccatccaaccatctcatcctctgtcattcccttctcctcctgccttcaatctttcccagcatcagggtcttttcatatgagtcagctcttcacatcaggtggccaaagtattggagtttcactttcagcagcagtccttccaaaggatattcaggactaaattcctttaggatagactagttggatctccttgcgtccaagggactctcaagagtcttctccaacaccacagttcaaaagcatcaattctttcatgctcagctttctttacagtccaactctcacatccatagatgactaatggaaaaaccatagctttgacagatagacctttgttggcaaaataatgtctctgctttttaatatgctatctaggttggtcataacttttcttccaaggagtaagggtggctatgggagtataattctcacatccagaacatgcagtgaattccccgattatcacccactccaagcacaaacaacattccctggctatttacatacaatgacacacattggcttgtatactttttaatataagtaccaattttattttatttttaaaagatttttttgatgtagacattttttaaatcgttattgcatttattactacattgccagtgttttatgttttggttttttggccacaaggcatgtgggatctcagttccctgatcaggaatcgaatgtacacctgccccctgcatcggaagaagtgttaaccactggactatcagggaagtccctgtaagtaccaattttaggattcttatactctttggttaattcagcagcatagatttacagtacacaatatattttcaaatttcctcctatttaccatataaatagcattcatgggatctgtgactgaattgctgtttcctaactcttattgacattttggagaaggataatattggcatattctattgccaacttgcatcactttttcttccattatgacatgtaaacataaaaaataatgctgttagttcaacaaaagaccccattgtcttatgctttgcatctgcttcctccccatttcctgtctgttgcatttaatctgcctgcaaacttcacgcctggaagaagccaatacatcttgtcaaattatttgccggggtcaattctgtattcaaactgccttttcatccgccttaaattttacaaaaagagtggcttctttctgtttcaatttccctaaagcattaccactcagtttttgcatttgacaatcctggattaataactacacaaggtgcctgtgttctccaagcctaccgctctcaaatgtaaaattacatttttttttcaaaacggatgtgtatagttgatccagtgacacataacaaattacatagataaatgaaaaattaaggtacattatttcaaagaatatatgcctttctctgataatagtaacagttttatgtattcaacatattttagctgaaccgaaggtgaaatgtgcattgcatggaaatcatcctctgtccccagtcagcaatatttctttggcatacttcatgaattgtaactcactggcttatgagtaaggccatgaggactattatggcctgagcccatccacctgctgggatgttttggggaagagactcttctcacttcaaaaggtgccctggctacttctgggagtttttcatggcactgtgagatgggcactcaaagcctttatgttcctgctcctcacctttctcatgtaccatcttgggggttttctcttttcccagacatcctcttagaataacctactctaatatcagcccccactgctggttgaggcta

SEQ ID NO: 39781 - DNA, 682 bp, Bovine  19866880839576
ggttttctatgttagggagggggtgttacaatgctgtgaactaatgaattgcctctgtttatagaaatgcggtgatgttcaataatgatctgatggcagatgtacattttgtggttgggccaccaggtgggactcagcggttgccaggacacaaagtaagcaacagctgcattactggtttcgccctgagctctccacagagggaccctctccctgatcccggaacagggctgggcagctcgcaggcagtgcttggtttccccccatcacagagtaggcacaacctttccagagggccctggccacgcttgctttttttttttttgcctttgtttccttctaccctgctttatatcccccacaaaagcatgccctcttcactccccagtcatgggaagttgttgtgataggtttggaaagtcatatgctgacccttctcctagaaatcagttagatatgcttttatttattttataatgagggaccttgtgtattaatctgtgaaagccttgataattagcagcacagagactagtttgcatgaacttctgtcttttgctttcacagccagatcctctggaccttggctttgtcagtagagcaggtgttaggtactctgtgttcactaaagctgatcactttagagtgtttttctggaataatttgctgaaaatgttttcaa

SEQ ID NO: 39782 - DNA, 1604 bp, Bovine  19866880877660
tttaattttattttatttttaacctttaccaatattgtattggttctgccatatatcaaaatgaaaaagaattacaaaagcactggaagaagctttcaaatttgcatatactataaatctctgaataaattagaaattagcaaacactctcaaattccttgtatgcttaaaatactattttatctccattttactcatacatatcaaatagattatgcatactttgtgtgagatatatgacctaagagtgtcctaatttatcaatagaactactcattctactaacatgataactttgtgctcatactatttttaaggtatgaatattattggtcttgaaaataaaaatatacatcaacttccctttctcagcctgttccccccgtgcaaaccacatttccctacagctagataacctacagggaactggaaaagttaaaaataaaataaggaggcaacactggcccagggttgatgagtcagtgattcaattgtcagtctccacctgtatcggaaaccactctggtaaattataaggcataaagtattcccatgttacgcctctttttaatcaaaatttatttcctcagcctaaaacgcatcagttccaaggtgtgatggttattgtccattttgcctatgcagttctgtctcccattctctgccctgattggtaaccctaggaggtctttccctctggacaactgctcccacccacttggcagctggctttcccttgagctgggccactaggaagtactggcaggagatgagaggacggcagatgataaaggtcagaggaattctccccccccttcctgcttttatacctggtctcctccatctacagcttctctccagctctccatggactccaggacacctagtcccccataggtggtaatgacctcccactgctggtgctctcgtttgcatctttatccctccattgttccctgagtcctacttacatttctgcaattaatcttcccaccaatgaccctttggttgaactattttgatgagttgttactgggagggaccttcacagatacaatagatttcagaaagggtgtagcttaaatcttataggcagtgcttttcttagatggtatttctactgtgagtccttctaccccacagttagacagtctattgatgtcccttgattggtgagattttctgatgactcagttcagttcagtcgctcagtcgtgtccaactccatgcgaccccatggactgcagcactccaggcttccctgtccatcaccaacttccagaccttgctcaaactcatgtccattgagtcagtgatgccaagtctttctgatgactaagaagatatatttattttaaaattactgtggctaaaggtcacttttacactgcccttaaaatatgatagatttagtccagtagttttcactttcagctgagtagttgtttaataccaatgatggtaagcaaagttctaagatggtcctaagattttcaatcctagtttacatattctgcataatctctaggactgtgagtttgatggctttcatttttatgattactttttataaccacagttgactttaaggaaggggagataat

SEQ ID NO: 39783 - DNA, 1267 bp, Bovine  19866880904025
acgaatgacctacaaccaaacccaaaatctgaatggagttcagaaacttaacactgagaaaagaaaaccagaaaagatatacagtgtatgattacatttatagaaaatctaaaaataggcaaaaaaaaccaatactgtcagaaacaagtaaggtgttaccctggggaattgtgcagtggtgttcaaaatgggtatgtggtgggcttttgggatgatggtcatgctctgcgtcttggtctgagtgctagttacatggatgcttctaggctgcgaaaattaattgctttgcacaattatgatctgcatacttttccatgcgtatgttatacttcaataacatttttaaaatttgatattaaacactgtcatagaaatatgatgtgatatgatgtgataaaaatttgcttgtcttacaaatagcaacaccgtatggttttgataaaagagaaagtgttagttgctcagtcgtgtctgactccctgtgacaccatggactgtagcccaccaggttcctctaatcatggaattctccaggcaagaatgttggagtgggtagtcattcccttcaccaggggatcttctcaacccagggatcaaacccacgtctcctgcattgcaggggaagtctttaccatctgagccagcagggaagccttagtgtttgctatttgtaagacaaccagtgtttttttttctttttggtggctgctcgacttgcaggatataggatcttatttcccaggtaagggattgaacctgcacactcggcactgaaagtagagtcctaacctctggactgccagtgaattcccgacaaccaaatttttatttcagtacactatgttctctgaattttagcttcctaattttaaaaatgggaaaaatgatatctactccattcacagagttaatttgaaaatcaagtgagttaacaggtatgaaaaaaagaaactctgtaaactgtgaaaatgcatacacaaggaagacattcttgttgtaataaagcaaagagggttttaattttaatttttaaatgattttccactgttaaggataactctctttggcatatgacagtaattgtgttttagatcaagttttaaaaagcaggtttgtcaattatataatggtctttaatgtactcagattgttgcttttgtttcagaaaacagaaatttacatgatggcttgtaagtggcacattcaatttcacacactgagaatgccgaaaagcaaaaggtccgcatatagtgcaggaactcaaatt

SEQ ID NO: 39784 - DNA, 920 bp, Bovine  19866880926738
tcatatcaacctatgattcttcatatatatgtcactgcctcactgtcaaacagcaatcaacaaggtgtcgacctattcctccaggccagaaagcaatttcgcttaatgatcctggcttgcaactaattttatttaatcactgtacattgttttacagttgaatcatctgaaatgctcctcctagcactggaatcatgacagacatttatgaactaaatgccccatgagttggtaatgctgaagcaagctctttgacccctcaggccacctcttcagatctggcctagataataaattgctctattttcctgaggagaccacaagttgtgttcaaaacccaatgtgtctgggcttccacctgaatgactgagcccgaagttcattttctactttcactgagttgctaatgaagttacaactaatttttatgtcttcttactgggtactgtacatttttctcattttaatttgaatcctcctcaattggaactttccatcttttaaaaaatctttaaaaaacggtagagaaagacactgaggttttgttaaagaagtttttagtgcatgaaaattattacccattttaatttcctctcctgtttggaaaatttatccatgtgcttcctaggagtcagattttctccactctatggagtgatgtagttcaatcgctcagtcatgtctgagtgattgcgaccccatggactgcagcacatcaggcttccctgtttatcaccgactcctggagcttgctcaaactcatatccattgagtcagtgatgccatccaaccatttcatcttctgtcatccccttctcctctgccttcaatctttcctagcatcaggatcttttccaatgagtcagttcttcgcatcaggggccaaagtatgggagtttcagcttcagcatcagtccttc

SEQ ID NO: 39785 - DNA, 757 bp, Bovine  19866880954613
acggttctactttctgggattgcacttgaagattcccctctagcctttgaatgaactttctgatatttatttttaattttcaaggactctatgttgttttctgatttttcttttgttatacagcattctattcctatctcctaaatgccacgttttcccttatctatctgcatgtatgaaacatagaatttttaaggatttttatcactcattttataatttttttagaaacagccagaaacagataatggggtaatcctattgtatatagaaatgaaggagtgaaagagtctttaatttttcattttatatccattggtattatttgactgccttatatgttatttttataatgatattaatagcaataatgatgaggaagaggagaataaagaagaaaagtcattagataagcaccttaacttttaaccaatacattatcatattcatgcagctcaagaaaaggactatccttaaaatcaccataggcccagacaaaaattcgggtttcatcagacaacttaatgtccctctgcattctatagcagttcttcaatgaataatttagtgtccctgtaatgagttctcctaaccagtgtgcctgtccatccttgtattatctattacagagagagactttgatgaaggaccttaatatgagcttttattcatctgtagtttggtaccttgagtcttgcagtcttgggtcccttcaactggtcaagcagcagtctaaagggtaaatctttcagttatc

SEQ ID NO: 39786 - DNA, 991 bp, Bovine  19866880979348
cggccccggtagcgccactggttgctccggtaggcgcaggactggaagcggtggcagcgctgaggcaccagccccttgcgggccttgctcacgaactgcagctcgggcttcttggccgccgtgtaccagaggaagatgtcgttggtctcgttcagagtcaagacgccggactgtgcagcaccgttggcgaaatcgtccagggccatggtcgggatgcggatcaagtagagcgccttgcccagcaccttgcgcttgttctcaatgctcaaagccagatcctgtcgctggcattccacctcagcccagttgagagcggcctcgaagaccacaatttctttggcattcagagtttccctgcggaggatgctttccagggtttggaagtcgatgtcgcagaacccctcggacttgagcgctagctcggcctgggcgtcgatcacctcccagcagcgctgggtgaggtccggctcctcgaacaaacagctctgggacaggagcacacaggcgttcttggcactcaggctggtctccaggaaattgacgcaggccctggcgaggtgagggacgatgtactttttggcagcataaagagtggccaagaccgtgtcagcagccaagtcaatttcatcacaatagatgtatctgcaagaaagagtccggcgtgtaaatcgaattttcaccaaatgactgtgtccagcaagaaaagatgcagctactttcaagttagttccaagaaaatcatctttaagtgacagttattacaaaaatgattagacattacagcaacatctgaaatacattcataaatcatcaacacttcaatttagtagaaagtgtgtataattaaagacattaacttcatgtaattattctagcctctattttaaagctatgttccctgtcctctcaaagggtggggggggggggggcggaaattgaggattcgagaactgtttgagaaaggactagaatcaaagacagttagtattag

SEQ ID NO: 39787 - DNA, 1263 bp, Bovine  19866881042571
acttaaagttttttttttcttttttttaggaatcttcactaaaactgctaaaagcttaccacaattacactcagagtaaaatccaaaactccttatgtcaagtgggcatcaatggttcttatactttttgacttcaggattcttatacttttgaatatttcaagaaacccagagagctcttgtttatgtaatatttactgaaatagaaatgaaaacaaagaaaaaatttaaatattttgtttaaaaataaatgttttgattgaagcttatgaagaaaatatggcctcacacagatagcagctgagcattttaatagtcttttgagataattgtggatattctctgatacctcattgaaacttgaatgataatttcttaaaagttgattgctgtgtggaatcaactgatgaaaccatcagtgaactttctgtattactcttatactaaaatccactggtttgctgtatactttgaatgaaccttttaccaacatgcatgattctttaatgtaattgcagtactattagaaaatattggttcactgagttatgcaaatctttaaaatgttgacgtgtttctttatacagtgttaaaaaactaatgtcaccaactgttcatcagaaatggtctttcagaagtcagtgacagtcttgggaggctatcaagctcatagtggcacaatcaagaattccaaaattccaacttttgctcgaagtttgaattttttcatttgcaataaatagtcagctcattgcattcatttttaagaaatgtcttttaaatacctaagtgtgaataagcatattttgcatattttctcaagtgcattggtgttccatgaactaagtggctggttcagttctcacacaattttttctttttcccatgccaaccattctgtttcagtttcaccagaagtgctttaagcatactttccacttcatcacataaactgttaagaaaatgtatactcaaggattgagatttaataaaatcaaaagtttttactgctgcatctcccagagattccccgtgagatggtccattgattatggcagaagaacacacagtagctaatctgccttcacacaagctgtttcatcagggttcctgagtcccccaagtcccccaagtatgagttggggaggcatgggggaagtcaagaccacttgacatgcctttcgggggatgttcactctggctgctgagggtccactggagtgaccatccaggtttaggaaccagcaacttcagctgtgaaag

SEQ ID NO: 39788 - DNA, 721 bp, Bovine  19866881045679
gtcagtcagccagccagggcctcctgaggctctagggcttttctatttgccccgtcagcgcaggggaggagatggggcctctttcccattagtgttaatggaggcaatcacgtgaatccactacgtagcaatgtgtgtcctcttgtgttctgatatcttaatgcacgaaattgcatctctagggaaaggtttgcctcctcttaagtgctcccaattcccattaatgataatggaacagaaagaaatatacccatcattgctcaacagtggggggcaaaagtgaaagatgattaggtttggggagtgtcagtggaaacccttaggaactgcaagcataatctgaaatggcccctctttcatcatttgtagagatgtaggtggacctagagtctgtcttacagagtaagtaagtcagagagagaaaagcaaatatcacatgttaatgcctatatgtggaacgtagaaaaaagcgtacagatgaagctatttccaaggcaggaatagagatgcagacatagagaatggacatggagacacaggcatggtgggggcagaggagagcaggatgaattgagagagtagggccaacatatacacaccatcacctgtaaaatagatagctagtgggcacctgctgtccagcacagggagctcaccttggtgctttgtaatgacttggggggagggagaggtccaagagggaagggatatatgtgcacat

SEQ ID NO: 39789 - DNA, 978 bp, Bovine  19866881066293
aaaagctgacgttactcaagaaggtgagaagacagagtattgaaactccagccaacttttaagtccactgatctcagggttcattcaggcattttcctgatcacccttttatctcacatccagcctggtgttaagacagggcacccatttaaaacctttaattgagttaaaaataaagtggatttttaccagcatttgaaaagccatcaatgccagttaacccattgaccttggcctaggaaataacttgcttgtcttctacttgtggctgtgtgggtgtaaatatacaggaaacccatttaaggatatttgtttctatgactgatggatgtaactaagagatatgaaactgacagtgtggaaaatgtgtctcttttctcttttctgcactaaaacaaaaaagcaagcagaatttttcatctgaagatgagcgagagatttcataaagaaagaagttggagcatgtgatgtaaatacatgagattatcttttgtgcattttcaaccagagtcaaagaaatatattttcataaattagagcagatatctgattttaagcaagcattcttgtttaacatagagctagagagagatgggtatgcatttgatgggcagatgctgactcagcaactcatgtctcttggctcttattaataggatggggaatgggaggtacttggggctttcggaaggcaaaggctgagtcttggaaatgagtgaagggagcaaacaggagaagagaaagctaaaaatatggtgtagtttcagctgaagtccagcctcattgtaatcccacgagttgctatggaagtaaacgtgaccacaggcttctttcatctcgaggtaagagggctgggttttaccctgaatcagtcactcattggctgtcggtggattcttggaggtaggggaggaagtgtgtaatacatcaaatgaggagactcccatcagagtaatgccattccctagaagggggcag

SEQ ID NO: 39790 - DNA, 1214 bp, Bovine  19866881135058
attccttcgaatgtaggggacttactgtaattggttggtggcattccaggaatcttgggccttagttcctgcagaagaaaaatatatcagtattttgctctgcatattcattgaggaggaactaggaccctggccaagggctgcactattatttcttgattgcccttccctttgtttctgtatcacctcccttctctgattagcaactctttgaatctgcctttttgaacagattcaaggtttggaaggtcacggaggctgaatgaagcatatttcctgcaaacaggaaatgaaggatttgtacttgagagggacccacagggttctgtttcgtttcaaggatggcaaactaaaaatatatatatttcattttttcccattagcatggttctgtttttacaaggatacatgtattttaaaattgggtagtggggtgcatttcctatttgggcaaattggtcgattcggtgttaatactttaagcatacaaatgcagactgcacaagtcatttaccatagaaacagagaaaaagtccatcttccaccaacttaaaataaaacaggctctatataaatatgcacaaccatatgacacacggtttctggggcacagtactacattttatttcctgtaaaaatgtcaatacagtcaacagagcactgttgggaagcacggctccctcctttctgtgctgggctcaggctggttggccagtatcttatccttgggtcagtccattttctcatttttctatttgttgaatgatggttgtagaaaggagcaaagtgcaaagacatttctaatatttgtcatttacttactttctatatcttagaaataaacactgacaaagtaatattgattttgttgattttgtccaacgcttttccaggaaaaataagtattagataggatgtgatattatgatttgtaataataaatatatattaatatctgggacttccttggtagtctagtggttaagattctgtgcttccaatgcaggcaggcaggttgggtcccttgttaggaaactaagatcccacatgtggcatggccaataagtaacttaaaaaaataaaattatatatatggtgtgatcactgacctagagccagacatcctggaacgtgaagtcaagtgggccttagaaagcatcactatgaacaaagctagtggaggtgatggaattccagttgagctattccaaatc

SEQ ID NO: 39791 - DNA, 1375 bp, Bovine  19866881155916
tggagaaggatatggcatgcactccgtattcttgcctggagaattcctggacaaggaacctggcgagtgacagtccatgggatcacaaggaatcagacattactgagtgactaaacaacaacaaattctgataatttttacacacttcagcatttgagcctttgatttgtttctcctacaaaataaagctcaggaataaaagcaagtacttgcttttgttctgaattgttctcaaactgctttgatgtgtagagagtagaactctttttcataaaatcttttaaaaaataagttttactaactagagtttacaggtaataaattcatcaattttaactgtgtaggttggttagtatgatcttgtaatcaccaccgaagttgaaacaaagcacatttccatcatcccccaaagtttactcgtatcatacacacttttaaggaaagtatttagtgaagtaaaatatacacgcagaaaaaagcaccggcgatacttgcgtagctgatgaattttcacaaagtgtatctgtcattcaaatcaagaaacagaacatgactgacattccaggggtgcccacatgtcccctttccccagcggtaaccactaatctggctttcatcaccataaatcggttgtctgcttttgaactttaatgtaattgaagtattatgataaatattccactccatctggtttcttttgttaaacatcatccttgtgagattgtctcctattgttgcctgtagttgtagttcgtttattctcattgctactattgcattgtgtacatatgtctcgatgtatttatccagtctatttcctgatgaacatttgggttgtttccaggttttggttattaggaatagacctgctgtgaacgttctgacgcatgttggcttgcatttttcgttatctttgctttcgtttgtggacagtaggaatataagaatcaaacactgcccgttcattttgatcaaatttattagctggggcacttgccaaagacttttcagaggagaatttacctgatagaagattaggcctcaaacttacttttgttttattatatgagaaaaaaaaaaagagtgggtttcaagacttgagaggcatgttaccaagatggtcaaatgttgttcacattctgggctcggtaccagcctttgatccctttctccctcccatttttctttgcttttcccctcttccttccttcctttcaatcatttttagatggatatgaatttcaaagactgagttgaattgtcctcagttggggatttttttttttttttttttttcataaaagtgaagatgaagtcaagtgctttcaatttgctctaaatgacttcttttcctgggaaatagtttgggctttca

SEQ ID NO: 39792 - DNA, 1386 bp, Bovine  19866881157187
cccttcctgtaagatcccattgtccaataaactatagatatatctgcccctgtctccaggctctttctctggtcttgagcctgggcaactgcaaggcttgcagggtgcagcccaactaagggatgaccattagatgctagaattctgcttagagatgtttcaattgaataaggaattcagaacgttgactacccagactgggtacacctctcagctttttcttctttgcccaaaggcaaaattaactccaggactttccaacaggacctcagctctaagaggcagaagactgcagtgtcagcactttctggcagcctttcaaccaggcttttacttctagccacgctatgataccctcttctatttttatttttaaagtcaaaatgtatgagattttttctctttgctgtctctattttgattttgaaaggtacacaaatatgtaacagcacctttttcttattcctaacatgcatagtttatattttaagagaagacaatcaaactaaacaataatgataaagacacacaggtatgtccatttgggaccagacacaccacctccctggaaactcccactcaccctggtttctatggaaggtctggcatcaatgagaaaggtacttaacactctgcttgtggggcaggggtgggggagcaagggccaagttatgtgctgatgtgcaggggcttgattcttagtgatttctccagcaactccaagatggattgtgtcttctatttttggattcacactgggaagccaattaaattaaagcgctattcatttcactatatttgtctccaggctgctcaaacagaaatgcaagtggcttctattgagtgagttttctgcctcaacgagaacaagattgtaacaccaaaccccgcgtacttcagagtcccacgtgccttaagggggagaaacacaaatcccaaccctggacgctacctgaaagctcctgtgaatgcaaatagatattatcctaaatgaaggcgtacttagcgtctatggccactcacgggtccttagaacagttgtcagaaatgagtctgcttactgatatggacataactgggagaaaggaagaagaaattctttttttccaacttcactcaggagagtgaagaaatgacagaaggtaaatacattgctctgtatgataataaatagtaaacataaaataaatagtaagtacataaacatcacttctctgatgttccttccttacacagcagcaggtagccttgcatcagagagagttgccagcaagcccatggctcccagctcccacaaaatggaaacagtaaactgtctcaaaatttcaaaccaaaggtccagaaatgagttgtgctggcatgattggcctgacttacaatgagcag

SEQ ID NO: 39793 - DNA, 1382 bp, Bovine  19866881192255
gaaggagtctggtttgggtttacatgccttaaagttattctctctctctgcctctctcccttactctacaaagaatatcataaaacttccacatctttccacattatggaaagtcaatttgataagaatgttgttatgtctgtaacctgtcaggggtaaattgagtagaaaattatgcatttccccagtaaaaccaagtgttaatatggaaattctcattaaaagccctaagaagctacagatgtttgagaaaatgtcactgattgctttgacctgaccttttttttttttttttttacagtgctttccttcagcccatcttaccccatgttatcagtttcagaccaggaggcttttttagaaccactggatatggcattaactcattttatccacaccgtctcctcttctgtcccctgcctgctgacaacagctctctgcatggtgctgtgggcaggaaaaatgcagcaagtttctccttcagtaaataggacatcccattcaggtcactcatgcagctcattttaaataaattgaatcaacttctgcctattatctgcttgtccttgaactaagataacattggacattcagttatcactcaaagaaggaattatgagggtgacaaaatttgctgagtgctccaaggccaggtttcacagaactttatttgggtaggactggggaagggaacttccattgctccagtcaagtagtgtgttcactgttaacagtgtgcccttgctgaaaagtttcagaaagtttgaaaatttgagaatattttcaacccagatttattcttgtgaaatgactgaggttaacagccttactgattcaacagacatgaatttgttagtgaaggacagggaagcctggtgtgctacagtccataaggtcacaaagagtcagacatgaattagcgactgaacacacacaagagctggtgcttatcccagaagtctggggatgcctagctccttcgcagaggacctcttttcattggaatttgccctctatagtactagcaaatcaagagacttaataactcaaattcttatccagaagttacataaggagtaacagaaagacttttttattttttgtgactactcggtctttgttgtggcatgtgcaggccttccccagtgtggctcatgggcttagctgccccgaagcatatgggatcttagttccctgaccagatatctaaaacccttgtcccttgcattggaaggtagattctggaccaccagggaagtcctgcataaagactgctttattcaagaagggattaaatttgattgaaataaatcatctctgagcttccgttctctggtgatggatttgttctagaagttttgcatctaaggctttaaatttag

SEQ ID NO: 39794 - DNA, 1213 bp, Bovine  19866881338168
gaccagctgcagagcgctcactgggtagaggatggctctgccaccccccattacctcaggtgcttcagcccccagaggccccctgccaagagatgagcactgaccaagccaaagggtagccattgatcactggcagccaggagccctgatcttgtacgacgtctgatgtgagtgagattcacccagatttagcaattcagcactgttttagtggcccgaattcatgcagtcccacaaaagaaattctgctgttctgactgccagcaaaatggtttattcatcacatcaccctcctggaacccccaggacaaccccatggacaagagtccttgaagtcttagggacgtctggtcaactctgtggactaaaggattagaaagtgctatgaagggagagactgtgactaggtccccatgggtcctgccctttgtgaacttggccagtttcttaatacagttttcatttccctgtctgtaaaatggaaataatcatggttcttattttgattatttattttggtgaagattaaatgagctatttcatgcacagctcttagaaaactgcctaccacaaattgaagagtttgctatttgtcttgagctatttgccacgatctgtgtcatgctcttcctcctggcatttccttgttatttttggctcccactgaacaatgtttgcctcattgaaatgcacaacctctccatttcacaacacaacaaacttcctgagttcttagccagcagtagggtaggaaatgtgaagctttcagaacaaagggatatcctaaaatacatgtgtgttgttctaacagaaaaatgaagacacaccaaggcctttccttaggaggtataggtgacagaaaatagaaatcagcatggctattgttctaggagaaagaaaggttgtaaaatgagatcacaagtgatattatgtttttcttcatccaccttctggtactattacttctaatgctattaggacttttattgcctttttttttttttttttttttaccatccaataaatgtcaggcactgtacaagatatgtgtcatagaaaggaaatgaagggacaatgctttacagttccagtgagggaacaaaatgtataaatactttcagaggctctgaagaaatttcagggtaatgttcatgaagaaaagggtccctgggatatcggaaaatacgattaaaaatatttatacccccaaagc

SEQ ID NO: 39795 - DNA, 1268 bp, Bovine  19866881515421
atgaaggttcaaaatgaagttattttgaattatttgtccattcatttgaaaatggaatgtgatatgtggccccagatgttgagaagaccttacaacattcccttattccgttatacaaacctcatctgtatgaggttttctcagacttgaatgtcatggaaatggcttggagggttttgttgaaaacgcagattctgatgcagaagctggccgagaccgaggtttccagcagcacccccaggagatgctgctgctgcaccccggaccacatgagcaggcgcaagtgccatgtattaactgcctcatcatcgtggtaagagggagctctcggcaagcttttgtcatggttttattagcgttttcatgcctttccaaactggctacaaacattaaaatgtctttcttgttttttaaaaactggattagtttttgtagtgaaagacacgtcttgaaaacagccacgctcctcagtccccacagccgagaggaagggcagggcccctcttggcagcgctgttctaggtgattccaggttaacacacttttccaagcttctccgcaaaacttaactttctaaataaagagcattttctaaaatattatataattttctttcttaaattattacgtgcactttctcctttattctagccacataagagcagtgtttttttgtaggcacaggtgaaggctgttgaactatatgcaaaaaatgaataaaacccacaaaactacatgcttgtgtctgcctattatactttttctattttgtctttccagccgctggtaagtctgtctcaaaagccttcatttcccttccattctaatagattacttctgacctaaaaagccagctactagatttgttagaaatacgcagggaattatccccagtcaaaaggagctgcctggcatggagcctgttcctgggagggtggtggtcaggaagctcagtagcgcggagcctgcgcgagaccctctggctctagttgtattctgagaaggcagctctggaggaacgcgctcgctccttctccgtgcccttctgcatgagttttgctccctccctctctgtcgttctggctcacacacacactctggtgaagtgaattggaagtgtgtttgcgtgggcgcacgttcatgtgtgtgttcaccctgtgactgagaaggcagtacatgtggcacaacaaaccaggggtgaagaacctgtgctaaaaaggccatgggttctctgctcacagtctgtcctgcagaggctttgtaaacag

SEQ ID NO: 39796 - DNA, 570 bp, Bovine  19866881945391
ctcttctcttatgtcctttcctcgcacttctctgtaattgcagtgaatttagtggctttcttaaatcagtgacattcacatatatcataggcttgttctttttgctgaaatatttatttgccttgagttggactgtatgaaacattaaccacagacttagtaactgacacttaatgttctcttgttttgctggaagccactgcccagggattaaagacctctggggtgggtagagccccttctgatgccttgaacattcccagagatgctgcagccagaccccagactctggtggtggctggctcaagttcccttctacaactatcgcacccgtaagcctctgagatgtgctctgagatccagcatttttcctttgtttcttcttcatttaatttattaactgtaagattaagagagcacacttacaaaaattctggtaaaagcagagtggtggaaagagtgagcagatttataaatatgatttcatcataagcttcccaggggagctggaaatcctttgctattgctctataaggagactacagaagggctcacgggaaagatgtcaca

SEQ ID NO: 39797 - DNA, 961 bp, Bovine  19866880479910
gtagagaagatggatgctgctctgacttacagaacctctgagtagttctggaggtaagacagtctgggaaggcattgtgttgaccacaggttccaagggactattgcatccacaggattaatagtacttataattctatctgcatgattctctgcaatatactggtctttagcaatctgcagcaacacaatgcagtgtttaattgattctaccatgctatttgttgtctctttgagggtttcaatttcctttctctgttcatcatctttgtttgcagttttgaagtctgtcatcaaaaagcttcaactgttctatcaagatctgtaggtaagcatcagcctctgtaagtttcttattaaagttttggacactaggaacaaatcctgaatccaaacccccagggggcgacgggatggaggcaaggagagaatcacactcatgcccaaggcctgggcaagtagcagagtccctgggaactcagggatgggagccagaccctctcccagaccctccagaagtgggtctaatcattccgcaagtggccagcaagaaagccattcaccaaggccccagccctctctgcctccaggggagccgagggccccttccaagcacccctcttcgcccccttctgctgaatcaacccacaacatgatttgtaatgattcaatggcattccttgtagaaatgatataatttcaaccctattccttgacaatctggttgattttcaaaatttgattattatacctgcttctaagattttgtaactctagtttcttctttgggattaattcttaagagaaagctaggtcaaagctattccttttaaaaataccttttataccagtgagcaaaattttgacaatttatatttctaatagtggagtataaacacatcaattttactggatccttggcacattttctaaatctttgcattatattaatctgcagttct

SEQ ID NO: 39798 - DNA, 1700 bp, Bovine  19866880487013
cagtactctaagatattaataacttaggctaggctgtgtcagggctgcccaggtagcgctggtggtaaagaacacgcctgccaatgcaggagacataagagacctgggtttgatccctgggtcaggaagaatgcctggagaagggcatggcaacccattccagtattcttgtctggagaatccccagggacagaggagcctgatgggctacagtccatagggtcgcacagtcgaacacaactgaagtgatttaacactcaggttgtgccaacaaatgcaaaaatgaataatggtccaaccacaaaagaagcttatttcactcacacggaagcctgagccgggtgggtgttcccaatcagcagccttctctgcttcacatggagatgcggggatctgtgttttcttccattttgtgcctctgtcatcccccagggctctggttcccaaactgtgcacaaggcgccccacggttccaaagtgaactcacagaactacgggtgaactatctttaaaatgcgagggaattacagccatacttggtatcagttggatacaataccacctactagatacagacagttttgctcaacattagaacacagccctgctttttttgatagcctatctttccaaagcttttttcttttttaggtggtggtttctgtgacaagaaagaaaggtccatgtggcacgatgtggaacaggaaatgaacttgtcaatgtttcatttgatttgaaggtttgagaaacagcaatgcccaacaaacatatcattactaagtacttaagcgccgaagaactgatgcttttgaactgtggtgttggagaagactcttaagagtcccttggactgcaaggagatccaaccagtccattctgaaggagatcagccctggcatttctttggaaagaatgatgctaaagctgaaactccagtactttggccacctcatgcgaagagttgactcattggaaaagtctctgatgctgggagggattgggggccggaggagaaggggacgacaaaggatgagatggctggatggcatcactgactcgatggacgtgagtctgagtgaactctgggagttggtgatggacagggaggcctggtgtgctgcaattcatggggttgcaaagagtcggacacgactgagcaactgaactgaactctggttctttaaatttatccatggtaatggttaggagataatatggattatattgcttggacctagatactaataagtggggctactgatatttcatttgacctagaagtacaatgcaaaaactactgagatgtcaagggctctgtgaacaaagggagtttggaaacttttgccttaggacagtatcttgtctgcatttccctgggggaaggagataaataactctcttaacagccaccactggcctgcttctgttcacatcccaagggcaagaactgattccatatctacatctaattgtaagggaagctaagaactggagtgtggacagatgctaaggcaaaaagggaggcatggacttgaggggacaggtgggtaaaacgtgagaaactgcaatccatcagtagctgtgtggatggcactaactccagatacaccgggatgaatttccctgagttagacatgcattagtgtgtggggagcaaggaactgggagggatgatggatctcaaggtttccaccttgttt

SEQ ID NO: 39799 - DNA, 3252 bp, Bovine  19866880488612
ctagagaattccagggacagaggaactttgcaggctacagtccatggggttgcagagagtcctacacgactgtgactaactcacatagtgtatatatgcaaatcctaatctcctaattcatcccaccctctctccctcctttgtccacatatccattctctctgtctgcatctctgttcctccccttgaaataagttcatctgtatcctgtttctagattctgcatatatgcattaatatcagtattatttttctctttctgacttacttccctctgtatgacagatgttagactcgtccacatctctaaaatgacccagttttgttcctttttatgaccaagtaatatatctttgtatatatgtgctgcatgttctttatccatttatctgtcattggacatataagttgtttccatgttctggctattttaatgcaagcatactattaattaaaagattgccatttattatgaatattaacatattcatttaagataaaccaaacttatgattcaaaataatatttttacttgctgtgcataatgaatcgcactttggtgctggatttgggcttctttgtatagtcattgagtctataaaatcacccaagtgtgctatataataagggcaaccagctgtatttgatgctgtaggcgaacctgaccaggcctgactctgcctgtctttcactttgtgaattgtttttgcctgactgcccctttctaagcctcatgacattgtaaaattagagggtttattataatttctaagacccttcctagttcttgacctctctgacccaggagcatgattttattattttaaattattataaagaattttagttgttatgtttgaatctaatatatggtatatctctactacattagatatatgtgatggtcaggaatgcattcagaatattcattcaccactaatttattgcatatccactatgtgccaagacatataggcaatatatccaaggcccctggctcttacggagtttatattctagtggaggaaccaggtattagaaaagcaaataaatggacacttcagataattttaggtgttgagaggaaaataagaataagttaatggatagagagtgacttgagaagagaggacttgggaaaggatgctcgggaatgaagagatgacattttagcaagatcagaagaagaagggactagttgttcaaagacctggtggatatcatgttacatttagaaggaatagcaaaaggaaaagctctaggtgagaatgaccttggtatggttgaggagcaggaggagtgcccacgtggccggagtggacagaagaaatatgcaagacaaggtgagaaagatggctgagggcagattatagctgacaccatgctcacgtgtctggatagttccctaagtatagtgggaagcctctggataactttaaagccaaagagtaatgtgatattggtggggaggaggttaaaaattctggcagccatgtggatggtagaaaggcaagttacagggtctgtttgcatagtgcagagaggtgatggtggcttagaccagagtggtagcagtgtaggtgataagaactaaatgaattggggaaacagtcgaaaaatgaaccagaagcattttcttagagattcaaggtagaatggaagggcaagaggaaatccaagataattcagaggtttctggcctgagtacctggttgaacagggatgttatggggttggagtgagggggatcaatcattctgttttggacaagttaaaattaaaatgcctttttgatattcaagcagagatgccagatagacagttgtgtattatgagtctggagctcagggcgaggtcacggctgcagatataaatgtgggagtcattagcattttagaaatggatgagttaaggagagaggggtggagataagtcaaagagggtcatatccatatttcaaggtctgaaataaggaagaataaaagagagggaggcaccaatagaggctgagaaggtgtggtcactgaggtaggggaaaaccaagaccaactgctacatccagagccaagaagacagagtgactccagtaatactgccaaaatgtcaggaataaagagatcagggaagattttaaaaataatagcaatgctaatatgtcgtaagacatgatttctggagaaccttccgactagaagtgaatgctacctgtacccattttaagtgtgtaataattctatagttttaaactccaggatgcagaagcattttttaaatgcttgtgcaaagtaaacctaaagccaatgaaaagtaattgcccctaatagtgattcaaggaaaagaacatatctgtgtgccctgggcagccttccagccgatctcttttcctagctgggagagagatgatttataatacccaagagtactagctttttgccatatttcacttttgaaaataaagttttatagaaagaaatttaaaagttcttttttttccccacagttgttgccaaattgcataggaatttcacccctgtcctttgtctttatttatcatgtgaagcaaggagtctagtgtatattcattctttaaaagctgtggattctttgctattggactgtttctcatctacttcctaaaaattttgaactgaattgtaagaagttggaaacttcccgtatgtagacagagtgtgcatctcagcattgggctgtgtgcaaagcactgtcattggaggtactttgatgcaacaaatacaaacccgatttgtgcagtttgtgataattatgcataaaagatcagatgaacaaatcatctccctcattctaactaaaacctttacaaggagcattagttccaagccaccagagggctctgaaagtggtaatttaataaatggtatcttagtaccataaaagaattggcatttgcccacctgatgtgtctggtttaggggactgagttatgcttctgggaggatttaccctataacattataaagacatgttttatacttaataggtttcttatgtatttttcggattatttagctaagcttttaaggagccatttttagtgctctcagagctcatctctaattaattcaattatgtgtgaacagcagtggttttgtattctgttattgggttctgtcttttccacatcaaaaaataaaaacatatgaaaaaaattttaggtttttaaaaactctatttccattattttattcctaccaagtaagatcaagtaacatg

SEQ ID NO: 39800 - DNA, 1053 bp, Bovine  19866880529957
ttttcaatggatagcattcagaacaggtcagtgaaagaaattttaggagtggttgaaatatgggtatattcaccattatacaactttgtgaaggagaaatgagtaaaaaggaatttcgtcaaaaaagcctacctctttttaaaataaatagtatttgaagtgcccaagagggttattaaagacaatgtcaattgctctaaataggccagaacaaatttgcacacttttaaaaaaatcagtcatgaacttggccataaaatcataggttgctgcttctcagagaaaaatgatcgtgtttactcttttaaaaagacattgtaaagtataagttgttttatccacattgcttatttacatggtatgttttaactcatcaaaataagtgtgtaaatttgcagaagtaataaataattcctgagatggctaaatctgggacgtgctcagagcagcagctacaacttagaaaccgcagcaagcaggttctgaagttggccgtctctaagaatgtgtggactttgggaccgagggaaggttccagagttgtccgagcacgaacagtcccatgcatgggaaccagctttcaagtggtagttcagtgtgttttcatttttctccaattgaaaagttaaatatgaatctgaaacagatgttttcattagttttaaatcctctgtagtatctcacagtttatttatagcattaatttttcagtgcagtaggctaattgtatggaaggatgctgttattttatagcttttattgtaggtattctgaatggaaaagtcatgtaagagcaacttcagatcttaggggaaaaaagaaaagtaagcatggttgtgtcaggggagtgttatctcctcggttctgtcttgtctcaacaaaaatttgaagtgacagacattaagccctcggcaggtcacagctcttggacagtccgtgttatagttcttggactgatcagttttatttagaaaataaaggaaaatacatcctcgaggcgtgagggcatttcaacccaaaaggtgtgaagagaagagagagagagtgcacgcg

SEQ ID NO: 39801 - DNA, 1175 bp, Bovine  19866880748557
tgtttcgaacattaaattggatgctttggcaaatctgtcagtaaagggagaattttccacttgagcaaagagcaagacaagtccagtttctgccctgttcatgattattacttataagaactacctgtggttatttcttcttcttatgaagactttgatttattatgaaagtacatggcttataaagaggcatattgtgaatgatccatatctttgtttgtgtgctttgaagattctaaagtaatttgaaacctctaattatatggcttcacccagtgctgagatttcttctattccaacctataaaatttcattcttagtgctggtcatgtttagaaaaactactgcaatcagctatgggccatcttctctgctttctccttgtcagcaataaggaagtcctgaaagtttgaaattcaagaatgccagttatctatcaattccttttcagcttctctaattagctggtactcagtaatcctctgctgggaggggtaaagagacttcccattgtcctttccactttatatggtactaaacaaaagcactgactgtgtgaatgcgtgcttggtcattcagttttgtctgaatctttgtgatcccatggactgtagcccatcaggcttatctgttcatgggattctctaggctagaatgctggagtgggtagccattcccttctccagggggtcttccagagacagggatcaaaccaggctcttctgcattgcagtggattctttaccatctgagccacaagggaagccctgaactactctcatattttcctttcatgggttttccagtgttacatactaaattacaacacaggtttatgggctagggtttaccttaaaatcagtaagtagtttttaaagttacatgttaggtacacagaagttgttaattacaatccttagttcatgacacacagtgattctttgtaaaagaatgtttccttttgttcttccttatgtcacgtttttttttttaattggtaggttttttggtttttgtttttgttttctggttgtgccacacagcacatgggatcttagttccccaacctgggatggaacctgcaccttctgcattggaagcagagtctaagccattggaccccctagggaagtcccttatatcaatttaaagttactgaaatcaaggaacctttt

SEQ ID NO: 39802 - DNA, 1862 bp, Bovine  19866880941777
ccaccctccactttccccccttggtaacattttagaactaatttcacatgctcaactccagggctgctgctactaaaactgcactttctaaagcaattctgatagtgtcatttctgaccagaagggttttctttaagcaacaggcattcagttgcttgcatctgtggtcctggctaaataaggacacaaactagtagaaacattaggtttgtgaaaatcccgtaatgtgtgtttaggcccaataggagaaagtatcaaatggacacactagatttttctttcataaaaaaggcaaaaaaattctaaatatttaatcaaaaataaaataggaaaagtttactttcaagtccttacaagatttaagagaatatatacacttttcaaagggtacttagatccatcaatttctgccttcccagtgtgtagatttctgaatggtttttaatggttggctgtaaaatcaagcctggaattctacaatgcccccagaatgcccttgctcactcactctttcatatttttggttgtgagttccaacagtcaataaaagttctctttactggcatcttttaaattccaaatttaccctcctcttggcttcatatctcagaagtgatatgaagttaaagtgaaataaaatatagttttacttcagaagtaacagtaaagctagtccccagtaagaaaaggtcttctgcagacctgctctctgaacttgtctggagagggaattacaggagcttaattgaccaaaagggagccacaggaggaggaaatatttcgcagaagcataagctaatggatgtgcaccaactaagtcctactgcttacgggaagcatcatgagctgatggaaatgcaaagttgtaaagcagtaggcaaatctaagggacatcttctaggcaggaaattagagactcattgatataattcacggcatatgacagctttggagtaaattcacaccctgtcctttccctctctccctccctctgctttccattatcagtctctcagcagggtttggatttcaactttggcaccagtagacagaactggaaatgagtgtgcattgcaaatcagcatatgccctcatgtcataatctcatccttgtacatcagacacggattccacgtgtactgctgcacttcaagtcaattctctatcattacagctgtaatttctcacctatttcaggagtttattttgtgtaaactttcagaaagcctcacttgtttgaggaggttcagatgaaacaaaaatctgagtagagagctaagtgggtgctttcttctctggcactgcaatctcactctcattccaccccttccaccgctcagatgatgtcagtcagggctaaacttgttgagagacaaaacgcaaggccatctatcaccattacttagaaatctcatctagcaaaggatttacgatctgctcatttcagaggagattaaaaatactccaaagattgaataaagcacgtctggtgatgcataaaaatgagatggatttcaaaaaagacccagggctgacagcacttggtcagaaatgccacattgccatgccaacatggacagggtttttctgggacagctaggcaccacagctgagaggtatttgaagagtggccagttcccagagcactgcagaggcagtcagaacagcatagcggttaagagttgcaggctttggagacagactgccagggttggaataagggtatgactgggaccatgtattaagtagccccagtatgcctagttattcataggattattataaggattaaatgacctaaggcttataccttagaagtccctagaacagtatctgacatgtagtaaagctatacgtgtgtg

SEQ ID NO: 39803 - DNA, 1762 bp, Bovine  19866880967390
agtggggcaggcatggttagcctcccagatcttacctgtctgggatccaaacgtctgtgttcatcatatatgcgtccacttagaggtgagccttctcaaagatgtgatcccgaaacagattttccacctcgtaggttatgggagtcccccagagcttgtataaacctgcagattcccgagcttctttcagagcccgatttccaagatcagaagtgacctgggcatctctatgtctccaggagcctgtattaaacatccaggtcacaaaaccaataatcaaaacatctaagtcgcttccctactgatcaaaaatcctgttttcctcaaatcagttaaactcaacaaaggggaaaaaaatacaaattaaataaactcacataagctgggggtaaaaataataaagtatatttgatatttttaattcttctcaaagtagtttcacttcatcatattagaactttatagcagaagggaaaaaaaggagattatcatcattttttagataaggaaacttgccttgtatatcagcaatagcaaatctttcttaccacaaaataaaaataaatccttctcaaaatcatcatcaatgataggaattatagatgagagagtgggatcttcagaccagctgaacaatgtaccttttggtcacagggatacccagagactgactgggcctattgagtgttcttctgtgggaaaagcctgttaagtcattccaaatggtcagtttcttcccttctgaagcctctaagatctacagtgtcttcatcaaagctcccacagcagaatcagtgaggacaggcaaggaggagagagatgattagagatgggtaaattaagctctttataactctgcctgtattcccacttactacatgttttcgtgttttcatagtttctggcacaactgtgagcaggaccagttttaggtatgggtgaagtaaactgctgttcatttattcaacctgtgtttactggttttcttccttatgccaggcactcctcttgacataagggcaacaaagatgaaaagaaatactcatagccataaggtgtttaatctagaggagagagagacacaaaagcaaaaactacagtcataagattgctgtggtggacttatgctgaagcttagatctgatggataaaataggagtttgtcagtccaataagcgagaaggttctagagacagggatcgtgtgctctgctaaggaggagtgagaccaagtgacaagttccagaaagtgcaagtataatgagcgctgtctgagggaccagagccaagtataaattttgcctgggaggcagatcataaaagattctgtgtacctcgctgaagagttcagattttcatacccttgtcaattgaaaagaattgaagactttttagctgggaaattagaaagatcagtggccgcagctgaggagggaggagctagagacaggaaggcctgcactggagcaacagaagtaggcataggagagagctgggagttaggtgagatacttgtgggttgtgaaatatggaacctccgtttaactgatgggtgaggttggtggtatgcatggatggatggatggtaagggaagaatctaggctcactctctgttttcttacttaatcatctggaagattgataacactttaccaagtgaatatagaagaagagacacttgaagaagtcatataaataattgctcatcaaataaaacttgatgtacaattttctcatagtatactaataagataatgctcat

SEQ ID NO: 39804 - DNA, 738 bp, Bovine  19866880990750
aaaattgaaaccctcaaagagacaacaaatagcttggtagaatcaattaaacactacattatatcgctgcagatcgctaaaagcactattaatcctgtggatgcaatatatcaacctggtcccttggaagctgtggtcaacacagtgccttcccagactgtcttacctccagaacctactctgagttgtgtgattcagagcagcgtctgtcttctctaccagttggacctgtattaacaaccttgggacatcatcagactccaacaccaaatagtacaggcagtggccactcaccacctagtagcagtctgacttctccaagccatgtcaacctgtctccaaacacattcccagagttctcttactctagcagtgaagatgaattctatgatgcagatgaattccttcagagtggctcatccccaaagcgcttaatagatctgcctgcatctgcctcagtcttgacacacagtggctcaggaaatagtctaaagttcctagataccacaaatcacttaattcttccatgtccaatggaacaagcgatcctgacctttttgattcacatgattatagaaatgaccaaggggaggcagggtcgatggaaaagcacaagagtgttatcatgcatctgttgtcacaagttagacttgaaatggatcttatgaaggtagttctttcaacatttattcttgaaagaagatctcttttagaaatgtacgcagacttttgcacatc

SEQ ID NO: 39805 - DNA, 1380 bp, Bovine  19866880996891
gaggttaattgttagagtacaaagctctgttgaagatggaatttcaaagttttcttgccatctgtcactgcatataaaaacttttaaacagatgcatcctgttactttagagatgcattatatccttgacaggcgataattatgcttgttaccccagaatctactatcaggatgagtatatatttactactttctttactcacagagtcaagccaaagagagaattcttttacatttcagcatcttttactttgctttttcctgtgttactcttgctgcctctgacttcagtgaaaaactagcttggttgtgtgtttcttcatatttggaaaaggacaccgtctttatgaatcatcttgtcagaagcaccagcaataaatctgagatgtgttctgaaaaggagggtacatggtgcgtctctttttttttcatctgcaaacaagtagtcttcaggaaacatgtttgaaagaatgtgaacttaacaaaagttcaacctgagactttttttaaaaagtgatttgttaacttcatctttttgtagaagagctttagaaatagaattgctgataaaagaagtccactagaggagaaatctcccggaatttagttatttaacacaaaatttatttaacattggccatgtgctattcacacttctaggtaatacaaaaaaacagacccaaaaaaaccccaccctcattaaaaaaaaaaacaagaagaaaatgtatctccaggtacagaaaggcagattaataaataattaaaataatgtgttagatggtgcttggatttgggaaaaaataaagcaatagattgggtgtagagggtatactgagaataaccactttgtcccgcaacaatttcatttcttcccttattctaagttggtttctgtgtatgtaccactccttaccagtagacgtttggattagttgtgtttcttgccttgtcagtaacacataaacttatgaacacatcctggggatgtgggatatgaacattcctttaaatcactttagtctgtgctcctacagttagtctttttactttaataactaggacaaattgggagaatagcactggcacatatacactgccgtgtgtaaaatagacagctagtgggaggctactgtgtagcacagggagctccactcagtgctctgtgatgacctagatgcgtgggatgaagggggtggcagggagactcaaaagggaggggatatgtgtatatatatagatgattcattcattgtacagcagaaactaacacaacatggtaaagcaattacactccaattaaaaaagtaaagaacttctccctattggatttcccactttccttttctttattcttcaaataatatattaatacctatcttc

SEQ ID NO: 39806 - DNA, 882 bp, Bovine  19866881143720
ttgttctcttgacagcttccaatcacagtttaaatatccagagttctgctttcagggtagcaatttttgattctatttttaatgacaacaaaagttctatgaaagggtttatgtatatggcttgctctgtgcattttacaagcctaaagaaaattacatttcagagaaggtacatatccaattacttggaaataagttacaacaaagtgcccttaagaggcagtgtaataaagacaacctcaattaaaagtcaccataacaaagcaaaaaaagacacataaaacaatgcacattaatagcttattcaaaagctaaatacagagtgggtggtggaaaatggaagtttctttcatgtagaagttaatgaatcattctatttaacaagaggtggactgggaaagggtaagggtctcttctatgatcaataggaagtggcagttagaattcaaggaagaaaacaacttccagttaccttgtgaaaaattatttcagacaaatcttgttaacctcaatcagttttaaagaaacactgagatgaatgaagtgagcccatgcatacacttataccctcattctggttacataaatatttattgtgccacaaactaagctcctgagagactgagatcctaccagaaaccttaggggagtggacacaattacacaccaatgtgatgacttccaggatagaggatgtagcagagcttgaaactcaggggcaggatgcctcatagtctggaggtggtggtggggatagagagggaaggagggaggaagaaagaaaggaacaggccaggtttccagacttgagcaaagatatggaaccttgacagaggttggccttcctggatcgtgaatgcaattcagttaggcttaagcttg

SEQ ID NO: 39807 - DNA, 900 bp, Bovine  19866881272854
tttcccaccttaggtactgatactcattttacaaactatttgcagtactttattaatattttaaagcactatatagtccagcatattttctattaataaaaggtgatttttaaacttttttaaaaaataacagaatttttatccaaaattttatatggaaatctcaatatataaaagagatcaaagccattttgctctaatgaaaggggatggtggtggatggggaacaggtctaccttgcctgccactccgccaccccaggaccttctcagaggcctcaggaagcacctgaaactctctctccaaggcagcaattggggcttctctggtggctgagaaggtaaagactctgcctgcaatgcagaagacctaggttcgatccctgggtcgggaagatcccctagagaagagaatggctacccactccagtattcttgcctggggaactctatggacaaaggagctgggcaggctacagtccatggggtcacaaagagtcagacacgactgagcagttaacactttcacacttttcactttcaaggcaataataacttctgagtctcatttccaacaactacttgggagctggccatgtagccaggttcagatgtccacagcaagttgctatcttacctgtacaaggtgacacttggctctaattttccaggaaagctgattagttcatgttgatgtattcacattagcattatgttaatattattgatattgtcaaggactttgagatatcttacattagcaatttccctcaagaatgacaagagaaagaatgagctggctgggtcaccccaagtttaaagacaggactaatcaagatcttttcaaaatgtcatctgttgatccaaccaacttcatggacatctttcaaagtcataacag

SEQ ID NO: 39808 - DNA, 753 bp, Bovine  19866881681894
tcacatttctttactgtacaccagcagcttttattggcttctagtttgctcaagacaagcttaacagaacatctgatatttattgtgatagaaagtgtaaacaacacgtaatggctattctgggcaccataaagctcagatatttgcttctttgacaattagggatgtattgcaagcatttgtgcattatctgaaaaacactccatttatgcaaacagatataataaaactgaaatacgtaagcagtgctggtgcttactcctggcagcatcttttctgtaggaaacaatttcaagggacactttaagaaatcccaagtattagaaattttagctaaaaatctatttggtcagaaaaattctttgttaaacgaagtagaaagcttttccaccttttttaaatatctacaaacttaattgaaagaaaaaagactagttggagaagtaccagaaagcttcaagcaatttgcataattaaaacatctttttctcgtttcctttatcttttattcttctgacctcagaatttcctttctgtattgcatatttttgcataattgagacgaaatataaagcaaaggctgaactcttatcctataagccttcagaatcatttgagggctagctgtgttgtgagtaactctaccaaacttcaggactgaatacacattgtctaaatgaggatacacatcctcctcttatcacgactgtgaatcacgagtctattactaattttataaatagaaagaagaca

SEQ ID NO: 39809 - DNA, 632 bp, Bovine  19866881721326
ctggacaaagggctgaagtgccacctaaagctgagtaataattatatacagatcacccatgacagtgctatctgctaagcatgtattatgttctcacattttccaaaagtttgttttatatttttctctgaaaattctctaagtctttccacttgtattcaagtgacacaaattacaaagtagcacagcaaagcacttatattgcctaagaaggcaaatgcagcctgccacaggcagctatgggacatcaagcctctccattctattccatgtgccgagaggactgtgcagctgtgaacgagaaaggcaagagtgatgtggaccacgcagagaggccacctggctgtccaaatgaaaatggcttataaacaatcgcttggaaaatagattccatttgtgctcctggccacagaaaaattgggtggagagtgaaaactaaatgggaaagaatcagagaccactaatacaaggaatggaagatctagtgtaaacattaaagatgaaaggagctgcaattccctgatcctggctctaggctacagccatttcactattaattagtagaccatatagcttggctagagcacctccatactgacattagcctactgcaacctcaatggatgcctcag

SEQ ID NO: 39810 - DNA, 1321 bp, Bovine  19866880250662
tgttggagaagactcttgagagttccttggacagcaaggagacccaaccagtccatcttaaaggaaatcagtcctgaatattcattggaaggactgatgctgaagctgaaacgccaatactttggccacctgatgcgaagcactgactcattgaaaaagaccctgatgctgggaaagattgagggcaggaggagaaggggatgacagagaatgagatggttggatggcatcaccaacttgatgagtatgagtttgagcaaggtccaggtgctggtgatggacagggaagcctggtgttctgcagttcatggggtcacaaagactcagacatgactgagtgaatgaactgagagaaagggcttagcctacatctcacaatagtaattaggtcattatctagtactcctgcgattataggccccacccagtcatggtccctctggatcatggaaggccaagcatttggaaagaatagcaataatgccatatcatcatcaaatccaggataccaccagttgtcaactgcattctggtttcagaggtagaatttgaaagaatggcttctggtgattattagatgatattaattgttaaatgcatctcaacttcagagatactaaaatgaagggagaaaaggtacatggtacatcttaggaccaacaaatctccccaagtccacctatgcttttggcattaccaaagttcaataggttcttgttggatgacactgccatctcctctaaagttacagaagaccatatttttgccaatgaaatgagagcagcagtgaatggcacttcccaggctatgtacgtaattgccagtgtttgactctctagtgttctccttccacaatgcactaatcatggaagtacatggtccctgcacacagagacagtagcaacacgagaagatggaatctttatcagcttgctctctgagaaacttcaatgagaagagtccccctgccaaccatccaacccattccggacatgaactgtgagaaaaaaaaaaaaagttattactttcagcaactgaaattccaagaatgtttggtatgacaacataacctaaactctcctgactgagaacaccatcttatgtttgaataagacattacctcatctggtcttgataattacacaatgctgctgctgctactgctaagtcgattcagtcgtgtccgactctgtgcgaccccatagacggcagcccaccaggctcccccgtccctgggattctccaggcaagaacactggagtgggttgccatttcctcctccaatgcagaaagtgaaaagtcaaaggaagtcgttcagtcg

SEQ ID NO: 39811 - DNA, 4501 bp, Bovine  19866880419964
cttgcaggtggctaccttcttgctgtgtcctcacacagtgaagggagagacagagacagagagattaagagagctcttcttctaataagaaaaatcctaccatggtggccccactctcatgacctcatctaatcctaattatctctcaaaggtcccacctacaaataccatcgcgttggggattaaggcttcaactggcagtggggacacagtcagtccataatgatgatatattctgtagcatcttaaaaataaaaatttgacagagacttgaaggtataacagatgtgaaattacagagttagattacgacttgcagagtgtacaaaggaaatagaattgtcaacactaccttatcccccttgagaatataaaatggttgaagcagtggagagggagaagagatgggcaaagagatttctctggagggagctgttgcagtgctctgactccctgccctcagtgtgtgtgtgtgtatatgtgttgtgtgttggtgaagacacacaagacagctagactaaccactccctcccttcccaccaaaggctttcagcccaaagcaaactggagcaggggggtggaaggaagacatgctcttcaatcaagttaaatctttatacagaaacaggcattcagcgtactgaatcaggactctgtctgtcgcttctaatgtcagccacccaagactgaactaaaaagtcatgggatctacaaggagtttttatttcatggtagagaaagactgcccatgtggagtcaagtttaaagggataatgagagacgaaaataaaattgtgctttgattacatcataagtcatgcgtggtcaatatactggttacatataattgctcatcaagcaagaggcaaatctgtagagtcagtggaaggggaggatgatgtgtatttctaggctgcacacaagatacctatggttttccatctaaatgtgatccctgagcaagccagaagtctgtccaaacttagctgtatttacggacttggagattcaccaagaccccctgatgtacctcttctggatgccaaaggtttttactatggtatagtttggaaggttttccactaaaaaaatctagttaaaattgtgccttggcacctgaaagattagccttcatttatccagaaaatgaagctgcctgattggaatttaccgctatagtattttgagattttgctaagccatgctagcccctggaaattcatgaaatcccctctgagtgtttggagaaagcatttaaaagacctgctggacccgctggtcccggggagactctctcctggcaaatctggcaaattcttcctctttttctccttccagattcagctcaaatattacctttgtgaagatttgcccatttctatggccaagtcaattctttctctggatactggctgaacagcctacctagctgttcatacatgtgtgttttacagaacatatttatttacttatctgctcttccataagatcttcagcttcttgaaggttagaaatactgtatttcatcagttttcaataccctcccctccatattcacattgctgaagttagggtggcttttgatggcacgtcataggcaatgtgtattttttagtggtacatagaatggtaatggtatatctcgtaattggtgataacagtgaactatagcatatctaatttactacagtaaccttgaacagctagtacatcacctggcatgtagtacgttctccataaattcatgcaactagcagattttgtaatggtggatttcaccagcaggactcattgatctgagtaattctggcattagagagcaaaaccagaggtggcagactttggggttgcacaactttcagaatgttgaaagggatgtaataattagggtaacctcagctgatataacaactagatgtccaaactgcataatggcacaaacttcagaagttcatatcttgccagcattagctgttcagacccagtgttccttttcagaggtgacagttctcagcgtggtgtttcagggacacaggctcttcccatgttgtggtgccatctcccccatctcatcaccctcccatgcaggcagaacagtaaatagagtgtagaagaagggcccacttttaaggtcttgttctggaaatgattcatatcgtttctgctcatattctgctggtgagaataccacatctagatccaaaccagggagtgagggccaggaaatgtaatcgttagtaggaggtccatttcccagtaacaacgctatgagatggagtaggagcatgtattttggtgggcagttagctggtggctcaaatgctagagaatccacctgccatgcaagagcctcagtagatatgggtttgatccctgggtcaggaagattccctggagaagggaatggcgacccactccagtattcttgcctggagaattccatggacagaggagtctggtgagctacagtccatggggtcacaaaagtcggatacggctgagtgactaacactttcacttttctttagctctttagcccagggaaccactggactcttgcctatttcaggttgggctgtttgcttcttgctgtgaatttaattttggtttccaactctaactgtgctagtcaataatttcttagttgcaagatatggaaacccgactctgatcagttatagtaaacatggaaagaccctggttaggtgtagttggacccatgagctcaaataatgtcagtcatctttctttcctctctgcttttcactgcactgatcttaattcacaaacaaaaactctctataagatgggaaagagaaggatgccttactgggtcctttcagtctatgatcttaggaggaaggagaatgctctttttcacagattcctattaccaaccccgctcttccaaaccaaatcagaccatattaaaccaaaccaaaattttttttggttctctggacttccctgttaactcagctggtaaagaatccatctgtaatgcaggagaccctggttcaattcctgggttgggaagatgcactgagcaagggataggccacctattccagtattcttgggctttcctggtagctcagctggtaaagaatctgcctgcaatgcagaagacttggcttcaatccctgggtcaggaagatcccctggaggagggcatggcaacccattccagttcttgcctggagaacccccatggacagaggtgcctggccagctacagttcatggggttgcaaagagtcagacacaactgagcaactaagcatggcacaaactctgtttggctttaactgggtcatgtgaccattcttgggccaatggctgggtccaggggggtggtgacgtattctgaatggagagcttgacagccccaccagaatcacctggaatgaatgcagtgggggatgaacagacaaaaaataaaagttgtttactgttcccagcacctctcccaactttatctccagttgttcctcctttgcagctgcccctaattgatgctatttctcaaaatatatcagaaccctttcgtaattccctgttgtaccctctttctgaaatgccctctcccatgcctctcccgtattcatccattaagaccagataacaatcatctttgcaaagctatttttgacaccccagtcttactccagccagcctggttacagctaccaaacagggtttgcattcaaaatgactgagctttgagtagagttctctgtgctatacagttggttcttatggattatctactttatacacatagtgtgtgtatattaattccaaactcctaatttatccctcccccgaccttttcccttgggtaaccctaggtttgttttcgaagtctgtgagtctgtttctgttttgtaaataaattcattttttttttagattcctcatataagtgatatcatatgatatttgtctttgtctgtctaactcacttcacttagtatgataatctctaggtctatccatgttgctgtgaatgaatttcttgttcaaggttttgcctattttctattggattttacatctttctcattgatatgtaggaattctttagatgttccaaatactattcctttggcccttatatttggtgcacccatttcatactctgaggcttgcgtttgtactcttcttttaatataaacaagtaatgtgtcttttttttttttttaaaaaaggagctttgaggctacatctcaggctcaaaaaaagtggacttgtggttctgccatgctggtcgcacctgcaatttggagctggctggatggggagcagcccgtgatatgtcgtgttggctgaggtgtaaaatgccatcttgtccaaaacaaacacccgtgccggggaaaccctcaaccgcgccacacagggacacagggagagggctgcaaggagtcggctgcccacaaagctccaattagcccccaaattatctcctgtgtcacgtgtacaaggatttctaaccaaaattt

SEQ ID NO: 39812 - DNA, 879 bp, Bovine  19866880551298
cactccagtgttcttgcctggagaatcccagggacggcagagcctggtgggctgccgtctaaggggttgcacagagtcggacacgactgaagcgacttagcagcagcctagaacaatatctaagaacaataacttcttggtggcaattttaatatttcagtttaatctagagctatttttcatggggtcagaataaagaggccacatttaatgcctgaatgcgactcggtttattttaaaaatttatattaaacattttgaagtctgttagttttgtgtttttaaaaaatctgttcatttgaaaggaaatccaatagtttcagaaaactgttaagtaacctttagtcacttaaatcacagataattgaatgcttttcttttttaggctctttggtttttgctcacgccacaatttttatacttttagatgcatctgctgttacgacaaggagtaacttttgcaggagatttgatgttgatcgttatgaatagttatctaaacaactgtttctaggctctagtttaattgcactgcactgaggcatagccagcagagataaatgaaatagtcattcagcctgatacagaccaatcctcttcattgtgttacgcagagagttttgactttagatactcataagtctgagtttacaatctcagcatcaaagccctttcaagtcactgtgcctccttaacatgccccaaagtacacttttctagttttagcagtctttattagagattaaaaaaataatttgtgttttatattccaggccccaggtatggtcgaaaaatacattcgccatttaagtcatttgaagaacaaatgctaaccccatttgatgaacagacaagacctcaaatctactttcatatttt

SEQ ID NO: 39813 - DNA, 2922 bp, Bovine  19866880556562
aagtgaacttaggaagtttccaggctgagccagagataagcgagagacattatattgggttggccagaaagttttgtttggatttttctctaacattgtatggaaaaacccaaaactttttggctaacccaatataattaatggcattatatgtgataaatgctaaagctgactttacactgggggcttgagtgtgtgtgtgtgtgtgtgtgtgtgtctttatcagtgactttgtgtgtgagagtgtgagttatatgtatatgagtgtgtcatctgtgagtgtataagtgtatgttgatgtgatgtgagcatgtgagtgtgtgtgattgaatgtatgtgtgagtgtgcaactgtgtgtatgatgctgtggtatgggagtatacaggtgtgtgtgcacaagcgtgggtcagtgatatgttgtaggaccgggctaggggaacactggggactgttgcaaagggtagaagtgccctgagaagggatggtatctgcgtgtgctgagcatacacagatcatacaggagatgatcaatacacatttactgattgaagagcagtcttcccagaaggccaggaaatagaatcgggtaggctagcatcagctgtggccttggtttcttttcaggaggttttgtcctcctagacaaacaaagggaacaggagttttgtttttccatctagatgttagtaactgaacctacagggtaaaaggataaattcttgaaataattaaatgctagtaacatcttgcctctttacgtgaccgtaagtcaataggttgtagttaattttaatttgcttctacaaactttttattctttgtaaatattcttcatttttttttaatcagtaaaaatgtttattaaaagggatatggcttttccatgaacttatactgaaagggtgtgaaagctgcttggggtgctggcacctggaccccgggattacttcagaccactcgccccctgtctgcctgccccgacctgaagtttcctgtcggcctcccccgctcctgccgtccagcttttgggctttgtgtctcagccctggttatttgtcttgctccgccttgattgacagcctattttggagtcacatttctagactgacctctgcctttcccaacagagcacagctctgcagcttacctaaggcctcatgctctgaaatcccaccttccctgcctcacatttagctttgcagcccttgggtcacaggctggggacctctacagcctttcagggtcaggtggaagctggagttaaattggaatgaaaaatgctggtgtgtctttacaaagctatcttctctgtaaaaagctagcatcttcctttggattcttctagcttttcttagaagctagcaattattcatcatttataaattgaaggtaatccatttcctgatgactcctggcagaccaagggttggggtgggagagtttcttgagaactttcatccctgtctgctgtttgtagaggaaataactaaaatgtctctatttctcagtcgtccacttctgagatctggttctttccaaatagatttctgtgtattaaatcctttaataatggtaagagtctcctatcagatttttaaacccaaaggacaattgtgtagggcatgtttcaaggtacaaattgcagacagctgttggtcaaggccaccagattgtggggcagcgaagagaatctgtcttttttttgacataaggtgcagtttgaattggagttaaatttagggcaggataaaactgtttggagtggaagctggtgtgggagttattttagttattttatttagtgttagcgttgggttacatgaggcctgggctggggttcagatggttgtgtgttagcaaagagggggaggggcaggtgggatttgggtgagcacgtggtttgctattggtgtcggaattagggctgggtcaggcgctttgctgaactctgggaagcacactggtggggaccgtccatctgagggctgtgctgtgactcagttttcatgcccactggaatcagacccccggtcctggcgtgcaactgtgggttgactaagataaggatgcgttgttctccctctgggagtgtctgggagttgaagggccacacacaggaacaccacacagcctccagcagagcccgaaagacccagggtgggcatctccctcttctgaggctggagggcaggtagaggccataggccctgctattcatctgtcctcctgcactgctgggcagtggggaccggactcggtctcaggatctgaggttcagggtcagccagctgggttctggggccacctctggccagaaatgaaccccacctggtgttcagtggacccgttttctcccatagcatcagtgaagaaatatctgattccatttcaacagtagactgattctattcctttgcctcaggaggagacaggctgggagcattccagtgccattctgggctatttgtctgagctcttgcaggaagaaatgtctttcatccccttggtttctttatttagaagcttttgataaaggtttattgattggaaagccagtgattccagtttaatattgtatgcagtttaggaagcatgccaataatatccttatttacatcatgcataaaaagtttaaacggagtaagacaagggtgaatcccgaaacatgtatgtaccttccaacaacattttcatccaatatttcttcttgtccattataagcaattttatcaagaatttgaagaaatatgtctgcttccttcccctaatctggcagggtagaggatctatgaaaaaagtgaaattaacttggcaggagagaggagcttagtgaaccccactatacgcccagagaattcctttctgactccctggaaaggaactccaaatactctttaaaggatatatatctccagtcagcct

SEQ ID NO: 39814 - DNA, 1300 bp, Bovine  19866880592604
gaatacaacaggatgagcaagcctcccatgaagcaaaggggaaataagactagaatatagcattgtgtatgctaaaactgaaaaagtccaaagtattggaaataaatgacaccatggaaagaaattgccacagctcactaaaacagctaactgaaaatttgtcgatgaaaactgtcagttcatatacccagccatcattataaacactataaaggaaatagctagaggaggtgagaggtgggacaaaaaaaaactctgtcctttgattcttttttgaagccccctgtgactcactgagcttctatttaagcttgaagactcagttcaactttcaccttctgcatgaagacttctcactcctccaggaaaagctatttgctatcattctcccccaagaaggaggggattaagtatatcttctttgctgcttcatcatgcatacctggtagcatgccaggcatatagtcgaagctcaataattataactgaattaattaaatcattatccagtctcctctttgtgttcccattatacaaaatcatatcagagcagcccttttctcatattttgaccctggattttgctctttccacctgactggcagacagtcttttgagaggcaagaggaatcaggatctagtgatttaggcagccaaacatttatcacagcacttttatggaaaaccaatctacagatgcttcttggatggagtaaaaataaatatcctctaaagtaattcaattctaacattctactatattaataaaacaagtttttataaaacatggtgcttgagaagtgtaaaatctagttgcaaagcaagtagaataccgataaaatgatcagcagtgatatgcaaggcaggccattgaattgtaattaggcactcactattttgtacccttctatatttaaataaagtcagtgggaaataagactcgggcaggtaactattttaaaccaatgaacacagtatgcattcctaagaaggaaattctgatacagagtctatttccttacactgtattcactgcactccctaatctccggtcccattcactgcactccccaatctttggtctgattataaggccaagtacacttttatttgaaattagctctgaagtcagaaattttttaatgctacaaaggtaacctggcaagtagtcttcatattaagaagcacaaactaagtaagagctaatagcaggtagctgcactgcctatgaaaagggagcctgatgatcagcaaaatttaaagaagggaaggtttcagaccatcagcaattcatgtttct

SEQ ID NO: 39815 - DNA, 1628 bp, Bovine  19866880603200
tttggacacaggaacagaactgattcaaatctgaaagtaggcccaagggtagaaatccaaggctgttttgtgcccaccattcatagtcctgttgctctttgtggacatcaatagagtcagcacacattttagttttttttctgatatgttcctgttaacctagaactcagcagaatagctggacacatagagtgctgttctctgaatttaaccacaaataggagttgaaagtgaggtggcagttctctgtctgtggttgggcttgaaatggtaccagacaagtttggtgtatccagaactttgttttcctcagcttttaaaaaactgtttcctgagatgagcaagctatagattcagaggtttatttatctctcagagatgtcagcagtaaagcccttgtttgggggggagtgccaactgttcttgagatttcttcataaggctaaaaaaaaagtataaacggattctagggtagctctctgaactacttttagaagttaaagaaggaaatcttagtacctcaccattgtataatttaaccttttttctttgtgttagagacttgctaggtattaataaatcccatttccttttcctggacacacagaaaggctgaatttaccatcatcccttgcatttggtttggggccaagtacctgggtttcgttcagtgaaatatggttgggagtaatgtgtgctatctgtaggcctagtcataaaatcttccacatttgtctttccctttctgggaaaggccatgtgttggagatgataatatcaaaagctacaaggggacaacctctgagtaatttagttcagttcttaattattccataattatttcttacatcaaagccattatcattttatttatgcaattaaaacttaaagaccctccttatttctttaccttattacataggtattttaattttgtaagtgaaacaggaaataaaaaacatgggaagttgggaattttttaaaaaatgacataattctaaaggaaatgaccttttatatttgagatagaggattggggaaaaaactaaaaaaatttaatgttcaaaggttggataaatgaaatactgacaaattgcctttcaaagataattttgatttgaatgtttctaaaacttgattatatgctccagtattaaaatcaatgctttttttttttttcaaatgctaaagcaaatgattcctgaagggtccactttgttttccagtatagcttaaaattgaaaggaaaatattagtgcagtaaagcatgtactactgtaatagaattttcccctccatttactgcagtggcagtgcttgaatggagtggtatgaaagccatatacgatatattatttttatacatcttaataaaaatatcatacatttttttcaccagcttttttcaagattgatgtatcctgatcaatatgatacgaatcttattgagaaatcacaggcaagatacaagataaacacactttcaatttaaagtacagtttctcctggtaaacagttggcaatgactaatctgtaggaaccttaattactcagtagaatccatgtacttacctggaatggcaccaggcttcctgctcatccacgtccgtctgcccactcggttgatg

SEQ ID NO: 39816 - DNA, 1990 bp, Bovine  19866880639840
aaaaacgaagatcatggcatccagtccccatcacttcatggcaaatagatggggaaacaatggaaacagtgacagattttattttcttgggctccaaaatcactatggacagtgactgcagccatgaaattaaaagacacttgctccttggaagaaaaactatcacaaacctagacagtttattaaaaagcagagacataactttgccgacaaaggtctgtatagtcaaagctatggtttttccagtagtcatgtatggatgtgagagttggaccataaagaaggctgagtgctgaagaactgacacttttaaagtgtggtgcaggagaagactcttgagagtcccttggactgcaaggagatcaaatcagggaaatcaaccctgaatattcattggaaggactgatgctgaagctgaagctccaatactttggccacctgatacaaagagccacctcattgaaaaaggccctgatgctaggaaagattgagggcaggaggagaaggggatgacaaaggatgagatggttggatggcatcatcgactcaatggagatgagtttgggcaaattctgggagacagtgaagggcagggaggcctggcatgctgtagtccatggggtcacgaagagtcagacacgactgagcaaccgaacaacaacacatgaggaaaatgaggggaggaaaggcgagatagtaccctcagctccagtgctaagtaagagaaagaaccgtgattcaaaccagcctgtttgactctggaagctcgactccttccccttggcgaatggaggagagggaaagagaagagagctgcatggagctgggggcaggaggaaggagagaagacaccctaggaacacggtctaaaaatcctggtaaactacacaatgaagtctgagccgtggtgctaagcctgcccctggtacccctagccctcagacaccatgcagtctgcaagtctgctctctcccaacacccccacttatctctcttccctgtctccctctttacctgccgggatgactatttgtctggtgttggaatctgcatctccgcatctgtacattaaatagtctttaggacttaggggctactgctagggcagggggcaagaccccagtccctgtcccaagtggggttacctgtgggagggtgacggagcgctggggtggagtgggactggagaggccactctgcctgtgtctgctctcagcatctcggggcagccagcctgcatccatctgcctcatttcctgtgcagcctccagtggtggcagcgcagcctctcagctgcaggctgttggttctccttctctagtcactggcactcgatgcaagtcatccagaagtagctgggatgatgcggctctcatcttcctcctagagggcctcgtgggagggaagtccctttactccctgcgagcccacaccgctcttcccaggacagcacactgtcacccaggaggcgaggctggtgtgcgcactcctgtcggctgcttccctgggctgggaacctctgcagaaccttccccaccccagccctcctgagcaaagagccaagccagggtaaagcctgtgcatatagggcctcaatttcagatcagattcacaaatttaatttcctattccttaatttaattctgcattttagttttgtttttattatttacatgggttccctttaatgattccaaattgctgctgccctctagcagtattttgtcttaggttaacttcttgaaaaccgatcagtgttggagtttattccgcgctgggttgagttattttctgaaacgaagcacaattaaattagaataatgaacatgctctttagaggattaattcataataagcaggccatgtgctacagctcacagaagaaagggcacgaggaccgaaagctgtttttttctgcctaaatagaaaagtacattctgcagagcagaacaaatcagctaatatatccagagcgcggccagccccagag

SEQ ID NO: 39817 - DNA, 2962 bp, Bovine  19866880643157
ccttgttttacttgccttccttctctgatttttcccttggaagagactccaggggtgtgcaaagcgggaagtcctgctggtgtgtaactgaaaacactttgttctcctttagatctgcaacggggcccctgtctcttctgattttcttgtggcgcccgtcacctccactatggaaagaaaaacgaaccatgatggtgtgatgggccaggctgccatgttttaccctatttacaggtcatgttaagtattgcttctacacttcagatggcctttcatgtttaatttcattcgagtagggctgtgcgaggctttcctctaggtagcaatgaaaattaaacacaattgagtttgatgtgtaccttattgattccagacccatttcagtagactgggacacttcagcgacctgcaaattctacacattagagttcagaatttacacaaacatcatgcactcaagacatggacttaaatgtttctcccagcagcacccaactcccaaccaaagacacaggctctgtcagaaaatggaagttgctaatgaaaatgcattccagatgatattgttggtcatcccctaggggaaaaaatgattcatgaataatttcatgtagaaaagggagtcatcatttcctcagttctatgttgtcttattttggttctctgtagtccacttcttatcccataggtccccacaacttcatttcaaaaagatgagggaagagaggggagaggttgtgtgttaagctggcttgggagctaccaagtaatgaaaactgctcagcaccttggattgattgcatcctgttacagcactgtttctcctctttgggtgtgatggtgagggtgcagcacactcgagaggcatccttagagaaggccacttgagcaaaaggagcaatcggtaacagagcaaggctgggtgagcgggttcccaccagtcattggtttcagggcatcgtgtcagtcatttctcttttgcaactgagctgggaattagaggctttgttcagtccgaagtgggagaaagggaattttaacaagagagcatggccttcggaggcaagagaaaaaagtgtcttccctggggcagggaccagaggtgagtcagaaatgactgggggagagtggtgttccccgctggggtcacagggccacttgtaaaatgatgcctagattctggtctccagccaaagttctcaaccttggctgcacatggaatcacctgggaggcttttacaacctggatggccaagccctgctgtagacccattagatcagaatctctggggtgggatccgggctgggagaagttgtcaaagctccaaggtgattacaatatgcctctaggctcgaggcccactagtctaggacctggctaatccaagagtggcctgaggaccagcagctttggtatcacctgagacttgtaagacttgcagcttcccaggctccatcccagacttactgagtcagcatctgcattttagtgaggtccctggaagagctgaagtctattaaagcatgaggaactgtggttctccagcttggctacacgttaaaatctcccagggagtgtttaaaaatcccagtgctcaggctgcacctcgtgccaattaaatcagaatttttgagggtgggatgcaaacatcagtagctttttatgggttttcaggtgactccgatgtatatgagttagcaaccctggctacatatcagaattgtctggggagcttttacatctccagatacttgagtcctactcagaaattctgatttaattggtctagaataggctacaaaaagcttcctaggtgattttaatatatagccagtgagagcctctgttccagaatgttggtccagcttcagtgagtagacaaccttgctacaagtcaattaatccaagaaccagtgatggaaaagaatgataagaccatgtctggcaccccactccagtactcttgcctggaaaatcccatggacggaggagcctgttaggctgcaatccatgaggttgcgaagagtcagacacgactgagcgccttcactttcactttttactttcatgcattggagaaggaaatggcaacccactccagtgttcttgcctggagaatcccagggacgggggagcctggtgggctgctgtctatggggtcgtacagagtcgggcacgactgaagcgacttagcagcagcagcagtcaccatgttggaaaagaccctgatgctgggaaagattgaaggcaaaagaaggcagcagaggataagctggttagatagcatgactgactcaatggacataaattgagcaaactcaaggatatagtggaggatagagaaacctggcacgctgtagtccatggggtcacaaagagtcagacatgacttagcagctgaacaagaacagtcaccattgggttgcaccaataaagtatatgtaaatccagtgacatttgcctctggccagcaagcaaggggatatatgtatatatggttatataagtacatgtggacttccctggtggctcaggcagatgcctgcaatgcgggagacctgggtttcatccctggtttgggaagatcccctagaagaggacatggcaacctactccagtattcttgtctggagaatccccatggacagaggagtctggcaggttgcagtccatgggattgcaaagagttggacatgactgagcaactaggcacacattctattttatttttggaaaaccagaaaagtgatcaaaacatttaaaatttctcttgagtgcttaagagccttgttggtttttgctccatggcatggggccagggtagggagttaagaaggagttaaatgaggattaaaaaaatcggggaggtctgggaaactgacttttgattgggaagtgaggaaagctggcattgaatgtttcctagagtaccaacattttttattaaaacgtttttgtggg

SEQ ID NO: 39818 - DNA, 1092 bp, Bovine  19866880680789
ttgttattctcccaaaacttctctgttacacaaaactgcatttcccagagttatgcactaagtagaaagaatgaagtagcagcaggtcagaccctctaataggacagtcctttctataaccaaggggttgattatatctatttgcaagagtcaactgaaaaggtaaaatacttgctttcctcttcttttcaataattagaccacctgatgcaaagagccgactcattggaaaagaccctgatgctgggacagattgagggcaggagaagaagagggcaaaggggatcagatggtggatagcatagcctactcaatgaacgtgagtttgagcaaactccaggagatagtgaaggacagggaagcctggcttgctgcagtccatggggtaacaaagagttggacatgacttagcgactcaacaacaacttcttttctactaggaaaacaagctgtgatttgtgcgctctggttcatattctttgtcactttgagaatggaaatttcttttttttttttctccaagtggtacaatggaaactgatattttcctttttattgactcttactaaaaaatttctatatttcttcccagagtgatcatttaagctagaaaacatgtcagcatgatcatcatcaactacatatgcttgactaaaatttttacttttacatttgtgtttgcttttctgaaataatcttccatttaaaaaatctttaaattccataatgtcaacactacttaagatcacattatttaaagagattttaatacattgactgataggactagatccttaaaaagatgacactgaaatcttttgaaatatatgtaaactatattttgtaatcctacatagtgtcaaagtgaactgatttagtcaggtcaacagttacattagcttagaatttgtaaatatcagcaattcattttgtcactagcggaatttgctgtcagggattttgactttagccagcaaagtgaaggggcccggcatgcaatcagatacttaaaatgcaatgtgaggtaatgtccccaaagaaattgtaaaagcatagaaagggggtttctaatatagtaagtcattcttctcc

SEQ ID NO: 39819 - DNA, 875 bp, Bovine  19866880826868
gaagcctggtaggctgtagtccatggggtcgttaagagtcggacacgattgaagcgacttagcagtagcagttaattcatttttgaacaaataatatagtcacaaagttcaaaactcaaaaaagtatgaaaatgcccacagtgacagcaactcccccagtctggccctctgtctatgcagccccttccacaacttcaaacaggatgattggctattataagtaactgtgtgtatgtgtccttccaaaaaatgtttatatacacaaaaaccaaatactaatatgaatttacctatcccctcccattttgcacacatgtaaatattctatacatgctagtcacaaacttgctttttttttttttttttttgcttaatataccttggaatatttattaaacttgtcacctggtatgtgctggacacccttacaggaagcattaagtgaaatacacaaatattctacttctaattttcatcaaagcattcttctagaaattgtcataaactaagacattaattggactgcatttctccatattaacagtactgtaactggaggattgcatctctgattaatgaccaacatcaaataaattatagccatgaccaaaatattaagtcaaagatagaaaagaaacttttatattagtattaaatagttgatatttccccaaatcataaattatacacatataaatacaaatttccaaatgattatataagcctcagtgcatgtaaacagcagtatatatgcttttaccataaattttatctatctaaaaatgtgctcatgacaaatacatttgatgatatttttcttgtcttcttagaatttttaaggggatatattggaggggcagatttgatgcccaaat

SEQ ID NO: 39820 - DNA, 2459 bp, Bovine  19866880843918
atagtgaaggatagggaagcccagtgtgctgcagttcatggggttgcaaagagtgggacatgacttagtgatgagaaacagcaaccaatatgataacataattcttacagaagttggtaagacctacttggtcttattctgtgacctataacaaagtgtgagtggtgttttttacaactagttttacaagtacatgattgttttcaatattgctaaaaatcctcaaaaatacaatcctggtcaatactattactttagaaattacactcttaaactcaaagaacaaaagatggaaattaaaactttcctttagaaaatgtcttaaaaagctgtcactgagtcaaagaagtaatttgataaagacagtagtcgactagaaatagaaactgctatttagctcctggaataaagccctggaaacaagcagctacacagctacattttatagactttaactgggctattagctttattgttcagagaatattgatttatacaaaagaatcagcaaccttaactatttcttggatgaaatgaacaattatttcatattaaaacttaagaaaaaattacacaactcatttaaattcatggtactgccttggtaattttcattacactgatttgcaaatataactcattcctgaaatccccttgtctggcacttacttcttagcaaaatctaatagtacagaatttcactaaagtctcatgtcacaatgatttctctccttttcttacttggggaagattttgttctcaacctactttaaagcagtcaggaaaacaagtgattaaagcatatccagtgacacagcatccttagttttgtagcataagttgctctcctaagttatgtacaaaatattcattgtaaatttattgtaaggggacatatgcattgaaattggcacactataactcagaaatgtgaagaaaaccatctatcttcctttattttatagctgatctcatttgttctcaaacccttctgctcataaagggaaagaaaagcttaattgttctattacaagtaatcccattttccttcagtttaaaccagtttttcagtaaggagattgacaaatgcttcaacatcttttctccctccttttctggcctttgcaagatggttctcatcttgggaaatagagaacggtccatccatgcatgatgttgaatgacagcccatgcacaactgtttttcttcttttgaggtatttatcttgatagtttctgggtagcaaagcctgatgtcattgctatcttttatctgctgtgatgatggtccatgatgggtttgattcttgtttcgtttgtttgtgtggttaaatgcaatgatagcttttctcttgggtgactctgtcattctcctgatgactgtgacctagcttcagctcttgttggcagtggtttccctggttttggctaagcttccgatttgctcattttcttagactctcttatgaacattctgctacagatttcctcatcttctttttgcaataatcttattagagagctcactagctagaatactcagctattttttgcattcttcctgggacctgctgggagttttcatcctcaacgtacctggcataggccaaaacacagcatcctgattctgtttgctttatgttaatgtaaggccttcttcaagatggtctccttatagagtctcaaatgggagtgatgacacagaaccctctgcttttggcttctctggcctctctgggatcttcctatcattttcccttagagttggccccagtgcagaaggtaccttggaaacagagcaggagacaggaggacactcatgaataacctctcattcctttctctctctactcgatcctttccttttggccagaagggctttattcttagtcctcttgtcttgctttagttcttgcttgacttccattagttaaatccttctactttcttctgtagatttgctctttttaatggggacagaagatggttaaggattgcaagaaaagaaatcaaaagggaaaatatatcaatagatatttaaaaaatgctcattacattcttcaaaatatccttaaaatttcatggaatgctatgcctatttttgaagtaaacagccagtgagagaaattaagggaagtgagatacaagcttataccttggtttccctgctgtagaaacacaccaactaagaatatttattggagtccctatactgtgcttgaagtttggggaatagtaacaaagcacaggacattgaaacctatccttaaagaacttatcatgtagttatggagataagactgatgtgctgttgattaaaggtggcaaatgaatgcttaatgaatcaacactattatagtacatatacaaagtgattgattttggctgagctggtgaaagaacatttaattgaaggagggggtgaaatgtcaactattttagagatatgataggactca

SEQ ID NO: 39821 - DNA, 1203 bp, Bovine  19866880853743
acccaaactcttgctgatgctcttactatatatcataaggaaaaaaatatattcattcttcagctcactttttaaaaaaactgaagtatagctgatttacaatgttgtgttaatttctgctgtacagcaaagtgattcagttatacatatatatatattatttttatggtttatcataggatattgaatatagttgtctgtgctatacagtaggaccttgttcatccattctatatgtaaaagtgtatatctgttaacctcctcccccttggcaaccacaagtctgatctctatgtccttgagtctatttctgtttcattggtagatttatttgtatcacatcttaaattccacatgtaagtgatgtcatttggcatttgtctttctctttctgacttacttcacttagtataatacatccatgttgcttcaaatagcattatttcattctcttttgactagcattccactgcatacatgtatcatttcctctctatctattcatctgtcaatggacattgaggttgtttccatgtcttggatactacgaatagtacttctgtgaacacagaagtgcatgtatctctttgaattggagttttgtccagatatatgtccaggagtgggattgctggatcatatggtaattctacttttagttttctgaggaggctccatactgttttccatagtggctgtgccagcttatattcccaccaacagtgttggagggttcccttttatccacatctcctccagtgtttgttatttgtagagtttttccttcacttaactatttagtcattatggacatctaatttggacaatattctttatctttggaagtaaatacagacaatcaagtgcaggatgttgctcggaaggaaaggtaccccttgactggcaaaggcaatggattgtgcactcgcattatactatagaggcagggccaatagctttggccttgagaactttggaaagtgaaagagttgaaaattaaagtaggaaaaagaagtttgttgcaattctgagcaatgagtattacaaatatttcaaagtagctgtaccatttctgtgacagctgcatctggggaacgcctctaaacctaattatatacttttcctttctcttctaactgaagagatgattagagacagaggtagaaagacagtgatacagacataattttcacaaaaagatta

SEQ ID NO: 39822 - DNA, 2046 bp, Bovine  19866880879499
tgatgcagttaatacgcgcatatgttaatcactttgtgtgtgtttctgtaaattcacagaagtgaaattacttggtcaaaggtatttgcatttttattactgttagactgcacctggggaaatgtaattcaaaggatgctggaactagatccattttaggaagatccattttggaggaaacaggaagatgggaaggaggggacgagacaagtttggaggttgttatgattacatcaggtgagatgtgatgaaggccagaacagagcagggcctgagagaaagcgggcagggcaagggtggaagagacactagtgaccagtttgataattcccggggagagaggaggaatcacagacagaggtccagagcctcacatggggagggattaactgagaaacagaaggagtggctttgatcagattctctaaaaccaggaatgtgtctgcatagacatgaaagtggaaagctaagaaatcaccatctcaggcctggtagagatagataggaagaatgagactcaaaaaaagttagagggtcttaatgtctcctggggagggttgatcagacctagtgcagttccagacaaggaagggccaagagcatggactttggagttcaggctttctgctggaaccaacaatcactaaacttcagtgctttagcacaattgattatttccagctcacatcaccctctcctgcaggagcagtgatgaggaagctactctgctcaaagcaattgtggagattcttagattcttacatattcagattctgcccttctccaggtcctcctctctcacattcagccattgggtgggagaagagagaatctgttgtacaggcaggttttatgggccagacctggaaatggcttatgccatttctactcagttgctattggttagaattgagtcgtatggctgcacctgcctgcaagggggcctgggaatggcatctagcagagagtccagaaggaagagggtgatgcttgatgaacaactaaccaacctctgcctcccaaactgtgtgtcctgggcaagtcatataacttttcatagtcttggtgttcacatctgtcaaatgggaataatcacttcataggtaggattgttgatcttttgaggattagatgagcttatgtacatgacccacttaggatggcatacgtagatggataaataaccaccatagtgaatattcatacatattcatagtatgtgctccttggttgggatgctatggttttccctgtctttctctgcccactccaggtctacacaggcagaggaaaactcagtctgcctatgactgacctggatcattctggccccaaagtagatttcttttcttgaaagaaatcacttggtttggtgaactccatagattaaattcatgagattatttcaaatctccctatgcctggtccgtgtagacccagccacagcctctgccagccagcttcagtctgaggataggcaggctgcagaatgattcttgttcattctttcatgttattcccacacttcagaagtctggagggaagcagaatgtttgctgttctgggatcatttgaagccgggcatgcaaagagttccgagtcactttcaagtctgcccgtaggaaatctttcttggcaaccagacaactagaattagttattaaaggcatgccaaatgaataaagacacctctgtgaggaaaaccgcaagagtagttactttttctaatatgaataggaggctaatatcaaatcacctttaattttccactctttctttgctgtttcgttggtaggtcaaatctaataatacagatactccagaaaaccgttcatctatcgcaatatataggcccactgcaaatgtgtgtcttaaaaaccagggtctggaatttaaacaagtatctgcacactgacaagcctgtttcctctaggaacattctcctagatgccaaacctgtgttgccctcacaggctgtaaggagccgacctgtgaaacagaataaagcctggtcttgtctataaaccatacatcccacagaacaca

SEQ ID NO: 39823 - DNA, 729 bp, Bovine  19866880955611
gtcattaaaaatattgggttaaccccactggtaaaccacagtctaggctttgtgccactcaaagatttaatagaaagaaaatatcttactcatagaagaaaagaaaatagtctttacccttatgtattctacagaagtgctgttaataaattgcaaagactttacaaccaatgaagaataaatcattgagctagatgaaaattcaaaacatgaatagtgaaagaatatacaagcaaggagataagaatagttatctctcagtagagatgatagtatttttactctttattagaataaacttctactttttcaacaaaaaggtatttattgcttatgtaaaaagaaaaaaacaataaatgtaacatttaatttcaaaaatatacagccagaccttagtccataacagaattgcaagactatttttttgctcaatcctatggtcttgcaagatgatcatgatttaggaaaaatttcacaaatataaaaagatcagctagatataaatttagtgcagtggttcaaagcatggattttgaggtcagatagacttattttggaactacacctctgcttctcactctgtgggcttagttgggtttcctaagctctctcaactgtggtctcatccatagtaaaatggaattaatgataacttcttacttccactgtataatcataagggatttgatttaggtcatacctgaatggtctagtggttttccctacttt

SEQ ID NO: 39824 - DNA, 1595 bp, Bovine  19866880989098
tgagaagggtctacctagcctttgctagtgaacttggccagttcgagtttaaaggtcaaccctgggtctctggtcactaattgctatctcagtatccaggataaaggcacaaaggttggatcttgttgaagaaactagattgctggatcccaagaagagaagactcttgatggaaaatgccaggctcccagtgaattttctagttctgaaatgctaatatttctcatatggaggctcacagacattcacggggttttcaatttcaaggccatttcagttttttatggggcttgatgttctctgcacaaacataggttcaataattgacagagtgccaggctgcccactctggcactcacaagcctgtcatgcaggacagcaaagccacgcagttcctacagcccccaaagccacgccgtctgctccctggcacagagaccttgccaattgcaggaagttgggaaataaaagaaaagtttcaaataaaaagatgtcaatttaacagccagggacctggaaacagatgttcctcgcgtagccccagagacgcccactggcccgcccatccgtcctccgggttttcaaagtcacttcttgtcaggtgccctggttaagagggagaattaatgagctgtgctccattttacggctgtcgtctgatgtgggagccgtgcacggagctgctccgcggacaggccagcccgactcccagcagctcagcctggatcaaagcagagagcagctcggcttttatagcaaaatgattaaaaccgcgtggggcttgtttcctcccacgtgacctctgacaaagtgcagaggagggagcagaggaaaggtgaacccagaggtctccagcctcagggaagagcaggacctgagatgcaggcatcacagaagataagcctggatatacgggcacacacacaagcaatgccttttctcctgcaagttgaaacctaccctcagaatgagaggccagagggcctaattagccaggttaagaggaccacagagcaccatgtagacgatagcaagctagctagctagctttcctacttattcaattactcctagttcttgaaggaagtagtagcactggattgaactgacaaagtattaattctcaaatgttcctgttgcatctggacaaataacttctcatccgactatagtctttggcaattctgccactgctgaccatcacagtgcccagtagcaggcaacctcacctctgacctcccacctgttctgctcctctggcattcccaagtagtctcctatttctatagcgaatagaccaaagcagaagtcctgagatgccacttccaagtttatgttttggaaagactgtggtttccttcttgggcgtgctctggctctgaaggaagccagtggccagcctgaggctgaactaggagaagcccatgtggcagagacttaaaacagacctcttgtcagcagcctggaaggagctgaactctgtccccaaccacaggagtgagggtagaagcagactctctctcaggtaacaagtcttcagattactacagcccggtcaccttgactgtagacatcagagagacctaagcggtgcc

SEQ ID NO: 39825 - DNA, 1087 bp, Bovine  19866880996062
tctgggtcgtgccagtgcaccagccccaagcatccagtatcgtgcatcgaacctggactggtgactcatttcatatatgatattattcatgtttcaatgccattctcccaaatcattccactctctccctctcccacagagtccaaaagactgttctatacatcagtgtctcttttgctgtctcgtatacagggttattgttaccatctttctaaattccatatatatgcgttagtatactgtattggtgtttttctttctggcttacttcactctgtataataggctccagtttcatccacctcattagaacggattcaaatgtattctttttaatggctgagtaatactccattgtgtatatgtaccatagctttcttatccattcatctgctgacggacatctaggttgcttctatgaggctgtttttttaaaaggtttcccaatggtttttttcttggttagaccatccttgggcttctctggtagctcagctggtaaagaatcctcctgcaaggcaggagaccctggttctattcctgggtcagaaagatcccctggagaagggataggctaaccactccagtattcttgggtttccctggtggctcagctggtaaagaatccacctacaatgtgggagacctgggtttgatctctgggttgcaaagatcccctggaggcgggcatggcaacacactccagtattcttgcctggacaattgcatgaacagaggagcctggtggtctatagtccattgggtcgcaaagagttggacacaactgagcaactaagcacagcatagcacacagaccatccttacattgattaggaactaagacagattgtgttttcttcttctcttccttctgtgcatatgagaataaagatttgattgggcgctctggtgtaggcacttataataggatcaagtacagaataaaaataccctctgcatgaaattaaaagataataaggccccaatgtatactaaaagcaatttattacgttctaacaacttgattatctcctttggaaagagtgaacacttctgcctacttcttttccattactgcccagacttg

SEQ ID NO: 39826 - DNA, 1669 bp, Bovine  19866881027802
agataccaagagaatatttcatacaaagatgggcacaataaaggacaggaatggtatggacctaactgaagcagaagatattaagaggtggcaagaatacacagaagaactatacagaaaaggtcttcatgacccagataaccacgatggtgtgatcagggtctgtttacataacctaattttgctcccacttttcttaataaacaaccaggatcactcatcagcacaagaaactcaaggcataatataattctaggcacaagcaaagaaagtctatgttccccttgactggacaaacttatcacgagacactgacaatggtttccccctccccaatatgtttacagactcctgaagatccgtggggtccaggctgagaactactatttgatgatcatccccaaggtctcttccaagcagggctctctgaaccgtgatgcacagcctccctgtggtcaggcatgggggaaatgagcaggagatgtgaactaaaggagtgagggaaagctttctggaaaaagaaaatcttgaaatgagccttgaaggatgggcaagctttagataggtggggaaaggatctcatcatgcaggaaaagcagagaaagctctaagatgagtgaagcaaccagccaggctgcagcacagcgtcaggaagtacttgtggaaacaagactagaagatgtcggttgtgactgactctaaatgccaagctgaattatccttcaaatgctggggaatcatcaacgattttagagcaggaaaatgatgggctggaagcagtgttcttggcagatgtatctggtgcctgtacatgctttgaggtgggaggagagcatcgaggcgacccagacaacagaccagatgtgtgaggaagagcctggtctggggaggatgtcggtgaagaaataaaggggcaaatctaagagattttttttttaagcacaggattaagtttgagtttggaagcatggaagagactgagatgtcttggagcctgctggtgcagaaatgagacagccaccaagggaagtctgtgggaggaaggagatgatgagttcatagggcatcttagggagtccgcacatagcatctttcagaagggttacttctgcaggtggggttggaggggcaggcaaggtggctttcacatcttatgatatataatctcttttaatggagggattttgtgtaatttttacttcctttttgtgctttttggaatttttcaactaattattttaattccatgcagattccaagagtctcattaaccctttataaaccatcttctcccagaaggaaagaggagagagtggtttacagcagcgatccccaatccctttggcaccagggacaagtttcatggaagacaatttttccggggactggggtggagtagggtgatgctttcgggatgattcaagagcattacattcattgtgcactttatttctactcttatgacatcagttccacttcagatcattagtcattagatcctggagggtggggacccctgatttacagagactgctggggtccaaacacttcataggggtttcctcttggcctccgagtctgtggtttttctatgggtgggtagaggatcccccctccttctctcctctctgccctctgcttctgtcctttaaagcctcaaacatcatca

SEQ ID NO: 39827 - DNA, 994 bp, Bovine  19866881045670
cagaactccaacatatgcattaaggcaagggggtgggtacacaatttagcccatcacagcctgtctttatggaaagtttccaaattaaatgaaagaataaagaaacctatcccaagcttcagagccccgtggttttggggggttgcatagaaagacacggttagatctaacatgtggtttaattttagggactgcatgcttcttgttccccaaaaatacctcacatgccttcagattcccttattagagcctcatatttttttacttatatcaaacagaggctttcttctgttaaaatgcaagcagccttagatggagcctcgcctgtcactgagactttagtagaaccatcacttccttcctaagagtagttgcagatgaaggacagatgactgggcacctacagggactgggaggaagtgaaaggaggatcgtggagggagacaagaggaacagagaccagaagcttgggtctgagaagacagacctcactggcttcacccttcaccctggataacagaagagactaaacattcatgccacaggccatacggctagagttgtttcggggaagtggttgctcagagactatattctctatcacactcccccttgcctctaagtgaggccatgtgatggatttctagacagtggattgtgagctatgatgtactatagttcaagaaagcaagcatgcatgttcagtcaagcccaactctttgcaaccccatggactgtagcctgccaggctcctgtgtccattgaattctccaagcaagaatactggaatgagttgccatttccttctccagggcatcttcccaacccagggatgtaatcctcttgcatctcctgcactggcaggcagattcttaaccaccagagccacccgtgagacctggcctataaaaatattctacacagcttctgccctgccctcatggcaaaggactctgaaacccaaagaaatagcagagccacaaaaggaaagagc

SEQ ID NO: 39828 - DNA, 1793 bp, Bovine  19866881087555
gactacccaccccagtgctcttgcctgggaaatcccatggacagaggagcctggtgggcttacagtccttgggttcacaaaagagttggacatgattagcaactaaatgaggagtgaccaaggtgggagtgggaaggcacgtcacttattgtccaaacaatactgacatagaagagggaagaaggaaaggaaagagtagtggaaaggtctaatattgctataagtcaaaaccatggcgttacaatcagaggcaaactttgataaagattgaaaagagtttattgcgtggtacagaggagatacatcacctacatcctgtgggccaaatatggcctgttgaccttttctgcaaatacagtttattggctattgactagggcggcttttgttttacagtggcagagctgagcattttcgacaggaattgtatggcgtacaaagcctgacatatttactatctagtctttcacagaaaatgtttgttgactcatgatgtagcagaaagaacacattgttctaagtcctgggtccaccactttgaatccacactagcttttataatctaattttcagagtataatttctcatctgtgaaatggggtactatatgatagagtgccaactaaccacttaactcagtaattatgatcatttatgatgctgaataaaatagtgaatgtgaaatgcatgctaagttgtaaagaattatacacatactaaatattattagggttgttttaggagtatctggcaaaagagaggagtcaaagaaagttgttttttcctgaacagaggtaaagaacaaataataagtgattgcaaagcacacatgagcctttttgtttgtgtcagttaccgtgtggttctgaaacaatctaaactagattattaaagttatggagaaagaagtaaaaaccacaggcttgatgataaattgaagaaatctttttggtgtgaagtacaacagtgtattatggccaccagatgggaaggcagagtgggactttgggaaaggaagaataagacgacaaatccaggtaatagtgcatggagtagctttatactaacaattatacattgtttatctgaaattcaaatctagctggacgtcctgtgtttttactttctctatctggcaaccagtcccccacacagtgtagttctggtggggcagctgatcatagagctctgctcgctggtcacaaagattgtgcagattctaggaaactgaatctttagcagagatgaataaggatagagctgatcatctgatggcaatattctagaaagaccatcagagttgctttgtttcatatgggtagtttagcccttcttttaatctacccctttctgtttcttaaaccagagttggtttctgttgtctgcagtcaaagagccctaacctatatacatacatacacacactccagatagtttccaacaaaaccgctgtgaggatgggtggctggtaaagttgagggctgatgaaaagattaactagggacagctttctgacggaggatctggacaaaggcagagtggagtaggcaggcaaagtgcactctggacccagaatctggcgagtgtttacatttgctgtcctgtatagcaacagggagctactcagggctcttaagaaagggaaggatgtgataaaaatgacatttgatttaaaaaattatttccaaagctggcttttaagggttttgcctggataagacggccagcaggaaagctggctggaggcctgttctcatggccccatagactggggggtctcaggcccaggtggg

SEQ ID NO: 39829 - DNA, 1758 bp, Bovine  19866881140562
caggaagatcccctagagaagggaatagctaccccctccaatattcttgcctggaaaatcccaaggacagaggagcctggtggactatagtctatggggtcacaaagagttagacacaaccgagtgactaacactcacatttttttcgtatatgtatacatatataactgattttctttgctgtatacctgaaactaacacaacattccaaatcaactatgctccaataaaaattttttaaaaaagattgccaacttttgcatgctttgaggggaaaaaaaatcagtatttaattgtgacctttgatttcttttaattttttaaaaatacatgcaactttgaaagaaaaaaagtagctgctagcctgggccttccctgacctgaaaggtcacttcaggtcagaagtcctcctgtgccccagggagtccttgctccctgcaaagtccattagctcaggcttaatgccgtcttaaagcctgtggccctctttattagggttgtgtttgtcacctggtaacttgtttattgccccagctctggggtgggaaggggaggatgggcgtgaaggttacaagtaggtgggaattgcacacctcaggccagagcctccccttggtcattattttcccagaatgacctctgggggtggggagtaccaagccctccttgagctaacacatgacaagctggcacaaaagaactgcaaacaggcccctaattaatgggtttgcttagagctgttcctctgtttaggaacttcatcccaataattgcaggctccataatcattaatcagtcactactacttttctgggtgctgaccataggcccagctccattccaaccaccgtgaggccagaagaacagaaaacaggaattcagacctatgccaagggcttcatcgtgggagcccacgaatcctcatgacaatccagagaggagggtattattattcctcttttcagatgaggaaaccaagtctcaataaaactaattagctcaaggtgatcagctcatcagcaagaaaatcagaattttcacctgagtctgattgattccaaagcgggggctctgggaagcaacagactaactgttcaaaactggttcagaccacactggctgggttgtgccaggcacatcgtctagaccctaggagcccaggaagggaacatacagggaaggggtcctgagaggagacaacattctaaaggactggtagcgtgggctgggccctgaagggtggagagaatcatacgtgtttaataagttgtactcgggcactttctccaaccactaagtccaggattggaaaggattgtggaatctgtgcctcactcagggccaataaatgattagtcaaatgtccgaggaggacgtgtagacacactcacacacaggcacacacacgcagacccacctcggcagctccaaacagtgcctggaatgggcacaagaaaagaggacctcagcaggcagtgagacgttggcaacaggcaccggcagggattagggcgagggccaaacgcagagaagacgtggagccagcgagtcctgtgaccaccctgggcccgggaggttggcagctcctggaatgtctcaatttagaccttatcccagaacatgagaaatgccaggggcggaggagaggggccaggagaggatgaagagcagggactgactgaggactgggctctttctcctcttaatcagccacctcccctcctctgagctccccccaccttaccctcaaaacacaca

SEQ ID NO: 39830 - DNA, 1081 bp, Bovine  19866881164984
taatatatgctgaattgctaccatctttcaagtactgcttctggtacttttacaactatttccttattttatattgagtatagccctagtgctatgaactaggttctttttgttgttgttgactttgtcttatttgcttccattatgcagttgaggatactgaagctcacaaagggaaagtatacactaaaaacaacaaaaatcagaaccaggcttcaaatccaaggctctgaatctctaaacagaataaggaaaaaaatattttctcccccaccaacctaagttcatgttgattctgccctggtttgctgacaactgcattcataagatggatgaaatcctgtttaagaatgacaattacaaaaaatcttttatagtgcttttcaagaactttttacaacaaatacccagcatcagcaaaaaggaacaattctagaatgggggcagagaaagaaaagataaaaccttataagtaaacattaatagtgaagtcaaattgttatagtgatgatgtttaaatcagacacttttcaaatgtgcatttcctttgttgcattgctgctgccagcactatagcactgtattttttctcatcctctaattcctactgtatttaggaaagaccccagcagagtgcctacttggagcccatttgatgaatggcagtgctgtgcaagtgacatgggggagcagcatgtggtacagatacacccagggattggcaggagacaatgggcctttgtggcagccaccaggtcaggtggacacaacagatcagcttccttagacacaacagatcagctgccctcaccatgcaggtttgttgatactgtggaagtcatcccagcctgtctccaaaacagcatgatattgacaaggtttttagttcctgctgctgaatggactacactcagtgtctcctcagcttgcagcagtggtaaaagaactcttagcccagcttccgttatgtagggatgttggcaggtaggggtttccatggtagctcagctggtaaagaatctgcctgcaatgcaggagacctgggttcaatccctgagtcaggaagatcccctggaagagg

SEQ ID NO: 39831 - DNA, 1546 bp, Bovine  19866881191012
atacttttaattattgaccagaaaatagtcatatggccacacctagctgcaggggagactaaaatttctactactgtggctatgggtggatgactagatgtctctgtcccaaggattaaataagtgagtgtttgtaaagcaattagcacagtggcttgcacagagtagacactcaatgtgaactattgtttctacctcttagttaacatcaggagcagacagtatcaaagggaggatggggtgagggtgggaagtgagccctgtgctacttgttaaaaaactgttttattggagtatagtggatttacagtattgtgttaatttctactatagagcaaagtgactcagttatatgtatacattcttcatattcttttccgctatggtttatcataggatactgaatatagttatctgtgctatacaggtggacttcattgtttatccattgtatgtataatagtttgcatctgctaattccaaactcccactccatctctcctttactcctccctagcagtcctgtgctatttttaaagtgagagaagcttcttctacactccttgtgatggaggtatggaaaggaagtaagtttggccagagatgggaggtttacagttgctcttttaggtttctgtcttgaaaattggtgttttagagatacatagtcaaaacggaaatgtgctaccccgggcacagggtataaataagactgaaatgtgttctgatgtcttaaagaactttaatgtatatttacatagtgacctgggaatgtttttctactaaaaattctgagagagaattagatactatgtatgaagggctttaaactcttaggaggaatggagctatgcaaatctaaaggctgggcattattaataacaacagtagttttaatgtatgtcatgcactttgcccttcaaaagactgggatttaacgcgcacaaggcaaggtggtggaaacatgagttcccagtggggtaactcaccctttcccagtgattagtgcacctcctttatctggggcaaaatggaggattagcggccacttagttatctcactgatcactggcccagaaacactccccttttctctgtttccttttatcctctttgcttctcctctaccagcgggaaagaatacatgtccctttaagccccaatttccttttttcctcctttcaaatcctttgaggagttctggctcttgctagaggcctaacttcgactagcaaagccagtattttctcagagctcctgtttttcttctttgaaaatggagcaatagagcctgtccctggtgtatgctcggaactaggactctgatcgtgcgaggggtggaggggagaacattgaatctggaggtagaataagtgtttcctgcttattggtgcagcaattttgggtaagccatgctatgaaagtgcttcggcatccacaaggggctatacaaattttatcatctcacagggcagagtggcttccagctggccaggcaagtggcgatacagaacacactgtaatgatccacttacaaatgccagag

SEQ ID NO: 39832 - DNA, 787 bp, Bovine  19866881240058
cctgttgagaaataacactattcagagaggattgcatgaaggataagcagtccatccacccttccagatttcctaacaccaatccctggatcctgccagagcgtctgaaacacggatgcctggagtgcatcacgttggccccggcagaattgcttttactgaactgcttttggtgtgatgccatcagcatttttaaatgtaattacaagaaacagtcccatgaaaagcattattacgtttcgggtaagaaggctgttgaagacattgttccttacgtcacacagtgttttcattattaagtatcctccggggtaactctgaatttactactaaaaatattagtgcttctcctgggcaattggtttccttatccatggcatgatttttctagaggatactgtgaggaacactagggcaaaaggcaattaattggttttccatgaaaaagggcttccatagtaaaaaaaaaaaaaaaaaaaaggtaaaaatctacagggcaaatttgtttttgcttttaaagcaagacttctcgtcactaatatgcattacacatatattgttatgatataacatttatgtccctggtgacccataggatcataattagccagtgcttgtgttgggtccgaacatagagctgatgtggatatttacttgcttaaatcaccttctcttccccactctgagacttctgattgcactgcccagctgccctgcagccaggtatggaaacctttagaagtactaaaatgtgacatgataactactggttgagtctccttttttg

SEQ ID NO: 39833 - DNA, 880 bp, Bovine  19866881330856
tactcttgcctggaaaatcccatggacggaggagcctggtaggctgcagtccatggggtcgcaaagagtcggacacgactgaagtgacttagcagcagcagcagcagggggagatggtgggctcttaagatatgagatgcaaaatcaaagcaggatgaggctccaaccacctcactcttgccctggaacttcctctatcttgagacacactgctctccccaaatcatccacccaaattaggtcaaaagcctgaggaaaccgtcaagagacaaggtaggaacaggggtcagattttctctttcattgattattttctgatgactttaggtctggtctggttaagccgaatccatcactcttagggggtggtgggtgaggagaggtgcagatgtaggagtttacctaggatgtttaaaacctcagggcaaaaagaaaggcatgagaagctaacctgaaggagatgtagttgcatacagtaggggggatctaaagagcctcctaggtaccagaaagactaacatagtaagaattttaagaggtaagatgaaggtaacttgctgtcaaaggatgcagatatggctaaagaaacaggggaacttaattcctttctcaagccatataggtgaatggctaccagatggtcagacagaaatacctgtctacaggctgctagagaaaaataaataaataaatgcaggaagaaatcagatcctccaatgagcaggtaagcgggaaattaaaatatctgtacactgacaatgcaggaccacacgtgttttcaaagagacggttaggaagacagtgtgaatatgtgttagcatctgtcctctgtcggccagcctacacccagagagggcagttacaaaccccacagcactgg

SEQ ID NO: 39834 - DNA, 804 bp, Bovine  19866881368088
atagtaaagaacctgtaagtttgcctttaactataagcctactcactctgtttgagccttcatagaggcagccctgaatcccagatgattaagtgggacctgtgctttttgagtatctactacagttattagttccactgtggaagctgaggacaacaggaaattttgagcttagaaggtcattttccaaaatatttccaaatatcattaaagtgaatgctttattcctcacaatttttttaatccagtaaacattatagcctagatatcctaagaaatcaaaaattaaatttcttattagaaactatcaaacctaacaatggaatttattttctggtatgctgtgctgtgctgtgctcagttgctcagtcgtgtccaactctttgcagccccatggactgtaacctgccagattcctctgctgatggaattttccaggcaagaatactggagtgggtgccgttttctacaccagttatcttcccaaccagggatggaacctgagtctcttgcgtctcctgcattggtaggcagattctttaccactagtgccacctgggtccgatctttctggtatatttatcctatagaattttgaaaaccattagcaataccaaaagtattcatctcacgacattctccaaggacctacttcaggaagtagtagggtaaatagatcaagcaaagatgcaaattcattttatgaggttagataaaatttcattcattaatttcaacacatcatcctttgtgaaaatgtgtactaaaagacaaaatatacatttccaagtgaatgtcttgagt

SEQ ID NO: 39835 - DNA, 969 bp, Bovine  19866881445259
actgtctattccttacatgttttgttactctaaatataattcttttccaaaactctgagttgattttgaagcttctatttattgctgagaggatcatttctcagatgtttgtagggatgtactggtttatctcattaccagaaggcaccattaaaagagaaattttaatcattctgccataaggatatctatttttctaattttgcataatgaataaatcaatcacttaaatagcactcattaaataaccagaaggttctgtctctgtagcattagcatacatattaattcagatggatgaatactgttaagaaatatttattgtgtactataggctctgttttggagaggaatgaagagggataaaattataagcaaataaatatatatagtctttacctttgtgaagttgctatcaagcataggtgccatttattagatattatgaaataatgtagttaaaggtataaatattatgaacatattttgaatatgcctgatgacacacatgctgtgatagttatctatgcagcaggataaattactccaaaatgtatcaacttaaaacacacgtatttattatcttacagtgaaagcttcaggcttcccaggtggcacagtggtaaatcccctgcagtaggaaatggctacccactccagtattcttgcctggaaaattccatggacagaggagcctgctgggctagagtccatgaagtcacgaagagtcacacgtgcaattgagtgactgagcacacacacagtgaaatctgagattggcccagctggttggcactggctcagggtgtctcacgagactgcagacttatgctgactagggaggttgttagggaagttctggaactgaaggatctactttaaagaagatttactcacgtggtttatggcaagagggctcagttccttaccacattggcttctccataaggctgctgaatattctcacgg

SEQ ID NO: 39836 - DNA, 1104 bp, Bovine  19866881449843
cccagcctcaaacccactccagcttgagctgttaacaagagaagcaaacaggtggacagtaaccaaccatgaggtttgtaatagatgagccatctcacacacacacacacacacacacatgcacctttgagcatttgggagctacagtactggggtatcctcttccatcatatttttcctattgctcctttcccaggcaggatcctctgagctagatccatggatgctcacagatcctgagccaatgctgaccaagctgggaggggatgcgggagtggagtataaagtttgaacacacctgatggcttcaaataatgtcaccaggttggttacaattgcttggctcctatgttcctcctgatttaccttcaagccagatgaccaatgaggtgacagatattttccccagaccactctcatttccctcttccaatcagacatgtatctggtgccctctggaatgacctggaagagctcccattactgctcatgttgcctctgagtctgagctctcccttccctgctccagaatttgcccatctagtgtaccagactccttctgccttgactcttagtccttaattttgcttagaattcagctctcctctgtatcagtcatctattgctataataatactatgtaataaatgatcctaaaatcttactggtttataaaaacagttaattttctcacttacagtctgtggattggtagagtgctctgattcagcctgtggctcagatacagatcaattccacatgctactcattggggggccaccagctccctgaggctggctcatctcattatggatggaagaagcataagaaaaagctagtagaaatttcccatgacccttaaggccttcactcaaaactggatactgtccaatctacccatgtccattgtccaaggcaagtcaactggccaagcccaaagtcaaataaatggggatgcatgatcgatccactgattctagtagggtatgtgcaaagtcatatggcaaagggcatggataattctattacagggaaggtgcaaagaattgagaataataacccaatctccaatatttctcaaacaagaatgctataatgagctta

SEQ ID NO: 39837 - DNA, 1147 bp, Bovine  19866880421029
ctctgcatatctgaggttattgatatttctcccggcaatcttgattccgcttgtgcttcttccgctcagcgtttctcatgatgtactctgaatagaagttaaataagcagggtgacaatatacagccttgacgtactccttttcctatttggaaccagtctgttattccatgtccagttctaactgttgcttcctgacctgcatacagatttctcaagaggcaggtcagatggtctgctattcccatctctacaccccaagaaagcccggcctgcagaatggcccctgaggagggtccacagcaattgcccagtggaatttgctttctgctctcatgcacttccatcctctctcttcaattagttagacagcagagtagcaactcaatcagtgtgttccaggagatcacactttgggaaggctagcaataaattaaattttcattttagacccttaatagcccaatcaataatttagggagcaaagaaaacattttctgggaaagcattagcttaaaactgaaaagtagctgcttcatcccttggaaatgacacaattttagtaagggtggggtagagggagcagaggctgacaaccacacttcacatattcttactccttctatctttgtatgtctgtctatctgtctctctctctctctctctcactttcactctcccttttctctccttatttatgccctttccttcctccttcctctctcttatttagtcttgcctctttcttgcccccactatactttggccacctgatgtgaagaactgactcattgaaaaacaccctgattctgggaaagatggaaggcaaaatgagaatggggcagcagaggaggagacagttagatagcatcaccaactcaatgattcatatgaatttgagcaaactccagactatctcctggaggacacaggagcctggtgtctgcagtccatggagttgcacagagtcggacacaacttagtaactgaaccattactactactactactaataataataatgttttgtattttctcatcttttttaatattgtgcttgctggtgcaataactaattagcattgtaacaaatctgcagctatgaattattttttcttggaaacaaatcaaaaccattacccactaat

SEQ ID NO: 39838 - DNA, 2824 bp, Bovine  19866880706597
tttttctatgaaagaaaaataaaattctctcttgtttaaaacattttttgttatagctaagtatatagcctaacccatgcctcctgtagccagtagcttactcttccatctcaaagaaatctggaaaaccccctttgttactataacatgtggaagttatgaagttctgtgttttaccatatatttataaacagatttggacacaccgctgcactaattattagctctcaggaaatataaaatgaaaatgatgaatactattacccacatgtctgtaaccacagggcaagtttgatcctgccctaccttggcttctgttggaaatccaatgtatttagagctatgagtttaaacaatgtaaccactgaaatgaccaatattgccaataaggggggaagtccaaagctggccagcagggaactcaatgtttataatggaaattgccccaggtgaggttaaaaagcaagagatacatattgcaaagcctttgtggaattagcaagtgtgcaatcagatgtaattacaatgccttaaattaagaaactgcccatttctgcaattaaataatttcccaaacaaagtcacttaaacagtatacacttgcaaagtccttgtgtaattgtatcatttatgagggcatcagaaagactgcaaattttcaagaaaagaaatcacaacacaaattgaattaaacaaacaaagaaaaataactctttcctctggaaaactgggtaaggcttcaggaaaagcttgatccaacagccaagactgaccaaaaactggtttatctatctccatttctggacacattttcaggtgttggctacaatctctaaggcagtgcccccatcccacctcccatcttgggatggagaactacatgtccctttatttgtctccattaagaaagagtatgccacccaatcacaacaaaaatcgggagtcccagtgtgcctgaactagtgtcggtcatacatctgtccctgagcagaacagatgagagctgagatacacactgtatcttttttgggtggagtcaatatcttctgaaacatggggaagtgagagagatctgcagcataaactgctagttccttttcctcccacacagccaactagaatgcatttctgacttttcttgcagctatatgtgatcatgtgacagaactgtagccaatggtatgaaagctttgcccatgacacacttccacatgtgatattctctcttttcctacttaactgttaaaaaatgactctaaacatttagaggagggcagagtcaagaagatggaaggagtggagatttccaaatgaggaaatagaagccactttattaggactacctgcatcacacaatgaaatgagtgggaagtatattttataatacttaggcagtgaaattagactgtttatttactgcaacagtaagtattactttaactatgatactacaaagaatactagagtgatgtttctaagagagggtcaaacgggagtaggacagcccaaaataagcaatgtccactgcaacaatggtttttaaacttggggttgtctttaaataaaatagaagcaattgtgctgccagagaaatctgagtctatgtgcattttccttcttagaagagcattgtgatgacttcgccacaaaccaaataaacaaagcagcaattgcctcttctactataataagcctttgcaaacatgccctgcatttgcacatggcttccttaataaatggatgctattttcttatgttcaccagcagtcgtatcaaacaagagatgcaatttaaatttgctctacatctcagggaaccactcttcactacaactagcattatctaaaatgaaaaatgtcatttttgtaaaatctcttcccttcaattttgacatgtaagcagaaagcaagcaaaagaaagcaaaaacaagaggcatagagaaggtagtagagaagaagctgtgaaaaagttccaaagccaatgagaaaggcaagtgagaatgactggttgaagcccaagtcaattaccttctatccgaagtgaaatatgcccagagtggagtaagactggtaccaagataaaagtatgagcaggtgttcaaaaaaagagatcagaaacagacatgccagacagacaagtaagcctagagagttccttcctttttaactggataaattctacttatcttgcagggttcagctgaaatatcacaaccttaggatagatttggatgacaatcctctcctcacctccatgtagttatttgtcctcttaaaataacttaatgacttttactcttctcccaaagttcttctgtatattgcaattaaagacttttctgtgtaattatttagtgcctatattcccatctagaatgaaagttctatgaaggcaaagaccatgctgacttcttcatgtgtatatttccagggcctaacacaatgcttggcagatagtaagaactcattaatttgaatggctttctggtgaatggtagggccaagtgcctgagtacatattcagttcagttcagtcgctcagtcatgtccgactctttgcgaccccatgaatcgcagcacgccaggcctcccagtccatcaccaactcccagagttcacccaaactcacgtccatcaagtcagtgatgccatccagccatctcatcctctgtcgttccgcttctcctcctgcccctaatccctcccagaatcagagtcttttccaatgagtcaactcttcccatgaggtggccgaagtactggagtttcagctttagcatcattccttccaaagaacacccaggactaatccccttgagaatgga

SEQ ID NO: 39839 - DNA, 2946 bp, Bovine  19866880727544
atcctgggaaaaatgaaaccctttcaagtagacatggaaatcacaaagtctgatattccacaaggtggtgtgcaatcttatggacactagaaatatcatgtacaggtcatcagtaacattaatgatatttccctctgggtgctttctgacaacactggcttgtttcatcttattatcacaatgaaacagtatgaaatgttaatataagaatttgttttagctatatatgtaaatcatgttacaagcaagttatttggttggttggctttttagttcattccttcagtcaggtgtttcaaaagaaatgtttttcaaatatcctctttatgcaatcccaaggatcagtttagaaggaaaaatatttggtaaaccattcctggtgtgctgaaccttgcttctgttgggcttctttgggttgggctgtatcatcatcttgtgtcctaaaaacaaacaagttttcttagatggttttgaaaactattcagtaaacaacttaatatgccatcatcttttcagggaaagataactaccactttactcttaaaaagatatagaatgtgatgggttgatactggtagctagaaacaagttgtgaaggatgaagatgaggagagagcatctaattccattgtggaaacaatgctccccattatttcacttaaaatgaatgaggcatattttgcaacatttactatttaaaagaaaaaatatatatataggctgagctgggtcttggttgctgatgggggccttctttagttgtggcaagcggggctactctgtagttgcagcgtgcgggcttctaactgcagtggcttctcttgtggtgctcgggcttagctgcctcatggcatgtggaatcttcccagaccaggaaccgaacccgtgtctcctgcactggcaggtgggctcaacctctggctcccagagaagtccgaaacatttactatttatttcaggcacaaattaaataataaacccctttcaaaaaaaagtaaaagaagaaatggttaatgaatataaaattacacttatggcctcttcaaaagttacctaatgtgctctggcctttcagtgaggctgtgaaattagtctaataaactgaaaaagagagatgataagtaagtacagtgtgtacctatctgaaaagtctctatctgtacttgtgaagcttcttataaaacagtgggaacacagctttagaaaggtgtgtgataatgagatgaacagtggccaggatcaggctggctctggctctggcagttaatagaccatgtgcttgggattctaggcctcagtgtcctcagcttcgaaacaaagggctggacttgctcaatgactggcagggggtccttccagctccacattcatttttgttcatagtcttgggcaggcagggcctttggaaaaggaacatttcagaagaggcctcttctgaaaagcaaactcaagagtccataattcaagatttagctctgaacaaaaattgggcaagaaggaaaatcaataataggggaaatcacacatttctggaagagaagcatgctgtaagggtttctggaaaacaaagcagtatcagagagcaccatacgtgatcaaccaaacccacagattaagaataaaattacaagattatataatgaatattgagaaataaccttttaataatagtgggaaattgctgaatagttctatgccaagtcttgtgctgagcatgttctatggattaattcctttagtttcacatgaatctgaagaggtaagtggtatattatcttcattttagaggtgaggaaacagagatgtcaagtgagctgcccaaagccacacaagctaagaatgaggaggaccagaatttgaatccagactcaaggccagatgatgacagcccattgtttgtgtgaaccactctgaagtcattggctaagtgattcagtgtcccctgtctactcatcccatggaaaagaaaaaaaaaaaaaaaaggttttctggaatttgttatcaggaatagtatctcttctaaagaatgacctatttcccttctcatagataatctttctttttggctgagttgcaatttgtccaaagcaaggcttgttttgttattctttgtatcagcccaaatgctgggtatttaacaggtgccagaaaggaattctaatttccctcttgtctacagaaaaatggaataatagctttggccctctgcgtgcatgctgagtcacttcagtagtgtctgactctttgcaacccatgtatcatagtctgccagcctcctctgtccatgggataatccaggcaagaatgctggagtgggttgccatgcccttctccaggagatcttcccaaacccagggatcaaccccgcctctcttacgtctcctgcattggcaggaaggttctttgccactagcaccacctgggaagcccagctctggccccctaccttgtggcagtttgcacatctagagatggcgtgggtttgtagggccggccacagctgggacctgggtccaagctgggtgacttagttatcggaggggcattgatcctggagctcaggtcaccactcagaaagttcttagcataggaagcgaggtttggcacactgaccactcggctgggcacttcctccatcttctttttctgttggtattaaaagaaaggcctgttagtgccacctaaaagaagcattattgtaaaagtaggtaagcctgccatgccagaattatgtgagccagagacaatacttttatcttatatattgcatgttgttgtgctttaaaaaaggctcacaatctctatccaaaacttctggcagcaaatgtatgttttcatttaaagtttttagattttaaaaggcaccctcagcagaagctggcccacgctgtcctcaaatacattaatatttctggaggaaccttacatttgtcacataagagggat

SEQ ID NO: 39840 - DNA, 2031 bp, Bovine  19866880732894
attttgcacttttaaattattgctgtgtccttgtgtttttatgacatgctaaccattatttctgtgatgtatttgttgacaaatccttggtcgaaagtacgtcaattataacattgtttgcataagaatcaaatatcactttataacatgtgtttttaaaaatacactcaaaaatacattcaaatttggaggctgcctatatcctaaattcaatttttgagatcaggcactaagaccttgacaaatagatatttgcccaaataaaccaaagcatgacatctgaagcaaataaggaactgaatgtccttaaaattctatatatcatggctctgaggttgtgtttattataatcaaatatgcatttttctttgtccccaaaggagaaattacctcattaatgaatcatttatttatcattcatttgatgagcatttattgcatagtcacaaagatatgaacaatttttaaaatgtcagatgaattaatgatgtagcccctgcccttgaagatctctcagaaataaacattccctgggtcaggatacaatgtcaaggagagctcatcagaaaaacagaaatagcctagtctctggctggaccaccatatcaactctgaaatgccaacctccaaacatttaagtagaaaaataaaactcctaattagtttcagccattttgggcaagtttctataattcatggctgaatgcattttctaacacataaacatcactgactcatttgtagcccaaaagacagacttttttttcctttgggcagaagcaaaggtagaaatgtgctataattttgaaaggatggtaagaagctgggacaggcttcataaagcactggaaacttctaaagtgtgacttgtaaggaggcttaatatctgtctagaagcaaagtgaaggtcaaacgtctcaggaaaaagcaaaggcagaagtgaggtcgtgaggtctgagagaacaaggctttgcaggaacactggctgtgcctggtgtggctggtatgcagggaattgccagcggcagctattgcctgaaatgccaagctaaagatttgggactttacatctcaggcactgaggttttgatcccgagtagtccaggaccgcattgcgttcctcctcactggtgctaacagccttgatgagagagacctgagcactgtgggatagtgagggcttgggactgtggctcctagaaaggcttattaaggaatggcccaattgtcctgccaaacagaaaggctatacactccgtacagttacagcagcacagcacctgccatcacctagcctttccagaggctgcccacagtgctgcctctcagcttctctaaatatgaagtttgttccttttcagcatatgggataaatcagactcacatggtcatcccactggaaccaactgacgcacacaggtctcgatccatcaggagaccagcactattgtctaaggaaaacagagtgtcagattgtccttatttatgttgctttctctgtatttgcttttcagtttgtaatctctaactttcttcaaataaaagaaaatagagcaaacatttcttgagcatctactgtgtgccaagcactgtgctgagaatacagagaatttcaactttatggtgaggaagttggacacaacatttaggtcaggacagtataatttggggtgagacacagtaaatagggttgccagattgtgcaaacaaaaaggcaggatgcccagctgactctgaatttcagatgaacaaggtgtcatttaacttcatgtcccatgccttatttgagacatactctaaaagattcattgtttatctgaaattcaaattcaactgggtgtctaatatttaacctggcaatattaatagcaaacaatttgtataaagaaaaggaaactatgaaaaaaaaaagatattttttgtccctaataggggcccaaaagagtgtcatagtagcttccattattgaatgcttattcagtgggaacacccgactacaactaaacaaattccatatttctaacactcatg

SEQ ID NO: 39841 - DNA, 1853 bp, Bovine  19866880762126
cctaactgggtgagttaaactgtgatacgaacgtattgctgaaaagtatctgcaaatcagacacttaaaatcaacctgatagatgaaggctgcttcccaaatcaatggggagaaatactcagtaatttttctgtttctgttcacttgcttccagctccctggaaaccaaagacaaggatatccttccccccaaaaggagatgagtcctctcgctccctgcaaatatggcaacccactccagtgttcttgcctggagaatcccagggacgggggagcctggtgggctgccgtctatggggtcgcacagagtcggacacgactgaagcgacttagcagccgtagcagcagcagtgttcctttaaatcatcctctggccaaggctaatttttgaaggtgttcctaatccagcttgaaacagtaccctcagctccattcattcagctggcatgtcatggatcagttaatatacaaggaggtgcaaacatctgccacatgtgggtatgttaggtgctggaaagacagagattaataagagatataattcttgatttcaacaaactaatggttcagcagaggggaccaatagaccacataaatggcaagcattcacctccttcaccacccccaccttctgtacctcgtattttgggtcaaagtgtatcattccaaaggaagtggggtgccatctgaatatttctcaaatgaacctgaccgtggaaatgaacagtaggctgaaagagcactttcaagctcaccaatactcatttctctgaatttcaaatagggcagactctccagcatcccttttctggttttctgcttgggatcccagtgagcgcctcccaggaccaacactgagccactctgggtgtatcctgagttaatcgcccctaatatacgctcttgcattccccatcaggcatttctcaggttctgtccaggactctctccatcactaaagtatgcacagaaaataaatagctctgcttctcccctaaccatccactgcaaaagcctcctcccaactcctcccaagcaaatggctggttattttaaacccacagtcacattaggtcttcatctttcatcttctaggcagtgaacctcatctgggttgtttctattttaaaggaacacccacgcccaggaaatcttcaggaaggaaatagtgaaagtctttctcaagttcatttgacaatttttcaaaggcagcattatgtgcatcttaaaaatagaacacctaatgcaatggggttttgctgaaatgattacaagggagtgtaataggtactacaaagtcaccttacattatagactcttttaacagttttgaaaagtgacttcatgtgctttcttccgtttattacaagtctctggggtggaggacaggaatcatgtctgccactttcctaatgaaaagcagtacagaactgtaatttggacactggtgttcctctttgggcctcagtttccctatctgtaaagtgaagataataatacttgcctcatagggttgttgtttgggactgtgtacagcactatgttcttggtacttgatctgtttgccactagcaacagtgaggaaactgatcccagagaggtaattatgtaatatttactttgctctctgaagaccacccttactcatctagccctgggcctctcttaacaacagcactcagaaatagttgttgaggcgaaatgacttgaataataatgaccaccagtgactttcctgtttcttctggagaaggtgcaggcaaggatctatgaaaacttcaccgcttctctgtccccggctcatccagacaccagaaacttccacaaaaaaagtttctgtaaaattaccaaga

SEQ ID NO: 39842 - DNA, 2927 bp, Bovine  19866880775971
tgctgtacagtatatccttgtagtttattttataaatagtagtctgtgtctcttaatcccttatctctgtcttatccctcccctctcttctctgataaccactagtctctactttatatccgtttgtcatattcattctttttattttttagattccacaaataagtaattaacagagtatttgtcttttgtctgaattatttcaaattatttcagacaaaacactctctaggtcccccgacacagttgcaaaagacatttttcttttcttagtgttatgtactaccacatacgccagaaattttaagatcaatatgcagcctctctattttaaagaaactatcagaaggattattttaccaaaacaacagtgacctgcatgctagttactacccttaccatccataggctaatatactcacccacctgataatctgggggattcttggcctgaggatttaacccacttggtcttgtcaaatctacaagtaactcagcaacattagttatatctatttcagctagaggagatgacgcaggggcattggccagtgtttgcagagttggaagaaaggcttcttcaaaacattcctggttagtcctattgaaaaacaattcaaggtatgttaccaaagaaaaagcatatgattctttaaaaacattatatgcaaaattcaccttatcaagacatactacatgtttatctaggaaagagccaaataattcaggtagatagaatctaggtaaattcttctcatttaccactgaagaaaaagaaaactaacagcaaaatactataactatgactcatgaggagcctggattcaatttcaagctagactttggtttatcaatatgactaaatacctgcttgcataagcaaacatggggaagaacacgccgaggcaatgtcgaagtcgaatgtcctcttcagtcacagggttgtaccataacaagacaagatgagaaagaatcctgctgctgaccaaaagtccagagaacatcagcttggctagtccttctgcagctcctgttctgagttcagacacctattaaaaatgactttcattaaaagaaaatttttatttgtattaatacctcccttttaggccttacattgtagcccatcctacagtacttttatataaatttatccaaaagcattcatgttattatgattatttaaaggcacataagaggattttatttcttctttttaggttaaggctatgtgacaaactattagtctagctataaattccctttcaattcttcagaagaacaaaaagaaccaaaaggtaatattgtgaaaccagaaaccaaaaccatatgtattaaacacttaccatggtgctaaaatatagaaaactttcaataacagtctctaccatcagagaaggtgtctataaatgaaagttccagaggcaggagtggcattatgtgtgaataacatgtaaaatgtgaatagaaggtgtacaagaagaaaaaggcattcctaaaaaagggtaaccaaaacaaaactagataaaaaaatgaaaaagaggtagtggtattcaaacagagatacaggtataaaagagtagtagtttaaaatactggctattaagcctgaattaaattcaagcctctgatacttcctagctgcatgatctgatcttatgcgtattacttaacttctttgtgactcacttttttcatatataaaaaatgggataacagaagtacttatcacaaaagacaaagaatatatgtaaaactcttagaagtgccatccacatagtaaacccttaacaaatgtcagtgattatttttattacaaatagaaagtaagttttcttagcaatcaggttagagagaccttgaaagttaggtaaagaaattcaccctcaatgaggtaggatatcgttgaagatttttgaaagagtacttagacaaatgagatttcaggaaaattaggttgacaggtcatagattatttaactagattctgtgatgtatatgcagactacatcatccgatatgtcaggctggatgaagcacaagctgggatcaagactgccgggagaaatatcaataacctcagatatgcagatgacaccacctttagggcaaaaaaaaaacagaggaactaaagagccgcttgataaaaagaggacagtgaaaaagctgacttaaaactcaacattcaaaaaatgaagatcatggcctccagtcccaacacttcatggcaaatagatggggaaacgatgggaacagtgacagactttatcttcttgggcttcaaaatcactgcagatgtgactacagccatgatattaaagacaattgctccttggaagaaaagctatgaccaacctagacagcatattaaaaagcagacacatttctttgacaacaaaggtccatatagtcaaagctatggtttttccagcagtcatgtggatgtaagagtaggaccataaagaaagctgagcactgaagaattgacgcttttgagctgtggtgttagagaagacgcttgagagtcccttggatagcaaggagatcaaaccagtcaatccaaaaggaattcaatcctgaatagtttgcccaactgatgcaaagacctgattcactgaaaaagaccctgatgctgggaaagattgaaggcaggaggagaaggggatgacagaggatgagatggttggatggcatcactgattcaatggacatgagcttgagcaagctccaagagttggtgatggacagggaagcctggtgtgcctgcagtccatagggtcacaaaaagtcaagacacgacagagcgactgaacaacagcaacaatgctgacaggccataatctgggaatgaaagacaagtctaaactagagggggcagaagggaaatccagtggaatgaggaaatacaaaaactatttcagaaatat

SEQ ID NO: 39843 - DNA, 3081 bp, Bovine  19866880799119
gtcgtgagaagccagaacacgtaaccttccttttggctgttgtaaggctctgacttgtcctgcgtggttaatcatcagaaggtttggaacagtggggagacatgatttgactgacttttaacagaccttagatggcaaagtagaaacaagggtcgaggtcattgtaatggttcaagtgagatgtattcatgactcaaattaagggtaggatgggatggtgagaaatggcaagattcaggattagatgttggaatggctttggaatgtcagagacagatttgggacacagatagctgtaaactttttattctggtaaaatataaataacatagaacttgtcatttttaagtgtaaagttcagtgatgttaaatacattcaccttgttgtgcagccatcaccaccgtctgtctcgagaactttttcatcttcccaaatgaaaactctgtactcattaaacactagctccctagtaccctcttcttgcagcccctggcaaacagccttctgctttctatctctgtgaattttactactctaggtacctcatataagtggaatcatataccatatctgtccatttgtgactggcttatctgacttagcttaatatctttaaggttcatccatgtggttgcatgtgtcagaatctttctcttcttaaagctgagtaatatatcattgcaggtatatatcacattttgtttatccatttacctatcaacgggcacttgggttgtttccacattttggctagtgttaataatgctgtgaacgtgggtgtacaagtatctattcaagttcccgttttcaattattttgaaattgaaattccaaaatggaatagctggatcacatggtaattctgtgtttaattttttgaggaaccaccacaccattttccatagcagttgcactattttatgttcccactcacaatacagctgcaatttctccacatcctcatcacttattttttgttttttgatgatgatcatcctaatgggcatgaagtggtgttttcattgcagttttgatttgtattttccaaataattagtaatgttcagcttcctttcacatgtttattaatagactccaaactttgacctaagcagctgaaagaaggggttgccatggagcaagatggggattaatgtacaaagagcaagttttgaaggaaaaatctccagaattaaatttgaggtacatattaggtaatggggatattgataagcaacaggacataaatctgacattcaggtgacaggtccagcctagacatataaatttgacagtcactaaccaaaagagcgtacataaaatcatgagattgaatgagatctcaagaaaatgtttgtagaggagagaaagtctgaggcctaagttctggggcccttttatttgaaggatgggagatgaggaagaacttgccaatcagatgagaagcaccatgctgagcatgtagtaaatgctgtaaaaatacttaatgaaagaatatcaccagtttttttataaacaaatttatttttctgtttcttttaatttggggatccaaaaggatttgggtttcaatcctagcatctgtacttttaagcattattttatttattttattatttatttttagcattgtcttggcaataataatggggttccccagtggctcagacagtaaagaatctgcctgcaatgtaggagacctgggtttgatccctgggttgggaagatcctctggagaagggaatgacaatccactccagtattcttgcctggagaatttcaaggacagaagcacctggcgagctacagttcatgggtttgcaaaaagtcggacatgactgagcgagtacacttcgcaataatagtaaaaataatgacagaatttcttgatgtttactttgtgctaggaatgctgctaagggtattagattcagtgtgtcattttaatctccaaataagtctatgaaataggcatttctctcccaagtgacagagaatcagagaagttcagtaatgccctcaaggttacagagttagagagaggtagagctacaggtccagcagaatccaaagcctccttttaagcaccatgcttttataaaccctagatgttaaattaaccccgcccaatgtcagtttcctcatctgtaaaataagaagtatgagaatgtccactttgtaaaactgttaaatttattgacaaataatgtatctattacctgacccagagaaggttatattctgagggcacttgataagtattatttcctgttttccttttccattttacttctgactcctgctgccagactcaatggagactttccataggatctgatgctcagaattcattaattatagctttgttaaacctacagtgcgtgcatgtgtgcatgctcagttgctcagttatgtctgactctttgtgaccccatgaacagtaacccaccaggctcctctgtccatggaattttcaacctttaagaccttaacaggtccactgcaaacattgtctctgaaatcaaaccattagcggtggatttctaaaacccttgggaagacattgcaacttgctcagtattgctcttgactgctgaattattcatgtcccttgatggattctgaagttgacttcctcctgagaaggattcacaaatgagacttgggccagctacttgaagtttcagttgagtaagaaggtggtgagtgaacaaaagtgagcaggtggcagaggaagtgttgccaagtggcctgtgaggcaccaggagcagaagggtgggtatattcaaaatctactcaacaatttcaggtgctgagggtggggtggggtgggagggtgggccagattatgtttccaaaaacaaggaatatttctttttgaggacatagtgtgagaaagaagaagaagaagaagaagaaacatttaataagtacctattttgtgccaacacatatttagatgtaatactacttgatcctcaaaaaaaaaaaaacaaaaaactgggtctgggttatctctctcttacaggtaagaaactgaggcttcaagaagtgaaataacataagcaatcttaaaaagag

SEQ ID NO: 39844 - DNA, 1276 bp, Bovine  19866880813029
tatttgtggagctcatctctttatgttagatttatggctactctgtgatttaatcctagtatttctttttttagaattgaggagttgttctgtaagctctgtgtcacaatatcattatttacaatgtggtgctttttacaatttgatttttttttcctgcaatcctgtactgtgctaactttcgagaaggttcatctaacaaatatttgagtgcttgttggatataattagtagtatttgatccctgggtcgggaagatcccctggagaaggaaatggcaacccactccagtattcttgcctggagaatcccatggacggtggagcctggtaggttacagtctgcgggatcgcaaagagttggacacgactgagtgacatcacttcacttcactcagcatgatattgagtgataatagatatagacctggattgtatgaaatacataattagtatctgataagtcataaaatttaaagcaaagtctaggataaaagaaacgcattaatatatttttaaactttatcaggacttgtatagtctattaggatatttgatctgggaaatgcaagttttttgttttaacttttaattttgatataatctcaaatttacaagaaaagttggaagaatagtacaagggactcctctatatccttccccacattcagcaaatgtattacattttgaagtatttgctttatcattcttgccctgtatttatctatatctttttttttctggaccattcaaagggtgatttggagacatgatgcctctttatccctaaattcttcagttatacttcctaaaaccaaggacattgtcttgcctaaccatagtatagttattaaaaccaggtaatataacattgacatactttaatattactgaattcataattcatgttcattttgtcaattttattttatagcttttccccccagcgaggatcatacattgcatttggttgtcatatttctttagtctctttaaatctggaacatttcctcagcctttcctgtatttcttgaccttgacatttttgaaaagtacaggacagttattttgtcgaatgtccctcaatttgaatttgtctgttgttacctcatgattagattggttatgcatttttggcaggaatatcttctgtccttcttaataccttgtatattaaggttcatgatgttggtttgtcccaacgttggtgatggtacctttgaaagtttggtttatgtggtattctctgtatttctccctaaaagttactgtttgtc

SEQ ID NO: 39845 - DNA, 2089 bp, Bovine  19866880828615
aacatgtgtatgagacgccccaaagttatattctgaaaaaagataccaacattccagcataatcatcaaaataacttgtaagaaaaagcaaacttttcacacaaatcctatatttaaagatgccttccttccaataacatttgttaagcgaccatctgtttgcctttgattatcatctggaccactaataagcgagtttaatctgagcagtgttatttgcatgctatttctaaatttagtgcctttcaaagaagtcagcaaggctggcctccaggaaatattgcctttgatgtaacatctggttttcagggaatttctgtgtagtgcccaatcagagggcggactaaagggcagagaaaccaagtgacttgcccagagtcatgtaagtagttactgacttaacctggattacctgcagtttctatttgttgcttaaagtcctagcctgcttatttccattctgtaagttgtatagagactgtacacatagatatagtcattcccctcccttcatgaatagatgtgtgtggatctttacgactaattacagatttatttgcatctttctttttgatgtttcctccctgtaacttgagaagaaaggaaaatttcctgttatcctctgctttgttaaaaaaatgatttgaagtaacagtgagttgttattgattgcaaaatcttctttagaagtgaactgatctttttccttgcaaggaaaatggagagttaaattgtatggacaactcacttgatttgagggcaactggaaggcatcatcactggcatcatcaatgttcaacctttcccccttgtcttggcttctccatttttccctcctttctccttccctgggctggagatcacaaagctgtcaacacctcaaatgcaagattataatgaaagttcaaggttacgatgctttattataaaagcaattctttttgttactttactgagtcaatacattttataatcattatatgattttaatagcctttgatcaattataaaaatatattcaatctaattagttcttttagctttaaaggtattttcacacttaagatttatttttaatcttcttaggtttctgttataaaacaatttgcattttatgtatcttagaattgttttttcatcacctaaagatcattctagtttttgtacaggggaagcataacttaatatcttataaattaaaaaattaaaattttaatttgacaaattggggtttaagtctcagctctaccagctacatgaccttgggcaaatcactagatctttctaaacttcaatgtcatttaaaatatctatctcataacactgaaagaatgaaatgagattatatgtaaagctgttagcacagtgctctgatacacattaaaaggtcaggaaatagtcctcaattttctttcttttttttcccttacaaagtgcattagtgttctgtgcttgttcttgcctgactattaagagattttatgaaaatcacaatcacatgtgattgggagtgagtgggatcttggaaacttgagaaactgtgattagaagattaaatgaaatgaagtactagagacttctgtgtttggctggagatccatttcttttgctttgggtgatgctgccctcattccatttaagggagttccttttgctctcttctgagtaatcttcagagtacagtcaggcaagtgacaggccttcctttagccaagggctgagcatgagattcaaaccattgcaattctgccacctcttttttttaggactttgaatcctggtgaaagaacacaaatgcaggaaaattgttaaatcacttggggccctgaagtgactatcagaggtcagagtatgctgagtggctaagagcagagactaagccagatagcctgagttcagaccccttactagctaaatgaccgtaactaggacaagttacttaacctctttaggccaggtttccttatttctacaatggagtcattaatagtacctaactcatagggttattatgagaattaaataagttagaatatctaaagggtttaggatgtgcctgatacatcttaaatacagtatatattataat

SEQ ID NO: 39846 - DNA, 1361 bp, Bovine  19866880939028
cttaggaaaaatgtagctgggcagaggacaccaaagtggaatcctaactatctgctctcttttatatttcctgtgctggcataggcagacatgtttaaagatatgtgatttttagccagaggagtggaattgagaaggtatggttagagtctgattgaagaagggagagatggattgggaattccaaaatttctcccagtaagaccttgactggttaagactctgttttgaaagaatccagaaagagttcttcctgtttggctattgaattcatgtaataacaaagctgaaaataattctaagagtttctcattattaagcatcagaataaatagcattatactactactctcttatgtggttctgattataccttgtttttaacttaataataccttatgattccatagcacataacagtttcaaaatatttttacttagattatctaatttaatgcttatagtaacaatgtaaggtagttattattatctgttgttactgttctattatagattcagctcagtttaattccactgtacacttattgagcacctattgtgtgcctagcattctgctaggtgttgggggataatgtccttcatacttaagtgaagagtacacagatgagaacaagcaaaacttatttattcagagctcgctatagggaaggagtcagcaccattgcttgcatttggcagaattaaaaggcaagcagaggagtggggaagttttatagtgaaacagaggaaggtttcatctgtgccctgattggaggctcctgtcatgaggaggccggaggtgagctgtttacatgcagggcaacctatattattgattggtggagcataatcggcttattctgattggtcctaagttgaaagctgggccaaaacttagggaagctgtcagttattgatcaaatgctaattgttgtgggcagattgctacagaggttgtggtttaatttctggaactggttgttgtgggacttgtcattcagtatactatctatcggtggtctgtttgtatactttctctcaggtgatgagcacttaacaacatgagagtatgaattttagagtcagagagataaacattcaaataaatctcctgatgtgtaatctggagcaaattacaccatctctgtggacctgagtagccttatctgaggctacttatcttttggaggtgatgaagaaactggggtaaccagatctttaaccagctgtcctggagtcatgaaaagtggggtgaagaacttgagtttaatccgggtttttcaactctcttcagtgctctttctggtcatgactttcagagtttatcatcgactttaggaaaggggtgagcatagatcttt

SEQ ID NO: 39847 - DNA, 1042 bp, Bovine  19866880968298
attctaaagagagctaatagagaaaacaaaacaaaacaacaacaacaacaacaaaaaaatactaccgcattctcttcctaactgttgtaatgtttaatcctaggggcatggggcaggaaccacagaatgccattatccctttcaaatcctgtatgaaataaggtgaaggagcaaacaaacaaaattaataaaattacctttctatgcagttgaagcaaaaagatcattgatcagttagatggtttaggttgaaccatatgaaactgctatttttgtagatccagagtggtcaaatacaggcagttcctaatggttcagtgttttctattctgtctacacaatagaaaccattgaccttaaaactaacactatttgaacttattccttagcagcatgtctttactgtaaaagcatttggttatttggtgatatttttaaattcaaggaaatacatatttattattgatattaaattaatgtaattttaaaaatccatccaaaaccccactattcttacacaattattttattttctgtttctttcccagctctattcatatattataacatatcttccaaggtgaagcatttaaaaatttaaatcatattttcaaaaagactgcatagattaaaaaagtccaaagaaatcttcccttatccttaaattttgaatctataagtggacacacaatatagtggagctgaaacaaagccctttcataatgaaacctgtgagaaactttagggtggaaaatgacaccctctgatagcctccagtactctccaaaggcaaaaatatattttacaaattatcttaacgagctgagggacatacgtttccattaggaatgattgaatatccacatagtcaagcctgagtgattcaggaggaaacgagatttcttccccctctctgcttggaggtgaccccctctagtgcccttgttcatggtcttgaagtcctctagcaattcttcaggctgggtcccctctctccaggatcaagggaagataagggacatagtataaaaagttagagtag

SEQ ID NO: 39848 - DNA, 1160 bp, Bovine  19866880969026
agggcagggaccggatcccagcatctgcttatttctggcctttagcacagagcctgcaggtgctaggtagatggaaatgatctgtattaaaaccttctgggacccttctgtcgtcttgttctatccctcctcaggaggccaaccaggaatagtttcctaggaaccagcaagcacggagaagggatctagagagtcggagggaaacacacacaggagcagccaggagcagaaaagaggcagagtcatcatactcctaaactgactagggccatgagagagccacagacaagccacgaggcagtgccggccgctgaaaggcaggcagctcatgtccaggaggccatgccatcagcacccagggaatggacctggtcctcgtttcgtgccatcaccttccatggagtttggccgacaccaccaccttccttttctgcttcaggtcatcatactcatagagcccgagcaccgctccttccgcagccgcctgggcatctccgcaggggtccacctccaccgacgggatctccaggtcctgaatctgtctgcaccccgcttcacagggcagaggaaccagaaaaccagagtcagtcagggacccctcagagggcagaaggcagagacttagggtgcggtcctgagaaaacatcaagattggggttcaaatcccggccctgacactgatctttctgagctttcacttcttccctttccatacagtgaggacatgcacacacctcacatagtagtgggaggacagaatgatggataaatgattggtctacctcacatggtagtggggggaaagaatgatggattaaatgattggtctaccctggtggctcagacggtaaagcgcctgtctataatgcaggagacccgggttcgatccctgggttgggaagatcccctggagaaggaaatggcaatccactccaggactattgcctggaaaatcccatggacagaggagcctgctaggctacaggccatggggtcgcaaagagtcggacacgacggagcgacttcactttcacttcacctcacgtggtagtgggaggaaagaatgatggattaaatgactggtctcactcacaagggaagtgaacgctattactaataccacttctgaaacactagggttccctgaggaagcgtcccag

SEQ ID NO: 39849 - DNA, 1102 bp, Bovine  19866881017120
taggcgtttccaataagaattaaaacgtgttttccacagacttatgcataaattcccaggaatacacagtacttctcagcaaacttgggggtcttggtttcggttcagcaccttgcacatatacagaaacacatgcacaatcactgtggtgcaaaagtaaaaactgtcattggagttcatatttaattaaaagctttctctgtgtgtgaagaaatactttctctagagcagcgcagaatttattccaaacgtttaagtgctaaatccgtaccgcgcactgtaccaggattaggcaagtgaaagatgacacggaacacaagactcaatgggttgctgtccaggagcttacattttgccgagcataagtttctccttttagagtttttacccagccacatctaatccttggccccgtaaacgatttccggtgaagtcccacttcttttccctaattttacaaatattctcgctttctgagatgtcatcgccctggaaactgaagtcactgtgggctctgtctttggacatttggcagatctcggatgcagctgaatcaccggcttgttctttccctacagtggcgagatgacagtgaccccaaaagtttccagcacttagagcataaacttaaagcagcccgaaccttcaagggacccacaactctagcggcttccactgcccttctatcacggatcctaaggaagttaaggcggttgggtcagaccctgcaacactcgcagcgcattgttctgggcgctaaacccataagcagcgcagaactgagaaatctaaggcccggcagctatcccaagtgtgcaaagaccgaaaagtgcccatctctactggactccaagcaccggcatgcatcgcgccgaaacggcaatctccgcttaggaatcccagcgcaaaggggcctgggaagtgaagtctccgggcgtccggagtcgcggtgcgaaggcagaaggaaggcattgctagtctgctccattagcgcgccggttcctggccaagctccgagcctctcgctgctgctcagggttttcgcgggcggcgggagcagtatggcttgcttgagtaaactccggggggaggggagagaggg

SEQ ID NO: 39850 - DNA, 1762 bp, Bovine  19866881024967
ccccatcccacccctctaggttgttacgagccccttcccaagattaacaacacctctttttttattatctgctccaacatatacagcttattaaaagttgatcaacttttatcgacttcttgagctaattattttggccaggggaatagaatattctgattaggtaggcctgggtcacatgaccaaccctagaaccatgggtcagcctcatccaaacaaagatggactcaaaatcagagagttcctcaaagggcactattaccagaaaaaggaaatgtagatatctagacaggcaaaaccaaatagcactttattgaaaaaaattcacttagtttaccctgacctctactagagacatgcatattcctccaaataagtctttcaaaacagaaaatagcatttgagatttcttgttaaatatgacttcatatatcttcttatagctcatctccagtctttctaacttctcaacatgtagatggtagaccagctttgttcaatagaagtataatgtgagacataaatgtaagccacatttccaattttaaattttctagtagtcataattaaaaagtaaaagtgaaattcatttttaaaatatattttatttaatccaatactgcttcaacatataatcaatataaaagtttcgatgaactattttatattattttttctatattctttgaaattccatgtgtattttacacttgcagcacatttcaattcagattagccacatatggatgaagactaccatattggacaaagcatttatggacagtgaaagcttttatattctattaagtgaaggctttatccttacccacctcccaaccaatttcctctcttaaaaaacttctatttccattctaatcatctttctccctccaatcaaataggacaatgttaactaattcacagtcttatgattttgaaaaaggaataaaaagaagtgttcacatattttatacttttcatgaatgagagctgaaataaaatggcaaatcactctggtgcttttattcagcatgagttaaagcaatgtgaaacagatgatcacatcttgatgacaattatggtactactcggcaggaaaaaatgaaggaatttggcctggtactattaaatagctgcccagataagttctacaaggaatagaaagagtgagaagaatcaaattacccatacacagctaatgaaataattgcatcatgttgttgggggaatctcaactgctaaaggtagaatatctgttagtgcacctttattccttaaagaagtctgctttgctcatgcttttgaggataaatcttcatatgtacttttttgtgtgtttaaaaagcaggctctttttctattatgaatcacttgatccgagggtttattttggcaccttgaggattatgtaaaacttattgctgaagcagcattttcttttaaagagttggtgtttaaggactctttaagaaagatgaaaaataaaataaaaagccctccaaaatgtcaactactttgggatagattttgtattattttctcaattcaaacaaaactgcagtatatataaacatgtgacagaattttattctgcaaatttagtatgattataatttatatgctgctataaaatactgttcattttcacagaaatatcttaaacaatttgtgtttgtatatgagttaattttaaaatgtcattacttaagatatacactttatcataaaaatcttttagccagaaaacaatactctgcacata

SEQ ID NO: 39851 - DNA, 743 bp, Bovine  19866881033449
tattgcatataatcctgctcaagtcttttattagattcttgcttgactacttagggccacttctgaatttgttatttagaatactgactaaatttattctttatagaactcagcaacattccattctccatggctacacgtcttcagcatccattatctataattttctttttctgtcttcctagaagtgttcttattggcaatggttactagctgggccttcttttctctataattacttctttagaaaaatattcttattttgcttacaaattattctccctatgtgcagtcagagttctttcaactattgacactcttcttgccctaacccaggacagccacccagtatgcccgcttggtaattatttcgttaggcccactatttcaaggaaatctttctttccagcactatatatggacttagagcatgagtgttagataaacaaagcataatgaaaacacttaagaggcagaagaaaataacagagtttcttttaagtgaattaatgtcataaatttaaggtaaacatatttttagggattattccaggtgcaagaaacagaatttttatgtctttattaatctcctgcactatgccaagtacccaaataagtgctgagacccccaactgtaaacaagacaaatgtggtctctgcccccacagagcttggagtacaagggataagcagaaaagacaaatgccaaacaaataatcgtataataaggaagaaggcagggg

SEQ ID NO: 39852 - DNA, 4704 bp, Bovine  19866881129742
tgccttagtagtgctgtaaattctacctataggtaagtctgccatgggtcacccctaaaatatcttgaaaacatgctcacaaggaacaaattattgagcagacagcataattgctcgctgcaacaaaattcaaaactctctcacagactacaccaaaatttaacactcaaccatataacattcacaatgtctggcatccagtcaagaagtatgagacatatgaagaagcaagaaattgtgacccataactagaaagaaaaataagagacgatagaaaaataggcccataaataacagagatgaaacaagtagtatacagagatcttaaaagaccttttataaatatgctcaagcttttaaagaaacatgaacctaaagaggaaagacatgggagaaagatttaaaaagcagagactctaaagatggaaaataagatatctgaaataaaattttcactgactgctcttaaatacttcagaagaaaaggtcaataaacttgaaacacaacatcaaaaactattcaaaataaataggagggaaataatagacaaaaacaaagtctaagtcactggagaatagtatcaactgtctaacacacatattctgtaactggagtcccagaatctaattttttcctgtaaagctagaactattccaagaataaagtatttctaaaaaaataattaaaggatgaagtaagatattccatgataccactaactataagaaagctgtgatgggctacattaataccagacagagtaaatttctgggcactgactactgtcagagataaaagtgacattttataatgataaaaacatgaccttttatgaacacatgacaaatctaagtgtgtacgtatctcacagcagatattcaaaatacacaaagcaaaaattagcagaaatatagatataaaagaatagagaatagagaaatagaagaaataaatagagaaaggagaaatttacaaatgtagttggaaatgtcaacactttttttcattaactgatataatgtgtgcatgcatgtgtgctcaatccctcagttctgtccaattctttgtgaccccatggactgcatccagccaggctccactgtccatagaattttccaggcaagaacactggagtgagttgccatttcctactccaggggatcttcctgaccccagggatcaaaccttggtctcctgcgtctcctgcattggcgggtggattctttaccattgaaccacctagaaagtatgaactgatacaatgatacaatagtcacaaagtcagtagagatatagaagaaactatcaaccagcttaaccaaatagatacttatagaatttgccacctatctgctgaaaagcacattcttttatttaccaatgtagatcattttttgttctataagacgtctcagttctttggtccacagtggacttgacttataaatcaatagtaaaaaaatatctggaaaattccaacaaaactgaaaatcaaataaccaatgggtcaaaagagaaatcacaagagaaattaaaagtatttaactgaaataaaatgaaagctagaaaactgtgggatgcggatgcaatgttttaatgtccttggctactgtaacaaaataccacagtctcggtgtcttaaataacagagatttatttctcaagttctggaggttgggaattccaagatcaatgtgcagccgagttagtttttggtgagaagtttcttccttgcttgcagaaggccaaatcctcacatgtcctcacatggcctttttgtggtatgtgcaggaggtctcctgcattgcaggcagattctttactgtctgagccatcagggaagcccagttttcctattttgtatgatttatttcacttagaataatgtctttaaggttcatccatgttgtatcagaatcccattcatttttaaagctgagtaatatttcattgcatgtacacactgccttttgtttatctgttcatctatcagtggaaatttgaactatgtccactttttggcggttgtgatattggtaatttgaacattgaagtataaatacctgtttgagtctctgatttcagttcttttgggtacacacccagatgtggaattgctggatcacgtttcatatgtttaattttttgagaaaatatcttactgttttccatagtagcagcaacattttacattctcaccaacagtgcaccagcatcccaatttcttgctaacatttttttttttaataaccaaactaatgggtatgaagtagtgtctcactggagttttgatttgcatgtctataatttttgagtagcatttcatgtgctttttggccatttgtacgtcatttgagaaatgtttattcaagtcttttgcttatttttcaatttttaaatgctcagattagaaataagaaaaggttgtattcaatcatcttacgtgaacttaagtttatatggagggaaataaaaagtgtggaaatcaatgaaataaaaaccagaaaaaaagagaaagttgattaaatttccagtcaattagcatgtcttattgattcctacctcctgagtatttctttagtctattactcttccagaatctaggttcttaaatatcatgttataatgccctgtgtaatatgaagtttgtttatctgttattcaaaattgaggagaaggatgaactgtgttgttttcatcttgatatcctcagtgcctggcatagtaccttaataatatgtgttgaaagattatttgacttattaattcacaatttctcctcacaaatttaaattgataagatggtgaggacatggccaacatgcatagacaacttagaacaatgtcagaaagcacagtggaaagggcacaacatttagaataagagaagtcatctcttaatagtgttactctatatacatcctgtggttctttggatcctcatctataaatgggtgcaattcaaataataaatattataagatgtttgggatttccattcactaaaaatgatttcattgatccagattgatggttaagctccatttggtccaatcaatcctattctattctgtgttagaattgtgcagttgtctccatgtatgcctcttcatgcactatctcaaaagtcatccttcttttgtgctatcttctttgaacagtaatcccagcctaaatcagtagacacaagactgctgaggtcaggtacaatgactttcatctttatctcccttgaaccttaaaagttcctggccagagaagggcataaaaaatcattgctgaataatggagtagaagagtaggaaagatctcagagcctgaagaaaagaaaattactaataccttatttctgaaagcagctaacatgggctccactgcccaacagctctaatttccccatgtaatacttgtcatttgaaatgccaaggatgagggtgaatacttgtttcagtgcagacttttgccaggaccccactgatataaaattccaaattgttttcagactatttggcaaacctctgttcttttctataagcatcagagaacttttccctctggcacaggatttccatatagcactttcttcgtcaactgagacttgtgaaatttgtctgtgctctggaagcagagtacaaacagtgaacagataaaagaacactgtaaatttgactgcaaacctgcacaaggtggaaaactttgatgctggaaatttctgtaagtcaatccacaatcaagtcacaagactgttgtaagagataactctcacctctctctgtgcgaactatatccatccttacaggtaccattctaatcccacttccctttctgatcagactgttactccctctgcatgctttgtatttctatagcatttatgaagccacaaaacctgctgctgctgctaagtcgtttcagtcctgtctgactctgtgcgaccccatagacggcagcccaccaggctcccccctccctggcaaagaacactggagtgggttgccacttccttctccaatgcgtgaaagtgaaacgtgaaaatgaagttgctcagtcatgtccgactcctagcaacccccatggactacagcctaccaggctcctctgtccatgggatttgccaggcaagagtactggaatgagttgccattgccttatcctcacaaaacctagcacctatttaaagtctgttctgtaaaaataattaagtttgtactgcatcatatttttgaagtgcttttacatttatctcttttggtttttgtaattatttggagagggtatttgtgttaatgcacccattttacaggtcagattcagagtactccagaaatttacatgaggttatgtatctaaatgtaagttttccgatttcaaacatatttactgaccttactggtttatacttgctaccgtatgtcttcccaacagagcttagtgggtcacaaggcacaaagcaatgagcttaatgattgctgtttgttcacttcagagcatatgttggtacaaagctcccatttgtcctaaaacatcctatttctgctcttttgtggtgttaaacattccttgcttcagattttagcatagcttctcaggtacttatttgcagtgaggcctagaatagtagaaaatagaaaaaattagctgtgaagaaactcaagatcatataagttaccagccttcttttcagtccaacatcaattcctttt

SEQ ID NO: 39853 - DNA, 2059 bp, Bovine  19866881246752
gaagtcgctcagtcgtgtccgactcctagcgaccccatggactgcagcctaccaggctcctccgtccatgggattttccaggcaagggtactggagtggggtgccattgctagacatccctaaagacatggatgtcagctacctacaaactctttcttctactattcttccctttgctcagtctgccctagccatatgaggtcctgctccttgaacatgtaaagcaaagtcgtactgcagggcccccgcactgctcttccctctctttggaaacttcttaacccagatctacacagttcattctcactcctctctggtaatggcccaaatttcgacttattagtgatgtctttctggatcaaactactcccactccctattcccagtcttgatttccttcctctgctttttttccatctgacatactatttactgtttattttccactgtgtatttcctctgaaacttttatcttgtgtttttcattacctattttattttttcctaagttagaataatgcagggcatattatatgcactcaatataatttgctgtatgattaattttaaaataaccttaaataattgacatttcatcctctacaaaagattttaataacagaaaaatcaaaagattaaaaactgagttcctaaaagtcatccatcatcatcaacatcaataagccctggaatagattaaacttataatactagcacattcagacatattgagtatttatttcagtaagtataatcaagattttaatcacgtgataaatcttacctgcaagagtaatacaaagtgtttacttgcaaaatcctgattctgcagtccacagcatcccaaacacagtacagccaaatttcttactacaggatgaacatttattattccaggaagaatctaaaatgaattagaaattaaaataattttgactagaggaaaaaatttaaaacagtatattaaaaaggtggtcaaaatgaaaatttctgtaagacctcatacatctactttttcctcatagatctacatttccatatatagtctattaactcaaaaaagtaaatagtaaattgctaaaacataagaatacagtcagagcaaaatatagtccttatattccctccacctgacaaaactgattcaatggcttcctagtgctcaaagagacatattgtgtctctgtgtgtagtccatattgtgtagtctttcccagtatcatcccataacacactatcccttgctcttgtttattcaattgatctgatttcaatgtctcccaattggtgctatccactagggacataatgcaagtcacatatgtcattttaaattttctaatagccacattacattttattccaaaataaataaactattatcaacacacgtaaccaatattttaaaatcaagataatatttttagctgtggtttcaaaaatattttataaaagtgagataacttatgttgcttgtactaagtctttgaaacccaatgtatttttacatttataaatatatatatatttagaatagtttttaacagtcacaggtttttaatatccacatgttgctggtggctacagtattcacaagagtaaatctaccattcttcccttcctttttcacatacttaatgtgcccactcaaatatcacctcaaggtcaccctccatgaacagatgaaactcattatcttaagttaacatacgaccataaagcttttcttcatagcaattatcaatggcataagctttcacttgtttatttgattcatgtcccctctcacttgaccaaaagatctaccaagggcagtctacatgtgttttgtaaatcatgtatactctgtccccaatactgaatgtatagtacataatacactataataaacaatattatttatatttattataaaattaatattcactcactttcatttttaaagcacagtaattccattaaaatattattactcctatatctaaataccttactcttccaatctttagacagattacttttatatatttaaaatcattagaccattcaattttgcatt

SEQ ID NO: 39854 - DNA, 1252 bp, Bovine  19866881351307
atagagcctggcaggctacagtccatgagtcgcaaagtcagacttgactaagcgactaacacacaataaggaattgtttgttaagtgtgacagaagcatcatggttatgttttgtaaagagtccttatctcttagaaatacttatcaatgtttttacagatgaaattttacaactggaccttattttaaaaacaagacatctggaaagaaaaaccgtggaaaatgacacagataaaagattgaccatatagcaattgtgttattgtttagtcaaagtcatgtccaactcttttagactgtctaaccccatggactgtaggccaccaggctcctctgtccatggaatttcccacgcaagaataatggagtcggttgcatttccttctgagatcttcctgacttagggatcgaatccacatctttggcattggtaggcagattctttaccactgagccgccaagaagacccagagaacaattgtacctgggtgtttttttattttgccttagctaataactttctgcagtagacttttctcagatgctaagagtacctggatctctgatttccctaaggcattccaaataagcttgccctttcctttacaagaggggctggggatacaaaggccccagaaataaaggtgcttcctcaaagcctcagtggattgtaatttgattcccactgacttccccttttccctgatctttcttcctctctgtaatctgcccccacacagacatcttccttcaaatcaaactcagcgtgctgtgtagttaggctcatttagactcagtcgtattggtttttccaggaggagagaagatttcactatgcagcgttccccagcgcaatgtcccatcggaatcgatccttctctttcaatcctcacccagggtatttgaccccttccatgaaggtaaattggtcctactggttccaatgcatcacagaattctgctggcttcattttccccaaagataatggtagcttatttatcaacagtctagcattcatttagagaaatattcattgaaaataagaccctcaggagatagtacaaaattactagcaaactgtttatatctgacaaggcagattatgtataatttttatgagttttttacattttccaaactttttatatatgtgtcactactaatagtggctatatcttggtgataggaaaggagaagggcaagaatccttcacttcaccttttttttccttttatatttttgcaatgtatt

SEQ ID NO: 39855 - DNA, 867 bp, Bovine  19866881410102
aactttagactaaaatcttgacggagacacacaacaatgttattttcttagctcctaggacttaacttcttttcatgaaccatagaatatttttaaatctacaataaacatttctagtgttggtggtatgacattatgttaatttggctgtaaatcactcacacatattgtaaaataataagaaatgttagggctgatcatgaatacactggttgtcttattatctgcactgtaggataatgtctcaataaggattttaaattttttgaaaggagcttttaagtactcacatagtgctggccctatttcacatacagaaaggggcacacaagacatgcagatggcttttaattatgcactgcttctaattataccatttagggttagcttattggcctctctcctctgtcagaaaggatcagctcagaggatttggatcttcaatgccttgcatttaaggcttttcaattctttaagctgctgatacattgtcagggcaatgctgaaaataaaaagtttgctgttgcagagaacctttcagaaggtgttattaaaatctataaagacacctttcagaaggtgtcttagataaagtcatgttgtctagactggttcctataatattatcttggattctctaattagaaaactaaaatggtttctctgtgaattgctcccaatgcttttccaaaatttaagcttttttgggtagcttccaagcaaaacatacatttttgaagggtcagaagctttcaaaatttccatgatgagtgagcatactttacaagtgttttgacagaactgctgttgcaaatattactagaactctactcaatacataaaagagttttctagcagcacaaaagt

SEQ ID NO: 39856 - DNA, 1650 bp, Bovine  19866881500783
catttttaaccagtttaggtgatgctgcagactccagtttgagatggcctttaggattctcagggctctctcttttacctccccccgatttgaacttctagcagcttctagcatagtgccctgctctcaatattaataatatgagttgagttactttgaactgttaaacccttgatgacaaggacctcgccttataccttttaaatatatcttatcacctccattaatgccaagacagagggggtgccagtaggagacatactaaagggcgggtgtgccagtaaaactttcatccataaatgatgcaaatgcatcactgggtgccagcacatcacaggaaatgcagaaggatgccaaaatggtgggaacgcccccgcccccacccccacccttaagggaggtattgcacaatcctcactggctgtttccagttgcagggtgacttggaaggggttgtgaaattaatgaatgaacaataaactgctttgtgaaggagggcaccactggttgatgtcaaggctttggttttacagatttggggccagagctgaattgctccagacagaaaaagaaagattaatcttccctcagcagtgctgctccatctttctcctcatgtttcattcagtctcttaaataggcattgaccaattataagtttgaaggagtgacagatgttaacctgctaggttatccacgtgtcttggtctagctttgcggtctgctgatgattttgttatgattagaattacagaagcatttgtgggtagagtaaggatttatgcagataggatatggggggtgggtagcatgaggagtgatagctttatattttgaagacaaagtttatttaaatcatagttttgggtaaatcaaaccagtttcaaggacatgaaaaagaacctgttactagtttttgtccattttctttccagggtggtctgcccttgaagcatacccgcccccaaacatctgcttttccctgcacttgcaggctcattaatgggaacttcccagagaaagatccagaaatagcaaattccactaaaaggcttatcattaagtacaatacagctctttatgtgggggaaggatggcttctgaatacgagtccattagggctgtgggctggaaaaaatgggtcagttttcttttaagggagaaattaatacagcaagcaagagccagcaatactgtgacattcatcctgcacagcttttcctcttcacgctgccaagtgcgtctgtccagacttgctattcctgtcctcaggcccctagggcagggcctatttgtcctgaagaagcctatcaaattatctggcaacagcctaaataaacatgagcaaggagattagaactgagtagagggtgtgtgtgtgtgtatgtgtgcgcgcatccatgcacgcatcctgaatgaaccagaaaagcaaaagttaatcagtaactctttcactgacctttttcccctttgttgggtccaaatgtcaattccacaggaggtagcttctagccaagtccatgtggtgctgtccccagagaagagctgataaaagaagcttgcttcagaaagtgtaagggtgagtgcttgaaaggaccgtccagtgtccagtctcctcctggcaaactgatacacagggctgggtgggct

SEQ ID NO: 39857 - DNA, 1109 bp, Bovine  19866881513178
aaaaacctacaaatttgagaacatggaatgctgtccaagaaaatttaatagaaatccactactaaaaagtcagatcagatttttttattacattgctaaaggatttgttgtaaaagttagggtaaaaaacaagtaaacaagttacattattcattacgaaacatggatttttttcataagaatgttccttataatccaactactggaatatattagagagtttgtggaaaacattttcaaatgaaggaattttatgaagaaattataactttgccatcctaactatacttggtatagacagagattttcaaacttactccttgcaacagaaactccctccaatttcttttcccaaataagttaatacacagaacctcaaatacagaaaccatcatcatctgaggcagctacattagaactaatttgaaaagcactggtgtaccacagtaatttcttatacttttgaaatgtttaatgaaattaaatacttgttttctgctaaacaacaaaggaaataaactcatctttctggaatgataatgaataaatactagataggttcagcctcttgcattaattcagatacacaggtcagaatagaagatatataatttgttggaatataaagagtacagtgatagattcctttcatttctggtagtggtccagaaatattcccattatttatttaaacttggaaagaatagggaatgggaacgtaagatccagtatgaaataatggaaagatgactgggatttgaagtctccaaaaatctggaatggaacctactagttatagccttgccaagccaggcttttaatttccatatctgtaaaataaggattctgtcacctaacttatttgtgatcaaatttttaaaatattaaaatattttataaactacaaaacatcatgcaaaggctaattattagtcaggtagaatcactagtcattgttttttaaattctgtactatgacacatgtatttaataaagttagtttgcagaagacagataactttaattgaatatctgcttaagaaaactgatcaatttgtgtaaacaatctgaccaatcaaaaggtttacataatctataccattaaaaac

SEQ ID NO: 39858 - DNA, 935 bp, Bovine  19866881561577
ataattctgttgcatattcaagtttgagaactactctcacgtgtatgtgtcctcaagtacaagatgtccataaagtcctagctcagtctgaatagtaaacaaatcatgtattttgtatataaaataatttgcaagctgcaacagagggtaattatttaagatttaaagaaactgttaatttgttttaatatttatactccactttctcggtaataaacactgcataataacggccatatcctaatttacccaacatgatggtagacttgttgaacattagcatttcaacattttaaatctagataaatcctctcctgtcacattttgcagattatttatatcatatgtagaagcaaatttattacaatttcaacctacataagaactttatggataccttcatatataatgtaaatttatgggagtaataaatatatatttatataaggaagtatataatgatttttcaaagtaggtgttcctcatggcgtattttgtggaacaaatgtgctgtgattttatgagtgtagagctttggatacagccagattcatttattttctacttccaggacaaatctctgactttccccacctttgttcatgcattttatccagcctaaaattcccttcccactctctttataggttcttggacccaatttcaatgtgtagggggaggaaagcttcttctatgccaacaagcaatcctctggacaccagatgggtatcttgcagttcaactcaactaagatgctgtccatccaaagatagcattagaacctgcaggttaagggctcagtcatataagactcttcctatcaacttcagatgccagtcccaagcccagttttcacctgtgcttctaaacaaccagctatagattggaggcccaaggaccccctcctgaacctcagatgcccatcacaaccccag

SEQ ID NO: 39859 - DNA, 1267 bp, Bovine  19866881604221
ttaggaagtaatttagaccttagtactcattaagttactaaattttgtactctaaagaaattgtttggttgaagtctacaaacatttaataaatccctatgatggatccagcatggtatggatgaagatatcctttctactttatgaacatgcctttggaatttgattaatgacatggccaaaaaaccaaaaactcgaaagggccaaaaaccaaaccaaaagaaagagtatccttcagaacaaaatgcagaacacatgaggcaaatgagacagtcattccccgagattgcaaagagtgactgctttgaaaaaaactttcatgaaatctgtctctaaaactcaggcccacctatctaagaagaaactcatgaaaactagaaattgtatagaattaacttgaattctagcatcaactcttctaaaagtagtctgtatatttttatcaattcactttaaatctctattccttcacctttaaaatgaagggccaggccagggttatcttcagagttccttgcagtattttaggattgcattgtctgtggacaaactcacatacacaatctttaattataagtttgtaaaaacatctagggggccaactccatctgctcctgaagtcttaaacctttattaattacttatttcccaaagccatctctgttggtaggagtgggcagagaagcagagaaaccccttggaccacaagcttttcacttctggtttctcaccacaaaatattccccaggacttgggggccagatggcaacgtttttgaagatgcaccaaggatttgaattctggttcgtattaaatatcacatgtaaattattaatctgtggcagctgtaacttgcatattattacactacattaaacattgatgttgcaaagaccagcctatgggccacatggagctgctgggggaccgccattggtcctccaattaaaactcggatatggaatccaggtaaattaggctccagtctttagaaggaatatttattactaatgaaagaacatgagcagtgtttcaaagtaaatgataatatctagcattcattgaggtcttactatgtgctaagttgtcttctaagtgcttaacacatactgataactttggttttcctgacacctctctcaggtaagcattattacttaccattgttatagagcaacctttactaagtaccaaccctctactggggagttgttttagttagtccagatacagaggtgagataaaacattgtcatggctttatggag

SEQ ID NO: 39860 - DNA, 910 bp, Bovine  19866881660478
atacagcttttatagaaggaggaaatggaaggatagttatgcaattatgactttagacatttgactagggcaactacagtactcaatttcctgtcaggaaagcaatagtaatatttgatccacatatgccctcatactaatggtaaaatagctgctttaaaagggagtaaatttcatggggcatttatagcttaatagttcaaggccgaggcattcttgtcagtgggctaaagcttcagggctgacacttcacaattgcatgatcttggacaagttacttcacccccttgtatttatttccttgttggtaaaagagaattgacaacagcccatacctctacagggatgttaaacaaagtgcctacaaaacacacggcacctggtgaaaagtaagaatgtagaagtgttagctgttcagttgtgcccaacctttagtgtccccatggattgtaacccaccaggctcctctgtctatggaattctctaggccagaatactggagtgggtagccatacccttcaggggatcttctggaccctgggatcaaagccatgtctcttgcaatgaaggtagattctttaccatatgagccacctttattttatttttcttgcgtgaacatgaatatcaagcataacatacagacttttaaaatacagcgggtattggccaaagattattagagtctgagcactttaaagaaacatttctttcctctaagcaattgagtaaacatttaactcagtcagtagacagaacgcaatttgcaattcaacatcaattaagagctctgaacagggaagagatgtgatcaaagtgaacatgaaaatagctatgcaatagtttgaaaagcaaaatctcaattcactataaactggaagaagatttgccagcaggagccaggaagcac

SEQ ID NO: 39861 - DNA, 1943 bp, Bovine  19866880347635
cgttatgtattcaagctgaacaaaagctctttgctatccctgctgaaatctgttttcacagaagtccagtccccctgcattcctcgtcagtctgcatcttatcacaccagccaggcgaatctccctcagcaagtcctcctccttgggagacatgacacagttcccagcaggacaggctggtggcacaggaggggtttcttctcccaaactgttggttcccaacgtaagctccagacagcagggagtcccctccgccctgaccacctccctcatagctgtcacccccttgacacctggagcctggcctggccagcgtgctccagacagtcttgtcttcaggaaaatgctggggtgtgagatcccaggaagccaggggacacaggctggtctcccacctactgcccccgactctatcagcacccagatgcagagtgaggctccagggtccctccttacacacggggctggggtggggacctcagccctgcgggaccactgacctgcggcagctgagcagatggccagcctggcctaccatccagctgtgcctctgttcaccgagacaccctccttcagaaacggaagctctgtgggccacctatcatgccacgtgggtggccatcgtgggaggggtggggacggtgggcgggcatccacatggcaccgggggccctgcagagggctgggggcacgttcccaagtggaagatccaccagcactggcaacaacacctcttggccacactcctgacacggcaggtgcatcgccaagctctccccttgattccgcgtcaccaccatgcccaccctgtgtggacaggggaccatggtctgcgtggtggccccatttctccccctgctccaggactgacaacttgctggtcaccacattcactaggcctacctcagcatcagcgcttctcctgggaccacccgacccactgactctagtgaatccccttagccaaggcggtggatctggggccaggtgtccagagacagagcccccaccctaggcgcactcacccttcccgatctggatgaagccgagcaggatgatcaaggccagcgccagcagcttggcagcggcgaaggcgtcctggacgcgggtggcggccttcacgctgtaacagttcacggccgtgagtagcactgtggagagagggcagcgagtgagtgctgtggaaacgcgggcagaggggcaggcactccccagcccctttcccgggtctgaccatctggactctagaagggagggaaccccaggctacaggctgagcacaggtgcccccaggctgccataagggaaggtttcctgatggatagatttcaacctcccatggggaatcaaaacacctccacccgcacctgagtccctccagggggcgcccttgagaagcacaagctgccacgtgggggtgggggtggtgtgtgtgcacacagtcacttttctgctcccacctgacacttcagcacaatttatctgacaccctaacctctcaaggggggaaccctctcttcagagggtcctcgtaggatcccttggggacacagaggatgagacctaagcctgacaagtcggcaggggggagggtgcaagggaggggctgaaggagacctacagctgggggtcccagtggttagaccagagaaccagcccaactccgctgctggtgtcgaggcaggtacagaagaccccaccccaaggcagtccccacggtggggtggagatgtggggtggggacacagggcaggcaagctgggctccacaaactcaacaacacaggcaggccccacctgggacccggggagaccccagacctgagcaggggcaggggctgagtgctcaggggcctggcgagctggcatgaaggcagccaactctgtaaagtcaaaagcaaatagaatgagataaaaggaaggaaggaaccagccctaccggcg

SEQ ID NO: 39862 - DNA, 1819 bp, Bovine  19866880445171
gagctggagcactcagacgagctgccttcccgggccgtctggtgaggggcctgctccaccttccaaccgcagcgctgcggagaagggacaggtgacagtccaaaggtggcactgaggtcctcgagctacaggacacgacgctggctgtgccctcctctcccgcccacaggcatgcctgtcgcgcttgtcttcgcatcagccccaaggaggcaggtcctaccctggccctatgcacacagggttgaggctcccacgctcggcagatgcacacacagccgtgctcagctccccaagcactcaccacagaccaggagaaggacccccccaccaccaggtgctacaaaagcagccctccaccaacacagagacctctgtgttctgaggcccagtgacacaagaccttttcggtcaaacaagtaccaaaaagatgcactgacagttttttcttcctggttcctgtcactcttgatgtttctagtgcataaggaaaacagcagaagggctgttaccgtggtcctccaccaccccctgaggagaggaaggcagggggaaggggagaaggctggtggtccggcatcaaggacttcagggtggacatgcagggcagcagcctagggccacctctctgcacccacgtgaaggggagagactggcatctattttcacatttcctgttctttccctctcaccagagcagttcctgggtctaaaccttttgcccaaacaacttcaggagagtcacctgtctccagctgcaaacctaaggtcccttctgtttgtctactgcagaaactataagagctaaaacgaggaaaagtaactctttaagtactaggagatggaaatggaaaagtggtgtgacctgaggtctgacccttgccagaagggtcccgggtccaggcgcacccggccccacccacctgcagcatggctgcctcgcactgtctgcacgggccccacgtggctggtggggggcacgcgggccactccgctgctgctgaccgggggaggggccgaggggttcaggcaccgtttctctgacttctccctgtgtgacaggaaagcacaccaacaacccgagtgttcagttctgctgaacaaactcccaatgcttcacagacgctacttaagtacacatgctccacagaagggtgatttccgtcaaaataatccccagggtagaagataactgacttgtcagattcactctaaagggtcgtttctagcaaaccaaagccacatttgtagagttttaagagtattaattaaggtttaagagtattaattaagccaccagcagtaacaagtcctagcatctgtccctcatgttagaaactaaaatgaacacatttcataaacaatctcacactcacttctccagctccagttgagtcttgagttttttctttgctcccatggtgagggattcaaatttatttagatcttcttccgtaaggctcagaaacttccacagaagaaacaaattacaaagttactgagaattaattaggattctgaaaacaaagaacttggagtttaacttaataaacatattcaacctctcagatacgtaaacccataaaacttaaccagataataaaagacagggaaacgctacaatatttacttgctaagtgacttggtgtccagagtccaaaatacaagacacccactttacacctgagagtcacgggctgtgtctcctgagccttcggcacaggcgtctggaccacagctgggtgaacgtggggccctggaaggtgcgtgctgtgcgggcaggtgactgggacagtggcctgcggtctcagctgctactggg

SEQ ID NO: 39863 - DNA, 1300 bp, Bovine  19866880543268
cgggctggtcagcaggagtggggattcaggcttggcccagtccttctgggtgctgttgacgatgctaccctgcttcagagattcactggctggagccatccctgcttctgcctccacttagaaccatgtgtccttctaagcgaggttcttttctcctcctttggaagggtgtctgcttggaataagacattttactctcgggtgtgggcctggcagatagccacccgcgagcgagttagcgagcgggcatcctcgctgcctcagtaggagagtgcggctctaggacaccccctgggagcagcaatgccacctgcgctcaggggatccccagtgcccttctaggaccgcctgccatctggcggcctctggggcccccagatgatggggggcatgggagcgggagggcctggtgcacccctgctctgatggggccgctggggctcactggtgaccctctctccgtcttacggaacactcaagatcgtgaagaaggacgagttctccaccaagtgcaaccagacggaccaccacaggatgtctggcgggcggcaggaggtgaggccaaccctgctgtcccggggagtgacgtgagggtggacatgtgaagggaggccgcctcccggcctcatcctcacggtgtggatgtgtgtgccgggctgaggataaacacgctgagtagaggtggttctctgactgcttctccatcgcctctttgacaagaggcccgagggctgcggggtctcattgcaggtgtgagttgcagggagaccagaggctttatcagggcgaaccccttagagccagaggctgggctgcctgaggtgctggggggtccgccccagagtcctggggtggggagctcaccacctggcccatggtcactcggcccgtctcagctgcccggggtgtctctgctggctccttgtgctccatctctccacctctctttgtctctccctccaagtagagagttagaggatagggttcttttgtggattcacttgtcagctgagacatcccccactcttagctgtcttgctgacctagagagtggcttcaggctccagggggagaggaatcctgatggctctgaagataagatgaaagcctgagccaccctgtgctctgatggttgataatcacgtaaaattctggaccacagtggtgcttcccaagggagtagaggactcctggtggcctcagagggctggagggtaaacttatcactgtgcttatcactgtctccaggcggagacctgtcctcggctctagccccggctcctgcggctctcacccctcc

SEQ ID NO: 39864 - DNA, 1412 bp, Bovine  19866880708577
tctttatcaccacttcacactggttctgctggactgacaatggcagggatttttcagaactggggttgatgatggctgaggtccccagatggactgtttgtggaacgcagaagccaccaagaggtctattcccatgagctaagggcttgctgacacaggctgcctccctggatgctgcctagctcaaccagacaccccaggatgggtggtaagggcaggaggagccatgcgctgctcctgtgatgggtgtccccacccagacgaaccacaccatcacacccgcgtctttcatcaattctggtaaacccccaagaaggcaaacagaccagcttctcattccatccaatgccaaggcctggcatcagtgggctctgaatcgtggtgctaggactgccccctggctgtctgtgcagttgtagaagcagcagtggggaatgagatcctgtcttgattaaagtggggtcagcctaaggcggcttgctgttcatcatcttgtttggctctgtggagcatgtgctgtgattaagaggcagccctggccacagcccacgtctctcacatctagatgaggcccgggcagatcacaactacagaaaactgactgttttcctttccagagcaagggctgaccactggcttagtgggggtggggcagagaggaaggagggggggtgcacctagtggcacacggataagaacgcagcaaggctgtacaggacctcagtgtgttcacagaggagcagaccacacacctctgtccatgtctcatctaaacaacagaaaagactcacgttaaactaacgtgcaatcttatttgaggttctcatcgttggcaagactgaaagcacagcagacagaagccccgctgtgtcccgcacgtcttacctgttttgagtagccaccatagatgatgatgttgccctgaggggtgatggtcatctggcagcccgaccggggtgtgggcccagtcccggatggggacagcttgctccatgtaaaagtgtccaggttgaaggcatacacatcattgtaatagatgtaatctctgttgtaacacagggacaaaacaaaggggtggcaacatgaaaacgtgaacttcacttaaaataaaggtgcctttcctacacactgtgccttctgaggcattccaaaaggcacagtggccctgctcacgccatgctcccgggacttcaggggcaaagcactcaaaacacagatggggccttgagaagaaagacgaacggggcagggtgggtctgcccaagtcacacacggggaatggtgccctgaaggcaggtcacaggcagccgtgggcaaggggctcgggtcagagtcacatgatgagaggtgggcctgcttccgcaggaaggacacacggacatgcggaaggagcaagcggctccaccgtcgga

SEQ ID NO: 39865 - DNA, 2238 bp, Bovine  19866880828724
cctcggccaggcagctcagtgctgccccatgctattcagtcccccttgccccgcacacctgcctggcatggcagccttcttctgcccctcttcttttggcagaagacaagctctaggagagcagggctttagggggtcatttgtgatcttgaatgaaccccaagcacctggaatcacacgcttggttatcaccagtcatcgaccgaactcagtccctcgtccagatcagaaggtgttcatgcactgatcaaggtgcccttggggaaggcgccctgagccctggtctgtggaggggacagcgtggacgcccagccctcaccttgatgggccgctccagctccggtttctggtagcgaagccagagcatgccagcaatggccagggccacgcagagccagttgaagaagctgaagaagttgatgacggagaagatatctttggagaaggcatagagcagggtcatgatgcactgcaagcagagggcaggccatgagcctcaggatgagccagggggagggatgaccgcacgcaccccttcttagcagaagaagtggtccgcaccacgcgagggccctcagagcaaagggacgtgctgatggcaggtggctgaggtcctgggcttcatggaggtggcagaggccatgtctaccctggtcgagaggtttggcttcaagtgcctctatgctgattttagatttttttttttaacaactaccgtgtattaattctggagaaacaaaaaactgtcttatgctctctggcatccaggggcgcatgtgatgaagggtactacacttgtgataacctatctacatctcatctcagcctctgatccccagcctggctgacaccaggtggaaccagcaaaaggggtccccagacagggcatgcaccaccatctcaaagcccccgtgatccccaagggacacacctgtcctccacctgccagtgaccccctacgtggagggcggggactcaccgtgaacaccagtgagggtacgggcgtcagcagccgtgggtggatcatggagaggatggagggcagatggccctcccgggcccccacgaagaacagcctgtggacaagggggttggcggtcagcctcggccaagggacccaggcaggtgggggtggaggggcctgtgccgtgggcctcagtgtccctcgtggacggctgctgaggggtcccatcagccctggcccagcaaggtccagatgaacccacgagggtctggatggacagggtagctgtgtcacctctaggcagggatttgcgttatttccaagtcacgtgaacatcctgacggctacattgttactcaaagtaacaagaaagagaaccctcagaactcacgtgaggaagccatgtgcagtgtcgacccacaccctgtcctgctctggccccacggggcccgcacgacagagccgccctggccgggctcacctggaggacgtgaagagggacccattgaccgagccgaagcaggacaggcccacgaacacggggatgatccaggacatgacgcccaagtggtagttcccgaagtcctggatggacacggaccgtgagccctgcctccgagacacccccgccctgcagtcccttcccgagacacccccggccccaaagtcccctttctcatccacacgaccctccctgaggagctcagtatttattcagatggtggaccagcctctgaggtggggctggaggtgtgtaatggactcagcccctcagctccagcaccgctgagccaatctaaaaccgtccgggcagcctgagcaccagcgccgttaaagcctcctgtggtccccacgcgcagccagtaccctgcacgcccagcaggcctggcaaagcaccggctcaacccctcctggtaggaggatggtttgcaaaggaggagccccctctgctcctgtctgagctcggagggcagggctggcatcttaccacggccacggcctccgacgtgagcatctgttcgggggtcagtgtggtgaagtaggccaggttcgtcagcacgtacaccagggtgacgattgggagcgagatgataatggccaggggcaggtttctgagaggaccgggcgggcatgtcaacaaaacaaggcccagcacggggccagccgacccctcagtggctgagcccacatttcactgcagggggagcggcacgtggctggaaggcggtgcatggggcagggcagctgtgcaaacatggccagcaacccagccc

SEQ ID NO: 39866 - DNA, 1189 bp, Bovine  19866880936906
tcatccccagccagcaagtgcaaatcactgcagccgtgtgtctgtaacaaacttcactgtctctagacccctgggcccactcatgcactgggaggaagctgtcctaaaaagataaccagtgatacaaggatttgtgtgcaagaacgttcatttaagcttcaaaagaagaaaaacaggcaagtccctggtggtgcagtgggtgggactccgggctttcaccactgagggcatgggtttgatctctggtcagggaactgagatcccacaagccgtgcagtgtggccaaaaggaggaaaaaaaatatccagcaaggttaatatttaaatacgtaaatgtacatccatatgattaaatatcatgcagcctttaaaaaacaacttcagaaaatgaaaggcatggggaacactcacatttaggtatgtgaatgtgtaacatagaaattgtacagacacatacattataggcattggaaaaagaagaaaatatgccataattttaatagtattttttatctgagtgagtaaaatatattttttgttttctaattttttagaaattcatgcaaacaacatgaaaaggtcaaacagaagcaacttctaaaaaacggcagctgctcatcccagtggctgccctgtctcctagcaggccagtgctgtcacggagctgtcagaggtgctgagaagcgccgacaggaaaccccgccactgggggcaggccggtggagctgaagcctggcgggagaggagccagccaagcaaacacctgcgggaggggcttccaggagcaggaacagaccctcaactccagcatctaccgacagagtccctgatttccaacttgtcctccaagtgccgcctctatagcgggaagaacaacgtgctgaatgttgatacttgtaagtcaatgggaaaaaacacataaaatctgaacgaaaagtgatttgtaagcattttactaaagcagtgattacgtgtctctaaaaaaccagaacaagaaaatagatagtttaatagtgaaagctatttgctgacttaggacaagtgaaagccagagctaaccaaaaaccgttttccacataaaaacattccttttaatattccctaccctagagctctgctcattaaaaagagagaaaagatgggagaaaaaatgattactgctcaaaaatctcagcacgagataccaagta

SEQ ID NO: 39867 - DNA, 1547 bp, Bovine  19866880968485
ctgcagcgtaggacatgtcccccgactttgtcctcgattggtcctctcagactgtctgccccctgtccacctagcctgagagggcctctccctttcctccacttggtagtgggggcagctccccaagggcaaccgtttttttgcacaaagggggccacatacctgccaaggccctggtgaacacattggctctgtcccccaacagtggtgttggatcgaaggcggagcccctctgcagctgacacaggcctcttgcctgcttccccacctagcagtcctgcagaggccaggcccggccttcctgccttggacaggttccccaggcgccagggcgacctcagtgccctggtccacctggctccctgcttatggggggtgctgtccccgtgaggccaggcgtggtgtaggcagtctgggctgaccttatgggacccttgctctccccaggtctcttgccagtgtgtagacagagggtggagtccgtgtgtagacagactgcctggcaggaggcacagtgtttgcagagggggacgagtgtccctgggcccctggctgtgtgtgggtggggctctctgcccagcggctgtgtacctgtggtccagcctgtccacaagggccctctgagaaggcaggcacatcttgcttgttagtggtggccatggtcttcctagaggcgtcaccccccatcagccgaccgtgggtggggggcagggttccctccttgtaatgtgggaacctgggagtccaccctcctctgaccttgagaagcctgcttgttcctgctcacccgccggctcccgctggtctttgggtaattactgcctgctgcccggtgctgagctgggtcagtggagaacgcagcagggtcccgtttctcaagaggccggtgtggctcagggaggccagcctgggggaacctcaggccctggcagacagcagaaatgctgctcaggcagcatggtgggccttttggatcaagaaggctcagctaggcacagggctgtctgggggtctgtgggagaggccgggtgggccccagggaaggccagctccagcaggggcggagggagggctccaggggtgcccgggtcgtgtcaggtgtggacgggaggagacacatggaggagactccaggctccctggcgtcagctgcagccccccccggcaggttcatctggccctcccagtgttcttcatcctggcctgcctcttcctgatcgccgtctccttctggaagacccccgtggagtgtggcatcggcttcaccatcatcctcagcggcctgcccgtctacttccttggggtctggtggagagacaagcccaagtggctgctccagagcatctgtgagtccctccctgcctgctgggcctcctctgtcccccaggggtctgttccgcccacctggctgtgctcctctgacctcagtccagtggccaggagcagcacagtggggcagtgccccccgccgtgggtcactggcagggttggggggcggtcagcatcaggatgtgcgaggtcctggctgagaggcccgcagtggccaa

SEQ ID NO: 39868 - DNA, 1114 bp, Bovine  19866881138949
cctgttagcttctgatttcctgactgtcaggtggagacgccaaagctacctaactcaactggctgtgagaaagcccagggagcacaaagcctggaggcagcaaacactcattaaccattataaactgtcctgggttagggaatccctgagcaatagtcaattaggaacagagcgctcgcctctaagtttagtactgagtcatctgcagaccctgctaaagacgtgaaaagataaagagggtaggagaggaaggagggagggagaggaagggagagacagagggaaacagggacagacacagagaaatatccctggtcaccatcaacagttacggaacttcccacagtcccactccctccaccgatgctcactgctcagggctgccctgagggtcacgtgccccgtttaaagcggaggattgaggcttgcagaggtgccccggatcagcccggccgccgccagcgccccgcaagggggggcccggatacgcccgcgaccccggacgaaagaagcctgcccgccccccgggcccgcacacctcctccttccgcgagcgcttggacactttcttctccatcttagcggccgtcttctccgccccgcggcccttcttctctttcttgccctttttgcccatcgcgccggatccaaggaggcttctgaaccgcctgtgagactctagcggcgcgccgcgcgcggcgcgcaggaaatacgtgctggggggcgcgtagagagtgcgtcacttccggttcgcctctcgcgcgtttccgggcgaatggtggggcctgttcctggggatggctgcttccgtagtccttcatggtccgtttatacaaaccggcctgggccttcgggctcggggtggtgtccgcctagaagcagcgaggccgcgccccgtcctgttcccccttcagctgtgccggggacgcggcgcctgtccctccgccgtgtttgttcaacagtgctgagccccgtgcacggtggcttagttggcttactcggtagcacgaacccttgagcaaattaaatggttgctgtggcttcctgccctggagagacggtcatgctcttaaaggattcgcagaccccgagcgaaggtgtaaaacgcactaga

SEQ ID NO: 39869 - DNA, 1074 bp, Bovine  19866881273449
ctgacctttgtgattattgaaaacatagatggtgtctttatggcctcttggttttttggttactgatctgtgagattttattatacaccaggattattgatgctatctatcttcttgattggtaatttgtttttaatattcattttgggggggttttgttcttgtttttctttttttgatgcccaaagtttcaaattatggtgtcattagatctgttaactttcatgtgttttagtgtttatttttctgttgagtctctgcatacattgagatcagatacttactgatattttctgttagtttgtaccttctcttttcttaaacatttaatgatctttggatttattttcatttttttgtgagtaagaagtctaattttgtgcctgctcaggcccacacaaaataatcaacttattgtctccactcaatttattgaataactcattctttccagtgtttttagaaatgaaatatgtggataattaaaaaataagactgtttgaacttgtgttgaaggtttgaaaaggcctctgtggagtaccaggagcacctgtgtgccatgacaggtgtcgattgctgcatctctagcttcgacaaatccgttctcacattggctaatactgggcgtaatagtgccagccccaagcattctttgaatggtgagcattccaagtttaaacaaacagttgtagtcaaataatttgtactcatgatcttactatacatttttagatatctctgctctttgaaatatttataactgctttggatctctcttgctgtctctttattttatgaaatgttttcacttaggtgaatccagaaaaactgtgctttccaaaccaactgattcttctcctgaggttataaattatttgggaaataaagcatgtgagtgctacatttcaatagctgattgggctgctgtacaggagtggcagaatgctgtccatgacttgaaaaagagtaccagtagtacttctctcaacctaaaggctgatttcaactacataaagtaaggatttcttttcagttatgaattatacttaaccccattaaaatttttttcagtaa

SEQ ID NO: 39870 - DNA, 886 bp, Bovine  19866881476798
ctttgactcacagacctttgttggcaaactgatgtctctgctttttaatatgctgtctagattggtcatagcttttcttacaaggagcaaacatcttaatttcgtggctgcagtcaccatcagcagtgattcatgaagacgaaccgtaaactgtagactgaagctcagttccctgaaggaaacacacaggcttctgtggaggtgaaatggggccattctttagatagggaaaccaagaagcctttctgaagccaaaatcagaaaacttcttggtcataggaagagggagtgggcagggaaatgggggctctcagtcctggaggctggaaaactggacagctttggctggaatcctgctcagtcattatttttcctttggccaggcacttcacagagagagctccaagctggtgtttttttttgtttttgtttttttaatttagtatttatttggctgtgttgggtcttagttgcagtatgggagatctttagctgcagcatgtgggatctagttctctgaccagggatggagcccaggccccctgcattgggagtatggagtcctagccactggatcaccagagaagtcccctccaagctggcctttggggaagctgagtgggtaagcccaggtcacctgaggagttccctgaggtcactaccatgagctgttcaccctatagcctggtgcacagagtcgtgaaattccacatgggggtctggctttttgttttttctccctggcctgtgttttgaaattgctgggtggtactacgtttataaacttaaggagtttcctccaaaatgaaatcaatactgtcagccctactttatgggagaatgatttccaaattgcacaaaatgaatccctctaatatctgcattt

SEQ ID NO: 39871 - DNA, 1089 bp, Bovine  19866881724879
ggaaagaaaactaaaacaagaaaaaaaaaaaaaacatttgttttctttggcacttttaaagcatttcttcctagttttccaaaagttcacttctttcaacccagccctctatctttgttctggtcctttgtttacattgaaagctgtcttcacttgtgcttcccagaaatgctgttttttggggttatttttggtgaagctaatttgccccatgtgacccacacagctcaaccgagcgctgtctgactcacgctcacaagcagagccgtcagcagcctgacggactcagaactgagccctgcttggtgccggggtcgcttctgctgctgccgggaggctctgggaagacgtggtccagccaccagcccagcgcaggcctgacggatgttttccattaggctcacagccccacttcctgccagtgcccgccgactgacgccctctgggccagtcagctccttttccaccttcccagccgcccctcctacgacccacggggtctggctcctgacatctcccacggcccttggctccatccactgggcctccagggcaggaagatggtcaggatacactggaggcctctgtcctggctgtgccctgggccagggccccctcaaccatgtctcatacacagctcgggctctgcagccgtggccctgccgactgagccaccaaggccaagacctctttccggcacacgttcagcttcctccactgcactcacctcgcagggtttttgtgagatttaaatggaaagctttagaagtagcgcgctggaaagacagtcaggactcagtgaagtggcagttgtagcgacaaccagggcacgtgcaggccagtcgggaaggcaatcacacaggttcacgtgctgacacacggcacggcggggacactggaggggacgcacacccacagggtcccgcagagaagctcccctgggcggccgctcgaccgcaccccgagaggagcacacaaagctgcaccactgacctcacccagggatgcagtccaggcaggccccggattccacatccccgtcttgggaacctgggggctgccttctcctctaaagacactccacccaca

SEQ ID NO: 39872 - DNA, 781 bp, Bovine  19866881764041
cctcttcagttacagagaatttgaagggtcttaacctaggcatgcttttgaggatatacaagtgaaggaattctgaagtatatgccaacatgtactgtaattttgacagtcttatgaaataaaatctggttatcctttctcttctgtagtagaaaggatgaaacgaagacctaataaaacgtctcctgggtccagagactctggacccagaagggtgtcctgcatgctgtcctgtacacatttacagagggagccctgctgccagggcccgggactgggcccgccgttggagtgccccctggcagctgagaccacaggccccgtgttgtgggcccagagagactctgttcatacagtgtagtacagtgtgaatgtgggaaggggctccaggaaacccacgaatcctgccaagaactaaactgaataaagcaggaagatgagaggttaaggtgcttctgtttagtttttcctgatacaaatgtctcttaattgaaaattaaaatttctctcccagttactttttggtaataatacattttaatgctgaaaaaaccactctgtttgttttttaggtatttggcttcgttaccttctcatgtgttaaaaaatgaccatgttaagaaatttttcagcacttcttctcccacccaacagcttcaaagtccaagtgagtttgtaaaatgtaattcagtaaaagtagaaatatttttacggtctgtgaatgaattattctcattttaacttgtaggtcctggcaacccttccctttctaaagtcggta

SEQ ID NO: 39873 - DNA, 2963 bp, Bovine  19866880506510
ctgctgagggtttaattctacattatttataaagcagaagcgaagtccaactgctctgaggaaggcatcacagtggtgagacgccagaacttcttaatcctgtgcagccaactgtaccctccagatggactattggaatcaattgctgcttctttgggtgagcaccagatgaaagcaggggctacatttagaggccaggttttaagagaaatactcacttttttgcctggaacaccactccatgcgggaaggcaagaggcaggctgggaaccgggataagcagagccacgtcacccgtctcacattcactcactctgcagtcgcgccgtacaataacgccactgtcactagctatccaaatctgaatgagctcggtccctcagtcacaccagccacaatgcaaggactcaactgccacctgtgcctcctggctactatcctggacagcacagacccagagcactcccatcatgcagaacgtctactgtctagcagacggcactgggaaacaagcactcgctgagctgaattcgcctctgctccataggtacagacctccacaacattattatggtctccgcggaaagacagccctgaagaatttacatgatagaaagtgacagaactggaactagggcctcaagcacctgattcagtaacattatagacccaaagatcaagaaaatacagaatggtatgaacaggaggagggagaacaggggatctggctgatcagcagaaagatcctgtctgtgaagaactgaggggttcagataccagattagctttcccagagacacaccacaatcatgaggtagaaaatccagtacaggtcagccatgacccctctctgcttttcagaggactccagacaaggattttgaagcctggtaacaaaaggaggtacaaggaaaatgagtttcagatctgcctatgctgcccagggttttacaacctcagggcaatcccttcctctttctttcttctacattcaaccttcatggcaattatctctgtaataccctcactgttctgaagccttcagagtctaccaaaggtataagcttttaacttgttctgcaagtttaaaatagtctgtttcagccttcagctatttctaaatagagttgatgatggccctcaaaccgtcagggttgagtttggaggaaagttggaagtgtttgtaggttgatgacaaaatgatgctctcatcacagaaaacctaagacaacaagagctgatctgctgtgtgacctggagtaagacacttgccctctctggggtctggatctctctgcctaatgtttaaccacacagtggtggctccagatgtttcagttcaggtgagcaatgggatggaaacagctgaggcagtcatcagatctgggccttggaaaggctggtataaggggtgtggttaagggtcgggactcaaaatctaggctccaacccaccactgaccagtcagttacttaacctagttaagacatcttccctactgctaaatagggatggtcaaatgagatcattcaggtaaagaatttggagtactacacacataacaaaggcctcataaatgttagctaacagcattatccatccctgctcaggagcaggctgcgtgtgacttggggtgtggaatcagctcccattctgagcctaacttcatttacccatggagtaaggtgacttcattaacactggataacttgcattgcacttgactctgaaattttaagcaactgcacaatgcagatttagtcacttgggaatgtgttctggaatatgtccctcaattcactgtctgggaagtaccatgtgctgctcccgagtgatacagctgactgacaggattccatcttagaagacatggtcgggccaaaaatgtaacttctagcccccctgcccccgactagggcttccctggtggctcagttggtaacaaatccgtctgcaatgcaggagacccaggttcaatccctgggttgggaagatcccctggagaaggaaagggcaacctactccagtattcttgcctggagaattcaatggacagagaagcctggcgggctacagtccatggtgtcacagagtcagacacgactcggctactaaaccaccgagtcgctctggttttgtactataaaaggaagtgtgagttattcctcctggtccccgggatgctccaaccactgaagagaaagcaggcgtttatgctgagacaataagtccctggaggagacaagtcagaggacctgcccggcccctcccagtgctgagggtctgtcctctcctttcctcttgcatactagcctggaggacagatgggtacttcatgatatgagctaaatggagtcatgtgctccactctgataagaattaagtgaaaacagaaagaaacagaagcttgcgagatcagaatcttttctcagactggatggaaatgttccatttcatcatgactttaaaatagcaacctgaaaacttgttcttgacttgactactgatatacaagataagtatgtttaacacaaatgtccttaatagaggtattttttaaagggcaaaactttaaaaagccaggaccacagggctgcaaagggaggaccctcttcctgtcctagcttgaccagatacacagttgaaccctaaatgcagcccgacactggagaaacataatgaggggagaaggcaggaagaatgaacttcccattagttaatatgctgggggaggaggaagggagagggacccaaacggaggacctaataaccaaggcctctgtttaccaaacaccaggcaaactcagttcaattcagtcgctcagtcatgtccaactccttgcgaccccatggactgcagcacaccaggcttccctgtccaggcaaactagatttcactaattccagagatgggaatcaggtactcaggaaagatatggaagcaactaaaacctcttctaaca

SEQ ID NO: 39874 - DNA, 3062 bp, Bovine  19866880601471
ctctttgcgaccccatggactgtagccctccaggcccctctgcctgtggaattcttcaggcaagaatactggagtgggttgccgtgccctcctccagggcatcttcccgacccaggtatcaaatgcacatctcctgcgtctcctgcattacaggtggattctttaccagtgagccaccggagaagcccattttgccagctgctaccccgcatagtattttgaaataaatcctagatatcaattcatttcatctgtaaatatttcagcacgtatctggatatatacttctttttttaacaaaaagcccaaacctgaataatttcatcatgcttcaaacaataaaaatttcttaatatcataaaatatccagtgttcaaatttccagttgtcccataaatgtcataaataatataattatctctttttcctcctctccttcgtttttttttttttttttttgctagcaactaaaatacacagagtgcttcctagactcttgatactattctaagcgcgttacatgtttattttctacaatgatcttaggcaaaattgcttagcttcaacaagtgcctgtattctcatttacaaatgatgttaatacctcatatacaaggagacgatgaaatctgagagataatggagcttaatttatctctttttcttttttccagtttgtttgcaaactgtattcaaagaaggccccggcaaatgactggtgtctttttttttggtggggggagagttgagcaggttttagctgtgacatgagaactctcagttgtggcatgtgggatccagtgggctccagttccctgaccagggatagaacctgggacccctgcattgggagcgtggagtcttggtcactggaccaccagggaagtcctgattggtgtctgttaaatcttttgaatttgagaatccagctccatgtagtacgtgccctttctctgtctctctttccctctctttctttctctctctctctccttgttgaaatcattcattgaagaaaccaggttgcttgtcctgtagagttttctaccatattaatctgcgtgcgctgccataacaaagtattccagactgggtggcttaaacaacagagatttatttttccagtcctggggaccagaagtttcagatcatgttgccagcagggttggcttctggtgagaactcttccagacttgtggacagctaccttatcgtgggtcatcatatggcctttcctctgtgtgtacacgccagaagcaagggagagcactggtgtcttttcctcttataaggataccagtcctaatggagtagggctccactcttatgatgtcatttagcctgaatcacctccttatggtcctgccttcaaatgcagccacattggggtttagggcttcaatatgataacagagggagaagggaaggagaggactcagttcaatccatttcacacacggtctggattttgttcattgcatccccatgatgtcatttaacctattcttctgtcctctgcatgtttggtagctttgtaactaggtctagatgcttgatcagataaagatttagtttttgataaaagataatttcataatagaactttgtatctccatctatattactttatatacacgaatttcacatttactgaaagtcttatagtttaattatccaaacacagaactcaattcctcaaagtagccaaaatacagagtatattttcttgtataaccctgtcacatttttcaacggtaaaatcacaaaatacgatactgagagctcgtgtttaatgagcgtcatgcaccagacctgtttgttcttcagaacaagcctgtcatgcaggactgttgtttcctaattttgtcaatggataaaataagatggtaggaaatcttattaaactgacttttaaaaacatctcctcaaatatttcgtcaagtgttaagtgaagtcaattctctttgggaagagcttcgatgggaattgggtggggcattaaatcaggagacaatctccgtaggagagagagagcaggtcgtcaataaatattcacccaacctagtgacatgaagtctcaccacagcagtttggttcctggtgagactgaaatacaaaatacgtgcggagagatactttccccacacccttttatatgtttgagttcctactacctgcctatgtctccttttacttttaagtattttcaccgatttttagcaaaaatccttatttgattggacttattaaactgacttttaaaaatatctcctcaaatatttcgtcaaatgctaagtgaagcccttcgtggttataagtttagtttttagacagtgattactgtatatgggattctaaaatccactttgtggattaactccattaattctcacaacatccctcacaggtgggtactattattctccccattttgtagatgagaaaaatgaggtcagagaaggggatgaacttgcccaaggtcagccagccagtgagtgctggcatctagatttggcttcaagccgactgactccagagtctgctctcacaacctcaggggcctcacgcgccgttcgcacccaggggcctgacgtgcggagcccacagcccactgctcctcaggaggccctgcggccacgaggccgcatctggctcccacggccccctcagtctgtaacttctcatgctcgtcacccagcatggttcccggccggctccacaccagagccacgcacattcacacatccagacggctggcctctcagacataccaggaccctgccattcgccagtcttccgtattcctcacagcagggaagcctctttggaaaaagtcctttgggtcggaaaactcagagccaaggacatgaatgacgcgggatcggagaatgcagcccggctggtggactggagggcggggagggcggggagggcgggggcgggagaaccagctagtgatccgcgccggtccttcggtgtccggccccctctcctgcacacgctccccgccttcctctgcccggctctgcgctcaggaggctgatcccagggcaccgcatcag

SEQ ID NO: 39875 - DNA, 776 bp, Bovine  19866880647518
ttgggaaggtctagaggcagcttgtgcaaaggccctgaagcaggagctaaataataagcacctgaggccctggggatcagaaaagtgtgtttggaacttaggaagccaggatgatggcaagacatgaaattggacaggaaaattgggttgaattttgagtgtaagcaataatcattagagttctttcaacattaaaaagtcatgctgggacttccctgatggtccaatggctaggacgccaccctcccagtacaaggggcctaggttcaatttcttggttagggaactagattccacatactgcaactaagacccagtgcagccaaatattaataactaaacaaattttctttttaaaacgtcatcctggctgctgtatcattgccattagcactgctgtgaacttctgcagggcaccatgcactgcgtggtcagtgtagcagagccccctggagttgtgcaaagtgcagcagccctgtctgtcctcctccatccccatgagcgttggaggatcctgaggctaaatgactttggggtagaaagtttttcttggggctttgatgatgtcaatcctctgtcatctttgagaagcccaaggggaactctggcccctccagggtgtctgcactgatccccataaacacttccttctccctttcatctgaaaggctgagcgtggcggcagacgcttcctcactctctcctcccttcaaactgacactctctaagcctttaagcagcttgaactccatcatctcagcgcccctggaagggag

SEQ ID NO: 39876 - DNA, 1202 bp, Bovine  19866880752237
ttcaaaaggaagtaggacaaggtgtcattcaaaatgatttgccttgggcaccaagaatcaccaatgcctttctctccagtaaattctccttcactgttgccctgtagacatcccggtcaaactgtaaggttgtgttaggagcttgtgtccaagaaatctttactagtgcagtatcttgatacaggccatcagaagctctgacgataagctcccgagagagtcccaggagagaaggatccaacacagatatgcgaccagtaatgggatgcacggcaatagcttcgtcagcattgccagttttgatgctataagtgacttctgagtcatcgtcactggcctgcagcataaggagctccataccccggtggattggcttcattattgctacttcatatatctggtccaagaacctgggaggacagtcattaacatttctgacgttgattatgacttgggcagccctgggtgcaaataagatggggcttccttggtcatggacatagatgtcgaatcggaaagagggcatgctttcataatccatctctaatacggtggttagagttcccatgctgggatcgatttttaaaaacttcagagtctctggttccaaaattttatagaccaacaaggaatttgcttctttgtcactgtcagaggctcggatcacgagggggtttggttgttttcatccatgatcatgctattcagtggagctgcttcactaatttggcccacaaaagtcgattttgagaacacaggagcattgtcattttcatcaatgatgtaaacaagaaccatgacatcagtaaatgtgcccgccatattgctgcctcgaattttcagctggtaagatgaaattttctcatgatccagtttcttctgagtggagatgagtccagaatatgagttcatggagaatacaccattcttgtttccctctcttaactcataggtaacttctgagaagcttgtagctgagatgaggaggattggggaacccacagggattgattcagggatctctacaaagtactcagagtttgaaaagatgggggcactgctgtcggaggggtagacgtgaatgatcactgtagccaggtcatgcccttgtggggagccttgatcttctgccttcactgttagagtataccgggcatgatttgcctgatcaagtttctgtgctagagtgatgatgcctagca

SEQ ID NO: 39877 - DNA, 1211 bp, Bovine  19866880816370
tattggtttgaaatctttcaagagaaacctactatagagattagtagtaggtctcttttttgtcctccgatgttattctgtcacactgttagaacaggctccatatttatctagatactctatagttaaatcaggtttaaaacattgtaaaaggcagttttaaagacatttttaaatctaaaagtcaaattctgaaagaatggcagcttttgtctcttgagtcctgctccttcgatactggccatcactggggaatcttgccattggtcagctagctaggtacattgtacctgccgttatcagttgccttggtttttatttgccttctttttaaaatgctgtttttgctatttccccccctttgtaccaatagtgctgtcatgtgcctgtcaataatattttccaagtactgattcacagaatttttgaaaaaagaaagagaggaaggtagagataaaagagaagagtactcatctaaaaacctaccaccttttcttccagctgtatctgtgtggaatgtttatgtaattgtatcatagtaaatatataaaattttaaaatatttttctcactattatttcattagcagtttttcatgtactacttatcctgcattgtactttttagacagtgcataatagtgcaatagtgtggtttagttgatgtgcagtacactaacagacagatgttcaggaacatttaggcttgctgctgcttaccattcaaaggctttgctcaattttcttcatattttaatcatcttttccttgtcagattatatttctggggatgggatcacctagtgaaagaatgtgattctttttatatagtctctaacatttgagtttccccaaagcaagtagacttttcttggcttgaaggaaaaatagaaaggctacacacaaccccaaattatctctgagatgtcatagtgtcatactttttcccttaagagaatattagatttaggaaaggtttgaccggtctgatgctggggttgaaatcatgcatctctgtatagcctttgctctattttgttttctctctttcagaatatcccagaccccagccacctccccttggtggcttcctggaagacctaccctctgttctttggcacggccatttttgcatttgaaggcatcgggatggtaagagatgcatcgtgattctctggtgcccttggtgttcttaaggtccattttaaggaa

SEQ ID NO: 39878 - DNA, 1153 bp, Bovine  19866880828787
atgtggtttaataaaaagatgaatgaaattaaagttggacagcaaaggaatgagccctctgtatacataaggaaaaaggctggatcaggcagattgccattgaactcctttcatgtgaagtccactgttctgtatcacatgagccaactttgcagggaagagggcagccctgacagtcacatgttcttcatactttgggcaaaggaagaataagataccttccccagtgtgcgtggtttcggagccaggcgctggggttggcttctagtccatgcatcactgtatccccataatccataaagggcttattgaacctgcagaagagagtgcatacagttagcgggaggcagtttaacctaagatcacatactgaaaagtcaggagacacatagcaaggcagaacccagctggaatggaaagaacactggggcaggcacccaagttctagttcagacttttgacacctggtggtatttccctgatggcttgttttccttacctgtcaatcggggcggtgactacataacaagggtaataacacacatattgcataggtacaggtgttctcatatccatgattctattggatcctcacgacaattctctgaggcacagttaggcacggattgtttatgtccaatttacagatgagccagctggataagcacaatggtctgactgagatcagctaatgagtcacggaagagcctccttaggtccctgccccaaatgcttttctgtttttctgggccttgttgaaggacattaagaagtgaaatcttattacctgggatgtttctgggatgtctctgagacccaagtactgagggagttgacaagatgctgttttcctcacctgtggcagaagcgccgggcacacctgatcaggatgtgcatagagtggcaggagatgaagccaatggccagcaaactgagtgggcccatctggaggacgggccaaggggcaagggaagagaggagagaatgagtttgtgaataacatggagaggagagatttggtagcacagatattactcaggaatcagagaactttctagcaaactggtttgtgagccttttttagcagtaacatttattctttcttttcttttttctttcttggaagtatagttggcttacaatggtatgtatt

SEQ ID NO: 39879 - DNA, 1510 bp, Bovine  19866880845048
cctggaggaagaaggcatggcaacccactccagtattcttgcctggagaatcccacaaacacaggagcctggcaagctatatactccactgggtcaaaaagagtcgaacatgactgaagtgacttagcatgcaggcagagcacattcacatcttaaaggctctgaggagtcctgtaatgaaaggacctgctcaatttgtttagctccatgttaagtatgagacataaacaattctattcctttttccttctgagtctgtggactttaagggacatatcaagcactaggagtactgataaaatacagctccctgggccccacctcaggcacaatgaaccagtgtctctgtgaaggaaggcccaggaagctgcattttgacacactccccagtcattctgattgagatggccccatgcctccacttctgtggatgagataatgctggtactcatctaaccacctccttccctcatttggtcttttttttccttgccactctgctcagcatgtgggatcttaggtccctgacagggatcaaatctgtgccccctgcagtggaagcacagtcttaacccctgggccaccttccctcattctgaaccctgactttggctggtctctgcctactctggcctcctgtcggggggaagggaccttgactggccccgacaacctcctggaccctttgtcacacagcatctctgctcccacaggtgaaaaagatccacgagaatgagaagcgcctggaggctggcgaccatcctgtggaactgctggcccgggacttcgagaagaactacaacatgtacatcttccctgtgcactggcagttcgggcagctggatcagcaccccattgacgggtaagaccccagaacctcatgatcacggaggggagctgcctctagcttggccctggagtgggcagtcgctggtcagggctgctaggtgcactagatgtggtcagaagacctctgctgctcccagccctggaggcccatagcttgcctaagggctgcgacaagagaggataggtgtaggagaaaggatgtagaaaggatttagtgccatgagacactccctccttactgcctaagaggcagaagccatcagaactgaaaacccctccttaaccccgtgagtgccagccttgggtatccattcagcaaggtagaaggagctgggaaggagcgccagactccgtgggctggcaaggctgaggtggggcagcaaggccctgagacccggccccaatggggcaaactggctctggaagttcttaagaccatcagagtgcccatcccgtctccatggcaagcctttggtttgatcactcctgccccatgttgaaatgagttaggaagtgctgtgtaaacgccctgtgggataggccaggagtggtcagccaaccaacatttattgagtgtctattacatgtcgagcacaattccaggcacgggatttaactgtagtgagaactaccacgtaggccctgcccccaggagctcacc

SEQ ID NO: 39880 - DNA, 1043 bp, Bovine  19866880862182
aggcacctcctgggggcctgaacccacactcgaagcccctcttcattcctgccctcctggaggatggggtggggaggacgcagggggctgtctgtgactgcttggacagctggaacgggcagaaaacaagcaagttcagcaagactttgatattctagctagagagctcagaactgaccacaccccgctccctgcagtcaacaactggaaacacctacaagaaactgaatgcaacaaataatgtcaccagtagaagtggacctgagcatcccctggttgggtccattcatcctcagctgctccagggagggaaatgaagccaggacctgctgccagagcttagtctgagggctaagtggctcctgaagcgcatgaagtttttccttctctccctattcaaagcctatctgttattaaaggctcaaataaagtcctttccagtccacagcagctctcttccctctggtcacccgtagctgttttcttcaccgggcattttgcacaggcagccccgtgtcactacagcttaccaatgcctgacatctctctgcagttcagagctgagcacacagtacgagaccctgataaaaaagcctggagctggatggaacctgaatcaccatggttgttcactctccccacccccatgttacagatggagaaactaaggcccagagagggcaaggggcttgcatgaatggcagctggggagggctggggtgttggctgaactaagaaacaagggtaagggttgtccctgtggtgtgtctgcactggcaggcatggaaggcagcatttcaactgatgaatctgagacgtccttcagcttcagcataattgcattttaagaaatcaaattctattttagctctctgggggcttttttttccccaaaccttaaacttcttattttgtattggggtatagctgattaacagtgttgtggtagtttcaggtcaacagtgaagggatttagccatacatacacatttatcaattctcccccaacccccctggggactttgtgattaaagaaattatat

SEQ ID NO: 39881 - DNA, 3329 bp, Bovine  19866880897408
accttgacgacaaggaccagatattagttcttacacttctccagatgtgagctgcgcactcataaatattcatacactcactgatattctcataaatatttaactaagacctgtcatatcaagagttcatccacatcaaagtgaaccaggttgggacttcctggtatctagaggctaatctacttgctaatgcaggggacacaggtttaatccctcatctgggaaggtcctgcatgctgtggagcggctaaacccgtgtgccacaactactgaacccatgcaccttggatcctgtgctccgcggctagagaagccaccacgatgagaagccaaagcaccacaatgatgagtacgcttcactcatcgccagccagagaaagcccacctgcagcaacaaagacccagggcagccaaaaataaatacctaatttaaaaaagaagtgacccggactgaatgtagaatccgcctgcctaccccacttctagacaggtgatcttgggcaagtaacagcttcttagcgcctctgtttcctgattagtaaaatcagcatagtaacagtatctatgtcaagggtttgccgagaaaattctaagtcccaagtaaaccttggtcattgttatctctgtgatcgtaatatgtatcagcaatcaccttatctattctatactgatgacacagatttccccagctagatggccaaccccttctgtgtctatcggtggcacagctaagagtttgagtggttatttttagacagtatcccgagccatcagtgatgacgccatcaatggcagcttcttcagtctgtacagaggcaagtcctggccttgcctttgccacagatacaaccccctcgcagggctctgccctcctcagcactgcatgatgccagggagctcttgtaaagatcatcggtcagacactccagacacttgggcctcgatattccccttgggaaccctgggtgggtgatcccttgtcccctctaggcctcagttcccctctgaatgaggaggggactgttctagatgattcccccagcctttccagtcccagcgctctgctcggtcagtctgtctaggcaagagctccagaacccatgtggcgggcggggttgggaggcgggtcaggacagcccaccgcgaggagaggaggaaaggcttggaagacagagacagctttggctgtggggagaaggggaggggaggggaggggaaggaggagacaggaggaggagggaccacggggtggagggggagacagacccagcccagagactctgagtggtttcctgttgccaggctctaagcccctcacattcctgcagacctccagactgcccggagcttgcctgctgcctgcctgcctgccactgaggtatgtccgacccctgccctgcctgtccctcttctaggcctgcaccccctgcaccctggcccactcctcactttgtgtacaaggaaaagaagctgtgttgggaggtctctgggcgagggactccatccttgctctcctgaagggcaagggacacagacttgctgcctgttaactcctcaggtgaaactgagatcatgtggtctcccctttggatttgcagaaagtaatccgactgtctctgagagagtattttctccctgtccctctctgcgcctgtctctcgggtttcagacgctgcctttacaaatgggggccacctcttcctttcctgggaatattatctgggcacagctgcaagagggatgggccaccagagtctgccctgcttcccattccaggaggagaaactttctaaacttggttcttgcactctgttttcccgaagggacttggcctgggtgataaactgatctttggagggataagagggggtcttcacctttcatcagcacctctgtgaaggctcctgttgccctggaatttctcccctctcaacctccaccctctccaacacacacccacaccaattccggtgccattcagcctgaaatagcactgtcagacaatcagcccggggttaggcattgttctcatcccgggctccccagggtgtaaacacaggaaactcagcagtagtagccctccgtgtgtctagatttgaagacccctgatatccgatagggtccagagaggcgcagggtccgatgggagactgggtgtggtggtggtgtgctgcaaagagtgggagggagaagacaagatggagagggtttcagggcgaccttctcacacctttgccatgagaagttcaaactctaggctgctgttaggtcttcaggtaaagcccttcctacctatggcttcactggctggttcatgagcaggcttcctgagtccctaagagcaccaagtggaaaggggggccttggggaacgcatgtcttccaggaagcccagtccacccaaaaagaaacagaggggcacatgttttcctccagaaaatgctattctatgcagaacacaaagagaaagggttttctctgcggttgaatttctgtgcaccccaagtgctgagagaggatgagaagcacatctgaagtaggggggcagactgaagacatacattttacatgtgatcttaggtaaatgtctcccctggacttagtctccctgtctgtaaagtaagaggaatggactcaatgatgtttgggatgcccgacgtcttctgaactttccaatgaaggtctcttaaagcagaattcatggactagcctttggctagttttcgaggaaattgcaagccccttaaaattgtatatacagttgtgtgtgtgtgagagagagatagacacagagagaaatagagacagagttagtggcaatatccaagagggtgttcacagccttcagtcttaaaaatattctcaaatggacacctgcccctccaagtagccagagggcatgatgtgggagatggagagggtggggactggaagtgaaggtgtatttgcaggaggatgaaaagctttgaaatgggagtggttggggggaagagagagttaacttgcagccatcagctgccacatcgacaaagccgggagctggagttgagggagggagggggagggaagggagggtgcctgggagaaggaatcaacttttgaaactttctccaagtcccacccaccaaaaggctcttctttgctatgactcactctaggaggaatgcgagttgccacggtaacctttttttcagggtctctgcctgctggctgggaggggacactagaaacagaatatcaggctctgtaggtctgaatgtcccccactccactccatcccaagagggcaaattataggtcctgccctcccgatctcccaatctcccggga

SEQ ID NO: 39882 - DNA, 1903 bp, Bovine  19866881024475
accagactagtgttcatttttctagaatttccatagatgaaagcatacagtacgtttccttttcttggcttctttcactcacttcttttatatgtgagattcactgaagttgttgcgtggacaatagtattcaattacatggctattccacagtttgtttactcacctagtgatggccactgagttgtttccagctttgggctattacaagtcaagccattaccagtatttacaagtctttgtatggacagtgcttcccatttctcttgggtaaatactaggcaaggaatggctgggtcatatagtaagctttaagaagctaccaaactgatcacacttgtttttgcaccagtctgggaaaagggcgtgtttgggaagctgataacagttctaagtggggatggaagccaaggtgaattcacttacctggtcagtgagcaaagcttagggagtaagtgaagtataatacctctgaagggaccattatattaccaaagtaaaaggcacactgcccagggccagatgcttacatttaaaccctgttgatcacaaactatagcccaaagtcatagaggggtctccgggatacatcaagcagtgctctttctgctcgcaggagactggaaggagtccctgagcttgtggtttgcattaggtaatgatatacttggtggccatgtcggggccttacccacctgcccacgttggtccatcctgcaggctgctggacggggcctctctatttggggccaaggtaggagacagcctttcctgttttccccagggtctccagcaaagtgtccacgctgtgctcagagttgatacagacctttttgttgggcaggtcaatgtcaaattgaactcctgcaggaagtggggtggggaagacagacatatacccagtcaggctcctaaattgttcaccccactctttccctctcctctagaccagggattggcaaacttctgaatggggccagagagcccatggtttaggaactgtgagctgcatggactcagccccatcatcttctgtagattgttttgtgttgttgtggcttccctgctggctcagctggcagggaatccacctgcaatgtggaagacctgggtttgattcctgggttgggaagatcctctggagaagggaaaggctacccgtattctggcctggagaattccatgactcgaatagtccatggggtcacagagttggacatgactgagcgactttcgcttttgtgtccgcactcttttgcgaatgcatgtattgcagcttgccaggctcctctgctcatgggatttcccaggcaagaatctggagtgggttgccatttccttctccaggggatctttctgacccagggatcgaacccatttctcttgtggttcctgaattggtaggcagatctttaccacgtgagccacctggaaagccccatattgttttacacgcctgaaaaaatgtaaaaaccattctcagctatgcagtaacagactgtgggcccaaaggctataatttgtctatctctcctctaaataagggttgtaaaaaaattttttttcttaattgcaaaagtaatacagacatgccaattttttttttggccacattctgtggtttgtgggatcttagttccctgaccagggatcgaccctgtgccccctgcagtggaagcatgaagtcttaaccactgaactgcctgggaagtccccagacacaccattaaaaaaaaaaagacaagcatttttgaataaaatttgaaagtgtaaggcccccgactatttcctgcctataagaatcactgaataatagggacccatccagtgtttctcctgatggacaaatgaaaagtcattttccaaagtagcatcatactctgtaaacaagttacttatatgt

SEQ ID NO: 39883 - DNA, 1851 bp, Bovine  19866881047081
tggggaggtgtgtgtgggctaacaccagtaatttccccgcctcccagagctgtctggagttgagccagttgcttgtagacctctctctcagggctggtgtgcaggccaagacttggggccccactgtcggggggaggcagggtgggtgtgtgtggacattggactggacaaccagccaggtcttcttccccaaagccctgcaatgatgataacagtagtcaggctgagcacccaccgtgtgcctgcatcatctcatttcactgtgagaaaaaggcatagttattattttacagatgagaaaactgagatcctgaggacagttaagcaacctcccaagctcgtgccaccaggcaacagccaggctggcactgaacccatctgtttgtctacagagcctgcattctcatctaagatccagctggcttctagctgcctggggatttttagtcctaaaaggactaggatgctaggagcccaggatgagcagaccagtgagggatggcatccttgtttccagaggctttgatattctctttcaaagttctgactggcagtctgagatctgtagacctatcccttcctggggagcagataggctccccaagctctctcatccacttaaactaagtgaccacagcccctaaagacatggaaacctaaaagcagctctgcgggacactccccagaaattacaggcttgtgtttttgaagagaccatccctaattaaaggagaatgccacggagagggctgtgacctgaacaaccaccgctctcctcccactcagcgccatgcttgagggtccatttttccttctcatagtctgcagggttgaaaggacccagacctgtagatctgcaaattctagttttcaaacttcaaattgtataatggtgaaactttttgttcaaaagacttgatttgtggaatgccactatcaagcattagacactcctatttcagtctcagagtcttacgtaagccaccttgtatcatctcacaatagccagctgaggtagatatatcatgatccgtgttctacagatgaggaagtgagttgcacaaaagaatccattacttttccctcaaggccatgcagttagtaggtagtggatgtagaatttgcacccagatctgctcaagtcctgagtgtggctcaatacctctgggctctaggagggagctgggtaggtaaaactatgttaagctgccttggtttggcttctgccttggtttggcatctgccttggtttggcacactcctgtgccctgtggagccactgtggaaccggaccggcaccagagagtagtttaaaaaactggaaacaagtccagtgtccatcaatgttgaatgaataatactttgtggtatggccatacaatggcatactactcagtgataggaagaaataaactactgagacctcaataacatgagtgaatttcaaagtcactgtggtgagtgggaaaagccagacagaaatgagtctattctgtatgactgtatttatagaaaagtctaggaactgaaaacagattgatagcggcagaaagcagattggtggttacttgggggtggagggagggatgggaggattactaaggggtctgatgagagtttcccaggtgatgaacatcactctcttgattgtggtgatagtttcatgagtgtgtctgtatatcctttaatattatatataggcttaagttgtgtgccatttatcaaatgaagttatacctcattaaagttgtttaaaaaaaaagtcaaaaacttgtgtttagcaggagacatggataggagatgacttgctcaagctgctcagggtcgaggggctccctctgggaccctctg

SEQ ID NO: 39884 - DNA, 2750 bp, Bovine  19866881103899
ttggacatttgtcttttattcctgagacctagtcctctctcctataaaatggggctgtaacctctaccttgctttcctgccttgtgggggttgctatgacatccctctgaatatgaaggacgctctttaaagggagagtaatgtttccaccataccagtgttcatccagagaaggcaatggtgacccactccagtactcttgcctggaaaatcccatggatggaggggcctgatgggctgcagtccatggggttgctaagagtcaggcacgactgagcgacttcactttcacttttcactttcatgcattggagaaggaaatggcaacccactccagtattcttgcctggagaatcccagggatagaggagcctagtgggctgccatctatggggttgcacagagtcggacatgactgaagcaacttagcagcagcagcagtgttcatcatggtggatcctgtgtccctggggttttgagagggaaggggggaccctgggcccctccatctaacctaagtagccctattttatattaggtaaaagattgtgtttatacaagtctctattgcaaggatggatggaggaagggaaaagttactcagtggctccacacatgtgggagccccagtgtagacacactgaattggaaactcctgactgagcatgtaaattttaactaaaaaattaatacctagacttccctggtggtccagtggttcagtggctaacactctgcacgcccaattcaaggggcccgagttcaatccctcatcagggaactagatcccgcatgctgcaaccaagacccaacacaggcaaatgaataaatttaaaaaaaaaatatatatatatatatataaagtaaaacctgccaattgtaaaccatgtatagcttaatgtgtgttttttctcatagtaggctcttccttttaaactgaggtgaaattctcataacgttcagctcaccgttcctcacatgtgccgcgcgtgggcctgtatagtgtgttcacagtgttgtgcctccactccagtttcaaaactttcatcacactgggaagactccctgtacccactgaagctcacactcattccccgatgcctcctctctccatcccctggcaaccacaaatctgctttctgcccttctggacgcacctattctggatgtttcctacaaaaggaaacattatatgaccttttgtgtctggcttctttcactcagcataatgttttcaggattcactcaagcttagcatgtaccagtgcttcattcctttcaatggctagatagaacattctcatagtagttttcataatttatctattttagattttttttttttaattataggaactgtcaaaactatgcaagtgtaggcgtaaaatgaatctccacatgcccgtcacccagatccaacattatcgagtcattgccatcatctcatccatggcccactctcaccacccccatattcacagcaaattcaggcatcatagtgtttggtctgcacacctgtcagtaacgatgtgtagtatgaagaggctcctggaggttcataccacagcactgggtgagaatcactgatcaagccagttttactcccacacaccaggcagcatctgtctctgagtctgttttaagaggctcctcagtgactgattcgaagccaggttcaggaaccagaggatgaatatttattggttattaggtctccttgatcatctggctcttagcagatttgtttgctcatggctttttttttttgttgccatcccagttaagttgaaacagggcagaggaagagctccagcagccctgcgagagcctggaagagggcttcagcagtgatcggcttagcaaggtcaaggcattcttgtaggagcagcgtgcagggctgaacatggggttctagtcctactcggcacctgggtttcccacttcaccccctgcgactgcctcttcgtgaatctttactgcgtttgtaatgtctccatgtgcacagcagatggcatcagtgttccacctcacttctcatttcttccaggatgctgatcctctcctgccctccagacagatctaggacctggcaatcctgctcagcaatggtagttcctgcggagaccctcatttgtcctgctcctctgtagcttccctgcaataaagtcaagccaattttgctggtgatactgtctcttgcctggtcttgtcacttgcttacatgcgtgtgcatgctcacatgttgctgtgaaggaaataactacagtgcttccttgggttggcgttctgacagctcccaggtccagtggatcctgaatcttggctgtgtgagcttttgcagatcactcaccctctctgggcctcacttttcctcatctataagtgaaggtgttgggtttggttggtgatcctctttcttttcactactttcttagactccatatgttgaaaaacttgtctgtcaagtgaatgcatttaagggatgtaaaattgtatggtaatgggaataatgatgggaagatgtgcttgtatatcagaataatgggaagagagagactgtctggggtagagtccaagctccacatctcccagctgggccacgtaatttcttggtgtccacaggcataaaatgtggtaacagcatctcttgcaaatggtggttgtggggattaaatgagatgactcatgtaaatcacttagagagtgcttgccagttagaaatcactcagtgaacattctctattcatgta

SEQ ID NO: 39885 - DNA, 1105 bp, Bovine  19866881118011
caagctgtttatgatctgcccccactctcctgtcagccccaatctttctttccagtcttaatttccacaatctcccctcaaccttaggtctcagtcatggcttcccaagtggcactagtggtaaggaatccacctgccaatgcaggagacataagatcccttggagaaggaaaaggccaccactcccaatattcttgtctggagtatcccatggacagaggagcctggtgggttacagttcagagggtcgcagagagtcagacacaaccaaaacaacttagcatgcatgcatgtgacttactatgtaaagcacagggcccctcccatagtttcctgaagccccctggtttcctccgttgtcccatagctactgtggagaggctcacagaagaagagatgcacaagttcaccggcatagaggaaacttcatctaaaaagtgatatttgaccctggccttgaaaggtaaccctctaaccaggctgagactgtgaggggtggagtagaaaagaacaaagggagaaaaggcatttcaggcagagagaatggtcagcaaaagctcaaggtagaaccgactgaaattcttggcaatgtggccacctcgctccagcattttccaggcaaagtactggagtagggtgccattgccttctccaattatgggggtagcagaaggattggcaggggctggaagaaaacttgaatctagtatcattttagagaaaataagtagtaatatcatgagcagtagagatactaagatgtgatctttccttttaaagagaccattgtgtaactgagcgtgggaccttgcctttctcggtcctcagtttcctgatcttccggatgaatgttttggatgagatgaaacttccatctctttccagctctgaagtcctgtgactgaaactgaagtcttctcttggctcctaattcctgttctgggccaggactggtgaccagatatgagatcagtcttgcagatttcaagacaaatgagggctctgtctgtgcagctggtgtccacttcccgtgcccggggttttgctcttatgctgtgtgcggccggctgtcaccacatccatggggtcaccagctcctactggt

SEQ ID NO: 39886 - DNA, 1536 bp, Bovine  19866881425864
accaccttctacatgacataagaatgtaaacccagccacaggaacgcaaacttggaatgcccaaatgaaatccccttctcctttcatccttcatgttccctgtattagtgaatggcaccatctgagaatcttcattgccaattccctttctcactcatcctacaaaaagcagcttgtattgttagttgttagttggactgcgtcttatcgttccttcagagatctcctttcctccagtcccattctactgccttggttcaggcatcatcccttctccccgatggtcctatttctgttcatgatccaagcagtccatatactgcagccagagtgatggtgtgttggggggacatgggttctgaactggtcatgagctactgcttatggcacacttcttaaactctgtgtctcattttccttgtaaatgaaataaaaataacaggaactacttggtaaggttgttatgtgaatttacagaatggtaagtgggaaggatgtagaaaaggctctgactcgtaataaacacccaatgacattagctaacattattagtaggtaatgctaatgttattattggtaggtagacttgatgatgcctactgttgctcacatctttttgtttgttttgatggtttttcatttcctccagaatgaagtttaagctcattattaagcctttttttttttttttaatatcaggactctgagtatctatcttgcgtcctgatatctggaactctccctgtgtgtgtgctaagttgcttcagttgtgttcagctctttgtgaccccacgggctgtagtccaccaggctcctctgtccatgggattttccaggtgaaaatactggagtgggttgccatgttcctcctccagggcatcttcctgacccagggatcgaatatctcttgcatcccctgcattggcaggaagattctttaccactgcatggcctaggaaaccccatatgaaggcttcctaaccctaaatcaaccttgtctttccttctgttaatctgcctgttgtcagttaaattcaaagacccccaaacactgaacctaaatgagaagagggaaagtttttcttttcaatactattaatgtctgtatttgaaagatgattgaaaggagacacactataattttaatgtgtaacctttagtgactgtggttggtggtattataggagtttcagcttttctttatgtagctgtatgtgtaagaaacaattggtatatgttttaattagaggatttttaaagcaaaatttaagactttggctaagcccagaaagttccatctatcctgtatcatctcctgcaggcatcttggctatcctcatcccccgcctggacctggtcctctccctggtgggctccctgagtggcagtgccctggccttcatcatcccacccctcctggagatcagcacctactactcagagggcctgagccccatcaccatcatcaaggacaccctgatcagcatcctgggcttcgtgggctttgtgatggggacctaccaggccctagatgag

SEQ ID NO: 39887 - DNA, 2629 bp, Bovine  19866881432418
aatagtgagccccaagaggggctccagacttctgtattcacacaggggaccttttacaaaaatataaacctgctaaaaggattggaccaggtaatttctgcctctgtaaggttaactcaaagggatgcctcctacacatctaccatgtctgagtctgtcctggtccactgtcttacagggaccagatacaaatgaatgtcatattattagagaaatgcaaatcaaaaactacaaagaaatatcacctcacaccagtcagaatggccatcatcaaaaagtctacaaacaataaatgctggagagggtgtggagaaaaggggacattcttgcaccattggtgcgaatgtaaattgatacagccactatggaagacggtatggagattccttaaaaaactaggaataaaaccaccatgtgacccagcaatcccactcctaggcatataccctgaggaaaccaaaattgaaaaagacacatgtaccccaatgtttattgtagtactatttacaatagctagaacatggaagcaacctagatgtccattgacagatgaatcgataaagatggtgtgggatatatacacaatggaatattactcagccataaaaaggaatgcatttgagtcagttctaatgaggtggatgaacctagagcctatcctacagagtgaattaagtcggaaagagaaggataaaaattgtaaactaacacatatatatggaatctagaaagatggtacagattaatgtatttatggggcagcagtggagatacagagaacaatctatgaacatggggagaggggaggggagggcgaggtgtttggagagagtaacatggaaaatcacattaccttatgcaaaatagatagccaatgggaatttgctgtatgtctcaggaaacaaacaggggctctggggtgggatgggacgggagatgggtgggaggttcaaaagggaggggacctatgtacatctgtgactgattcatgctaatgtttgacagaaaacaacaaaattctgtaaagcaattatccttcaattaaaagataaaaaaaaaaaaaaaaaaagactgacataaacataagggcaggatgcacaataaaaagcccccaaatagcagccattacacatccaatcaaatatccccactgtgcctgctttctgcactgagggaacagatgtgtggcctgatcttgaggacaggaaagacacgtggatgaaaagctttgcctcagccctgaagctaggaggataaatgctgggagggccaagaggagatataaattacttccagttgtggaggtttcctggaggctgtggtatgcaagggagggaaaggaatttgtacatggagacaggcggtggtggggaggcgggcgagatcattccatcttgaggcagtgtgaacaaaagcaaggcagctgggagatgcagctggctgcagagagggctgggaaggctgggcaggtgggctggggtcaggcactggggcaagcaccggggtgacatgtggacacatttgctccccccacaacacacacacacatcctgctgtgggatctcattggctcctgctgcttggggcattaaagaccaaaacctagggcctcagctggaaacctggattccagcagggagtggtagggtgggagaagagtcaaagcaaaggaactcctccaaggaccacttgccccaagaggcaccagtgtctccatccttgggcgttcccagtgggccagccagcatcaaccaggtctcctgggaaactgtgaaaatggaaaaactcaagtttgtactcccagagtccacagaaacggtcttcaacatctctgtggatggtcaaagccaaagaatagcaccatcttgtggccaagacacctagataccgggaaggctgggagaggccctgtgcccctgagggaccacaaaggcagaattggatgagacttgttttaatactatcataatgggccagaattacactagcacacagtttagagctgggagagttttacttaaggccccgggggtgcagatactgtgcgctgtacagatgaggaaactacttctgggacagatggagtgactgctccaagatcacaggtggccgaaggcagagccaggtctcatctcaggtcactgatcaaagcagtgatgtggttcccaagacctttcagtaggaatgccaggtcaaaactgctcccacaagatgccttttttcccctttctcttacaatcatgcagtgaaatttccaggatctaaatgctgtgcgatgacctcatctcgccccagtggcccatgggagatgtgcttatatattcttctgtttcaaacattcctgttttaatttctaccatggcataacccacataaccataaactctttgagacactcagaaatgttcaagcgtgtaaaagggtcctgagataaaacagtttgagagctgctgccttaaagtattttttaaaaagtaaataaagctatacaaacgaaaacattccctttgttttgatataactgaatcaactctgtgaggcactaactttttaagttgactgggattctaattgccatctctatagatatttgattaattaaatacacatcaaaaaaatgtacgtgaat

SEQ ID NO: 39888 - DNA, 915 bp, Bovine  19866882178851
aggaaaagtctgagccgtcttggaagaaactgctcctgaggatgttcagaagagttcttctccagcaccagcagacatagcccagacagtgcaggaggacttgagagtatgcagcatgtcttcagttttattctgcttctttctgttgtaaaaaatctcttctgtgtttttgttgctaggatgacttttgcaggtgaatttttgtattcatttggggaaattcttccatattgaaccatacctcagataagatgcatattgcattataaagtcaaaaggaatttttttccctcctctaaggaaatttgaatactttcagacaagttttgggtgctatattgttgccatatcaacaaaccttctttttaatactgcattcaaattgcatgttactatgtgcttgttacacaaaaaaaggatagtgtatcttcaaaaaaattacatggcacagcagacttttccctgaaatctaattgaggacaactttacagtagaagtagaaactaattgtaatatgttctaattagaataactgatttcaaaagtttgaagcttttcagttacctttcatgagtcacaccaggatgatactggctgaattcacaggacctttacagcagatgctctgtgaaggagtatgttttagggctgtatttatgcagccagggttcttaaattgttatttgtctaagagttattaagtgtcttgaaattttctgagcattattctatgggaactgtcagtaacctctctggtttgtagtttgctgttctgtataaaataggtttgtaggtgagtagtaaagagaaatggtgacatgactgtagcttgcaggtggaaaattatgtttattggagtgagagtagatgacaagttaggtggtttaactgtagtcctggagagaggtaatgaca

SEQ ID NO: 39889 - DNA, 1516 bp, Bovine  19866880442569
tgctcagccctcgcttccctttatccgcgtttctcatgttggggtcctgtgctccttcagacactgaccctgttcttcctcatccgtgttgttcagctccccctttatcaccaaggtaaaatattagcaaagtcattcacccacaatcttacccactttctccccttttgtttcaacccctcctgtcacttctgtttccctcacttaactcctcccagggccctccacatcagcaattccgcagcgaaggattctcagagcagaagtcaaattcctggtgaaagagaattccccaaagagaagcctcatggagacatacaaagtcaggtcctggttagcagaaacgaaaggtattgtgtggaaagagtgacctagtgctgggtgcttcctgcaaagtagttcccatgaaattgaaatatggtcagaatctcggttccaattttatttctattaggtgctcagtggctaaattaagaactttctggatccctcatttagataaaaccttaactattaacctctaataatgtcatcatttcactgagtagaaaagaaaacatctgggtgagttcaatgagccaagggtgtggacagaaggcctcagcattctaattgtatctcgctgaccttgatggagggtgtgagccaggagggagggtgcgtgctagtggtgacctcctgccgtgggagtggatggaaactctgtgctgggcacgcaggcgaggggagcagagggccccttcctcaccatgagaggggctcctcatgttgaactccatcctcagctctgtgcccacttttcttctgcccttaaaaactggtgatgatttgtctccttttgtctggtctcctgtgtatatcaggctttctcagtctcggggacgagtgtccctaaggtctctgccccccctgctctcccctgcctagatgtggccttgcactttgcaatcatggccaaggggttggcgctgcagatggctccgtcctggtggccacacctctggtcactctttcaggctggtgggttccctgccgccctaggggtggggcctcatgtttctgaccctgcctttattgggcatttctggttcttccctagtttgaatttgatctctaaggggactgaacaagaacccagggtcatacgtttccccaaaagtgaattctgtggatctgtgtgcaggtggatttattctagaggtgctccctggagccctgacccctgacccctgaagcagaggtggagaaggccctgggctcagccctggggaccccgggagatgacctacaacctgctccctagtcccaaggacagataggaagttaggggttccttaacagtggtgtaggagttggggtgcttggctgttgccagataagttcccactgagtcagatgctcccacagaagaggttatagggtgctgagaaagaggaggggctgacagtgtctgctgtgtgttcttaagaatctgtcctagaaaagcaaaagcataaaaaaagcctgttgtcaaagt

SEQ ID NO: 39890 - DNA, 1081 bp, Bovine  19866880736742
tttctggacactgttggttgtaggtctttgggctaaccactcagctgcctcgttctcatgtggttgcaagtctttgggatctaagtatccccatcattgaaacaacaggatcccaaaggtttcataagttgaggcatcctgagtgacacttacaatcccacagtaattccaagaaaagtgtagtcattttgtcttagcaatgcaagtatttgcagagaacactacccaatgctctagacagcaagtaatttcaacagcactttgcttgagaagaaacgaaggtctgcctggaaaactcagagacctctgtacttcccaccctgagatgctgcttttctgatctctgaatggtatgctttacagggtaacagccagaaagtcattttgactgttacgtgataaccaataaatctttaaaaagtgacctgccttcttccatctctaacatggagaaactaatgaccaaacagaacaaaggagaacaccacgcagcactcagcagctgcctctgctggcatcactgtgacctgcggtgactcgaggacaccggtgctgtccctgccatccaggagttgggcgttctttctcaccttctcatctgcatatgtgagaaggcggccatgatgcagtgtcatctaagagggccgagcggagcttgttccaacaggcccggtgcactgagtttacggttggacgccatgggaagtgctggtcctcccgtctcagccacgatgcagaagtaacatgatgggaacacgtcttccctccctctgggtacccgtccgcctcctcctgatcagaggagctctcagctctgacgacatatcgcacatcacggccgctccagatctgtctccgcgttactctgcctgcctgtttccacacccagtatttctcgtttaacaaattgttcttgatgtgatgtgttcacaataagcccataagcacagccgaagcacaatttcctgctcacttcagtcaaaatacattaatcctctggatatttcccggggacaatgctatctcttttgtgcagacttaatttctatctttcagctgcaaaggaaacaaatcctcaaaa

SEQ ID NO: 39891 - DNA, 652 bp, Bovine  19866880803080
ccccaactccccgggcctcccgggtcctcccggcaccgcccccagatcctcccgggcccccgtgcggatcgtgggggatgtggttgtggtgccctctggtggcggagggtcccagcccgctctccttacctccaagacagggtcagtgatcccttctccaagtgctgctctccaagaacacgcatgcactaaagctagcagttgataataaagtttaacataaattattttgttttaaaatgcctaaattctttctttacgtattctaagcagcagacattaaagtatttcctgctaaatgtaaccatacagtttattccacaaaacgttatttaataagactgagggttttttttttttttaaagagattatttccatccaatatttaaagacttgaattttatttaaacttgaaaatgactttgccttaacttttgtataggacagcttaagagttctgagatgggcctgggttggcatgagtggggtctgctgtcacggtgtcactgggtgagcactgtagggaggactagcagccgtgtttgtaatttacctggaagatcttacacaattgatcttttttcagattgttgaaaaatcctgtaaatgcaaatagtcgatactgtattaaatatgtgcacttgggagtgt

SEQ ID NO: 39892 - DNA, 1415 bp, Bovine  19866880829282
gctattattatttcaatctccttgctctgtcctctcctccagttcccaaatgtggacatcacacctttctgtaactgtccctggatgttctattctgacttttttgttttttcctccttggattcctgtttgggatgattctattgacccatgtttagacactcagtccagtctactgaacggtcctcagaggcgttctgcatgtctgccccagggttttggtctttcttatggttttcacatcactcccatcagctctcgcacactgtccaccattcccactaaagcccttagcgtgttaaccaaagtagttttgaaaccctggctccgtaacctccagcatctctgccccatccatacctattttacacttcatatatgatcagtgtatttcacacgttcaattagaccccaataaaactgtgtctaaaaaaaggaaaatcaggttcctatttacaatagagagaactagttacagaacatacacaaataattgtatcactgaaaaagcagaaaaagttcaccagcaggacatttttatattatttgttgagaatcaattcagaggtagaagacattagtaatacatatgcattgtagaaaatgattttattttagcaaatatatgagaacttacccacttagccaaataaatgctgttttccccaaaacaagactgtgagaataaaaagtcttattctgacacgtggcccccgctcaacacaatttttggactgtctcctggatttgaaattgccttcagtccccacttatgaggaacataagaaaactacttttattgttttatgatcacacctggtaaatgaaatccgtattacatttcccactttaaagccaggatttataaaatatatctgaccaacaacccaattttgccagtataaacttctgccttttgacaactgccttcatgactatttttttttaaagccaaccactgttattatcattcttgtattttataggacaaaaaagaaagaaagaaagggatgtaacaaacatgtcaggttgcattttttaaaacctgcacgtttgtacatgttgttctgtttacactggagagcaggccctccctgccttcaggcgcagcgggtgcacgtgtctgaggcccttctgcagctgcagccctggcacacatggcacggcccatgtggccacaggcgcagcagctcttcctgcaggaggtgccttgcaatctctgcatttgcaagagccggcacatgtgcaggacccacctgcggtgcaggagcggttgggatccacggcgaactgaagcagggctggggtccagagacgactgcacaaaggatggcgaggatggcaacggggcgtgtgctcagtgactgcttttctcaagaacatgatcttggaacaaaattggctttgcgtttcct

SEQ ID NO: 39893 - DNA, 1029 bp, Bovine  19866881205751
ttgcacacagtcctgctgcctggagccagccccctcactaggtagacagtggctccaacactggaaatgtcagtgtgtttgatttccagtctgaaatattttgaacacatgatacattttaatagatttaattatttaaacttttaaggatcactgaaacagatttaatagcagaagtttttcttattattttattcccactttcattgtttggaacgcctggatttccatttagaaatagtctgacagcttttacatctcaactggcagcaggctcagaacgcgaggtggctgccaagggctctgtgtcatgctgaaatgcaatattgtggcgttttgctaaactctttctctacaaagctgccagcggctgcaagcctgcgagtgtgaactttgtgctgaatctgagaacccgccgagccctatcggtcatgaattaggaaagatggccctctgcagtccctgccctggggctgtctcttgatgaacaaagttaagggagagtttcagcgtggagctcctggggtaggtttgacacacacactgctgggaggtggcaggatatctccccgtgttacagaccatcgaggggctgggccctgctctgggaagatctacaaaaaagcatgataacagcaacactgaaacccgtgacatggtttgaactgttcaacaacaaaacagggagagcactggctggtgtggaggtgaggggccgagccctgcgtggtttgttccatgagcgggtggaatgcaggccttgctcttgtgatgccccagctactgaaagggcacagagggggccaggggtccacggattccctaacggagcacggcctggaatcttcttctgaggctgacgagtcctttctcattggggttactggcatccaccgtgacccgcacagacccccagggctcccgaccccaccccatggaagcaaacttacacccccaagggcttatctccacatccgcacaagtggtgtccacttttcacagttcctggactctgggtgcaggtcccca

SEQ ID NO: 39894 - DNA, 1117 bp, Bovine  19866881296773
ttgcagttcaatccacgtagcaggagtcgagtgtcccaggaccccttgcagcaggttccacccagccaacacacattggggtgagcctcccggaggagccgggctcacagtcttgaaatcctctgggcagatcggagttccggctgccgatggcctttctgatccggttgccatgggaacggcggtcagatggaagaggataaggtagggaagttataaaaagaagtctgtcattaaaacccgcaccttgtctcccaagcttgtgcgtttccatggaagcaggagcagatccactcacggcgccatcgggccgtggcctctgggctgtcagtcattcaggccttctctcaggagctgtttatgaggccttcatgaccagaccccgcaaaccgcccaggccaggcgaggagctctgcgtctggggccccacagggcctgaggtgccttcttggagggtcctactgagtggggcaccccaacaggcaggcagcctggctccctagggtgactgcccccctgaggctctgtcaccctcagtcccaggcccccacacgcttccatgaggccagcccctggggggccctgcccccgttgctggtctctcctgtgctgacctagctccccgcccaccctaggccacttctctgctgcagaagtcaggctccctcaagacacagttgatggcgtctcaccttcacctgcgactcttctgttggaggtgcatggcgccccctctgtcgtcagagcagcgtgtttaactgtctccaagacaaacgatttctcacctaggtttgagacgaaacaaaaactgtgtattttagacacaacagacattgatctctgttgcctgaaaattcatgcagcaacctcctcgtctgcctgggaaggcgtttctaagactcactccaggggcctttacgtcctgagatgaagcacaaatacacaatgatgcaccatcgtggcctcacccaccctctcacccgcgcatccgccctaccattgcactcacggtgctgttggatccactttctcaggtgtagacaccgaatctcgttcatctcagtggtctccttacctgtcacatgggagatgcccactatgtgtgtgagctcttaga

SEQ ID NO: 39895 - DNA, 1491 bp, Bovine  19866881528047
cagctcttatcctttactgctgctttattggttgcatccaccgtacaagcttctcgtgtgaagaaaataaaactcagcaactgactagaattttctgatctcggctaccagagatagccgagacacgtgacaaatcaaatcaaagcacgtacacctgccaacaacacacaaagggtgagcacttgcctgggaaggtaatcttagcgtcagacctctgctgcagcagcagcttgttctcggtgttgaacaagaagacactgaaagctcggtgcaacagccctgacggcgagagagatgcgatgccctgagtctctgtctggggctcgcaagggctcgggcggccggagggggcgacgtggtattcccgccctccctgcgcccgaggaccccggcccgccgcccgccgccctcgcgggcacctctctcgatgttctcgttcaggtggcagttcttcttggtctctgccccgatcctccggtcgttctcgtcgacgaggatgcacatctccgccatgagctgcacctgccgctcgtccaggtcgtccgtgctcacctccggcatcgccgcccagcctccgcgccgccccgggaacctgggggcgtgggtcccaaagtcggaggacgcccccactgcctccccagtgccgggccccgggccgcgcttacagccacccgcgctacccacgcgccggggaccccgggcctccggctacttccccacacggttgggttagactacgggatacgatccggaagcgctcggcccgcccctcagcgcgcagagcccggacccccgcccgcctcccgacacctcacagactctctcctccgtacctgagacacgagccgtccactgtaggctgcaccgccgggggagtatccttcagactccgccccaaggcacgggccccgcctccgatccgggccccgccccccgaggccgcgcggccaattgcccgcgccggggccagggcgcgccacattgccgccggccaatggtgcgccggcccgcgacgtacgtcacggtcgcgcggtggtgccactccagatctccaggcgtctcctcccacggctctggggtgcggaaccttccccaggccgctgcgcgggtgctctcggtgccttcagtacacagctgaggtgacgctcctcgatggcggaacggcctgacggagggcactcgctgactagggtccgagtgaacgtccgcttacgtcttgccctcggccctggccgctctagccaatcgacgcgcccgaggctttgtgctcgcggcgcgttgacgtcaggcgtctccgcgcgctcggggtctgaggcgcggggaggcgcttgtgtgaagcggttctgtgagctaaacagacctgttggtgagcgtgagctgtccccgccgggtagtgtggcgacttcaaagtaactagacaggtttgtcactatttgtgaaggaaaggagttagaaaacgacctctgccagtcgggagttgctggcaaacca

SEQ ID NO: 39896 - DNA, 881 bp, Bovine  19866881591398
gatgttccccgtcgtccggttctttgaaagcgcgcccagcagatggcacacctcagggtcagggtcatccagggagcagggagggacggcccaggggagtcgtgggcaccagagaagctgttactggaatggccatctcgaccatcactatccgagctctgtgccaagttcagagcttttccatggtgctaggaaagggtgacaaaggccttccatctttcataccttctttcagattcgttataggcattcagtaattcaagatatagaataattgaatcgttgcacacgtgttcaccagtccctgactttgaaatgaatgaggctttattgccattgtcagtaaacaggagccatgaccaaggcccagagaccagcttttcctcagacccagaagaacgttgagagggaggcgggggaagatcctcgcctgttcgtgttcatggggccccctctgagccatgcccgccctctggtggcctgatgaccatccccgcagcttttctccagccttcccagttccggccgcatggacggccaagagaggacacaagtcagccccactgtctcgaccgctggcagcctgcctccgcctccggatgcccactcacctcatgtgctgtggacaaggtggacaggagggcgagggtgccccatcctgccctgcccatatgcaaatctaacctttctgatattccagcagcataaacccgaaggcaggatttcagcaggaaaatatttacccacagctctctccctcataatctatcgattttaatatcctccccactttggctgaatgtcaattttaccccaaggactgctcctgcaactcattttatttacttaggcctttcaaaatattagtgttggaaataagt

SEQ ID NO: 39897 - DNA, 1072 bp, Bovine  19866881665789
aaaactaacttatggttgctaggcgtggaatggctagttatggactttgggatggacatgtatgtactgcttcatttaaaatggataaccaacaagcacctactgtgtaatatgtggaactctgttcaatgttatgtgccaactcggatagaaagaaggtttgggggaaatggatacatgtatatgtttggctgagtccctttgctgttcagctgcaactacacaacattgttaatcagctataccccaatacaaaataaaaagttcaaagttttggaaaaaataaaagaaattcattttttaagaacagaaaattaccgaattaatagaactctaatttgggactgatgaatcccaaatttatgcatatacagtttttgaccagcccatttcattttcttctaggaaagcagtagtctggagaaataaacaagtttgttttaaaggaatcccttcacagtcttgaagcaaagaaaccaaaagcaatatgaacacagggcaaagcatgccaagcagcctgcatacagcttttgcttggctcaacaggtggacactgaacttcatgtaattttcccaaatggatcatgaagtaacactggcttagaagggatatcagttaatcatgattttgtattacgagtgtcagaaccacggttctcagacatccaggtgtgacttaagcgttccctctcttcactgtaagctatgactcctcacaagataaagttgatttaacacagatttttcaagctcttctaaaaacacacagcatccaagtggcagataaatttaaaagctgtttttgtcactaggtaaaccatgtaggtttttaagtttctatgatggcactttctattctcaataacctgcttatgataaattctcaaaaccctttataatgaaataatctgatgatcaaaggtaaactagtcctactgttaaatgtatcagcaaccacagaagcacagaatcactgaaacgctgtacgatagacttggaaatgtaaactactaacagaggagaaaggcctgaaacaaatcagtttcagagatccatgttttccacaatgcag

SEQ ID NO: 39898 - DNA, 889 bp, Bovine  19866882177429
ctccagggctgcatgggggccgctgtctgtactcagggtgaacttgggacacagcggctcccagtgtggcgtatgtgctctgcttacagcaggacttctgattgatgcatcctcagaaacccagaaagggtggcacagcctgtgtccacagttgaatgtgatattgtaaacagtggtgttgttctgagcactcgggggcatgctggttaatccagggctcatagaaagagcagtcctctttccacccagccctcagtgttgctggttaatccagggctcatggaaagagcagtcctctttccacccagccctcagcatcactggtgagcttgttcctcagtgaggacccctcccccggtcttcacttgtcctttcccactgccttgttccttcaccgtggtcagtggggagctccatcagggctggtataggtctgtgggcaccctcggcctgtgtgctgggctgacttgtctgcccacaggtggtggacacccctgggatcctggaccaccctctggaggaccgcaaacaccatcgagatgcaggccatcacggcgctggcccacctgcgagccgcggtgctgtacgtgatggacctgtcagagcagtgtggccatgggctcgcggagcagctggaactcttccggaacctcaggccactctttgtcaacaaggtgggtatgggccgttgtggtcttatgtgagtaatggcgaaggtgatgatttcattagttttcttccttgctgcagcctcttatcgtcgtagcaaacaaatgtgatgtgaagaagatctctgagctttctgaggacaatcaggtaaatcacctcgatgttttcaaaatttcctgctattcggaacctcgtctcccacaaccggagtgacaaggaa

SEQ ID NO: 39899 - DNA, 1958 bp, Bovine  19866880400797
tagaaaactgcatcctgctttgatgggcaggaaaaggaggtactaagtaagtgtatttgaaatgtcagacccttttgcctaagcacaaagaatacaatcaggtcagaaaatctaaactctgaataaatgtaagctctttacaccatgtctgaaacatgaaatactaagttcaattatgactggttgaaatgttgtaggtgttaataagcctctaccaaataagagaggattttcaagctacattcactgaaatcaatgtcaagccctttctgtgtactttaatctgaatgcttataatttttcctaaacataccctccattctgaagttaattttgcatgtgacatgtaaatataagccttcctatgaatggagaagcaaagacgtgaagttcaactctgataaatttctacaacttctttgctctatttttgcagctactgttcagttcaattcatcttcttactcatggaagccagaatttgcagcatgtgctgagtttttctctgctatttagttaggcatttccttctacttttaaaaatgtcattttcagccaaaattcacgcttgcagacctcctctttcacgttcctcctcataacagcattgcagaactttcattatcttcagggttttcaaatcacctttgtcccccactttacctcctctctggcctccgcagtactactccccccggctaaagtcccagtgacacaaatatccaaaacccaactactgaaccctcctcaatacccctgcacctaaccaagtctccatagtctgctagccagcgtatgattcagactacactttctgatactgggggtaagtctgaaagaactgatggaaaagatacttgggttttagtggctcagtggtaaagaatccgcctgcaatgcaggagacacaggtttgatctctggatcgggagatccccaggagaaagaaacggcaacccactccagtactcttgcctgagaaatcccctggacagaagcctggcaggcacaagccaggggtctcaaaagagttgcacgtgacttagtgactaaataacaaaggtgaacgtcagaatttgacactactgaatgagctcactaaagacttttttctccgtgtgatcagcttggacatagagtatagaggatcctcttaggggttccttactaactttttgttaaatgctgtaagaacaagcaaaaaacttcccagcaggcctggggtgggtgctgtagtggctaaaagcctttcaggctggtgagaacccactactgcagcagctgagccccagcctctaaaggcaacaccaggtgctggggaacccagctgggggcctggcgacaaacaggagctcctgattagcttttccaaatccagccttacctcccctctgatccatgccctaactagtactacttttataccctcctttctccaaaatatgtatttaactcttaacatgtgttaagctctgtgcagctggcccaagctactagaacaaattacaaatctgtgttcctgctctgctaaaattcttcagtggtattcaagattcctcaagatttgcccactgattatctttccagcctgatctcccacctcttcctgggtccttgctttctaagtttcagtcctaatgaactattttcaggtttactatctgatgttatttccctaactttgtctgccatgacatggttcagatgtcttagtctaagagaaagcctcttgtcaatcagccccaggttaggtacaaaggaaaattctgtgtggcctgtaatttctattttctgaccgaacacttttcactccttccttccttccagtgtgtgaaaatacatatctaataatatcagctcataaaataactgtccttttcctcgtctcctctaaagccattttcgtgagggtgtgatacacaccctgttttttcaattcaagaaaaggataaggtagc

SEQ ID NO: 39900 - DNA, 873 bp, Bovine  19866880447920
cgcactcccttaagggcacaaagacctcttctgctgcctcagaacacatctgataaagtaaaaagcctttaaaagctttcttcagtgctttgactgccaaccattcactgtcagtaactgacagacttggtatcttggacattaatcaactaccaaccatcttgagttgtgaaaaaagtcaatcaagagagtctgattcagccatgccaattagctccatttgttccataaacaagaaaagacactgaagagccctgggagaagacacactgcagagagaagtgaggactccggtgatagcactcacaaatgcccccttcctcttctctgggtacaagacctgctcaaaagtcacacttgccaccatctgttagccacttcctcctggtgcccccttcagctctgcacacacttccgtgatagcactaagcacatcactggtaccttgtttacacatctgtgttcctacgagacggtgcacttgagggcaggggactgtgtcttgttcatctctacagcctgcccacagcctggcacaatagacacttgttgaatgagtgactgaatgaactggtaaaatgaaagcacccagggaataataaatcagagacacacatgcttgggtggaaactgggagtgggaaaaaaagaggtctttacatttaggaggagctgaaatgcccagggagagaaatttagtgaaccaaaaagtttactgaaacctgacagctagaccttaaagctggccagagaagcaagagaggaataaataatacataaatcactgggcactgaagcagaaggaactctaccagaaagtgatgtatcccatagccagagagcaagaccagacagaaggaattcagttatccca

SEQ ID NO: 39901 - DNA, 1655 bp, Bovine  19866880499667
atggtatgaaagctgtgtaactctatgatatcatctatgaagaatgtgcaatgtaagaaaaggctcagaactcagtcctggagacgttaacaattagcagtcagaacatgaagaagaggttctcattctctgttagagaacagagaaaggaacagaggtaggagaaaaaacaagagacttccagagaaactaagggaagaaaaaatgtgggaaaaagtggcaaaaggccatctaagatgaaggctaacaaacatctcttcagtatgttttagataacttttctaagcaacacagaagtctttggtaaccctggcattcctcttccattataatttattaacccatagtccttttaatggacatctggattgtttacagttatctatcattacaaatagtgctttggtgaatggccctgtgtattttttttccccacttgtactaatgtatctgaaagtgaaaagtgaaatgtatctgagagtccctaaaaatagaaatgcagaaacacagcagattagagctagaaaggaactaaaagttggccttgaacttgtgtttccacactccttgggtaatgatctacagtatattacagcaatataatacaatatatgaaagacggagcccaatcagcagacaggttgattcttggtcaattgttccccaaggcaaggagaacaatttacaccgtggttagttgggtaaataagctcagcggttcccttccttttactgtcttaatagaaacacagatttaaagaaagatcaaaatagtcttcatctttagtcctattcttttagcactgaggcatctgtaagatacaggtgtacacgccaatggcagtcttgaattgtgttttgaaactcccactcaaatatcaccaccctttatttgtaatgaagtacttgctaaacagtggaaactcagggagaaaggttccacaccactgttttcttccaagtaaggtccttggtacttttacattttgacactttgaatactaagagatattgaggtacaatacttctgaattcaatgttagattaggactcaggctttagattttcttcaaatatgctcagagtaactagcattattctgacacaaaatgtgaaggtctctgatggggagggaaaaggcattttaaaagattccaatctgagggaaaaaatatttgtcatgagatttctataattaaaagcttatccctcttcccttcctagattttcttgtcctccagtctcctcttcacatacagaatttaatcttgcaactgcttattaatgctcagctgtgaggcaggcagctgatggaggatgctaaaattatctggggagtaataactgtctcaaacttttctaaggccagagaacggagttcctgagccatgactcttgcttgtatgccctcaaatagagggaaggtctcactgagccaaaaaaaaaaaaaaaggaaaatggaaattcccaagttttaggcaatgcattttcttctggaacaatttcaccactaaaatagtacagagaagcaatgaagtagagatctgagggtcaaagtttttcttaatgatggaaggacagtcacagaaaactaaatataaacctgctctttcttgggtctatggaatggggtaaagttataacaagagtgggag

SEQ ID NO: 39902 - DNA, 1339 bp, Bovine  19866880644668
attgaatatctagaggatgagatggctgatggcatcaccgactcaatgcacgtgagtttgggtgaactctggaatttggtgatggacagggaggcctggcatgctgcgattcatgggggctgcaacgagttggacatgactgagcgactgaactgaactgatggaatatctcatataatttattgaatattacactaaaagtgaaaaacaaaatggttccaagtaccagatatttatcttagtgattagatgactgcctaagacgaatgactcactgctactgcccagcatcacaggagtatgataccagatatggccagccaaggaaaaggtcaaaattcaaagaacagtttctactacatgtatattgcttttgcaccattgtaaagtcataagtcagaccatcataagttaggaatcatctatacaaaagtagccagcacccaacaaagtaaagcttacaatgtctaggatccaataagaaaataccaggtatctaaaaccaggaagatgctacccataatgacatgatataacaatcaaaattgactcagaactgacatatacatgagaattagcaaacaaggagatcaacacagttataatatacacgtaccttatgttcaaaaagctaaaaacaaaaaagatatttttaaaaaacacccacatgatagtactacagatgaaaactaacatgaatgtataagctaaaaaaaatacctaaatgggactaagagcaattttaactttgtaaaagaaaggattagtgaacttgaagatataagaagagcaagtatcacgacttagcgaatgaacaacaacaaggtgaaaagaagaaaatttttaaaaatgaacaatgcatgagtgagcctaataaaagtttaaatggagttcctgtaaaggaaacggtggaacacaaaaatatttgaagaaataatgtcaaaatttccaaatctgacaaaaactataaacataactagacaagcacaaccattaaaaaatatacatgcacaaacataagaaacatgaagagagctacacaaaggtacatcgtaatcaaatgatcaacagaaagttttaagagcagccatagaaagtaaaaaaaaaaaaaaaaccaaaaaaaaacccacagaggaaccaagataagggtaagatcacatttaaacatcagaacagaattctatacctgacctcaggtttaaccttaggggactagagaaagaggtgaaactgaaagtagaaaggagtaataaatatcagagcagaaatcaataaaatagaaaataaataaaaccaaaaaaaatgttgagatcaataaaattaacaaaatgctaattcg

SEQ ID NO: 39903 - DNA, 1254 bp, Bovine  19866880781344
aagaagtctcaaattgttgcacaagaatgtaaaatggtgtaggcactttggaatacagtttgacagttctttaaaatgttaagaattgactcagcagttccactcctatgtagaatttccaagagaaagaaaaacatacttacacataaaaacatgtacacaaatatttatagccatgttatttgtaatagccaaaaaagcagaaatagcttaaatatccatctacaaatggatggatgaataaaatgtgacatatccaaaccatggtatattatttggcaataaaatgaataaggtattaatacatgctataatggagacaaaccttgaaaacattatgctaagtaaaagaacctagtcacaaaagaccacaaattgaatgatcctgttcataggaaatttccagaataggcaaatctctacaggctaatggttgccttaatgggaagagtttttttttttttttttttttgaggggggtgacaaaagtgttctaaaaattagattatggtaatggttcactactctaaatataaaaccccccacttttaaatgggtgaattataaattataaattgtaccacctttaaaaaggtggtaatgaaaaaaaaaagattcaaggcaaatatctcttaaggttgatcatgattgtagaaaccaaggaatcaggcaagcatgatgatttggattgttggaatacttaaaaaggagaaaaataatttagacttgagaattaagacttcacccagaaagtgatcaaagacttgttcagttcctttctgtctttagaaaatattgctaatgaaaattatttggtcttaccctgcaagaatcaaaaattccatcttcatcacctgcacaaattgaggtgttaggaactatacccccatagctcctctcagaattacagaaacttcgagaaatataatgcacttctgcttcatgtaactctttggtaacattacctattaacaacaacaacaaaaaaataccagttaaattattttggagagcagacattttgatagcaatatgaaatgttcatgttcaacaggttttctttccatagtgactgattgaacaattatgtaaaattgtatccagatatgtatgcatgtatgaatgcctggagatatggtgaaagaaagtctaccaagtcttaacgatagttatctctagatagtaggaatttcaggttactttttttttttaatgtttgctctcttgtgtttcttggaggtctcacagaaggat

SEQ ID NO: 39904 - DNA, 1063 bp, Bovine  19866880782420
acttcgatgatacttagaaggagcagaagttgtagctgcagatggagcaggtgtttggtttctgtgttctttctgtactgatgattcagtttctaaaaaaggaagttttggaagatggttatcacgataacaataataactaacattttctgagcacttaacagcatttccacaacactttgaggtaggtaatactacccatctacagtaaagggttagagagctttaatacgttaaaaaaaaaaaaatacaaaggcatccagactaaaacaaaacaaaacagaacattatcttgacaatgtaattgccaacaggtgatgggagatataagtaggtgaaaagaagagactccacaaactgggaagatgggggatacggtggggtgtacatgatcccctaatcctgtacagttgcagaaaacatagcttgggaagcgttagtctccctaccataagttactcccaataaacatgtcattaaaacaaaactagagtgcttactctgcaaacatagcttcaagtcaagtcttactagcccctcttccaaccggaggcatcaccgaacttaaccctttccagtccctgccctgtccccacattctgtcctcccaacatttactgtttctcatcaagaatatggggaagactgcaatcctattcctgggcatatatctggagaaaaacatgattcaaaaggatacatgcaccccaatgttcatagcagcactgtttacaatagccaagacatggaagcaacctaatgtccatcagaagaggaacagctaaagaagatgtggtacatatatatgatggaatattactcagccaataaaaggaataaaataatgccactgccatttgcaacaacatggatggacctagagagtgtcttttgaagtcagacagagaaggagaaataccatatgacatcccttatatgtggagtcaataaagaaatgataacaaataaacttatttacaaaacactctcacagacttagaaaatgaacttacagctactggggggaaaggatgggaacttggggatggtcatgcacacactg

SEQ ID NO: 39905 - DNA, 2233 bp, Bovine  19866880829540
tcccctcttgcccagtacccctggcccgctttctctctctatatatatgtatagtgttcaacatgtattccttgtatcaattaatatttgagcacccactaagttcaaacattgttctgcctgagacagttgctgactgtataaatgcataaggataaaggcagaccaatgtgtggatgtatgaggcttaaacagttttttcagtaccttgggttacttgaggacttcctttcagtgagcagccttaaatatgtaaaacaatagtctcagaagttttgatttcattctttcaacagaagttttattaactaactgctttactatttagtagattctggggatagcaaagtgactctgacccagttcctgtccacaaagggctcacagtctaatcaggaactgatttgtaatgaaaaggaagttaaaggttgattatatgctgaggtaaacgataatagaggtatgaaaagaaaaatgccatggcaacacagggcaggggttgaggaatgggcttgccaggaaaagcctcacagagaatatattattgttggcagccccttgaacgactttggctgtgagaagatgggagttcagttctctgtgacccttggaacctaggccttttaattattcataaataacttaaaacatacttctaggactgggagtttatttaaaagatgcacctgcatttctagtttaacctttagtttaactagtcctttaggaaaaggtgtttatggatgcagctgtatggcagcgttacagatgtttgctctttagagttccttacagcacagttacagatatactgctttacttaggttgccctttcctttttaacacaaaatgtttctcatttatagtatatggctcctttttaaaagaaatgcacctttacaaaggagattctaggtttttcatttctatgttgtgaagtaagatacatttcttggaaaaaaatgtttgctgtaagtggaactgaaagcatttgctaggagagagttaagagttgctaaactcgtgacatgctggatctgtggtgagctgagaatgctttcacaacaatttgattcagcactcactcactgagtgctgtggtcaaagcactgctgctagactcggatggaaaagaaaatgaacaaaacataggctctgttttaaaggatcttccaatttactgcactgagtctcttttcttctcttctccatttttgtcatttcccagataatgaaaagtagagctgtaatttatcgattctgtaagctgaaaagggtataaaattagtttgcttaaaatgttgggctggttctccttactgctgccaggatttaaaataacagaaaatatttggtgcctccttccacaaattaacatttccatgagtggctgcttttcatggagcatcttgagccagcccctctcgtgctgtgagtcttcgttgacagtattaaatcagatctgagcagctctaggagacagttgagagtttgagaatatgcccagtgtcagcatcttggctagagtgctgttaaacaaagaacactcttggcacccaacaactgattagacatgtaccattcaatgtgtgagctccaataaataaagccacgcagggcattcagtgctttcatttgggcagaactaaatggttaagtgtccgcttaggcttccccctaagtctgttcgaggcaatcagcacataatccagaagatgtaaaatctccaagtatagccacttacctttactatgtaaagctctgtgctgggtgcttcacactgtaaagagacaagactgagtaccagtcaggtagtttacagattgagtggcaccctactctaactcttctacctgccatcccattgcaggtccatttcttcctggcctgccctggtctgtagccacctaccacgtggtgttgaccctgactcgttcagtatggttcttctaacacagtctctataaccttatcctgaatgtagagtggatattggaaacagtagaagagatgggcctagatctctggacagtgtctgcagtgactgatgaagcccattgtagcactaatcacttgaggtattgcttcagggctgttgtatttttgtgatcaggtctcatgaacaggcggaacccagataggaagcagtctttaaaaaggttagcccattttgttcatgtttcctttttctacagagtgtgtattttcctgtcctcagactaaaaacggcaca

SEQ ID NO: 39906 - DNA, 1194 bp, Bovine  19866880829770
tgtccctgagcctttcagactttcgcagcgtaagttgccctgcttccccgttgccacttaggatgcagcttgcttgggtctgcatcagtcacctatcatttatccacctgctttccaaatgtaaaaattttgttgctgctgtatcttcagtcgtttttttcccttgtgggttagagtttaatttttcccctgtcactgttacgtagtgaggtttgcaggggccaggcacccccattctgctgtctctgactggaagttcctgaactgtcctttatctcagcttttcttctcgtgctggtcttttttctgcttgtcgcctctgacttgtaactttaccctcacttgttccattgccagtcatcctttttctttttttaaagccttcctttgatgtagaccatttttaaagtcttcattgaatttgttacaatattgcttctgttttatgttttttggctgccagcacatgagatcttagttccctgaccagggatcaaaccccatgccttagaaggtgaagtcttaaccactggaccaccagggaagtccctctgtcatccttaatatttattttttccagcttatttgaccttttatcttttgttgtttctttttactctacgcttctttggcacctcttgatctcctccttttgtaggtgcctccaactaagcagagtaacccttctctccctttgcttcttggcaggttcccttctaagcagtatgcgtacgtgcatgctaagttgcttcagtcatatccaactctttgtgaccccatggactgtagcccgccaaggctcctctgtccatgggattctccaggcaaaaatactggagtggactgccatttcctcctccaggggatcttcccgaccccgtgatcgaacctgtatctcctgcattgcaggcggattctttaccactgagctacctaggaagccctctccccaatcaaagcctggttctagctgcattttattaactgttcaagaaattattctgaacaacagcagcgaccacacacacatctttagaaattaaatctttgttgatttagcgcatgtcctgactttgcttctctctcattcttggtaccttttattctgcttcacgtctctgactttcatctttatactatctactcatcttttgatatgtcttcctccctggagggtttaggcagacttacata

SEQ ID NO: 39907 - DNA, 1353 bp, Bovine  19866880979751
ctgtcctgttcctctaaagagtgctttgcaggttggaagtcttgattgttgtcggttgagtaagtgtttttcactctctttctaatagctgtttctctgtaatatatgaatttgtccatcttcaagatgtgcccatcactctcctggactctgtagcctcctatagatactgctccatatctcgtatactttataacaaagcgtattgaaagaaaaaaatcttgctagcctgacttcaccgctgatctcctctgtagtattctgaataaccgtcgtcctcaagttcctttaattaggccgctactggtgatctcgttgccaaatcgagcaagcgttttctgattctgtttttacctttgtgacactgtgcattattcatcgtctccttctcactttccctctccctcttctcccctccttcccccagttccttcctggcctccctgctgtgtcccagtatcatccctttcccctctacccattctttaaatgttcgttttctccaggattccttttttggccttctccgcttttcacgctgcactccctctcatggtatcattcacacccgcgctctcagctcccacctcctacaccaattgtgaggatgtatctgtcactcccagagctcatctgttctgttgcctactcgattccttccctcgttttgccttgtcacacatagcagtgccaggcaagtggcgttcatcgaatgttgaccaggctttagagcttgttttatgccttaattcctgcagacatggaaaccgaggcccagagaagtgtataatggcttgcgcaggatcagagagctagtttggaggaaaatataagccttctgacacctggaatctgagatcaaacaagctgcttattttattctctctacttgtatttttttctgtgcatctttggtttccagagcggtaggaactggctaccaacaaaattcttcctatttagaaattttcactgtatttctgtacttgcgagaggacatacttagatttttgattcattgttaatcttatctgcaccactgataaagaatacctggcaccatgcactgtttaatttagattcagtgaacagcatagctgttattacttactgcctagttttaaaagaagtcattttcatggatgctagaataaaggcaaagtaattgaatatgcctagctgttcttgtaagaaaccgttttctaattttctagggaaaattaaagataaaaatcagggaaaagaagaagctgtaaagaaaatatctttttttcctgtcttttcccccgctaggcatttgcagtttgaggcctaaattaaaatgacgacatccatagttggatgcatgtaatc

SEQ ID NO: 39908 - DNA, 1056 bp, Bovine  19866881020240
caagagcaaacgaaagaatatccagtgcaaaagaagccctctctcctttaaagggtcactgtcttaatggctaataactccctaagtatctttgactaacttgaaaagtcaagtcaatagacccacctggattaggcagagttttgaaagctggaattaagtgaaagataatattagctcaaatatctctcaccaggatcgtaagcaccagtaaggaagggtgcccagatggttagctcctagctcctacagcttcaggcttagtaggtgtagcccgaggtgtacaattaccttatattaacacccacgtattgacaggtgccagcgacttgtacacgatagcgattctggggtgacacatccagctgtaaggcctgctatagtatcaacgtatctcaaaagggtgtaagaatcttaaagggttcagctggcagaatggaaggggagaaatatcgaagaggaagagaatggctgaaaatgaagaatgaaaaacaacagttagattatcagaatatttctctgggagactattttgaattttgaactgccgctttcctccaccacacttatatagtgagaaaggagtgttccagagggaagaggagggggtccgatcagttcccgccctcagtcagcaaaggctccgctctacataattactcccaaccccattcttgcctggagaattccagggacgggggagcctggtgggcagcagtctatggggtcacacagagtcggacacgactgaagcgacttagcagcagcagcagccagcacagtacccagaagtgaagaaggagcaaaggatcagcagttcctccactccctttctcgagggggaggggttcacgctccttgtattcccctcacccgaagcagtcgcgggagaaaaagggtgtggagggaatccggggtctccgtggactctccggctgcggaggatgtggagagagaagacccttacctggctaaaagcggtctttcttctgcgctgctatcagccccgccacgggtccctggcgttctgcctcgcgcaccttcgcgacctagctc

SEQ ID NO: 39909 - DNA, 731 bp, Bovine  19866881077542
agaatcaagagaaaaagaaaacccctatagtagaaatgttaggaggatgccaaatgttacaaaattaacctaactgaatatttttcttcatatttttctaggcaattgatagcattcatcaagtgggggtttattgtcttgctctggtgcctgccaatacactgcccaaaactccgctgggagggatccacatatctcagacgaaacagctctttctggagggatcgctacatccttgcaatatcctcatgtgcccacatacgtgcgtgaccaatttgccaaaaccccggcaaaagcaaccaggtaatatgctgactttaaagacatgatgtgaaaattgtaacttcaagaggctgaattctttcactgtgatttttttctctagaaagtaagtaacacgagaatagtatcagcagaccaaaagcatggaggattgagatttttgtaaactggcttgtccaggtttactattggctcagtcttctgaacaattctcagtagagtgccaccattttccatgatgtaaggcatgggatcgaggtgatcagattcccaccgggggaggtagaaaaaagcaagtcctaaaaaaaaaaaaaaaaaagaaaagaaagcaagtcctataaagcaaggttctgacaataagacagcttgtatttattgagtgcttactaagagctaaatactagttaacttttacattttataatgggatcctaaagctttgtcctcag

SEQ ID NO: 39910 - DNA, 1296 bp, Bovine  19866881091823
ctctttttttaatgtattctatctaacccaaaataaaggctgcagaaatgttgcctaatctttcctgtcttttgcttatagggaagcagcacgagagtgtcgtagaaagaagaaagaatatgtgaaatgtctagaaaacagagtggcagtgcttgaaaatcaaaacaagacactgattgaggagctaaaagcacttaaggacctttactgccacaaatcagattaatttgggatttcaattttcacctatgatggtgggaaaaggactggcttggccacaaccagaaagacaaaataaacattttattttctaaacatttctttttttctatgcgcaaaactgcctgaaagcaactacagaatttcattcatttgtgcttttgcattaaactgtgaatgctccaacacctgcctccacttctcccctcaagaaattttcagcaccaggaatcatgaagagacttctgctttgtatcccctgccctcttcaagaagtaataatttgtttacttgtaaattgatgggggaaatgaggaaaagaaaatctttttttaaatgatgtcaaggtttgtgctgagctccttgattgccttagggacagaattaccccagctccttgagttgacgtaatgtttgggccgcatgcttaaagtaagtaaggtgcaatgaagaagtgttgattgccaaattgacatgttttcacatttccattgtgaattatgtaaaatcgttgaagagacataccctgtgagaaaagaattttaggatggtgttgaagaaattaagaatgaattcagagtgctttctatgtatattctcttcaatactgaacacttgtccttggttcttaaaaatattctgtattaactatagctcttcaatagggcagttgttgcttcttaattcagttctgtatgtgttcaacatttttgaatacattaaaagaagtaaccaactgaatgaaaaagcatggtatttgattttaaattaaatcaaagtaagtaaaattacaaagcttcatttagtttagtactaaatttttagtacaaagatgctcattagtaaaccagttccttgagttatataacaaggtttttaaataaatgtttttgtcatcaccttcaaaaatatttatattgtcacacatttactttaaaaggtttttctaattaaactgctcctctttgcacttataccaccaacaggaaagccttcaagatgttgaagcaaagtgatatatttgtttataaaatgttatgtgttgtagaaaaatgctgattttaaattgtttccata

SEQ ID NO: 39911 - DNA, 895 bp, Bovine  19866881235143
cttcaatttaagtctgagtttggcaataaggagttcttctcaggtacttgaatccgtttgagactttctgtcccaccgatctttttctcctttcaaaactacatcacagtagttaggtttttccttgatacgactttgtcagatgaaagtaggattaatttttttttgttattaatctaacatgagaaaaacaaaaactagtgggagaaaaagaatatttacttaaataaccatgtttataacaaaagcatttactttctttcagaaatcctgtaatatggagagctgtgattggaactaataatataaaagggagtgagccatacagcaagaagatcaaagttaatgcaatcattatccatccagacttcaacgtggaatcttatgataatgatattgcactttttcacttaaaaaaagcagtgcgttataataattacattcagcctatttgtctaccttttggtgttttccaaagactaaacaaaaacacaacatgttttataagtggctggggaagaacaaaagaagaaggtaattataatctgagttttgctgatacaggttttcctgataatcggcagagggtgaattcttttatgtatgtttttatatctctttatatcatgagtttaaacagtaggtctttataaaccagtgaaaagaaagtgtgttttaattttctatgtttttttcttccttgtgggagagagaaatttatcttccaaagcagaaatagagacttcttttgttatacatgcctacatgccaagacacttaaacttttagactatctcagagagaatgatgggtccaagtgtttctatagtttctgagactcctaggtgataaagcaagttctgtggcagatctgcttatcttaaatgataagctt

SEQ ID NO: 39912 - DNA, 1038 bp, Bovine  19866881380597
ttgctttttatttgtttgaacttgcacggtgccttaggtgaaataccatctgtaagaaggcatatatatttgacctagaaaacagccaaaacaattctatgatttgagttttgggagaaagcagtctgggcttattctcaagtttctgatgtggaaaatgtctagttactttcctaaatgaggtgagaggacatctactgagaatggaaatttgaatgtcctgaagctaaattcttttgaaaatcttttgtaagattagcaaagttaaaagaagagagaactaatctttgaatattttatcactgatttttttccccaaaagaaaaattattaaatagataaaataaaaattctcatcttccagcagattgaactattttacgagtttatttctggctagactatgaaaatattgtatcttttcaccctccttcaatgtaagaatagtcctccttatttgtaaaaagaaactttagagagttttaaaagtaatttagggtttcacattctttggagtcttcttggccacttggtaggggaagataaaggccaaaatgccctgtatttggcttaaggtttgtgaacctttatatattacctctgaaaggaggatgtttggaggatggtggctggtacatataattgattgaatggaattgtcattgtaagaagaacatggtaaaatttaataatagaaaactttctttgtcttctagccagtgtctcctggacatgatccaagcctctgcctttttcagttttgctaagattgacctcattcacattcttggctacattttggctctttctctctctgtgtgtgtgcttatatctctaatagccgtaaccccagtcccactccacatctccagtcacagccagcatatcccaccttcctggtcaaagatttacatgtagaggatagaataggttttagatacaggtatagatttgaaggtgatgactccagaacttttttctctcagtctctcatttctctccctcctaattactccttaacaaaacagagaggcccca

SEQ ID NO: 39913 - DNA, 1082 bp, Bovine  19866881388803
actttcctggtagtccagtggttaagaatcccctgccaatgaaggcgacgtgagtttgatccctggttcgggaagattctacatgccattctaagcccaggagttgcaactactgagcccatgcaccctagagcccatgctctgcaacaagggaagccacgactatgaaaaacccaagcactgcaagtagagaaagcccatgtgctgcaatgaagacccagagtagccaaaattaattaattaatttataaagctcaaaccatgggacactgactagggtgtttccgtgaggactcttactttttaagagataaacaagaacactttctgcgtgccaggtgctggtctaagcactctataaacattaactcatttggttctcaccaacaatcctggggtagatactatgattactcaattttaaagagaaggaaagtaggcagagaggttaagcagttcacccagggctggctaggccgtggctctcagggctggagcccgagcaccccgcctctggagcacatactcccaactgctacatggtctatttcccatcagccagctcagcggccatagctgaccctacattctccccatgcaacgtgaacatcaagtacctcaaatgtgtttttggtcaccccagcaagcccaaagtacatcatgcctcctgtcctggagctgacacagatttctccaatttcatctgttttgcagagttgaggaggtccatcgggtttcacaatgcacatcatccctagggtacagaaaacacagtcaaggaacagcctggaaaaccttcacaaaaacagcctcatcctaatgaacccaggaaagtttcccatttattgagcagcattaagttagaataccaaacaggaatgttaaagagagacctgacactgtataggtatatcggaaatttccatcttttggtcctgaaggtaattttttaaattcagcaaacaaaacatacaatagatgcagactgaagcttttaaagactgacattaaaaatgactgcaaagtctgaagaaacgggttaaattaatttacccttacacagatcaaactcaaacacacag

SEQ ID NO: 39914 - DNA, 2765 bp, Bovine  19866880621716
tgggtgcaaccgaattttttcttctggctgccatgtcctatgaccgctatgaggccatctgcaaacccctgcattacacgaccatcatgagtgacagagtgtgcaacttactggtctttgcgtcatggttggctggtttcataataatttttccaccactcctcgtgggtctccagcttgatttctgtgcagccaacactgtagatcatttcttctgtgatgtatctcctatattacaactctcctgcacagacacagataaagtagaaataatgatgcttctctcagccattttaactctcctggttactctggtgttagtgattttctcctacacaaacatcattaggactattctgaagataccttcttttcaaaagaggaggaaagccttttctacatgttcttctcatacggtggttgtgtccatttcttatggaagttgcatcttcatgtatgtgaaaccctctgccaagcaaagagtgtctttaaataaagggatagctctgctcagtacttctgttgcccccatgttgaatccttttatttatacactgagaaacagacaagtgaaatatgcttttaagctcatgatcaaaaatattgaggctttcttaatgaagtgaacaacattagtgacattcttgagtttataagtaaaataaatcaagaagtgtgaagtgtgttgtgcatctcttctatgtttgtgttttacataatattactatcttccatgacttacaatgttcattgtgacttgcctaaaaatcccagtctaactttcacttctattttctcctcatgctcagatcacatatacatttcttaatatgatcatattcatttgccttttgatttggtgactctgttgatttcctttaaaaattccctcagaggaagataaagtgagacttcaattatccatgttcctttccaccgttcagaaatttagatttcagtttggtgcatattctatgcagagtttagtaccccacctagatttgatcacctaatcagcttttctgcagtggattccaagtttgaattctgaatagaaatttggaacaaaccaatttaatgcatttcttaaactacacacattgatagtttcaaattttcaaccaggcttggactactggtatatgtttagaaacagattgaagaaaatctagagatgttaaggcaatactgccttgcaataaccagataaattattgctaacattaactaattatttacaatggccaggtttgtgaaatgtactagcctgcatcttgaaaacagcataagacatgtattatcatgctcacttaagaataacaatctgtagcctatttaaagcttaagtaactcgctggattagaataattaatattgtgaaagtgaccatagtacccagattcagtgattcggtattaaaaaagatcagttttcattccagtcccaaacaaaggcaatgccaaagagtgtttaaactactacacaattgcactcatttcacatcctagcatgtaatgctcaaaacccttcaagctaggtttcaatagtaggtgaactgagaagttccatatgtacaggctggatttagaaaaggcagaggaaccagggatcaaattgccaacagccattggatcatagaaaaagcaatggaatttcagaaagacatctgcttcatcaaatatgctaaagcctttgactgtgtggatcacaacaaactgtggaaaattctgaaaagagatgggaatagcagaccacctaacctgcctcctgaaaaacctgtactcaggtcaagaagcaatagttagaactaggcatggagcaaccaactgtttcaaaatcgggaaaggagtacatcaaggctgtatattgtcaccctacttatttaactattatgcagagttcatcatgcgaatgatgggctgaatcaatcacaagctggaatcaagattgccagaagaaatatcaataaccttagatatgcagataacatcacccttatggcagaaagtgaagaagaactaaagagcctcttgatgaaggtgaaagaagagagtgaaaagctggcttaaagctcaacagtcaaaacactaatatcatgtcattggatcctatcacttcatggcaaatagatggggaaaacaatggaaacagtgagagactttattttcttgcactccaaaatcattgaggatggtgactgcagccatcaaattaaaagacgcttattccttgggagaaaagctatgaaaacccagacagtgtattaaaaagcagagacatcactttgctgacaaaggtccatctaatcaaagctatggtttttccagtagcatgtacggatgtgagagttggaccataaagaatgctgagcactaaagaactgatgttttcaaactgtgtagtggagaagactcttgagagacccttagacagcaagctcaaaccagtcaatcttaaaggaaatcaaccctgaatattctttggaaggactgatgctgaagttaagttccaatactttggctacttgatgccaagcattggaaaagaccctgatgctgggaaagactgagggcacagggagaaaggggcagcagaggataagttggttggatggcatcatcaactcaatggacatgagtctgagcaaactccgggagataatgaaggacagaaacctggcatgctgcaatccatggggtcatgaagagttgaacatgactgagcaattgaaagacagaatcaaaatatccatatttttcacagaa

SEQ ID NO: 39915 - DNA, 818 bp, Bovine  19866880621720
tgtgtagctttagaatctgtgacccaagaagatagttccatcactttgtattttcatccgtataaacataattgattcttttaacaaagaaagaagaagaaagttatgtaaataatttaatgtatactaaatagattggaaactttgaaaatacagaaaatacaagttaagatactattttttttctctttgtttctatttttataagattatcaatgtactatgttttcctttgggaacacatgaatttatgacacttaaggaaacaaacaaaaaaacctcatgaattgcactcagtgaaattttgaataaagattatatgagtacatttttataggctgttattcctttttgattcttctttctttctttttttaaatagaagtcagcgatgagaaaccacacaacagtaacaacctttattcttcttggactaagcaatgacccacaattacaggtggttatttttcttctcctttttttcacttacttattgagcatcactggaaatctaatcatcatcacccttaccctgctagattcacacctcaagacaaccatgtatttctttcttcgaaatttctcatttttagaaatctcattcacaactgtctgcatccccaaatttcttgtcagtatggcaacaggtgataagaccatttcttacaacaattgtgcagcacgctgttttttactattctcttgggtgcaaccgaattttttcttctggctgccatgtcctatgaccgctatgaggccatctgcaaacccctgcattacacgaccatcatgagtgacagagtgtgcaacttactggt

SEQ ID NO: 39916 - DNA, 771 bp, Bovine  19866880417044
ggagaggagcagtccagtacatgggcagatgcgcacagagcccgacagggatctacccccattgaagacagtggtctcattctcatttcaaacacacttgtgctttctgccaatggtgaaccaaaccatgaattttcactttgtcacataatgtgtgcaaagcacaagactgtaccacggagattgtcttcaacatggcaaagagaatcacagggaagacaagacatccatcttcaaaaaggtaaacaaatcctcacggtcattcttactgtgggggatggacttaggataacactggcttcaggcttggcctgtacctggtgggtaggtttggggggcatctcgtcactgtctccttgttaccagcctccatttcagtttctttacttgatagtggtccagtttgactcagaagaaaatataatatagctcaggttttaaggaactctggtaagccaaactaggtattacagttacaaagaactgaaaaaatgtatctgtattttcacactgtcagttgaagagcttggtgtctacttaaagggggcttcatgaatgctgagcatctcctgactgccctgcagatccactctccatgtctggggaccctcttggttcttttgagtgctgatgcccctgaccacatctcagggctccctttcctctggcttctgactggatttggtttcagaagactgagggaggaagaagagaaaggtcagggtatttctacccctagcttccttcttctgggtcagtgtgggctacctt

SEQ ID NO: 39917 - DNA, 1390 bp, Bovine  19866880468840
ctctaaggaacagctatcttagggcattaccgtgatgtgaccattggtcttccttattctccatctagaccatcacaatcaaaaccaagaatatccccatgcctagcacagtgtttaatgcttgctgaaaaaaaaatttaattgaatgagaatttctgattttttaatatagttttctgttttatattccagctatccaatttgatatcttgtcccaaagtattattcccatttcttttattctgttttctgttactttcatagtattgatgaatataaatttatttgacatgtatttgcgtattgattttctgtgtcagtaggataggaaatctctaaaggtgagaatgtcatctttttgggagtatactgtgtgcctgcttggtaaatatttattgaataaaacaattaataatttattgaataaaagaattaaaaattaataaaaaattaatgaattttccagcaaagatactgcagttacaaacacctccctctagtgtttttacataatgaccagacttactgtttttccctttattcactttcttcttgattttgatgattgttgtctacagttttcccactgtttaaaaaatctcatgacaaggatagaaaaaaatgagtgggaaatttacaaagagccccttttacgtgttgactagggaatccttttgtgaatggctgagttccctcgattcatgcaccactgattcccccttctccttcctctggcttcttctttttcctactcacaggtctgcccaaagctgctggctaagccgcctcaaatacaaaggggaattaatactgtaggatatttagaattcagtgcctacttcactgtgacatcttagaaaatcaaggcagggttttaaccctagtagcaagtggcaatcttagcatctatggacttaaactcaccaggagcagagcctgttttatgaattattatctgatactgctgtgcaaattgaaacttgagcaaacaggggacctgagtttttgctttccactttagctctccatcaaatcaattttagtggagagagttagggtataacagtgaggggggtgtgtgtgtgtgtgtgtgtgtgtgtgactgcatgcctgtcgaggttgcacctcaggtaggtgagtggctatagacacttaattgtaagagttaaggggctcctgtgagtgagtgtatcacccaccatcctcgcatccccaatgattctaccccctctagtttcacttgtcttctcaaggtgctctagatactggagttggccatcagcacgctgtcccatctcaacccagatgctaaaatgacccaaaaccaggaaatataagggaaaagatagatttcacttagtgttggtacaaattttttaatctttttatg

SEQ ID NO: 39918 - DNA, 824 bp, Bovine  19866880487465
atttattgagtataaaaataataatttgggaagcactctcaaaatctgtattataaaaataaagaatttgcaataatgcaataacagactgtatttctattttatgattctgataataaaacacttagattccactttcctggtttatgctgttatcaaacccccccctgatataattagatagccttgtttgaaatagttatttagattttattattgcatagcaaaaatccctttgttaaaaaaaaaatcttcaatatcttaaatctaagagctatgttgctgaaataagccttgagaaccccaaatcaagttccttcaaaataaaagagccagggatttctgtaaactgattaataatgataataccactaccttgcattttcaattattttaatagttaacaaatcaatttcactttcataatctctctcattttattctctgaatgcccctgtgaggtaggttctattattcccattttgcagatggagaaatttatagttgtattaaatggcaaagcagagactagactggctatcatgttattcaacaattccattctgctcaaaaccctgcaagttacacgcaaaaccatctagctaagaaacatcatgtgtgctatgtgctttgcaatattgtgttttaaagctgattattaaaacctgttccagaccctttctcagaaactccaatgtttcactttctaccttaaagctgggtgcctgagttttaagccaggtttttgttgttaagtggctttgactccttagctagacagcttgccatctcgaaaggagagggcgaagtcttctagatctaaa

SEQ ID NO: 39919 - DNA, 766 bp, Bovine  19866880752254
ccctaaaaagagaacgtacatgaagaaaatgcctacttctcaggtgcctcacctactgtgtgtatagaggcattattgtattgctgctgccttaaaaatccatacaccaattactacagaaaacgagagctctccccagtgtttccaaggaacaagtctgggagaatgatatgtgtcgatactctgaagcctcagaggagcacaaactgttttaactctcccaggacccacttccttgtctgcgctgccatggaaaccagtctcttgtccaactcgagttccccgataattagtcttgaacattcttgatttttaaatgaataaatcagtcccctgcatcaggtttgttacatacctcaaactctgcatattactctgacaaaatgctctctattcactcatttcttaaaaatacctatcgaacaactggtatacacaaaataccaaggaaggagaaggggagaggtcaaagtacctttaggacccagtttgataaaagcctgccatgtgccagcagaccaaactgtcaccactaaaccccagcaaaaagtttcctcagctgcccaaccccagcactgacacaggtgacccctagagtccatgtctgagctccctgattggctgacacatttagctaccgctgagtcactcaacagtttactaattttacacaacagtttacactacaacattacctctcagaactcagagaacatccattgggaatttatgagtatttttgtattagcttagcttttccttatta

SEQ ID NO: 39920 - DNA, 1471 bp, Bovine  19866880761594
ttcttagataaagcacagatcttaactcttggaagcataacagcctcatagaggggagagaatcacaacataatgttaataggttttgctaaccagagacagaatcaaaggaagagtgtgttaaaatacagcctttaaatattgtcaactttctcctactcatcaaaaaaaatttcaaaaacagaaagtgaattactgaggccaccaagattttatatattttttcacttataccattaataaaagcatcaacaaagttacattgtatttttatgttattataaatacatacttatatatcataacctgcaatcaagaactttaaaaaagtatcacttaaaaaaaaaagtatcacttataaaatggctatacattgctgaatagcataatactttattatttttattttggttgtacatataaatgaaagaacctgaaactgtcctgtccatcttcttttaaactgtacgaattttacttgagttgttaccttcgaggaaggtcatctcttcctgctttcagaaaaaatgagtttaatgtttaaactcataatgagtttaatgagcataaatgagatctctatcaggatataatggccataagcatagatcttagcccaaagtgctctagcgcagccaggaaactgttttcatttacaaaggtttctagtttgtttcagtgtttgtatcagtggcttttcttagtaggtatgagcaccatgaactcccatttaaacttagaattttttaatctggccctgatgctctgacaaataccccagatatgacttatacagtgtcctgtggggagcattgttaacattgcccaaatagccttcctactgatttatttgcttatagacaacttacatacctggcctcccgagggagctgcatgtctcaaatttgggcgccatgataataacaacagtttgagagaaaatgaaataggctgtaaagagagaggaaatggaatatacaaactattgtgtggtatcatgttcattttcagtactatataaaataatgaaaatgtttttcaataacctgtgtcgatttttataatgtgaaacatactttgtggaaaaagacaatgaatggacaaaaccaaaaaattagtagaaatatttttccttttgactcaaatttctgcattgttttcggtaagtccagactagagttgaattctgaaaaaagagtaactttgctataaaggatgttaatttctacctttggcaactttgaagttcctctttcagggttcacggacaaggattatccttgataaagaatctagtgtggtaggcagcaaaggttttatttttcgtattcccccttaaactgaactttcccatagtcactcaggttttcagttgcccatctgggattaaaatgggtgtgctttctggtatgtgcatggtcagtcagtcatgtctgactccttatgatcccatggactatagcccgtcagg

SEQ ID NO: 39921 - DNA, 1576 bp, Bovine  19866880815647
atccattaagaatccatacacaagaaaagacattcaaacaggaaattaatagaatcactgcaagaaacaaatctcatcaatgcaacatgcacaacaaatatgagaggtgtggagtatttcacattctcaaagtaaaaaccacttcccagtacactagggtgggaactgggtataagtatgtggtgctggccatgtgtgacaattgttagggggtacaggatttctgagggatgtatctgtgtatgcatgcatggattaactcatcataggtatctgaaaatttgcaagtacatctgatgtgactgctagtgagcttgagaatttcataggtgagaagccttcagcctaagagtggaaatattatagagattctttactgtgaaagaaaggtaaagcattttggaatctccttgtgtttctcacctataaacatagtcaaatattgcaacaacagtagaagcagctcaaagaaaaaaagatgcatatttgacaaagaagagaaaaaaaaaatcctgtgttctgcagatgtgcatttttaccttaggtaatccaattaaaatcatatttaaagctctgacaaaatatgataagggaaataagagtattttcccatcggaatatattttaggtgatagataataggagcacgcatacagtcattcatttgcacgagactattaaactaatgattataatttctgacctgcttgttataagattccatatactgaaagcatactgcctttctctatttctgacataaataaaactgataagcgaagatatgtgcatgcaattttaattcaacagagtgatgtgaagtgcagctcataaggcaaatagtataaaccctatcagttctgtttattgtaataacccaaacaatggcaattacaaactaccccacagatttttggcatggcaggaatgacagatctacaaaatccagctaatgctggtctttttgtagtactcagttaccaagccgcacatgtacaatacacaaatctcaaaagtaatgagatatttctttattatcaaatccgttccacagactggtgttaaagatcacatagctcatttctagaaatctcctttgtcaacctcttaggtatacttaagaaaaataaaactcacatgcattcacaaattttgagccagcctttaaggaaattcataaaggactactctgttactctaattatataaataataatatgttttaagattctgtatttggaactcagctaaaatataaaaactcttttgacatgggagaaaccaagctgattggtaacagatactatgaaatctcatagttcatagttaaaagatcgagtctattcctttatttgaaaatacatatgtatatcttttgtatacattacaatcataaaacatgctattagattttttacatacataatagtataaataaacttcaaaccttaccaacttcttagtttcatagaagatataactggtgctggaataaaatgactgcgttctgatggatatttgacttacaaattataaagataataatttggatattttgtttaccctaagttgctaa

SEQ ID NO: 39922 - DNA, 1929 bp, Bovine  19866880820798
actgagtactggaaagtggctagtgtagctaaagaatagaagttttaattttaaaattttatggctactgtctatagtataggacagcacaacactaggaaataggccaaggaactgcttaaatttttcttttttttgtatttaattaactcttcagtggaataaactaaaagcaattttctcttttgctccattaatcatcaccacttaagactgacattctggagatgttctctcaaacagtgttcattcaagaaacagttttgaatacttaatagatgccatacactgtggcttcaaagagaaataaaacacatatttcttcattcaaagatgcagcaggaaaacatcaactggtaatggaatttgattttggaactgttgccatttgggggaaattttgaaggactgatttagataacagtggtgaagaatattttaaattattttttctctccttcctcccccatttagatttggaagtagcaaatgggagtggacttgtcaaaattatacttgtgatgatgacgggaaccattttggatcccactgtcaaccccacctgaaggtggtaatgaacttctgctggtttctttgacttacgtaattttcattacatctcctttcttttctactctttattttatacctgcttgatatctcaactgttttcagatttattaatttctttgcattttataatctgatgtcacagatgatccaatatcatccctctggctctaggcaatttcatcaaactgtgtcattcattataactggctgcttttgtggtatgctagcaaattttcaatcagtatgatagcatttatagccaagttaatttagattagttagcaaatattatgccatgagatcatgtataaaatgatatcactagggcccaaatatgtagtgtataatgtatttctttactcattaatttgaacacttcccacagaaaactgcaataagaagctcctggcataatttctttttaataaattctgaatgctgcctattacttttgattttcttattctccagatggctacacatctacactctattttttagttatctctctaagcacagatttcttactgggtgctattatttatttattttcatttatatctttggtttgtcttaaaacaaagagaaactgtttcaaattaactgataatttacaaataggaaattagtgaagagcttaattttccagtatgacttaatatctctcaagagctataccactcgatgaatttctgatttttacactaaacattaacaatttaaaatcatgtagtagtgaaaattatacaaatcctagaaaatatattaagtaatgcttgtattgagatctttgataaatcatagtaatttaaaaaatccaaacatttatatcttaaaacctttcaaaaatagcattacttactttctttcaaaatatttcaaaaatagcattacttactttctttctccccatggtataatgataacctcatagtaacatctactttgattttcttctttaaaagtataagaaagtacctttccatacaaagaaatcactcttgttgaattactggtcaatcatggagtgggaagctgttaaggtacattactgtttagaatgaaacgtgtaataggaaaccttagtatattattaaatttttcaactaatggcttacagctatagttagagggaaataaagcttcattatcaaacttcaccctattcttctttattttcttattagttttagtctcatattttccttccctttgaatgacttactgggttctggtaaagaaggtaagaagaagaacactgactgaatagaagatgacggggtggttgggaggtagtacattacctgttttcaattttcgtgtttcaggacctctaggaggaaaaataatgacctt

SEQ ID NO: 39923 - DNA, 1747 bp, Bovine  19866880830677
catccaactttctatcatacattgtttctatgtaagtagtttttacctattctttgaaatatagatgaaagttgagctcaaagtcagcttcatgaagaaaccctccatgggctgtattttgatatagatgcccttcttcttgaactattcaattctctcctcatttatcaccttgcatttgttggttttcctcattccacttttctcttccagtctatatttcaaggcagagacacagtggtaacaattttacatccacatttcagcacaacgtctggcacatgttagtcactcaagggatgtttgatgaatatattatttgatgaaaaactaaagcattaaataaaaatattgtttttagaaatacagagcaccatgaaaaatgatcttttgctaagtgaaaaaaaatgtattaaatgttaagtatacaatcattacagctttgtaaaatacagatgtagcaggaaaagaatataaagattcattcatacattagtggttagtgagttcactgatgacttcttttttcagagtaatttcagtaaagacttttattgtgtgctaacttgcttcagtcatgttcaactccttgcgaccctacgcattgtagcccacctggcttctctgtccatgggattttccaggcttaattcatataacaacaaactatggtttgtattctaattggcattatctgcttaacaaatttcacttgtatatcattcctctttgtcttctattttctgtcatcacacaaaggaaatatacacaagtatggatttataaagttaaaaaaaaaagtctctttttccccccaaagttttcaacacagaggtatagagcaatgtttaccaatcaaattgtttatgcaaataactgcatctagattggcctgtaactatgtgcagtggaaacgatcattcacctctgatgagccaagcagatagcatatgcaaatctcagagctgcataatagctttttctggacctctaactttggtttcctttcagaatattagttttaacaccactagtctacaaacttcatggatgttaactggtaagattttgttttgttgggcttttagtttttggttagtttttctggcagagtttttcagtatataaatgatcacaaacatattacacataagtacttgcttttttataatagcaaatatgaaatgtatagacatttgcttacagactattgaaattaaagtaggcaattttttttgttttagactatatatcaaatgacctttatagtaaacattaagaatatgaatttaaaataaatttatattaaaatttcactgaatccaccatttattttacattaaaacatcttttcctattgagttttgaaaattagtgttatcttttgtgtagtaatttattttgctgatttgttattagcagtttagatataaaaactgtatcccatatccacataggtactaattttcctattcatatatacaaggcccttctttatttctctttatccttaaagaaaagaaagaaaatcttatactaacattttctagtaactggattatgattattagtgatttttcactaatattataaatcagtcatttttatacatttaattagacccagcataatgcaccatgactcaaacagtatgctaatagtaaaatacaagccactgagagccatactaagtttctcaaagacagttggaagaaagcaaatttaaaattagaaattacaccttttt

SEQ ID NO: 39924 - DNA, 1162 bp, Bovine  19866880839896
aaaagttgaatattcatttccgctcatttctctgcgcctcgctcctcctcgtcgcctctgccctggttccctacagcgttcacaactccatctgcagtgcagaattgtgagcactatttcatcctcagggacagtccttctctaccgtctgcactagcagcaataattccagcaggacttgtttaaaacaacagtatgtcatctcgagacaggagtttctcaaaaggctcttttaaggtacaaaggctcctcctatgatctcctttccatttttatctctagactccctttttaaaaaataaactgtagtgtctcaaaaagataccacttattctttttgagacactctctaatatatgtaaacatataaagtatttatatatcatatgtaaacatatatataaagttaaatattttatatttatgtaaaaatttgtagtatagttttgaaaactaaattttagcctatagatgactacaacagaccctaaagaccctaaattttgccatccaacagtttaagaaaatgcatagactttaacttgagtgtattattagaatccttgttaatttcagattattatattctctaagataataaattcctttagtgaattagaagtactgtgttcaacttatcttgaaataatgtgactattgcataaaagaaaggaacccagtacaataatgattcttgatgaacaggttacagatgtaacagaaaatttactttgtgaaggtcacttagatgggcactgacaaaagaaattaatacagctgttaagcagaaacagtatatattggaaatcatctattgttaggcaccaagaataactgataagtgccaagttgtaccctaaaaaatgggaatgtgactttcctttgccactcaggtgtgtaatctctgctaagtcccctgctctgccagtggttctctcaggaggaaaacattcctgaagacctgacggatctctcaagactctggttcaacagctctgactcagctctgagggcagaatggaaaaatctgagggagggaaaagagaaagaaaatttgtctaattcaggtccgtagtgctgatggtaagtcacttgagtcatgtccgactctttacgacgctatggactgtagcctgccaggctcctctgtccatgagattct

SEQ ID NO: 39925 - DNA, 1738 bp, Bovine  19866880871579
gggacgttgtattctaggctgctactaataatctcatcagaatgcaaaagcagcgactgtgttataaaaccaatgatctgttatattctgcaagaatttacaaaagcctaatgtcatttactacaccatgagaaccatacttggataaaaaaaataaaacacaacagaattcaaaaactgattacagctggcaaaaaaaaaaaaaaaaagctgtttgccaatgcaatgctttaaaggtaaaacatacaacagagaaagacgtggtatccggtgatgacttcagaagggaagaagtacgtgtttgggtatgtataggtgtcgtatgtcatttagggccgtgttgaatcagggcattccttcaagcccaggattctcgggtctgcagttaactgctgagtgtgtgttgccagttcaggctgcaaaagagtttgcttttttttttctttctcagcagcattttggacaaaagcgtatctctagcagtcttaaactgttgaagtccatgttgcggcaaatggatgctaaaaaaaaatccaagggtctactaatttgacaatttagcctaaaagagattggaattcatgggagatatttgagaagagaaatgacattcagatgtgagtttgtgaaacagtgctctagcaatcgttctgagatgatgttggaggagggtaagcgttagtgtggaaagtgaagaggaaaagaatggttcccattggtgttggtggtagttgaaataagtagagggaattggatgaatcagaggtagatttaaaaagaataatcaataaatatggggtgtgagcaagaggtagatgtcaagaaggattgtgaggtttctgtcctgcacatgcaagtagatatttggccaattattgaggcagaaaggcatgaggagaaaaggtttgtgtaagaaatatggtaagttaaatttctggagctctggtgttcaaggcacctatgaaatatctgtaaagttttaggaatccgaataggaatcatcatgaaaacaaaaatttagggatcaaagaagaaacagtgattgaaggcaggaggagaagggaatgacagaggacaagataattggatgggatcaccaactcaatggatatgagtttgagcaagatcctcgagttggtgatagacagggaagcctggggtgctgcagtccacggggtcacaaagagtcagacacagctgagcgactggattgagaagaaacatgtggactattggtaaagattagagtaatatagagcttcccttctggattgcaatataggtataatatagtgtaatatattgtgtagtgtaatattgtaatatagtgtaatataggggaagaaaagagtaacatcaaatgtactctaagaaatgataaaagaatttttctttgcttttatacatgaccatatatatactgttgaatttttgtaggaacttttttggggggctttttactatctattgttcgttacattatattgatatttactatgtgttttgcattgtactagactagtatgtatgagacctttcctatattctgaatatcatccaatacagaaattattagaaaattgtcaaagctcaattaaaaaatttaaattgtctgatacacacaaatacatacatacacataatatatacacgatgtattcccagtgaaatagccatttaaaagagttcagagaagtgtcagatttatctattcatctatctttatatactttatcta

SEQ ID NO: 39926 - DNA, 921 bp, Bovine  19866880893054
attttttaaggcaatgattgccttaaatatctgtatccacagaacctacacagagtaggtgtttgatgatgctgaataaatgaatgaattccttggaggtaatgaagagtacgattagttacatacacataatatttaaccaacgaatgagaacaatgttatcatactgcctcaggctcctctggccacgatgtctgagtggtcacatggaggatgaggacagataacacgtgggcgttcatgaccactttccttgatggccttcatgaatgaaggcaggtggtagaaaagcctggagagactagagagcttgagatttgtaaaggatgggaaaccttgaatgtcaacctttgctttggctgctgctgccctagtttctaatcagaatggagcagtgagtttcttctggaccataatgagcaggactaatattcccatcctgctgatgagtgagctgaagccaccggttaattgactggtcactcccaaattccgagccaagctcccctttggttgtaaagtttgcatctgtgtgccctacaccgaggccagaggtcagaccgaactgtcccacggatgctacatggggcctggggtggggacaacgtgggtcctcgctctgctccacagacacagataatgcaatgcactatgttaattaccacttaaagctgatacagacgaaaataaacaaatgcgcacccattctggttccacttctaagacctcatcctgagaccgtaacacagtttgttttacggcttccccagtcacgtgagagccagcataatgaaacctctctaatctctatttttctaaagtctgtgtagatacagatggctctgttttggtctctgggttttattcttattttgccacaattttaaccttttatgtatctctttctgtgagcttccagca

SEQ ID NO: 39927 - DNA, 1820 bp, Bovine  19866880925074
tgtctgttactgcacgtaaactctgtatttcaaaacaggtccttgcaaagagaaggcaggaacggctttggcaaacagagttaggtttaatttaatgtggcaaatgatggagcagaatggaaaaaaagaaaaaaaaaaaaggacacaggaagtgatgagtttctgacactaagtctcctgggctcactgcagactgcagtctcgctgttggagatgatggttacggtgggctgcaacgatagggctataggcatatgcgactgagttttagttgatattcttgcaagacaggaagtgaacaagcttatttcccactgggaaaggttcagacatgattaacttgggcatgaccaaataggtcaataatatgacaatgaatttctagcacaataattaagtgggaaaatttgtgtgatttgttcttcttgttctgcacataccaataatgcattagcatggattcatttagtttctttcattaggtgaaatcacatagctacaatttaagatagtgacggttcaatttgaatacttaaaagttatttctgcaaagcaacattaaattatatttcttttatttttagcataggcttttgtacttcagcagcagaggagtgatctggaatctatctatacatgcatactaattgtttcaggagtgattctcccatccaatatcaggtcttactgataccagtcaccaggataaagggaagaattactacagagaatgaaacagataaaaacaaatccttcaccttgggatactaggattcaatgtatttcacacttaaatgctgttcctgtcagttattaaaatattttaacttttctttaaataaaccatctatctatatatatataatactcaaatcagcattggaagagaagccagaaatcataaaatatactatttcatttcatgtggtgcttcattctagggtacttgcaaaagaacaaaaataaaaccccaaagcaaaaattaaaaaaaattttttttcttaatattattctcttaatattagtaatattcttttaatattattctctttcaatttaacatcaggacttaaatgtaagaggtttacataattgctctttaatatttcatgttcttgtttcaccccgccccctccacgtccaagatactcttcagtcctttgctgccatttgatataggacaattttccccctaatactggaaactatgcagttcataagtatgccttagcaaatagaggacaaaaatgacagttcagtagcagcccaatgcaagtatcaaggaagacctcaaaccattcattagttgtctttgcttatggcttcccaggtggcgctagtgataaagaccccgcctgccaaagcaggagacataagagatgtgggttcgatccctgagtcaggaagatcccctggaggaggaaatggcaacccactccagtattcttgtctgagagattccatgcacagaggagcctgacagcctacagtccatagagtcacaaagagtcagacacgactgaagcaacttatcatatatgcatgcacggttacacaactatcttgtcaacaaggatgccatgaaatacaaaaatcaacatatgctctaaatggtggtatgggtaaatgccagtaacctcctaaataagccaatctagaatacttttaaaattttattcccactttagtttgtttttcttttgcaaaatgagactaatttcctggcttcgggtttctggtattttccccatctgctccacagcttcttatcggtcactgacattggttccttgaacacatgggcacattctttcaggact

SEQ ID NO: 39928 - DNA, 2562 bp, Bovine  19866880962079
aaaaagagtgctctctgatgtgatgttagaatttcattagcaaaatttatgtgcatcctttataataaagattacttcagtactgttctgtattgtaagattcttaaattccatcttagattgaaagagaaaaataccacttatacttctaacttctgtcaacaaaggtattaaagtctaggtgctttgctttagctggctatgaccaataagcccatgaataaatcagtttttaaactttatgagttttcaattttggttacaccagaacattaaaattttggttatatcaaaacattaaaataattcactcttagattcttagttttgggaatgatgatcaaatttacaacaagcagtgattaaattatgctctttaattttactttgaatgttaatactataatttgattacaattaagatcccagtttattcagatagtatttaattagaaggatgggaaagaactggaggctatattctgtgcatcaatagaaaacaactgcattttttttaacagccaaatcacaaagacactattacagagaaaaggtcctatgtttagcatataaaataatgttttgtaaataatttaactttcaactttctacccatatattgaataagaaatccagaatctaaaatatgatctgagatggagcatgtagaggataatttaattgttgaatgatttcactgtggaaaattaatgattaggatacaaggaggcatttttattctaggttgcagcttttttgcctgtgttctgcagttaattgcagacatctcaatcgggcttcaacttgcaccaatagaatctttttataggagaaaggaagaaaatttccttggctggatcagaatgtcagagaactctggcatttaacctcaagacacaggcttaactaaactcacatggagaaaggaaccgcagaaaaagcttatcagaagtaataaattgtgtcaagataaatctctgaatgttggcacctttgcccatctgtttaaattacttgaaaatgtttttgtaggtgagagtgaccttgatgaattagatcttgaaaataagaagtctgtgaagttttttccctcttaaacagcaattttcatattaacacaagtgtgacctatttaaagagaaacaaattagtaaggaaaagaagactataattcaaataagttacttaaaatcttcagtttacaacaaactttatgaaatatccttagcaacttgaatatgaagtatttcctttttttatttttgtcaattgggttcccagttttagaagtgaaaaacagaatctgaatatgatttaaatatcagataaacaagggatagttttttaatataagtatgtccagggcaatatttgggaaatacttaactaaaatattacttgtttatctgaaatttaaatttaactggtgtcctttattttactgatagctctattttttagggagcaaaaaaacaatcatataaccccttttattttggttgtatatgtacttaaaactataaatattatgatcttgtatacattgtccttatttatatttttgtatctcaatttcatttgtatgtattatcaagacttacttaacgttatatgactatggaaagtaagaaattacacatgtaaaaattcccttccaacacagtttaatgtattctgcaggtaattcatactgtacatggggttctaaaggcaagaatactgaagtggtttgccattcccttttccagtggaccacattctgtcagatctctccaccatgacccgcccatcttgggtggccccacgggcatggcttagtttcattgagttagacaagggctgtggtcctagtgtgattagattgactagttttctgtgagtatggtttcagtgtgtctgccctctgatgccctcttgcaacacttactgtcttgaatttctcttacgttgggtgtggggtatctcttcacggctgctccagcaaagtgcagccgctgctccttaccttggacgaggggtatctcctcaccgccgccccttctgaccttcaacgtgggatagctcctctaggccctcctgtgcctgcacagccacagctccttggacgtggggttggtcctccaaatgataggccaaactgataggatactgaaagaggaatccccaggtcagtaggtgcccaatatgctactggagatcagtggacaaataactccagaagaatgaagggatggagccaaagcaaaaacaatacccagttgtggatgtgactggtggtagaaacaaggtccgatgctgtaaagagcaatattgaataggaacttggaatgtcaggtccatgaatcaaggcaaattggaagtgatcaaacaagagatggcaagagttaatgccgacattctaggaatcagtgaactaaaacggaccggaatgggtgaatttaactcagatgaccattatatctactactgcaggcaggaatccttcagaagaaatggagtagccatcatggtcaacaaaagagtccgaaatacagtactggatgcaatctcaaaaacagcaga

SEQ ID NO: 39929 - DNA, 1636 bp, Bovine  19866880973238
agtcaaaaagagagagatgaaaaatagaatagaattgggaataaataaatgagaactaattaaaattaaaagcttttgcacagccaaggaaaccataaagaaagtgaaaagacagcccacagaatgggagaaaatatttgtaaatgatgcagcaaacaaaggattaatttccaaaatatacaagcagctcatacagctcaatgtcaaaaagcagacaatccaatcaaaaagtagacagaagagttaaatcgacatttcccccaaagatacacagatggccaacaggcacatgaaaagatgctcaacatcactaattattatagaaatgaaaatcaaatctatgaggtatcaccccacatcagtcagaatgaccatcatcaaaaagtctacaaatagtaagttctggaggggatgtgaagaaaaaggaaggctcctacactgttggtgggaatgtaaattggtacagccactttggagaatggtatggtgtttcccaaaaaaaactaaaaatagagctaacatatgattcttcaatcccactcctgggcatatatttggagaaaactataattcaaagatacctgcaccccaatgttcaaaacaacattatttacaatagccaagacatgtgaaatctaaaacaaaaatacaaagaactcacttccaaagcagaaatagacccacagacataaaaaataaacttaaggttaccaaaggggatagaggtgggggagtataaatcaagaagatgagattaacctatacacactactatgtatgaaatagataacttacaaagatctactgtacagcacaggaaactatactcaatattctgtcataacctataaggaaaagaatatgtgtgtgtgtgcatgcatatgtgtacgtataagtgaatcactgggctgtacacctgaaactaacccaacgttttaaatcaactatacttgttttctcaaatatgcagaaaaatagaattgggtgttgttagtatcgttacaggcttttgagaggcacctgcagtttatctaaatatgaaaaccactgttacactatggggagagaagagattcatgactggaagggaccttaatagggcttctgaggtgctggtaatatactgttactgcatctgcttactggttatgtaggtagattcaatttgtaacaattcatcaagcctacacatatgaaatgtgtacttttgatatattatatttcactaaaatactttaaaataaaacatgtgctacaggggaacatgtattattttccatctgttttaagtttacctggacaaagtgactttgaaagtgacttcaggccatcgatcaacttcatagttaaataagatcttttcttattgaagaaaactgctaagctttaggtttcagttaactggctctagctttttcataacttagttgtcttagacaagtgaccttatgtctgcaaaatctcagttttctgctttaaaaaatgttatagggtcatttaatgagatattaattctaatcttgtttttcctgaggtaggatggacagccatattctaggcttcccaccacccctctttgggtttcaagatccattcttaagaaaatttctcaaaccagtcctgttgaaagaaccaa

SEQ ID NO: 39930 - DNA, 1566 bp, Bovine  19866881082849
tacttactataaaaatgaagaaaatgtaaaaaaaaaaaaatttctacaatccaatggcaagaaatactcattcagtgtcattaaaatgaggcatctttctttcaggttatattttttatcaacagcatgtaactgctatgtgaatttgcttcaaggagtaaatattgcccaaatacatattccagcaatgccatacttccaaaatatcatttattttgccaatttagataattccataaaacactttaagaacagaaatcacatacttagaggcaacttatgatatcaagaaatcaaaaaccagtagagaaatgtataaaatacaaatggatttgaaatatatggaaaatgctctttcatatttaaacaaatggaaatttaaattttaactagacagcaatttgttcacctaccatgttggcaaaggtacagatgttaaaaggggtgccatataatgacatccatcaacaagtaagacacccatcctttggctcagaaatttcacttggaagaattaatcctacagataaaccctgtgtatgcgtgttgtgtacccacatggacactcagcagagacctgcttgtaataatagcggcaaacttcaccacgcccctactctccagccctctcacccctctctcacccagccttcatcttctctcacctgggccacagaaggagcatcctgcctcatcttcttcttttccctcattcactctcacaacatcataaaagccagagcaatgtttttaaaacatagataacgtcctgctgctgctaaaacctctccagtgcctttccgtcatgctaaaaataaaatcaacaccactaatctggcttgtaaagacccacctaccctgcctctgcatgcccccaatatctcccatgcctctctggccctcacccttggcgtatttagacatggaggctgtctcaaggttactcaggcacgtccagctcattaatgctctggaatctctgactgaaccccttccccttagatttctcacaatgaccccttctcacccttcaaaattcaccttccgtgacagtctcgagtggccttccctgatgaccccaggtcgagccacggccaggcactcactttctaacacttggtccctttagctttcctctttacactgtccatcctcacctggctgtgttcctgggcgttccatcgtgtatttgtacagattcttctgctcctgtcagtgaagtttcggagagcaggggtactgtcagcttcattcgttgctttattatcagcaaccagagaagtgcctgcacataataaatgtttagtaaatattcgttgagtgagtgaatcagaaggggatggaacacatcccaggactcccctcagatggagcacagtgtggctgttgaaaagaaggggatggtaggcaatccaggggttatcctctgaccaaggctgcaccatcgcacagatctggccttggtctccctcccagaccttatctcagatcctctgtccttgggcttcttggtgtacttgctgtaccccacatttgttattcctgtctctatacctgcatccaccc

SEQ ID NO: 39931 - DNA, 2733 bp, Bovine  19866881115442
aatctaatataattgaacccctaggtttggatgctaattagtatttttttaatcttaaaaccaaaataatttcatataaattaaattgtcagggtataattcaaaagttgccaaactttctagtacattttctttatctggaaaaagatttctgaggagtaacaaaacttctggattaaaaaagaaattgaaaaagaaatttaatcagattaaaaaagaaattacagcataataccaatgctctgatttttagtaattaaatgatatatcagttcagttcagtcgcttagtcatgtctgactttttgcgaccccatggactgtggcacgccaggcttccctgtccatcaccaactccccagagcctgctcaaactcactctttctaaaagcaaattacatactctggtcacattctgcacattctatgctatccctcaatttcttaacattatattatttcagtttagttaaacatgtaagtatcaaaatcatatagtacgatatgataaactagaagaaagcaaaaattatatttacaggtgtttcagataataattgagaatttggaattggatgctgaattttctagactaacttgctttaattacatatattacttggggaaataaatgatttaatctccctaagtctaaatttccttacatgtaaaatgtctataacattactttggtatagggtcactatgaagattaagacatatatttatacaacttgtgtaatacacagagaatgtctgatacctatagcacttaataaataaatgatctcctgtttttaacgtcatagtaaattatcaacaaatggaagtttaagacctatgcctatattttaatttctgtagccacactgagtcttagtactgcatatagtcctgggcagatagtaggtgctcagtaaatatttgctaacgaaagagttattgaaagtgattctgccagctcctatgcagaatgcatgaggaagtaagtgaggcattcaattttgtctcttattataagaaactgagtctaacactcatgaacatctgtgtcaaaggtaatttaaacttttattcctaaagaaaaggatgtatatatagaaatatagacatgtcttataccatgaatatttctcaaagtaaatgatgccttgctttaactcagtctcattgtgtatagtcaaaacattgtattagaaataggaatgtgctttcttttgtatgcagacacttttggcaattccaagaaatccatatatttcataagcactgcatgatggcacatcatgtctttacattacttaaaaaaaatcaactgaaaaagcaaagatgtcacaatgtatcctactgcagttgctttggtcagctaaataatcagagcagaattaggagaaaaaatagtatgataacaaaaaggtgaattcgaacctcaggcttatgatgtcccagggcagatattaatggctgctctttctctaaattcattcctttccttccatagtttctgtgtctcatcgtgtaactgatatgttacaaagcactagcttatttggggagtttcatttctataatgtgtatgcatttggctacgtttgttatgtatgcaactattagcttcccaattgatgtctctaattttgtgtattttagggcataaaatattctttatggatgaaactttgtctgcttaatccatctgccagcaagttctttttttctggccaaatattgctcagggccttcaagtgtttcttcatctgtgaaatgaaaagaggtacttccaaacctaaaatgccttgatcttcatgtccccttgtaagtttaaaaatctttctacagacttagagactaagtagcaaagaacacagcactctggatgcacacgtagctttaactctctgcagtgaaggcccaacgatgagctgggcttgctgtttttcagtatttataactcttcaaaggtggtcttgatcgagggatttgttttcaacaaaagcactttcttaaatactggctatcaacttactttttattgaaaagtagctgtaacccttcttagtataaaagatcaacattgaagcttagagttagttaagaatggtagatcagatgttcacagttgaattctgtctccctaaaaatatatagaagagtcctctccctagtacttgagaatgtggctttgtttggaaagagtaactttacagatgcaattaagtaaaaattaggtctatagtgtgggctctaatccaacagagctggtgatctttcaaaaaggggaaatttggacacagacacagatacacagagagggaaggtagtatgaagattgccatctacaagtcaggaaatgcttgaagctaccagaggctaggcaagaggcctgagatagatccttctctaaaggctttggagagaatatggctctgttaacattttaatcttggatttctgttttccagaactgtaaaacaatcaatttttgtttttctgagttaccgagtttgtggtactttgttatgggggccctaggaaatgaaaatactatgctctgaacatttggactcagttttctagtaatatcttgggataactatagtctggatcatagaagtttctagaaacagaggctctcacagtagaataatttctttgcattatgaaatagggccattcttgaaaaaatattttacataattatgaaatgaaccatgatataaaaatatttataatg

SEQ ID NO: 39932 - DNA, 2382 bp, Bovine  19866881146896
tgacgggctaccattttggggaatgtggctctctatgtaatatgtatatttcactttcctttatagatatgaaaaacaaacaaatttattccaagaaaggtctagtttgaattagtatagctcttctaaagtgacttgaggaaaatgtgtgtcataaaagttaaacatgaaaatatgtcacaaattctctgaattaataaatgggtagcaaatacaggggacataaaatcctctaaatcggggatcggcaaaccacaccctccaggtcaaatccaacccccgtcctggttttgtaatgctggtaaaccaagaatgacttactagatttttcaaaggactaaaaaaaaaaaaagcaaaaccaaaaaatagtatatgacagacataaaaacaaaagatagctcagttgtgaccgactctctgcaatgctatgaactgtaacctgcctggctcctttgtccatgggagtttccaggcaagaatactggagtgggttgccatttcctcctccaggggtgattcccaacccagggatcaaacccccatctcttatgtctcctgttttggcaggcggattctttaccattagcaccacctggggagcccatatgatgatagacacagatgtcccacaaaagcctaaaatattgaccgcctggctctttacaaaaaagtgtgctgatctctgatttaaatggtcagttttattattgaaaatacaaaacggcaatatcatgtcactggttataatgagacttttttcccctggagtttcaaagtaaaaatttataataattatagaaactgcatcatgtgtgtccaaggcccttcagttttaaattgcacgatccgtcatattacctacacatttttcatcctattattttcacttattatcatgtcagatgcactttatgaaaatatgttaatggcctcataataatctattgtttaatgatattatattttaatctatccacccactgcattgttgggtactcacgttgatggcaatttttcaaaaacattaaaagaaaataaatgtccttgcatacacctagtatataatcattttaaagaaaacaattaataaataactaatcctactgcatgtgggctcagtcactcagtcgtgtccgactctttgtgaccccatagactgtagcgtgccaggctcctccatccatgggattctccaggcaagaatactggaacaggttgccatttcctcctccagcagatcttcctgctgctgctgctaagtcactttagttgtgtccaactctgtgggaccccatagacagcagcccaccaggctcccctgtccctgggattctccaggcaagaacactggagtgggttgccatttccttctccgatgcatgaaagtgaaaagtgaaagtgaagtcactcagtcgtgtctgactcttagcaaccccatagactgcagcccaccaggctcctccgtccatgggattttccaggcaagagtactagagtgggttgccattgccttctccgagcagatcttcctgaccagggatcaaacccaggtctcttgcattgacaggtggattctttaccactgagccacctggaaagcccttttcacttactatatccagtttttaaaaagaaagacatgacattgtaaatcaactatacttcaataaaaattaactagaaaagaaaagtaaaagaaatacatggtagagtgactggatgtttgcagagtgagtcagtctctacactttgactcaacatggctaaaaattgcttaacagaccggatgtcattgctctctgtttttgtgatttagtagtgtatccatgttgggcactctaatgatttatattttgaaagtagtattgtaatcatgccataaggcattagtgaactatttgacaagaaaatcatctgatgaaccttctgaaaagtaaactgtatgtgtaactgatactgaggaatagtaattcaaaatacctgttgaacagaaaagggcaactttgtttcatccttgagattggagcagttccttgcaagaccatcaaaatgcataattggcagctcttgcagatggcagaaacccaggtgggctgataagcttttgaattacatgatcaagcaggaactgataaaatgaactatatctggaatgaagaatctgcatatttaacattgaagccacttatatcaatgtgcatatagggattttagtttaccacaattttaatatgagccaaagcaagctactacaaatttagagccaacgccataattcagctctagccagcaagtaagacatcttaactccgaccatatgcagtatacagtcctaacatcacatataagcccatataaagtacgtactgggatttcatttta

SEQ ID NO: 39933 - DNA, 1472 bp, Bovine  19866881211332
acacggcactacagcagcacaagaaagaacagaatccatcagttcttatgactgctctatcctaatactaagggtatgagttacaactttcctttccgcttctttttcatgttacacacattatagatacacttaggtcactaaacttgctgtctctggtcacacatttatcagcttgactgactgataactgtgatttttaagataaaactaatcaatctctaaccttagatttctcactgaatacatgaaccagaaccagatggcagggtgttatataagatcattttcacctacaactccataatgaaatgaattaacagttttagtcaaacattaagttgatagagctctaccttgtaaagactgtgcataaaaaatcgggtaagtatttcaagaattaaactcaggcaggagactcattctctctaaaaatcagcccaactccaacatccttgctcagaattaatgcataagcgtaggatccttctggacctaaccagagttgaggtttgttgagactgcaacatgaaacttccttttgagaaaaaatattgatggtctgattgtgtgggcaaagggttgtttatgttcattaactgccaactctcctcactcaatgaattagatccttacacagtttttttgcacaggccctataatttaagattttatcactaccattcttccttctcttctgcttttaatatgtaattcctttacatccatcactgaaattattgtatcatgcctttatctgaagtcagttctctgaggaaaaactcttacccaaacacaatatttttttctcacattccgttaccccttttaatatcctggttttcttccaaaatgtagaataagctagcgctcataagtttagaaataatttcttctccttgcaaagcctctgtgtgatgaacagaaagtactgttaacttttttttttttttaatgaaaaacaaagctccttttagttttgttatacactggtggtgggggaacttaggaagagacctttccctgagtaaagaatgaatgggcagattgatagaatttatccaatctaaagaaaagaaataaaaatgaagaaaaagaacagattctcaaattattctagggaaaaaataaaatataatcaagtccagaatatgtgaagttggagggtctggaaggagaagagagggaaattttgagagaaaaatctttgaagaaataacagccaaaatatttcaaaatctcatgagaaacatcaactcacacatccaagaagctcaaaaatctcacacaatacaaaaacagaaagagaactatgtctgagaacatcaaagagagaaaaccaattaaagaggaaatctttaagcggccagatacaaaaggacatattacatatagaggacatggcatgaataactgctgtatttctcaatcacaaacaagaaaggacaggacataatagaaaaaaaaaagtt

SEQ ID NO: 39934 - DNA, 2076 bp, Bovine  19866881216593
tcggacacagctgagtgactgaactgaactgaactgaacttccacttgactggtgaccataactgcttttttaatatttcctgtctgtctttcctctctttgttcttcctcctggaaactcctccaacacaaacatatgtatgaagtcttccctgaactctcagtgcaaaccaccactctctgtgttcccagagaaacttacacatggggaactctaactctatggacattgcaccgcagtcaccagctcttatcatagttcttaggtaggtgctcaaatgcttgctaaaaataagcaagtttgctcaatctgctaaagaatcatcagccaatgatttattgttattgtcacacataaaaatgctaagatagacataatacacagccttttacaggtgttctcaagcccactctaaatacccacctaatcacacattctgacctcattttatcaacaagcatttttgaaaacatgggaaacaataagaaaacaaacagatgagcctattagcatgaaatatgcaaaactctgtgttcttgtttgaagggttgcatttattgcccttaatccagtttacaaactgcaggagttcaggatattcaccgacctttgtgtttgatgaagacatagctatatatttaagagctggcagcactatcgaacctggctgtgtttgtagcggtaattaggcattttagcacatattagtgtaaacagctgtgtaaaatccagatcaatgttagaaacacaagttatatggttcaattaaaatattacaagactggtttctgagggtgcccggaaaatgctgagatgtgcctgggaaaatccattgttcccatacaatgacctgggctaacaggtgaatttaaggaaattgtctttcggatcgtatgaactggagaggatacaataaacaggggactctggggccagggttccttttctaaacctactctcagtcttcctgagacatcatgtgtcttagtggagaaagccccactattcctcgcaggaactggaagatctcaataaaagtaaacagggcaaaagtaaaaagacctttaatgctacaccaaaaagtcagctgtcacattaatcaagccacagctaaactctgccaccttttaggagttagcaaatatcaatgtctagctcctacactgggaaagcttcacgcatagaggcaaaacagaggatctgggaatgaacatacctgatttcaaatctttgacctactctttatcaagatctattctagatctcagttttctcacctgttcaatgggcataatacctgtaccatgttaaaaattgagagtacatatctaccaaaagtacaatataggatccatgttggcatcggtgatatgaatatcccaagaagaatatcataagcaagagataaaaacagactcatactctatcactttatagattagtgccatgtgctcagtcgtgtctgtgggggaaccccatggactgtagcccatcaggctcctctgtccatgaaattttccaggcaagaatactgaagtgggttgccatttcctactccaaggcatcttccagactaagggactgaaccagtgtctcctgggtctcctgcattgcagacggattctttacccactgagccatcaggaaagccccattatgctctccttgaagattccagccctccattgctacctgacaatggtggatatgttgccagtgagggtcgagccaaagggccatctcagtccattggtattttccgatggcgcagaacacctgcggtcagaagcaaaattcagagatctgaatgccagctctactaagttctatgccggatgctagacagtcaaatggcccaggtaaattcctgttgtccatggtgggcgagagacagatagtgtaaccctgccatctgttgacctagcagcatattgtaccacttctgacacgatctaagggaggaggataagagatcaatatttacaaggatggagttgctaactttattttgcaaactctagctgtactgctgcactttaaatattacacgcaggctggtgaaaccagagaaagat

SEQ ID NO: 39935 - DNA, 1116 bp, Bovine  19866881335156
atacaaagtagcccaatcagtcatcagggaaagtgggggcgtcctgcttcagaaaggggtgctgtgtgtgctcagtcgctcagttgtgtctctgtgaccctttggactgtagcccgccaggctcctctgtccatgggattctccaggcaagaatactggagcgggttgccatgaccatctccaggggatctttctgactcagggatcgaacccttatctcctgtgtcttttgcattacaggaagatttgttacctgctgagccatcagggaagccccagaaagggtacagagctttggacattatacatatgactccttgtgaaatcagagaccttgaatagtaatcatccgtaatccccatcctggttaacattattgacactaaactcacagtagaggggaaatttacaactctttgtttcagctctttttatcttgcttttatacactattcaagtgttcactaatgtttgggatatttggtaccttgtaaagatatcacagctcagtaagacaaagtgaaaaatgaggtagataatgtaacaataataaattatcttgacattcactttctttatggtccttcaagggtcattgttcccaatttataagagaactacatcatcaaaatttttcttcaattatctttttttttcttttatcccccagtatgactgcaagtagagaaacttatcggactgaatatagtgttgaaattttgctcttaggaatttcatctgtgtagcttttgatgttcttacaaagccataggatatttttaaatctcttttcaagaaagactatttattaaattaccccaccttccctcaaagacaaaagacacgcaagttgtattgaaaggactggagacaggaaggcctttctggggagaacacaatctaggagtcagagactgaggacctgaagtagagttctagcagaagacacggaaagtggggatgcgagatataggagaggaagacgtaaagcttagcaactaataacatacaagagctgagggagaaaagaagttggaagaggactcaaaaagttagttaggatgacaaggtcgcaatcttaagcaacactttaatcttcagcttctttttttctca

SEQ ID NO: 39936 - DNA, 2204 bp, Bovine  19866881417937
catcagagtcttttccaatgagtcaactcttcgcatgaggtggccaaaatattggagtttcagctttagcatcagtccttccaaagaatacccaaggttgatctcctttagaatggactggttggatctccttgcagtccaagggactctcaagactcttctccaacaccacagtttaaaagcatcaattcttcggcgctcagctttcttcacagtccaactctcacatccatacatgaccacaggaaaaaccatagccttgactagacagatctttgttggcaaagtaatgtctctgcttttgaatatgctatctaggtttacacccatcaaaatttaatttgattatggaatagtatgctttctgttattactgttttaatatatattgggctacttagtatctatacttttgattcctctttcccatcctgtatctcctaacacatgtacatatattcccaggtagtgctagtggtaaagaatcttcttgctaatgcaggtgacgcaagagatgcaagtccgatccctgggtcaggaagattccctggaaaagggaatgacaacccactccagtacttgcccagaaaatcccacggacagaggagcctggtaggctacattcaacagggtcacaaagagtcagacccgactgagcgacttcaccacctatttaggtgcagcgttcagtgcttcacacatgtagaagcgcagcttcgtgactgccacatggagatgcgtagcagacagtagccatatttattttctcttatctaatgcaataaagcgatactaaagggaaaatacacctgcgatgaagaaggaaagaggcaaagataaaggaagaaggaaaagagatctcataataagaaggaactaacacactgtaggggaaagaaaggaaacgtgtggaaaggttctctacgccagagagcaacaggctctgaagtagcaagggaccaaccagtaagtattaacagttctcagggctaacaccggagaaggcagctttcttctaaagcacttttaggtgtatttagctagaaccgtcacaatgtacctaagctttcatttccatgggatcttttcgtttacatagtacctgtgttggaatataaatagtgagaatggagaaaggttaccatgaagtcatacgtagtattgtattgactgtttttttatttcctttttagctttttgagttactgacacattattgcagcaaaacatatgtagggtcaattcatgctgaatagttattagaaaccatgataacaaaagtcattacactgcagttcagttttgacagtaaaatttctgcaacattatcacaaatcctcatgcattagtgcaatgatccttactatagtttcatattagaatcaaaagattgctgtagcatgcttgatacaaaaagtcaagcaagccaaattcttttctgcttttacagataacatttttgctctttttctatgtacatcatgcagatggtagctttgttttatatacttttctcaataacctatgagtacattgcatatatttctttaaaatgaggatttttcctagaaaaacaacacaattctgattaccagcaccataggaaataatttgaaaatgattttatatctgaaacaacttcaaaaattctgaagctatattattcactgtggtgttatcgttcccttcctcagataatgtgttagctgtgggtatagttttttttttttaatcagtgttttactgtgattagataatacaaaatttaaaaagggacatgtatattattcaggatgacttttatagaaaagctgtgagaactacccagctgacaaagggaaatattttttaacgtctacttgtttattttttaatagttacttatttttttaatttaaaattattttttaatttgaggtataattgacatgtaatatcatacacatttcaggtatacaaaataatgactcgatatctgtgtacactgcaaaatgatcaacacagtaaatctagtcactatctagcaccacggttttagtattttctgtcctgcaactgccaagtatctataatactatggactatagtcaacatgttgtacattacatcccatgattaattcgtaactggatttttgtacttcttgatgcctttcacctgctttgccaacttgccaactcccctcccctctagcaacaaacatt

SEQ ID NO: 39937 - DNA, 1473 bp, Bovine  19866881418156
gatgaaggatgaggagataaaaagaagaaagatgttctgaagttggcaaaggatgtgcagaggggataataaatctcagaaggaatgagtgaggtagagtgaggagagtgagataaaatgaagacagttatttcctcctgtgcctttcattgaccctacttagacgcctgagggggtggccacaggcaatggaattctggattactcttcacttctttagtttcttctcatcttttccattttcttgtaactcttcccatttctctctctttttttcttaagaggtccagtcaccagacatgattgttgtctatctcttgagtgataaagtgggggcaaggagtggcagtttttagccagtggtagaggggaaggaagaagaaaggaaaggaaatctcccatgggcagtttttctgggggagttaatattggtaagtgacaaatgtaaactggttctctgtaagttggggcatgacagaatataggcatttatattagagtattacaaagcagtctatcactaacgtcattaggaacaagaccccccagccttcccttgtcatgtgttaattttcatctggctttcaaaaaacaattctgcacgttctttcttagataaacctgcctgctgtgcactcttttctcttacaaaagttccactctgttcaaatcacttccagggaagaagaggttaaacaggagagttcatcgtggattatatatctaccagggcttttttgtttgtttgtttgtttttggtaacatatggaatccgtcattgcgaagagaagttagaaaagacataataaataacattttttgttcctgatccaaatctgtttctccccaaagcccagaaactgtctttctaacactgaaagatatgagccaacaaggcagatcttgggaaagactgtccctttctcttcaaagaaatattcttggagggtagcctgggctgttttcctttaagattttctagaatgaacagatgtaacaattttctataatttgccttggtgcagatgctaaaagagaacattcaccataaaatatatgcagtatatgtaatttcagctggctgttctggggttttaaagtaaaaatgtgtacctgcaagctgttttatggtttctcagtcataatgatctctgttacagagaaggctacaatgcaacccctccttcacgtgcaaggtttccaaaaatatcttgatacttttgcgtgttctgcaaggcgcagcaaggtgcagtgttctgcccatgttgggtttgggaagggtattcaaatgtttagtttttctctttgacacaattacagagtaattgcatcaacagggaagatggtggataatctgtggacgaagcccttgcaaaagatgctgtagcccgaacaggctttaagtaataaaggctgcagaggaacttcagctaaggttatcttcagcacgacggcaggatgatgtttacttat

SEQ ID NO: 39938 - DNA, 900 bp, Bovine  19866881430027
attttggagccctaaaaaataaagtatgacactgtttccgctgtttccccccccccccccccatgaagtgatgggaccggatgccatgatcttagttttctgaatgttgaggtttaagccaactttttcactctccactttcactttcatcaagaggctttttagttccttttcactttctgccataagggtggtgtcatatacacacatacaaacacatgtacacacagactctttctatggagaaccccaaacattgactaatacgacagctatctaagaaaggcaaatatggcagtttcaagtagtagcaatttttatatttgaaccttttcagaaaaatcaatcatttcatttattttatactatccaaaacaatagatgatacttggtttatcaaaaagaaagtaacaatcttttgctatacaatttcaaacattagtgaaaatctgatagaatcagaactagtatggtactgaatgcaattacgccatattttccatttattttgttgcctttcagtaaagttcagaaagaaaattatatattttctttaacagaagattatgtttcaaaaggagaaacaaataagcacattcctctttcaacatgagattaatttacaatctaattactagttatcatatataaagatctgtgagactcaactggttgactgcattaatatatttttagaacaagtcatctttaggataaaactgttgattactgctcatccctcatccattgtagtaggctaagataacttatttaagattgaattgttttggtttcatttctaatctcaaatgtttattaagaggcactgttttaagaggaaaaaattcctaatgcctcaatgcattacatgagctaatttacctacaaggtcacaatcca

SEQ ID NO: 39939 - DNA, 696 bp, Bovine  19866881580120
atctacattgtgggtgacaaggatcgagaggaagcacggggtctatttaatttagatctgtctgtcctgaaagatgtggctctgcgtgtgtgcgtgcgcatgtgtgtgtgtgtgtgtgtgtgtgtgagtgtgtggtttcatttttgatactgctaccaagacagatttaagctgtcaagaaatcttcatagaattatggcttgtcagtaaccttacatgtaaatttcatcacttgcacctcctaatttgcagattagtccacaaaccaagattatattcttgacctctaggagtaggggattcattcaattaacctgcaacagttctactctctgaacatggaactaatcccagtgccttggatccgtttagactgtcatgggtgcgatgggtcaacacagattaagtcccattcatctgcctggagtcttgactaatagcacctgttggtgagatagagaggcagccccgtctgatgaaaacccagagaccagtattctgttcctcatcctaccactaaatcgtcatgtgactctgggtgcaacacctctgctccgtcagtcatttaaagtgaaagccaacatcatgaacatgctgtagaaagtgcctacaggatctggtttctgctaatctctttagccccatgacatgtgtttctttccctcactctgagtttagccaagcaccttctttctt

SEQ ID NO: 39940 - DNA, 1318 bp, Bovine  19866881812738
aaataggattaaaaaacacaacctgtaaagccaaaaagaagcttctaactttaaatgcaagccaaaggcatcactgaggaccagcaagttaacatcctgaggaagaatgtttgctcaacaaatatttactgagtatcttctgagtgccaggagtgtgggggtaccctccccataaggagctcacagaccagcgggaagacaaacaaggacaaatttagagtccagtgaggtccagtgttataggaaacctgcctgacacacaggacgaagaaccctccccccacaccccaacaacccagctctggaaagaaatagcgttattttaaaacaaatggcattggaatgatgatggataaagggccaatcctctctcttccagaaatgccaggcacagcggtggactgggggagggccgctaacatgacctctcattcatggagacccccggggggttatgggcgcatcagtaaccttcacagtcactcccctgcagttaatcaggcatatctgaaagcctgcacatcttgaaaagcacatcattaataaatacctagaaatgaaacagctatgcttgaccttatgatgatggaatttttaaatgtaactttacttaagaaaaacagatacagttacacttcatttactctgctgccataaatacttgggaactatttaagaatttgaaaggtaacaaaataaaaataaatgtcagaatctattccctaaagcaatatacaacaggaaagctgaaactcaaaaatctgagaactacttttactttagagatgatcctaataagcagactagaaaagaagggaagagtggttacagacacagcaattgtaaggaaccatcacacctgacaggagcgagaattcaaaaagacagaaagaaacgggacataaaatgcacagtgtgaagccctctgcacagagttgattttataaagtagaacttaaaacagaaccatggtctctttcttggcctattccttttcctatttaacttctgaattccttgcaggtaactttaaacagtcctacacaggttcatctgtacttataatgacattttttttcttcacaggacacaataacggaggacggggacgatgaaggggtcaatgacttacagaggaacaagctatgttttcgatttcaattttcttactctttaaagaagttgtttgtgttttgtttgctaacatatacttaaagccctttaatgtaccattctgggaagatgagcatcttgaaaaaatatgaaaaaaaaaaatgctgttacaatgggttaagtgtaattaaaatgctgctcatgg

SEQ ID NO: 39941 - DNA, 1564 bp, Bovine  19866881817517
attgcaaacactgcaggtacattagctcgggctccttcttcagaacaggcagataaagcctctaaaacagagatgaaaaactgagcctaggagtcctccataccactaaattgtgatgttcgtgggtaaaactcgcaagagatgcattttaaacagctagaagccaatgtgactcacaggttatagtaatgagtttcaggtaataccaattttgtaggaaaagttagtcttgggaggacattgattgctctctgcagatgctatctcagttaccagattcaaaaggtaactcagcggattaaattttcaccaggctgagaccactgtcttgtcaatgacttacaggtaggcaacattatacaattaaaaaaaatttagtttatgtaacatgaatgagtagatacacatatgatagctctatggttattttaccttataacaaattgctttcttctctttgagtaatatcatttatacggccctaaactactggataaagccaacactgtaaaattcataactaaacaaaaataaaggataaccacagataaagaaaatgtagttgacatccattcaataaaatattatttggcaacaaaaagaaatgaagtactgattcatggtaccatatgggtggaccctgaaaacatgatgctaaatgaagccagccacaaaaggctatagagtgtataattccaattatacaaaatgtccaggataggcaaatccacagactgtagtacatgagtgattgccaggggctggggagaatagggaattgggaagtgattgctaatgggtatggggttcacttagggtggtgaaaatgttctaaaattaaacagcgggtaatgactgcacagtttgggggaacgttctgaaaacgaacaaattgtacattttcaaagggcaaatgttatgatatatgactatctcaataaaactgtttttttttttttaaaaagacgcaataatttatccaagtagagtaattctaaatataagaggactaaattttcaaccacgttcactggcaatttgaattttctcagagtgagctcatcttacatcctggagtctatctgtgaagactgtaaaacgtttctctttcagtagtcactttcagaaacaaaagtcttctcttacgagagagacgagtaactccaattataggcaaattcacacagtgctgctccgtgttaatgaagtacattctctatcagtctaatttattaagtgaacgagtagtcccaaggaaatcttgggtcactcaaatatttggcagtcaccaaagaatctgcaggtagctacttaattcgcaatcaactacatcatcaaaagctacatacatctgttgctttgcaatcagtagcaactgttaatcaaagaaaacagaaaatgtaaatacgaatactgaccttgtttcttttaacccttctttctgaatgacttccaatatctgctttgctgtcattggtgagttgggatgtttttctagtgcctaaaaaataaagacagacataagacttctagattactgcatagaaacatacaagagcaaatg

SEQ ID NO: 39942 - DNA, 1540 bp, Bovine  19866881901664
tgtatgtacatttatctcctatagtctaaactcaaatctcattccatgtaaaacgtatgtggttaaaatgtgagtaacagcatgaaagagggagaaacaggtcagagataatgagaaggaaaagagaacaaataaaaagggaaatgcattgtttaagccatttagagtaagtaatactttatttctgatttttcatcaaaaacacaaagcagtttctgactatgagcataattgtatatgcctctttatttgtaataactttattttggcatttggaattgaatcacccattaagatattattttagctgctgaatttattaaatcatttgaaacaaatcatgtaaggagataggcatgcttcctaagaaatctgttctgagtaagacaagtgtacttcattttaacaaggcattcacaagtccattgctggattccaaaacagttcaatcctgttgcattcacacaactagtctgtaaatgtaccaatttagttctaacatatcaagcatgaatttgagtttgaaaagtgtcccttgagtttcacaggtgtccattttgttttgactatgataaaaggtggcatttgggccgttgtggataagccttgtactgtatctcaaaaatgttcacaattttctcttgttctggttcaatgttggcatccagatccccatctttcacctttaacacattcattttactatcacagcatgcagaatagtgtatttcatagactatatttcagaaaacacataggtgttttctgtttcacccaggctctgcatgtcctacccaacatgtcatagcattagaccaacttgtgactttcagaaactgagagcttttgaggaaaagcaaacaagggagcttaggagcagactcatcaccaacagtcaacagtggccctcatctctgagactgcaagttgggtacatggggagtatttaagagaaaagagaacctcttcctaaccagccaaatcagccaaataagtgctgatgatttggctggagtgagagatcacatccaaactggcctcatgtctggtcaagagttatactggtatttctggaatgttcaacagggaagaaaagagcagaaaggagcaaaaaatggcacttgaggaaccatacaatttattactgagactggagcaattctgatcacaaaagagggtaatatttaaaattacactggcccaacaagcataatccaggactgtcctgggaatgctggaatgcacgttaccccctgatagcagtaactcagttacttccttcaaaaaggtttatatcttaatatgggaagtctgacaaataaatgcacaatctgtacaaattcataagccatgagaaatgtgagttcaggaatatattggggaacaggaaggtcaatgtgattaataatattggaggaaatacttccagttgcctatagttgaataatgaattgctttagaatcagaaactcttatcagctcaaatgaagatactctgggaagcaagagaaaataaataatgttcttactgttcccctca

SEQ ID NO: 39943 - DNA, 3445 bp, Bovine  19866880408065
cgaaatgctaaacaggtgaataaggcagtatgattttggaatggaattccttctcttggatataaatctgtttatttatttttctccagtactctttggacaatgttcacttgaatcagcctttctaaatctgtcaaatactaatatgcttctaggaaaacctccacacctggtaacatctcactacagtagcagatctgaaaatataagggatatttagcccattgtctgggtttctgggtatccagtattgatgcaggtatttatttgtatccaaatgtttggaggattttaagagaatgaaaatggcagagaatgtgaactagtttttgtcacttttttaaacttcatcataagtttaattcagttcacttcagtcactcagtcatgtgtaactctttgcaaccccatggactgcacacaccaggcctccctgtccatcaccaactcccggagtttactcaaactcatgtccattgagtcagtgatgccatcaaacatctcatcctctgtcatccctttctcctcccaccttcaatcttttccagcatcagggtcttttccagtgagtcagttcttcccatcaggtggccaaagcattggagtttcagcttcaacatcagtccttccaatgaacactaaggactgatctcctttaggatggactggtttgatttccttgcagtccaggggactctcaagagtcttctccaacaccacagttcaaaaacatcaattctttggtgctcagatttctttatagtccaactctcacatccatacatgacactggaaaaaccatagccttgagtagatgacctttgtcagtaagcaatgtctctgttttttaatatgctgtctgctgcagctgctaagttgcttcagtcgtgtcaaactctgtgtgaccccatagatggcagcccaccaggctcctgcatccctgggattctccaggcaagagcactggagtatgttccaattttcttctccaatgcatcaaagtgaaaagtgaaagtgaagtcgttcaatggtgtccgactctgtgcgacaccatgaactgtagcctaccaggctcctccacccatgggattctccaggcaaaaatactggagtgagttgccatttccttctccaatatgctgtctaggttggtcataaatttcctttcaaagagtaagtgtctcttaattccatggctgcagtcaccatttgcagtgattttggagcctcccaaaataaaatctgccactgtttctactgtttcctcatgtatttgccatgaagtgatggtaccggatgccatgttcttcattttctgaatgttgagttttaagccaattttttcacgatcctctttcactttcgtcaagaggctctttagttcttcttcactttctgccataaggggtggtgtcatctgcatatctgaggttattgatatttctctcagcaatcttgattccagcttgtgcttcatccagcccagcatttctcatgatgtactatgcatataagtaaaataaggaggttaacgatatacagctcttgacgtactccgttcctaatttggaaccagtgtgttgttccatgtccaggcctacctgttgcttcctgacctgcatacagatttctcaagaggaacgtcaggtggtctggtattcccatctctttcagaattttccacactttattgtaatccacacagtcaaaggctttggcatagtcaataaagcagaagttaatatttttctggaactctcttgcttttttaatgatccagcagatgttggcaatttgatctatggttcctcttccttttctaaatccagcttgaacctctggaatttcatggttcacatatttttgaagcttggcttgaagaattttgagcattaatttactagcatgtgagatgagtgcaattgtgtggtagtttgagcattctttggcattgcctttcttagggattggaatgaaaactgacctttttcagtcattaaaagataattaaattctggggatttgaagcttcttatttctcttattttaacattttatttaatatgtatgtatataatatatgcttatatagagatttaacaatttagtataatgtacagaaattcaaagttttgacatatattttaatgtgatatttattaaggctattaaatatcgtgccatatgttgcattccaatgtttcaatttaatttttgattttaaaatattttctttacttttatcttaactttctccatcttcatctatttccaatattactgcaacaagaaaaagacattaatagtagtgtcacctagaaagcccctaagaaagaatttaggttataattgtttccagttatcaaaattaatgcctaaacaaccatagctcaatgagacactgacaatgaataatataaataagtaagccaggaacactatttctgttagagataaataaaaactaacagatacattcaggaaaacttgttgatttactggatatgttgaataatggaaagagaagaattaaggataatatagatttattagacttagaacaaatggatcattaatggtgcaacttactgagctaaagaagcctggaaacattcaaatttggtggtatggagaggataaagagagccagtcatgttaaggtctggtaattactagtaaatcagacaaaaagatgcctgcatctgcaagccatagatcacagatccaaactagatagcaaagatatgtacaggagattgatggtgcctcaaagagaaaagctttcaaacataaagactcagtattagacagactggcagagagtaacatctatgaatctgaaactgggagctaaataatagtttctatgtgcatgcaacttggctcactctcgtcaggttatctgaaatccaacttcctagaagttggaaactgtgtctatagtctccaccattagattccaaggacctagtagattctgatcaataaatatttagaaatgtatgttgaccaagcagttaccaagcatgttcagaggtagttaaattcaatgaggaaaaaaaaatgctaaaaaaataaggtaattttactaaaacttaggctatttttataaaagtaccatgtaatatgcaaaaatatcttattctttcttaacatatgataggttgtcagaatcaactttgttctagccttttttcagtcctaccctacacttgactcttttcaaatacctacaaaacatattcaaaagcagctgtcagatattttagactgaatacaaaaaataaaattgaatacaagagactatattaccttaaaattttaagccataaaatttttcagaattatggtaattgaaacacttgcacaggtttaacaatgcagcataagaaatacaacagcttttatctctttaagcttattatcataatcattgaaatgaatg

SEQ ID NO: 39944 - DNA, 1898 bp, Bovine  19866880830864
aaaaataaaaagccacatttcatcttcatcttaaaagaacaataaattcaaacataaagtataattccattgaatattcaaccccactcatactactggactaaatctggccatgccaccaaaatatttaaataggtttattgactggaaaattaaaaatttcatcatagcctgaaatagttatttgttatgattttatcaacataagcaccaacagagctaataagcttattttctggccagtcctcagttgaagctaaagcatatcaatcacatactgtttgatactattatcaagcagtatttatagtaaggcatattgacttaaatgtcaatattatgatacatgtagacactgatcttacttatcatgttatcttggtataaaaggggatcattttgctaaaatatctctgttgtgatgtttgacatggataacaacgttggacacaaaattttattttgttgcagttttctttagaaaaaaaccttttgtcatgatgttataatgaattcagaggaaatagctgttttatagtacagagaaaaatgactccatctaaatattgccctttctaaattccaaattcacttgaaaagttatttgattccattttaaacagccactttttggtcattttaaagcttgattgaaaacaaagattaagtgaaaaaatagaatttacttaataaattatgtttaaaattattatttgcagtttcactattaaagacaataatgaggactggatactggcaaattttgaagtcacatgataaggttatcaccttcatagacttgcagctttaaaacaggcttccctagtaagtcagacagtaaagaatctgcttacaatgagggatacctgggtttgatccctgggttgggaaaatcccctggaagagggcgtgacaacctattccagtattcttgcctggagaatccccatggacagaggagcctggagggctagagttcctgggatctcaaagtgtcagatgtgactcaccatagcacagcacaactttagaataaacatattaacaggcaacagttatagagacttcttttagtaatcacagttttacgctttctccaagatgccaaattaccagtaagagctgccttggggctctttagcaagaactgctaacataaagataggtgactggatggttaatgatttatagatattcccacatcatcattgtgcagaaccctgtgggagaggaaaattataaaatatagatcttattctttagaagttcaatacacagtttgtgagacagggcacatatcaaaatgaagatgtagcagagtcaaacccaagtgaagagatatactgagtttgatgagttgtatcaaaataacagattgattagaagccagatataagaagaaaggaaattcaaatatcttatgaaaagaggatattaaaagattttttttttttagaattggcagtttccaaaccattgtttaatggttgataaaaatcttatttgcaaaagcaaaatttctgaaaatatctttgattctactttctcattcttcaccatatcgtgtttccattcctttttatttttcaaatggaaactgtctcagtcatacatcagagtatatttatgtaactcagatgaacatattaactaagatttcaaagagcatgggaatcctaccccaaaattcaagattaacaaggaaccatactatgtcattgatcagtcgctaagtcatatctgactctttgagaccccatggactgcagcatgccaggcttccgtgtccttcactatctatctcctggagtttgtccaaacttatgtcttttgagtcagtgatgccttctaaccatctcatcctctgccaccccctcctcctcttaacctcaatcctt

SEQ ID NO: 39945 - DNA, 1763 bp, Bovine  19866881014303
ttttctaacatgtacctgccccagtgcatgccacttgttaagacaaagtctacatgcctgatagagaaaattcaactcactaagtgcaaacaatgaaggattacggtagcctagcaatgaatccaaggaaaagagagaccaaatgagtccatctaaagtgagagcaacttttaaaggatcctgcactgaagaaatgctatttcataagtttgctgtaacaagtgggttaccctaaaaatatttagtgcaagcatatatccccagagcagaataatatattgaattctactttaacaggagaaataagagagaaaaaaatctgttgtctacttcctttattatgtgcaataataatcatcatttaaaggttttgctgcaaaatacttgtgtaagattgtgtgattgacaaataagaatgcaaaataatgagaagaaattttatttcaaacactctagataacatgttctaaaaatgataattaaaattggaacaggtgttttttccccaagcaaaatatttgaaactatatttgaagataatatattaagagaggggaatatctactgaggaatgctgacccagtttgtttttaataacagagcagaattgtcgcttctgctgtttaaaatcaaaccaagtgtttcacttcaaaatatgcagatttcccccttctttctgtcatcttttgacaaccatcccacacattcacctcctaccttttgttctcattctttagttctttttccccctgatcttttccttctttatgtcactatataaatcatttgtatttatcatgtgtgggtatcctctgcttctttctccattatcacccttttagtttgtcttcaattctgctgctcacttacatttatttttgttaaataacacatttaggtagtctaactttagttgtagcagaatatatcttttcagttactatataatagatatttctagaaagtttgatgaggaatgttctcacttaagactaattgaaactcaccttggtagacaaactgatttgttttcatggataccagtgactgaacaacaaaagaatgttagttgagcatgttaaagccattcttactgctaagaatccatttagatacttgatatctttgataagatattgcttatatagtctgggcatctgttatactctcaggactcaaaacgaacctatggtgacacacttgttcatctgttctgataacaccaactccaaaataaaggtaattataagccgactgaagatcagccataagcagagcaattacacaggtttgtcagagtggacttgtcaagcaatgaggctatgacaggattataagtcaagcacatattagtggtggcaggagtcaggccagtatagcagcattattctgggagtagctttgggcactgtctgatggcttgtccataaatcctggagctaaaatcccagtcccatccaggtataaattactttacattctatctaattgggaaattttattctaacaccatctcttttcatttcatgcaaacatttcatccaaagatgaaatgttttcatttcatgcaaggaacatttcatgcaaagatgggcacaattaaggacaaaaattgtatggacctaaaagaagcagaagatgttaagaagaggtggcaagaatacacagaagaactatacagaaaaagatcttcatgacccagataaccataattgtgtgttcactcacctagaacaagacatcctggaatgagaaggcaactg

SEQ ID NO: 39946 - DNA, 1065 bp, Bovine  19866881079474
taatgtgtagtaatatgcttccgctttagcatcattccttccaaagaacaccccaggactgatctcctttagaatggactggctgactcattggaaaagactctgatgctgggagggattgggggcaggaggagaaagggataaaagaggatgagacagctggatggcatcactgacttgatggacgtgagtttgagtgaactctgggagttggtaatggacagggaggcctggcgtgctgcagttcatggggtcgcaaggagtcggacacgactgggcgactgaactgaactgaactgaaaatgcttcagaataattataataaacttcaaagtacttgtttttagtcactttggtagaaggaagtgccataagatgctgagagaataccatggggagtagatggtattaattatattgtacacttgctataaactaatatgaggcaaatttgacaaaatgttaatactatctatatctagatatttcatatgttagttattgtcttttggtttgtgtacttttttataatttgtaaaataaatacattaaaaatactacttacaacccaggtgagttatgtctataaaaaaaaaaaaagatttttcaataaatattttatatttattctgtttcagctattttaaaaaaatgtaccttgataaatttttcttataaactttccctggttttctgtctctgaataataagagaaattttgtatgaataccctgaagaaatcttgaattttcttctgtaactagaattccttttattttgaattccccagatactttcccctgctctttattttgtgtttcctgtgtactagtcatttttacagaggcagtattcattacattgatccctgaccatgtttcagctcagctttttaaagcagtttatgtttgcatgcaggcaaacagcagaaagaaattcccctgggctctcccttacagttcaagaaaataaaaaatttccactttttaataaatacttttattagaatcatgcaaagagggagtagatttttttttttaactccaaagggcaggaaataaggca

SEQ ID NO: 39947 - DNA, 1461 bp, Bovine  19866881093549
aattaagtatctacaataaaattaaaatcctttatataatattttcaataatgtgaaatatattttaaaataaagcattttaaaagatttaagtatcacaaaactctcatattaataaacatcaccttttgaattttgtactgatcttgtcactgtatttttaagataaaagtataagaactgtcatattggatttttcaaggaacatattccatctatcagaaggcatttcctgagatagtttggacagtgccatacgaaatatctactctctcttctaagataatacttatttttagtttgcttccaaaagaatttcagttggctaccattcgaattgcaattaaaagaaaatctagatttatatctgacatagacaaaaaaacaagttttaagggacaaattattttagtgaagtttagttttattgggcaattcgtagataatcttttaatctctggaagctaactaattagaatttttcttatttttaactttacaaaataagaaaaacatttttaatccacttgacaaaattttatattttgcaaatattaattatgtagaatataactgtaaatctgtggagctaatatatattttcagaatttactttctgataaaatgtgtcagtttatgatttttatcaatttaatagataatttttgcaatctacctgttttttttattgtgagaattctatattgaaacaagctttaaaatatttataaaccagttgtatacctggagaattatatcatacgtttgcttaactcacaagtctaaagtttaataatagaaaattttttccaagcataaagcctgcagattcttttcacaaagtgttggttccaagtttaactgttagctattggctacccactccaataattcttgcctggcaaattccatggacagaggagccattgggctacagtctatggtgtcacaaagaatcagacacgactgagcgactaacacacagacacatgattaaagagagaggttatttcattaatgttaacttgaatattttgtcctttgagacagacttatttctttgtgaggtgattaaggtgagaaatttatgtgcatcagtgatgccatgaactactaagatgggccttctcttttagttagcagtgactaactaaagtaactaaactaactaaagacaagtaactctgatccatctggcaattcatgagtagtgaactgaatttaaaaagaaaactgttagtataccattgacagcaccttgcagcatctagtcactttaatatgagtcttgtatggacagtcactttctatcctccgtcctctcctaaagaactaaattgagtctctgaggcactgaaaagatttccattggaatgaacctttttactagatggaatggaatccagtttaggtggacaaaggctataaattttactagatgctcctaaaaacttacataca

SEQ ID NO: 39948 - DNA, 785 bp, Bovine  19866881106160
caataaacacaaaaacccaccaagaatctgcactcagctctctgtactgatttatcttagtccttccagaggaaaaaagtaacacattacctatgaaaagtgatactgaaactgacataaccaataatactgaataacagaaagtcaaaaaacaaaacctaaaaacttactaattcaaatttctaagggatgattatttgaacccagaattttatatactcaggcaaatgtaaagagaaaaaaaagtacttttaaacatgccagagcaaaaaaaaaaaaaaattgtcatctgattatcataaatatgatcttttgtcaggataagccacagtaaaagaaaaagaaatacctaagaaaggacaacatgaaccaaacgaatcagcagcaattgagtattactcaaaaagaactcgaagaaagcttacaagaagttaaaaggagggctttgaaacttgaaggcagagatggtttctttcaagcagcaggatttagtaacaaaggattatgttcccttctttatgtgttcaggcaagacttggttctgtaaaaagtactgacttaatcataataatgtatacattcatgtggggcataaagtgattcaacagaaaaacagtgcactgaagacttaattacagttgtagaaacagtaaattttatggtattctttaatagttttgaattgtttaacttgaaaaaacacggaagtaaggaaaaagttaaagtgcaggcagactaaattctttatcttttacatcaatggggcaatatacaatgcctaaagt

SEQ ID NO: 39949 - DNA, 1438 bp, Bovine  19866881144823
tcatatctatttcctgcaattcttttacatggctttggagaaactttaaattaacaaataatctcttattcctcttgaatattcaaaatctctctcaatggcatctttctcattagttcttatgcacaactaattctgtcctgaattgaataaaatatttatctttatccaacctctaacgcaatctaccaccttatttcttgctttctattcaaaacattttcctacagttgtctcaaagaggtataacttgttcatccactagttcagatttagaaaatgacatattctttatttttagaactgacttctaatttctgactctgagcccccagtctgtctaatgacagataacttaactgctttcagttaaatttagtccaatccaatgattaattaatcaatttgaaatgtataaatttgttacaatctagttaaacttttccatttttattctctccctcaggttccaggttttatattcagaagtgagggaagtggatgggaagggaagtaacacactcactgttgacagcagcacaatgtctgagtaatgcttggcccgttttatacagtacaatctattatctcctcttccaaaaattagaagaagctctctaagacttctgtagagtatcaagtaagagtctcacgtagtcttctggtcaaggtcatctcacaggctactccctgtccatgacagctaaccctattacatggtcttttaatcaagaagaactcttgagcccatggagacttctcacttgctcccctggcaccaggatgttctataactaaacaccaagatatggtttttccactaattatgtacagatctgagagctggaccataaagaaggttgagcattgaagaattgatgcttttgaattgtggtgctagaggaagattcttgagagtcccttagtaaggagatcaaaccagtcagtcctaaagagaatcaatactgaatattcattggaaggaccgatgctgaagctgaagctccaatacttaggccacctgatgcaatgagctgacttattggaaaataccctgttgctgggaaagattgagggaaggagaaggggacagcagaaaatgaaatggttagatagcatcatcaattgaatatacatgagtttgagcaaactctgggagatagtggagggcagagaagcctggcatgctgcagtccatggggttgcgaggagtcggacattcagatgaagaaatcaagtaggtaattggattgttcttgcctacagatatatttttgaaagctgtaagcatatacatgttatttagagccaagaaattgggcaagataacaaagaaattgtggggagaaggacaagaggtctaatgacttattcccagggtagtacaggagctgaaagacctaagatataatatagcaaagaataccaggagtagcaa

SEQ ID NO: 39950 - DNA, 1512 bp, Bovine  19866881220474
ctatcaagactctgtgatatgctcaatgagagcttaagtcttttgaaattgccattcttaatatttaaaaattatcctgaagttatccattataccattatatagaataaatataggttgtggtttccatttatttggcatcacaggataccataaatagtgagtttttataaaaaagaactatactgtccagcacacaaacaaagaactaactaaatatcatctttgccccaaaagaatcacgctgtgcagagtttcccctgcttttctaagatgttagtttctgagaggtaataaatggtctcaaatgttttaatcaaattatttctttaaactataatacaatgtactggttcactgtcttgtatgacagtaagaaacactactaattcttaatttgcatctcattagaggcaccaaattattgggaaaaactgtgtgtgtatgtaaggtgaaatatgtactatatgctaagaaaagtaacttagataagaagttttgcttcttctgtacatgtcttattatcaagtctatttcccttaaaatattatactttacatttgcaaaggctacttatagggcattaaattacagaggtactataatagtctgaaatgtaaacttgcacttgtataatttttcattttttactgcacagaataaaaatacctggttggtataattgaatagcagtttcgtttggttttaacagttcactataggattccagatatatttacactttattttgactttaaaaatctgacatctcaaacaatgttttgatatgtcagtattccctaacactatttctttttctccttccatatgtattcttaaagatcatttcaaataaaagttctccaaattttcaattaaaaaataacttctacttataacaagggctatgagatggtgtttacatcgcttcttcaatcaaatgttttgaatttcaataagaaatagaatggctttctattaacacaacttgattaataatgtaaaattaatttttagaaaggaaaattgcagcaatttggttttttattgaaatgtgcattaaaaaggtgtttgcctaaatctcaaattcaatttactgttcacaggccacagaaagttatgaaaatgtgattgtcttaatctgggtacagaaataaatagatttgtgccctttattcatttcctttatttgtgatcatgttttaagaaaacagtcactgcacactcaccatacggtttcctttcttagctcggccagcttgtgcaggcgttggagtgccttttcctgttttctttcatctttcctggatttagatgctacatttcgagcaaattccctttgtttcagttctttgagcctctattaaaaaatatgaaaatgattaatagcatttgagtctatagtaatgtcaaagtcattattattgttattgaaattttctaatgcatcatctttgatctcatctaaggaaagtacagcatttgtgacaatctacttctaacaaaatatgt

SEQ ID NO: 39951 - DNA, 894 bp, Bovine  19866881227525
cgcaaggagtcggacacgactaagcgactttccacctatttgagaaattctcttagcatttatggatctcagatactttcattcataaaaaacacatgttgaaaaattccactttcaagctagcttcagttcagttcagttcagtctctcagtcatgtccgactctttgcgacgccatgaactgcagcacaccaggcccccctgtccatcaccaactcccggagtccacccaaacccatgtccatccagttgatgatgccatccaaccatctaatcctctgtcctccctttctcctcctgccctcaatctttcccagcatcagggtcttttccaatgagtcatctcttagcatcaggtggccaaagtatttaaaaatgttcagtaaagtcattggtgttttcatacaaatatgtactcaatatgtagtctttctgttctttacagtactcataattcacaaaaataaggcaaaaaaaaatcaacattattatatatattttgaaattgtcttgcaatcatttgtcttgtgtgagcaaattctatttataaaaagatgtttatactaatatgttaataaatgaaagcttttcaaaaaagattatgtaggtatagaatgtgagattagctgaatacttgtcatattattctgtttattatgaaggatatcgttcatttctttactactcctgatttgacaaatccattgacgccaaggtacagactttcaagaaagataacaaccttggcattgttggcctgaaattctactctcaaacatacatactggatgctcatctatggtcttctggatgcccacacatgaataccatttgttaagtgataacatattaaataaaattaatttatatttggcaattacacagcaccaggac

SEQ ID NO: 39952 - DNA, 1493 bp, Bovine  19866881230407
gacggggtagccgttcccttctccggggatcttcccaacacaaggatcgaaccctgatctcccacattgcaggcggattctttactagctgagccacaagggaattttaccatataagagtacaaaaatatacaaaaaccctatacaactatctttactatcattcaattaaaggaatttaattgaattcagagtttaaaatttaaatacagcaaaatataatctcagattaaaagacaatcattaaaattgagaacattgtattttctcattttatcacaggatgctaaaaaattcccccactgacattatcgacctgtatcagtgaattcttccttatgaaactaataaccactctctctcttcctttctatcagataagcctgctcattcccctcaagaatatgtcacatctgtttttttcctttgaaaatgcaaataatttttctctaatttgaaaaaataagaaataaggtgaatggtccttaatacttggaggagggtaggatatataacagtaatacttaattggggacatcttaatacttcaggatgtgtataattcaagagaatctacttctgaaaaaaaatagatatatgtacgcaaaatattacctataatttcaggggcttcaaagaacctctagagcccagagaccctgggaccagaaatcttgtttaaatgtggctgacaaatgtttaattatcttctagtcaaatacattcaactggcttccttctgcctcacaacagcagtgatgagaaaatgtgtgggcttctctgaggtctccactgacacagatcctgagttctgccacgtccaaatacaccagccaggttaagctcataataccacagtataagacagagggaatgagcaacaggcctggataggttttgcagaggacattacaatgaagagactttaaaacatttaaatttcaaacaaatattagtctaaggcatacagaggctttacatgcgagtgaacagagctttgctttctgtgagaaagactctggtaggtatttgctatttaaatcttttcaggtaattagtccctgtggtgccttccatttcaggctccatctgttcatgctaatgagatgtcacttggtgtcaggaattcccatcctccagcattaggcagttaaccaataatggggtgcttgtgaagctgcacacataaagagaggtgatgaacaacttaaacttaattatctctgcttttatccacaaaaaagggcaaaggatatttatagtattagtgttagtagaaagtcccctctctgatgaagaaatttcaaaaagaagaaaagggaaaagtttaacatttcagacataatcatagacaagttatttctttaaatatacaacctgatttctgaaaatatcagaatctacagaaaggatcaaatgtctatcaagcatcaccttttatctctcacatttacagtatttacatgaaagtactagttggtcatcatagagag

SEQ ID NO: 39953 - DNA, 726 bp, Bovine  19866882113135
ataaaaaaaaggctattggatagacatctaggaggtatcctataataatttttgtttcatgcaaccttttggcattatgtgaaatatggttttatcactataatttgttttaaaattggctcaagaatgaatatattttgccccttgcttgataactttgtagggtcacaacatctataatgttctttactttaatttccccatctatttttgccaccagagagagaacagtgcttttgttgacacacaggtgtacctgattttcaatcatattatttctgcaggatctcagttgggggtaccagggatttatggcaaagacagaaattattattaaatccattccacttttctaggagtatcatgagactacagataaaaagagtaaaagctacattgtttttcttataaacaataatttttctaactgactatgaccaatgctattattgcgactcattcataatctattttatgcccagactgtcagggtacaaaattgcttcaggtcaaagttagtaagttagaattgtggaatacatatttatatttcagatgaactgaatcactgttaaattctatatttataaattataaatggcaacaaaaaaaatcacttaatatttactgtagacaagtaatcattgtacaaagcatctaaggtagcccatatcttgaatctggagggtatcagaatgtaatatgtattatgtgctagctgttatt

SEQ ID NO: 39954 - DNA, 812 bp, Bovine  19866881284187
cattccagtcaattcggtgagtattacaacttttttaccctatatttcatgtctcaacctttattccatagtgtttgtctctctgggttatagttttaatctatctttcagttcactgattcccttctccagcagtgttgaatcttctgtttaattgttcattgagttttaacttatatttgtcactgaagttctatttgttctttttccaaatatgcttgatcatttgttaaattctctttttcctcactcacaattttcaagcttctttttaaaaaatatcttgaagcatattaaacacacattttatgttccatgtcagggaatgctaatgtcaaatatctccatgtagtgattctgtatctattgtttttgctggctttcactcacagtactctgtttccttgtatgtcttacaatttttggtgatagcttcatgttccttgaaacttcatctgaggaaattatgaagtctcaggtgaaattacattcttccagagaaaatttgtgttggtatctgccaggtacttgggagctatacccagtcaatgccatttgaaattaaaatttctgtctacagatttggaccacagactcaaaagaatggttatgaatcacaggggagaatttattacctcttctcaacatcaagttaagacttataagcctccttacttttattttctgcattgtgggtttattttattttcaatttttaaaaaattttaaaattattttatatttatagaaaagtttaaaaaacaatatagagagttcttgtatgctctgtacccatttccctttattgttaa

SEQ ID NO: 39955 - DNA, 1167 bp, Bovine  19866881383802
tattagggggggaaaaaaaaagcccttcttaattgttctctattttttttattaactaaatccagaactcctgtcccttcaccaaaaaagtgtagaatcggggacatctgtttgcctctccattgacattgctgatcttgacattgattgaaattagtgagaaacttcctctttaagctattgtcccataataaggtaaaaatgatactgatttcctaaacatgttgggaatatctctttgataattgtgcatccttgataagcattactcactcctctacctttctagaagaatctttctgtgtttctgacaactttgaggagtgccactacattgtctaggggttgaggagaaccaggatgagaatgaaagaagaagaatgggagaaggggaaacctacttattttctttccaacaatattggaaacatttcagagttagttgtcattcacaaacactctcagatactagttcctttgatcctcagcccatgaggaaaaatgatcagtttaatcccaaagcatttgctgaacatatactattagaagtcagaaaattaaaagctcagaaaacatgaaaacatataagacatagaataagactcataaagagtccacagtcccagtaggaaagacagataataataggaaacaataggatcccacgagagacacaaaagtgtcaagtatgtagaaggtttagaaccagaatgaagactcaccccctctggtataaggcagagagtccacaaaggatgggtaagattttgaaaacagatattagaagaaattccagcagaggatacatagggtgccaaggcatgtagcagcatggtgtatttacaggattataaagagtcatcttgctggaagaaaaagatatggggaagtgctttaacatgggtagggggtcaagtggttttcaggagaggtagacagaagctgaacacaattccatgaaatacctggcaggacacgctacagagccttggtctgtatcctgaaagtcaaaagaaagacaataagagatcctgaaaaaagaaaacaactttacatttgtaggttctgggaaaaaaatatgagtttggtttgggacatattaaattaaagttcctatctgtatttatataaatttagttaatttagataggaacttatataaacaca

SEQ ID NO: 39956 - DNA, 2467 bp, Bovine  19866880380190
ttgggctgtgctagtcttattgttgtgcacgagctctcactagtttgctaagtgggagctacttttccacgtggtgctcaggtttctcactgtggtggcttctcttgttgcagcgcatgggctctaggcatgtgggctcagcagttgtggctcccacagctgtggcacgtgggcttagttgcccaacagcatgtggaatcttagctccctgaacagggatcgaacatgtatcccctgtattgtcagacagattcttaaccactggaccactggggaagtccctcacatttcattttatactagctttgttactaggaaaaaatattctttcatcctagaaatggtgaaattgagacacatgaagattcagtggattacctggggtcccatggcagatgatgggagaggtggtactacataaacctcctaactctcaatccaggcttttcctatcactaagttgtctttaaatggttccgcagaaagaaaaataaacatggtggcaaagaggagctgtacatggtagaaactacaagtcttggagccaaataagcctggtcttaaactgtggcatcactgcttacagtcctatgtctgctgttgctgctgctgctgctgctgctaagtcacttcagtcgtgtccgactctgtgtgaccccatggacggcagcccaccaggctccccccgtccctgggattctccaggcaagaacactggagtgggttgccatttccttctccaatgcatgaaagtgaaaagtcaaagtgaagtcgctcagttgtgtctgactcttagcgaccccatggacttcagcctaccaggcccctccgtccatgggattttccaggcaagagtactggagtggggtgccattgccttctgcaattgctaaattacttgatatctctgagtttcagttttttatccagatagatacaatgaagatttttttgtggagtacttgcaaagaattggatgtagagcattgaattatacctgacacacagttggaacttgatgaagaagagctactatttctagtgacaattactactccttaattataatacaaattataattatgtgtttgttttttttttctaactgttccttcttcacctgcatacaggtttctcaggaggcaggtaaggtgatctggtattcccatctctttatgaattttctacagtttgttgtgatccacacagtcaaaggctttagtgtagtcaatgaagcagaagtagatgtgtttatatatattatatatatatataatataaaatataaaattatatatatatttatataattatgtgtttataattatttacctttcattcagtgaaaaacattatgtttatgatacatcagttcttgctctgggctgcagggccacaaagccaaccaagacacacacctgatgttggagtctctccatcagtagttctcagccattttgtatcatatgcaataatgttacagtaaatgcacatttactagttttcactaatttttaagatttgtaaatatagcttgccctattttcttcttatagataagaaagccagaactgcctagctctgctagcattgagaccactgcttatagctccccagaagtatgtgaccccaggcttgtggatctctgagacatgcagaccaaaaggaagtgggactcagggtacacgtactgggctctccatggcccttttctgactccccagattatcactgcatcagtatatcagcagcatcttatggatgtaaaatgattttagctttttaaaactcctgtcatatatttttccataatcatatcacttatgcatgtcatattttattttagagtcagaatataactctcagataaaacacacctttttcctaagagaatgaaaaatgatggaaagaaatcatgtcccctgtctttcctgggaagttgtaaagcaactggttgaattcactcttaaaacccttatgaatattcagagtaggatctttatgcatctcatggttcctagctattaaatacaaccatattgatgaataattagattagaaatacaccctatttgccattcatctcaagctcaacccaaactgaagccctcatctcaccgattgaaagagattttcagccagggcacaaaatagattaaagtcaggaactcatttatttattcactcaacagtttgttttgaagtatttacagtgtgccagataaggaagataaaacgttgagcagaacaaacactgccatcctcatagtccaatgagagacaaaaatagaaataaccacacaaataagaatgataactttgatgaaatctgtgagcaccacatggctctatggaaagcctgtaataggtaaatttgatctgggcaaggtgtcaagaaacactctcaggagccatgatgtttgagcttcaatctgatgtcaaaagcaggagtgaactagccaaaaag

SEQ ID NO: 39957 - DNA, 1589 bp, Bovine  19866880414998
cagaattttccaaaaaaaaatttttttccaattttccatcctgctgtactctctattatatcattcaattacaacgttttaatcctgttttttgttttcaaagaaacttgctactaagctggatgaaaagtatataaacttagcttgatagatagcactgaattggtttcttaaaacaatgaccatcctaaatttatcaacatgaagaacaattagggagtctgtcttttggaatgtaaatcaaccttttgaacaaaaccaaaagaactgaacccttattttcattttttaagcattctccaacttctgggatcttcaagtaaaatcttatctccaagatgacttaatatttgggtaaggcatcagcggaaaagtttcacagtctatttcaaagaaaaaatttgcatatgtgagtcagacatccgcagcattttgaaatacactggcaaataagaattacacacactgtgccaatgagttctcacatcatctaaatattgcacatagagccttcattggtgatatgcttttaaagttcagaattatgtttcagcacgtgcttgcatgaatattctataatatgcccaatctcaataagcttgtcagcctttatccaaaggcattccaggatctaattgttctcactaattcaggtgctgaggtcttttgaagagtgtgaaacaagtttaactcacttaaaataatctgttaggattgcctcagtgttaaataattacactatcatgtggtgatgatggaagacagttgtttgggtgccaggggcccgaaggctgaaagacaagcagagtgtgaaacgtgaccttcaacactaacattaaccccaagtaaaggcaactcagtgctcaaatatgtatcaaagctctaaatatttttacatctggattcttagaacaaaagttggtctatttgatctctttggtttagtatctttcattatcaactgcacagaccatctaaaggaagtgcagattctgactccaccatagtgttttaaagttgtgtcaaaatttccatgctaaagctttattttcagaagttgatgtgccgagagatgttttcagcaaattgaaactacctcaaagaagattaccgaaaggaaactataaaaacaaacaaaaaaaatcattgtagaatgagccatacctgtaaaagtggttatcataacagtctatttaatgtaacaaaaacaagtttcataaataaaaagaactcaaactttcagaattctcaatcatatccctgcattacttattgccatatctcatgatttgcattggatacattgactgtaagttatgctgcacttttaggaattgaataaaaattaagatactcttttttcagaaaggaattcttaaataatattgatatgtcttaaatgacttttcaggtgaaaagcataacacaacaaaagttgtcacttcatattaccaactcttttaaaaccatatagaatacaaaggaaatggaaaactttaaaaaatgtgaccatgatcaggttatcttaaatgtctcagctcctcatttttcctactgtaaaacttctgctgacttactcactcctgcat

SEQ ID NO: 39958 - DNA, 1543 bp, Bovine  19866880478514
tgcccagaaatttgggcactatcagagatgcctgttgcaataatgaccccttcctggccatagattctaatctcaagtgtctgtaacataatctgaacatagatcaaaagacttctgggtgaagttttcatagggtaattttcttttcccggcaatgatcaaaactttccaattgtacctaactagagaatatgatttttgagtgatcaaggtttaagtaagttttaagattattactaacaaaacacatatcacctgtgacctaaactgagttgagacctataattctttcaggtaagaaacaagtttgcaaacttcttttaactgctaggaactttacaacaaaattttttaatattaaatttggaattagatgggtagagtagtaattcttagtaggaactgcttggctaactccgtgtctcacagaaaatttataccctaatattagcttttggctaatgtttattctatgagtgagatataagttctgtttttataagggcccatactgagtggtagaaacggccatgggagggtccaattcttattgaccccttgcatattttatgtaagctgaaatataacttgagataaagtgataaaatattaggagagagtttaatgtataatgttaccttctgcaagaaataggatatttaccctgtttttataatcatgcaaagaaccaacaagacaggtgtttctaaatgatgtttagttcaacaaagaatgtgttcctttaatagtgagagccatatttttgtcttacgctggctcactacacatttaaaattgacagacattggagcacttcaaatttatatcttcatttcagccattcatttagtaggtcaaatcatcattatatttcaccagtatggtggattttaattcatttaacgttttaatctttcatcagtttttcatttaagaggatttcacagcatatatgggatttgtataaatttgtgtgcagtaaatttattcttttaacagttttattctttcatcagaaattaatttaaatggattccactatatatcacttctacttccagtgcagctttaggtcaggctgtaattgatgcaaaagcaatgaggtattaaaagagataggaaatatctgaaattggaaagagttcaagaagtggcccattgtaagggcattacgctcctcagataaagtggggagggagaataatacagcattttgatctgaagccttgcatgctttataatttcaattctcaacaaagtcaaaaagatctattttatctaagcctgtgtctttaaagcaaaattaactgctccagtgctctaaaacagcccccatatggccatgtggatgtgtgtgcttgtctttaccatccatttgaattaatggcacagcttctttcagtgaacattctatctcttccctcccctctgccgacattcattaaatgacatccaagtgataaacattaatataataaatacagtagctatgaaaataacccagggaagaggggcattctatcatgttttcatatagaagtag

SEQ ID NO: 39959 - DNA, 682 bp, Bovine  19866880484168
tgtacttcagttgaagttggtcttctgtaaatgcttattgggaatttctaaagcactgacttggagaggccaagagcctcccatcaatccctgcctggatagccactcctgtcaccacgggccaggcagggtctacagacgtgttggggtcctttccaaagaactcttggatgacttggcggattcgaggaatacgagttgagcccccaaccaagactacctcatcaatctcagtcttttccaggtggccttctttcaacacttgctgaatgggtacaagtattttctggaaaagatcttcattaagggtgtcaaagagctttcgtgatatttctgtttcaaataaaacctgaccctctccatttttcttttcagataggttagctccaaacatgctgtccacatggggatcatttgcttgggaaaatttgtcctttggcagttcactgtcactagtcggaggtccctttctgtcattttcctccactgttagtagtactgacatctgggcagtctcatgaagtgtcaggtttaacttgaccatttctacagcttgtcttaatcggtggatttcctctttcctagagggcaggaagccatatgtttgatagatctgtttgtataagtactgaagcaatctctgattgaagtcttgtcctccaagtttattgtttcctaagtt

SEQ ID NO: 39960 - DNA, 1088 bp, Bovine  19866880546783
gtataaataatcatgcttagtaagatttatatttacttgcataagtttcatttagaaaaggcagaaaaattcatttatgcatgagactgtattgactatctttcatgtacataagactgtcttaagcaaatgcttcctggctatttttactaaagtattccaaatgtaaatattgcttttactttcataatatccacatgtttgtttaaataaaaaataataatattttaaattaacaacaggggagacatatagaatgtttcctgatcccatcactactgagagtggctaaaattgatccttcagttatacatagttttcttattctttggcttccagccactgcttcaatatctccaggcaatttatactctttaaatagcatgagattcccaatatttgcatgaagtgacagaaagaaagagacttcaatttgtatcaattcacctacaaatactagttctataactttgaggatatttccaaactatttccatttcctcttgtgaaatgagaaaagtaatatcttattattgcaagaaagaaataaaatgcatataacttgtctgatacacagtagaaatgcttaataaatgtaacgtccctttccaactctacgtagtgtgcctttcagtcttgcttaaaaggggttaatcaagaaaaataatcgagctgaaaaggaactctgaaatataggttatattttttaagattgaggatggcatgtgttcaatctatgaaaaatttacaaagatgtaaaatctgattaaatacaaaaaatacagaccaatgaaaatgcaccaaaaaattttccccatctttaaaactttcattctctcatctctacagattaatgactgcattttttgaacatttaaatttagatatagaagacttcacttcggaaaccttaattccagggaatttgaaggcaaatatgcaaatcaaatttgaaaatcaaaacaggaaataatatacacactcaccaagaatggaatacaagttaaagttagcatggaaaatacagcaagatacccagctgatttttgaacttccaattcctgttctcgaatttcaatatcttcttt

SEQ ID NO: 39961 - DNA, 1683 bp, Bovine  19866880549890
tatgtcaccatcagttcagttcagtcgttcagttgtgtccgactctttgcgacttcatgaatctcagcatgccaggcctccttgtccgtcaccaactcccggagtccacccaaaaccatgtccatcgagtcagtgatgccatccagccatctcatcttctgtcgtccccttctcctcctgcccccaaatccctcccagcatcagggtctttttcaatgagtcaactcttcgcatgaggtggccaaagtattgggagtttcagctttagcatcagtccttgcaatgaacacccaggactgatctcctttaggatggactggttggaccaccttagtactacctataagtatgtccatcagaaagtaaacaaatattttgaggcaaatttatgcttgttttgtcattctgttacactcattggggaaagagtttttatgttaataactaaaatgagattcaggaacttagaatgtgcttggttctaaaccagtgagtcaagtttattggcttgtggtttgaaactcaatgaggtgaaggtagatttagagatatatcgatagaatgctgagcagcaaaagaaatatcccatatacatctctataccagtgtctatcatcatatataggagagttaaactcttaccaacctagtgagctcatgttgcagttttaagggagattcagtatcctttggagaatattttaagtgaccaaatactgttattttcctatactaggcaaggtatgcaagtttagtattcaaaattttactcgtttactttaactaactgtcaggaggtataaaaagtattttgtaatgaaagtaacagattatatacaatttaatcaaaaagattttttcatgactggatttttattttttacatttaaaaatttaaagttttgacttattattaaatgtaattatgttataaattttaaattatttcataagaaatgaaactctgtaatttctggttttattagtggtccacagctgcatcctctggaacctgatccaatcaaaagcaggctgtattcactgatatcataaaagcttacattaatttttgagctttaaagcataaatagcactttcacatgttaataccagaggcctgctatgaataatatagaaggctgacattcaaacaaaactggagaactgaagcagaaaatactgcatctatattttataacaataataatgatcctaccttatcttctgaaaaagaaatagccctaaacattttatttctggttctcagctatgtgctgaatctctggaacactctggacatccctaatctgttgtgttttatgcctccttgttagagacttccttttccaacccagtgtgtaaaatatagacaccttattttcaacgtgtggtgtttaaggagtacacttctactccctgtttgagatgaatgagtggagtcatttactttacttacctcacaaaattccactgaaatgacagtgaacaaatccaaaagtaaagggttcagggaatttcacagtgatgaatttctgcataagtgattatagtgataatcaagggtagaagaacctgtaacaaatactagatgaaagctgtaaaagcatagtaagtgggtccagtctatccactggagaaacacaagtacagggagtaagattaagtagcacagaattaatcaaa

SEQ ID NO: 39962 - DNA, 1947 bp, Bovine  19866880589036
ctgggtattgtttttgctttggctccatcccttcattctttctggagttatttctccactgatctccagtagcatattgggcgcctagacagcatctttcagtgtcctatattttttccttttcatgctttcatgggtttctcaaggccagaatactagtttgcctttcccttctccactggaccatgttttgtcagaactctccaccatgacccatctattttgggtggccctgcatggcatggctcatagtttcattgggttagacaaggctgtggttcatgtgatcacactggcatgaccccatcttgtcctaattacttcccaaaggtcccatgtcctaataccgtgacactggggataaggtttcaacatatgaactcgaagggaaccaagccttcatccataacaatataagatagctagatagctcatttcccaacaatcttagcctcatagatatttaatttcttttaagattgccaatcactaatgtaataagccaaggtatgtgattttgttgtttttgttgttcagtggctaagttgtgtcctactctttgtgaccccatggactgcagcatgccagggaaaagagggtgagtgttttactttaattattcatcatttcctgctctatgtaagttaagttctttgtccattttttcccttggggactcacaattttttaatcatttttaagtccttatacgaaaggaatacaaaccattgcatacacagttgctgcaaatgtactttccctacttgtcaagttttgcttggggatctttgaaatgaaaaacttgcagtttgtactcaagactgtcatcttctcctttgtgtgcctcttttgggtggcattcttcagaaggccttttcatcattaaactatatgaatttttccagctttccctctggcatgttatttcatataagcattcaaatatataatcgatatagaactaatattattgcatggtgtaagttaaagatctaaccttatttattcttcaaatggttaattaaaatgatttctctgttatataataaattcttacttatttgtgttttcatgctttttattacactccactgaagtatctggctttacaaaaatactgcattgttttaatatacaacaaagaacataagaatatatgatgctatttcttgcatctccgtaaaacatttaaatcagcacaattttatttcagttaaattggtttttctgcttattttattttattgatgtaaatagtttaaattcaagaactacttaccaataattaaataaagaacctggcaaaaaaaatcaccttgaagggctaattttgcttaggatacgttttacttcttttctaatgtgtcaaaatatctagaatttttgaagttctggcaatttatttcaaaaatatatatatgagaaccctgtcctcttgtgtcagtgtaatttacattctatcaatcattccagttttaagtagtccttaatcagggtgtaaaggataaaataaaatcaaagtttttgaacatttatatgaatgtgtcattagaaataaatagtaagggaaagtgaacactctactgttgctctcttttttcttttgactcttgtcttatttgttcatttggtagctcttgtaacatgaaagttattttccttcaaattattttctagttataaaaatgtgttgactttttttccagtgatctttgcacataacaccttaaaaggactaaacatcccctattgcctgcatatatctatgttatatctattttagacaagtgtttccttatggaagttcacggttcacgtattgctgaagcctggactggaagaagcacaagctggaatctagattgccgggagaaatatcaataacctcagatatgcagatgacaccacctttattgcagaaaggaagaggaactaaaaagcctcttg

SEQ ID NO: 39963 - DNA, 1298 bp, Bovine  19866880599165
ctttgcgaccccatggactgcagcacgccaggcctccctgtccctcatcatctgctgaagtttgcccaagttcatatccattgtatcagtgatgtcatccagccatctcatcctctgacgtcaaacctggaatattaggtccatgaatcaaggtaaattggatgtggtcaagtaggagatggtaagaataaacatcaacatcttagcaatcagggaactaaaatggacaggaatgggcgaacttaattcagatgattattgtatctactactgtgggcaagaattccatagaagaaatggagtaacccttgtaatcaacaagagtccaaaatgcagacttgggtacaacctcaaaaatgacagaatgctaaaggtaagaacactatatcttcgatactgatttttctccaatagaatataagctccatgagaaaaagggtttaccagttctgtttacctaggtaatcagtatttgctgaatggtatcaaataaattttctcccacctcagatttttaaaaaacattgtattatattcatcttcacattaaaacaagttcaggagaacaaattcctcactgttatgtgtccatgttctttctcagccttggtcatatacctgcggggttgttgtcagaatgtacatattttacattgtaccatggggccttcttaattgtttatctaccatatagtttgtctaggcgcctaatcaagtggatggcaaaataatacacttcattacagattttcagcctaagaaaattttgagaaaaatgcaactcaggcaagtgatattacctgcaaggttagcagcttgaattgttgaatttctctgctttagatcaaattctgctggtacggaaataacagcattggcaactggcattccaagatactcctctgccatttcttttaattttaacaacagtctagagccaacatattctggggaaacggtgatggtttcattacttgtcacagaaaattcaaccattccatttttgtttaaaacctgtgaataagatttgcaaagatgaaaacactatatatgagtgtgtatttatatctacatacatataatacatacacatatactaatacacataaatatatatatatatacacacacactgaatgtattcaatcaaaacttaccctgaaaaggtcataaaatttcatttgttatctagcaagtgcatgtacaaagattagaggctattaaaagatatactttaaaattataaaataaatctactctagtttttaataatagcagaaaaataaaacttatcatta

SEQ ID NO: 39964 - DNA, 729 bp, Bovine  19866880610734
gaattttctatttcattttccctctgtgttgaggtaggaccctcagcaccaggaaaaaggaggttgtattccttcaccacattttattcatctcctactatgtgtcagatattatgtatgaagccctggctcatacaactcccttctttctgttgatagctttccacctaattttcaagacttcagaactttgccagattctatgcttggacatttgcaattggaccaaggtcacaaaaggacagcttagttggaaagggggaaaagggagaaaaaaaatgctaagaagttacataaatgtcctctagcacattccctgttctgagggctaatgtactgtagcaattcatcagtcattctaatagtcttttaacttctgtctgaaagcctactaaatgctaacatcttaaatgtttaatattctaaaacatattttcattaatcatgcaaattatctaggcatctatattttactataactctcttcggagattgcagcctaaggctttgtgtatgagagacccacattggtgaatgatactgtagatgaaatataacatacagaattttagaaatgaaaagttgctagtaaagtttcagtagctatatgttgtcacagttattaaaaaaaaaaaacaaaatgatattaatgtcatgtacttctgattaagtagcaagcaactaaaatatgcactgctgctgctgccaagtcatgtcagtcgtgtccga

SEQ ID NO: 39965 - DNA, 903 bp, Bovine  19866880765020
agtcatctgtaatcagttaagttcaaaagtctgacacctttgttaatattacttattacatattaaatcaaataaaaagtaaaactaatcctgagaagtatccccttaaaatataaaaatacctcatccaaatctatttctgctctgtgcccttattcctcaaacttggctccctgtacaagtttaatatatgctcaagcttattaaagcatatcaaactttccagagtttaaatatgaaacttatcctgttactcaagcttttcttactaacatgcctggcttcaaaagtaagcagaccccaaaggaaagccttgtcagagaaagattcttcaggcctacctacccccttccaaattcatctcattggggtaaacaagccacaaaagaaatgtcccattcctaaaatattgctagtttgaagtcggcctatagggtattaatgatattcagacagagttgtgtcagatttcccctgtgttggtttccattgctacctctattatatgctattcttctcaagcttgttaatagaggaaaatttgaaatactcaaccactgagcagacaacactcctaagctcaatatatttttatcttctatgtatttatggtccaagattgtcctttaatttaaaattaaaagaatcaaatgaagcaaagcatcaaaaaatgtattgcaactcaattttgggtttagtttagaagaccaaggagattgtcacttgagagaactttagcctctcaacaaatcaaaattaattttctctgactagttccttaactgaaatgcaaagaaaatttggattatttcttgaacatacccaagcaactagcaaattgagtcaattagccataagagatattgatagaacaagcattaatgcaatggatattaatcatat

SEQ ID NO: 39966 - DNA, 1091 bp, Bovine  19866880782954
tctgactctttgcggccccatgaattgcagaacgcccggcctccctgtccatcaccaactcccggagttcactcaaactcacgtccatcgagtcagtgatgccatccagccatctcaccctctgttgtccccttctcctcctgcccccaatccctcccagcatcagagtcttttccaatgagtcaactcttcgcatgaggtggccaaagtactggagtttcagctttagcatcattccttccaaagaaatcccagggctgatctccttcaaaatggacaaatttgacttataccttcataaatcatgtcctctgcattcattatttattaaggtgctcattttttaaaagacataatggattctattgtttttcatctccttccactctccattctctcaccatcagcatttaacatgctgctttctcatgaacagtaaatgtatgtaatgaatttatgtgtcaactagagtatgtgtatgtgtctctttctcattgatgagaaagggtatggaatgtgcattcctggaaagcttcaagaagagaaaaaaaaaaaaaaaaaaaacacctatgttgtctatgatgcattatacccccaaggatcctgggccagatgatctcttaaagtcaggttttgatctataactaaatgatcagtgagccagcttcaagtcgccttatatttagtacatagagccactgctcaagagtactaaatggtgtccctgggctctgaaaaaaaaattaatgtacaacccttagggtccaaattactgccagggagtgatttaggtaatgggaaatgaattccattaatatctagttaggtggttaatcagaaagtaaaataataataataaaaagtaaggagttaaatctattttctcattttgtcctccatgaacagaaaatcataactgttaggtgtgctcctcctaaaagctttaataaattttaaagtagtgctcaagactccccttgagttcttcatctctaaactaaatatgccctattcctttaatatttacacataagatctgtttccacatctttaatcacctttattgctcttttcaatttcattttcatttt

SEQ ID NO: 39967 - DNA, 1495 bp, Bovine  19866880831458
tacaggaatgccctgcatgtacagatgttacaagttctctaaatgactgaggtgaaaattctatgaactgttttctctggagatggtgctctgaagtataatgtttttatttcatttttttgttctttgtagtatatggaatatggcatttatcataatttaaattttaggggataaaactaaaaaaaatttgaagaaattttacatgaggcaaaatggctatgactagaaatagatattaaatgcacatttataaatacataaaagcaaaatgcccatgtgcctcctccactctgtctgtggagatagcatatattttcttaaaagctgcatgtttcttgaatctcaatccaaatcatatggcaagcatgttggaaacaacaggcacgcatgtcaggggctaaggcaccaggcaaccctggcacactgtcaggccaactgctggactgctgcttggcattgctacaaagctcccctgctggcagctcatgttccaggctcctggctgggctttgccatttgccctgcatcgtcgtgggcaggtaggcaggcaggaaggcacaagcggggatagttgagcaatgtggggctgctgtgaccacagctggtgccaagggcctggcatacaagccacccttcccccttcctcctcactgagtactgtgaacaaagggtgcaggtaatacctccaatatgttatatacaggttccgatagagtttgcttattctgtttcgaggttgttttttgttttcaatttaaattttaattatccctgggctatagggagagcaagatatttccttcacctattttccccgaggaggattgtacacattgtcacagacacacttttaagacacatcaaagtgcatgtcagcataggaaaagagaaatgagttctgaataaaaagaaagtatttactataaatagcagttaactatcttattattttaaagaggcatttctcagcaaggcaaaggggtcttgaaggttgtgtttatggaaaaatacacacacacacatattctctatccacttttttccttgctgggaatatttattcaaagtaaacaaactgttttaaaattcagatgataaatagagaaactctaaagtgcacaaaataaacagattccactcattggctccttcatgagccaagtagttgccttaacttttcttctccttctaacctcatctagattcccagctgaaggagccagtagcctgattctgctcagttctaatgtgttgtgagaagaaattcagaatctctctgtgcttggaattgtagaacccaaagttgctattctgctctagaggtcatgcaaggatcagtcctaacaccactcagccctcctgttagtttgttgggagaagtgtctttacctcctgtcaagcaatgacctaaaaaagtttaatccgattaacattttcaaggtcaaagagggtacaatgctgtctattttggcctaagagaaaagggaaactg

SEQ ID NO: 39968 - DNA, 1215 bp, Bovine  19866881061823
agagtatatattttatatatatatatatatataatatgtatatatatatatattgacttgttacatgaagatgttaaaattggtttttaaaggtgatgtaaatagtgatttccttaatgaaaaaatacatattttgtattgttctaatacaacagaaaagccttttaatctctttggtttctgtatattccatgtacaagtgtaaatataatcggacaggtttaaaaattgtgcatgtatgtatacagttgcaagtctggacaaatgtatagaataagccttttatttaagttgtgattacctgctgcatgaaaagtgcatgggggaccctgtgcatctgtgcatttggtaaaatgtcttaacaagtcagatcagatgttcatcccaacataacagtattccatttctggacacgacttctgtggtttaagctttgtggaagaatgctttgaatccaagggtcttaaaactttttaaatcaagtcaaccacttttcaaagtaaagagttcacacaactactttcatgaattttttaatcccgttggaaacatataccaggagtgttccagtatactggaatacaggcacactaccattcatggtatgaattctggggtttacacaaccagttttgatgcaatctgctcagtaatataatttgtcatttttattagaaatttaatttcttcatgtgatgtcatgaaattgtacatactgcagtgtgaatttttttgttttgttttttaatctttagtgtttacttcctgcagtgactttgaataaatgaaggaaaaaattcatggtctctggtttgaaatgattgttactttttgggctctctctgattttcagatttttcgtaaacataaaaagtctctggtcatgagaatagcaagtcttcaagaatgctttgccattcttggaaagataaagaaaaaaaaaaaaaaagaagatggtcttagagttaatgtgagacagggcagtggaagcatagctcggaagaccatcggctcacagcctagcctacccacccttggttctgtttcttgtgtaactggatggtcatcatggatttttaaagtgggaaaaacttgtacagtattcaaaaataaagttgatttgatacaaacttgttgtaagataagatgttactaggtttttatccaagtttcaatgggcattaaattttttctaaataaaagtcttcaaacatt

SEQ ID NO: 39969 - DNA, 969 bp, Bovine  19866881076348
ctgctttttaaatacacatatacttagttataagaaatggagaaagaatcatataaaggaaaatagtttttatggtaaacatttggcaagcaaagtggatttccacacatacacacactcatgtgtacacacacacatgcatacacacacatacacacaatatgatgagaaatatcaaataggaagaaataaaattaattctggctagtaaaattcaaatttatttgagattcttttcttcttcagaagaggtgaatgagagaaggatatgacattttctccttaagaactaagaattactgaacatggaggatttatttaatgcaaaaaagtcacattattgagattagacatctctttttcaaggtgcttctgggagatagtggctctcatacctataattcagtggaggcatctttgcctggtaagagaaaaatggacctgaggactaaagttaacaccttcatctctgcatagcacaattttaagaataactctagaacatatttgctgtcttacatcactctcatttctaaaattttcttttaaggagtggactctgtgagtattttccctaaaaatatggccaattttaagacaaacaaaaaaacagaaaatatctcacattttctctaatccatgaaagaataacttataatactgttgtattaataactacaattaaggtaggaaaaaaatgaaacttcaatatgaaatgggcaaaagaattggaaaataactcttcatttgtataatcagtatgatgtaaaaccttattttaaaattaaaaaaaaaataagaaggcaagtgattttatcatttttttgatcaccctaaacatgcttactccaggaagaatgagtacaaagaaatgttgattctcaggaagtattgggtcggctgaaaagttagttcacatttttccatatcctgtataaagacacgaaccaactcttggccaactcagag

SEQ ID NO: 39970 - DNA, 726 bp, Bovine  19866881083873
tctcaatcacaatgtaagaataaatggatcttagaagaaataccagttagaaatcatcataccatcactcttcctcttgtgcctttgaggctgatgccaaatgcaatcattttctgccaacaatgcactatctttgctgaaatgttttatagctatttgtctattagtaaattattttacaatatatgctacatcatgtcacagtgccaagaattttttgacaatttagaactttctgaagctaaaggagattattagatgcatgcagtacaggatgccatgtgtagtcaactttcttcaggctgactaggtttaatcaggggctccactgcaatgcacttgaaaaagctctgaaaaagaactcccaggccagctactactggagtattgggttctagcagagtcatctggatttttcaaatgtctgattcatgtattctgatataaattccaatctgaaaaaaaatattccttgcttttttagatgaggaatatacctgatatatagaaatttgcctttcctatcaaactaccacacaactgcactcatctcacatgctagtaaagtaatgctcaaaattctccaagccaggcttcagcaatacatgaactacgaaattccagatgttcaagctggttttagaaaaggcagaggaaccagagatcaaattgccaacatctgctggatcattataaaagcaagaaagttccagaaaaacatctatt

SEQ ID NO: 39971 - DNA, 576 bp, Bovine  19866881214500
tttttgtatttggaaggtcaagattttcctcttgtttttttgttttgtttttttcatcttgacagtaatgacttaaggattggcataagcctaggtcttatgctatgggtagtttttccagcagaggaaatgaattcacactaatacattcacatgttctttctaagtcatttagtctcttcatgtggtcatgaagcagagtaaagctaactgacccccctagaaattgaaactatatccttcatcagttttgtcccatggtccaatcatctgagctaaccaggtaagtaacacattggaataagaatcagtttgactataaaattatagactttccttaggatattcgagtgcatctttttatacaaaaacatttctgatactacatgaagttaaagaattagcatatataatttttatacttttaaaattatataaaaacataatggacatcatatattcacacatgaaagtgttagaattttagagttctatatttctgagattgtttacaatgttttgtattttattttaataaagaacaaaacattaaaacggtaccattttttaataaag

SEQ ID NO: 39972 - DNA, 820 bp, Bovine  19866881229998
attaaaagtgtattcttaaatagtttcttgattaagaacaaatgcctcattaatctggaacatattgacttgagaacacaaggtaagtcaaagaagtaatgactgacatgacatggaacacaatatgctgtgttcccattgcaaaagctttagaagaacagactccccaaaaggtcactagatacagcgaattgaataggaacccagcgtcacccaaagatgcaaaggtaagctttcaaaaatctatataacagaggacattgtgtgcctgtatcactgaaacttttccatctatagattctgagtgcctcacatttatttcagaatgaaaaaacccaagatctaaaaaaactaacataaaacatatttgcatataaaaaataatgacatcaaatttttaagaaacttggtgtctgtttaccctactccatctctcaagttttacttaaatttgtgaatagaaatttaaagccaacacaaatagctttgaagataattctaacaacataattggatgtggattctctttgaaccagaccaaagttgcatttcttaaaggaacatatagtactaagaaaataatagatgcccatcaatatgattaccttaaaagttacatacataatttcaaatgacagatcagacatttgaggatgactatgaaattttctaacgacaaaatcttgtttggaaacagccattaaaatataccatacattcttctgaaaagcttcagaatttctaatccatagagaaagggacttttttgtgtctcaatcattactaaatccccagaaccatgcttaggacataatcaata

SEQ ID NO: 39973 - DNA, 754 bp, Bovine  19866881267485
accttttagcagctattcattatttaaaagagcggcttcttttctttcatgccagtcacagttttctgtccaccatgtagcctctgttgaaaattattaaaccttactaagaaaaactttccaacaccaagttctaaaagctagaaaaatattctttttcttttacattcacaaaattgccaggctggaggaggaaatagacacaatatgagaagaaaatccatttcttcctccagtcctaaatggcatactgtactcaccaacagattgaggaaatgtgatttaaatcaaactatcagcaggtgagtgtaaaagccctagaggtcattcccaaggagctttactgtgggtgtttctgatcctgctgctgctaagtcgcttcagtcatgtccgactctgtgcaaccccatagacagcagcccatcaggctgcaccgtccctgggattctccaggcaagaacactggagcaagttgccatttccttctccaaggcatgaaagtgaaaagtgaaagtgaagtcgttcagttgtgtccgactcttagtgaccccatggactgcagcccacaaggctcctccatccatgggattttcctagcagccacaattctagtagcattcaacctatattagaccttcagacaatattattttattaaaaatccagcagttattgaaaagtgacacaataaattaatcagttgcttcattcaaaaaagctgcacaactgactggacgacttttcacccattcca

SEQ ID NO: 39974 - DNA, 1243 bp, Bovine  19866881313064
tacactcatccctagttccccatacttgtacttcctgaaagagatcatacacccagccatagacaaaccatacagaatgcacacaccttgattttgagggaatcagtgtcataggggcttggtgtgaaatcggtgtgtactcgggcacggccacagaatggtccagagtaggggctgtcatcatcaagtcgaaagctgtcccggttacttgtaccatctgaacaacttgttattccacctgatgaaagcaaagcagacatttacagttctcattgaaggttcataacattctgaaccgtcacctggacataactaagcagaaacaatgctgaacaattggatgccagcctcctgcgggggttctaagtgactgactgcttatttttgctcccagtccttctccatcagtgacttctgtcctgagccatttctgatctttattcagtcaacctgatccttctttcctcaaccaccaattcaagcactctcctacttcggcctctgtgatctgatccagtagcacagtgctttgagcattggctacttgctaaagaggcaggaagtgtatagccctaatgccctgtacaaggcagataatgaattttgtacatgtaaacaaagacagaagcctataataacagtttgatttttgtgtgctattgatcaggaatggtcaaagcataagccacaaatcttcctacaacttactatgatgtagcaaaaatggtgtttcagacttcctcctgtgtaccaaaagccattctgagacaacagctctatgcataaaaggtagcgtttttgcttgtagtgtgaatgacagggaaagagaaagtgtgttataatatctatactcctaaatggttcaaacctgttctaaactgggctattaaaacggctccaaaaccttgttctctggtcctcttcctttctgatccggaacctcaaggggggaaaaaaatagatttcgtatttgctgcctaggggcaagaatggttcacagggggtggttactctgagtctcctaccactctcagtcgtcacctctctttttcctttggtgcggtcctttggtgctctgtttcatgagggagcaggcccagtatctctaccattcattcaaataagtgtagaaataagataaagatccctagggatgcttcattttttatataatgaaagtcgctcagtcgtgtctgactcttggcaaccccatgcactatagcctgccaggctcctctgccca

SEQ ID NO: 39975 - DNA, 1294 bp, Bovine  19866881314445
ctcttggatctttttgcctataaggctaaatttttattcttatgtaactcattctaggcaggtaattataagcaattcctgattactacaaactaaatgattcttctaaagacatttttcaaaaatctttagtcatggaatcaaaaattgatattttctcactatttaattttatatattgtttgagatggtggatatcggacattacagactttatatatgttctatcttaagaacttcatttcatttcaagcttataatattttcaaaataggctggtggtactgaaaaataacctgataattagaaaagttaaaaatgggagtcagtaatctgtaaaactttgtatgtcctttaaaagtcgcacaccgttttagttcaagacggcgtcaaaggtacttagtccttgcaagcactcttattctcagatcttcctactagctatctttaaaactccttgtttctcttttaaatgagtttatataaaaagatcctggcatgtgacaaggggtgagcttgatagacactgtgacacagaacaccaccccaaggatgagggctgtgttagacacaattaacacctttttctgacttgctacccttgctgaagaagcccttcagcttgtggcaagaggagagaaaaagaaggactgaaattgaaaactactctggaaaatacaatcttctcatgcagggcttacggacctagaatgatttctgagagcattaatcacttcaacttgcctagtaggcacttctgccaggccatcattgcccggaaatcgcgaaagggaattgagtgtgttcttgttctgcttataaacaatctgaacacagggaaagctgttacttttttatatacttgaagcattcttatggcctattggagcctgtgcttagggcacttttgtagcctataaccagtctatgccctgcctattaaatattaatgaaggttacaatgtgttatccacctctggataatgggtcaggttgcccagaggggcacagaataggctcacctcagcacttctccacagtatcttctgccattaagtaatcaatagtcaccaccttttaaaattaattctcccctcattatatcaatagaagcagattgagaagtagtggttttcagaactattactttgggttttgtcagtcatctcattacaaatcactcaacagattcaagccagaggagtaaaatatcaatccatgctaagaaacccttaagaagcaaatctaagtatttaaaataatgtttttacaatttcatattctctgtcagaaa

SEQ ID NO: 39976 - DNA, 960 bp, Bovine  19866881773080
cccaaatttctcctgtgtacaaataaggggatacaattggaagatatttaaattcctttggagcaaaatatacatacaaaagagaacatatgtgtgtatgcatatgaaacattaaatattcatatatattatatataaagatatatataagaagatacaatatatatgtatgtatatttggataggcctataaatttaagtgtgtacctgatacttatcctctatattggagaaccatatttaacttataaatcaaaagctggaatttggttgatcttaaattcgattgtcaacaccagataactagtaattatgttggctcctaaaattcttgtgagatagaacattggattagaagtcagaatacttgattctcatcctagctctgttattaatgaattatctttccctggataagccacttaacttctctgggttttcccattttttaaataggctggtagactagatgttccgtaagttccatcctggcccataaaatatgattgtaggactaatctagttcaataattcattgatgctattttctaaaaattattctgtcatactaatagtcaagcaaagtgtcagaaaatgaggtgcatttaatctaacacttgtaacaaaaattttacattatttaaggaatgtgagccaagtgaactaaaagatatgcacatttatatataaaagatataatatgtgtgtgctcagttgcttcagccatgtccaactgctttcaaccctatggactgtagccaggctcctctgtccatgggaatctccaggcaagaatactggagtggattgccatgccctcctccagtgggatcttcccaacccaggggtcgaacccaacagctcctgtgtctcctgcattgcaggtggattcttttcccatggagccacttgggaagcccgaaagatatagcatatacatattaaaatatatgtatgaaa

SEQ ID NO: 39977 - DNA, 1173 bp, Bovine  19866881913944
caaagaaaacccttaatatcactaaaaatgaataagtttctttctttagtggaaatatagatggacgatagatccttctgtgtattaagaacaaggatcatcaagaggcctccacatgcatatactacatgcagcatggaaaagaggttgaccaagttcctctcactaagaaccttaaaaacatttactaggaaatgaattattttccctgtcccacagaagacttttcccaaaagtgttagtatattaacaagtaaacatgaaagcttgcagcagaaaataataacacaattatgttgttcactttccgcaaagaattagagtaatcataacaatctctcttacctagtttgggacatgattttcccttaaagtcagcacaatccgcacatagaccagtcttataatctttgtatgaacgacaagaaaatgaaataaaattgcagcttgtttccaaagctgccatgaataagtaaactgctctctggtggtcgcatttaataaattcaagtccttaagtgttaaaaatcaagcagttagatgtattaagccaagttcaagtaaattagaaaaaaaatttaaagattaaattctacctaatgctgtgtactttatgaatatcacaatgctgactacaatgcagttttatctcaagcaacttaataaacggtaccattggaagcttaaatatggtatgccttttacatgagatatagaagaaatttttctaaagtaataaagtagcaaaaatgtttaatttcagtactttgacaaattacacacacagtgctaccatatttaattattagtgtacacataactcccttctaaactctcacccctaacattcctactcaatgccaaagatacctgtgcaaacaggtgacattaaagatttatcatgtccctttcctttcctaacttctcacattcctgtccctttgattaaactactctagttttttgtggcctttaaagatgtggttcttgaccagttcccactgtagatctcaggacatttctcaccgtggctctaaagtaagccaaattccacacagagagcagttgtttagctctttatgcacagaatgaccaaatgcaagagttcataaacctgtgaataacacacaataatactgcggtaatggttggagaagaaaacggcaacccact

SEQ ID NO: 39978 - DNA, 1558 bp, Bovine  19866880121189
catctgcagtgattttggagccccccaaaataaagtctgacactggttccactgtttccccatctatttccatgaagtgatgggaccagatgccatgatctttgtcttctgaatgttgagctttaagccaactttttcattctccactttcactttcatcaagaggctttttagttcctcttcactttctgccataagggtggggtcatctgcatatctgaggttattgatatttctcccggcaatcttgattccagcttgtgcttcttccagcccagcgtttctcatgatgtactctgcatataagaagggggtggtccatctcaaatgaggttaaccccgtccatcctgtggacgggaggctggtggctgcccccagccaagcccagtgtatttatgttgctgcagagataggctctcaggcccccaaaggaaagcacacaacgaacgacacgattcgcctatttacagaagacgcagattgctctccaaataagccacatttactggccaatccccgcccccccacatccccccagcaaaatgtgagaagcaatagtcagagggggagtgccatcacagtctaagaaatgccaggatagccttgaattacttggattttgacctgaatttgcccttcagtcctaaggagaaggtgatcactgggaacacagaggctcacctctgactaaattcctgctaattttctactgggtgttaggatgctaacagtgagtgtgaggtctgacaatgggttgattttactgagcagtgtctcggaacatcgcagactttctcttccatattcagtgtcagaaattatgctctttagggggtacatttattgttaggcagcgtgtaaacagctgctttattttagaataaagaagtgccaggaggtacttgtttggcagctgtgggtgctcaggttggcagtgtcataaataaatgcgcaagttttatatttccattcatttggatggaccttctgttcaagggcctgccaagacgcatgcaaggccaggatggtgaaaggattgactttcataaattttcagcgttccacgtcgttccgcctgttacttttcactcttcaggcccagagaactgttacaaatacgggtctccagcgccatctagtggacaggaagtggggggtgatggcgcacagacaccgggttctaaaatgtgaaagcagggttctgggtgtggcccggtcttcctattccttttggagtgtcttggccattctccgagcaggatgaaacctgagaaggatggcaggagcccctgctgcagcttggctccttggaaggcctgggagatggggcggtgcattgatctgtgcgcttgatcagtggagaaatcagttattaatcaacaaagaactattgatttcccagccaggaagcagtgtatccgctgttcctattaacagccagtgtgctggggaagttgcccgagagcttctgtgccccaggcttcggtcagcaggtcattaagggtaggggatcccgagtctccagagtgatgactgggggaggctgaggcattctaa

SEQ ID NO: 39979 - DNA, 1693 bp, Bovine  19866880350026
aaaaaaaaaaaacaagttggaaatggaagttctctcaaatgacattcgtgagcacacagaagatgagacatcatcagatcctcttctgaggttgactcttggtatccttcatgtcaacagactatctgcacacagctgtctttgagggtaatccacagtgcttagaaactgtgcacagagagctcggggagagctctctgcatcgcttcagtataagtgctctgtcgtcacttagtcgctaaatcgtgccagactctttgcgactccatggactgtagcccaccaggctcctgcatccatggaattctccaggcaagaatactggagtgggttgccatgtccttctccaaagtgctctctataaatcaaatttaacttgagttatgagttaacaggtcttctagtcaagatcataaagttttatgcccacatcttgagtgttttactacaagtcaccattttaataatgttgattataaataataaatagaaggctcaaacagtaatgcttctactcactttaccaaagcaagatcaaagttatagaaaaatacccacaaaaaattagtttatcaatgtacaaaaatgctgtttggtgcaaagacatatttcttaggttagttttaattttttttctcttggtatttgccccattcagctaattataatgtgctaaaaatgttttaaagttgttggttttatagtccagtgctcataagtcaccctataattaagaagaaaaaagaaaaggccagtttgcatgcaaagaaaatatttttttaaattgggatataagtattaatgaaagttataaatatctaagcaaaagaacacagaaaatcagttccagataaactgctaaaattttcttcacaggtgtttcgatttactaacaaaaactgggcttctgattttgacctataaggtgattattctaattttctctctttctaaaacatatgagtacctctcagtcttataaagtggtttttacagtaagtcccctacatacaaatgagttcgctccaagagcatgttctaggtccattttgctcagaagtccaacaaagttagcctagatatccaactaacttaattggaaatttagtactgaactgtaataggtttataatacttttcacacaagtaatacataaaaatacacaaaaaaataaagaaaacatttttaattacagtacagtaccttgaaaaataccacctacaccactgtcgcttttatgcttgcttccagatatcctgggctggaaataaagatactgccctgctgtactctacacagtactgttcagtaaagtacacaaaagcaccgccaattgtagagaatgcacacaggcaacaacgtacaccagacccgtgagctaacttacaacatgggacacgtgaacacacacgtttgcacctttgaaagttcacagcttgaaggttcataagtaggggacttacagtatatgtcataggcttaattatggatttgatctaagaaggcacagtgcctgagaagcagcccgagctaccagaagcatacaacccaggagaggggtctagaaaagcctatacaaacaaccaccacaaatgctgagaaacacggtataaacagggagtgaggctacacttgactgtgggcagtagagtggctgcacgaataaacagttccgaaaccaacgtgaacgtg

SEQ ID NO: 39980 - DNA, 1937 bp, Bovine  19866880357077
tgagcataagccttcaatgatgtgtattgggttgactaaaaatttgttaggttttaagtacaaataaaaggactatttttaattttcatgaagaactttattgaaaaacatattcactaactgaccaaactttttggccagcccaatattttacttattaagtaggaggaagggtagatggaaggggaaacaaataggaaattataggggtaaatgttttcaataggctgaggattaaatagcaacgttttaccgaaaaccttgagcgtgagattctctgatacaaaccggtgacctctggaggatacagtagtgagatgagctatgtttagaatggtattatgttgtcgtgtcttggtctgtaaaattgactaagtggctacagttaattgtgaggacctagacagatttgggaagcagaattttgcccgaataagttcttctaggagaaggacaggacatggtgaagaagagggtttacgtttcaggaccataaagacctgtcttccgctcctggttttgctggtgtgcgactgagcagatctcactgttttctcagtagtcaagcaggaggagcaatgctccagaaatgctgggttgagacggtgctgggcagattcagcgggcggctgcactgcaggctggtcctgccgctaggaagcactcaacacctttgcctttacttttcctttcctccctttccttccccttttccaacttctctctgcattctctccttcccacctttgtccccttccttcctttttgcctgggatacatttcatttttatttgctctagtatttaaagaactcagtggctttcaagaactcaggggctggccaactttcttggtacagggccattgagtaaatatcctcagctctgtgggccataccatatctgttgcaactactcagctccgcggtttaaatacataatacatgaatggatatgcatggctgtgttccaaaaaagctttatttataaaacagatggcaggccacagtttgccagcttctactttggagtaactgtccaatagagttttctgcgatttgaggtgccatgatttttcttttcaatcaggcttatttcaccactgagtctgtggcatagggttttcatcttataaaggcattgcattgctcttgtgtgctgtttttacgttttaaaaagttttaacacaaagcgtaagtgattcagtctcaaaatgccttcaacaatgttctaacacctggttcatgttctgaatctttcctcttcaggtgtttacattgaagaagttctcaataagtggaaaggggactacgagaagctggaacacaatcacacctacatccaatggtcagtcgcctgctctctctcgaaccgtgacctgtttaatcacgtgtgcttcccagagatcactaatatacaaatgttatttctctaaaacataggcttttccctctgagagaacaaggcttgaacttctatgctaaagaactaactacctatgaaattgaggtgaggcaagctgatttcatttcatgcgagttagccaaattaatgttgccgtttgatggccctggtaactctgagtcattccgctgaatttttctttttttcattaggaattcaagaaaacaaaggaagcaataagaagattcctcctggcttataaaatgatgttagagttttttggaataaagctgatagataaaactggaaacgttgcccgggctgttaactggcaggaaaggtttcagcatctgaatgagtaagtagagcccctgcagtgagtccccaaggcacggggttttctctgggttggaattctctatggcacatagagccacaagcaggtggatccatggatttgaattcaaaagctcatctgaaatgcactttattccccattctatattctaaagcaaaactaaataacaataacaa

SEQ ID NO: 39981 - DNA, 3158 bp, Bovine  19866880418739
attttctgaccttgaaattctatgattaatctaagaaataactttattgactttattttatattcatgacacgaaaaaaagaaagaaaaacagaacttacatgccatgaatgtgtctacaggcaaatgtaaaatggaagaataaaacaaaaagtcacactgagataagaggaaaatccaaaatgaaatgtctattatacaagccatagctggaacaatatattaagattgattcctgtgcggtatttctttaaaagaaaaacaaaaccaaaaaaagtactgtattcttgagattacagaagcatagttaaaataaggaagtggtagcagggaggactcaaaatatcaaagaactgtgtatacaagaaagacataaacatgataaagaggagatgggtggcattaatgatgatggatgacacaatattttataagagaaaagattatattagagctccagttgacaaaaggaaatggctttggcagaatctgcaatatgggaaaaaaataatagaaagctaatccttagacatgatggtgtggtgagaactgcattttaggagagattttttgaaaattatgaaatatgggaaggacaagaccattgatcacaaaaggttttaattgaccagaaattgtttagagggcattctataggagaaaatgaagggaaatctgtttcctaaatgtactgaaaatgtgtctacagccttacataaattattgagcagtcaacatcctgaaagtgcgttcacactgtcatccttggaaatgaatcagatgtgtaacgaggagcagtcctgcagcagagacgctgtaaaagcatgccagcctgtcaacacagtctggtgcgcttcctgggattaagacgtggctcagaggttggcatccctaacctctttctgtctcatctttctctctgtgcaataaaaggtctgactcagtgggctctgtgtttcttaccgcccagagctgaagaggatgcttgttagtcatagccacataatactctgttgatcccaatctaattacttttaactgaagcctcactgtgataatttatgctcatgtctttaaacttccacttaaaataatttgaaacttccctcttccttacacattcacacttactcatttcttggtctaatctctaagctacttggccaagtagctcacagattactatagggtcctagctggtaagtgtactctaaaacaacctggagttgtttttcacctcattccatcactcaccattggttacattggttcctggaccacaaggaaacctctgaacctgtgttgggtctccattgctgcataaggggagtcagagagtgggggacagtctggtgagactgaaaaaggctaaaacaatgctgaaaaaggctaaaacagaaacatctgtttcttttactttaacttttgtattctattgtttttgctacaagataatcactaaactaaggttgcctatagcttaagtaaacataatggagctctgcctcccatgcaatgaggaactctgcctcccatgcaatgagtattaacctaaatacctttatttagcccacaggaaacatcctgaccaggcccacctatgaatggctgcaaaaagtaagagattggcacacctcatctagaatttcagcagtggccacaggactggaaaaagtcaattttcattccaatgccaaagaatggcaaagccaaagaatgttcaaactacgatatggttgcactcatttcacatgctagtaaggttatgctcaaaatccttcaagataggcttcagcagtacatgaaccaagaacttccaaatgtacaagctgagtttagaaaaggcagaggatcaagagatcaagttgccaacattcgttggatcatgcagaaagcacaggaattccaggaaaacatctatttctgcttcattgactatgctaaagcctttgactgtgtggatcacaacaaattgcagagtattctttaaaagatgggaatgacagaccactttacctgtctcctgagaaacctgtatacaggtcaagaagcaacagttagaaccttatatggaacaactgactggttctaagttgggaaaggagtatgacaaggctgtaaattgttaccctgttatttaacttctatggagagtacatcatgggaaatgctgggctggaagtctcacaagctggaatcaagacttccaggagaaatatcaacaacctcagatatgcagatgctaccactctaatagcagaaaatgaagaggaactaaagagtctcttgatgaaggtgaaagaggagagtgaaaaagctgtcttaaaactcagtattcaaaaaactaaaatcatggcatctggtcccatcactttatagcaaataaaagggaaaaaagtggaaacagtgacaaattttattttcttgggttccaaaatcacagcagacagtgacttcagccatgaaattaaaagactccttggaaggaaagctatggcaagcagcatattgaaagctatgaaaaagtgtactgaaagctatggcaaacaaagacaccactttgctgacaaagtctgtatagtcaaagctatgggttttttttttttttcccagtagtcttgtacagatgtgagaattgaaccataaaaaaggctgaacgctgaaaaattgatgcttttgatggtggagaagactcttgaaaagtcccttggacagcaaggagagcaaaccaataaatcctaaagaaaatcaaccctgaatattcattggaaggactgatactgaagctgaaactccgatagtttggccacctgatgcaaagagctgactcattggaaaagaccttaatgctgggagagattgaggataggaggagaagaggaggcagaggatgagatggttagataacatcactgattcagtagacgtgagtttaagcaaactctaggagatagtgaagaacagggaagcctggcatgctacagcccatggggtcccaaagagttggacacctcctagcgattgaacagctacaacaacaactctagaatctggctggcaccaggaaatatttgcaacaacttaccacctttttttactttgcctcttcaattcacccctttttgttttgccaaaaaacatccagcatccaggcctggg

SEQ ID NO: 39982 - DNA, 2352 bp, Bovine  19866880468337
gtccgactctgtgcgactcctagatggcagcccaccaggctcctctgtccctgggattctccaggcaagagtactggagtgggttgccagtctccaatctaccctctcatagtttttaaaatacttatttatttttgactgtgttgtgtctgttgctgcacgggcttttctctagttgcagggagtaggggctactctctagttgtggtatacaggcttctcattgcactggcttcacgttgcagagcacaggctctaggtcctcaggcttaaatagttacagtatatgagctcagtagttggtggcacatgaactgctccagaagcatgtgctgctgctgctaagtcacttcagttgtgtccagctctgtgcgaccccatcgacagcagcccaccaggctcctccgtccatgggattctccaggcaagagtactgcagtggggtgccattgccttctccaacagttctatgagacttcttatatcactaatctggcataggcagataagaacatgataagtaagtgatgctatgcttctcattactgctcctgactgagtgtgaacacttagccttgagcacacccttggacaccaaaaactgccaactctaattcttcactgctaactactgaggcatcaccctagggaggagcgagtccaagtggaaacggattaaagaaggctgcttccatgaggtatagtgagacactctccttgatggcaaaactccttgaagctttataaatctttatattactcaaagaaccctttttattttctacccaagaaaccatttaaagctttttcctttattaaaaatgttacttggaattcctctggatttaaacacacttggctttatgaaatgaaataaactcccatgtgtgttactttgtaaactcaagtcataaatgttcatttgaagcatattaattttcaggcttcaaattgttctcaaaagcttaagaaaagatgactgagggttaaatgaagctgtttatttttaatcttcagttaatttttcttactgctaagtagggtttcccaggtggcagtggtggtaagaacccatctgccaatgcaggagacataaaagatgcaggctcaatccctggatcaggaagatcttctggaggaggccatggcaacccactccagtcttcttgcctggagaatcccatggacagaggagcctggcaggctgcagtccatgggggcacaaagagttggacacgactgaactgacttagcacgcccacactgctaactaggtggcctttatgctaacccactcaactgaccgagaggcctcacagccggtgtgaaccctcccaccccgtctgtccctcccgttccgagctcctcctcctgtgagtcaggtcggctcgccctgcggccggcgctctgcccagcgtccgcctggtgtggcggcatcccccgaggtcccacagacacgctcgtcctgccccgcgcacatcgctgtggtgtgtgtcacactgcccattcagtcacgctctggatgacgagtacgcagcggtgcttgtgttccctcaccgggtgaaggccccagagcccgtgcagtcccggcaccgcctctaactccaggccccctgtgacacgccgcatctgtctcccggacaagtgggtcccacgtctgtctggtatgacacggtcccctggcagtctcagaatctcacttcctctcagagctccacacactgtaactgttgagaataccggtctggctctgcaatctaccaactgctcacctttgagcaacttacttaacctccgtgcctcagtttcttcactggtaaagtgaaaccaacagtagctcaccaacctcagagcttctgtgaagatccaagttttcaccatctgtaaacactcagagcagtgcctggcacacagtaggcaccatctccatgcttcttaaagtaacgagatggcaatctaactactggagtaaaagcatctagcttcagttcatctacaagctgagactggactctgaactcagggagatctgggtttgaacctagttgtcgtccagaagctgggccttggaagccaacttcggtcagcttctgtgtccttgtatgttttaaaacaaaaggaaatgggaaggacaagggtgtgtgtctggtgtgtgtgtgccacatcccccctctgaagggctgcagaggctgacacgctaacaaagccagcctgaggtgtgtgtctatgtgtggctgtgtgtgtgtgagacacgttccccctctgaagggctgcagaggctgacacactaacaaagccggcctgaggtgtgtgtgtgtgccgtgtgtgtgtcatactccccactctgaaggg

SEQ ID NO: 39983 - DNA, 882 bp, Bovine  19866880473315
gaagctgcacagagctggtctggctaaacaggctcaagggaccgggcagctggcaggaagtggctcttatggcctctgtggctacagaaaggcaaagaatgaacaacagggtcaaaggtcacagtcagaaatgccaggctaaactgatcaacaaggcaaggagagcctgaggcgtggaacagttaggtggggcaagcctgtgggtcagagtaggtgactgagaagcaggacccactgcaggaagagtcaagcaagagcgcagtcctggccaacagcctaaaggtgagctggtgtccctcgtgatgaacaaggccagagcagcgggacacctactgacccactgaagctcccttttctctctctgggtacatcccatgatgtatcctgccataaggatgtggcagagatcaaattcagtcctgtatgtggagtctaactgtcattattataattgttaaaactgcgatatgtgataataattgagaaatacatggacagataacttaaactcacacacacaaaaaacaaaacactgcaagatgagcatattttctttttttgtggcagaacaaaatagaatattttggggtgttattttctttaaatttagtctgctcttgttactttctaaccgaagtgtttaattagcctctgtaattgccgaacatttgtgatagttgtaatctgtgaacaaattattgactgttactgtagcaaattctggtaaattcacatatcaaaatttatatacatggaaaaattccaccagaaaagaattcgattttttaaaacctcaagtctcaaattatccagctattttgacagtttcagtgtcttgattaaatattttatgatgatctcacttcagataaaatgtaaaag

SEQ ID NO: 39984 - DNA, 1653 bp, Bovine  19866880561671
ctcctgcttggaaggtggactctttactactaagccagctgggcaccataggacagcactcagcctcagcccctcaaggagattgtgcgctctccagaggaggttaacaactcatttatcaaactgtaaagggaaggcttgtttctagttgttcataacatacagccaagactaatagagccttaaatacatatgggtttatttaattattatttattttataattattatcattttttgcttcatgcaggaagtccagagcaggtggtggttctgagacaagttatatctgagttcactttgaagttctcttcatctcctactttgtggtccctcagtggttgctgcagatcctgtcaacacatctctaacccaggtaagaagaaataggggaaggaggctggggtggtgcctgcatcagggaatcagagacttgctcagacactcctggaagtctgcttttatcactttgacttgaactgtgcccagggtgaaatttttagtggcttggtagtcagaaaaggtgaatttgagctttgcagcaccaatactcaaggaagaaaaggagctaaggttgaaatgaatttgagtgagccagcctacgttacttttcacagcagggttgttggaaaactttagttacccctccagtgccaagatctacagcagataccaaactattgcaggctcttggtgagaaagattatacctggagatggttatctggagagggagttacatgcattttccagttgactatgaaatctgaaagtgaaagtaaacagctgtgtcggatagcaaataaatttcaggattgactaacttccataattgatcctggatttctgtgagtagagtcacacatacagtcgtccatttaaatgatctttgaatctgaaaggatgagatgcttggcttcacttaggtccttaattaagcatcctgacacaaagcatagtcacttctgagtgagtcaggctgaccctcagctgtgcattttcctgtaactttgtaacagagcaggaccctttggggccctcccagccacactactccctgctctagctacccgctgaagtacccagataaaagtatctgatgcatgtcttcctgagttgtttcacggatgctgaaactctcaccaaatggaagatgttaactacttcatgaccgtgagaacgtagtccccagacccactggagcctgaggatgatgaagttagcccctgtgacaccatcttcttacctcaccatcaaccaaccagagcgctgtgcactagctgatcacacactttgcgatcacactcgtccacctggcctttgaaaatgcttcccagaaacccactgggagtttggggttttgagcactagctgccctggactccttgcttggtgcctgtaatgaacactgcactttccttcaccacaacccggggtcagtgggttgactttaccacttttaccgactcaagtttggtttagtgacaacttgggggtatcacccatgggattaattcttggatgaagaggaagatgtggactctcagattttgacatatctggaaatggttttaaaagggaagaaaaaagcagttaagtggccagaggaactggaacaattataaatgacagataatgtccttatagagcaatg

SEQ ID NO: 39985 - DNA, 824 bp, Bovine  19866880601442
ataaattgatctttggaatgagtaaaatcttcagtgcttctaaaatatcatttaagaagtcaaaaaaataaatgatattattctgagcaaatagtagactttatttatcaaccaaacctttctataactatctaatatccaagttatccaaagggagcaaatagttatgaatatcataggtaatataacgttctacttctaacagtctaaatccatatattaatcactaattggggcttctgtgtttatctgcattatctctgagttgtaggcaagaggaatgaggaaaactgatgtaaggagtgaggagaaaaaatttaaatactaagccattccgctaacaaaatgctcaagctgtctagcgtaatttgggtgcttggtgaatcactgcttagcaattcatgaacactgtgggtgcctggaattcaattctattgtcctcgagctgaattgctttgaaaaaggtcacatgagagggagaggaagttttgactttcacatgccagttattgctaaggaaaccacttcctcagtattcacagattcagcatgtctgcagttttggcttccatacggattacattttggtgccacattaagaaacaagggtggagagtattttaagaagtcaacttaactatgacatgttcacagaacaataagaggagccttctcagatgcctttcttttcagaagcactctaggtaagcctgggtgaagcttccaggatctgacaggatgtttgaggttcaaggagcacgcctgtgatggccaaaaccaaatgagaagtgagtacagctctgctgtgttttctgattggcaag

SEQ ID NO: 39986 - DNA, 1021 bp, Bovine  19866880718537
gaattgtgtacaggatgcaaaaattcacatccccagagtgttacaggatacacttactcactgggtctcgtcttcagacttctttttaaatattaaattcacagccacacagactaaaaaccaggtgacaactaaatgctgaccacagaaaaatcaccaaccgccggctgcgctgagaaacgcggcctctactgctcaggacacgtcacagcctcccctcccggggatacacaggcgtgggggccttctgataattcacggcaacgcggcgtcatcatgggaacccgcatcgcctggacttccaccgtcttggttccgggtgtcactcgcctcatccttctccgagggagatgcactctccttttgctcctcgggatgagtaactgtcttttctgcccgaggactggaattgtttgcaacctcatcctgccctgggtctccgggctgggcggcctcgctgcctggctcctcactgggcttgtccgtctcttctgactccttagaggccacttttttgtcttcagctgctttactgatcccatgcgcggctgaagaggcgtttttggagtctttgggttttttgtgcatagacatctgaccgtgctgccccgcggtgggcggcccggggggcttctgggctttgctgccctcgggctgtgccttcctcgggggtccccagataaaattctctgagggcgtgtaatgtttctgggcaaaccgtaggagctttctcctctcccttctgtctctgattgtgtacacgaaatactccaacgcgctctgtttaatattgggaatagtattttccaccagagcctcatgaaggataaattttacaagaggagatttaaaactttcatatccaagctcgccaaggcttttcagaatacgagtgatcctcaaatagttgtgctgagacctggaagcaggttgaataaaatgaaggaagaaaattaggtggggtaagaagcctgggaatgaaaactactgggaaagtacttttgatggaagtgtaaccatg

SEQ ID NO: 39987 - DNA, 3511 bp, Bovine  19866880762550
aattttcatatatgtcaccatccaatttccttgctttcaaccataatcagcacattctatttcttatttttctctttttatttcgaagtaattttgaactttacaaaatcatgtaagactagaagaaagaacacttttttccctttgggtcatttgtgagttgcatatctgataccctagaatactttggcatgcatttgttatatcctaaaacattctctaatattgtgatagtgcaaccattaaagtcaggaaatgaacatttattcattactactctctcattatcagacccaggtttcacaaaattattgcaataacatccttcatagcaaagaatccattctgagatcctgtctggtattcactgtcatgactctttaaaagactcttgctctttggaagaaaagttatgaccaacctagatagcatattaaaaagcagagacattactttgccaacaaaggtccgtctagtcaaagctatggtttttccagtagtcatgtatggatgtgaaagttggaccttaaagaaagctgagtgcagaagaattgatgcttctgaactgtggtgttggagaagactcttgagagtcccttggactgaaaggagatccaaccagtccatcctaaaggaaatcaaccctgaatattcactagaaggactgatgctgaagctgaaactcctatactttggccacttgatgtgaagaactgacattggaaaagaccttgatgctgggaaatattgaaggtgggaggagaaggggatgacagaggatgaagtggttggatagcatcaccaactcaatggacatgagtttgagtagactctgggagctggtgatggacaaagaggcctggcatgttgccttccatggggttgcaaagagtcagatacaactgagcgactgaactgaactgaaacagcaaggggtaagcacctcatatgaatatgaccataatcttcaaacattttacaagtaacatttagcttgaaaaatcaaatacacctgcttgaactaacagtagcaaagaaacacataatccaagagcctgacctgaatcataccaggcatgcaaaagttgcaatcttcacctagaccttatgatcttagttgcaaagaatcccaaactacaagcctatttttaaaagccggctcaaatgtgacaacagtggttttactcagaccagcatcattaagtaatattcaagtgtccttacacaggagagaaagtcttgaggctttggaaagtttcttaacagcctctttgagcatcccacccgctcacttaccaagaataaaaatatgttctgagttgtttccaaaatttaaaaagataccgtatataaagtgccaaactcagggcttggcccacagcaaaccctcactgagcaggaaagctactgcagttgtttccaacactgtaccttcactgtgttgaaggtcaaggacttactagtatcagataccgatcaatccatgataaaaatctctcctgaaatatttagataaggatcaaatatctaaggacatatcaacaaaaaataccagaaaaaaaactcaccatctcactgtgttggtagtgtagtcgctaagtcgtgtccgactcttgagactgggggactgtagcctgccaggctcctgtctatgggattcttcaggcacgaaaactggagagggttgccatttccttctccaggggatcttctcgaactagggatcaaacgcaggtctcctgcactgcagcagtctcctcgcactgcaggtagattctttactgactgagccaccgggacagcaccatcccattaattctttacttctattagatttaccataaaatggacggtaattacttaagaaatagtattcctaccaacgtgtaccacatggtgcccagaaaggggcagtgtaagcagatgccagagtcccatctttgcctgcacaccttcaggcctttgtcaattatggtgatcagtgagataccttgacgctacattcatccaccaaataccacataaagggtactactccaaatttcaagactgtcaagtaatttatcacctggtattcaagaaaagtccaaaaaaccaaatttaaaccaagccaatctccccttccccaccacccaacacatagacacacagtaaaacttccatccagaaaagggagtttcttcaatttgaggcattttatatgtcaacttagacttggggtgaagagcagaaaaaggaataaattaatacaactagcaagcagtggtaaccaccacatggaacacagactgtctgctctgtgggattcttccaccatgctctcttcctcagggttcagtcccatgccctcacttccagagaaggaaaaagcatttccaggattctgaataaaaccctcagaaagagcagaggcactgccccaggtaacatagctcacccaagcattcttccatcacctacacacgaaggggctctccagtctacactgcaccctctgctcttccagagtccagactcccgtctccagcttccagacgggcatctccacgcgtgtcccacagacccttcatgctgcccaagcagtgtctcaccgtcttccgcctgtaacctttgaaccttcatctggtactgaattccttcccccgatgagtaagtctacctcactcacagaaccttagccaagctagaaaacgtagggtcatctcagtatcttccgcagaaggcgagccaatgttaacctactccaaatgtccctggctcctcaactcctttccagtctccccagctccctcctgcccactctgaaccccactacataagtagtaccttcatcactgctcatttcagggctgcactaggattctgcatgaccccgctgactccacaacctcctccaacccctcttccacgtgatagaaggtgacgtttctaatgtttctcctgcctcacagcattgcaagcccttcaatcctttgggtcaattaaatgaggcactgctctatattccatttataggcagttctagatgccattgaaaacctttcacaatctggaataataatgagctgcctttgccacttgccccacaaaacttagatgttattacatcggaactttaaaatgtcaagtgtcctcacaccttcgtacttctactcacacaatttttatgcctgaaatacaccacccactcttaccctaggatcttgttataacaaaaataacctgggatatcagactgctaaatgtgtgggaaggaggcaggagaagcagaaacagaaaaggctaaacactaacttctggaatatacctcaacaggtttctacacaaatatgaaaaaaaaaaaaaaaatatatatatatatatataatggcctgtatctctgtgagaaagaacttttttcattgtatgatcacacaaattgttctagtacatggggagcacacagctgatctttaataaactacattatattgccaaaaatcacaaaaatcatcctggataaaattacgtg

SEQ ID NO: 39988 - DNA, 2440 bp, Bovine  19866880825667
aaatactactttttgaatagctaatacttgcacattttccacaattcaaaggtacaaaagggtacagcactgaaaacaaagcagtactttaaaaaaaccagaggtttaagacatgagccaaaatttgtacatactgaatacaaaataatgtttggtctatcatccttcctctctagctgctgctgctgctgctaagtcgcatcagtcatgtccgactctgtgcgaccccatagacggcaacctaccaggctcccccatccctgggattctccaggcaagaacactggagtgggttgccatctcctcctccaacgcatgaaagtgaaaagtgaaagtgaagtcgctcagtcgtgtccaaacctcagcgaccccatggactgcagccttccaggctcctccgtccatgggattttccaggcaagagtactggagttgggtgtcattgccttctccgtttctttctagaaaacctctttattctacaaacttccccttctttccccaaatcacatggttacagtgagaacaacctctttcatctgtgacccaggcccctggccactggttgacttagctgtggacaccagatgcaagctgggccagtgagctttcttcttaagaaatttgaaatgaagactaaaactgtattctcagtttggttattctcttgaactgagtagctgctgggagcagttaccttctgcccagtggactcagaagggagtatggagacagaaaacagctcagtaccaccagagacaagaggagggagactatctggtttccacagtgcttagccctgaggtcccagtcttccttcaacggccagcagcactactgcccttgagcctaacctgttccctgcaccttactaacaacacaccctaccttctgttaaggctgtttaaataggtttctgttatttgcatcaaaatagatcttaattcacatagtttttcatgtgaataatggaattgaatacatgagcaaacataatcaatcactgccaagggcctgtaaaactctttttaaaacccatacatattgatggtcaatacagcaattttattcattgttgaaatattctttattactgctaatgaagaattataaacagtaatatgtgtctttaatttttttctcagtaacagaaacactttctttgagacctcaaaaattgagaggagtttaactatactcacttgtcagtggttccttctctaaactggaatcttctggcgcatcaaaacgaccttctggtaactttggcttcttaagaggttgtttgctaggttcaggttttcctccttgagaacttattttcctcaaattacacagaaggggtgatcctggcagagggaagacagtgaaaaaacagaagctgttcatttattctactccaaaatttaatacttttaattacttgttttaaccttatacattcacatttatcaaaatttaaaaatacaaaaggaaatatagtgacaattcttccttttgcccctatctttcagacagccagtttccttctttggaggcaaccgatgctatcaatttgaaaagaagagctgtgaaataagctaatcactatcaaaattgtaaaaactattttgattcctatttgaaacaatgcccaaaataccaagaatcaggtcactaagagtaactaagtagtaggaacttttaaatgataatacttagtatttaaatttcaagatgtcacaaggaattgtatttaggactcttaaattctaataatggtcctctttttctgtaaattaaacatttttaaatgtaccaggcacctgttgttgctgttgctttagtcattaagtcatgtctgactcttgcgacccatagagtggagtctgccaggctcctatgtctatgggattctccaggcaagaatactggaatgggttgccattcccttctccagggggtcttcccaactcagggatcaaacccatgtctcctgcattggcaggtagattgtttaccaccaagcaacccactgggcacctgcaatgtataaatgtgatcactttctatgttacaatgagaaaggtaagttttcagaatattcattggaaggactgatgctgaagctgaaggtccaacagtttggccacctgatgggaaggaagtgactcattggaaaagaccctgatgctgggacagactgggggctggagaaggggacgacagaggatgagatggttggatggcatcaccgactcaatggacatgagtttgagtaaactccgggagctggtaatggacagggaggcctggtgtgctgcagtccatggattgtaaagagatggacacaactgagcgactgaaccacaacaaaagttttcagtattatggaagttatccaacccttattgagataaatcttcaatgagggcaaaaccactctgaaaaacaacctctg

SEQ ID NO: 39989 - DNA, 2174 bp, Bovine  19866880831828
aacatatttctgtatttctgtaaaggaaaaaaaaaaagctgtcatttggccaaagtgttgtccatcctgggcacctgaaccccctacctctgctcagctcctctgggtatttttgctgggtctccctagggccctcgccccgggggcctgggctccagaagcacctccgtttctgtttccatggggtctgtctgccaggatcagtagatgagcagcaccgattgtgcaggagtctcgggcccccacacccccagccactgcacacgcacagtcccaggctacccacctcccccagactctccgtgctgaattgggaccccaccctccagtgtgacttcactccctgacaccctttgtctcagggaagggtctctagaggctttacaggtggcactgatgaaactgctgaagatgtttaaaagaacaagtgtgtccatgtcttaggagtgagaacaagagggtataatgagtgttaagccgtgtcttttcctctcagctagaagcatctcctaggctcccaaaggcatgatcaattttactaacgatttgctctgacctactgaacagtcttctgcttaatactaataatgcacatttgcagaaggtttttaactttgcaaaaactccttggttcctgttactcatttaatcattgcaaacccacttgatagcacattgctttttaaaaatcacaaaaacggggattctgtggaattagtgacttaactaaagtttggggccgatcagtgacagggccaggtctttggagcctgtattttttttcccctgcctctgtcttaaaaaagaaattcactggcttaccagtgctgagttcattacctgaatctgttagaataatattggaaataaatttcaaaaatgctgcaaaaatatttatagctctcaaatctatggagatgccacaagaataaagtgggatcatagcagagtggaaatattaatagcatgagatttaggctctggcaaacctgtgccaatccttactactgtgtccaaagtattcaacaacccgagactgctttctcttttttaaataaatgtatttattttggttgtgtcaggtcttcatcgtgctgcacgggcttttctctggctgctgtgagtgggggcttctctacttgctgcatgtggacagcatgtggggtcttagttccctaaccaaggatcgaacccatgtcccctgaattgcaaggcagattctcaaccactggacccccagggaagttccctgctttctcgtatgtaaaatggaggtaatttctactgaatatgagtgggaggattagaaatctaacagatataaaagaatgcctgttagatttattggcacctaataaatactaccttttaccagctatttggatttatttttattaacatcaacatcattataattgaaaactatggaattaatacaattccaggataatctgtgagctcatgatgatgatgttagtaggtgaaactgtacaaaatacgagaaaactggcctttaatctggacatgtggtccagattggctgactggctcttagtaacagcttaatgtttttccatcctctggatactgcaaactattttattgtctgtaaaagtaagtttggccagagaaacaattattcccagaactctggaaactctagaagacacgggcaatttgttttgttaacaatctgccagtgatacaccgaactctgcctctgtttttcccccttgtccctgtcattgtcaattactttgcacgatatcaggatccggaaaacagttaatcaggttagattgctaggcagccttgagttggctttgctttaatcacaaaacatgctgctgcatccatcaatttcccttttatgtaagcttcttcattattgtgacatttcaccattgtccatggcaaacgtgtttgccgacttccatgtcacggaaaagaaacgtggtatgaacagaagaacccatggggaagggcagccaagacaaaggtgtggagtgaatttgaagatgtaacttagtgaaaagcccaactagtccaaatccgtgaagcccgtgtaaggaaatgtgacctgtcacgagacggtaacagcaacgcttgcattccaccagagcagaagtctgatgacgacatcaggaagcacctcagagctgggctggaggcat

SEQ ID NO: 39990 - DNA, 1961 bp, Bovine  19866880892635
actccacatcatccactccacacatgcactgagatcatcctctagcacttggcagtggcagctcactagttctgctactggctgtcatgctttcttttctggtaaagaaaaagcagtaaaaggaacacatgatatttcattctcatatttaaagaaatgtataaaaaattttaaagcagctttggtgagatataatttacatgttgtaaagttcatttattttaagtatgtaattcagtgatttttaatgtgttggcagacttctgcaactgtcactgctataaaatttcaggacacttctgtcatttcagaaagatccctcatgcctatttgcagtccccctggccccttactcattgttttgcaagttagtagtttggtttttactgtggaaaacatgtcttcatgaagcagcaaaaggtagttgatgctctggggtgaagagctgagggcttcacggtggtgcaggggaaagggcgctttgcttgttttggtttggtcccagctgtgtttggtgtgagtgcttcctttcggggcccctttactgctggccatgtccccccttccccaggagcccactgcctggtgctgccctgtgagccaccttcccgccccagagggttctgccccctgcctcgcctctgctcccccttgatcaaaattctctgtccattgcagtttccttcttcagcaaataaaaccaaaccaaatccagttcttactgcctgtaagcttaggtataatgaggaaagaaatgaacttataataatatgggaaggattgatacttctggagaggtgaagagattatttgcatctttaaatctgtattactagcttcaacagtaaatgacttagcatttcaaccggtgacagtggagagtaaaaccaggcatccagtggaaaggaattttgtttcgaagggtggaattatcgtggtaggagatgcagagtattcacaagtgtgttctggaatctgctcatggaatagtcttagctcgctctctcctctgattgctagatttggtttttttttttttttttttttgattctacatttctcagtccccaaaatacagtgtgggaatattatctacttcctatggcatctggtcccatcacttcaaggcgaatagatggggaaaaaatggaaacagtgacaaactttattttcttgggctccagaatcactgtggaccataactgcagccatgaaattaaaagatgcttgctccttggaagaaaacctagacagtgtattagcagagaaattgctttactgacaaaggtccatctagtcaaagccatggtttttccaggagtcatgtatggatgtgagagttggacgataaggaaggctgagtgccaaagaattgatgctttctaactgtggtgctgaagaaaactcttgagagtcccttgggcagcaaggagatccaacccgtcaatcctaaaggaaatcaaccctgaatatttattgaaaggactgatgttgaaactgaagctccaatactttggccacccgatgtgaagagctgactcatttgaaaagaccctgaagctgggaaagacagagggcaggaggagaaggggatgacagaagatgagatggttggataacatcactgactcaatggacatgaatttgagcaaactctgagagagagtagaggacagggaagcccggcgtcctgcagtccatggggtcaaaaagagtcagacacaactgagcgactgaacaaccacaaagaggaggtgagtcacaccataaggggtcacacggggtgggttaggaggcagaaggagtgagtagaaatgtggagcctacactttattgtggcttccacaagaaggacaggtgaggcaaggtaagcaggtagcaggtttaggattggctggtttgaataattccagcaggctctgagtctgaggggttgtcacctagcctggtacctgccctgg

SEQ ID NO: 39991 - DNA, 1163 bp, Bovine  19866880996981
aagttggaattggtgaatacatacagccgtgtcagatatttctacctgagggcttgacagaaagggtaacatttcagtttggtcttagattttagaaagcattatgaagaagtgagaataaggaaaaagtcctatgataaaagaaaaaagcatagaagcattaaagtatacacacatatgaataatttaatggccaactgtggtcttcagaaatctattaaattttgtgcttcagtttgtttatgcattggggatagtcatatttgcctttttaccatcctagaaaatggaatgtgttaagataatccattttcaagtacttcaaacacttcaaaggaaaggcatctaaaaatcagcatagttgaggtatcagatttttatgattcttactattatgattttattcactgtaataatataacataatcctcctggtcattgctatgaaaaatttgcaataaaagggtattgcaaatttttaataaatacttgttttattatccaggcttttattcataaggaaaatctattagaaaaccatacctactctaggttaaatgagaataatattacaatttttttttctggatgtttctgactgtgattgtagtgtctcacaataacatttaaagttaattttcaattttaatcatgattaatttggctctctcaaaatcaggctgtgtattattcaagtaacacttttcagtgtcatgaaaacaggagcacagctgtgtgttcaaaaataaacatttcagttgcagacacttgcaaatagttcagggtatgtgttaatatgacagtagtaatatttcaggtatttctgcttaccttgtgaaaaaaatagcatctaaaatgcaaggtaacaaagagaaaaaatgacaagtaatcttaaatgctcacatgaatacttggaaatgtcagatatttaatcattataatcttgaattccccatgttttatgtgaggagcattatagcttacataaaatgccatataaaattatacaggattatatccaaactttatattttattctaatgttcacatgggttaaataaaaatctacttgtttagacccacatgggagtaatctcacttttatttttgcagtttcaattttatagtttcatcaatcaaaaatagatttattttgaaaagga

SEQ ID NO: 39992 - DNA, 1400 bp, Bovine  19866881102790
catattttaattaaaaaaaaaccatatctatggcttttcagagtgataaaatctcttccattcaatttaacacaaactatacccaaatatcctctcctaaatttaaaactgtatgcatctcatttctaacatgtatccattgttttgtttttaattttgttcaaagccaatataattaagataaaaggattcatttgtcagttaagaatatatatcaatagattttaaataagctttaaaagccagtcttactcatcttattccttcaaatatagtgtgaatatgtgtgcctgtgaatgtgtgtgtgatgggatctggggacaggtgtgtaagttccacatttgtgtgttagaagtaaagttcatgaactccccctacattattggtaggactatgaattggtgcagctgcaatggagaacagtatggaggttccttcaaaaagtaagaatatagctaccaaatgaccctgcaatcccattcatgggcatatatctggagaaaaacgtgatctgaaaggctacatacaccccagtgttcgttgcaggactgtttacaatagccaagacatagaaacaagaaatttcattgacagaggtgtgaataaagaagagatggcacatatatgcaatggaatattactcagtccttaaaaagaacgaaataatgccatttgcagcaacatggagcaacctacagattgtcatactgggtgaaacaagtcacacagagaaggagaaatatcatataacatcctttatgtgtggaatacagaaagaagcacagatttagagaatgaacttatagctgctgtggtgaaggatgggcagagagggtagttatgaagtttgggatggagatgtacacaccactatatttaaaatggataaccaacaaagacctaccgtatagtacatggaactctgctcaatgttacgtagcaggctggatgaggggggaatttgcgggacaatggacacgtgtacatgtatggctgagtccatttgctgttcacctgaagctatcaaaatgtggggttgatataaatacatcagataaaggaaaataggacttgggtatttaagaatatatactgtcttatcatacctcttcttccaatgaattaacagaaaaacaaacaatttaacaaaagtgattgctgcctgtgttttatcacagcaccactttttcctaatatgctagccttggttttgcctaatgcattttcctcactccctttcatggcctcaaatgatgaaatctccttctgagaaaaggtaatgtggagaaaacggccttaaaattagctttccacaaaagatgacataaaatatcagtgcaaagaaagagataatagaagagctaaggaaagcatgtcaggttaggcattatgcagcattt

SEQ ID NO: 39993 - DNA, 900 bp, Bovine  19866881146816
gtgaggaaataccctactcatcagtgagggaagacgtggatgcagacagagctgtgcatgccgcctgtgacccagagaaggtcgtcagggacccgagcccacacacctgtcaccacccacgtctactcagtatgggactcgtctcatccactgcttcacatgaaggtgatctcaggaaacccctctggaaatgatttgcttaaacaaaaatacttaagatgttcataaatcaaatctctaataccaatctaaagtgataacctatatgttccaatcaagagctggatatcaatcaagaataggatataatatcttatacttaattatataaaaatactatgtaaatcatattaccagattcctattaaaaaccaggtggcgaggtggtaaagaacccacctgccaatgcaggagacatcagagacacaagttcaacccctgagtcaggaagatcccttggaggagacatggcaacccacttgagtactcttgcctggagactcccatggacagaggagcctggtgcgatacagcccatggagtcacaaaaagtcggacacgactgagcacagcacagcagcaacagagttaaaaacttaccacatataaagcacaggtcagggcaaatcaatctctattttttatgaacagtatgataaaattcacatgttcctaaatacaaagttaaaatataaactataaaaatgaaggaaaaaaaaatgagctgattcttttaaaacccaaaataaagcaatgttaaaggatactgatctgtctgtggtcttcgaaagttctctggaagattggcttcatatagtagtcttgctttagtatttcccatatcttgcatgcactgtaataaaaaaaaaatcaaatattttcattactcatataaacatt

SEQ ID NO: 39994 - DNA, 1142 bp, Bovine  19866881236343
atgggaggtgctgttaaaggtggttaatgagctttttgactgaggttcacataacagcaggttgaaaaagctagagatgcacacactgaggctatttatgaaaaaaattcacgagattataataaagtttaagtgtttgatcccagacctggttcctgccttccctctgccattctgttgtttttttatacaagaaggaaaatcatagggacctaattaaaaagtagaccaaagcaaaaccactgccatgaggttttccaggtaaagaaaagttaaagaaaaaatggggcctatttaaactaagacatactcatatgccaaagtttattttctgtcaaaaatcctcttagtcttattcaactcagaaaaatgaaagctgatgacctagatgtgaaaatttgtatattcttcaacttaatctcataagtcattcaactctaattcctttgtgaattcatataatccttcaccagtgaattaatggataatattcttctcagtcagttccttggagaatagatttttgtgtatatagttaaatccttgttaatgtctatgattataccatataaatgaatgtgtcaaagttatgcccttgaaatgtggaggaaaagttacaagattatcatttcagtgttcaatatagtctttcttggcaaagtgcagtgctgaactattctttcctatgaaaataatgagggatacaaatgagtgatgcagtgatactccatcaggctgttaggaattcaggttggtgggcaaagaaaccttcaaaagcctaacgactgtcattcttttctgacatttctccattttaagaaatagactacagcaaaatgaagagaacctaccctgaaaggactgagtcacagcctggactatttcacattgatgcaatttaaaattagagctgaaaatctctaattaatggggtaacaggatacaagccccaggaggccctgcactgtgtaacatggcccagcatctcagccgtacaaagcataaagcatcagcccatttgtacctgagctcccatgcattttggctttgtatttcggctccaggttctttgaggatggaacttcagtgccaagtgtttgatctggaagactcgggctagaatataactaaacagcaccttt

SEQ ID NO: 39995 - DNA, 3078 bp, Bovine  19866881248590
cccttaacctaaatattttttctgagcatcgttttctagcatctgtaatggagaaattataataagagatcaatttgccgatatctgttagatcatagaaaaagcaagagaatttcagaaaaacatctacttctgcttcattgactacactaaggcctttgtatggatcaaaacaaactggaaaattcttccagagatgggagaataccaaaccaccttacttgcctcctgagaaacctgtatgcaggtcaagaagcaataattagaaccggacatggaacaacagactggttccaaattgggaaaggagtacatcaaggctgtatattgtcaccttgcttatttaacttatatgcagaatacatcatgcgaaatgttgggctggatgaagcacaagatggaatcaaaactgtcaggagaaatatcaataacctcagatatgcagatgacaacacccttatggcagaaagtgaagaggaactaaagaaccttttgatcaaagtgaaagaggagagtgaaatagttggcttaaaactcaacattcaaaaaactaagatcatggcatctggtcccatcacttcatagtaaatagatgggaaaacaatggaaacagtgacaaactttattttcttgggctccaaagtcactgcagatgatgcctgcaaccataaattaaaagacgcttgctccttggaagaaaagctatgacaaacctgtgtggtagtagttcagtcatgtctgactgtttgcgatcccattgattgtagctcaccaggctcctctgttcatggaattcaccaaataagaatattggagtgggttgccattccttcctccagggatcttcacaacccagggatcgaacctgggtctcccacattgcaggaagattctttacagtctgaagcaccagggaagactggactttcctttttgcttccctcaatcatgtctttttaggaataaagttttaaattttgatgagagtttttaatcaattttttcttttataggtcatgtttatttaagaaatctttgacacaagtcacaaaatattttcttttgttttcttctaaatgcttatggttttgcttcttatattttggtctattgtccatttttgagttaatttttatagatgtaatgtatggattgaggctaatttaaaaaataaagatatttaatttttccagtgtaattcaaagactattttcccctgtggatttaccttggcttgagaaaggacttggcatattccacaaatagaaaggaggtcagtgtggcctgaatagagaagaggagagcagtgtataatggcattgcagagaaaagcagcggcgaaacttgtaaggtcttaagggccttgataagaaacttggattttattctcaaagcagtaccattgcctcaagcattataagcaagagtgctgggtgatctgattcatattctaaaatgaaaattcttcatctgtctgtgcaaatccatcgaaaccactctgaacaaggtcactactgaccatgcaatagtatgctgagtttgatgaagttttattgtttattcagtggggttaaatttggcccatagctcagcagttcttagactgcccaccagcaccagttgcctttgtaggagtctgtataaaaccagagctaatgcacttttttgaatgccagctgatatgctgctactgctagggaatttctgccaaggatattaaagacgctacctggtgctttatgtcctttggcttctcttcgttttgctatttctttatcgccaaggtaaacactgtgctaatgccaataggaaaaagctgaagaagactttttggctattagagattgcctatcccttggcaattattaccagcttaaagtatgtgaaattaactaaacatgaagaatctagaatagcatttgtataataataaaatttatgaggcactgtgatcatcctccattggacttgaaaatgattaaattagcttaaataaaaagagactttgatacagaaaactttttttctgtattagagctgattatgagagaaactgtagatatctctcataatagaatgggtttgttttgggaaaattttgttgaagaatggttaaccagttaagctatatctagattatcttttcaactcaattctaaaaggctctttatttaaatatgtatctgtgtttaaactatagcagtttaagtagatgatttacctttcagaaaattttgtatattgaagttgagatgaagaaatgaaagttaaatcaagttgtataaataggttattcttttttcttctactgtatgaattctacatgattaatatcacaagttgggctgatcagttcagcatttgcatcataattacataatttgtctaacattatgagaattctggctagaaggaaggacattttattcaataaaatattgctactagtcttaataaccccaacattccttaattttgtttttttgatatgatctctacaataattcaatttttatattgaagatttttaaatctttaaatgtagaatttagttttagtcttctaaggttttaacatttactgagatagccttgctaaaatggagttgagaaattttgtaatttacagagatgtagagaaactcccacttctgttggactagatattgtgaaaattctctcactaatggcctctggaaattatgagatggatatcttcaaattaaaaatggaaattagagtggtaagttagcatggaggccctgatttccctggcagcatctacaataccagaaacgcagactggattttgataacctcataaagggaacaggagacaaaaatctttgcctaggaaaatgggcaaagaactaagaatcatgcataaagccagcatgctcaaaaggctaggccttcagtgaaagactgagctgggggaaaaaaagtctgtctcggtaaagggattcaaaaggatacttttacattcttagtctttggtttcgggggaaaaagcctcccctaaaatgattaccagcctatctctacagatatttcaacacaggtacagtttagaatcacc

SEQ ID NO: 39996 - DNA, 1544 bp, Bovine  19866881429008
tgtaaagggagaattttcaagatttagtggctgctccagtttgacttggtaggaataggagttgtgtcactaagcggctgggcaggggtgatgtttgaagcaggcagggctgggagccagtcaggtgccgtgcaccagagagcatgctgatccccagttgcttacagagctgcctgtaattactcaaagtggccttacttccccagaaaattgtcatctgctcaaagaatgagagcagaactgctgagaaggtacttgccgccaggggagacagccgccaacggttcatgattaattgatgtgaacatacaaaacgcagtccctctggtctcaaggtgggatcaactcatcggtacaacttatgcttcagagttccccccaggtcaggttgaagctgggcttccggctgggaccacagccttatccagtagctgcttcctccactgtctcttgcttcccatattcttcttctccaaagatactctctccataggttatgacccataatctcagcaaattatgcacttcttgggaacccagcttcagatagtgcttaagacaatataatgcaggttaaaactgggaagtggctcatggtgggggataagacctagggcacagccccacgagtctttcacagccatggttttctctctggctggactccgcagcctgacacacacaaaatgagcagcacagtttattttgttcatcgaatgaatttgatttgaggtctaatgagttggaggagacagcaggatatccaggataagctatagaacgaggtgccacaaagtggttatggctgcacatttagatttttcccagcgagagagagaattcaggaaagaggcggtaattagtgtcaagtgcgaatgaagtcttcagtcttttcagtgtaaagcagccagcatttgtctttaccttagttagatacataactccaattagtctagatcaatggttttacattcctttagtaatgtttaggcaaaattccagttggtgagttttgctcaatgctagcaagtaggtctagtaaaaaagagtaacgtctaattggggaaaaagttatggattctgtttctgtcttctgtttttattgtcaaacaattgagtgagccacttgatattcttttagaacaagagtgtgcaaaattaataaaataacaaaataaagtaaaatatacttatgaagagattcatgcctatctctcttcattgcactgattttttttttttaaagtagacatttaaacaaaccagacaaaagcattccactgtccccaaagagcacactatcttttcaaatatggttctccagtatcttgaggtaagtggttttgaatgctttaaatcttggttgtcttatttcattccataaactgtaattatagctctttataacatgctaaataattcctcccctactggatgtttttacctttcaaatatttatagagtgtcatcattccttagtcatctctttacaaagtggggcctatttttttcttataatatttttcataaatcaatttcctcaa

SEQ ID NO: 39997 - DNA, 1164 bp, Bovine  19866881500277
ctgtcaaagaataaaagtaggcaatctataattcattaaacaaactttcctaataaacaagaacacaggtttacttagacaaagcaattttataaaatgtaatttccttagattcatactgagcaaatgtctcattcaaatgattaaaatctgtattagcagaggaatctgtattcacaaaggcctcacccggctgatcttgtgtagttcataaagccaccccatagaagggaactgagccaaaaccacgtggttcccagctcctacactcaccaccattcctaccctacgacacaacaggagcaagagctcagcctctggaaggcgatgcactctgcttggttgagcaactaacgtaaatagtagtgtcaatacataagaatagggaagctatacaactttttaaggtctagatgtaattattagaattcttctttaaaaatgattatctccaatcatgccttagctagtctgtctataatcagtgtcctttaacattcacagactcacacaggtagatgagacaacacaccctgtttaacactctcattttaaagtgatacacaggcagtggtatttaccttgcggtctgcagggaagacaggaaggcgtatgaaagtaggaactgaaaggcacctgaggaagaaaagcaagtatgggaaagacagcgggcctacccgcctaacccggaggccgagtgtatggaggcgacaaaaggcgaaactgaaaacgtggggctgtactgtgcaaggacctgaacaacccacgagagctaggaactagatgaattttccaggtgagctgcaaaagcaaagctactcctggggtggtgtgccaggcataggaacagccctgctaaaggagaagatgaccaccaccaccttgggcaagggctgtgtggctgagacacagacagaccaacgcctgggaagacagccccgaacctgccacctccccatagcccgaaacctgaacattccctacctaacaagctgctcaacaacaggccgttcccagaatactctctcatctcagagccttacgaaatcccaacagcgggatttaagctttacttcaattcttagtaaaaatttatgaatggtaagctactccaagctgttggattgtatgacatcatatactccaaagcagaaacagaattca

SEQ ID NO: 39998 - DNA, 1278 bp, Bovine  19866881525763
actcttgagagtcccttggactgcaaggagatccgtcgtccatcctaaaggagatctttcctgggtgttcgttggaaggactgatgctaaagctgaaactccaatatttttgccacctcatgcgaagagctgactccttggaaaagaccctgatgctaggaaaaattgaagggaggcggagaaggggacgacagaagatgagatggttggatggcatcactgactcgacgtgctagacagggaagctctgggagttcgtggtagacagggaagactggtgtgccgtagtgcatcgggtcacagagtcagacacaactgagtgattgaactgaactgaattgctagaatagcatgggattttaaattttctagtatgggggtattatttagttagtcataaattttacttttaacattttagtatgtttaactggaaataaaattatggctgctaaaatatattttttgaaatcaactattttgccctctcaaaccgggtagttcatatatgacaatgttataaaagttttctataaaaagttattattactgttgctagtaaacatctgccatgcctattaaaatatattttctacaggtgatttcaacattatttctcatattgacttttattactggaacttttcatgttcatgttagcagcatctagagattttttgaatgtttgaatgccctctgccttggtttggttggaattttgctaaatttggtaatgttgcttgaactttctgagtacatttctttaactttttcatggacttccttgtatgtacataataattaagtgttgaaatttatgaaatgcttttatgaatttagataatttttaaatattgctaaaatttgttgaactaaagagtaatgtaaatacaataattcatggaacaaaataattaactttacatgtttggtgacacagatgcaaatgttttgatatatggagatgttaagtctcttgactttactcaaggtgctgaatagcattaaattcactattttcctttcctgttttacttgtgaaaataacaatgcactaaggataatagaaggtctatttgcatttaccagttgtgatagaaggcttttgtaaatacgtattgtaaaattgatgcatgtttatttttagcattgtgttattgcctctgctgctaataaatgaacaaatgactatctggaggacagctaaaacactcacttattttcagaatactagaggtgtatttttatttagtaattggagtagactgtattaattaa

SEQ ID NO: 39999 - DNA, 702 bp, Bovine  19866881771934
tgactggatttcttctcccttccactgtctgtcggtgattacagaattgcatattttgttagactgtgacaaaccgcttcaaaagtaatgggaaaaaaaaaaagcaaacagaaactactttattaatattttcctaagaaaccttagaatgagaacctggccacttcctcaactgatattgtgctttctcatttacacagaaagctatcattattttccagctgacatgtttgatttatggttcctaatatctttcaagtaatgtacttggtaattgtagtcactctattgattttcataaaacttctttgttctctgtgaagccacatctgaagctggtgatttacatgccctccatccccagctgctgttgagggcgtgggtaaagtaaatattcgaacagggcttccccccagctctggacatcatttgccctgggaccaaatctttcaattccctaatgaatctatccattcacaactgtgtattgctaaccaattcacacagccttgtgtgttcaaacaaagaggtgcaccaataaaaataatcaagtggagccaagaaggaattaacttaccttcagagcaatacaggtagttattaactgttattttgggaaagaaaggtcaaaactgctaaggaagagaatactaggaacagaccctgatgtttcatctctctctgctagaagccatagtcctt

SEQ ID NO: 40000 - DNA, 1308 bp, Bovine  19866882059807
taccaagaaaacattaccagacatgctaaaaggcaaaaacaaaaaaaaccatagtttgtaaagacagagcaaacatcaaaaccagactcagatatagcagtcatgttgaaattatcataccaggaatttaaaacaactagtattaatgtgctaagggccgctgctgctgctaagttatttcagtcgtgtctgactctgtgcgaccccatagatagcagcccaccaggctcctccatccctgggattctccaggaagaacagtggagtgggttgccattgccttctgcaaatatactaagggtgctaactgataatgtagacagaaagcagggacagatgggaaacgaaacagatgagaaatgaaaagtctaagaaagaaccaaaagaaatgctggaaataaaaaacaggaacagaagcgaagaatgcctgcaatgggctcattagtagaccagactcagttgaggaaagaatctctaagcttgaggatacagcaatagaaacttccaaaactgaaaagcaaagagaacaaagactgagaaccagaacagaatatccagatcgtgagacaactacaaaagctgtaagatacacatcatgggaataccagaaggagaggaaagagatgaaagggacagaagaaacgaatgagaaatgactgagaacttcccctgcattaatgtcagacgccaaaccacagatccaggaagctcttagaacatgccagataaattaaacacacacatagaaaacaaacaaacaaaaaactacacttaggcatatcattttaacgctgtagaaaatcaaaggtaaagaaaaaaatcctgaaaaaaagagagagaaaaaatattacctgcagaggaacaaagataaaaattacatccaactgctcctcagaaaccatgcaagcaaaaagagagcagagtgaaatatttaaagtgctgacagagaaaaagcaccaaactagaattctgtactctgcaaaataatctatcagaaataaaggagaaatgaagactttctcagacaaacaaaaattaagagaatttgttgccagtaggtttctatggaagacgtgttaaaagttctttagagagaaggaaaattatataggaaagaaactcagatctacataaagaaataaagagcattggagaaagaataattgaaagtaagataaaaactttttaaaaaaactcaattgagctaacagacagtggtttgtacgaaataataacagcaacaatgtatttgttacctatatatatggcttaggtataaatgaaataaatgacagcaatgataagagg

SEQ ID NO: 40001 - DNA, 2237 bp, Bovine  19866880291279
ccttggaattcgtgaagttgcttaccgttgaccaacccaaccccagccgaggctgagggaacccagtctgtgagttccagtcttctggtacacatagcacacagcgatagttatgtgtacagagcatgcacaatagtcaatttttcaggacgtgttgttggaaaaattcagtactggttagcctagggacttgtgaagaaagtggagccagacctaattgtcaagaccagccagaaaagtagtacatctctatttagggaggtaggagtactggcagaggcagcaattctctcctatcctctgtgccatcactaaagttggtgctgaaatgcattccctgggtctctagagacaggaactaacagtaggggtagggtcactccagggcattgctgatttgctccatagtagagacaacctactcctctcactggtcagtagcatctttttccagtctatttgtgttcctctgttcactgtgggtgctgctgtaacaaacagattgagcttattagacggttctcatttaaaattaatctaactttgaccttctcagcaccaaagttctggtctttattcttctaagcaccaaagttctggtctttattattatgatttactaaaaaaaaaaaaaaaaaaagccttatcttacttgagataaatgctccaagtggtgttatcagaatgtcttccatctccctggtattgattagccagtatgtagcagggctctggtaactggatctgaggacttgtttttgcatttttaatcctctcagctttgaatctgttcagttactactcagttcgtggtttgggaggaaatataattaagacagttagctagctattcaattcaaaaacacacaacccatgtgatgtgtcatcatcttataatcagtaatcccatgtggggaaaactatttccactccttgcatgtaaaaaataatttaacctttgatgttaaaacacgtggcataacacagaaagcatctgcaatgaatgaaagatactttcaataaagcataatttacacacaaaaaagaaagcctcaccatagtaggaagcagcaggaagatggactggacaggagtgtacaataggaggactcctctggtggctttgaggaagctcacaggttgctcagtggtaaagaatctgcctattgtgtaggagatgcaggttcgatccctgggtgaagaagatcccttggaggaggaaatggcaactcactccagtgttcttgcctggggaatcccatggacagaggagccttgggtctacagtccatggggtcacaaagggttggacaagactgactgaatgtgaatggctcaggtgcctttgtccctggggtgaggatgtagatctaaatattatttatttcatgaattttttgtggggggaggtcccaaggcggcagaggaataggccagggagaccactttattccccccaaattcatcaaaagatcatttgaatgttgagcaacttctacaaaacaacttctgaatgctggtagaggacaccaggcacccagaaaggcagcccaatcttttcaaaaggaggtaggacaaaatataaaagacaaaaacagaaacaaaggatttaggaacagagacccatcctggggagagaggggtgaagaaggagaagtttacacacaacagaaaaccctctcatgggcacgtcagtggggagctttgggatctcagagggtaacataactgggaaaaaaaaaaaaagcccatagaatacatgcctaaccacgaatatttgtggagaagcagctcagaagttcacatctggcagcagtgagtggggcctgggcagggaagcatgggctgattcatcggtccttagggtaaggaccagacttgaatgacctgaggacaatctgagggagttaatgcgacataaaaacccaaaccttgggattgcgaatgagccaagaaaaaaaaaaaaaaacgacaactttcctacgaaaggctctaatgccatacggtgacccctggcatgctcagagaacaaagggttgtgccctagagaacaagcccgttgctgtttagggccttccctccccagagccagagaggcagctgtgtgacagccagagccagagggcaaggggctgctgccctcttggccccagagactgcagcttccaccaaactgtgagcaggctcccagttgctaaccgtgtcttcctgggatcctggcagttcacatctgccag

SEQ ID NO: 40002 - DNA, 1145 bp, Bovine  19866880438075
aatcagtgtgctgcacttctggcatcctgcttccttgttgtcttcctgttgaagcctctcccgtcctggaggattgccccccttagtgcatctggggttctttggtgcttcctgatggcacagtctttgctacctatgtcccagtgctgcaatcaaatagcctctgacttggagcatcagattgtacattgatcaaaaatgcttccagtgtcttacaaaggcgcccaagtcactggtctataagtctgtgtataattcagacatacatgtgtatggtaacaacttttaaatgaacttgacttcatattgttttgcatcttgctttttacctaacagatcatgagcattttctatgtcattaatattttttaaaaacatctaatagctgcataatttatttaactattttcctcttgactgtttagatcatttccagtttcggctcagaaataatattgtggtgaatatttctgtattggaattggtttgttgggttaaatgaggcagaggaggcataaatagaaatgaatggcacaaagaagacctacatttgagtcttagagcaccagtgtatcctactcacatgtggtgtagtctctcagtatcgtttctggagagaccggaggcatggctcccaatgttggtactaatggcgtaatagataacactttagttactgtttctctgtcttatctgaaaaagaatgtgttgaaagtcgtggggcaggcagaagcagacatttagaatttgtgccggcagccatgtctgtctcttttttttaaagatttatttatttttggctgctctaggtttttgttgctgtgagtgttctttctctagttgcactgtgtgggcttctcgttgcagggcttcttttgttgcggagcatgggctcttaggttctggagttgtggcacaccggcttagttgctatgcaccatgtgggattttcccagaccagggatcgaacctgtattccctgcagattcttaaccagtggagcactagagaagcccctcaggagggcaagcatgtcttgactgggttttgactttgtttttaaagattttcaactttgtttactttttaatatgtatgtatatttattatttaaagagatgggaataccagaacatgttacctgc

SEQ ID NO: 40003 - DNA, 1414 bp, Bovine  19866880439511
atcacacttaattcaaatttattccccagcaacatgacaaatgctctagtgccttgctgtgtgaggccatggtccaattctcaacagcagtcctcaggaatggcttacaaagagcagaaaatgctccttgggtcctgtgccattaaagggtggctccactaagttctttacttctcaggctatcacgttgggaaagagaaattcctagagttgtgaggcaaacaaatatcaaaactgctctctctttcagtgaattgaaagccagaggtgaaatcttgtatgattcaaactggagctcattggaattcaccaaaacctgggcgagttccctagagaccgacaaaagcctaatagtgttatttgtttgtgaagcgggggaaactgcaaatccattccacctgcccacccacattaatatcattttctggtctgggaagttaacgaggggagggatttcctacaacactctggcagtagggcatccacatgagggtgggataccccctccaacctgcaggttacctattttttttttttttttaagattgttggtcaagtagcctatcgtgatttaacttttccagctttaatgaaacatttttagtttcacttactagttcacgcagtcagctagcacttattgtctactaaggcaaggttataaatgaatacagcaagctgtgatggggtttgtagtctagtggggcaagtgtagacaacacacaaagaaacagacacataagaaaaaaaaaatagatggtaatgaaagctatgccgagattaaagtacattgatttgatcaggaggcatctcagagcaggttacctgtaagcttagacatgacaggagggaatcaaccagatggaaaggacaggggaaacatcccaggcagaaggagactggagccaggtcaaggctagctcccctgagggagaggactcagcagtgtgggaggagggggcagctggagatgagatcacatgggcttcccgggatctctgggggcctccgggccccggcaaaggaaagagcttgggatcttactcaaggtacaatgggaaaaccctggagggttttaagcaggaggtattgaagatcccccggagaaggaaatggcaacccactccagtgttcttgcctggagaatcgcatggacgggggagcctggtgggctagagttcacggggtcgcaaagagtcggacactactgagcgacttcacttcacttcacttcattgtgatccaatttacattagaaataaattactctggattggcctataacagggcaaagggggagggagggacaccagtgagaggctgctgtgtttgtcaaggtgaaagacggtggtggttctgaccagggcacagtactggggatcgaggaagtcgacaagactcgggaaatgctttt

SEQ ID NO: 40004 - DNA, 1628 bp, Bovine  19866880457325
ccgggttgctgtttgtcctgacacggcattcttaaggaattaggatattaaagatgtaataaccatttgatatatgcagtaaaaatatttcgattatggcatttctgaaaagtgctgtcttcatctgttacaggaatttaccaagtgtcttttaattaagtcggttctaaatgagacacctccttggtgcggtaattttctgaatgaagctaccctgaagtactaattagtttgtttttaatgcttaatctactctgccaacgtggtggttagggtggggttgacctgctgaaactggatgaggcgtcacctgcagcagctatggtctctcctggctggagacacggagggatttcatctcacgccagatcaacttctaaactgccggctgaactgaccatgggctttaaatctacctggaaatgctcagccacagcccctgctcctgattaacccaaagaaaccactcactcagtacaggaagagggggtgagctgccttgggtgggtgtggccgccccatcaccagaggtgtcaagccaagggcatctgggtgtttgggtagaaaagtgggctggctgatctcagaggtttctttctgtctaccgtcccactcatggttctttattattcattcttaggtcactgactgaacatctattaagtccctcttgtgtgcatataaatgaagagcaaagaggggcaggaccctgtggtggagggacccacagagcaactgcatgtggtggtggagggggtagaaatccagtgtgaagaggccacaaaggagatgggcaggggcctttgggacagcgggtggaggagtcacatggaggctgggagggtagacataggaagttgtttaggaatgggagttacacccagatgtggcacctactgggcgatttgaccagagggaaggcagagcctgcctgggaagagctttcagtcctgggagagacaggagaaatctcttcccccatctcacatgcatgcacatgtatatacacacatgctcattcaagtcctcatggcacaaaaggacactgcttatttttttttaaattgttttttctttttacttgaaagtaaaggcaaggagatccgaccagtccattctgaaggagatcagccctgggatttctttggaaggaatgatgctaaagctcaaactccagtactttggccacctcatgcgaagagttgactcattggaaaagactctgatgctgggagggattgggggcaggagaaggggacgacagaggatgagatggctggatggcatcactgactcgatggatgtgagtctgagtgaattccaggagctggtgatggacagggaggcctggtgtgctgtgattcatggggtcgcaaagagtcggacatgactgagcgactgaactgaactgaactgaaaggcacaccaggaaaaaaaaaaaatcacacaacatagcaacatatagatgaaaaagtgaaagtctcctattatctcaattatcagccccctcccagagaaaaccaccactgatcttcttccagacctttccctctgtacctatgtatgtttatgtgcgcatgcacacacacacacacatggctgtttgtttaatgagattatattaaaca

SEQ ID NO: 40005 - DNA, 1528 bp, Bovine  19866880467682
gagccatgctcacgctgtccccagccctccacatggcaccccttttctcatccttaggccctgctcagggtccgctccctctaagttggtttctctcactcatgattttcttgtcctgtacctattcattttctccacaaccctatcccaattcttatttacatacaaatgttttttatcgtgatgttttatttactagtctattgataggtggtacgctggaccccaggtacccaaagggcaggaatcatgctggtttatttcttccagtacatactcagccttcatggtgtccggggcagttgtgctcagcaaagttttgatgtgcagatgagggaacaagggagcagatgctcagcatgagtgggtctcaacccagcatttgggttgtgggttgatgtcttctccatcgactgatctttttggcagacctcctgactcatctgtaatccgtaggtgacgctctggagcagtgacacccacgtgaccctgaggaggtaatgagctagaggggtgagtccggcttctggttcatgaggacagaaagtaattgctttatcttcaatttccagtaggaggagttgctaaagggctgagaagtgtgatgcctgtcctttccatgggaaaggaaatcggcatgcctttcccatgctgaggcacctgcctgagacaggacaggcagattgctccataaatgatggacccagaagcagtgtgccaggcgcaggctgtgcggtatggaggctgttccctatgagtgccccattctgaaggcaattagtctaattgcttttgttatttcagaaaacaaattaagccacccgagtgtttcagggcagaaaaacgtctgcagtgtataagaaacgtttcaggagcgtttagttcacagccagcagtgtctgagcagacgggcaccagggaggcctaagggaccaggcgctgaggaggttgggaccttcgtgggcaagcagtgtgccgcgtgggaagaggtcaggggagtctctactctgctagctgtctctgtcctcagggtcctgtcgaggcaagggagccatcctggactcctgccccctgccctgtgcccccaacaaggtctgtggatgctgtgtcctctcgcccatccctgtcatcactgtgggcccaggcccaccctttgcagtcaggatcactagagtcgctgccaagtaagtctccctgcctgcttcccagccgtcacactcacagctaccaagggggctgcctgaaacacaagtggcacaaacacttctgaacagctttgtggggattcccaggtggtgcagtggtggagaatccgcttgccaaagcaggagatgcaagagacgcaggttcgatccctgggttgggaagatgccctggagaaggaaatggcaacccactccagtattcttgcctggagaatcccatggacagaggagcctaatgggctatagtccatggggtcacaaagagttgaacatgactgagcacacaaacagctttgtggcttcttataggacaccaggcaacc

SEQ ID NO: 40006 - DNA, 893 bp, Bovine  19866880536919
tttttggctgtgctagtcttggatgctgcgcatgggctttctctagttgcagcgagctggggctactctctaactgtggtgtgcgggcttctcttactgtggcgcacaggctctagagcacaggcaggcttcggtagctgcggcacatgggcttagttgcctgtggcatatagcgtcttcccgcagcagggactgaacccgtgtctcctgcactggcaggcagacttttaaccactgcggaagtcctgttcctagctttataaaaaggatgtcatgttgtatgtaatctttcaggacttttttctccacttaatattactttgctaaaaaatccatctgtatcattacattccactgtagttcattttggctggtgtaaaataccccagtgcataaatacaccagagttcaccactcactctccggctcatgggcaagtacattgttgctaagatttaggtcttgttcacattgctgctgtgaacataactgtaaatgtcccctgcggtacttgtacaagagtttgtctgtggaaccagtttatactgcctccagctgtagatgagagagcctctggatctacatcctttgctatatcatggatccgtcttgtcagattgctttccagttggctgggtcaatctacctccttctagtaatatataagaatgccatttccccaaactctttctgaccctagagatcaagtttttgaccatttaacaggaagaaaagaaaagaaaatctccctactgtttaactctgtggcaaggtactgattccactaaaagctgagagagaagggatttggctcagagaactgtttccagcctgataacttcagtgacatttctgggactgaatccccagtggctcagctgctttcccatgtc

SEQ ID NO: 40007 - DNA, 1188 bp, Bovine  19866880591496
tttacaacaataacatttttcatgggtaaggtgggttttttttttcctttggtcactgcaggaaatgaaatgcaaattaacaactgtaaagattataacataatgaaataggacataaatgatgaactaatgaattaagtgactccaaggcatggaggaacaaaatgctcttcaaaagcaaacaagtagatggagcaagagattagtaatctggggagagggccgcccagcccagggcctgaatttgcccctcccaggggatggtctctctcaatactttatcagactcaatggctctcctctgtccagccagttgctttagccaaaacaaaacaaaacaggaatcctccttgacaccactctctgcacatcccgtcaagtcaatgtgtcacgattcttaaagatttccacttcccttgaaccagcgccctgcctattcctgagttcaggagcccattcccctaatacccctccccacccttccgggtgcctcagcccctccagttcacctctctcagtcactggtgcaaagtataagtacgtgcctgtcattcctccttttaaaaaaaaattaatcaataaagtgaaggacagggaagcctggcacgctgctgttcatggggttgcaaagagtcagacgtgactgagcgactgaaaaatgacaacaaatcaataaagcaaataataagaaaaataatactttcaaataataaaaagcaaagcaaataataaatcaccaaacaataaatatcctctccagtgattctccattgctttctccttagtctctctttgttcagcctcagataaaggaaactactgaaagacgtccctatgaaagaaggctcagtgccccatggaacaggtgtgcaacactgggaaagaggagcctcagaatggcagcgggaggtgttctccacatggacagtatcagaagaggggtgcatcactgctttagtcaaaactttttggttgcaaattcagaaatccagttcaaagtgacttaacaaagatgggaaactaaaagtcgagggatttcgggcacggtgggatccagggcagagatgatgccttcagggctctgtctcccaccatgtctcctcggttttgattctgtgctggctgttcactcttatgggtaaaatgtcctctaacagctccagctaagaaccatgaggcaaaagagag

SEQ ID NO: 40008 - DNA, 2800 bp, Bovine  19866880635250
gccccgtttcccttctctttaatctaggggctcttgggactgggcagaggtgaaggtgaagaaggggttcctgcaaggcactgggcagggtggaggtctcaagcagtccttcccctactgccctgagcccatggcatcctcctcctcagccgctactgtgcagccccaggaaggaggcacaatgcctgattgcctgtagtccccaatcaaccctcactgtctcccactgcggtcactaggcttgatgcagagcttcagagagggagagggggcccagggtagggcaggcagcaggtaggaaagcataggccctgagcctggcatgtagcttctctcaaaagactgtattcgaggacccagccatcagatctggttctgattccactaacttttcacattcaaattaaacagtgagtctgctttcctctgaagaaggaaatggcagcccactccagtattcttgcctagagaatcatgtggacagaggagcctggtgggctgctatccatggggtcgcaccgaattggacacaactgaagtgacttagcatgcatgcatgcatgcattggagaaggaaatggcaactccagtattcttgcctggagaatcccagggacagaggagcctggtgagctgctgtctatagggtcgcacagagctggacacgactgaaatgacttagcagcagcagcggctttcctctgacatggacgcaccatccacctttaaaactcagagaaagggaggggcaggtgccacctcctaaggcctcaccgctgagatcactccaaggggggtgttcaggtgtggtgcaggtgtgcaccctcagatcaccaccccgcaagccacagaggccttccgtgaaggttcagcctcaccccagtcacctgtgggtggctgccacctcattggctctgcctgccctggtgtctggcacagctctggggcacactgtgtcagccaggcccttctgtccagggatacctggggaccaagtacaccccgtagcagcccagtcagccccacctggagagtatctaagacaccagctcgtggggccagacagctccctcccaggggagatcagcacgtgtgctgggggccgggtcggggggacggaatgcgccatgctggggttttcttcccctagacctgtgagctcacctgccaatgtgcagtagcatgaaaacagagggtgttggggattatttaattgagttctgaatttatgcttgagtttctgtagaaggagaaaaaaaagacaaccctctttaaacaagtttcattgaaaggttataaaacacagataatttacatgtgggagcagatggcaggctgggtgctgttccaggcaaaccatgtgtcccccggcggctctttttaatggatactctgagtttatatgtggtttataaactcaagggttagtgacttctgagtgattgactgtaaggcataaaaatgcctacagccgtgaccttcatttctactgaggaggctttcctcactcctcctactctggtggcacccagagccaacttagcccatcaaggctcccaaaccctcatccataggcaggttttgatgacaacctgactgagactccgcagccttcttctgttgctgagcttgctgctgttgtgtgccccggctcccggcccacatcctccccctctcaagtttgcttcactcttctgaatgacgcctatcaccccatctcctggcaccctgtatcaggagagcctggccctaacacacaatgctggccttcccctccaggccctccatgaggggaagccctggagctggcctctctctgtggcttgcccactgccctgcccatcccagcgccctcccgtttctaagcagaacgtgtctgcgaataacagagccctccctccggctgggtccggtcctcatcagctgcgtggcctggcacacccccccagcactcctggacctcactgtctgggttctctgaccaccagtgataaggctgtggagtagcagagaggagtcaggaggtgtggctgggacagcacaggtctactgcatacaggtttggatgaccaagtagctcatgtagggtgcagagaagcgaggactcctattacttctattacaaaggttcatttccttctaactttgcagggcccgtcccagatagttcaccctgagctcctctgcctgcgccaaggagtcatcaagtgtgcaccatgttggtgggggtgtggtggagggaggaggtggaacagtcacagccaaggtaccaggaggacttgggtgctaaacacgtgacaagcctcactgatggggtcagcatcatcaccagcccatgttggggaaaccgaggcacagagcaagggaaggacttgctcagggccacgtggggccacctagagcccaagttccccactaaaccatagtgctatcctgccttttcccaaggtgaacctttactcgatgtgtcaaagcaggaccaaacacacctcctggaaatttccaaacctggagctcaagagaagtaccctggctggcacaggggacaagacaagatgccaggcaagatggagggtcagattcctgcagctcaaactggatgaagctcatagaaacacacaaaaagcaaccatgtacacatggttattatttttgtatatcattttagtgcaagctatgtgtttctaccattctggtggaaacttcctaatctttcaacagaactcccccccaccgcccttttctttttctttttttctggaacagagggcaagatcttatttcaaaaacttcaacgagg

SEQ ID NO: 40009 - DNA, 2057 bp, Bovine  19866880637103
gacatggggctcccattccctggggggaaaagggactgtcccttactggatagggtccctggccaaggtgggcctgagtgtggccctctcttgggggaggctgccttgtagcctgtcccacccatggagcctgcctgcttgggctgtaccagcagatatggctttagagtgtagagggagatggtgacacacggccttcatgtcacagccaactacacagccagagctccttggagatcagagaaagcagatgctttgccaaccccttcacccctcccactgaaacaaccatctcttctctccaaggacacgaggctgtctgggccccacactgtctgcttgcaaataacgacgaatgtgtggctagggctgcaggcatggatgggcaggatgtggccccagggaacagtgggttctgggggttcacgtggttagagctgccctagcccaccaccagggcagcctggccagggagggcagatcacccccctcccagggagcccaatttgcccatgatgggaggaggctctgatgggcaaggaagccaggagccaaggccacctcctccctggcgtgtaacctcaagtaaatctgtcaacctctctaggtctcagtttccctctgtaaacgggggtgggagccctggccatgaggattcctgaaggtcagataagcattagtgggagaggcctgctgctctggtgggcctcagctggggctttttgctgggcactgcaagaactgctcctgacccagcctccccatcaggcaagagggaattggagggcgggagggacaggtgacaggagtccagctgagggtattctgactaactctgacctggctctggtggcagcaggcccagcctcccggtctgctgggccgccatctgaaacacattaccaatgctttgtaaactgcacatcactcggccacatgaaagcttgggatctaaaaatagccactcccagaggatgccccgcattggcggggctcagctgacctccgcacgcacacccaccactaggctgtcccttttgccagggagccccgactggcagggccacacccacccaccctcccagtgtgggcagccactgcctgaggccactttatctgagcacagatctcatccagctggtcaatgcttcaggcctcaaggccttacctagggcacaatgtctggaggagccaggaggaggctgcccagagtgtgtcagtaaccgcaggcccccttccccagacctgtatatggctggcatgtctgtggaagccagtggaactgtctcacaggagggacactggggccctgtggaggtgaagcatgggaagggggacttgactgccgtcagatggtggacaggagggccactggtggatgtgctggtatgagaagggcagggtcctgccctggaccccatggtgtcagtggggaatctgtcccagcacaaaggcagggcagctgtgggtctccaggctgccaaggttgactctttgccctactttctgtgggctcctttccctctggtctctatgaccaactgcaaaaccactcttttccctaaaaataaacatgcttatgggattgggggaagctttgtagctatcaaaggaaataatagggtgtttaagaaaattacattgcgttttaaataaccagcatgaaagtcattaagttttaagtttcattcaaatcagatggctctgtggctggcccggtggccaggcaggcagagggtgggtgggcccttagggacgctgagcagcagcctctggagagttttacagtgaggtctctgctggctgtagctggggtccaggcagggcagccctgagtatatgctgtgctgcagcagccagcccagagctcgaaggcaggctctggaagcagtctgcagcccaggaacctcccagctgtggtgggcaatcccctgggtggggctggggcatgaacatagaccaaagggtgtgggacagatgaagctgggactgcagaggccgtagggattgatgaccatgttgggataggggtttagggatggtggtttggatcaaaa

SEQ ID NO: 40010 - DNA, 1727 bp, Bovine  19866880718137
gcccgggttccctgtttctggcccttactccttgcttatctctccaggcctgagtttcacatctcagaggatgaaacaaggcctgtgaacctctccgtccgctataaagtgctctacgctatgtgagctgtggtggtggtggcggcaatcattttgactattttagctgctcttggcaaatggccagaaggttgcggaaggccttggcagggttcctacctgcagctggggtcatggtgggggtggaataattgccaaataccttcctggcatgttgatttccagacgagatttatgggccctgggagtcattatttcagagcaacttaacaaaaaaaaaagaaagtaaccacggcctcatcataagcacttatttcactggaaagttgtttgcaaaacacaacagacatcaataatgatgttcacggagttgtaaatcttctaagcctgccttcccttcctggggactaaggcacttgatttggttctcaaagagctcagaagtttccaaatagataacagaatcccagagtccattaagcaaggtaatttacaatagtggcaggccaaattcagggaaatgcattagagcagcttcccatttggcttgtagaaaagacattattccgagcacacacacaatgaatgctgttaggcgacaatgaggacactggttagctctcccaatgagtttatttaccctcctcaccgtgcagtgcattaagtttgagtgatagttgtaccaccagatgagattctcaaacccttgactagacacctgggacctcatttccaacccattaaataggcatcactggacattgtaacaaggagaaagcaacttcacgtagagctctgactcagaccttaagccatccctggtcaaaggtgtgcaataaaaaaacaatttcaaactttgtacttcaagagatcctagagagagtttgctgctgctgcttctgctaagtcgcttcagtcctgtctgactctgtgcgaccccatagacggcagcccaccaggctcccccgtccctgggattctccaagcaagaacactggagtgggttgccatttccttctccaatgcatgaaagtgaaaagtgaaaagtgaaagggaagtcgctcattcctgtccgactctttgtaaccccatggactgcagcccaccaggctcctctgtccatgggatttgccaggcaagagtactggagtggggtgccatcgagaagtttttaattccggtatatacaggtgatcaatgttaagaactaaaatagcaatctggcaaatatttctaaggagagcttccagagtgcagatttaaaatctcaagggaaaagggctattttggcatatatttgtcttatcagtatgacccaatgatcaactgacactatgatttaaaaagtgagaccaagataattttgtgaaaaattgagttttagaaccatttcatgtatcagacctggttggcattacctcaaagcactttgttttcatgttcaatatgaaaagtattatattcacacaggtagttgaaagtgtatacatactcacaaatattcacctttaaaaaaaaggttaaagaccagaagcataactcttagcttcaaggataataggatgtgttctgttatttttctgattcaacacagtgatacagagaaagaatatcaaagcattaaaaataattatgcaaaaagatactagggtgaaaaggcaaattat

SEQ ID NO: 40011 - DNA, 1318 bp, Bovine  19866880750302
tttaggtgagccaataaagcccagaagagttaacttacccagagccactcagccaaggagtggaaggtaaggcgtctgagggtagagcttcccaactcaggccttccacctccactcctctaaggggccatggataagtcccttccctgacacgacctgctgtccccacctgcagaggagggctggcaccccaggacccatgcactgtaccatgggggagggggagccctgtgacctgataaaacacctgtttcctccaccggagtcttgtttgtccacagtggcaggaagcagccagtcacaaggcatgagggagcgtgactgtatggcttcgggaccgcagctgctccccctgcccctccacgcggctctgtgcccaccctgctccacccggacctcagctgttgtgtgacttgaaaccactgcccccagagctcattctcacagctcagctaaacctcccttcatgcggggacagggggtgggaagtgatctcaagaggacccaggagggcatgggctgccaactgcccatgagaagggaccaccaagaccccgcctcccactccaaccccactcatatctaagtctcagggcacctggggaggtgggcagagctggtatggacagccctgtttactgcctgtgacagctggttcgggaaaccctgttcaggcccggggaggaacacctgggtgctagcggccaacacagggctcgccatcagcccctccctctgctcctgagctggaggcacggatgggcagtcctaagctgcggccgaggtggcaggtggggcaggtctgcaggacgggcgggcctccttcagggtgacttcctaggcctgaaaggcatcacggaggcccccctgaaagtttccaccctgggggtatgcgggtgtgggggctgcagattttccaaataccacacagccctccaagtcaggaaggaatccaagtcaaaattacttttaagtctcactgcccagctcgaacctataaaatgaacaacaaaagaggggaaacgccatgtgggctgggcttgggctctgccaggaaccctctgtgaactggggccatggggaagcaaagccgcgattccttcctacctcttgagcccacagttctcacactttgctccaggaaaacaatcagtgagcatcattcccactggtaaagaaggcaacccgtgtgaaaactagaagtcacatgagggagaagcgaataataaacatgaggggagacaagcaaagaagccacacgtgggcactgcccggggtgcaccccacaccctggaagcactggacgagacacaggagg

SEQ ID NO: 40012 - DNA, 1425 bp, Bovine  19866880758866
aatgtgcttgtctaagtccttgcacaaaattagagtagacaaaattaaggggaaaaaaaatctcatgataacatataaccatatggtgatctctataagaaattgtagctcagatgcagactacctaggtagtctgtaaaatctcaaacataaaattgagcttaacccagaatgatggagtccttgagtacctagcacaagtgcttagctcaagatgagcccatcttcaaactgtgcatccagaattttcacagatccacttccaagaagtgtgagctcactcttaaaaaaataaacttgaaatgccatggaggagaaacaccatgcaacaaccagcataaataacaatgtgactcggaatataaaatatatgtttaatgatttttgaagattcaaatatggttgaaaatcaagagtcttgagatgaccattcatcttcatgaagaactaaatagaactttcagaaataaacattcaaagataaacgctcaatgagagagtgcaagagtacattagaaaaggcctgaagaattcaggagttagaagatgaattagaaaaaaattatatagaatgcagcacagagaaaccaaatatgggaaatgtgaaagagataatagatactgagatagaaggaggtagaatgaggacttgtaacgtgtctaatcagaatgcctggggaggggggaaagagaaataatggagcagagacaatatgtaaagatggctgtgatgaactgatgaaaggcatgaatcctcacttcctggaagccaaatgaattgcaagcagaacaaatgcagagaaatctgcatacttacattatagaggggcttccatagtggctcagatggtgaagaatctgcctgcaatgcagaagactcgggttccatccctgggtcaggaagatcccctggagaaggaaatgccaatcctctccagtattcttgcctgaaaaatcccatggacagagaagcctggcaggaggagtacgtggtgtttcaaagagtcaaacacagctgggcgactaacgctttcacgtcctggagaaactgcaggaaaacaaagtgaagattttaaaatgattcaaagagaaaagaaggattacatacaaaagaatgaaaaggctgtcagctgacatctcagtaacaaggaagccaaagagcagaataattaaatgtttattaagttgagaggaaagatctgtgaacatagaattaattacagagcacaaatcactcttttaaatgagggtaatatgggtattttagacagacacaactaagaaaactcgaggcataagaaggaattatgaggaataaaagcagaattaatatatactattttcatatatttaggtcaagggaggagtgattatagttcatatggtcctgaagttcttcctgtgggagggtatagttattagtta

SEQ ID NO: 40013 - DNA, 1971 bp, Bovine  19866880763966
gaagaaggaaagagctacccctccgtattcttgcctggagaattcctggacagtccatggggtcgcaaagagtcggacacgactgagcaactaacatataacataaagggaccctcctcccactcattatcttaaattccatgcataaggtcagaatggacctagtcctcctcctcctccaagaagccttcctggctgcccaaccttctctggttcctatcatacacccaggaagcgcgtcatggttagaacaaaagagagaatcaagggtgacgtgtgccatgtttgctgattctgtctctcaaacaagacgccactttccttacatgaaggatatgacatgtgtctcctaccctgcatctgcctagtataagagatcaataaatatctgatcattgattatagttattaaaaacctgacagctgattatagttatcacagaaagaacacatcacgtacaattcccgctcatgtgtgtacagctagccccatgcaaggaatatcaagcatgagggtgggtaacaaattccaatgataacccagattttccaaatataaagacacagggcaaacattggccccgaattttttatatgaactgaatttttaacttttcatacaaatgttttagagccaggcatggacagcttaaaatcctttttgcaaagctttgcccacagagaaagtaatttgcacgttctcttctccagcagtttccaaactctacacctcatatctgctccttctaataattttcctctgaacacctgcctgctgctccattaccgtgggatgactaaagaacaagccatccttcactatcacatttcttctacctgacagggccatctcaggatttatgccacctcccagagagctctgtgtaagacaagctgactagctaggagtgcactgggaatcagagaagtcctgagcccagatatcctgagctcaccaataatagccatgctgtgcttaggatcaaagacctctgctttagacctttcttcctcttcaccacattggttttcacaatttctctgaaaaaatcaatttggaaaaggcattttgaaggggaaagcaaataaaattttgttactgaattttatttagaggaaaaatgtagtactttccataaaaaggcaatttgattatattacaatttcattcctaatctgtatttcctatgtcaaagcattctttaatggatcagaaatagataattgcaggccgtatactgtgttgcagcctccggaaacaatgtgtctctaatgtcttctcccagaggcccgcattgctagcaacacagggccaactcctgccagatggatggcccgcccagctggtttgtcttgccaccaagatggctgtgatcatggaggtcgctctgactgagctgcccagagctgaacacttgagggaatggactccccacatcatttccctacagattcctgaattcctcacttttgccccagaaaagatttgacacagctcccactgaactccctgtaggtccaattttcacactgacacctgctcacgtccatccccgagtggctgaactttcaaggttggggcaaatacaggaaaggctgtctgtcccctagacagattccttccacaagctgagaaatggcacccaaggtcactccacagtcgacatcaacaggaagccagagcccgtgaagggataaggggttgcggtgaagatcccagtgggagggcagaggaaggacacagccaccgagctgcaacctcagcgctcattcatttgctgactgtgcacactgcgtgtctgtactgtagagaccctgaagacacgccgcgctgtgaatcagacagacatgtgcctggtgtcaggaaatgtaccttccagaaggggaacgctaatactaaataagcatctggagaaaagtgaagtggaagactagatccaggagctggaatgggcctgcagcaggagtcat

SEQ ID NO: 40014 - DNA, 1060 bp, Bovine  19866880789245
aaaggcattttaccaagctgtaatgaccaatataaatgtcagttacgctttattagaatattttagagctcgttctctggatcatgatttacactatcttagaatacacagaaaatgaactggggttttcacctcactaatcttatttgagaggcaaatgcagttagccacatccaatattgaagaataattactgtttcctcctccaggacagagtgagacaacagtatgtgacatgaataggaagctttcaagcaatcagaacaaaaattatactttcttttacacagctgaggattctgcaattcagtctggcctcaattcatctgcatctttcattactaacactacctcagaagagagggaggctgtgcagtaagactagaacactgggcttaaagtctatacaactaggcaatctgaattcagtcactgtagccaagtctctttacctttctgaggtgtggtttctatctatgaggataactgtttcataagcttgttaagagaaccgtgtacgtgacagtatgatgaaaacagtatgttgtaccatgctggccccacaactgcttgttcttgatattcaaattacctttatggaaatgagtcaaacaaccttttaaattaaacacacacacacagactcacaaaaatatattacccatttcatataggaatttaaccttggtcaagtattttgcaggtcatccaaccagaaggaagactaatactgcattttatttatagtgcttgtacagcaatagaaaatagcatgcctaggtaaagaactcctctggatacaaacaacattctccacaagtttggtaagacatgaaagcacaaggccaaaaaccatacctaaatgaaaccactgctgaacaaaacaagactgtttactagcgctaggcacacaacatcatccttggctttgatatagatcacatcctggggggagaaaatcttaactagttaaaagcataaaaaccatattcactcttgtttataaatacacacttttcttctcataactaaagaaattagaattagccatctccaccaa

SEQ ID NO: 40015 - DNA, 2531 bp, Bovine  19866880831842
actctttgcacccgccggcctctgtcctggaattttccggcaagaattctggagtgccatttcctactccaggggattttctcgacccaaggatcaaacccatattccttgcatctcctgcattggcagctggattctttaccactgagccacctgctaagcccttaaaaaaaattaaccaagaattacattgtaacaaagtagatggtagcaaagagtattgtgaaatacccaaaggtacaatagaatagatttttccttaataaatcaacaatggctacaagacacatatgtgactcaaataccatggccacagaatagtacagatgtgaggaagatggacacaaatgcccctgactgtacactctactctctgagtgacagatcacaaagattaataaataggtaaactacagaggaacattacaaatgtgatccaacagctgacatatggaaggaacctgaattaggttcctagggctgttgtaacaaaacttcacaaactgagcaacttaaaacaacagaaactctctcacacttccaagggccagaagtctgaaagccaggtatcagcagggtcactcactctgggtgaagcctttcctgcctcttcgtagcctgtgacagtgctgtcaactcctggtgccccttggcgcacagctgcatcactccagtctctgcccttgtcatcacaaggtgtttcctatgtgtccacattttcccctcgtcctgtaaggccattggtcaggctggactgggactgccctaatgacttcatcttacttgataacatctgcaaaggctccatcatcaaataaggtcacattcaagggcaccaggtattaggaccatgacctatcttttgggggaacacaattcaagccgttacagatctcagtgacaaagcaagaagatacattttctttgcaaatgtgcttgtggcaggagaaaacttatcttggattttttcagatacatgtctgtatctgcatatttatcatataaataaagtcaatattctcctcaaatcttacaaatcttttttatattatcagttgtatctcatgtttcatttctggttctattgcttctatatatgttctttctttgatcaattgaactaatggctttgtgaattttttcaaaggcttaaatattggttttatccatcaatactcattttttctgtcttatttattcagtttattattgcttgctttcctaattttcttagcctttttttttacaaatctaagagcttcagtggattcagttcactgtgtatatgggttttttattttgttctgtctttatgtttcctagagacataggaatttagaattatacagtttttctaaatgaactattctggcaacatcccatatggttgatattttgtacttttaattattctggggttttttctgaattttcctcttgacttaggcatacttccaggcaactttttaaatctgtgtagtaatacacttcacccccaaattacttttcatttatttccaaactttttgggttatggttggaaataaagcacatgcaatttcacccatagttcagcgtgttctagggggaatgttcctgtgtggggtgctcagatgtgatcactggctcaacacatgtgaccatggatgggcccaaactctcagactagaggccctaatatataagccatgcagagttggcccacctcatgggcatgcatatgtgttaagtcacttcaaatcatgtctgactgcgaccctgtggactgtagcccttcagactcctctgcacatgggattctccaggcaagaatactggagtaggttgccctgccctgctccaagggatcttcctgacccagggatcaaacccaggtctcccacattgcaggcggattctttaccactgagccatcagggaagcccaagaatcctggagtgggtagcctatcccttctccaggagatcttcccaacccaggaatggaaccagggtctcctgcattgcagggtggattctttaccgctgaaccatcagggagcccaacctcatgggtaagtctgggtaaaactttgcttttaaaaaaggaccaaggggttcctggacggctcagtggtaaagaatccacctgccaaagcaggagacacaggttggatccctaacccaggaagatcccacatgctgtggagcaactactgagcctgtgctctagagcccaggaaccacagatactgaggccacatgccgcaactattatagcccaaatgctctagcgaccgcgctccacgacaagagaagacaatgcagtgagaagcccatacaccgcaactagagaaagcccgtgcagcaacaaaaacccagcactgcagaaagtaaagttgttttgctttttttaagtaccagttcaaaaattaaattgcaaagcaagctgaaactttatctccaagaggaaactccccataaagcatagtaaaaattcttaaaaccttctttctccacttttaagtctgtcaacatcccacctacctgcag

SEQ ID NO: 40016 - DNA, 756 bp, Bovine  19866880831891
ctgaaaactgtgaaatcctgatgtcctttgaagagcatggtctggcttattcacacatttatttctgttaccacacttaaaagaaggtggcctgcggcctgagaaaacccactggtgggatgttaatgtgaatacaacgtcccagcacagagaggcagcagacttgtgtgccaaggcatctgatacaaatgctttgatcagcctggaaagtgaactgtctttcttccctactctcagtcctggaaccgcaggttacatttagcaaatattttgactggtgaggctgcaaacaactgtcttcattctgaggcagaaaaccaaacacagcgtgttgaacaaacaaagaggaggaatgattcctgccttggcccgcagcatcctgacaggaatcagtccggggaacatacacgggaatcactgatgagaaggatcaacacaaatgctcgtctgcttacaaactggctaggtttgaaggactgcagctgatatcagatgtcagagacatgtgctgttaatgactgaggcggggacctgcccaggtccctgtgggcaaggacagggcagggataggacagggcagggaaactctgcaggtaatttccaaggctttaaggtgaaagagcaagtgtctcagatgtcatggtcacacctagagggcagtttggctatcaatgaagagaatgaaataaaactgaacatcaatcctggggacgttcattgtgctgtcgcgtccagctctgacaatgaaattttcca

SEQ ID NO: 40017 - DNA, 2144 bp, Bovine  19866880836954
gcagaaagagatttgagacagggagagggagacacagatgggacaagaggaggcaatctgaccacagaagagattgtggagtgatatggccacaagccaaggaatgctgagccgccaggagttggaagaggcaaagagtggactctcccttggagaccctggaggttgtgtggccctgatggatttcagacttctgggctccagatctgtgacagaatacatttctgttgtcaaaaagtttgttacagcagccgcagggagctaacacagggcggctcagcctgtcagagctggagatctgcagcccctttgccattatagcagcaactttttggatttggggcagccctgctggagtggggcctggccatggcagcatgtggcgcctctcgtatccatccttccaggcctctcatgacatccgcggcatcacaagctgccatagtctccatgcccttctcgtgtaccccggagtcccctgccttggaacacagcgaaagctgacctgatgttgcacatacatcttttatgaatggattttgctcagctctgaggttgtctgtttcttgcctggaggcagtggcaggaagttggtgctgtttggggccctttagccctgaagtggcccactccctctcctgcctcaccggcaggtgacctcacaggaaagttataaatagcaatcagggatgggttctgagtgcctcgaagtggaagtaccatcatttgatgacagttcagtgcaggggagacagcgggatgcggggggccatcgcttctcctccgctctgatggtaatcagagcaggcagatgtctccgacagctggggctaataggctgtcagacagggccaggctggcctgggacatcttctgcgcatcctggccctggtccagcccagactgagggaaatcaagcatggggccgaggagggaggctgtggacctgctggcagagactgtgcccaccaacccccccacccccaacctgaggatgaaaactcactcactgggagtggggtggggggtgtctcctccatccagtctggacagtttttccatttgtgggaaatggtcatttcaattattgatgagagatgaaaactaggctaattcagttcaatttctccaatggacaaaactatttataattaacctagcatcaaaggtcaagccagtggtaaattactggggtggcagaagaattgcaataaggacccactttgcgctgaggtggaatttatgcaagaaccatcttgagaagtgctctgaaatgtattcctgactcaacaccagagtgtggggccacctgcaagaccatcatctcagcattgggacattttgagcaaaagagggtctgggtctgtttcttcaatgtgtggccccgaagagggagtgagctggtggcttctggggaagggaaaccaagatgttcttgacttgtccatccatgtagctggggctttgtctttggtagggatcctggaccgaggtattattcagcgaacttgacaggaagaggactcaggggtctggcagagggtagtggtttcttccagcacatgcctggatcctcctccagcctccagggtgcacctgcaaactttgggcaagagaaacttggctgtttcggcaaagagttctgtctctgacatcacattgcatctctggaaggtgttctccgtccttctgggagttaggtttctgattttctgaggacttggcttccagtaagacctccccactgtatgactggttccttaagacttaaggtcaaactaaggcctcaccacttctgtcctgggacccctgatgcacgctctagggaggggaggggaggagtcctgtccaacagaatgtgactgtagctcagtagaccaaccaggctgccttgggacactctcttcagatgttttccatttgtttcttatttttattttttaatatttatttatttatttgactatactaggtcttagttgtagcatgtgggatctttgatctttagttgtggcatgtgggctctggttccctgaccagggattgaacctggaccccctgcattgggagcatagaagcttagccgctggacccccagggaagtccctgtccatttgatttgtttcctgggaggctggggctaa

SEQ ID NO: 40018 - DNA, 1604 bp, Bovine  19866880861845
attatattatattatgaaattcggttgtagtcttcaatgtaaagaatctttcaatgaacaaagtacctttttttcttccaattcctgttttaattagaaaagtgatggaaaatcttgaagtacctccctatagctagttttaaaaatctatttggaaaccttgaaaatattggtaaattataaaagaaattgaactctgatacttttctcttatttcattgttccctattctctgaaaagccttcaacgttgtatttctatctcagaataaggatgcattttcctctcagaacctgaaggtattctaattatatgtaaatcagttcacagaaataaatatccatggttaaaggacatttaaaatgttaaaaggtttttctcaaccgttcactgtttaaaataaaaaagtctatttccagaaccctggcagctctaaccccctttcacgactgcacagaagcacatgcaaagccatttttcccgggctcttctcttccctgaaagacctcaagtggggaatcacagtttgattctgaatttgaggcaattctatgttaatcaacttttttttttaacagtgaaaacttttttcccttttattcagaatcaaaacagacaattggacagagaaactaaatagaaatcaagaaagttgctatcatattggaaagggtatcttaagtattatccttcaagtcctgaaaacactgccacatatgtatgtttaaagtatcatgattgccttgatgcctatattttgctctaattccctggccataaacaccaacaaaatgctgatgatttctctgtctccacccccaaatcctcggctcacagagctgaatgcctatttaatatctgcagttggttatctcacaggcattgtaagctgagcatgttcaaatgtaatccttgatctgcaaatctacccgccccccactttctccctctcaacaacaggcagtgctgtgctttaggtctctcaggacaaaagcacagcagttatccttcattctgctttatctctcagtccactttcaacccatcagctaagttctattggccccatcctcaaaatttgtccagaatgtgactatgtgttatcagctccatgatcattactctggtccaagccaccatcatggtttgcctgcattgcttgtactggtcttctccctaattgtgacctagccctcctagaggctactttgagcaccatagttagctagaatgatctttcgaaaacataaagagagtcatgttacttcagtgctctaaactctccatgacctcccagtgtcagagcaaagtcctattcatgcagatggccatcaggcacatgaaaatatgctcaacgtcactaattattagagaaatgcaaatcaaaactacaggtgaggtaccacttcacaccagtcagaatggccatcagggagactttcctgtgtccaaaggttaagacttcaccttgcagtgcaaggggtgcaggttcaatccctggtcagggaactaagatcctacatgcctcgaggccaaaatacatcaaatagaagcaacattgtaacaaattcaacaaagactttatttttttttttttttaaatt

SEQ ID NO: 40019 - DNA, 1357 bp, Bovine  19866880901070
tgggccaactctctgcttttctaggaccgtgcatgctattcttcctgctcaatagaggacggtgtctgctccaccaaattagccaaacacagataatgttgtcagagaatggctccattagatttcacagacgcctgacaccaagacaaaagcctctaccctcgcagcatttcaacatcaattttttcttacatgactcaaaaaataaatttgttttgtggggcagagatgatgagtttgacaggtttttagaacagaagataaaagaaaagttagcaatattggctggggggattccagccagtttcattaggctatataacatacacaggcatgtcggcaacttggtgacctggaagggcctttcctactggccgatggatgtgggggggcctggctcctgtccccatggggatgtaacttggtttgcacattctgcctcttggagatgacaatgttgagattcagagtagagaccttaagctaagaaatctggtggggaactgagggttgaagaggggccgtacccacagcctccacatgactgaacttttttttttttctttttgcaactgtgctgcgtaagcaatcttaattctccttccgggatcaaatccatgcctcctgcattggaagtatggagtcttaacccctggtccaccagggaaatctcggaatgtttcttataagactcaaaacagtactcaggtaacagtgcctaggaagtctcgggtctgctgggagaactgagtggagagtgggacacgggcatcccagaaatgggccagctgttcagacaaagagaggtcaggaaagcactgcacccacagtactgggtgggctaatttcagcacacacgtcaggaagacctgagaaatctaatgaactctctacactttattttcttttcattgaagaacctcttataataatagggaatcctaaaaaataattcttccatcttactacccttatacaccagagaacattttgcctgtgtcttcccatatccatgtgtggaagtttggtctttctgttttctcttcctgttccctctggcaggagtcacggcacacatcttgtttctggggcatacaccaagttgggagacctccaggggagaatggaggtaaagactctttctacaaatagcatgcagagttaggcccagggtggattccttggcagagtaaggggcttgggtgtctgctggacatttgatgggaagaccagggtctccttcattctctccctgggggcctggttctcactgttagatgggcaagggactgggacatgggaggagattggggtgcagcatgatggagtatgaagtctgaagaccaaaaatgggatt

SEQ ID NO: 40020 - DNA, 2379 bp, Bovine  19866880932938
cttcccccgtctatgtgttatttagtagcaggctatgctggttagttgccttgcatgatgggaaattctcccttgtccacaaagtaggcaggactcttagccccttactgggaaatggaggtttttggtgggatacctggaagaaagatagtagtgctcaggttttcaccttcccagaggatttgaggttgatttctaagctctacagaggggacacaggacaaactgtgatgcagaggtggagcccccatggggcttgagcaagatcccataggtgctctgctctgccttgcttccctcacttgccagggagatggaaaatacccccgggggcctacagactttaggtactgcagagcaactggcatcctgttcccaggagaggcaccagtgttgttctccacagccgaggagaccctgggcccatatgagggggaggcttggtggacagtgtgtgacttagattttgggcatctccatgatgagcaatgaacaacaactagagggtcagaactttgggggccctggacccttgcttcttggagatgaaacagtggatgggccttccttgagcagggcttcttcctggcacccagtcccaaagctcccagtcctggaccacccttcaaagctgggctgggtctactgtgttgaagatcatgggcagggccagagcatttgtgcagggcgagcaggggcctctcagaggtggtgtgtacagtggggagaggcaatcggagggcagggtgggtgaaggcttgtgtggcttgctcagaactttgtgacttagttctcagagtagagcagaccccttgggagaagggccttccgtggacattgaacactgcatcaaagagatggctcaacagccagaccccaatcggttgcatgagctgaaatactaggggcctgaggaaggagtcaggtgggatgaaagtttagagaagatttctggaacctaacttctacctgctcagtagttcactgcgatatttcatccttgccggtgttacaaaaatatggtaatagtaaacagctccccaaacagcaacatgtagggtttataaagcagacacttccagggcactcccagagctggtgaaagcctggagagaatctggtacctgtagccacctggctggcaggcctcacacgctgccatttggagggtggccccagggcctccagccagagtctggctttgatgtctcgaaactcagaggcttgttttctttttcattaagcctgtttgtgaggcttccagcagcaagcgagtcttacccaatcctgtcacatagcacatatggcctcggagtcgggcgtcctgcttggagcccaggcagggccccactgggtgtggggacggggaaaactccaagtggtccacatggactcaacctggaccttcttccagtgccaagttcacagaggctgggtaaattgatagctttggctgagatttaattgctcggatagagcagtatgtgaagtctcttgtgggacataagagaaattagacctgcttaactgggctgacccctgctcataagccaccgccactgttcacaggcaccctcttcctccaccagggagactctgtgagtggtattgtttacagtagctgttcgatggggctgcgtattaatctaacattagttacggtggttaagcttttagagataatgaaatgtaaatgtgcctccagaactcgccatgttccccgaaaccgaacacattcgtgaagaaaaattgttgggtaaaatgactacgaatattaatcgtgtggatttacaccctctacagatggcagtgcagatgctgggtagagttaggatgctggctggcaggaaaggggagctgggctcagtggccaccgaaaagtctcacgggagtttcactggggccagtggtggggtggggcctcagcttgactctgagctctgctcttcaccagctacccgaccagggtccctgggtggtctgcccacctgtgtccctccactggtccctgcacatttaccctgatcacctccctcctctgcagccccctcgcactcgaagtcagaaagagccagtgatgtttattttttaaccaacagtagttaattgttgagtgcctatgcatgccaggcaccacgccaggcatctaggttactctcactcatggagctgacatcccagcagttagcaaataatcaccaagtagctgtgcagttactgactgtgagaagggccgccaaggcaaagcaaggagagtgataggcgatcataatatgatggcagaaggaataatggctgacactgggcttccctgcagctcagttggtaaagaatctgcctgcagtgcaggagaccttggttcgattcctgggttgggga

SEQ ID NO: 40021 - DNA, 984 bp, Bovine  19866880934227
acacgatgtagcaactgagcacacacgcacacaacccatcgagagcagcagtagcaggacactaataaagtgggggacacctctgtctgcattttgggtcttgtctgggcccttggctgtcagggcctgcagaggctgtggttggggtgcggcttgtgctgtggccctggccgctcggtttccggagggcagttcgagaccccgggcctcgtagctcacctcccctagagcccccggtcacgtgacagcccacttttatggcctggcacagccacattttattgtcgaattagtaggaataacagtagcattttagtggctgattgggagctgtatattagcgactgtattagtaagtgcgcagtgacaggagaccagtgagagggagaaaatgagacgcagtatttatcccctgtgcaaaatcttttttattattaaaggcactgggttaactgaggatagatttaatgcctgctggtaattttattggatcagcagcagctcagggtccccactgcagactgagctccagacccctcatccaggatcactggatttcttggagaagctgcaggcctgggacgttgcagacaggagcactttcttgggacttgctctgagccttttctctgtgggcagatgctgggcagttgatgtgagacggggtgaatctctcgcccatttggagatgaacagtgtggttggtgtaggttctgaggtgtctgaagaaagagattgcagggagaacatcagaactggtgcaggcccacccctaactctcaggggagcctcccagcagggggctgcaaaactcaaaagtcttacaactgggggcagccaggtggtacccctcaccctgtgctccattctgtccagtgctagctgggtctgctgcggtggtccagccttggagaaggatgggtgtgcctggttctggctgcaggagcacagctgctaagggccatatgggctggagcttagatt

SEQ ID NO: 40022 - DNA, 1726 bp, Bovine  19866881000816
acagtcaggctctcactagggtgtttaactgaagcaagccagggaggccatctaggagagtctgcaagccacgctgtacttctgaatcaagctgggatgctcagccggatgagaggtatgagccttgtctatatgtggggaggtacagcctggctgctgtaagcaaatatctacagggctgttgtgtgggaaatagattagatctgccctatattaactctgagggcaggtcttatatctgcagggagaagctagatgaaagcaggtttcaattcaatataaagaactgtccaagagaccttctttgacaggtaataagttcccagatactggaaatatttgaacatagatcaaatgaccacctgtcgagcatgataaaggggtccccatgaagggcctctatcccattctaaggagatgacaccaacaataaagacactggaggtagggcactctgatctgaaggtaagattcagtgccactcttcccttttaattttgcaaactccattagtatgagtcctaaatccattaactccttggtggttcatcctgtcccaaaatgaatcttacctccccagccgatctccaggcctcctgataagagggacactgcctgccctgcccctgcactgagcctggcacaaggtgggcagaagagaagctccgtaaatgtgtgaagccaggtgaatgatagcttgggcatgtccaaggcaagaagccagctgggctccagctgaagtcctcacgcactgagagtccatatattttatgacctcagagtgcttcctggcacagactccttccaatggtgattcatttctccgttgcagctttgccagtatcagggttttctacttagttctcaatgaactagctatcatagttatagctccctaggaaatgccatacagtaactctgtcagggtttttatttgcttggacaaatcgttttatttcagcaaggtgttttattagcttagagagtcataaatcacttcaaaggtagatgaaagatgacccaagacacacaattttatatgagatgttgttctttctgctgaagatcatgtctccttgattatgactgagatcaaattagtttcatgcaaattatgaaaagcaaataacatcaacatacctgtttagtcacctggccagagctaagaagctgattccaacacccatctggttaccatcactcaggaaatctgtcatcaacatgcagggttataacctgcatgtccccaaaaaggcagtttgaagttccttctccaaaacataagtcctcctgggcccaaatcacaccaacgatgaagacactggtgtgagaatagctatgagaaaggagttgtattagctagcataggctctgctatgatgcagttacgcctaaacccttaaatctccatgacttaacccaacatatggttatttctcatcctcaccaggtttccagtgagatttggtcacgccataccacagggtgactcagcaactgatcctgctgtcttccatcttgttagagcaggaagaggagagggaataaaaaactctacccacttccttcccttccttcctaccttccttccctccttcctttctttcatgttaagactttttttttttaagaagtttcaggttcacaggaaaattggaaggtgcagagatttcccatattccccccatatacatgcataatctcccccgttattaacattgtccac

SEQ ID NO: 40023 - DNA, 2698 bp, Bovine  19866881006142
acttgtgccctgcgcaggaggcacaatcccaccttcctggggtgctggccacagcctctccttcctcacccactatccactccacagcctttagccccagtctgaccacacagagctgcctcaaaaccagttaaaaagcatgacccagacttaggtacctagcttgtacaaaaagtggttaaagcatgagcaaatagacaagcagccaagcatgaaggaccagttttagcatctgtgagtttgttaagatgagagtggagaaccatcaagttctcacaccatcaggatactacgatggcactttgtccccagccttcaaataaatactgtacaaaacttatatatataaacttgcaaagtgaatggctgaacaagcaaacatggctataaataagcaagtaaaaagcaacagccttggcctctatctgcattctgcgggcagagccgtgctcatttctgagttctgcagcctctccaagtccaggtagcatgatacctggctgttctctcagccagaaagtttagctaccaaagggcagtgcagcctctctccatcccctgagctgagaggagagatggtagaaagggactgctgacatttgcaaggcttggggctttaactcttctcaacagtccaccaaggtcttctcttccttttacaggtgagaaaactgagggcagctcagagaggtgatggaacttaccagaggtcacacagctacaaaaataaccatcccagtcctttggacatctctccccaaaccaagtcttccccaggaaaagcaacaatggagatgcaaggggatatgtgataactagaggcagtgagcactccaatccagagccagcagttaaaatgcatcgagggcaacccaagagttgtaactcttgtcgccactcatgatttatgcagacatctcccattagctctaatggatgtagggagcataaatctcggggcgcagctccagacaggctcttgtgatctaaacgccactaaaatcaatgacatcgccccagtattgatatggcaattgtggcgcttcataaataggcctggcaggttgggaagaaggttggcctgcctgccacagcctgaccgcaatgccgctgctggtggcaaccacgtcccttgggagctgctccagcagagtgggccagaagcacggatccagagccaggacactgggttcaaatcccatcttcccatctcactatctttgtgacctgccaagctactgacgcaccctgaggctctgtctcaagatctgtaaaatgagaattaagtgaattatcatacatacagtccttgaatcgttgtgaagtaaagcttcactctgagaaatacaaaaggcctgcgtagactattcaagagagagaagcagtttgtttgaatttgtcctggaggccttcccggcagagtgcaacaccaaagcccagccggcaagagggccaggattcctgagagggcctttgaaggttgatgcccatgagttcatgcaggcatctggaaaggtgggtgggaggctggaccccaccaggagtgcacacccaggcttctgccccagcaggcacagctgcccacaggacaacaccgcctgtaaggacccccccacccctctgggttaaactcagagctcacagccgcgccacctctttctctgcccctgattgaagacaaacgagcacataagaagctgggtctgaaactctctggaagacgggaattatgttctattctttacatcgatatttcgatcagtgttttaaaaataaatctatgaggaggtctttgctctccaaagataactggtaacagagacaaaggcctctgtgagtccactcagttcacaacgaggagtgaagaaaagctcttattcagactttgtcttgaaaattaaaatgataaatgataaagatatgtttatttttagcttatctttttaaacgtgatcattgcaagtctgctaattattagaatgaacaaaaggtaagtgatgggttggcagaatcactccagcattcgctctggacaaacccacagaaaagcaaagcagggtgcacggtgtgatggaaaggagaaagcccagcagcttccccctcgcctggcttcagctgtcctaagcctgcgggctgctctccctgcaggtccagagctgactgatgctgcctctgcaccataggaaacaagcacagaacggggacgctgagaaccggatgaaaagagagacaacaaaagcccgcagaaggtaggctagatgcgctgaatcaaggaaccgtgagctcaagctggctaccaggcagctttaggggatccttccatcttctccccatttggtccaggccagccccccaccagagagctttcatctggctgtataaaccaaactgctgggtcctagatgggggccaggagagagtgggtgtgtggagtccttgatcttcctgccggatctgaggacttcagacaagatgaaccaccaaacagggagcgatgagactgcctatttctttccaatgctgaaacccgggaagcagtattggtgaagccatttcagccctgctcttccactgtgctggacagagcacgtctacaggcatctcacacaccagcccacagacagcacctggacactgacctgctctaccagctagaaccctggagccccagacacagggctgccagtttctccatacc

SEQ ID NO: 40024 - DNA, 2111 bp, Bovine  19866881007932
cttgtggcccacctgggtaacacaagatggtcaccccatctcaacatctttagcttaattacatccttaaagatgtgggaaaagagcaagtgttaagtctcaagggtcaggcagctctgggtttgaagcccacctctgtactactcaataactaagatttagttctttcttagaatgttgccaacactcgggttgattccaataaagggcccagcagggctgtgatgtgagaacaggccttgctgtccttctctaacagcacaggaggtgcaacctagtcccagatgggggctaggacctagtggccctgcaggatggcctgggatggggccatgtgctcccccacggggggactcggcacctctctgtcacctctcaggataccatgtcttcctgggccctggaacctggcggccttcccgctggtttctgcctcagtgcccccagcaacaccaacaggtctccatccgggctttgtttgcttttaattactaagctgcctaacgagaccccagcatcaccatgtacagacacacctggctgcctctgacagataatgaatcctcagccacgttcaagggcaggccttcctgacagcagggggacaatcgactgaaccaaatcagggtgagctgggaggtcaaagaatattgaataaggagtgctatccccaccccacacgtgccctgcctccctcctatcgtccgggagctcgatgcccacgtcacctcagaactatgtgtttctgacaaggaggattgattctccgggaaaatggaaagtggacattgaacaaacactccctcacaaatcgaaactaaggcagagagcctttaacatcacctgtgagtgactgagggaagaaaagtcaagttctcctaaggccggctagaagaccgaagtttataggctccgctggtattattttcctccacaaggtgaaaggcctgccaagcatggatttcttccaccctccccactccaaattctgcaccctgcatgcaaggccacacaacctccctggagccatcctcaggcagaagggcctcctcagtgatctagggtgaggcaaagggcagagcaggaggcatgggaacaactgggggtcttgcagtcctcaaggtccaagaggccagccagatagggccccgtcaatatccatccagccccaggcagggaagagccaccaagaggcatggaactgcttggtctttcctgagccatcgaggacaccagggcagactcagctctaactcttcccccacgagaatcccccagcaggcacagagttttaggtgttggtgacatgtggtccatttcccatcaccctgctgagtgttgagatggatcagattccctaggggacagtggtggccagggaagaagaaggttttgtgtgagctgacagtcagccagcttcctggggaaccaaagacaccatagctgtgaggataaaagccaaatacacttttgatccctttcttgtaaaaattttaagtacatatgtacgggagcgcatgcacgcacacacacacacacacgcgcgcacacacacatctggaagagcctctagaaagtcacacactaaagtgttaacagtgttttacactcagtgatgggacctagaatttgtttttcattgcgctttgtctctatttttcaaatcttctacaatgcacaccataatacttttataatgtggggaaaactgctatttttttaaactgtacagatgcaaagaattggcagccttagtaatcctcacatccctacatccattctgcaagaactgtttctaacagactgttcctaattaaattatagagaaaatcagtcacacttttgctgatcgtgtccaggatgagggaccacgggcgctacgattcccctggggcaagggggacactggaccctctactcagctcccctgcaagtactggagcctcatgccaatgtttatcccatttaagaataaccaaaggatccaaatagatttcataaatcacttagtctctgcagctttctcctcgaggacatgcaggcaggcttctagcaaagatgacgcaaaataacaagacggatgtagtaactaatacaaagtgcttggttca

SEQ ID NO: 40025 - DNA, 733 bp, Bovine  19866881014663
cctcttataagtggctcctctctgtctacatacctatgtttcaggcaaactttccctagagccttacccacccatatccacgtgtggaaatcccatccatcctccaagagccagcccatctcttccgtgaagcccttgtagccagtgagggtacttgccctgagtttcttgcccttgggctgttccacagctttcctctgcccatatccccatcccactgagcaccatcataaattgtgatctatcccttattccctgctaacctctgagatcctcagtgtcagaaccacatttgctcctctcagtctcgcccgctgtgccagaaaaactgagacgtgcacttgcaggcatctgcatcagcccataaatgaagaagtcaaaagtaagccctagttttggagagtcagctaattcagccctctgagacaagagtgacatggaatgatgcaattaccttcctctggcctggatcccagccccatcagcagccccggaaggaataagctgcctctcctggagatgagtctccatcacaccaacccaagtgcaggcccctcccctgccacagtgatgtgcagccctccccttgcttctgcccccaccctggccccatcaagacagcccccccccccccaccattaccttggaggaaaatccccaacaggactctgggcacttcagaaaacaaaaatgctacactcggtacacatgtggggctcttcatggcgccaca

SEQ ID NO: 40026 - DNA, 4422 bp, Bovine  19866881049678
tcagaaaatggaaagagagacatgctgtatatttctctccctgctccctccttattttatgactatagctcctgccaggaagctccgtagcttagctctcataggactctgttggcattatttccccgctcccccatccctttggtcctcagggtggtaagaccttgcccctggggaccccattatcctttgtttgtttcctttcccattcccacactaatttaagtagtcttctcattaaacctcttcaattgacctatctgggtggatactgtttcaagatcttaaacgatacatatgccatccttttgtctttgagagtctgctttttcatccctcctgggtgatgtagatggttcctgaacaaaaggaagccctaagagatagccatggtggatgacgggtgaagcacaccctcaggtacaggtaagcgctaatgcggcaagcccagcactcacttggaaaagatacctgaaggtaaacatttctaatcaagggtgagggtcactgagacaagctggctggtttctctgatcacagcatcccttgttgttatgattcgttcatccactcaacacatgtttttgagcacctactggctaccaggaactttgttaggtatagtgggctgacgagtagcccctgaaatatgtccatgtcctgatccccaggacccgtggatatgaccttatatgggaaaagttgtgaccaaggattttgagaggagtttatcctgaatgatctgggtgggccctaaatccaatgacaactgcccttacaagagtgaaggagaaggaaatgtgacagaagaggagggggcagtgtgaccatggaggaagagactatagcaatgcagccacaagccaaggggcatcagaaaccaccagaaattgggagaggcagaagaggaccctctactagaggctttggagggagcgcagccctgccagcatcttgatttgcgacttctgatctccagaactctatgagaattaatttctcttgttttaagccacccagtttgtgatactttataactgcaaccccaggaaactaatacactagtttctgagaatagaatactgatcaaaacatacatggtccctaccctcctagaatatacagtctaggggagcaaacagacaatgaacgagtgatcaaaggtaagtaattaccgactatgatgaaacaacaaatatacttggatagagaagagtgcagaggagcgctttatttattggatttattggagtttagggtcagcatctttgaggaggtgatctttgagctaagttttgaaaggtgagaagaaccagccatagaaaactctcagaaaagagctctccaggcagaggagacaacaagctgaagactttgtgattggaaacagattctagaaacatgaagtagtccagtataggtagaatgaggtcagagaggtggggagggctaggacacaccaggctcatgggccatgataagctcttggtattttattggtataaaggcatctgatggttgagcgctggataccgtgggctactttaaggttttacgtcaattcctctggttattggtgggaaatagcttgggacgggggatcagggagagcatggagaccagttagtagactcttaaagtcttctatttgagctctgaagatggactatgtgatcccttagagatggagaagaggaggtgaattgaagacatattttggagctagaactgccgagaattgatggatactgggaaggcaagaaagacatgagttaaggacgaaaacaagattttagctttgagtaactgggtatatgttggtgccatttattcagatgagacaatgaggagcacagtgggaaaggaatgaaaccaggaaatatgctcccactcccatcacagtgtcaataaattcttctgagataaagaaagttagcccagtttctgttgttttagggacccagcgaaaagtgtcctggctcctgcaaaaggggcactaagaccattggccacctagatctaagcccctaataccattcaccacaacacacagagaaaaccaggagtagggaatagggtcttccagagacatacctgtcctgtctcccatgcggcatccacagtctgctctaattaagggttccaatgatcaggatctaatttaataaaccctcgccccatccaattgactctactaatcattcaccatgtttctgaccctgctggaggcaccatgagatgatctgggggaaacaatgattgaaagatatctcctgaatacctgaacacaccactacttaacaaacattcccactaaaacattttatgttctaggtcaatgtcaccctcagtttcttgaattctaaaaattgactacccttccccaatcttccctacaaacatatattataagaaatttactctataaaaagatgacatgtccacatggtctaaacctgccttcaaggcaacagagacaaggaccatgatgatgatggagcctgctcagggtctgccggacagctgaaatcttgtgttaaaatattagatgatactctttctggagaaggtgtctgaagaatcacctcccaaatccattatgtgggtcattttccttcattcctctctaacatacaccatactgctcagatccaggaagaaggcaaaatatacacatggcctcatgccatttgccaaaagtttatgcatatttctcattagaaatccattcactctagcttcactctgccctccttagcatttatttaatctcttattttaaggccatgtccgatactaacattcttgataatttgatttcccactcacaagaaactaaaaacagtaactatgaatggctagctaaaagcttgagaacaaaggaggagacagacattaaaaagcagaaataagaataggaaaagtttggggccagatagtaccagggcaaacaatcccactcaattcagtaaccctggggggcagcactgcagggtttaatccctggtagttcagttggtaaagaatctgcctgcaattcaggagaccccagttcaattcctgggtctggaagattcccctggagaagggatagactacccattccagtattcttgggcttccctggtggctcagacaataaagaatctgcccgcaatataggagacctgggttcgatccctggtttgggaagatccctgaagaaaggaacagctacctagtccagtattctggcctggagaattccatggacagagaaccctggcagtctatggggttgcaaagagtcgaacacaactgagtgactttcacttactaattagtagtgccaggacagctactgggcaaagacaagtctcctctgactaaggttgtcaggaccaatcttttccaagatgaactctctaggctgacccccagaaagagcagtcaatatcaactcaatacggtaggatgtgtcatgcacctatagcgtactcagcacagttccaagcctggaagaagccaatcacagctgcctgctgagtcatggggtactcctcagcctcagttctcctggcctcaaggggtcttctgggcattgatgctataggcatagaaaggaactcagtgctgacattttaaaattaaaaacaaagatctgtacttactttgatgaacactgatatccagacaatattccaatagctgtattaagtaaacataaatgtgagaatggctagttaggagaagcatccatggtcactgtggtgccagtgggcaccttgctcacaccccatcaattagatgtttcactttgattataaaatgatccactgtgccaggagtgagttcatatacccagaaattaccacgtacataatgctcaacaagtcatatatcactcacacatgttcatagtccagaacacacgtgtgctgagtcgagatgtaagttgttcgagcaagaagggcctttagcaatgaaatggctcagtctcttccttctgtgagtgggaaattcaggtgaagggagaaggaggaatcctaaaatcccctccaggccaaacaccatcaactcaactcacaggcctttatgggtcacacagcattttgtccctgaggccttgaatcctcagcagacaaatgtactgaggtcaagcgcaccccactaggcacccacgtcgagtagctggaggcctctacagaaccccaaactctttgagtcacaaggaggcagccctgttcgaacactggctctggaaagctcttcctcaggagagtatcccctccctgctccaacgcaagctcctgtctagaatcttctctcctgctgaggattaactatgctgcatcttgggcaggaaatgagttctttgctgcttattgtggtcaaatcctaaaatgaagtcaatctagcaggaaggcggataaacttatgtct

SEQ ID NO: 40027 - DNA, 761 bp, Bovine  19866881056506
gtaggattcatcctgacttgcatagccagagagggacagaggcaggccagggacccagtctttttgcctctctgaccagggctctcctaagatccaggctgcttcttcaatcaactacatagtttggtttgaagatttactaagacatttctggggaggaagcagaatgttaaattatgcaagacaaggaatactgttccctgcctattcccaccttctaatgtgacctcctggtctggcttctaactggtattactggggactgtctgatttgcccaaggtggacttgacccaaagccagggacagagtaacttttggtagaatctgatccttctgatccccacagctgtgtgtcatctctgggaatctaatgtgcagctgcaatctgaaatgacctgtaggagacttcattatttggcagcagtttttggtcatatggttgtggtgttggtaagattagagacagaaaaaagttttaaagctggcaaagtaaaatccctaatacatattggggattttaaaacttcctgacctggtaaagaaacacactgataagtttctcttgtgtgtctctgagtctgcctggggagtaatctgaatttatgttgccttttaattttttcctttcaaacttactgaattgtatgatttcaacatttaagcatcacagttggctactgagaatcatcagtgtgctcgcaagtccagaaacaagatttcaggcaaattctgaaattctatgtgtaaaatctagcccatt

SEQ ID NO: 40028 - DNA, 805 bp, Bovine  19866881084231
gctagtaagctgggtcatactcagaatgtctggctatgcaagtttgaaaaaacacatagaaaagttagagaacaccatggtaaaggatgtgagattatatgagaaataagagtagagagagtacacaggtaacggtggctggaactgctgcagaggggccagctgataggcagaaccgactgggggctgctctgcactgcagggatggtcttcctgcccgctgcagtaattaatattccccgtgatgtggtcactgcacacttaacgcctcttcctgactagaggggcacatcctgctcctctcctcctacagcctgccctctggtaattatggtgcttttatagtaaatctccttggcttcatgtaagtcctttcacagcacagcagccaacaaattgggaagcattgttcctaaaggcaaggggtgggccatgagttgtaactccaactctgttagaggccagcgatgtttgtctgcttcttgcctctgctgatgacatttgggggaaaaacaagtatggaagggaggacaagtcacaagatagcttttataaaatgcctattatggaaataatgagaacccaataactaccaactgcagaggcaagaaaaataataaaaataataaagcagaaaatgcacaaagcaaacaattaagaccattttattaaaacagtacttgctactcggcaagcattaattctcaacacacaagggcagtaaatgtttatcaaccgaattttgcatgttaagaaattcacacagaagttaatatgctccccaagctcctaggatacttcacag

SEQ ID NO: 40029 - DNA, 1783 bp, Bovine  19866881110379
aaggtgagggaaggtgaaggttaatgcactgcgggttttacagatcagccatggttgtagaaaggacaaagactctgcctgcagcctccacacacctgctggaacagggacccccttcctctgtctgtccgcagccctggcttccccaggcctctgtgaaggtctgctctgctcctgtctctggggcagactcagatggactgtgagtccttctcagaggatccctgccaagcactatgggatctaggccaatcttgtgtgttcctctgatcctgcagggaccctgctggggagctcatcaagggcaagctagggatgtggtgttgcacccacagagacccaatatttgtctgaacagcatcttcaattttctctctccccctattatgggtcctctggcctctagccagagctctcgcccatctcctcaccaccttccttgcattattcaggatccaaacaagttgcctctcttccatagagttggacttccgtgtctgtctctcttcctccttccctctcctcactcccctccccttttcccttctcccagtgactccagtacttctcagcaactggaatcattcatatggcatgaaacttccaataatggaaaagtacttaataatacctcttttactaagctcctttcctaactggtgaggaaaagaatgttctggttaattaaccatctaggttaaaagaaagttaccagagctgccatactaaaactaccaatttttgcaaggaagaaaatagcatatactacaatttaataattgatgaatccgaagatatttaagactctcctaaggcttttagtcaccactgagaaccctgaccattttgtgctgggaaatgtcataaatgccatttcacagggttttttgattgctggaaggagatttcacccaaccttatagacctgccatatgcaaatactcatgagcatgtacctctaaccaggcccctcccccacagctcttctatctccaaccaacacagcaaaaatggatagtttaatcccatccctccctcctggtatgccagagctctcaagtttagaaaccgtgggtacatgactcaggaaggatgacatggggtaaccttcaagcagttctgagaggccccacccaaacaacttccatgatcctctgatagccatcaggtctaccttaggccctggagaggctacaatccccaccaggtgagccgagttccctgactcagggagaagggtgcagggaggcccggcagtggctgagcccagaaaggcatgctcatatttcatcatccttcactcaaaagcataatatcatttctttccacagaagttaagcaaccatgacaattccagggcttagatgagctcccctctcctacatgaaggagggtgtcaggggactaaattagtgcccactcagatctgggcgactagctgactcactccttttttctgccgttctcctgctccctaacccgatcctggtgtatttaaataacagagacgattttgggccccagctcctccgggatccagcccatgagctgttgccaagctccttggcccacgggaagctcccccctcacggctgtcctgccaattatagaagaggtttgctcacatggcccacgaggcgagggctgatgaagcccacagaatcccccagagctggggagcggcttctgacatttcaaaaggtcaatcaatcacactatttcatgggaatgtaatcatctcccaggacctaaatgcaacaataaaaccaaatagcgccagaca

SEQ ID NO: 40030 - DNA, 1395 bp, Bovine  19866881186849
cttgactgacagagacgccttttcctccaagactttgcattaacacaaggaacgagaaaagctgatccgacaaaacgctaagaattatgtctttgatgtatgaacactctttgcccctttggaccttataaaccagagttcactccacattcccctgatgtgttcaaggtgcacgtcttcaataacaagcggtctctgaaggtagatttcctcttacaatcgagggactatttccactttaggggcttagaaatgcttccgattaattgttaatttagccttttgagacctcaatttatatgtagcattgaccagtgtctgcaaacaatctgagaaggggaaggaagaggtcccaaggaaattaatgtaatggtttcatctcattactagaagcgcttgttccaacagcccaacaacttcactcattcattcaaacccgatctgaaatccaattaaaattggaggtcacacacagcagcagcggttatttcctcattactgagaggtgagtggacttcaaaactacagaaaccaaaggagatgagagcagagctttgtgaaataacacagggtccagcacgaaggaaaactcgaggtgggaggtccccagggactgtcatggaaatgcacagacatacggtctgtggaaagccttgtttcaaaaagcatatggaacccatcttgaggaagtagtttcatattcctccagtagaccctttatcagaacccacaaactttaactccactcaaaaagaggcccaaaaaattaaaacaaaataaaattaagaagcagagaattaaccttccagagaaaggttaaaaaaaaaagtctgtaggtctatgggaaagaaatgctagtcattcgttcactcatccttttaacaatatctgttaagatcttacttgggctatggcagtgaacaaaacagtatctgtgcccgaaaggagtgcacagatttgcagtcatggacatggaaacagaccataagcaacagatatgatacatagggaaagtatattgtagattgaaaagtaaaagttgctcagtcatgtccgactctgcgacttcgtggactatgcagtccatagaattctccaggccagaatattagagtgggtagctgttcccttctccaggggatcttcccaacccaggtattgaaaccaggtctcccacattgcaggtggattctttaccagatcaaccaccaggggagacccatatggtagattagaaaggtgtcacttcatggaaaatagatggagaaacagtggaaacagtgtcagactggattttttggggctccagaatcacggcagatgatgattacagccatgaaattaaaagacacttactccttggaaggaaggttatgaccaacctagatagcatat

SEQ ID NO: 40031 - DNA, 2149 bp, Bovine  19866881322035
atggaccggaggagtcactgaaccaattatctagtgattagcttcttgcagaatccagagagttactggaagaaaattggtaaattcttttcattcttaataaaacctaaccattatcttgctaatgccttatattaagagttcaaagtcatctctataccattgatcttcaaaggaagatatttcctaatttatttaacaaggcttgaaaaaatgagggtgaggttcctttcagatgggaattttatttcaattttgttaaaatctcaagcattcttgtagaaaaagtgaaaatgttgtagtttcttttttttttttaatttgaaaacatgaaagtgtgggtgtaacagtgtaacatatgcccagtctgactcttcgcgatcccgtggactctagctcgccaggttcctctgtccatgggattctccaggcaagaatactggaggggttgccatgccctcctccagggtatcttcccaatccagggatcgaacctgtctctcttatgtctcctgcattggcaggcgggttctttaccactgagccagtagggtgggggagggatgcaaacaaataataagaaagatgctcttataacactattattactgttgaaaaaaaggaaaatcattccaagtactgaaaagtccaaagatgacatcatttgattttcttctctaaaggctttaaagggctctgcctgtggatcctatctcttgcatccagtgaggccctgtcactcttcaatggactggggggttcactattgcggtaagatcagtccaggtgtccaggcacacagcttaaacagaaaggtgggagcaccagggtactaaaacatttccccgcagaaatgctgtgggcaaggagaccctttcgctgaaccaggaggaggaatgggacagcatcgctccaccctcagagcggaggacagcagagccctggggtcccacttcagcttccattcccttcccagaacactgtgaaaaaaagtcaaaatgatatggctgtgaagaaagtgcaacatatgtttagaaataccggtagagggaaacatctgaggagtaagaaaagctttgccagcttttactacaaacgggggaagcagtagatcccagccccaggtaaacagactcccccttttctgaaactcccgtagcctaggaggtcagtttcaatttccccgtctagtgcactggacttttagacaaggcatagtggctgcctgtggactgaaaacacaagactgtaatccagggcctgattccagctataaaatcgcttgcatgccaacaaatgacgtgatggtaactgatatcccacagctgggagatttcacagtattccagatgagtgttttggaacgagaaataaacttgtgtcacggctgacttcctgccacttctggttcttggcctccatcgaatcactgggttcagtggcagcttgtaatcccctgagcattctgagcccaccgagggggaggggacgcccctccacccgggaggagacaggcacccttgtttccacaggaggcacagagaggctctgtgtcatcagcctcttgggaagcggacgtttctgagatcttaatattttccctcctattcctgagaaaacgctctctccataaaaatgagttgtcagctgctcttgaggccctctgaattgattttggctctgtccattacaggtagcttctgtgtgaagaaaccatataaatcttactcagtcagggagtgtttaaaatggcaaatttcagagtaaaggcttaacaaaaaccataaataaaacttcagaagtaatggaagtgtttataagcatctgtggaattccgcacaagaacaacaagcgtggttcgagtgccgagagattgactgaggtgctgtgtttgctgggagagagaggatatccatctttatttggcctctgtttagggaggctggacttggagaagcacagatgggggcagggctccgtggctggtacatgagaaggacttcatcaccatcaagggccggggtgagtttggactggggaggctgccaggaggagaggaacttgccaaggaccaggcctcaggtcccaagcatccaggcctactgtgtggatgaatggtggataggtaccaccttcacagtgatcgtgt

SEQ ID NO: 40032 - DNA, 827 bp, Bovine  19866881375301
tgtgaaataagggtaggaatggtgccttcttctagagttgttaggaggattaagtgaaatataagcctgtagcacacacagtatggtggctggcatacagtagtcctgaaatggtggccatcaccatctttattgccattaatgaagacaacaaaggtggagaaatagtaagatcacttgggggagggcaatgagtgcaatttctccgtcaattattgtggctcaatcagaatgtctttccagtacttgaaaaagtactcccccaaaacctgtaccagaactgaacagaagagaattcactgacagaagtgacaccaagaccctgaatgctttgcttaaggaagaaattatctgctgcagaagcttcaaaccagatggttataaatgagagttagcacatgggcattatttaacgactgaatttctttaactaaaaatctaattttattatggtataaatcacactttcttgaagtagggaattaattttagattttgcatttagtgttcataacctttccacgaatttgacagccaaatcatttaaaacgtcatttaaccaatacaatacaacagctttattcctcattgtgcccttcctgaatccattatctttcactataacgtaggggaacttaaagtaaaaaattaccatcccataaagctgtattttattgtgcagttgaactgcataatctttatttttgaatcaatataatgtgagtgctgagtaatatttttcataatccaaaaatctattacagattctcagctaccaaaaacgtagtttgcaagctgcgaaagaggacaaagaagatcctcagatt

SEQ ID NO: 40033 - DNA, 1569 bp, Bovine  19866881378551
atacgcatacgtgggaggcacagcctcttctgctataataaaagaatcccataataaacaccctggaaattacagatattcattttccaccaataaaaatcatcagcactgacttccaggtacctttttcccccaggtgtgtgccgtctcctgcttcttgtgcggccagaagtggaaacacccagtaggtttttactgacagcagaccagtctgaccttggagacctcttctcctaggtattcccaggattaagcacaggcccagaatatggcagggagtcagtcagtatttgctaaatgaattgattgtcaaagacacactcccatgagccagctactttactgaactgcaggactcttgccaataagacattatctccttacaaaatattgactgctaggacattaaatacactgaatagaaatcagggcttttcagagtatcatattttccagacaattctgatttcattcattcaacaaacatttatggagtacctactatgtgtcagaatggactcaacatttcataaaacatttgtattttatgggaacccacttttagagtatcatattcctcacagaggaaagagtaaaacctacctacctaactaggcaactttttcccatggaaggaaatgcaaacacatccctcccaaatttaattcgaacaaacatctacttagtgccaatgtgactttatttttaaaactatcaaagtactacttgggattgatgtatatcactatgtcagtccacaagcatttattaaacacctcagtgttcaaggaaggcaagaacttcaaaatagtcctcaccctaaggaccaggctgtgttgctgggagcctccgcatcgacacattatgtacccagaattaagactctaatctggatggcacacaccccgtgctccacccaggaggagaggggaacgggagaaagcattatcttctgcatcttcttcatctccaaaattgttagcctcaactgcccaaaacttcaagtaacccaaagatgtatctattttaaatacaggacacctaaattaccaaactggagctgcatccacccatgtaaagtcacatacaaatgtacccacataaataaacatccacagggcatgttcctggttcagtgggaaaccaatgaaaagtggtccaagtgaccccaggggagcaggatcacaagtgcaagttcagcctgaccaaagccttaacttcaaagactctgcagggagcacacagaaccaatgagcataatgtttaaaaacaaacaaacctgtaagcctccacaatttaaatgctaaaactgtggtccaagtcctagtttacttttttcagaggttttgctagctctgtcccagctcccttttgtatcagagcagagaggagcagcccagtaagctgtttacgtgatcctatttttgttgctgttgttatttctcgcacatgatcaggctggaaccaaaggcaactcagtccacattaggatcagggcacaaagaacatgggggaagacccattttaggcggcttcgactggttttttcccaagtctgcagactcccct

SEQ ID NO: 40034 - DNA, 724 bp, Bovine  19866881385994
ctgatacccttctggtggttattattgttgtttagttcccgagtcgtatctgactcttggcaacaccatagaatgtagccagctaggctcctctggcccatgggattctccagtcgagaatactggagcaggttgccaatcccttctccagggaatattcctgtcccagagattgaacctgcatctcctgcattggcaggcagattctttaccattgtaccacctgggaaacccgcccttctgactagaaagtactaaatttttctgtgctaatatcagatatttttgttgcactccatttcttgctttaaaggaataatcaagaagtacatattattcagttttgtaagatacaccaatgacagctgatctaccaggataatgtgtcgacctgggggcagcatttgtacagcaggtaaatggccctggaaggatttaacatcccttctgtgttcataggtctaaagtgttaggaagcatcctggtggctcatgctgagtgtctccacaataatcctcaaaataattggaggcagcccaaggtgtcacggccttgaatcattagctggtggagaagcaggaacaaacccacataatgaggtatcagcgagagaggggacccactgagagaagcaacatctgcccccctcagctggaagactcagggacccccgaggacccagagaaagtacaagggagctgagtaccaggaggaaaaatgaggg

SEQ ID NO: 40035 - DNA, 935 bp, Bovine  19866881400388
cctcttgctcttccccgcattctgtctttttcctaaaatcccatcctacaccgcaggcttgagcttgtagaaaataaatgccaataagtcaagcaggcaacttctgcctacagcctggccatgcaattccaccaaggcaatgaaaccccaaccctgctacctgcttgaatgggaagcaggagggtgaggggtagacaggaaaaatgaatatctcaaaacatgattcagcccacaggcaatatttgttaagccatgatggcttcacgtgctagtgaacctgagccacagtgagtggcacttcatgcactgacctccagattcaagtcacgccacagaacagtgaacagagtagccagctccaggcagaggagtgtggggaagtgaccttcaggctcagcatggcggaagctcttggctcaccagctccagcccgttagagctgagccataattgatcaccgcagcaaatcaatgcaagtgaggtcctttccaaagctctgtacaaaccaacttcataatgaaatatgagcttgtgaagtttctcattttgtactattctgacacttcttgcaatgtgattaaaatataataagatcaagtagaaaatactatttgctcaatcaccaccaaacctaacacagtcaatagtccaattccgtccaggaagaaaagtcatttccaagactctataaagaaacctacatttaaatttcatgttctctgctgttactttgaaaaattacatgttttaaatataggacaaatacagggcaagccaattcttgttataataaattttttctaacattctcggtaaataaaatctgtaagccctagccaatgaatggctgcttcaaggttcattcaataatacataattccaggccaaataataatttgctcaattccttgaagtctaattcaagccccatttcc

SEQ ID NO: 40036 - DNA, 825 bp, Bovine  19866881425121
actggctgcaccggtcgtcctgcagatacctttatggaatgaggtgaggttgtgtacaaatccgtcacaccagggactgtgatacccccaaatcactcatcttacaagacagaggtgcaggggtcagagggcaggggtgattctgaagatagctacatggatatgggtgaatcaggctgcctccaacccctttctggtcaggagagggttgtaagtaaaaatttggatttcaccaagtgctagtagacctgcggacaggtgttcaaacaattgagaagcaacttccttcctcctccaagctcagtgagctacaggcgtgaactaggctgtgagcctagagatactcccagagaccttccaaaacattcagcaaggactgagggctcaagcggctgggggcgcccaagaccttctgacgtttggattatgctgctaacaggacttcatcagtagccaaggactggctggacctggggaaacttgggccccacttgggtgacatcaccagctctgccaagtcctggatgctctgccttgtggtctcatcaagccggaggtgatacttagggatacgatcagttgtcactgatacaaatgagctgggtccaccgggtgagctgcttttaacatatcctgaaaaattctaagatgtgatgagatctaaacatgtcacaagcagaaagggcaagaaatgtttccaagtctcatttgctcttatgaagtgacatctagaaagaaaatgaattcgatgaagaggaaaaggcgaattatgatattaaaaattcatttccatttagcaaattgctattagcatcacaattcagg

SEQ ID NO: 40037 - DNA, 1649 bp, Bovine  19866881452971
tgattctcctgaattatgaaagaaggacaagactggtgatggttctcagggctcccctgagcccatgagctcagtgtgcagagcccttgcacgaggtgtgtgcagatggctaagtggaagtggtagggctggagcccagggctcccccccaccactgactggccaggatggtgcagtcctggtggggcccccagctccagagggaagccagtatagggtgaagcactggggtagttcagagtggagcagaggcacagccctcctgccccccaggactgccctgagcttcagtgaggtgcagcaatgttgaatgcatgctgtagggcgcacacaccaagggatccaaggaatgggggctcaggcacacctccctgcccgccccccaccgaccccattcctttttcagtgttcgtctgtatgcctaaaggccaccattaaaaggtaatgttctgggagagaaaacctgttcaaacgattgtcagaattacctccccagtatgaattaaccagttggccattaaacatctggatgtgaattagtcgattacctgaaacaccggtggcagctgtggtttcaaaagagcactgactattggaacctgaatttaaatccctgttttatccccgccagtgggtgtcaagctgtcctgtgcaccctgatacatgaagtgtttgttcagaacacaggacattcagagcctgcaccctgggatcctgaatcccattcaggacacattttaacaaatgctgctggaggtcagggccacccttggagaaatgctgaagaacatctgaccttggaagtcatcggccgtctctgtcagcttcagcctctgtctctaagtgaaagtgttagtcgctcagtcatgtctgactctttgcaaccccgtggactgtcacctgccaggctcctctgtccatggaattctcagggcaggaatactggtgtgggttgccttgcccttctccagggaatcttcccaacccagggatcaaactcaggtctcctgaattataggcagattctttactatgtgagccaccagggaagatgagggtgtttatgtgtctctgaccatgcccttgggaggagactgagaaacaccagcctttggggaaagatgaggtggtggggaggccctggtcttggatgtgaccccaccgtcagccccaggggcagaggagcactgacactatgtgtgctgggaggggctgtgctcaagagtgtgagcgctgtgctgccatggggcaggagtgacacccaagaggacaggccagcagaggccttctgcacacgcttctgcagcttgtagagcaggaagccaagtgcctggtgttcagccctgggtgcctctccccttcagacgggtgggcactggcccagtgctctcccatgtcactgaggaaggtcgtgcaccttgaagaagacagagggtgccgtgagaagggtggaagctgtgactctattacggagtcggagtcgacaggaaccatcagcagggcagccccggggaggaaagtggcatatggtatcagcaggggcaaatgagtgcggtgttatcttcccgctactttatgatcactgtttgcggagagtgcttaatttaaagtgtcttctcggcatctcaagtgtgagcaaagactaaaca

SEQ ID NO: 40038 - DNA, 1651 bp, Bovine  19866881639001
gtgttggctgaacctgagctcgtaaattcctttaaagaagacagtcacagcctgcatgccagcacttcattctgcatcactccacccctaaatggactgcactttcctttatgcaagaggtgagaccctgaatgtgtgggtgccaaagctccatctataattcaattagatatttaaagtgtcaaaaaggcttccccggtggctcagtggtaaagaatccgcctgccaatataggagatgcgaattctatccttggattggaaagattccctggagaaggaaatagcaacctattctggtattcttgcctaggaaatcccaaggacagaggagcctggtgggctacagtccatggggtcgcagagttggacacaactttgcaactaaacaactatttaaagatggaatctgctaactaaaggaatcttacagagaattctatatcaggagacagcttccttcctcccctgcaagtcttcagtctggacaggaaggcatcctgtcctccttccagcctgtctccaggctcacacagagaaaaagctttgagctaaagcggacatcgcagtaattctacccaaaacttcttcctgccgacaatcaccacatgcacaatctaaaagaaactactaatttttttcttttaataatcatgtggtatggaacacaggtcaattttgaaataagatacataaggaaaaataaatcagaggcctgcctcatattcctatgagtagtaatagatgctgaattggggacctagtagcttggttcccctggaccacccattccacagaagatgcaataaatgtgacaaccacaagttgccacaatcagaaaagttcctttgtttgccactcagatggaagttatttattatttactgatctacaataaatatccatactccatgtgggccagacaacttaccagtccattctcagattttgttttcagatcaagttttattaagccaaatcctaaagaaagaacatggtcactgttaatagattaaataactcaagagcagcatctctgcctcccttaggcaatcttaaaaatgccatgagtgtagagggtaccagtctccactgctgcctgcctctgtgggtggagcttggttgccatggagcctggttgccacggaacagtggcagatagaacaggcacagcccccacctgcagtcccagaggagtctgagaaaaaggtgtgtgacagcgtgagcaccagcctaaggacaggctaaatttagaagctgcagtccaccgcagcggcacccagacctgctcccgcctgggagaggaaacaggaaggtccacttgtctgagcaattcgctagcctacctggactgggtgcacgaccaaaactgcgtgactagccacagaaggcttatcctttttccctgacatgaaggttctaagagctgactgacccagctctctcaaactgtgacgggtagaataccaaacaagcaaacccagtctctgagctgaaaggccactccatgcaacactcaccatagcccttggtgaagacatccctggcagatttgccaagatcagcatacgtgggaggcacagccatcttctgctataataaaagaatcaccataataaacacccggaaattacagatttcattttccacca

SEQ ID NO: 40039 - DNA, 914 bp, Bovine  19866881958319
agctgtcttggtgtaaggatgacgactggtcgaaggaactatgccgcctatgggtgaggtcttttgctgcaccacgaaatacagagagtctcagtttgtatcctccctgaaagcagggctaaagcctttcttccattggctcatgccaccatgaacccgttagcaagagggcacgttctccatgcttggagttcatttcctgagcatggcttgctggttttgtcctctgggtctgattacagggcagctgcaagggcagacttgtcagtggcctctgctggggccaaggggccactcccaaccatttctataggaggctgagtcaggaatgctgtatctttcagagagtgggctcaccccgctaggggtgaaacaggagcttccagcagctggaatttcctctggccttgcccctccccatcccttcatctgatgagcagcatttctaaaaatcacaatttgtaataatcagctctagggacatgctagtcaagtatatcacatcatcaatgacaattgtcatgtcaaggtctttttcttttccctcagtaacaggacgatcagagagtctcccctttgactttcaaagagtacatcactcttaaatttggcttcagaatatcttaacatttccaggaagggatcaccgacttgatggggccacagctgagttcttctggtagctgtttatgggaagcatctgacccagggctgctggaatcaggaagggccataacaatcaccttttatttccctgaggttggagaacatatgcctgtggggtgaaggtttgccctgcttcacttactactcctggcgcaaacctcacattgttttgcatgtctgctcaggaaagcagacagtggggtgaccacttgccaggtctgttgcacagtcacacagcggaaacaaag

SEQ ID NO: 40040 - DNA, 3417 bp, Bovine  19866880392068
atggtatcatcaactcaatggacatgagtttgggtagactccgggagttggtgatggacagggaggcctggcgtgctgtggttcatggggtcgtgaagagtcggacatgactgagcgactgatctgatctgagcaactgaactgaactaatccaatatgactggttttaaaaggaaaagacagacacacagggaagatgtccatgcacgaagaggaaggcagagatggagagatgcagctgcaagcccagggttgccaaggatggacagccactgccagaagctaagaggtaaggaggattccacccagagtctctgaaggaatatcagcaggactagagtctcagagggaccttgcccacacattgctttcaaattttcaacctccagaactgggagagaatacatttctattgttctaagctacccaggttggggtattttagtacagcagccttaagaaatgaatacaacctctcagttcaggtataaggcctgactttcatctctggagagttctcccctctatcccttcacaatgagagccaggctggaccagaatgcactcaagtgataggaactgcctgcaggagagtgagaataaaagcaacaggggcccgggcagatggcatggtctcagtgaatatgttacagagaaggaatattattttgaatcatagcattatctgtacatgtagcacctgtggtctggctccagaactagaatgtgagcactcgggaggacatagttaaccaggagcctaggaacctgccatgtttccccaccagggctcaggccaacagtctgcatctttaaaacctcccaaatggctctatagcttgagttgagacatgggaaaaactgaggttcggagacttgaagtggcccaagtcctcaaatctggctcaagacacagcactgcagaggaatccaaaaggggatgtttccagagaacaagtgtggtccaatatacctggtggtgtatgttgggtccttgtggttgggaaaagttacttttttttcatactttttggccacaccacagtggcaggtggaatcatagttccctgaccaagatcaaacccatgcccccagcagtggaagcagtcttaaccactggaaagaagtcttggaaaaattacctctgtaagactcagtttccttatcttcgaaatgggaatagtgagggaattatgagaattcagtgcagaaatgcagtggaagttcagcatctggccctgggaatagtggccgtacagtggcaggcagcagccctgccacagttacaagggaaggagctgggtggaaggagacctatgctattttgcctcttagtccaacgtgcctctcaggatactgttccatctttcaatagtctgaacagtagttactatgacacccagcacaatcttagagtgagctggagcatgggattttagactgagacaggagggcttgggaactctggacagtatctctgcatttggaatcctgttcatagatattagagctcaggtttttaggtaataggtcgcgctcttgaaaacaaaggtcctttaccagcctcttgagtgccttgcactaaagatgctcagagagtcctcaccataatgggtggctgacctcatccggatcttacacagcaaggaggggctgtcctgtccccggtgtgagcatgcactggcaggcaggctgtgttccagcccaggactgtaagtcaggcttggaggttcaaagatgctggtattcagtatatttccaaaatgatttgttctaagctaatttatcttctgatttctatacaagtcatgagcaagaaacactttcaccttcagaaagatgccttttaacttgaagatcattttcatcattagaaaacagaaaccattaaagatgctctcccctgttagtgctcaggagtgggcattcatatacatacagtttaatcttctgacagatcttggccaaaaatgggagtgaacaaataccagcaccacttctggagtacgtctggagagaaaagcaaaaagagaaagagttatttatttcaaggaatggttctccagtttctaaaggtacttcctctcttcttggctccacaatttgaatttctggactcttctctctccagaatctgggccatattacttaactcaatttgccccttgttcctgtccccacactccaagttcattgcacctgtgtgctggctccttcgcttgaaggtctctcttcccccagccagctagtcccatcttcttgtcttttccagctcttcccaaaagaagagacccatcttggtccattctattcagacaacattcttctcctccctatcttcagtggctttaaaaaaggatttgaaaaataaagactgttttcaaataagataattccatcctgttaagagataaaataaagactaatgggagacatggcttaggaagaaggaaggccccttccctggggggtagaggggtggaaggggtgcagatgaagcccccagagtttcctgaacaaagggatttcagacagcagtttacataagactctagctgggggataaattaaaaacccgggcttttttttttttaattaaacagtgcttttagaagtattgcagttcctgtgatgcttttcacagacaaaaggaaaaacaactgggtagaaaaagtcaggaactggcatttatcaacaaagagagaaagggagacaggtatcccctgcttttccaacgttcacttctcgccaccttgattcgatgaaagacctacgttagtatctattgtcatgaactgaaagaaatccaaagaggagttttcactttcataaaaacagaaaaaaaaaagcgaaaagcaaaaatagtgttcatcatctgttgtccaggagccagagtggagccaatgagtaacctcgagtactgagagaggccccgcccagctccttccccagaaaccacactgaacacttaggtatcagggagaaatagctttgaaccatgtctgtgagcttctgtgcttgatctccacttattgtgtgcatctgttagcaagatgagtgctaaggtagttgctgcttagccttaggaaagacttcataggaatggtctatttttggatagcagggaagcatgtggtaattctcaccaacctagagagtccttcagatggctgtgagtgttactaacagttgtcagtattctgaccctagcaacggcagacaagtaaccttttctggctacaaatgagatatttaaggatctttgtgatctttgtacaactttctagaatgaggaacaatcctgactagtgtcctcaactaaatgcaagaggtggagcagaagaggctgtccttgtcgtcatggagcttactgtctagtggagcataggggtggataatcccagctcttagcatgct

SEQ ID NO: 40041 - DNA, 1150 bp, Bovine  19866880392845
tcacatctgaatgaagcttaattacccatctattttcttcataaggcacatcttggtctcctgcacttaagcacacaatgcagcgcttcagctctgcactcagggactattttaaacagtggaatcaccaacagaaagcataaacacgaccaaaatgaggcagtaaatacgttgtagaaaggactcttgttttccgtgtgagaactgaaacaagaagtcaaagtcctgcctttttcaatctcagcaatgggaacatgcaggttaggtgatggaaatttctcattgctcgaatgaccgcaaaagtgtcgtgagtgttaattgggaggttacaaatatattttagccagtatgtgaatttacagatccagaatttgtgaataatgcggaatgaccatatcttgaaatatcatttatggccatgcagtactttgaaacacctgtagttattagacccaatgtaaaagaagtacatatgggaagaatgggtacatgcatatgcatggctgagtcccttcactgttcatctgaaactaccacaacattgttaatcggctataccccaataatggacgcccatttttaaatatttcaaaatatttttagtactgtgatactttcatttcgatacgaagggtttctttttgtaatcctttgtgtttgcaattaaaaatgttattctgagaaaggatctccagcttgcccagcctcccaaagggctgcatgacacacacaaagtcatacattctggggtgttctgctttgagaaggaagaactccacggtctaaaatgtctgggagcacagcagaatttatctgcttcctgggaagtcatagggtgaaagttctacagtaaaaagatctgcttagctcatcatttgcccagcagttttgaccgagagccccttctcctcaaaggagagctattaacactgtgggcatcatggtctacagaaacaccttggaagatgctatgaagaggaatcaacctctaacacactcaccagcagtatccagagagaatttcccaggtatatttagactagaacccccactcctcatctcttgagtaaagcgggatgtctttggaattcctctcattgcaacaaaagctttcctggtagaactaaaaatgactaaggcagcatttctc

SEQ ID NO: 40042 - DNA, 1916 bp, Bovine  19866880429568
ccattgggaggagagtatatagggacattcggaggctgccttgaaggcttcaagtcacaacccctgtccctgatgctgctcacatctgtatctacagctcggatcccttcctggagcttgctgcagagacattctataggatctttaaatgcaacttttactaagacctcctcaaaacccaccctatccccctaaagctgttcttgatctcagcaggcaatgtcctgctgctcatctatccaatttcccaactcacaaaagaagcatcatgcttagcatctctttctctttcaccttcacatccaataaacaaccatgttttgttgatttaacggtctgaatcactccaatagaggctttctctctcccactctcactacctctgttcaggctaccacactctcccacacaaaagtgtcctccaaacaggtctccctccctctggaccaaaccattctccacgccaccacctcaggtatctttttagagcacaaagtgaaagaagtgaaagtgttagtcgcttagtcatgtctgattctttgcgtgaccccatggactgtagcctgccaggctcttctgtccatgggattctccaggcaagaatactggagcggactgtcatgcccttctccaggggatcttcccgatccagggactgaacccaggtcttccacattgcaggcagattctttactgtttgagccatgagggaagccctaagtctgggtatttttccttcttgctgaaaaaaccttcaatgtctccacttccatagctgaaaggtcaaatcccatacagaccctatgtgatctgtccctaaatctctctcttcatccttctctctccgctccactctcgtgttctgtgtctcagccacactgaagcacttttacttcctccaatgtgctgtgctttcttttgtattcaggtccttgcctttgcactttctttggctcaaaatactttctgcagccccttccctcttcctgtcacttgacaagtccatagtcttaattctgagttccctcatccaaaagtttttctcgtacccctttgctccatcccatctcccataatgctcccttagcatctgtgcttgtaaattagaggcattgactactttacatttaattatctgtttacttctcattctcccactctatcctataatctccttaaccggcaggggtagttttttgttcatccttgacttctcactgtatttgataccggataggcactcagtacacattcttgggtggcaattcgccatctagactgttcagctcaacatacaggctaagtaggcaggctttaggcatatctctccattgtcatccactttagtcatagctccgcccactgtggcccactccatcacccactcccagcatgtgaacgaatttctcaggaacgactgaagattatagcacacactgattttcagcttttgactctgttcacaacaattagttattggtgaaaccgtctgagtgcaagaaagagccccaatctgacagaacttgaaccctaatgctattttaagaggcagggacacaatactcttttgatagatcagacagatatgtcccaagggatacaacaaagctgtctttgaccctcttctttttagtttgttcctcattactccccatccgaccatctcctctcgtccctgttcttggtagagtcagagggtaaaattctgtgatgtacaaagaacgataagaactactacctcattactgccagaaagcaggtctccacgtgaactattctaaaatcagacatcattgagggggagggggcaaactctaatatttaagcagcttctagtcaataattctctggatcaacatatccaagcgatacacagggaaacttagatattctgaagtgcattacttaaatttttt

SEQ ID NO: 40043 - DNA, 2436 bp, Bovine  19866880482275
tgatatctccacggaaagagggaacaaaggaaaagagtgagcggtgagggccaaaatcaccaaaatcaaaaaaagctttgaatgtgttgaagactctattacatattactatttcaagaagaaatggtcataggcagttaaacatatgaattcagaaattccagggttggttgttcctgaaaatacagatttaggaaacataagcatatagatagtactgagagaggattatattctcaaagagagattatagatgaaagggattctaggcagtttcctggggcttccctgctggcttaagaatccgcctgcaatgcaagagaccagagggttcgatccctgggctgcgggggaggacatggcaacccactccagtattcttgcctgcagaatccccatggaaagaggagcctagtgggctatagtccatggggtcacaaagagtcagacactttgctgagcgactaagcacagcacatcacacaggcagtttcctggagcactccaacactaaaatgttaggcagaaaatgagtaagaaagatcagtcagtgaggaggaaagaaaactagaagggctgaaggttattcaactgtgttaaatgctactgaaaagtcaaatgaaaaataccagagatgtgaccataaaatttggaaataagattactgataattctacacaagagcagtctcagtaacacagtgaggaagaagacttactagtttgagagtagataattctctgtatacgttaactaatataattcttaaaataaatatatgttacaaattattttaaaattaagcatgtcatttgccagtttccccatatgactgatttcccagaggaagaaaatcatgtcatattcatctctacattcctaacagagtgctgatacacaggagttgtttaaaaaaataaacaaaaatacactttcaggaaaatttctcctgagaaagaaactgtgtctaaacacaaaagacagatttagggaatatactaaaatataacactggctgactaaaacacataaacttttcacatttcataagaatcttgcctttcccaaattctaaaatcaaccacagtctgtaattcagaagatttaaccacccactgattctttttctggacaaatataatgctcacagtgccagtgtgaaatataatctctggataaagaaacattatttatagacccgagtgacgtaactgtgacacttataagcatgcaaatatagataaaagtatattcacccaggcttcacccaaaataccttaaaagtattacttgatttcaatcatcagttatgtaagaagaaacagttatcaaatcatcttttctaaaagcacatgttaaatctttcggtaactatctaaaagatatggcaaatctctatgtcaaattcacatttaagaaaatcaaactacaattccattgcttgctatttcactacctgtgggaaaatcaacttaaatacaatacccagtaactgcagtcattaatttacttaaacttacttctagaaatcaattatattcaaagaaaaagatgcctcaaaaaggtttcaataatagattattggaactcttaagatttgtttatattctctaccatttgttcttatttcaaagtaaagttatcaaaaccttggcatctgaaaacccattataatttttaaattttgaatattaatatttataaattaacatatattttccaaggagaaaaacagcaccttattttgaaaattgctaaatatgcttttggggaacaacaataaaactgagttgtaataggttggaagcaataaaagtgagaatttgagggaaaattaaaacatttttataggatctactataaaccttcaactctctcaatcactcatgtagagccagacatcctggaatgcaaagtcaagtgggccttaggaagcgttactatgaacaaagctagtggaggtgacggaattccagctgagctatttcaaatcctaaaagattgaaattgagagtgaaaaagcactgtttaagtgctgcactcaatatgccagcaaatttggaaaactcagcagtggcctaagagctggaaaaggttacttttcatctcaatcccaaggaagggcaatgccaaagaatattcaaactaccacacaattgctcatctcacatactggcaaagtaatgctcaaaattctccaagccaggcttcaacagtgtgtgaactgtgaacttccagatgttcaagttgaatttagaaaaaggcagagaaaccagagattccaacatctgttggatcacagaaaaagcaacagaattccagaaaaacatctgctttattgattatgccaaagcctttgtgtataagacaacaactgtggaaaattcttaaaagagataggaataccataaccaccttatctgcctgagaaatgtg

SEQ ID NO: 40044 - DNA, 1504 bp, Bovine  19866880518678
ctgaccccccaggaggttctaaccccacccttctatgcagcagccttgactgagggcacctgttaccctcaggtgtgaggcagagagtcggcacagttggatgttctttttccatccttgtctgaacctgaccaacctgtaacttggctgcagcattgccttgtgaagttgggcaagtttctggaagcttcacccctctgatctgaaaccagggagattagaatagtttgtccttgtctgaaaatcactttgagacttgcaggcagcagatggccctccaaataaaatataatctcccctctgccagaccaaacatcctcaaggtcaggttcacaaatcccacaagaagtatgaagcttatgggtcattgagggagggactggcatcaggggcttggactgggaggggggctccaatcccccgtacctcccaccattccctgaacagtgaaagagcccgaagtcttcttattgattaggttgatgaggccatcagtttaatgataataatatgacttgtggaaaagatcctacattttcaaatagaataaaaggagaccagctgaataagagacaagattgctttttctccctccagcataatctcctaggccccctctctgagtcaagagcgtgtctcctgtgaaatttcgccctgaaaatccgcagggtctttaaatttcacagttcctgcctaatgtcctagggaaatggcttcattgagaatcccctggggactcacagggggcaaaggacacttaaaagaggatccctcctttaatagctactggaagtggtcagatgtaagccttgggctggcctttgctgcccttggtctctgttcccatttttgtccccagttgtgctgggtgagtttggcagagtctttaaagtcctggcatgaatcactgggaggcacttggcagatgccaagcgtgattgtgacaccatcagaataatctccactccaggtaccaaatagctgttgctaagaattggaaagaatattattttctttctgagaatttgcaatttggccggcaatgggggaggaatttcattaaggactgtgggtgggtggtgggggattctatttgtggagttaccgtgtttctcctcaccaagcctcattgagcactcatacccacacagtcctgcacagcagctgcggctgctcccatcttacagatgtttctcagatatttatggtttaggtgcagcagagccttgaacctctgagacttggattcacacctgtctctctaacttgaaaaataccattttcttacctccatgctatcttgggggcttccctgatagctcagctggtaaagaatcagcctgcaatgcaggaaaccctggtttggttcctgggtcaggaagatcttctggagaagggataggctacccacaccagtattcttgggcttcccttgtggctcagctggtaaaggatctgcctgcgatgtgggagacctgggtgcgatccctgggttgggaagatc

SEQ ID NO: 40045 - DNA, 1159 bp, Bovine  19866880734946
ctaagcagctgagtcttcacatgacaagtgggcacgtgagtggctgtcctatgggatgtgatgattaaaaagataattctgtgcctagtctggggtctccccccacaatgtgcccctgccagagaagagcccaggcaccccagctgtgtgaacctccctgaaattactggtctgggaaatttgtcagggggactaggaggaggaacatgctgtggtttggggatgtgcttttgtctcagaaacagcccccaggcaggtcacccccagacccagcgtagagtttgctactttccctttatctccccctggccttgcctgctgttcttcagcttgaggctgagcaccccaccagacagacctctctgcacactaacgcctcgtcttctcccgcagggtgccgggtttgcagggttcctgtgggacacggcggccggggtggagctgagagatgccgcctggcaggagagctcgcccggcaacgggcatgggaagccggtgggccccagcccatacctcgcgaggttcaaggtatcgctcctattgctgtgtggggccactccttctgaaaaggagaaaagcccactttgaactgtgagccagagaagcccacctttttgccttggttttattctctcttggggctgggtcagcacacacacttggggttccctcagctggggagcttgtccagagaaggaaggagaggaatttgggggagatcatagctctggtaacttggacctctgggtgagaaggaagtcaaatggctgcttcccaaacctgataagcagcagaatcacctggagagattttcttaaaatcaggatttcctggaccctgccccagacacacaatgtctgttttccagaatcacctcctgcacttcatcagtgctctcagtgctgggtaaggaagctgctcgtttgggaatctctggattagagggcagctgaactgctctgaggacacccttctcttactagggagaaggggagccctccaggggtcactggggcttggaaggggctcagaaggagcttctgggtggtggggccactgacacttccagacaagccctctctctccagagttgggagcagcaagcagactgacctgagctgtctctcgattcccctggatgccatgggaagtattcatg

SEQ ID NO: 40046 - DNA, 863 bp, Bovine  19866880734997
cccaaaaatatgctcctattgaaatcaatgtagtataccaaaccccaaaacccctgtaaaacaattcattctctttgaacacaacccagagaaggcgtgcaaattactggctggagtatacactgtcctgcaaacacagataaagtaattattgcagactaaggaatttaacttaatctaacctttttaattgcttaattaagacagaataatcattttttaagtccctttgaatatgaaaaacaagcatgagcttatcttaggaatgatctctcattgaaagaagtaacactaaatctaaatgctatgtcactgaaagaataatttatgagccaaatgccttccaaaacacaaaacctttatcctttaaggtcttcaacaaactcaaaagtgacagtattatacaaattaaataaaataaatcattaatcacaataaaatatatcattcctaagatacaaaactagcttaaatatgttcatttatggacacacccacattccattctggtcagttagaatacttatgagtcagtatattttcagttactatgagcaatgggtcaaaaaaaatgaggttttgcaattcaaatatacacaaagtgttctattgttacattagattcaaaaatttcaagattaaaacaaattaaagtagataagcaaaaaagttccctaatctgtaatataaaacttatagataccaaagattttaatgtaaaagaagtgatatatctaaaatacataaagtcaacagctacataaatgtaagttactctttcttataatagtatatcaggaatttaagagttttttttatttataaggtacattccttcaaatatcacacctcctccttcaagg

SEQ ID NO: 40047 - DNA, 1041 bp, Bovine  19866880746934
ccccaatcctgacaaccactaaatctactctgtttctatcagcttgttatttttttttaattctacatataagcaagatcatacagtatttatctttgtctgacttatttcactcagcacaatgacctaaaaaacaaacttcttttaaattttaaacttttaaaaagaatgttttatacttttaaaaaattccccaaatcctctagcaggaagagacataatgagtgttaaatgtaagaattataaatgtctcgagagctcaatatcccaccaagaccattctcagtattactagttcaccaggaaatagtggaagcctcctactagggtaaaacagggcctcacacaagcaagagccttctagaccacaaagcttgctcttaaaccacagccacataccccagcctcacatgagacttggggaggagcttgtgcttggtttccatgataaacaggtctgcacctgtgtgactcttgtgaattttttgacataaatgtgcatgtgtgctcggtcttttttggagaagacattgtgatgtggggcattgatcttcagaatctgcttgaaactagttatttcagttattagagtgaattaaaattactaagccctacataaaatacattttggccagctgagcctaattttagattgttggtattgatacccatcagcacagactgataccacccccgcagactctatagcatctgtttgcctctattaatatggatggaagttttttgtgtgtgacttgagaacagaccctccactgatgttgctggaacagccaagaaccatgaaggtttgaggggtggtacagattgtttcccccacctagatctttgaacttagttataagccccagggtttagaaagatgaaagtcagaaactgggaaaactattcacaagaaacatttatgattctcagtccagagcaccactcattcagatcccaggtcacaaagcagagcacagaactggagggaagaggccattttctctgcttgctcaggaaatatcattctgctctgacaag

SEQ ID NO: 40048 - DNA, 1370 bp, Bovine  19866880751574
tgcctatacgtacatgtcttctttttttttttttttaaacaggaaataggttagcaaatcttagcttcaaatcccatctctccaattttatgtttttaatgccccaagtgacttgatttggagttatacattgcttttcaaaattgttctctcacataatgtctattgggttggagagaatagataacctttaacactcagattctaggacacttctcatcaaagatgtgtgtttaaatgtccttgaatagcattactgtgccaccttataacaatggctttgtctatttctttctaggtgtttgacttgtttctggcccaaattgcaaatttaagtcagaagcagagggagcagcagctactctagaaaattccatctactttgcaccaatttatgttggcccactggtctcactcttatctctcgagcttgatatggtaactttggtcattgcttttggttcttttggcttttgtgactttttaaaatttatttttggctgtactgggtcttcattgctgagcatgggttttctctagttttggcaggcgggggttacactctagctgctgtgaggggacttctcattgtggtgggttctcttgcagagcacaggctccagggcatgtaggcttcagtggttgtggctcatgggcctagttgccctgtggcatgtgggatcttcctggctcagggattgaacccgtgtcttctgctttgacagacagattcttgtccactgagccattagggaggccctggctttcatgactttttaaggctaacagcagtttcttacttttttttttttaagttgtgattgttgccttgctcttccctccagctggttctgcctcccagctttgaagaacttctttatcatttagccctggcaggcagaacttctctgacttctggcctcactttcagaaggggagttggataaccataaatgctcaggttagatgtgttgggttcaggtgattatttctgttaaggatttggagtcacccgttttcctctctggctgttgcttggagaaaatagtatgcatgaaagataataatggagaaccactttaattaatagctggtcaaacacctaatgcagggcttactatgcatgagctcgacttctattacacagtaaccctggccctacataaatttggttcttagaacatttcagactctgacccacaaaattagtcacaagccacagttagctaagggttggagaaaagcataggaggtggcaagaaggaggagcacctctccccagcagttttcctaatggctctaattcaagcagcagctaaagaaggacacggactcaaacgtcatgttgccctaacagcaaccaaacttga

SEQ ID NO: 40049 - DNA, 830 bp, Bovine  19866880767891
ccactccagtgttcttgcctggagaatcccagggacggtggaacctgatgggctgctgtctatggggtcttgcagagtcggacacgactgaagcgaattagcagcagcagcagcagtagcttaaaaagaatggcaatggcaatgctaaagggagagaaggtgagaaccagaaaagtgcatcataagttgaacttggcacggtgttgacattggggctgatgttgccaagcgagcctaaaatgggaggcagagcagagaaggcccgcctgttgcctgtgtgtgtgtatgagagctgtctcccctacctccagccagaggaacttcctcctccagcccatgggctgcgtgaaggaggctcctcaccccactcacagaagtgcagggcccaagggcattgcctcattccctcctctgcttctggggcattctgagctaagcaaagtctcctaattaggcacccagaaatcaaagtgctaagctctaccaagaagtatgtttcagaaaccctccaatttaatcaacagtaaagaattagctgtactatgagaaagcagaagtctgaaactaactgcacatgttgcttttaagaggaaatgaataaagcaaacaggagctagagttcctaagtgtgatggtgataatcacatcgtctttaaaaattaatgaatattatttcctataataataactctgggcactaccaccaaaggcaacgtagagcctctgatggtaatgttctccattctggtactgtaaatgaagccaccttgttactgttgggagctttgctataataatctccagccaaatgctccataagaaataaaata

SEQ ID NO: 40050 - DNA, 1979 bp, Bovine  19866880792560
ctgagtgctctttagttttgggatctgcagtttgtcaacactgtgtcgtgaggaaaaatgttgaggtatgagtgaaacaagaataaagctttagcagagaacctgacatctggaaaaagcatcttctttctcaccttcattggttctgtccacatttcagtctgctcctgtgtcttgtcttccaaacttcccagggataaacccgcccagtctactgtaattttctctcctgcctttaaaccatgccgttaacttcctaatgggctttcttgtggggcctgagaccttagattaggccaaatgttttaacctttttagaaagtgtcatgaagtaggcaatttgctgctgcagaggagaagtgttggttggaaaagcctttctcagtctccaccaggagcccccctcccctccactgtccaccattagccctgctcatcttcagccattttcagttaaaattgcctttggcaattcctgtggtttgtgcttgctgtgatttccagggggcactggcctgattccacacaacggggcttcctgagagccaggatctgggatgcctgccaagtactcaagagcctggaggcctgaagtgcccgaagcttgactgaacctgccctcaggaaaacgggttctctttggggaacttctccacatgtggaggatccagagccctgcagtttgagggggagcctgtcttcccatctgctgaacaatccagttgctaaaaatagagaccagacatcatcttgcccttcagagatgctctctctggaagcatttggctgttgccgaaaccatcgtcctgttcatcagaaagacacaggctccaccctggttccaggtgccctgtgacttgcagctcctcctgatttctccctgatatacccatgatgacacagaaaaataacaaaactcccaagtcagcaaaaaaccagggactgacaaatgccaggatcttggaagcatcaactgatgatgtcgagaagacagagctgggccatggggctctgtctaggatgtaattgatgacatgaagattcatgggaaggaaccctcaaccccctctccctgagaaaagtcagaaagtactttataccttctcttttgtttagttcctgactcatgtacttgaagtaaattctaactggttgccctccccgccccccacacacacttatttttcctcctctcagctgcaggcctcagatgtggtcttttgtaaattcatctctctctgtctttgttactccctgtatccaagtagagaaagaaaccatgggaagaaaaccagatggggaataggagaaactggcagggtttcagtgtattctagtaagtatgtttccccaaagcaaagtgctgtaaggagggtgccctgggagctgtgcatgcgggaaaatagaaagctttctgtcttgagttaagtctcagggaaggaaatgaactttgttagagcaagggttctgaatcactggaagctatgtctttgccctgtcctctcccacagtgggtacagaaagatccattctttatgcaggtgggcagaaaatggaaccattgccagtctactcataacatctgttgaactttcatcactggtctggacaaacttttccttattcaaggatgaatgaagacaaaaaaagggcttctctggtggctcaggggtgaagaatccacctgccattgccagcaatgcaggagacacaggttcgatttctggttcaggaagatccccaggaggaggaaatgggcaacctccactctagtattcttgcctggaatatcccatggacagagtaacctggcggcctacagtccatgggatcacaaaaagtcagacacaactgaacaactgagcatgcacacaaagacaaaaaagactgtggggaaaagtcctccaggataaggtaaaggcaatagcttctaaagacccagaaccaggtctgtttttggaaaaatcacctacagcagg

SEQ ID NO: 40051 - DNA, 2637 bp, Bovine  19866880824414
cctaatggaggaaaatatgatggagtaggaacaagaaatctgatgcctggggctttactggaaatcctaccttggctctgggcagttgggcagatgagatcgtctctgggtctgaagggcaggcgggtcccacctggcgctgatgttgtggaaaggaagtcacactgttgagtccccctgtgcacccagtcccgtgggcctgccgcacacattgtctcacacaatcttccctcagtcagtaagagatagtttgtccgtccgtcctttgtagataaagaactcaaggctcagacaggttaaacaacttgtcaagggcagtaacaactattaagaacagatttatctgatgtcacagcccttcctgattccgtggctcccctggcctgaccgtgatattcctttcactttggtccatttctagatcctttgctgccaggtttcaccataagaacaatagagcattggacacggacaagtccaaggcaactggctgacagtcaccaggcccccacaaggcaggtgccacgctgtttcctcccagcttctcctcttccttccctcccacccttctctgttaggtttctcatggaagccagtggagtattactaaccagtcacccactcccaccttttctgtggggacattaatcccccctgctgcccaggttgtccctgaatgatccaccaagtgtgtggaagcagttttatttttttaatttatttttggctgtgctgggtcttcgtaactgcatgggcttttctctagctgtggagagcaggagctattctctagctgcggcgcatgggcttctcattgcggtggtttctcttgttatggagcatggctcagtagttgtggtataagggttaagttgctccacggcgtgtgggatcttcccggaccagggatggaacccgtgtctcctgcattggcaggcagattctttaccactgagatactagggaagccctggaagttgtttttaagtgtgagttatcattaagtgaaaatgctaacagcaaataggtattattttgtgtgtttgtatacatgcctcttcacagaaattgagagaagaacatattactgaagttatttaaacagatgaggtctttcaaaacttgactgtaggtaaagtactgagtcacgccaactaattttaatgtgttgaccatctgactgccaccaggacacagccgcttggttttttcttggtcaagtgttaaatagctgtcaagtcagctattgagtgataataagcatccaattatcactgaaaatggagtctggtcccagtatcctgcctgtgcttggagattcaaggagagctccattgctggtagaactagccccacacgtctaggagggacaaataaaatggttctttactgagtgcctcttatgtgccagtcaccaggcaaagcatgctgcatccataatcttgtcccagctgcttggcaaagtgtgcaccactgttatcctcacattagagaagaggaaagtagtgcctagggttgccagcttatcagtgtagggggtcatgtttagggctcttcacaaacaatcccaatccagttattcagttctttttcccaaaataagggagggttgtacttccctggaaaaccccatggatggaggagcctggttggctgcagtccattgggtcactaagagtcgggcacgactgagcgacttcagtttcacttttcactttcatgcattggggaaggaaatggcaacccactccagtgttcttgcctggagaatcccagggacagaggagcctagtgggctgctgtctatggggtcgcacagagtcggacacgactgaagcgacttagcagcagcagtacttccctaccccctcaagggttggtaacacatgtcccttctgggtagaagtggtttcctcatctgccactgaggagaaatagtatctatcctataacgtgctgggaggatcaaaatgtagtaataaatgcaataatgtatataagaatatatattaatagtatagtgtatggcacattgtaagggtttaaagatgttagctcttactattttcatgatgattacatgatattgctccttgagaatctccagcttcttcctgttatgtattaagtcacagccaactgtctcagccaggcattccgggtgtcacttcctgatgtttctgtcatggctcaggaagctcggaggccaccttggcacctagactgtatgaaggaagttagggaggtgaagacaggactgctttgagtagtccagcctctggagtgctccgttagcatagccccaggtggtgttagtagtaaagaacacgcctgccaatgcaggagacttaagagacgtgggttcaattcctaggtcagaaagatcctctggcaaaggaaatggcaacccactccagtattcttgcctggagaatcccatgtacggtggaacctggagggctgtagtccacggggtcacaaagagtccgacacaactgagcatgcacaagttagcacagtggctgccttagccaatccctgatatggctggaagggccagtccagcaggaagaacacagctactgggggctaggtgaaagcaatcttgggagttagtgtttgacactgtgcctgctg

SEQ ID NO: 40052 - DNA, 1499 bp, Bovine  19866880831965
ttttgccatctagttgctctttttgatcccaatattttaattatgtttttttttccaaaccttcagtgaagtttctagaactatgcagtgaacaccccaacacacctaccgcccacattccacaactgttggcgttttaccatatttcttttctcacatatttgtccttctaaccacctaccaatccatatatgcatatatatattaatattattgatacatttcaaagtaatgctacagtccaattatttgatttctgatatttcacacaaaggctggcctcaaaataattcttcctctcactttcaactgacccactccctgcagaccccaggtcccagtgtgaaaccccagcctctaacaccactgcagacctgatgaatgcctctccttcagggcctttgtctggggctttgtctgaggcttttgttagccctttctaccctggatgaaatcaccattcaccctcaccctctcctcttcaaccatctaatgtttccatcctaagcctgtcaggctaccatgaaatgaatatttctaaagcccaactttacatttgatttcagccaagaagagtggtattttcacacagttctcagtataaatgatccctccagctgttcttaaggaaatgagcctggctctgctcttggcccctccagcccattacccaacccttaggaacaagcagcgtcacttgtgcccagtgagacttagctactgctgctttcaacggtcactgccaccgtctcaagagtttagtttcttgtttcatttttctgggacagaataagagccattaactgaatgtgcaagagaaaaaaatttccactttcagaacacactggaaatctgaaagttatctaacacaatatagggtctgtgattccagcttaatgctccagccaaaattcttcatctggctttcagtgctgaactttcacctcttaccaaaggcttctcttccatttaggccagatgaaattcacctctgcgttttgtcagaggcaacggcctccttccccattaatcagtaaaaagcgaacgtttattccttcttgtaatgcaaaccagccagttagatgctctgggcgcgaagttgtttaaagcagcaattatgagggcatatttcataagagtcttttctttattttttaaaagaaataatttactaagcccatatttattgcagaaaattcagaaaatacaaaggaaagagagagaaaggaaatgctaaccataattctgcaacctaggaattaccattaacattttgatataaatccttttagacataaaaaaaagtgaaaacatagtttataaaattggaatcataatgttatttctattatttttaaactgttaagttataagttattgtcatttttattaattgatatgactacatgttattaagtactgtctgatgtaactgtaataaagatatatatatagatacagatataaatatagatatatgctataataatccttgttgg

SEQ ID NO: 40053 - DNA, 4324 bp, Bovine  19866880853937
caaaatgttgtgggggaacgaaggcattcaccattttgaaatcactactgatattagcagtttagcaaaaccactttcttactatggggccatgggcatagataggattggctgtgaatcatgtgtaggtttctttgcaaagctctaagtctgtgctatctcaaccacatgcgtaagtaaatcagaagatgagtgaagaagctgttcttatgggatagctgtgattttgctttattttatttcaaaagtcacgcttctcagtcttagatttttggctagcagcagcatatttcttgtgatgtaattcagagttgatcatgacacacccatttgttgtgaagcagagcaaagaattaatgggatcagatatttttcagagggtctttcagctttacaggttgattctattgagtcgacatgtgtccagaacttgttaagatagggaagcaggctactataatggagtggagatgaggggaaactcaaagaaccttccaaacattttttagtaactcacccactgcagacatcatttccaatcatggcatatatgacaatggctggataatccaacagctggttcctagataaactgagaaaccatagatggaagttgaatatcgaacacttggaaacctagctttggaaccaaccaatatgagaaagaatctttaaatggccatcctctgggtaactttttgctatttttctttcattctagtgtctccattcccacttcccctcttctctataatctttaactcacttctccattaggaaaagaccacataaatacatacctacatttagagtaggttgaagtctccagtagggggacacgctaccatctttcacaatatttgtcatcagtaaatccagatcagtttcctgaggtacttatgtccagatgtgtaggacattatgacagctgtggacatagtcaactttgaaaaatcaaggatttctcaaggttcctattctggacaccccaggccttgctaatgaattttaagtcaaatatgagcaaaaacttgttttctcattcataaagcaggaataagaagcagtctttttttgtctttttcagatacttgggccagacctaagttttactcactttgtatacatttttatgacccttttgaaagtatacatgtaaattaaccatatcctgtggtcactggcccaagaagtgaaaacttcccagtgtttggagagtgactaacaagttatggatgttcagtataagtggctactggataataacagagagtttttttttttttttttttaatttttcagaatagaaacccaacctaaaaacaacttcttatatccctcccttttccacttacctttctataaatctctccaggttttgggaggatgcacctgaatagttaaaattgagaaaataattaaagttaataaatccaagtcagcactattagtatgagaattagactgatggacggaaatcatggaagaaccattattgtatggtcaaaggtcatccaaaccatcatactgatgagaatgacttcatcctacaactttcttaatgggccttctgtttacttggcattatattaacataatcctaacatttttggattcatagatttaaagacatttactgagcgcgaatgggtacactttctaatagatgtgagaaaaaagtataaatctatcagcagagacagaaactatccacagattaaggaatgagttagggaatgagagggacagtaaaaaggattgttcaagaactgcacatctccctggaaatccccatttaatagcctgctggtgttcctgctcactcctgaggctcctcctgactggctggcctgtgcaagagtcagattgtagagctgatttatttaagctcccatagtgacacatatcggagaaggcaatggcaccccactccagtactcttgcctggaaaatcccatggagaagcctggtaggctgcagtccatggagttgcgaagagttggacacgactgagtgacttcactttcacttttcactttcatgcattggagaaggaaatggcaacccattccatgttcttgcctggagaatcccagggacgggggagcctggtgggctgccgtctatggggatcacacagagtcggacacgactgaagtgacttagctgcagcagcagtgacacatatgacttcattcccctattcttgataccatcaataatgaatctcttttatgaaaattgtattcattgaatgtcctttttattgtcaacactctgctaaacacttattaattcatttaggccttagcaccacagtacgaggtagcatcgtgtgtgtgtgtgcgcgcgcacgcacgcgcgtgtgctcacatgggcgtgtgcgcttgtctcttgcatctcttgcactggcaggcaaattctttaccactgtgccagcttggaagccctaggcatagtaggtctccattttatagaggaggaaactgaggctcacttaaagtgactttcccaacgccacataactaatcatttggagagttgcacttcaaagtctgtcccttctgtaagactgagctctggttccctgtgtgacacggcttctctagactgagttcactgtttcaaataagttctgtttctttgtccattggaggatagtctgcagtgattagcgagtaatcctcaggtgcgtggtacaatttaagtggcaagggagattttcctgtaacttctagccttggaagcttggggggaaagccagtgggtttcttgtggaaacaaatgggcaaaagggcagtgcacagctattaggaactaactagcccatgtcccctcaaaattgtgtgaccatgcagggtaggcctccttttccacatacaactagatacaagctatatgtgcagcattgatgttctcttgactgattcaggaattatgcataataaatgaatattgctttatttcccctctcattgtggtaaaatatacaacacataaacataaccattttaatcctttttgagtgtgcaattcagtgacattaaatacatttacattgttatgcaacgaccatcactatccatttctagaattttcccgtcataccaaatagaagcagtctctgataacaccattctatcttctgttggtatatattgaactattctgggtacctcagataggtggaatcataccttactcatctttttgtgttggacttatttcacttagcataatgttcgcaaaggacctccatttgtagcctgtgttagaatttccttacttaaagactgaataattttccatttttgcacataccacattttgtttatccattcatctgtcaatgggcattcgagttgcttctaccatttggttattatgaatacgctgcctatgaacatcggtgtgcaagtacctgtttaggtttatttaggttattgaaatcattggaccatatggcaatgctacatttaatttattttaggaatcgtcatacactctttgtttcctttttgtggtggggctttcctgatagctcagctggtaaagaatctacctgcaatgtgggagacctgggttctatctctgggtttaggaagatcccctggagaagggataagctacccactccagtattctggcctggagaattccgtggactttatagtccatagggttgcaaagagttggacaccactgagcgactctcagttcagggtagtactaaatgtgcacacagacatgcaaattaagagccgtcagttcaccttagcatgtaagcattcattcaccctctccattcatttgttgagaacctgccatatgcctgacacatagtagggaattaacaggtgagttggacacagcctttatacctgaggattaccatctatgggggcagacacacgactgagcactagagtaaggttgagtgcagatccaaaccagaaaactcaatgtgatttgagcctattatctctgctcagagaaggtgccaggttttacaacactgagtcctaaacatagactcgaagtacttctgggcgtgaggttgttcccttttgctctcaagagggaagataagaaggacagccactgggagcctacagtggctgactcatcttatcagctgggcccttcattcagtgccagctccaggactctcaacttcccattttcagtaagataataaatcaagaggtgtttaattctcactctttgatttttttcttaatgagaaatgaaaactcaagccatgagtgggaaaaaaaaaataaagggacaggtcagggatgtcaatatttccctcatatccaga

SEQ ID NO: 40054 - DNA, 816 bp, Bovine  19866880882930
actggtaaccactgatttgtcatgtgaaaaatttgatgggaccatgagtacaactatcactacaattcagcgatccttaaaataaaattttgtgcttgattttttacaatatcacccctatgtctgaaagaaccaaaagattcttttatagttatcatagaggctttctggtcttagactgtgacttgccctgagagttgaaagacatgagcttgtcattttctttctgtaagtgctaaaggacactcagaagactatcccatatcattgtccttacagacatattaactgccattaacagtcaagtgtagcaactatttgggcaatcatttgcttcaagattaaccacagttgaaagtctggttatttgtaatgccctcatcttacttctcaacagggaggagcccagccaaaggacctgaccaaagcaaccctcaaattctttgtgtgtttatctcctgggatcactactgatatcaattctgtatcagttagggtccattcaagggacagaaatcaaacaatattttgaacacagaaggttaaatataaagaatcaccacttataacagggaattgaactgataaggagatggccagtaaggaattaagagaattctaaagattacaggaaaatcagatatagtgatcatctactgcccttagggctgagatagactctcctgaagaagagcagtaactgtggctcatttcacagagaagtctgctgaggatgcaaagctgcctaaggggtctgacaggaaagctgttcaaggacagctttgtactggtggtgctccatgtgaagccatttga

SEQ ID NO: 40055 - DNA, 2106 bp, Bovine  19866880913633
ctttcctggtggctcggacagtaaagaatctgcatgcaatgcaggagacctgggtttgatccctgggtggggaagatcccctggagaagggaatggaaagccatgccagtattcttgcctgggaaatcccatgggcagaggagcctggtgggctacagtccatggggttgcaaagagtcgatatgactgagtgactaacactttgactttcaagcatgacaatatctcagtttattagagtgaatttacagagttgattatagaaattttggaaggagatcatcactggaggaagtaacgctgacttaatcaaataacctctttcagtctaaggattgaatttgtagcagctgaaagtggtacacaaatacatttgtagctttgagtttcaccagaggatggcgcccatacttctctgataggttttgccaagttggtttggcatcctttcaagccgtatccgagagacgttttagagactggttacctaaactgttaaccaaattaaggcctttattattaattcagttaaaatgagtgtaagtgtataacatcttcagaacaatttatgccaaagaattaagcaggctgaaatgaatggaaagctacttatttcctgtaactgtactcacactttaaatttatacaacttttaaaaaccaatttctacaagtcagatctttcaacattttcattttcttgccatctgctgctttgtaaaccagccatttaatatgaaaacttgctcagaagctgtacttttaatgcacttactagctcatcaggtgatatctctaattgagctgtttgctcctcaattgggaggcaagtgcaagttgctggtctgttttctcggctttcctggtggacttgagccaaaggtatggtcatcttctcgtttcctcttccttgatcccctcatttgttcagtggtgtcttctgatcagcagtgaccataatttttcctccttaaactctgtaccctggatactcaagggctgtctggaggtagcagaagcctgtgctcagaaactgtgcttctctcttgaacatgaccccaaccttacttatatcatacatagatgtgcttagttctcagtcgtgtctgactctttgcaactccatggactgtaacccaccaggcttctctgtccatggggattctcaaggcaagaatactggagtggattgctatgccctcctccaggggatcttcccaacctagggatcatacctgggtctcccgcattgcaggcagattctttaccatctgagtgcaacagggaaacacttatgtaatagaatccactcacaccacaatcagctcacataaagtctttcaacataagttaaatccatacatggaaggttttgctgtgccatgaagtaggaatatgctatgctaagtctcttcagtcgtgtccgattctgtgtgaccccatagatggcagcccacccagactccctcgtccctgggattctccaggcaagaacactggagtgggttgccatttccttctccaataaaatagataacattcaaggacctagaatatagcacaggaaactatacttaatattttgtaataaaagacagaggcttccccggtggctcagacagtaaagaatctgtctgcaatgtgggagacccaggttcaagcctgagtcaggaagaacccctgaagaaaggaatggcaacctactctggagtatttttgcctggagaattccatggacagagaaagcttggtaggctaaataaaggaaaagaatctgaaaaagaatatctatatattatatatataatatatgtgtgtatgtatatttatatatattgctccacattgcccttctctttgcaacaccctagactgtagcctgccaggttcctccgtccatgagattctccagacgagagtgctggcgtgggtgtctgtgccctcctcaggctcgaaccggcatctcctgtgtctcctacattgacaggcaggttctttaccagtagcgccactgcaccaaaatactgccaggcatgtatgtggtaggtacttaattttgctcaggaaggattcgtgaatgtagacttataaacatttaagatcagcc

SEQ ID NO: 40056 - DNA, 1055 bp, Bovine  19866880955221
taaacagaattagtacttatggaccctcagggagactgctctggcggccatttttcttataaaatgccagcctccagctatattctaaatggtgtttatgcagcctcccatcctcaagagcaataatcataaagacttcaaagctgtgggtgaaagtattatagattcatgacttattttattttgatttgcattatgccaaattctagtctctaaagcctgcatatttcctattttatttcagggcaaaccacatagatttgattcatcttttctgtgtgggcagccagggatagaaagacctacaatttttcaatcccagacactttatggcagcaagaactataggcggaagttcgcgaaacagcgtttcatcttggagaatgttctgagactccttgattctcaattttctgtgctaacagggggaatggagagacagacccccaaactatctttcagttaacctcctttctcatcacgtctttggccaaaggaaattaaaattagccaaactgtctgatgttactttcacaagcttttcagttcagttgctcagtcatgtccgactctttgcgatcccatgaaatgcagcacgccaggcctccctgtccatcaccaactcccggagtttacccagactcacgtccatcgagtcggtgatgccatccagcccatctcatcctctgtcgcccccttctcctcctgcccccaatccctcccagcatcagagtcttttccaatgagtcaactcttcgcatgaggtggccaaagtactggagtttcagctttagcatcagtccttccaatgaacacccaggactgatctccttcagaagggactggttggatctccttgcagtccaggctccctttaaattactggaagtgggtggagtgaaagctaacaggacacaggggagtgtcacagagatcaagctgcgccctggtgggggccacgtggacaccaggaccgtgccctgaaggcacaacgatggatgcctttactggcacgcttgccgcatgccaagcaccactgcggctcttcacataca

SEQ ID NO: 40057 - DNA, 1967 bp, Bovine  19866880961401
caggctcctaactcacgtaagacgacacggttgagtagggggctgctgccttcgcattgtctccattctgtttctgctccacctccaatctttggagcactatgacccgggaaccagactcaggtgtttgtctattgattaagacgagattcaccctaacctgggcaaagcaaccaagccctgagactgacccagcattaacctgcttcactgctggttcctgtcttgtgggaacgaagatccaaagatcttagaccagacccagacaccctaacctttaataggcagaaataccagagagaagggaaaccaacccattacatctctcctatttatcttctaactacagttaatatgcccttatcccatccacagacctacctactcacctaagaacttcctctccatcaacctgatccaattagacacagaaccagaatagccaggacatagaggggaaggaaaagggactaggagatgatccagaaggaggatatgccttgtagtctcatcctaacttttgctgggacctcggcagtagcatagcaagaagaggggagtaagctgggacgcagaaagactatggatcggcttagcccccacaggggagacagcagatgacttctccagcatccaggagcaggataaactccagtccctgtggatatcagtgaagtccagtctttcagaggaggaagaagatggtgtagaaatgtttcttgtgatcaggcatgaggtgccacttccagcaggttgaagagacttcagccaacgggcaggggaaagacagagagaggccactgggtgagagtcagggccaagcaggctgtcagggccccagccaagctctctaaggtttgttacatggccccagtaccaacaaagaaacaagatggcagaggaaaggctggcactcaggggctgggtcagcaagagccaaggcctcccggcagtggagagttaagggtggcgatgcaggttggaggtgtcagtcattgcagctgggctaggctgagacaggcagggacacacgcagaaaagaggcaaattgcaaaagtacatgcacacacacacgcacgcacacacacagacacacacacacacacagggaaagcagactcagtgacggagagcgggatcttggagaaagatgggagctgagagctccatgtggagtccataaaataaaagtgaagacaagagccagtggcttgggattcatctaaaatgtgaaaacgcagacaccttcggagcacagagaaggccccgcatgtcactgtgactttaatggcgataataagcctgcagttttccagtcctgggattcactcacccacacagagacataatatatttttcccctacgacaagaaaattgaatctatctttcagtctaactgatctgaggtataagtgaaaaataagactgtgttctatcaccttcaatctttctcttcgctccgagataggccctattattttcctttattttttcgggcgtgagagaagtgttaatggataagacatcagtcattcacccctgaaatgccggagagcctggattttgtgtcccagctgcagcatgaaagttgaattgcctctggggtgaagtaggggagggagcgggtggggagcaggggatatggtggaagggccaggggtgggaggtgtgaagagaaaataaattatgcccccagattctggatctagaggtgatatttggaaagactctgcatgagcttgcatttggtgcttatcactttattcttatgtacttctttaacttgctccaaaagcaccaaaaatagagcctatctatgaatgagggctcatgtaagagaacttgtgggccgtgaaggggtataacattagctgctcccattcgatggctgcccaagcacttgcggaaaccttcagttcaccaaactataaaatagagcagatcagaccttcagacactcgattgt

SEQ ID NO: 40058 - DNA, 1486 bp, Bovine  19866880981033
acatagttggcagtaagacagcattatattggattgctatataaaattttatttattgctatgagtcatggtcagaaatgcttgaaaattgatattctagatcatttttgtggcttgaaagaagggaagacagcctgctctaggattttttttccagcaatggaaaggctctgcttaccgtcgggtatatcctaagcacttttccctcctgcctcattagtgtcttaactcttttttgcttttcaacagtaagaaaatatgcccaactcattgcatgtagccattatcttatacaaacactcacatagccatgatgacaggagttatatgcaatttcctattttatttggcccaccctcaaatgcttctgttatcaggaaatgctaaccatgagttggtactgagagaactttcaattcactgttgtagagaattctgagatgttttgtgaatgattcattcattcatttcttgagagcatgactttgattcagtaatgtgtaagccagttgggaattttaaatgaaacagaagggcaggcaagtgaaactctttggctcagttgctaaaaagacttatgctgaatgttctcagtaggtaaaatcatcctgattgagttggtcattaaggccagctttgccagaattaattcagtggagagatctatcaaattgttaactacccacttagaatgagtgcttcctacagttgataaaatattttttgtgaacctttgggagacattgaaatggtgaatttggaccttaaccagactccaaacttctgggaaagcatccagcccacctttagagatgttgatctatctttgtagaaattcagaacaacatacagatatcccttatgagaataatccaagaccccttactagattctagactcatttcctcaccacactcagtgttgccaccccatttcttctcttgccctgggtctgtccccactaaccttaatgtaggcttattttcatatgcagaattaattagtttggaagaagacagccagaggaaacaaagcagcaccccatgtatgagttactctaaaagtacaagtggtcagtcaccagatttcagtggtctgtagaaacactatggggtcacagagcatcttcctgacacgtccagctccagggatccagagggaccagaagtactcaggactaaaacaaaatcccccaccatttataagctgaagggctgaacctggaagggaaggtaacaatttctggggttttgcctgaattcccaaatttgcaccagctctgaggttgagtggggctggaggtgctagagccttccctcctgctttttttattatgaaatcatgagacaggagttttacattactgctcatcttctctatcagatgtactttgtctcactccctctctccatctggctgaaacctctagttagaaaataaattgctgtgtattgattgttcattttcttcctaatcacccagacat

SEQ ID NO: 40059 - DNA, 2126 bp, Bovine  19866880984313
tggtttggctgtactcctgattctggttttcttctcctgtttactttcccagagtcctccaacatctttcccatagattctgtctaggttttatggctgcatttcttgggacagacagggtagagtgtgcttactccattatacctggaaccagaaaacctgaatgcgttataaagagtataaatagttcatgaaaaatgtggtgtcatacagtgacctaaaataaatttaataatgtcatttaactttaattaaattttaaataatgcaggttttgcttataaatttaggaagcattttgaagagcacaattcgtataatttagtttaaaaaagtcagccatgagaaatttaaattctttcttttctctaaaagtgttgcttgtaataagcagaaatattcaagctaatacattgacctccaactcaaaatagtaggtacttaataattgtttgttgtgacagtttctgatggtgtttctactactgaaaatgctttcaaattcacaagtgtggttctgaatttctgtgacaaactagataaatgattccccaaaacacgtatttttagaagaatataataacctccccagagtggctctaatctacctgctagtctcaaaacttgacatagcttcacaagtatccttcagctatgctaaacttctctctcctttttccccaaagatactttgcccttggagcatgtatgcactgagtcaccatctccccatggtttttggatttctattttttttctgcagggctctctgctcaaatgtatcttctctgaagatttcctctcctccaggcagagctaagtggctcccaccttcagaagacctcaacctccctctcttttagtgtcattttctaagaaccataattgtttccatcttgtctctcttttctggttacttatggtctccttaaagatgggcactttgtcttgttcacctttctgtttctagcacctattgcaacattggagaggaaacagagagagtggtggggcaaaatccaatggagcgtgagaggaagggaagtaaaagagaagagaagaccagtggtaaaaggcacagcccaagatactttgaaactgacaaaaaaatccagcaagttcatttcagctatcaacacaagtagcagtgaactttccctatgatggcctttatcttgagccctaaaccaaagggattgattgaaaagagactccttgccatggacagttacatataaaagtgtaagatatgcttctgaatctgtcctctgcagatgtgctgattcaagaagtacagcatgaaaatcctgacctaacagaagaatctcaagcatacgctcatcactcttccgtattataattgttatcagttacgctgccctgctatgatgtgttgcatgggacaagcagaagccagaaagggctgtgtagataaatcctaagaaatagtcccaatggaatcacaatatctccattctttaatgattctttgaaattccagaaagtattaaaaattggaatgatgtcctctaataaaaggagggaaatgtatccctctatatgacatatgtaacactaaaatagaaacttttgaaatcactctttcaaaaatttctattatagttaagtgctgtatcttggaagcatttttggtctttgagagaaataacaagttttgatgcctgcagtcctcctatagtatatctgtgtgcatttgccttttagatcaagcatctcaaaaattggtattaaaatctttgtttgttgttgtgatcacactagatcatagctcccaaacagaaatatcctagttgttttgttataaataatttctgttatttcctctcaacatcttgggttgagaccaaatattccacccagtggatgggttcatcaaatatttactgagggcctatttctgtttggcaaaggtgacttctttgcttcttccaatactctgtggctttaaaatattgtcttaaaaatttcactttgaaaaaaaaaatttcactttgaaatgatttctaaaaagttgaaataatttccataagttagaatactaaacaagaagttgcaaaaatagaacaaaggatttgcacataccctttcatccagattccctaaat

SEQ ID NO: 40060 - DNA, 2362 bp, Bovine  19866880995614
cagcagcagcatcaagtactttacagatgaggaaactgaggcttagaaagattaagcaatttgcccaaggtcagagagctaaaatttaaaagcaaaaatgttaacacccagttatttggccctcagccaatgttttcagttattctataaaactaaatatcaaatcagaaatttacctgtggtggattcattttgatatttggcaaaactaatacatttatgtaaagtttaaaaataaaataaaattagaaaaagaaaaagaaaaaaaaaagaaagaaatactagagaaaaaaaaaaaagactgtaagctcccaaactttagagtataaatgggatcataacttggaagaaggaaagacataagggaaaagagaaaaaggataattaggatgcaaaaaaaaaaaaaaaaacatggctcatgaattaccttgaaagcataattttaaaacacaattatcttaattcattcccatcctgagaaaaggtacagaataaagccaaacttcctccctggccggctgacaactttattaagccaaatgacttctagcagtccccattcaaagaagcagaatccctttatgggaggccaggctggtgcaacatttgccagagaaaagtgcaaggcattaattacatcctgggttatattgcagatgatgtcaaagctgagtggctgtgtggaccaagaccacaagggaaatgtctaatcactggaaaatctgacatttgcaacattgactgtttgcttcccagccaaacaaggctgctccttgaagatgccagagaggcgctttacctctctccatcatggtgttaatagttcactgggccatcatattctctgtcacagaccccaaagaaaataaagattagcacaaaatatgggtggaaaactcaaaattggcaaggaagctaaagcattttagaatattcaaaatttttagtaactgtgggagacaatgcaacatattgccttttggaagtaaagccaaaatttgaacgttgactctgctgtgtgacctggggaaagttatttaaccactctgaccccccgattcctgggtctcagattcttgtatttaatattgcattaaattaaattacattctcagccaatggcaccccactccagtactcttgcctggaaaatcccatggacagaggagtctgctaggctgcaatctatggggtcactaagagtcgggcacgactgagcgacttcactttcacttttcactttcatgcattggagaaggaaatggcaacccactccagcgttcttgcctggagaatcccagggacaggggagcctggtgggctgccgtctatggggtcacacagagtcggacatgactgaagtgacttagcagtagcagggatgaggactctgtgcctcgatttttcttaactgaactctaaaatacagcgctgcccaataaagcatctcagaagccaagaacatacagtctgtagtgctctctctgctctaatggcagccaagacactctctgctgattgaatgtaaaacagagaaagcaaaggagaggtgtctccgattgcaaggaatcccaggacaaatccgagcaggaacccttggggtctggggtttgtgattctttctgactctgcaaggggtctgccagggctgtggtcatgtcctttgctgctgctgccgctaagtcacttcagttgtgtccgactctgtgcgaccccatagacggaagcccaacaggctcccccgtccctgggattctccaggtaagacactggagtgggttgccatttccttctccaatgcgtgaaagtgaaaactgaaagcaaagtcactcagtcgtgtgcgactcttagcgaccccatggactgcagcctaccaggctcctccacccatgggattttccaggcaagcgtattggagtgggatgccactgccttctccaaatgtcctttgagaagtctcgaaatacagcaaatgctgtccacctacctgccatctgcatgagaaccagatctctctgattaccatcctatcaaggtgcttcttaaggatgactttttttttttaacacttgcttttattcatcacccactggcctcgttttctaggcaaaggcagcctgggcaggatggcagatagcccagcgccacagccagcctcactgtcctggcttgcaggcccttgctgctcctcacctccctactgccccggggcagctatctctccgccaaggcaaagaaagagggatgaacaaccccgcctcaagggccaacctttagagcaggtccttcatagatggagctcattctttataaaataaacaagcatacttctgacattacccagccagggttctgatgttca

SEQ ID NO: 40061 - DNA, 988 bp, Bovine  19866881007237
tcaaacatctgttgtttctggatggctttaaaattccattgcaagttcaaaaatgcttaaattgcaaagcatgtccttatgagaagtatctacttggtggatgtttgtccttctctctcacgaatcttccaggaacacttcatttaggcctataatatctggtctgtttctctatgcttagcagtaacatgaagtgtttctttttctcagatcccagtttcaaagattcagctttgggcatggaatgcctttccctactaagtttattctttatgtgtttggaatgcactggaatctatgtaaatacttttcaaaatcagaacttgctattttctttcactcttgtacttgccattgcctgactacttcataccaatttctatagaactttgcaagttctagcaagatttttttggagaaagataattgcaatcagataaagagcaaatgtagtacaaacttctttttcagagaaatggttgcattatggctttcttttttttttaaaatcattccttgaaacatcccatctaagagataggattgcaagtggaaaatgaattagaagaataaatgttctactgaaaaaattgagtttttgatgaacatgtattgaagagggtcaagttcttacaactctctcaccaagctactgaactccctaactctgcgttcttccaaaatgtttgagaatattttaaagttaggatggatagacatttacaaaaagtaggatggtttttttttgggggggggaggttaaactactccattgccaatttgactgggatttaagatcattcgaaaactgttagagtttaggcaacccttaaataatgagtcttggcattcatttcctacattcagtcctggatctaaagaaaacaatttgagacatattttctttcgtatacaaattttgtgttttctctttcaactcgataatggtcataaattaatacagagtgtattatcctaagaactacag

SEQ ID NO: 40062 - DNA, 1547 bp, Bovine  19866881111227
attttgcaaccaccaagtccaacatttccctaactgtgtccaggaactccgctgtcaagtgggaggttaaaagatacaggaggaggggtgctatacccaggtttagaaagtactgggtcaaataagcctaaacagtttgctttacttccgaatttctcagcgtctttaatgttttattgcacactgggagcccccaagaccaagagagtgaacacactgtttccaatacattctgaccatcaggctcttcctagaatcctgttaataccattactatctagtggaatgccagtgttctccagaccagagtttgacaagcaaaacaaaacaaaaaacataactatatatgtgtattaacttttccttagggttatccagactctgcttgaaccttccaaggaccagttactctactaatgcacagacctagcattcagtgttagaaagtgccctcagctatggtaaccctgtccaactcacaagctcaacctcactgatgggtttctcagtctcattgtatcaacatttgggatgatgtcttatcgtccaggctgctttgaaaaatgtaggatggttagcggcatctctggcctctccccactaaatgcctgtagctccccctccccacactgtaacaaccaaagatgtctccggacattgccgaagtcccctggggatgggtgcagggcaggggcgggttgggggctgccttaaaaccagccctgttgagaatcactgctgtagaaacatcactccttaggcactggagaagtcaggatacttagagctctagtttagagaccgctgagcccactctgaccctgtgtcccagcattgactggaccctcagtgctccctccagtgacacttccagcactcagagccctgccctgcatccttctgaacaagatggtccagtttttggatctctccttattcctgcccccaggtccttaaagcctaactcacttacgtagaatgttgctaccttggattaagggctcaagagactttaaaggattttatctactgatttgcctttgtgctttaaaagccatctggggaggattttgtacttgtgtctcataaatttaaaagcaaactgctaatctcatcacttctctcttaaagggtgttgatccaaaagatggaatcccatacgagaagaaattctgtgaaggtatgaatggtaaaagtcagtgtacttatcctaatagaatattcttttctagtctgagtcaaattgagtcgaagagacaaatgaggaaatgcctgatgctacagcataatgagtttaactgattcctttattgggtgactggaaagttattagagggatagttagggagttttggatggacattactacttttaaaatggataaccaacaaggacctactgtatagcacagggaactctgctgaatattatgtaacaacctaattgggaaacgaatttgaaaaacaatagatacttgtatatgctcaactgaatcacttttgttgtacaactgaagctaacacattattaatcaactatacaccaat

SEQ ID NO: 40063 - DNA, 1215 bp, Bovine  19866881199594
ctcagctggtaaagaatccacctgcaatggaggagaccctggttcgattctgggttgggaagttcccctggagaagggatcgggctacccactccagtattcttgggctttcctggtggctcagatggtaaagaatctgcctgcaatgcggagacctgggttcaatccctggagaagggcatggttacccactctagtattcttgcctggaaaatccccatggacagaagagcctggcgggctacactgagtgatttaagtacagcacagggtagaatggtgaggttttattgctaccatagtaggtgatttcaggatgtttataatgaaatgaaacgagcccctaaatagcagaaattcctcccagcccgcgaaacatccaccactagggggttagcatgctgtgtccatatgagagtgtgttagatggtgcgtgaagagagtttggaagagtgtgtaatactgtggcaccattagaacaaaaccgtgtgtgtctttatgaataatcagctatgaaagtgaaagtgaagtcgctcaatcgtgtctgactctttgtagcccaacaggctcctccatccatgggattctccaggcaagaataccggagtggggtgccatttccttctccaggggatcttccccacccagggatcaaactcagatctcccgcattgcaggcagatgcttaaatgcataggaaacatcctagaagggaatccaccaaaagtgttagcagtggttgtctttgcacagtgatattctgcttaaatttttctttgtttctctaatttacaaattgtcctataatgagcttgtgtttgctgataccagagcataagcctccatttaaggagaaggaagggaaaaagccacagaattactagtacaatcttaactcccatctcagattaagagtcttagcatccaaagagctttagagaagaaaagaacctttggaagcgtccctgaagggtggaaacaaggggtgatgaggtgatgacaagcacggaggcagcaacataggagtataaaatccccataggagggccccaggccccaggccctgtgcctctcactccccatcctaacctgcctctccaggaatcttcagctttctcttagtctccattttataatttcctttgccaaaaaaaaaaaaaaaatctaactgccttgcaaagtaccctccctccccctgtgcttatttttaaccat

SEQ ID NO: 40064 - DNA, 1172 bp, Bovine  19866881272411
taaaactataatctctgctcccacccgattaggaaaatctgagaacagaatttagtcatttgcggaggggcaccaggttgggggagatgggtcatatgggaaatgaactgaaaatgtcatgctggtccaacagggatgcaaggacaaaaatccaggtgggctgtgactctaaaacctgtgttctacacttctctggtacccaaaccagaaatgaaagagtcatccttgattctgccttcctcacatttctcatcagttccttaataaatccccttgggtcaacttccacagtagatcccagatttgtctactttcttccactcccactgtctctcgttatgctatccaataaaccatcatctctccccaggcccaaaacagcctccttcttcatccctctgcccccatatttaccatctaagatccttcctcctcaggacagccagcatgatattttcaagacacagatcgaatggaaacagtcttctcctcaaaaacctattcacagcttcccattcctctcaagttgaatccttacctctttggccatctacaaaactctgagagggcagaaaccatatcagcttgttctcagcgtgtactcacagctcagcatggtgcctggcatccagaagggacccagactacattctgggttccagtctcagttcctttgctcactagctacatacttggaaaggacctaacttctctgagcctctgacttctggtctgtacaagagcaataattcctacagtgatgagtaaagttgttgtgaagtttaaatgagatgaaaatgtatgcaaaactctttgaaaacggcaaagaagattctagccatgtaatgaattatttatgccccaacccagggtcaaaaaggaagtgtagtcacgccgactctggttctgataactgccaggtgctttcaaggcttctcgatgaagtgcaggcttcagacaaatgggaaatctaatagacctctctctgcagttggccgcatctccagccagcacagatataattataattagagttttaagagttctgtttcatttcaaaaagattccatggtacagtctgcagtctacctgagatgtgtgtctagaagcagattcctgtagcaggtgtttttattctagcctatttgcttcttttcttacaatgtcaaggg

SEQ ID NO: 40065 - DNA, 1485 bp, Bovine  19866881483903
caactattttattcagctgaatcaacagagcttaaactcacctaaagtttttagcagaattgagcaaaggtaaataaaattaagtataacactggctctaggggaaaaaatatgtacttatcagaaaatatccttgcatgtacgtgtggatacacacacatcaaggagcaacagataaaagatcaggcaagcacacagggagaaaacacgccctggaaattaagaagctaatgaatttataataataatcaatgagaatacagaaaaaaagaaagacaacttactagtaacatcagaagtgacctcaaattaatttattttgtccaaagtcactctaaattcaaataagaatacagacatccaaatagtgttgaattacctaccctattcaaacttataacaaacaaactgatggctaataaacctaaaactagctccctgcctgtactggtggtttaatgttacactcactaccagggtccccagcagcagtaaagggacctgaaacaaaatgtgctacacggctaccaaagcagacagaattgccgtggaaataaacaagaccacgtatcttttataactgggttatgtatctagttagaaaaaaaaaacctaagaataaatgatgaggtgtcagattatgtgccaacctaatgttggccaaaaagttcatttaggttttttggtaagctttctgaacacactttttggccaacctgatacatgcctagaagaaaaaacaaagactagtagctagctctaagagcaatggcttttagtcagaggttgtatattaaaatagcccaagtgagcttcttcacgataacaaatacaaagctgtatcttaacctacaaaaccaactagtagagctgtggtccaataactcattttgaaaaagttctctacatgagtcggagtaaacacctctggttaaacactacctgtccctgcccccctgcttttttttaaagaataaataaagaaaaagtaaattgacaaccattgcaagtgaccaatttggaagtagagatcactgcttattcaccttttttatttcttcatttttagtacaattccaaattaagataaaagagaaatattactaatactatatgattagtatctgaacttagaaacagcaaattacaaaataaaaatggagctaataaatgtaaaataaaaaatttcctggtagaaatatcagatacagtaaaaatgatgtagtaaaacattctaaaaatttatacagatttaacacaatttcaaagcaaattttcacaggtttttgtttttccaatagttttcaagttattctaaaattcatactgaaaaagatgaagaaccaaagtactttgctacaaaaaactagaaggacagtaagagataataaactctaaaatctattttaaaacattatacaacttagcttcaatttaaaagacatatagtgctagatgctcagttgtgtccaagtctttgcaacc

SEQ ID NO: 40066 - DNA, 1819 bp, Bovine  19866880473572
acacgttaggagacccaggatgcacctcagggagaggtaagaagtctggtttcgccgttgatattgtcaaattactgatggctttgcttaaaccaggtccaaaggctacaaccacagaccttgcctgcatgcctgtagcctcagctattctgagtcgtgggacttggaaagcatgggcagctctttcagttttcatagttccagttctgagaggcacattatttaagagcctgtttgctttttgcttttcagctaccatgctgggtttgtgggagagcttcagccatcagcttgctttatagggaaggcaggggcagaaatgagactgaggaaccctgcctgcttaggattttccttaacactctaaaagtgttttcttcctgcaaaaatttcagtaacaatctgtaatcaattagctaactagctcccccttttgaaacttttctttctgataaaaactgcataatgctgcaaagagatgtctaacatgcttagaatcaattgtatcgaaaaaaaaaaaaaaaagatgaatgtgttaaaatctgtccacacataatatctgcaatcatgccattattttaattaggttttcagctcttagctttagatcttctttattgaaggtactttgacacagcctaaaaggaaaggaatcaaagacaccttcctgtagagttaactgaaagccaccactggcttaaagagtttggtaggaaaaatggtgaaacaagccaaaaaataagaatttgtattacatgtcagaaatgtagactctcaacaaatatcataccacctgcattatttattttgtattgttgttttatttttgttttgattcagatattttctcctttcatcttacactggaaacaagaagagttatctttacaactcaagcaaataatctgttacgtggtatattatataaatttcaaaaacaagcaatgtagccattatgtggtatacatacttcagatgataagagtaatagcagagagagaaactgaacaataatgcatgttgaaatattaggacaaggcttatatatattttttgtaaatttacaatattaggacaaggcttatatatattttttgtaaatttactgttttcttcacattttttattgaagtataggttcctttacaatgggtatctgctgtgcaacaaaatgaatcagttatacgtatgcatgtatcttttcttttctagatttccttccatttagatcaccacagagcactgagtagagtttcctactgctacacactaggttctcattagttacctcttttgtacatagtgatatacatacatcaaccccaatctcccagttcaccccactccctcccttccttggtatccataagttcattctctacatctgtatctctatttctgccttgcaaataggttcatctgcaccatttttctagagccaatgtataagaaatatgatattcatttttctctctaaaggtgtaaatctctttaacccaggtatcctcaagcttggccatgtatttgaatcctgtgaagaactaacttgttactgatgtctgggtcacgtccctcagaggatctgatttcctggttcggggtgtgacctggttgttgggagtttaaaaagttctctgattctcaaagaggcagccaccagccattactgagaagctgtttcaagtggattagtacccaaacacacattctccgacaactttattgaagaataattgacagtgtgactgtatacatgaacttctgacaataaaggcaaacacccaggttcctgttgttcatcctcgtcccacttttacgc

SEQ ID NO: 40067 - DNA, 1218 bp, Bovine  19866880500377
caactgccaaattgtttcagcctgggagaaagggacaaactcatcttctgggctgtcagtgggccttgagtcaggacaccaaattctgtcagaaacgattcgccttcttaagtcagcaagacataaacaaacaacaacacaaactggaaaatgcagagcactgaagttgaaactgagacctcacgtttctcgctgatgtaagaaagcacaacacgcttttggaaactgtcagaacacaggtgcacaggaaacccagcagctctcactcaccttttggctccttcccaggtcctgtgtcagcagggactgtggctgccctgccagtgaggggccttatgattttaatgaaacatgcagcagagataagtttggggtggggtgtctcctgaaatgccaagtaccctcaggaagggtcactttaattatacatacatcgcttttcccataaatatggaaacccaagatataaggaaagaggaagcttaatggtgtgtgttagtgtgtgtttccccagagctgtgtgcaggaggcgggatcaggttattgacttggaaggactcagactctaactccgagatgtccttatgttggccggtggagtccacactgcctcttgcagtctgagttgcttcctagaatcacgatcctgggtccctcttatgacttgtaaaatcagaaactccaaggactgcagccatgaaattaaaagacgcttgctccttggaaggaaagctacaacaaacctagacagcatattaaaaagcagagacattactttaccaacaaaggttcataagccaaagttatggtttttccagtagtcatgggcagaggtggatgtgagagttggaccataaagaaggctgagtggtgaagaattaatgctttcgaattgtggtgttgaagaagactcttgagagtcccttggacatcaaagggatcaaatcagtcaatcctgaaggaaatcagtcctcaatattcactagaaggattgatgctaaagctccaatactttggccacctgatgtgaagaactaactcattggaaaagaccctgatgctgggaaagattgaaagcaggagaagaagggacaacagaaggtgagatggttagatggcatcaccgactcaatggacaacagtttgaacagactccaggagatgatgaaagacagggaagcctggcgtgggtccttcacggagtttccaagggtcgga

SEQ ID NO: 40068 - DNA, 1944 bp, Bovine  19866880513076
cctgcagcccatgacagctgcagcctgctgggggtcccggtgtctacatattccgtctctgatgtgggtgaaccagcccactccgggcattggccagtcatatggcctagaagagcctttcattgcttctaggttcacagcgaaaatacagtccgttccttctcaagagtgaccctgggaacagcttgcaaatcagtggccgacttggagccctttgcaaacaccctgtaatcctttggcctcctcgccttttggcctggcatcagcatccgtgtgggttctggttgggtgctccctcccgcggcccagcactgagagtccagtcacacttgacagagggcccataggacccatcatcaggctcactgtggtggtggtggggtagctcaggaccctttatttaaagaaacgtgagatgtggacgcagatgtgaaggcatgtgactgtcacgggtcctgtttttcaaaattagctttctcactaatttcattaaatcaggctccacttcagagggaaaaccggctgtcgaagaatgaatttcacacagtccttagctcagggttttgatgtgaatttgggatggaaaccgttgtaggcggatacgccctttgatgaaaagaagagccagccatctccttttcatcttatccttccatccttacccaacgtttcagggtgcccacagcacaccccgcccaaggctgtgagccttcggacgggttgctgtggcaaccccgtgttctcagggcaggcaggtgggggcaggaggtgctggctggaccacggggtttccaggatggggctcttgagccttgaggactcggggggtaattggggatttgctctcccaccatgcgagtgggctagggagtggggagtggctgaagggaggaggcacccccaggtgggtcccagatcctaaagggcatgttatatctgaccttgattttcttttctcccttaaatatgaaaagctgtgtgctggtgtgtccgtctgtcctaagccctgtcagtttcctggtcctgcagaccctgactcgcctgttttttctctttgtgtcagaggtgctcctggacccctgtcggacttggtgcccggcgtctacgtgccaggcggtgtgccaactccaggagatggggctgcacaccccccagctggtccagtgcaaagcctgtgacacggagttctgttctgcctgcaaagccagctggcaccctggccagggttgcccggagaccatgcccatcaccttccttcccggggagaccaggtaccttccagtgtgtctttcctggtcaccttgtactaatgaatgaaacagaacctgttaaactggtgtacacctcacagtggaagagtctcgagcttaggaagaccccaagggtataatcgtttgttgttggtggtggtttagtcactgtgtctgactcttttgtgaccccatggactgtattccgccaggctcctctgtccatgggatttcccaggcaagaatcctggagtaggttgccatttcctttttcaggggatcttcccgacccagggatcaaacctgcgtcttctgcattgcaggtggtctcctgtcttgcaggcagatgctttactgttgcgccaccagggaaacctgtgtaattgtttggaagctcaccggtcctcagataaccatgtaaagtgatgacatatttaacccttacagtcattatgatgctcgtggaaggtcctgcagtcagaatgtattcaaaatgccagaattggctctcaatttcagtgaatctctactcataaattctttaggttttgcacaatctgctcagttctgtggagaatcacgttccccttggtaaatgcaatgagttcataacgatatagcaaattcaccccatgatcggtgaatttgaaccacttcttcagatgactctgcattttcagcgacataaaattta

SEQ ID NO: 40069 - DNA, 3422 bp, Bovine  19866880575430
actcagttctgctccagccccagcacacagaccacatgtggagctaaccctccctaggtggtgcattcaggtcagggctgggctgtcttttattctaaccctttctgtttccctgtctctgtgtctctgtctatctctgtgcctcttcctctgtctctctgtctttgtctctctctctgtgtctttctgtctcttcatcatttggatctttctgtctgtctctctgttttaaaatgtatttttttaactggaggataattgccttacagtactgtgttgatttctgccatgcagcaacatgaatcagccacaggtatacatatgtctcagccctcttgagcctcccttctacctcccaccccatcccacccctctaggctattgcagagtaccagatttgagctccttgcgtcatgcagtaaatttccactggctatttaattttacatatggtaatgtatatatttcaatgctactctctctctgtctttgtctctttctgtgccactgccattccaatcttgggacattatggtgaggatttaagaattatttcaggggcttgtgttcatctaaaagtctcccttgatattttcaaacccaatattttgtcactctgtgattttatttttcctttgcaagtattttcacaaacacccaagtctaaaattgcacaaatctccattaccaagagattgctgaaaaggataaaagaaaaaaaactccaccatgaaccaatgaaaactacttcctttaaaaatgtttaaagctaaatgaatgttttacagaatgcttgtcaggatgaatcttatttcttcttttacttattaatccggaagagggggtgtgccgtgtcatttccaagtttgcagacaatgctaaaaatgctattgaacagaaagacgtcaagctgacaggcatagacggcagcaaaaagattgctcaggctggcggagtgggtggaaggtggcagctgagcttcagtgtgggcaagtgtgagcagatgctccccgggggaaccagttacaacatgactctcccagggatcagtggcctgacatgggaaaggcggcttcagttcatcagtgtcagtgccctgcgtgtgtgtgtgttagtcgctcagtcgtgtccgactctttgcgaccccatggactgtagcccgccaggctccactgtccatgggattctccaggccagaatactggagcaggttgccatttccttctcccggggatcttcccaatccaggaattgaacccgagtctcctccattgacatgcagattctttaccactgggacagcagggaagtccagtgccctgtacataactctagtgcgtgcctgtgtgtttgaaggtatctgcatccatatacattaaacttgttgtttagtctctaagccacgcctgattttttagccaccctgtggactatagcccaccaggctcctctgaccgtgggattttccaggcaagaatactggaatgagtttccattttcttctccaggggatcttctcaacagaggaactgaacctatgtctcctgcattggcaggcagactctttacaactgagcctccagggaagtccccatatattaaataacccctcccagaattttacatgtacattacatgcaaatcaggttaacaacttggttatgttacatggctatttaatggtgaaacaatttgatatttttcttgacctcagcaattcatcatctcaaagggaagtcacacatataagccaagtagtatgtgctccctgtgctgctttacatgaaaatgcagactcccgcatagcattttagcattcctaagagattctttagacagtaaacaaagagtagaagaatattgtgtagggcaggtccttgaagttcaccactgcatttacctgaagaacgttgtgaaaatattaaccattctattacacaatgccttctttacgatttgactactgtatcgagatttgtgtctctgaggtagaaaaataaaagaacattttgctttatttgttcttatggatctgtgaattttaccattgctctttttttcttcttcttcttctctgtgttaatttccaggaagcaaaagtcaatttcacaacccacgtgcagcaagttcaggaaaagcttacagaaaaagggaagacgatttatcgttgactgtatgagttgggtcgactgtagtctgaagcaaacacacaccatacggtctacagtggaggcggcaagccacgggcgcttgtcttccgagaacagtggtcacacggaatccaacgcaccgtggcacagaatgcatcgtgcgattcagtctgtccccatcttaaacattttctctgcgttttagccctgctcctgtccaccctccagtggaactgtaacttgggtttcctagcttccatctgtaagagtgtgcgacatatggtctgtctcaccttgtagcttttcccattctcagctgacaggctggctcagccacacaggaggcgatccttgtgcctctgagataacaagagattctttatgcttctcaggttgtcctggtaaattaaatcatgtcacactgattaatgttttattgcaggccagtttaatttcttaaatagtgatttgacacaatttgtgatgtagttcaaagaaaacatttgtccctggtttttggaggcaaacaatttggtcacaaagactcacttgtctactaggcatagactagctgttagttatactatctatgggtcattgcaagattctccctgagtctggagcgtgtttgctggagggaacgtgccctttgaaggagagactttccagggaaacgagattcgaggtgacaacatcaataaacttctatagcttcctatctgaccatccatcactaacactttttcccacataacatcagataactcaaagtgattttccatatgagctttgtatatatttatccttgacatttccttaagttcttttaccggaatatcacagctcaatggcagcacattttatctatgtattaaaggttagttaaaagaaatgaatttgagttcaatcaccttggatgctttgcttgaccatctccagtgttctggaggcaagcaattctatcatccacacttgatacataaaaacaatgagagggacatatggggtcgaaaatgtgtaaagtgaacagtttgcgataaaatggccaatatcttcatatgtatattattttacaagtattcaaagactaaaagagtccttgtgtgtatgtagacacgtgtgtctgtgcacgtgctcagctgagtctgaccccatgtactacagcccaccggactcctctgcccatggaattctccaggcaagaatactggagtgggtagccatgccctcctccaaaagagtcctttggattttgcctaatcaaaacatttt

SEQ ID NO: 40070 - DNA, 854 bp, Bovine  19866880638762
gcttgccctgcccagtgcccttcatgcataatcccgtctgccatactcacaccaaccagaagctggggctcagagaggttgccacccagcccatgtgcagaagagctgcacttgaacttgggcttcagtccgtctatgctcacccctgtggcctgcccagacctctcaggaaaacaattttgtacagacaccaaatagatctaagtaaatgattagcatgtgtgtgtttttaacatttctttccttgataataacaaagagcatactatgtattatcaaccttttgtaaagtatatgaatatatgaataaagatataaaattagacctcccttctaagcctctgccctgttttctttggtttgtctgtacacatctaaatttagatctgtgctgaccttgctcattttttccccccatagttgctgattcagttttttcttttttttttggtgattattttccagagtttgagattctttggttttgagttatttcacttaataacaagtgacttcataacaacccactccagtatccttgtttgggaaatcccctggacagaggggcctggtgggtgacagtccctggggtcttagagggtcagacacgactgagcacacacacaacctcagcccctcagctacttgagctcatgattccggggtggcccctgctggcaggtcaccccggagcctccgagcacagcctgacagggtctcttctgcttcagctctgctttcaagctggacgaggacgacgcaccaatcaagcgctgccccaagtgcaaggtctacatcgagcgggacgaaggctgtgcccagatgatgtgtaagaactgcaaacacgccttctg

SEQ ID NO: 40071 - DNA, 1367 bp, Bovine  19866880647331
cctggaaaatcccatggatggcggaacctggtaggctacagtccatggagtcgcaaagagtcggacatgactgagcaacttcactttcacttttcagtctgctgttgagggtcgttggtggggggaggatcttcatagtccatgcgggtataatttccccactgatggtcgctcgccaagccctccagcctgcaatgagtgtaggagcatcagagcacagagacctcctggcaggtggagaatgtacgacacgagtcagatgggctgtgagtaatgtaacatcagcatcaggaaagcagcgctcactggaacatttctcctggccttcgctccacaaccacccaaggcttcaactaatgtgattttggaagatgctcttgtttcacagtccaaaatacttgggggaaaaaaaggcataaaattgacgtggtggcttgctttttctccccagtccctcaggagattcctctttaaaaacttacatatgttcccttttattattttacttgcaaagaagggaatttgaacctatggaattattataattgcacatcaggcaaacccaactctgagaactatttctgtacacacattaaactaatttatacactgaaaggcctgaccaatgggctgacggaggggcctagagaaatactgatgattcccacttcaactatcctctcactagaatatttctgttttcttgaaggtaaaataattttgaaaaaaaaaatcgacactatttcccagatcttgttagtcaatcacacctagttttgctatgtctgtttccatctttttagaaacattatacagctgcagaaaaacatctctttctgctttatatactctgccaaagcctttgactgtgtggatcacaaactgtggaaaattctgaaagagatgggaataccagaccacctgacctgcctcttgaaaaacctgtatgcaggtcaggaagaaacagttagaactggacatggatcgacagactggttccaaataggaaaagaagtacgtcaaggctgtatattgtcaccctgcttatttaactttgtgcagagtacatcatgagaaacgctgggctgaaattaagatttccaggagaaatatcaatcacctcagatatgcagatgacaccacccttatggcagaaaatgaagaactaaagagcctcttgatgaaagtgaaagaggagagtgaaaaagttggctttaagctcaacattcagaaaactaagatcatagcatccagtcccatcacttcatggcaaatagatggagaaacaatggaaacagtgtcagactttatttttggggctccaaaatcactgcagatggtgattgcggccacaaaattaaaagatg

SEQ ID NO: 40072 - DNA, 1289 bp, Bovine  19866880832265
gatctggttagaaagtatgaaatcgagcgtgtgacccaggatgcactaatgcccaggggtgacaggagcttacgcacagtggcccggcaggactcgaatgtcaaatcccttgcaccagatgtgcgttcaccagcagggacccaagactgccagctctttgcacggggcacctggctcaaaggaatggatgatgtgtgtactcgctctaacagacctgcaggtagctttgcgacaatggcttctgtctcttggattgttccttaaacaagtactctcttgattgaaaaagtgatgattttatttcattttatttttagaaaaaaaaatccctgagcgctggatgccgaggacagctggagtgtgtgggacgcgggacgctattttttccccatcgctttgggaaccaagcagatgggctgccacttgattagatcgggggccatggatggcgccttccagctgttggccacgtgaccacgtttactacgggcaaaggggagaatttcccttctgttttccctgtccccttggtcctcagcttcttgaaattgtgtttctgggctgctgaaagcacatctctctgcttctttttgaaacatgcagccacggactctaagggaaaagaacttccaaacacctctgtaaaacacacagagggactctgtagcagtcaggtaacctgagcagaatctgggcatttaaatgaagtggggcagtttctcacaagtttggcagatagacaaagccctggttccgagagagtgtggcctgtagcagagaacaggaagcgatggtccaggatccgagagaggggtccttcctgcaggcatgggatgagcctctactatctgatcggacactgacaatgaaaggtaacactttctatgcacactagaactttacaggttatatgtgatctatgggcttcccatgtggttcagtggtgaagaatccacctgccaatgcaggagtttcgggtttgatccctgggttgggaagattccctggagaaggaaatggcaacccacttcggtattcttgcttggagagtcccatgggcagaggaacctggcaggctgcagtccacggggttgcaaagaggcagacacgactgagcgactgaacaaagtcatctatgctttacacctcacacacgcggctccataaactccccgcccaacgccacgtgcagggcctctttgctctcaaatccatccatcctcagacacaggctcggcagttcatggtcgaggaaacatgaaagctcctcctgccatcagagcatctgt

SEQ ID NO: 40073 - DNA, 1058 bp, Bovine  19866880880287
ccagtggccctgcttcttggaaaatacgtagaattctatcgttagggtttcctgtatgaagccttttccctgtgctctccagataacagtgaaacagacacagcctttttctttttgtgcaagtaattctgtaattgtagaagagaatctttgaactaccgggtatatgtttattggagttttcatttattacatttccagtttttaaacaggatttgcattttagctttaagagaattgaagctttaatgttaactttaaaaaggaaaacaaagaaaagggaagaaaacagaaaattccccccaaacccaaactccaagatcagaattaggagagcctccatcaccaagcacttgctgtgcctagtctcatgtggccatgagtttaccttgtttttatttcatgtatagtaagaaaagaggagatttattataactgacggtgtgagtctcatggtgacaaattggccagaagcattctggaatattttaaacttaggggcatcttctcaaagtgtatgttttctctccttgctggggtacaggatccagccagcaagcacagtggtcagattacaaggtctccagtcaacatccctcctccccgccctgccccgtcttcccagagcctggaagggctgtgctttgaggtttgttttgggagaagggtaaattgccactggagaaatccccaatccccaaaatatcccaaagagtctattatgaaaagattttttttcagatagaggctaatagtagctaaattcctttcccataacaggcctcttcccttgcatttgggaggtacagtcaatattggtctgaaagggtgagtgagcagaggctattttggggtggtctgaagaacctcaaggttgtcttgtagagtaacaactgaggagcttgttctgtgaacaggatagttgggaggtgagtgttggggctgctgagcagcttgcagcatggcacgggctccttggaccgtgggtgcccagatgtgtatatgagctacccagttccctattgatagacctcagttgcctctcccgggtttgtgtc

SEQ ID NO: 40074 - DNA, 919 bp, Bovine  19866880902061
ctgagaaagagtggcctgtttccttaaagtagaaaaaaataacaaaaatagactttacttaagcctcttatttactcagatgatatcaatgctgcttctagcacaagacgaccgactgtacctgctgcccagagatttttagaaagtcggagagaagagacagcagtggggctttgctgtgagttgtgcctctcacattgctcattagaaggtaaatgcataattaaacggcacactcattcaagagcaatacactttacgggaatatttataaaacagttatgtttacatcaacggtgctatataagtaacaaataataataacattgtgaagaaaattagctgcttagatgcataacatttaatatgtagttctgtataattaatatcctggcaatttaatgtgttactcattttcttttttttctccctcccctttcttacgacgaaagaaacaatttgtttaatttcatatggcattttcatcgtagtacagagccaaaatgtttcacgccagattaatctaatttcctaccccataactttgaaactggccactggattattaatgcccatttagatgacatggaaataactatttgctcttttgttgttacctttcatctctctgctaaatgtcctgatagaacctcgcaaggcacggggcaccccttgggaaaagaactatttggccccaaatggcaaaagtgctgaggctaagaaagcctgaattagctcatcgatctttacaaccatcctggaaggcagggatcattattattgccttcattttgtgcatgaaaaaactgtaacacacagatgagccaagagattgataaaattgcacagcgcaaagggcttgactccaggcttgaactcaggtcttcagagtctaaccgctggcgcacctgcctccgcc

SEQ ID NO: 40075 - DNA, 1700 bp, Bovine  19866880991802
cctatgaaagtgacttataaactctgaaaaactgtatacacatcaagtatttttaatactagcaatcagtcattaattactgagtatccaccatgtagaagttgacaggctaaataccaagattcaaaaatcctagtctctgctcttaagtaacgtgcagactacttggaggaaaccaagcagagaaatgataaactatcagcaaaacgcagagtatagtgggaagccaagaaaccctgccaggagatttcaaaggatgggaacattcattatgaacactttttccaaggaagtagacttaaagctcttggtcttaaaaaaaaaatggcatataaaaagtatttattagggttctagagtatgggtttccagggtctcagccctctggggtcttttcttccctgtttgacctcccatcattgagtagagagagtctctggttatggagtcacatcactcttgtgattagggtctgtggtaggacaaagggtaagggattttgcaagtgttattaaagtcacaaatcaggtgggaccttgagcaagtttgagatcatactgggtgggcctggcttgatcaggtggtggccacttcctaaagagagaccctccagtgggccttgcagaggcaaccatgagcctccaggaaatgaattcagaacaagctctctaatgagaaggcagcctggcccacattctggatacagccctgggagacctggagcaatgggcccagctaagctctctctggattgctgacgcacagaaactgggagaaaaggaatgcggattacaaagtctgcggtggtttgcaggaaacaagcacaaccaaccaccactcagggttcaccatcttgaaattgctccagggctacggtgtctggcttcacaagtcaggcttctctacagaaggccttcatcatctgagctgcaaagaggcgggcagaaagcgttgctgtgggtcacatcctgccaggagcaagctttctgccctaggagacagtcaggctgcgggcccgaaggagagactgtgaaacatcacacagcatgcagccaggtttgccactgcatctgagaatcacagactccatctctggaagggacgttcaagtttccatttcagtcctctgcctttacccctgagtctcagagtggctcctgaaagagctgcaggtagaacccaagtcttctgacacccacatgagcattctcagcactgtctgaacatccagtgagtcaaggcaccatctcaccccatggaccacaatcattataagaggacgagatggtagacagcatcaccgacttaagggacatgaatttgagcaaactgcgggagacagtggaggacagaggagactggcgtgctgcagtccatggggtcgcaaagagtcggacagggcttagcaactgaacaacaacagcttggcatctcgttcaagtccaaaacaacaagatgaggaattacccagttttccttgcttataccacaccagcggttgctttttcatgataaattagtaataactctcaggcacatttggcaagctgaagaaaaatggattttttttacactgcattgaataaacatcttctgcttgaatatctcctatacttcactgacttcaatacagcggaagtttattgacgtgtgtactgcaagctacgtttgaatgatgcttcatatattatgctatgcta

SEQ ID NO: 40076 - DNA, 854 bp, Bovine  19866881024315
atcccccaccaaccttgtacccttgctctgagtgagtcagtgaatctgtctagcaaataaatcatcctcggagactgtctcctctgagtctgcaagccctcagtcctgagtctctgtacaatgcctgaacctaaggcattcttgctgtatacacagcaatagcaagacatcttcacatctgactctgaaataacacgtgagcagattaacaaaatgatgtgcattcactcagattcgcaagattcttccatatatagcatatggccagacttatcctcagataggtagtattaataatacgtttttctattcaggagcagatctcccttgatttgagatgagacaaaccatgaaaatgttctataccttatttccaaaaataaagacttggctctatttgattcagctcatatcagtaattaattaggagaataatataggcccatagaatattgtatttaatcccaacaaaatataattttcaaggataactatttgattagcaagagtgaaagaagggttattagcattgttattgaagctgcatttaaagtcacacaatatgtattttttctttaatgcttctcaagtaacactgcaattcctcaaatggttcattacagaaatagagcttcagaacacacatttgtatttcatttgtcggcaaacattttagtttcccataaagctaatgaatttcttccaaaaccctgactcgccttaccaaatacaaatgtcttccccttgaagcaattactcccaaatggttgatttatacagcctcacaaatcataaatttccaagcaaataaatcactttgcattggtttcaacaaagaaaaataaaagattttt

SEQ ID NO: 40077 - DNA, 1988 bp, Bovine  19866881248312
tatagtgtatgttctcagcctcactaagcaattactctgggtaaaaattgctgaattttcttttaaaaaatgatgtacagggcagtatatgccttactggatatccagttcttaagtttaatatttggatcacacactcaaatcagtagaccattagcacaagtatcttttcttctttcttttttaaaaaaattatcctttcttcttcaaattattaggattattattgatgattttgaattgttaaacaactaaaaatatttctgaaaaagtgtggtgttatctattccaatccaatagactcactcaatttgaaaaaatctaaaggccagggtgagatatttgaaatcaaagatgcatttctcctatcctgtcctgaatcttccttttcctcttatatgtgtattatcccagatctgccttcattttcttaaattactttcttactccccacttgcagctgaggttcttaaatgcctctaactgcagggctttactgtgggccattgcctaacccagaaaaccaaacaagacctacaaatagaagtgacatatgtggtttttacacttgaggggctcatagtccaatgaaggaaatagaaacaaacaaaccaaaacccccgaaaatacagtgaggaaagttcccactgaaactttcaatgtatgatgagaacaccaaggaaaagggagtgacctgaggctgggtctttgggaagagagaaacaagggccagcttcatggagaagaatgggtatcagagagggactaatactttaacttacgatcttccctaagaatccttgatccatgatttcacgaatcaagaactctccagctgctattgagattttctgttttcatgaaatccttccttacatgtattgtctgagcaaacatcattgagatactggtttaattgccaagtaataattctaatgcttggtcgcagaagaaattggagtttcaatgtcatgtagatatttataacaaacaatagtgcttgatgtaatagacttcaaattattctcaattgtcctattgtgtgaattatttatgaacttttacacatctgtaaactatgaataaaacacttttaaccattccatacatagaaaaacaaattatcaaagatctttccatgtgatttacttacacttcatagtgcgatttcagcatagcatttcacatgtacaaattatgtcataggcttaactattcaacatttcaatcgtgtatatttattagtgtccagaggtatgttcagaacctttgagaatcaccaggtgggcattaagtagtatgctgctgtttagttactcagtcatatccaaatcttttgtgacccccatggactgtagcccaccaggcttctctgttcatgggattttccaggcaagaacactggagtgggttgccatttccttctccaactaagctattaataattaccaattgcttggaaatgctcaaatgaagaggtcatttcagctaacagaaacagaaacgtttagaaatattaaagaaaaataattagctacacatgggttaaaaagttgacagctgaactgtgtatctccatagactgagtttctattttcagggccagtctgttccagacagaccagtactgtaaataactggaagatactaaatgcagggcaaaaatcaatctaagaggaaaaacctggagtaaacttaaaccaggcattattaatctaaatctagttctataaaacataccatattgaagcacgtgtattaagctgcaaaataattttagggataaggcaagaaaccatagtttttaccacatacaaaaaaaaattaaaaactatatacaatggataataataagacagcaagagatacctttgttggttaatggtcatacacttaagtaggcaattcaataagaaagtctgggatattactaaaaaatcttccctcaagtcttaataattataagccaagagagaccaaagtaagaa

SEQ ID NO: 40078 - DNA, 1060 bp, Bovine  19866881259049
caatgttaataggttggtattcatgttccttctaccattttccagaacagaaagtttctatatcctcagaatgtcttcttaaataataataaaagttattcttcaaatttgtagagcgctttgcatatccatcccattttacaggactttgttttcttatatagataactaaaacagaaaagtggtttggaaatagagcactgctgtaaagaagacctaaagcatgagtcgttgggtttttcatggggcaaagggggaggctggaaggataatgaggagcttattgatgaaggcaggaagtgcaaggataaaactgataccagaggcttaaaagatggtgctccatgttttgtagcaatgaaacaagtggcaaaacaactgtttgcatttacctgagaaaaaataatgtacccaattaacctgcacatgcagataacatttctaggaagactattgcaagtgccaattggcttctgttagttacatatgataagatatggaaaggcggaatttagctaaagagagaactattcagtatgcgaacagaatttccaatccagacttacgaggtcaaaaaataaaactgtttaatatttccaggctctccagcaggcacaagactctcaaaatgaaaagtggcttcagggtaaagagtaaatcaaagattcagtcataagaccctttgtttagacctcagactaatagattctctcaactaggaaaaagcacgtctaaaaatctcaaaagtgttatttcactgcaattgtatacttggacaaaagtggagagagttctcttgaaaagaattatagtcatgacttttgggacatggagtgaataacaatcagatttgtagaaggaccacaaaaagtttaaaggtattgcacaagattggactaaaagggcataaatcattacaaaaaagatatctctggagttctcaattttctacagtcaagaaggagtctgagaaagctggtctgatgagaacatgggctctttcttatgggaaagaaagtgtttcacagggaagcatcctagagagcaaaaccccaaacca

SEQ ID NO: 40079 - DNA, 642 bp, Bovine  19866881435450
ttcctttttctggaccattttaagcatggactatgcttcaaaagaacccttaatatggcaagttaccaaatgtaaagagatgtagcagaaatgcacactcattggcagtctgtggactagcagattgctggtggttatgtgtatccatggaccatctattccattaaatactcttcatctttcttttgtgggaaaaaagtaaatataatccccctccttgctttaaaaaaaatgaattataagctgattagtcaaaacatgcccttgaataagttatcattaaccacctccaccattttccattctggcaaattagaatcgacccgagttgagtatgcccaccgcccaccgtagactgttagctgaacaccaaatgtgtttgttcaccaaatgccttgctcattaagggtgccagccattctggctagctgggctgccaaggaaggctgcatggtggcggtgtgacttgacttcgatcttgaaagacatttaaattgaactggatatgggagagacaattatacataacaggcaaaaagaatggcaggaacaaaagtaggtcagagagataagagcagatgttgctctaggcgggagggctggaaaagggatgacttcaaactaagtgaactgagaaaaaaa

SEQ ID NO: 40080 - DNA, 1605 bp, Bovine  19866881720752
attcatgttagcctcagcctccaggggcaggaaaaaaaaaaaaaaaagtgaaagtgttagttgtgttagttgctcagtcattcagtcatgtctgactttttgcaaccctatggactgtggccggccaggctcctctgtccatgagattctccaggcaagaatactggagaggacctttccccgcccaggggtcgaacctgggtctcctgcattgcacgcagattctttaccatctgagtcaccaggaaagccctggggcaaatctccaggggcagagggatcaccaaatggccctgtggccatctccgctggcaatctggtgaaacggtcctttaggtccctcatcacagatgctcctctcttgagtgaaaagtattcagtacaaaccaaaaccacggagggtggtccctgggtatagcccgcccttcctctgtgttctgctaatggggataaatctcatcagatgcttgggaagagttctgttgtcagcagaaaactgatcacgtgggtagtaagcacacacagttacgatagagaggggtcaggactgtgaaaggaaatgggacatcttcccctgtgagagacacatggctttccaaataaatgggagcatttacttggatcctacaacattttgaaaagaagtttaagtagaaacataagtacatcctttttgtttctttggtttgcagggaaccagtttgttaatatcattttgggaggacttaacgctgaattgcatttatacatgcatgcagtgactcatcagaaagtctagaatgtggaagctggcctggacagtgtattctttcctccttgttggacagactgggaaatggagatggaaactctgggtggcttgccaaaggtcaacgtagagatagaattagaatcaaggtcctctgagtcccagatggttctcttttcactccatgtgctgcctcctctttggggatttccttaagagcaaataattcaaaagcaaaatggtagagaagagaaacacttgggacatgacccaatgatgagcacaaagcatgattttggggaaaagattgacttggaattgaatctctgatctgccatgaagacttctccaagcctccgtttcctcctctgtaaaatgggggcaataaaggctacctttcaaagtcatattacagattagggaaataatatgcagaaagaactcaggggagtacggctggtgatcggcacatacatttcccttgtccctagggctgtgactcaaccctttgcagggagcttggaccagatttgtcttggctgttgccagttaaaggatccctgggtgaggctgtgtgagatgagtgctgtgagttcttacggagtttgttccaggccctctgctgtgatcagatatctatttgcttagaggctcccactagcatgttagccacatgtccttggagctgactcagatgaggttgactgctcatctccatggtttctgtttgcttccaagcatgtctggaatggattgggattaggctcatcactccaccttcctataaaagatcctatggaaaggggcgcatggatcagatactttgccacatctgagtttcaagaagctgtctagaa

SEQ ID NO: 40081 - DNA, 1072 bp, Bovine  19866881992952
atggtgaatgttataaaactgagacaagagcagaaggtagacctctgggggcaccccaacacagagagaagaaatgagtaaaggagacagaattggagaggaaaaagaggagcagcaagagacagagcaaacagaagatgcttcatgagcggagggaggcaggagacagggctgaggagccactgaggccattctagggaaagctttgttttcaataccaaggagagggatttggttggagggaaaactaactatggcctttcaagtacagtagaagcttcttccttgtcctcatgggctgcagacacagtctgaaaatcccatttgaccagcctgttcctgaccaggactgaatttcctgatttcaggggggtttcacaaggcatcatggtcctgatggtgaccactccaaggatctaaagtgatctctgatcatcaacgtataactgatgagtcaaggctaggaatcatagacttaatttgcccaaagttgagtttctgtaggtctcctggcattcctgtagtcgagcaggacgctattgcagatggtgatcatgcatgtgtgtgtgtggggtgggcgggtggagacatgtgttccagggataaacaggtattttgcagggatccagttttctcttctctcctcagaagtcctggcaagggacaccttgagttctccagcagaacagctaaggactggggaaagaaatgttctgcaaaggaccagagattcaattttattcattctgtatcaaatttctacatctcacagtttgggctcaacaggaggtgacactgttaactgttactcttttcgcttcctttttttccccttcactgaacataaacatatcattacacagttacactccactatatttagagttgatttttaagtatctattaaatcaaacagggaagcgaggctgttctacctggagccagtggggtggggtgggggagatagacccggagatgggaggaccccagcgatacctgcatggccgaccaccacagacgcccaagcacctccatcctgctcttccctggagacataagcagactgctctca

SEQ ID NO: 40082 - DNA, 1339 bp, Bovine  19866880587305
tatggatgtgagagttggactgtgaagaaggctgatccccgaagaattgatgcttttgaactgtggtgttggagaagactcttgagagtcccttggactgcaaggagatccaagcagtccattctgaaggagatcagccctgggatttctttggaaggaatgatgctaaagctgaaactccagtactttggccacctcacgcgaagtgttgactcactggaaaagactgatgctgggagggattgggggcaggaggaaaaggggatgacagaggatgagatggctggatggcatcaccgactcgatggacatgagtctgagtgaactccgggagttggtgatggacagggaggcctggtgcgctgcgattcatggggttgcaaagagttggacatgactgagtgactgaactgaactgaactgaatttcttctgacgactgcacatcattgtaggaaatgtgccagaatttattgaaccaatctcatagtgaaagacatttagattgtttccaattttctgccattataaataatgctttaaaatatccccatatatttatgcttgcaaatttgtcctattagctccttgatatattatcatacacaagatcaaaggaaatatacaattaaaaatttaatagatattgacaaattcatctttaaaaagaatccatcaatttatattccaatcaattgcatttccttctaccttatcagaacaagacagcattcttctttttaatattttctcatatgatatgaaaaaaatcttactgctgttatatttcaccatacatacaatgcctatgtatgccaccctttctctttacatattaaaaatatgtctatcaatattttgttatatatgctataaacttttaaaaaagcaataagtctttggctctcttagtttctttaccatctcttttgctgtatacagatttaaaatttcagaattgaatttttcaaaatttttttgtgatttctgggtttaataaaataactccctctccccataattaaagattattattaaattatttcctaaattttcttctggtatattaggttttatttcctacatttaaatatatttaatctaactcaaatgtgtttttgtttatggtgtgaggcaggggtttgtctttactttccaaatatgttctcccaatactacttaatcatctatagttttctccttattaaaatgctatctgtacaatattagtaaattctattctgttccattgatcttcctggcccttcctctgctaccttattttaggaaatgtatgcataatgtatttaatcaacccatcattcacctcctatacatat

SEQ ID NO: 40083 - DNA, 1779 bp, Bovine  19866880623161
gccgctgacagccccccatctccccgtcttgccccagtcccaccagtcacctgcgtacagaacggcctcaggtaccatgaccgagacgtgtggaaacccgtgccctgccagatctgtgtctgcgacaacggcaacgtgctgtgcgatgacgtgatctgcgacgaacttaaggactgtcctaacgccaaagtccccacggacgaatgctgccccgtctgccccgaaggccagggtatagctcggggcctgggccggggcgggcgggggctgagggatataaggggggacgctccttagcccctatcaggggaggcctctgtctctgggagcacgtggagcaaaccttgcctctaagtcacgtctctccccacccccccagaatcacccacggaccaagaaaccaccggagtcgaggtaatcctctgcccctttgccgtcgactctcgccacaccccaccccccaggactcttgacggttcttctctaaccccgttgcttttgtttcttctcctgcaaccccatagggaccgaaaggagacactggcccccgaggcccaagggtaagcggcgccctctcgcggctgtcgggggaggtaagtgggcgtggctcccggcctgcgctcaccgggcctgccctttcccgcctcagggacccgccggcccccccggccgagatggcatccctggacaacctggacttcccggaccccctggaccccccggacctcccggaccccctggcctcggaggagtaagtggagagtcgaggcttctgtggaaggccttaggagccagccctgcgcccccaccccccactcccgctcccgccggtgttttcctttgctgggttttattttgttttggcagatggcatactttgtattttgaaataatttcaaacttataggggaaaacggggagaagagttgcaagaataatgcaaagaactttcatatatcgttcacaatctgtcacatttgctttatcagtttctatgtatacgtaacattatcggggtgggagggggagggtttcctctgaaccgtctgagagtaatttgctggtattgtgtccctttgctcctaaatactttagtgtgtattttctaagagctagaacattcttttacatgagcattacataatgagtacattttagaaatttaacgttgacatgatactattatctaatatgcagtccatattcaaacttcatcaatgttctccataatgttctttacaccattttttcctccctgattcaagatccaatcagggttatgaattacatttaattatcatgtctctttagtttcctttcacctggaacattccttagacttcccttttctttcatgacactgaactgtttttttgcaaaagccagttgttttgtagactgtctcttaaattgggtttgttggatgtgtcttcctgattagattccaatgatacgttttgggcaagactgttccacgggtcgtgttgttgtggtgcacagagaatgtgatatcattgtgtcccattactggtgatatcttctgcctttcaactccctgccctgacctgttttctcatgcactctctcttctagaactttgctccccagttgtcttacggctatgatgagaaatcaacaggaatttccgtgcctggtcccatggtgagtcatcagcagacgacatagaggacagaaaaagagcagacgggccagtgaaggcacatagggtggcatagataacttgggaggtcaagatgacctttgggacttcagaatcca

SEQ ID NO: 40084 - DNA, 1338 bp, Bovine  19866880747490
ttcctgaactgtatcaccatcgccatggagcgccccaagatcgacccccacagcgctgtgagtcactggggctggcggcagttgctgagtgcctgcttggtgccctgccctcccgggttagaggatttgtacccatgcagtgagccaggcaggcagggaggcccagagagacacggaagcaaggagccaggaatctccccgattctgacccttgcaactggcaccccgggatgcctcctatatcctcacctgtttcccttctgtgaaaaagcagccggctgccgggcttgctcctagcctgggcaaaaggaagctttgctgcccctggcagtttgcagtggtgccttcctgtgcgccagggcttgtgaggcctgtatgtgagtcagtgagtattgcagggatgccaacagtgagcctggccctagctggtctgagtggtcaagggtctccttctcaccgggacctgtgcactgatggggaggcaccctgcccagctcgccccatgggtgatgccccagaggggagggaaagctgttctttgctcctctgggtcttgccaggttacaaacaagtagcattttaggggccttcgggggagcattggtcacttatgcttggctttgaacctgccatcctcctcaggagaggaaaggccatgggtcagagtgtgtggacgcactccttcaggcctggcttctttgggatgggcccggccagtcctgggagctctctccccaggctggcatcacagcctgtcccctccagcaatgatctgaggcctagaaaggtggggggctctgtttcccgcccatgacatcttgcaccaccaacttggaggcagaccctgttctcgttgctgcctcccacaccattgttcagatttcaatgttatagagcttctgtttcccattagggtgggctccagccaggtcggtgggaaggggtggtggtggcagagggaaatgggcagtggaggggccagcctgggaacaggtgagagcctgtatgcatgcagtaagggtggccagccacaccggtctgcctcctgcctcagagctcgccgtggccaggtctctcccccaccgtccctctcagcccctccatctccagctctatcacgtgcttctccctctcccccgtttccctgtttctcactccctcttgacacactttacccgctgcctctccagctctctacacccctctcttggccatacaatgatggaatcagctcacagatatcaggggattgggccgccttctttcctgcccggcctcacgctatgcttggcataaatatggtgcctggggatgcacagcctgtactcaggcccccat

SEQ ID NO: 40085 - DNA, 614 bp, Bovine  19866880763989
gctggggtgagtgttacagtgcatgattgcccggttgtatgtgtgtggcccatgtctaggtttgcctgcttacatttgtatgttggcctgtgtgtgtgtgtttgtgcgtgtatgtgtgtgtctggtgtctgcctcgctgtgggcatctgctctgtgtgtgtgtgatgactctgtctctctgtgtatggctctctgtgtgtttgtgtgtcttccagtgtatcaagtcttatgtgtgtgtgctgatgtctctgcccgtgtgtgcatgtccctgtgtatctctatcactacagatgaccctgccacctagtgtattctcatttgtgtgtgtgtgtgtgtgtgtgtgtgctctcccctgctgagcagcgaatctgatgcagcctcctggccgctgatctgggggatgctgagtccccatttcttcttaggcatataggatgggtggcaggaggatggggagggcgtgttaagtctggatccagcctcttggcatcagccactggagttaacctttctgttctggctagattgtgatctgtggggacccccaggccaaggataccaaggctctgttgcagtgtgtccactccatctacatccctaacaaggtttggtct

SEQ ID NO: 40086 - DNA, 2008 bp, Bovine  19866880785382
tttggatttttcctgaagatgatagggtgccacaaaggttttaagcaagtccatggtatgtgtttgtattgtatcaaaagtcttccagaagccatgtggggagcagaagggagtgacagacgggaggcagggaggccaaggagagggctactgccataatccagccagttcatataccttgtccctggagacagagagaagcatgctgggaagagcaggcagtggctgaatctgtagaactcaactccagttggatatttgtgaggtggcagcaaggatgacacccaggtttctgcttctgggaggagcactggggcttgtgcatatttgggctggagggcattccttgcaaactgcctgtgggatgcccagggtgtctttggattgcagaagagaggtgtctcctggaacctgtctggctgggtatgcatggggacaaggccttccaggaggatgaggtcttcaggacacaggaacttcgtaatcaccttccttcctagttctggattgctgagagttggagccaacctcatgctctagaagacagccaacagcagggggtggggaggggcacacagcccactggtatcctgggctgcagagaagagagagggagggtccagaatagacagtctttcaggcctgagaggacagggcaggtgatgctcctgctcgtttctcacactctgggcccaccctgtcgctctagatacatgttcagggagggtttctatttataagtgagtgaggtcagctattcaaggcaagggaggctggggtggggtagggtgaggaagagaccagatgtggtaggtcttaactttgaggggattcacaaactccttttggattctgtttaaagctagggccatctctcttaaagatagacacacgcatggataccccagtgcagacttcgaggatgggagtttacagacacctgacctattccttgggcctcccaggagtccttggcctgcagacagaggagctgggactacaggccaaataagactttggaggacaatctcttacagttgccctgggcccagactttcaaaggttctccacatgtgggagggagaagggtgcttttctagagatggcctgctaaagggggcatcctctggctctacggctcccccaattcatcaaacatggggagtgcctcctgtgcacagcacatttgaagagaataatagactgggggtatgggaagtgccaggagctccaaagaaacaggttccagcagaaaagtcattctgcttgattatgccaaatgccgtaaaggagatttctggggacagaagagagctcacacccaggtcaaggattttggagggcttcctgaaggaggtatcttgtgagagtggccttgaaagaaaagtgtcactgacagctgaggccaggagcagaggggtctggtggagggattggggagaattctggcagcctggcctgggaatgcacagggaggcatgggatgctctgaaggaccatcatatagcctcccccactccaccccaagttatctgagcaggggctcttgaagtgaatccagcagtgctcttgaatctggagcttccaggaggtgtgggctggcttgggggtgggacccagagactatttctatcgtccagatcagaggcaaggagggcccccaggatgtgaaggggaaatagaactagtgggtggggcacagccattccattggcaaggtctgtgggcccaggcacctgctgccagagggatgaagggcaggcgtaagtcctagacaactcctggttgcaagatggaatcctggagagggaagtccatggaaccaggaagctggggaaggaacaggtttgggagaggaggtgagagggtttgttttggatgtgctgcatttgagctggctgtgggccatcctgggaaggctatcaggcaggttggctctctgggtgaagagccaaggcttggagggagattgttttgtgtcatccacaccctggtgacagccggaaag

SEQ ID NO: 40087 - DNA, 1571 bp, Bovine  19866880833035
atggaggagcctggttggctgccgtctgtggggtcgcacagagtcggacacgactgaagcaacttagcttcttaaaaaaagaaagggaaagctttttttttaatggatgcatgccagttaatgaatgtggagggaatgatagagtcagaaatttacattttacagcttccaacctaaccactgatttaggcgaggataatcgataaaagctaagatcacagccaaatgatgaggttcaggaaggaatctcagccctacactgatcctcaagcccccaaatcaggatcccacacttcactgaagcccagacaaaggagaggaccacagttaagacaggttccagataggcttagtaggttatttaaataaaatcaggtgaccgtttctgcaggtaaaaggccaggagaattaccaggggaggaatttccctttcctcacatctgcctcactgtagccattcccctggggatgccaggtctgggcagtgatcagaaccaggacagcacctgccagtggtgatgtctgcagtcatcccagcccccaaagcctacctgcagagtcctggatacggaacacgtggctctcctccggtggctatcctctgggcacggaagaggggattctctgctgccaggcctcttggagccgagatagaagggacagcaacagagagtccagcacagccagcccctcccaggaacaccgaagacccctggaacaagaggcctggctgtgactgccccttcttactagtttcaatcctcaccctctgccaatgccaaggccctggcgccagaggcccttccttgtcaatctttctcacctctctctggtctgcagatgtgtagtcagggttccctgggacacctaaccactgcccccacaacacacctgtgatccagcagcaacaggccctgctcctgtagctccttcacctccttgttggctccaaacaggtcccacagggtcagctggggctcaaactgctgccagtgctgggaaaacaagaaggggcagaggtgcaggaaccacaaggtggggagctggcaggggcttttctaggccacctgcctgggggtgtagtgaggggtggctccaggccagcacagagatcttagaaaccgactatcacgcacaccgggaccaggtcaatgggtcagcaggaaggtgggctccttcactcctattccatgtccaagccagatccggctcccagccaagccaggtcttcctttgctcattcccctccctgttctggtcagagtatggccaaccctagttggagctctcactggaaaagaccctgatgatggaaaaggttgaaggcaaaagatgaaggggtggcagaggatgagatggttagatagcatcaccaactcaatggacaacatgaatttgagcaaactcgaggaggtagtggaggacagaggagcctggcatgctacagtccttggggttggaaagagtcagacgtgacttagcaactcaacaacaagtccaggttctagggctctaatttcatctagagcagttctgggcttcactgatctttattgcacttactatctgag

SEQ ID NO: 40088 - DNA, 1645 bp, Bovine  19866880838848
tgacactaccctttggcagaaagtgacgacctaaagggcctcttcataaaagtgaaaggggagagtgaaaaagctggcttaaaagtcaacattcagaaaactaagatcatggcttctggtcccatcacttcatggcaaatagatggggaaaacagtggaaacagtgggagatttattttggggggggggctccaaaatcactgcagatagtgacatgcaaccatgaaattttaatttcttttaagacacttgctccttggaagaaaagttatgaccaacctagacagcatattcaaaagcagagacattactttgccaacaaaggtccatctaatcaaagctacggtttttccagtagtcatgtatggatgtgagagttggactataaagaaagctgagcgctgaagaattgatgcttttgaactgtggtgttggagaagactcttgagagacccttggactgcaaggagatccaaccaggccatcctaaaggaagtcagtccttgggtgttcattggaaggactgatgctgaagctgaaactccagtcctttggccacctgattcaaagaagcgacttccttgaaaagactctgatgctgggcaagattgaagtcaggaggagaaggggatgacataggatgagatggttggatggcatcaccgactcaatggacatgaatctgagcaaactccaggagatagtgaagggcagggaagcctggagtgccgcagtccatggggtcgcacacaacttagtgactgaacaacaagtaataacaaagccattcttgtctgagaaggtttgcttatttacatgtttggggactaggtacaaactgggcggcttgtgacattctcttttcagacttgtgaccttattctggctcaagttaatgttgctgttaacattttcaaacatatgctaaaggcgagatcagataaaaacgcaaataggagaatgttcaggctccttgtgactgccacagtcaccctgagactgcctcacgagggaggcccttccagcaggtgggtgagggtgaaggcggttttaccttgtcctctgaattactgcttcggatccagcaggctggcttcccacagaacagcagagaagggccaagaacaggcataggaaccacatcagggtaattggccaataagtctctgtaagacaatccaatgatgtatatttcctaagcctgccagtcttgccacatggagcccatggagatggctgccagaaaatgtggcaatgtgcccggctctgccctccagtggagcatcatcagctccatcctgctccattcctgaaatgggaggttcttggacataaaaagagactcttcatgcagaggcacacagcattaggggagtctggaggggccccacttatgagcaaaggaatgtccaggaaaaccccctcgggagctggttgttggaagagaagagatggcagtagcacagtgagcacaggtgccccttcgaatgggctagaggagggggtgacagccacgagcaagaggctggggtggaggcactcagattccagggagggaagcctgccctaggatacttgcaggcgctgaggaagcaacgctctccaactgctctccctcaggcccagggcccaactcacaagtgca

SEQ ID NO: 40089 - DNA, 1247 bp, Bovine  19866880844440
acttcgagggcaccctctgggccaagccccaaggctttgtgtccaaacccacctggcagctggtgaggggctcttcaggtactgacttggtcgcctccttacaatgtgtacataactaactttttgatgggcctcctctctctctctgtaaaacaaagggattggccaaggagatgcttatcaggttggccctggtgcactttggacctgggctctaatggagggatttctggcagccttggcacctgctgctctggggtcagggctgagggtagaggggttctgtacacacctcaagggcctgggactggtctctgtgaacagatgccctgcctcagtcatcctaccccaccttccctctgggcctccacctgctccttggctcctagagcaagaccaggaggaggcagcagcagctccatctggcctggggctgcctacatggacagactggggtgacaggggaggggggactctctaacctgtcctctgcattgtctcagctaataacagggctaataaggagccgctttttctaacctaattgtattcaaacattttagttaattctccattcatattttagcataatgggatcgagtgctctcggcacttatggagattaatgcagagaaagagttccagctgctaaggcaacgctgggcgactagcgccctcttgttctgtgggtactgaaggaaggaaggaagaggctggctcaccaggtctacctgccgtgatcgcatcgttgtgtggatgacctgtggccttatgttgtcccctgtccctggcctctcccacccccatctccctgggggcccaaagggccgcctgagcaaagtcatggttggctggcccatctctggaaacaaaaatatggcctaaagcaccctacagtgcaccagaacactgggactttctgcctctcggttatccacacctcaaggctgatgctggagcgcggcagctggtgaggctgaatgggagctctcgggtactcttcttccttcggcctttggtgggggtccacccaggccactccttgcctcagtttacctctctgtttaatagtcctgcatgggaaaggacagttataaccaaactggtctgagccaaagcttcctgccgccctggcacagtcctcagaggctacagccctggctggcttccgccgtagacttcctgagggggaagagctgtctgggacctgaggttgccccaaggcccccatgcggtgcctcttcttt

SEQ ID NO: 40090 - DNA, 1378 bp, Bovine  19866880885353
gccccagctaatagcttttagctctctgggtttcaggggagagttcttgagcagagatgtgggcgacgggggaggagacagagagaggctcagaacccagggtaacaagaaggcgggcgaccagggtgagatgaaaaccggcagctggccgtgagaggaggggttggctggggggctcaaagaccagttgtatctgatattcatcactcacctcctgctccagcaccctcaccctgaaggaattattccccatcctcactgccctgagtgactagaattcaaggagcaattaatgaaggggagggtgctgcattccatacctgggctgacaaagtgcagagccaacagcccacaggtgagaggcagagaagtggaggattcagcagaagctgggaccctcagcgtaggggctcatgtggctccagtatgattttttaatgtgagagcagaaaggtgaacctgaaattttggagcactcaagttccttgggtgactgacccttggtttccatgtgaaccaggccaggagattggatatggtttaaggcccattgcactcagctgaggagaaggcaatggcaccccactcctgtactcttgcctggaagctcccatgggtggaggagcctgataggctacagtccatgtggttgcaaagagtcagacatgactgagcgactttactttcacttttcactttcatgcattggagaaggaaatggcaacccactccagtgttcttgcctggagaatcccagggacgggagagcgtggtgggctgccgtctatggggtcacacagagttggacacgactgaagcaacttagcagcatcagcagtcagctaacttcccccaagccccttcctgcactggtacagggctgcaggtcagaccctttcagccagatattacacagacacgcagacaccgtggagaatgtcagtggccaaaggccaagatggctggaggaagccatggagatgcaccctgctgacatcacagcaggcccccttcccaacccatctctaccctgtcctgtccaggcctgtccttgggtgaaaggaccctgacactccccagggaagagtcagcagccctgaggagctgagactgaaggacggggtgggggtcgggggtgccttcagctcctcccagggtgagcaaggaggatgagtgggagactcttaccacagcacctccattgccactcacaatggaaaccccagtcctctgcagtaggtgcagggcctcacatctcacagacctgtcacccatcaccctgggtgaggtgcagaagggcaagaagcatgctttactcctgggggtaaaggaggctccaggtcaggtgggagtgagggggtagcaagggtaaatgcag

SEQ ID NO: 40091 - DNA, 1943 bp, Bovine  19866880887518
acaccttcctaggagaacagaaatatgctgcccccatcagctattcttgtgggggtccagggacagcctacctgacagcctcctctctgccatcgcctctgtggatccaggcagatttgacagggctcacacagcagggcctggggagcactcagggtcccagaagagcatgattcttctttttaaactgcatctcagatccagatccaggcagggagcagactacgctcacactgctgtctgggggcaggctgcccacagccgctcagggtgggcacttctcttacctgcacagggcgatgttgccttttggcccaggtaggagcactgggccaagttcacccctctcttcctccctcgcagccggttcccccaacctcccacagggacgaggacttgcaactgcagctggctctgcacctgagccggcaggagcaggagaaggtagtgggctaagccacccatgccactgctggtgaggtgctggtgaggcgctggtgaggtgctggtgaggcgctggtgaggcgctggtgaggcgctggtgaggtgctggtgaggtgctggtgaggcgctggtgaggtgctggtgaggtgctggtgaggtgctggtgaggtgctacgcgggtactaaccaggctcttccatctccctgcggtggaccaggctcttccacctccctgcagtggtcctgctgcccctgacctcagggcacctcccagcctgcactcttcttgaccctagctcaggtcctttcaagtctagcatgggcagctcatgctttcctcactctggtgccttctgcaggaggtgaggtcctggcagggagatgactcacctgtggccaatggtgctggagctggagcccatcgtcgttgggacagagagcctgaaagagcagagagagaggaggagaagctgaaaaccagccaggtagagtagtctcggggccatgggttagcagagctgggagatgaattgggttaaatatttataaagagtgtagaacagtgcttggtatatagtaagcaccacttaatgtttattcagtgaaaataagggtagaggagatgtagcagactgaggtcccatcccgcatgggctggtgactgagctggtggcaaactggggtgcaaaacatcctgatgtgagatgccgggtttggattctgtatttgctgccatttactttacaactcagggcatgtcattgtcttagcctcagtttcctccattcaagtgtgctggttggacagttccaactctgacattctaggagcatgtgatactgtggatcaagactgagagtagcctcaggtatatggtactgaaaacatcttgggctcgtgcacatggtgtccatggtggaagaatgtgtagctgctggtagcaaggctaccctccaaaactgctcatgctactcttgggatgtctctgtactctttcagccaatgttcacggtggcaaatttcttttggacatggactaagggaagtaggcttatcataaaatgtgtcttaccactgatgggctgaggggcaggacagccaaggaaggggtcaggcaggcttgccttccatcccagctctccctctccctggctgtgtgactttaagcaattgccctcttagcccaagatagcacatctgtaaaatgggcaccccaacaaccttccctaatcacagcgcaggttgttaggaaaatcagacactaaacggatgaggaaacattttataaacgggaaagcactctacagaggcaagggatcattaatagatgtttgtggaatgagtaaaggagaatgagctggagggaggatgacaggtcagggcccgcccttcctctgggccccgccttctcttgagcatggctgcctctcccctcaacagtcctccagcctcgacttggtggacatcttcgcatcagcttcaactccgccctccacaca

SEQ ID NO: 40092 - DNA, 1271 bp, Bovine  19866880902262
cggcccaccttggccaatcagccctgcccagagcgcacctgctcagccgctgccccagctcagacacgaaggccgcccgcatctgtaaattgctgtcgcacctgttgtcctgcccgcattccttctggaactgtacctgggggtggtgggagttgtgaagggcccaccatcatccatagctctccaggaccgtgcccttccggccctggccccggccccggccctacccacctccgtgtggttctccagagcctgcgcttggttgaggaccgggtaggcatccagggacccaagccccagttggggacgatcaggcaaccgcaaaggtaacgagtagttcatggagatggtgatgggtcggagtttgtcgcggacgttgtcctgggaaaggaaggtaaactgaacccagctctgcactgccctccaaaccaagttgtatcctcatacaaacctaagcccctagggaggagctgcgcccctctccctcaaccctaaaaaacccctgtaagactgaatcccctctggtctgctcaccaaattgacccgcttcggtaagatgtggctcctcctctccagagactcctctggaggaagattgactctcccttcattcctggggtccccaagttgagttttcccttttcactctgatgtcccagagaaagtctgcgcttgtccttgcttctggatgccttttctccagagacaagctaaaaatctcacatacttctctttggcccccatccctgctccaaaggtctctgttctctaccatgggctggatgctgtgtgctgtagcctccacttacctatgaccttccaggccaatccaccacctttgtctctggagagaactcatgccctcacccttgacctcggggactctcctgggcccatggagttacctcctcctgggaccatggagtcaatgtactgcccctcaccccctccctcaccatcaggagcagctccagtgtctggcagcgcatctcaggcatggagaagaagccgtggaagacagctgactggctgcgtgcaaagtggagtcggggtgggcggcggtcccggtcagcctccagcgtgtaggccagggctgtgggtgtacaggctggtcagcaagtgaccaggtgagcgtgccccccctcgccctgcagcccagcactcactgatgttccgcctgtagttggggttgcctgcactctggttgtaagcaaagcacagctccacctgcacactgttgagggtgggggacatacaggagggtcaggtca

SEQ ID NO: 40093 - DNA, 1149 bp, Bovine  19866880905794
acctgagacaaccccagctctagcatttactgcggtacagccttgagcaaataatttatcctctctagcctcagtttcttcaactgtaaagtaaggttaatctcttaagtggggtcactgtgtcatggggccattgtgagaagacaatgagatgatgtatataaaatcattagcacaatgggctctcatgaaatggtagggccacaccaacaccttcgccccagagttgctgattcctccacagctagctgctctgcaaggagaacaataacagtaacaatcatgacagtgatgttgaggataccaggccaagaaaggtgtgtcagaggagcttgagagacaccttagggaagggaggcccaggctcctcagcaggctgaggttcagggcggtacccacatgctgagtgaggcctggagtgtgtagtccaccagcagaggcagggtcatgggccgtaggtcatcctggtgacttgacctgaggaaggaatacagagggtaggggaggactatgtcagctgaggctggggggcacccaggatacctcaacccccatatagactggcttcctgaggtcactcacgtggagagctgcaactgcgcctggagttcccttgtgtgtagggtcactccgatgacctcgaaagcaatgagcagctccatctgccataagggcaagggaggttgtttgaggccaggcaggggtgatgccatggggaagagaggggctgagtgctgtgctggggagttggctctctggtctccatctcccacctgtctccactcttccaccttcctagccttatctgcctccctcttcccattcttttctgttagtaatagctcatgtagctcaatacttctgagctacacgaccttgagcaatcactcaagcttgctaagcctatgtttcctttctgtaaatcagcaccaacttcctcagaaggttgtgagaaatacataaaagaattgggctcagggcctggcatgcagcaggtgctcagcaaaatcagtttcctcgcctccacctgctctagctttgtgcatagctccgtagtggctccatttttctgtctctggggtctctccccaccccctactgcatccctcctccccagctctagctctttgattcaaggaagcctgggaa

SEQ ID NO: 40094 - DNA, 2238 bp, Bovine  19866880928245
tggatagcaaccggccttcatctgggcggacagagcctgcccgagcctgcccttcttcagccccgaacactccccagctgaagtcacagtcccctgtggcccattattgccagcgtggcctttcagtgggaagtacagcggggaagcgggggctcatttggggcaggcgaggccaggcaggaactgtgacgtctgggccaatatgtgggcaccaatagaatgtttcctctggagccagccagcctggcccaagactccaccaaggtggctccacaaatagtgcctggcaggcagtgcgggagcagggaggacaaagctgggggcatgcaggaccctggggctgtggggagcctgggcccacggcccatcccaccaaacactggccagcttcactctgtgccagcttgggccactgaggccaaactctggctgcctccccagtcccagtgtttgcacggggagcacagtgccagaggaaaaggagctagaagtggccctgcagctactgttgactccctagtgccaccctgagcaagggacttaaccttgccctgcaatctacatattgaaaataacactacctagctcagcagaccattgtatggattagatcttctgagaaaacctagtcacgctgtgaacctgctcagggcaccactgcttgcattcggggtggaccctgccccgtgggagcatagagctaggagaggctggacactgggactgagctgctcactcacacccaccctgctccctagttttctgacggtgccttcctgggtgtgaccacgctgaaacatgtccatctggagaacaaccgcctgcaccagctgccctccaacttcccctttgacagcctggagaccctcaccctcaccaacaacccctggaagtgtacctgccagctccggggccttcggaggtgagagggccccagtagtacccctagaggccatcctcctgtgatggagtggagacatactgaccctgcactaagacatcctaggcatatgtcctagatttgctccctaagaggtgtgggacgctgggcacttccccatttgtaaaatgaagatgacagttccagactaccccaaagcaaagtcaacctgaccccatggttcactgtctttacctccagtactcttccatcccttccccaaccccagcaactctctgtctctccaggtggctggaagctaagacctctcgccctgatgccacttgtgcatcacccgccaagttcaggggccagcacattcgtgacacggacgccttccgcggctgcaagttccccaccaagaggtccaagaaagccggccgccattaaacaggtggggtccaatgggcatggcccctattctctctctggagactctggaattgaggagggtgtcccaggatacttccatttttacagggaaaggaggggaggactggggctccctcctctaagggggaaaatgatacctcctaggactcccaccattctctccgaacagcatctagactgttggcgtcctgacaccagtccttgcctcaccacaggtcctgacccagccagtcctggtgactggcctctgccttctgccggagaaactactgatcctctcacctctgactcccatcttctcccaacaccctctgctgatacatagatctgttcacacctagacatgtcctggcagggcacccgggcactccagcacaaacccagctccacttgatgctgagagctccagcacgcctggcctcacggccacagctcctctcagagaagctgttgctaagacctccaagtccattaggaccagaacagggtgaccatcaggatggccacccttccagaatcctcctcttgatttccctttccctgtcatttggaaacaaacatcagatccttgccctaccccttgctcctaggaagggtctgaagcccctaccctcaactctgccagcccccacctgccaggacactggtgctttgccacacatcctcccacgctgcatttcttccccagatttctataaatataaatttatgtatgtataatatttactcccctgtcacctgtctttgtgacttgagagctattgatgaggtcagactgcagtttctcacatctgctttctagaaggagggccagccgaagggtcttccttggagacccaggctggactcctcgacacatccagcaatctgttcttgcccagccctggcctgccctccaccccagc

SEQ ID NO: 40095 - DNA, 1336 bp, Bovine  19866880937881
gaattacatttctgttacactgggaaatttattccccataaaaattcaaaaatgtaggtataatactgattctaaaaagttttgtgttcttcaacccaatgaattcagatggtggggtcaaaatggtgggtttaaaactggggtcttggggaccctaaaatcagctggtgagcaatacacgccacatgggtccatccgcctgactcactcagccacagcccttcttcccaggctacctgacatgccagatgcccacactctgtggtatctcccctctgccccacctaggggaaacagtgggtccactatgacctcaccggattctggtggcctcacaatgtccccctgaggtcactacagagataagcttaccgccccctgcacctcaggcacaagtctgccaaggccagcgtaggtgatcatcctcggtcctctttctggccacccagggcaaggcttgggccagagccctacaggaagcctctgagggaaccaggaactggggcgcacctcccacaccgaggagcaacccaggagagacttctagccgtcatccttggaggtccttgcacccagttcccttcacccaccccaggaagagatgcagaaagacacttcgctgccacccccatctgggcccttggcctccaacactgccctgggggcaggccggcaggccagctcctctggactcccaggcaagagcgagactcggcgccgcaccagccccaattcccgcaggaagcccagcatatccaaggtgatcctggggttcgtggcagacaagggggcaggcaaccgcgtgtccctggccgccctgaagaaggctgttgccaccaggggctacaacatgacccgcaatgcctggcgcttcaagcgagtgctccaggggctggtggacaagggcatgctcaagcaggtgacaggcaagggggccacaggctccttcctcatgggcaagaatcacgcctccaagtttaagctcaaggccaagagacggcggcagcggcgccagcgccagcgtgggcagcgccggcctgtgcagcgccagttgctcgtgggctccaaaccggggcacaagcgacccatcaagggggttcgcagggcggccaaatgccgccgcagttaatcaggaaggttgggcaagcaggcaggggtgccaggcccaccataggctcagagcagtgagaataaaaggagcctaacttatttcacacctgcctcctggaatctttggggttcaagggagtgggagaggaagaggtctgggggcacacaggaaaggtaaggccaggggtgggggaaaccggtcaaatgaggttaagatttgggaagg

SEQ ID NO: 40096 - DNA, 1198 bp, Bovine  19866880943333
cactttctatctctgggctcacggaatctggcagggttattccaaggctgaaatcctgagttgagggatgggagccaaggattagggtggggaaggggccaaagggcctggaaccctgcaccatttaccctcatctctcctagccactcccattccaaatttttgccctgagggtcctgatccatcagcaagcttgggaggtggaggctgagggctggcagagctccagcgaaaatacacctgggccacagagaaccctgggcgtggggttggccaggtgtggggctcttcacttcacccttggatccctcccccagagtctggggctcagcaactcgcatgatcgggcgctggtgaagcggaaattgaaggagctggcggcggctgccgagaaggagcgcaaggcccaggagaaggctgcacggcagcgtgagaagctccggcgcagggagcaggaggccaagaagagctagggagaggggcgggcaggcactggcacccggctcgggaagctgctgggctctgcgggcacaggccgccttaggaggcggggcctgggcaccaggcttgggttggcctggctccatgctctcaggagaacagccctctcaccctgtcatctgtctggacccagatccctcagagagagacccaggggagaggacccagtaataaatccccttgcaaggactttttggcacaaagttcctgggggaagtggcagattatgggcagagaggccagggctgaagcaaatcagggagcccagaggtgcctgagtgattctaaccctgttccctcaggccaagggggtcctggggctgccagtgaactaggaggcctgcataccttccagaggccctgggctcagagatacgggctgagcctctctgcagcagcaggtggataaagtagttcctttccagctctcccaggtgactgtgtggagagagctctgcaggaggctggtgggcctacagcaagttgcactcaaagcagactcccagtctgcactcctcaacagaagagcagagacatctttgcaagggctttagaagggaggggtctcagtggtaggatgatgcccctgcaggtctgcccctcctgaggcccacacaaagcctgggttttgacctactctccaagttgggcccacttctgctgctcctgcggaggccacctggaacctctctgaaga

SEQ ID NO: 40097 - DNA, 1127 bp, Bovine  19866880963696
caccatgcactcgcagactcaggtccttcaacaccagctccaggcccggccggtagcgcacggaataatttcggaactccaccctcacccttcagtggccagcctgctggcggacggctgccctccaccacccagggggcctggtcaccaggggaggacaggttctgcatcagggggacgtctcttccccagcccagccctcttccatcttcagtctgcctctcttcccaggcccctgccatcctcacctaccagggaccctggcagggagcccctggcgcttgtgtggcccaaccttgtggttcaatgactctatccatctgacattattccccacagaactttgccctcctctactcccctcatgcccaagatgcctaagtagccccttccacatgcccccactccccctttcatcattctttattactgagtggctactccatgacaggtagtggggtagccaaggtaaactagacagagtccttgtccctgtgaggctcacatcctaatctaaggaggcatacaattaacaaataggtaagtctatataatgccagatggtgatgagtatggagaagtgcctggtgttgctgttctgtacagggtggtcagggaaggcttcctggaggaggtgatatttaaataaagacctgaaggaagtaaaggaacaagacaagtagatatccaggagaagggcatgccaggcagaggaaacagcaaggataaatacttcccagtgtgctctggagcacagtgacaaaggtgagaggtaggagacaggtagtggaagaccccaccatgtagggctttgcagggcagtttaaggactgtttttttgttttgttttttttaccttgagtaagatgtagggccatgcacagaagaataatgtgatttggtatgtttttaagggatctctctgctgctatttggggagggagagggtaggatgttttgaaatgggggagtcagagtgtcagcaatcaagaaacaaagcagccagtacagataatctgctctcttgctgctgctgctaagttgcctctgtcgtgtccaactctgtgcaaccccatagacggcagcccaccaggctcctctgtccctgggattctccaggcaagaat

SEQ ID NO: 40098 - DNA, 1965 bp, Bovine  19866880977822
cttgccaggatgctctctgaaagggaggagagcttgggtcttcaggtggaaggtgggggacaaaaccctcgattcctcccctgactgggctacttgtctccttacccccagcctagatatccaggtgccaaagggggcactagtggctgtggtggggcctgtgggttgtgggaagtcctccctgttatctgccctgctgggagacatggagaagctggaaggcaaggtgtatatgaaggtgagaggggcagggattactgggaagggaagcttggtcaggccttgggcaaaccctgaggtacttctcctttggccagggttccgtggcctacgtgccccagcaggcatggatccagaactgcactcttcaggaaaacgtgctatttggtcaagccctagaccccaagcggtaccacaaggctctggaggcctgtgccctgctagctgatctggaggttctgcctggtggggaccagacagagattggagagaaggtacagtctcttctctcactctctgggggagttagcacatacagctgccaacctcaatccagctaagatccaaatatgcattcattcattcacatattcatctatgaatgatgttatgcctaactctgtgcaaggcactggtagagcagatctactactgggggaagctgacttgtaaacaggtaggggctgtagaatgtcctggagcccaggactaaaggcctgttcaaggtactgggaatgagtaaagaggtggtctgcataaggaaaagcatcacttttgagctgaatcttaacaggtaaggaagaagctcttatcattcatcagattttatgacatacctactatatgccaggcaatattatatattagtaaatgtgtgtgcgtgctgagtcacttcagtcgtgtacagctccttgtgacctcatggactgatttcctccaggctcctctgtccatgagattctctaggtaagaatgctggagtgtgttgccatgcccttttccaggggatcttcctgaccgaggaatcaaacccacatctcttatgtctcctgcattgcaggtgggttctctaccactagcaccacacgggcagcccatacattagtaaatacaccagactaaaatctctgccctcatatagcttacattctagtggagaaagagatgttagcaagataaatcagtaaaatatataatattaggtgaatgctaagaggaaaggatgtacaaggttgtattatcagtatgctttgtgaaagcctcactgagaattggagacttgaacaaaggagtggtctgtatctgggaacatgaagccctgtctgggacatctgaggcagagagagcagtaagtgcaaaggctctgaggcaggagtgtgattggggcatttaaggaccagcgagaagaacagtgtggctggaatgaaatgagcagggatgaggaggaggaaatgaagtcagtgaggtgtccaggaagcagacatagggccttaagtctaccttaaggtctacagcttttaccaagggtgatggaaaacctctaagggttcagttcacttcagttctgtcactcagtcgtgtccaactctttgcgaccccatgacagcatgccaggcttccctgtccatcaccaactcccagagcttgttcaaatgcatgtccatcaactgagtgatgccatccaaccatctcatcctctgttgtccccttctcctcctgctttcaatctttccccagcatcagggtcttttccaatgagtccgttcttcacatcaggcggccaaaatattggagcttcagcttcaacatcagtccttctaatgaatattcaggactgattttctttaggatggactggtttgatctccttgcagtccaagggactctcaagagtcttctccaacaccacagttcaaagcatcaattcttcggagctcagttttctttatagtccagttctcacat

SEQ ID NO: 40099 - DNA, 1287 bp, Bovine  19866880981874
ttattgattatgctaaagcctttaactgtgtggatcacaacaaactgtggaaaattcttaaagagatgggaataccagatcaccttacttgtctcttgagaaacctgtatgcaggacaagaagcaacagaactgatcatggaacaatggactggttccaaattgagaaaagagtatgttaagactgtatattgtcaccctgcttaatttaatttatatgcagagtacatcatgcaaaatgctgggctacatgactcacaagctggaatcaagattaccgggagaaataccaacagcctcagatatgcatgtgataccactctaatggcagaaagtgaagagggactaaagagcctcttgttgaagctgaaagaggagaatgagaaggctggcttaaaaatcaacattcaaaaaatgaagatcatggcatccagttccatcacttcatggcagatagatggggaaaaaatggaaatagtgggcagattttattttcttgggctccaaaatcactgtagatagtaactgcagccatgaaattaaaagatgcttgttctttggaagaaaagctatgacaaacctagacagcatattaaaaagcagagacatcactttgctgacaaaggtccatataatcaaagctatggtttttccagtagtcatatacagaggtgagagctggaccctagataaggctgagtgctgaagaattgatactttggaatcctggtgctggagaacactcttgagtcctttggacagcaaggagaccaaaccagttaatcctaaaggaaatcaaccctgaatagtcactggaaggactggtggtgaagctgaagctccaatactttggccacctgatgtgaagagccaactttctggaaaagaccctgattctgggaaagactgagggcaggaagagaagggggcgacagaggatgagatggttggatggcatcactgactcaatggacatgaatttgagcaaattcttggagatagtgaaggacagggaagccttatgtgctgcagtcagtggggttgcaaaaagtcccacacgatttagtgattgaaccacaagatgggcgtgggagggcaggagagggctggcctggtgtcatttgatgctagatcctctagtgcagcggagtgctattcctgacccacccactccaggctgttacctgagattctccccaccctcggagcactggaagtccaggcctgcgggctgggagctcacaaatgtgtgcaggtgagacagctccaaagcttgccacatgtcttc

SEQ ID NO: 40100 - DNA, 1934 bp, Bovine  19866881001330
ctggctcagagatctagcggcaccttttccattgcttttcctctcttccaggtggggaacttgggacttctcttcatgttgttgtttttcatctttgcagctctgggcgtggagctctttggagatctgggtgagttggggtagggagggcagaggagccagggctggagactcagggactcctgggctaactaagcctctctcccttccctcctcctcagagtgtgatgagacgcacccctgcgagggcctgggccggcatgccacctttcggaactttggcatggccttcttgaccctcttccgagtctccacaggtgacaactggaatggcatcatgaaggtgagagccccccacagtgaggcccctcccagggctggctctggcctcaaggagacggccccacttcttggctcaggtggcactcgatgtgaataaaagcatgtaaccttccaccctccatgctggaacactccgggactccctctccccaagacattctctaactcacacctcccaggacagtggctcatgctcttttgcccctcggacaccatcacgccctcctcctgcccttccttgttcccctgcaaagctctgtgacactggagacctgacttcctgtgaaagctctgcccactgccctcccaacctcactcctctaacctgcctccccaggacaccctccgggactgtgaccaggagtccacctgctacaacacggtcatctcccccatctacttcgtttccttcgtgctgacagcccagtttgtgctggtcaacgtggtcattgccgtgctgatgaagcatctggaggagagcaacaaggaggccaaggaggaggccgagctggaggctgaactggagctagagatgaagacgctcagcccacaagccccctcaccactgggcagccccttcctctggcctggggtcgagggccccgacagccctggcagccccaaacctggggccccacatgccacaccccacactggagcagcctcccgcttctccctggagcaccccatggtgagcagagacccccgctccgcctctagggaatgtggaacagagacgggtggtgtgggtgctcagttggtgggtggcgcacagggagcaggcagcaagcagaccctagggctcctcctgaatcacctgaccctcctgcctcgatgtggagaggtaagcaggcccttggctgtccccagagatggctgcccacacttgcagcgtggggccaccccagcaagccactggcacacttgctggctcatctgtcccggtgcctccagcttggctgggacttcccttcctggcttttagggtcaaggttattttctgtttcctacctgtttctctcttacccttgccctgattttgccaaacgtctttcctcccccaccctcaacctgcctgatgccatctctcaatccttcttcctgatcttttctttctttccccttctctccctctgggctcccctgttttccatctcctatctctccttcctcctcccacacctctctcttgcccaccttccccactgccccctttctctctctctctattgttattgttatgtgtgtgtgcgcatatgtgtacttatatgtgacttcctctttttctctgtctcttctcaatccctgccacgacacttcccatcactgctcctctgaccctcactcccctgactctttggctccccttatgggctggtcctccccaggacagacagctgtttgacaccatatccctgctgatccagggctccctggatggggagctgaagctgatggacgagctggcaggcccagggggccagccctctgccttccctcctgcccgcagcccaggcggctccgacccacaggttactgtgtccctgtgctgtgccccttccccgactgtgctgggctgtgccatgctgtgc

SEQ ID NO: 40101 - DNA, 1182 bp, Bovine  19866881007950
agaagcactgggtgaccgctggcagactcggggccagtactactgacatcctccctgatcacaccctgctcccccagcgtccccttctactatttatcataagttatgccccgccagaccacaggggacgctgcctttggctggcaccagcaggctcgggcacacacacctttcaagtgcacgcacgtgctatgtggccatggcctcctccctgagggaaggctggggccgtggcccgtgcattgctgagcactgcagccctgtgccctggacacacatgagcgcgtgggggtccaactgctgtggactgtgcttgcgcacccaaatagtgcacggccatgcgtgtcccagcctctaagtgccaaaaccaagccagaggccttctgccagagccaggaggaagaggcccccaatgcggggacccttcctgtattcacactggacccatcatgagccataggcactggattgaccctgacctcgagatgaaaactgcctacaaggagcagcccacagacccccagtgcaactctcagcacccctggcagagagtggggagcctgcctgaggtcgctcaaggaggtgttcataggacctggtgtgctcagaccaagagcggaatgaactagaaaaaaggtccccaggggggctttctttcacgaattgctgggaaaacctctgaactcagccatggccattccgcgcactagtaggaaatgcagcctgaggaaacagagatggacatgctgctaggcagccaggacatgctgtgctgggaccactctgggagcataatggaattctcaacagagtggggaccggtcctgggccaaggagatgatggacggatacagagcagataccacttctcacccacatcaccatcctgaccttgaaggcctggagggatctccacgcgatcacagagggagcgacacctgaatgtacaacaggaaggaagccccatcatgccccgtcggccagaccccactctgccctcactgaccatgggttggagacctagaagtggagctcttggctctctttggcttttggagccagtttagctttgccttctcacctgtggcccattctaagaagttgagctatttccagaaaaaccttctcctgaccccgggctgttggcaggtccccttctcaccccctcccccctttcatggt

SEQ ID NO: 40102 - DNA, 1493 bp, Bovine  19866881043775
ctcctgctgcagtgcaggacaccaaacgtgccctctcctcccacatccttcccccaccacagcgagcctggccctgtgccccaagccctgccctcctgaccagcttcctcactcactgatactggcttccatcttgagaagccacagctcctttgccatctccacccacctcagcttgagaatgtctttccctgccccgtgtgtgtccaggtcccacatcaccagtttacatacgctcagttcagtgggactgcagccacctttcctaggggcttcccagtgcagggtgccctcccccaacatgggtacagaatagagcctgttgcctcctccccactctgccctccctcttgcaggtgtctcttctcagatggagacagacatccccagttctcactgggcacctcccaagagatcagagggctggctggatgctgggcacagaaggctggggtcccagggtatagcgctggggctctggccctaaggcatctgccatgctctgacagaggaggagagggtggtcctagggagggaggggacagggaaaactcgacccagtggtccaaagtatctgaaggccttggcttctctcctgacttcacatttgactgtttccctttcattaatattagtgaggatgacagcatttactgaatgctgagcctgtgccaagagcttttcattcattcattcaacaaatatttactgagggaattccttggtggtccagtggttaggactctgcactttcactgccaagggcatgggttcaatccctggtctgggaactaggatcctgcaagctgtgtggcatggccaaaaatttatctatctatctatatatatacatatacatatatagagagagagtctcccattgccagacattcttctgggctctaggaatacaccagtgaacaaaacaacaaaaagctctattttcgtggacatggcattcttgtaaggggagagacatagaatagcaccatataaatacatttatacagggacttctctggtggtccagtggctaagacttccaatgcagggggcccggggtttgatccctggtcagggaactagatcctacgtgctgcaactaagaatttcgtgccgcaactaaagatcccgcatgccacaactaagaccctgtgcagctaaataaataaaatattttttaaaaatacacttatacatattacattatacattatatatattatacattgaagggtggactggcccttaactgaaccagttaactggtcattaactgaagaaggagccgactgagggaagatcaggagctcacttttggatctgtggcttgagaggtctatcagactcccaagagaggcatcaaggaggctggcagttagacaacctgaaagttcaaggggagcccctctaggccacagagagaaatttgggactgagtgaggtcacctggaaagcccagacaaggaaagtccccaaagtggtcttgggag

SEQ ID NO: 40103 - DNA, 753 bp, Bovine  19866881101363
ctggttgctctcttttcccctagtgctcatcacctaacatgcccatttgttacttattctgaggtctgtcttgaatactagattgcccttcacaagggcagctttgcttccatcacagatgcagtaggcacttactgtttgtgggataaacagagtgagccagggagtgagggagcagaggtcggtatgcagggcaggtatgagtgatgggagggctgagtgccaggttcttgccctcacctcagtgtgcagcctgtgggtgtatttctccatgaccaggggatctatgggttcctgagacgggatgatgctgtcaggggcaggctcgtccaaggaaagcccgtcccgacttaaagatttcaccggcttcttgtcatcctttgttttgtgcttcttgctatttaaacggtcctgcttggagagacacagagatgcccagccttcagtagctcccgagagaggtccaggaccttttcaagagcagctctgaggggagcaggggcatcatgctggagtgactgcccactttccgcagcccctcctatcccttccccagccccaaccccaggcccagaacacatgctacatgcctctttcccaggtgacagcctgggtccttttttatcttctttgtctctgattccaaactgtttcttttcctgggatgcccctttccggtcctcctttcccactttcccagaagttaccttcacttctgtgacaggaggtgatttttcgatctaagggaagtga

SEQ ID NO: 40104 - DNA, 1215 bp, Bovine  19866881164843
cgctgagtgctggggcgggggtgctttgccccatccccacttatcagagagggtttcttcagagtggggaagttttcagtggacataattctaatggaggaagcacatggaggatgtgaggaggggtgttcctcacgtagggcaatgcgccagctgccagggccatggatgggcatggccagatgctttctagctgagctgcaccatgagtcagaggcacagggctgggttgagcaagggggttcccagttgccagggaagctggggcaggaagagagggagaaggaagcaaggcagaacagcggctggcactctttcagacgacagggttctgtggctgctggctgaggaagccatctgggggccctgttgaaagagtgaccccaggggatgctaccccaactctgctgggtctggagtttgagtgcataaggagcagactgggtctccggtggtcctcactgaggttggtccagggggtcctctaattcaattcaaggcagctacttgggaagtctcaggtgtgttcttaacatccaagcttacccttgtccaccttgccttcctgtggatccatggggagacctcaaaggcctcgaagcttttgcacagctgcattccctcacctccattgagtgattccacattgttgtcggacactatgcaaggtccccggggcatctatggggagcaagtcgagatccctggccttctgagactgtatctcaggtggggatggaatgaggagtcaagacacgatgcttccagcacatgggagaccagtgctctggaggtgaacgctggccctgggtgcctggagtaggggtggggtaggagccaggcttgaggaaggcagaagtgacccagggcatccagggtctgctccaggggcccactctctgctctctggatggacatttctaaggaaagctgccagaacagagcagttgaagggaggaagggcggggggagaggctggtggtttgaggttggtcctggctggaggaggaacagagatggagaaaacctcagccccagggaccactgtgcggctacacctgagatctgctgtgggcgatctgacaccgggatgggaggccatccagacctcactcagggcccacggcccgttggctctctgcagaacataggcaaggggcaccatcccacgaggctgcagcaggaaccaacctaggcagcagacagacccacaga

SEQ ID NO: 40105 - DNA, 1500 bp, Bovine  19866881209317
acctgcccccctacccctacagttcacccattagcaaggaattttgctctttaatgaggttgagtggggagcgcaatgctttcccaagcatcaactctttaatggtggggtatcaggagttgccagggaagggttttgaaagccagggtccctcctgggcttcccaaacatcaggaggaatgaatgggcagactggggccagagggtctcaccaggaggtggccgtgcagaatgcagggtccagtatggatggcttggctaccaaggtcttatggaggatgttgatgacaggccgggccctgcatagaaaaaccagacatcagtgcctcaggcccaccccaggccaggccagggtcagggctcaggcttgtatggacctgattctgaaggtggacagaactggggctccatgcaggcaggtacggaagagagaggtccccatccaccgttgccctggctcacctcagcagcacgatgcggtctgacaggctccccaccagcaggtctgggtagaagttctcatccacgtccatctgcccactcagggagtagccaaaggtggccaagccaggcagtcccagctgctctccatggattacctgggggcagggggagacggtggggacaggctctggggaaggttctacagagtggggcccatggggaataggcaggagtgcgtgaggaaaaggaagaaggtgcctctgtccctggccatctgtacctgctggggctgtctgaggagccccctggagctgccatggtagatgtacactttgcccaagccctcgaatggggctcccacagcaatgtctgggaaagagagatagttcagggtcaccctgggtactatgggccccatggttttccagtcctatgctccaggccacagagcccagcatggcatgacctccctgtcaagcagtgctcagagcatcagggaacagagttctgtaacttaggattaaaactgggaccattaggcacccaattgcctccttttatatatgggaaattaggcccaggagagggaagtgacttaccaaagtcacatagcaagttaatgtctccagcaggtctagaccccagattcctgaccactggctatttgttttcccttattactgtgccttccttctcccctgtcaaccgcccctccagacacctggttcttctcatgacatttaagagcagggtcacaaaagcaggtgttccccatttgtgactttgccagatagttctcaaacactcatctcatccagtcctcacaagagtgctggcagtaggtaatactgtccccacttcacagatgaggaaataggctcagaaaacttaaagtcggacagctaataagtagagaagaggctgtttgagcctatgtctaacagtgggggctgggattttcatcacaacactataacttttcttgttaaattctaaccattatttccacaaaataactccaagatgttttgtcttcttaaactttctagtttgctg

SEQ ID NO: 40106 - DNA, 2069 bp, Bovine  19866881249906
ctggagcttttgggcaatgacatgggagtggcagccgtgtggatgatgagcggtggtaacaagctcctccgcagctccgggtgctctcccagagacaccactgcaggggagagagggcgagaccctgagtccactcaagggtggccaagaaccagggcctgtacctacagagagatactcacaggccaagcgcttcttcctgtccccatcaccatccaggctgggcgagaagaaatcaggttccgactctgacttggtggcatctccctggggtgggagaacagcggggctattaggaacctgacctggcaggggttagtgggatggaccaaagtctccctgtcttcacacacacaccacatagaggccacaaggaaccagccaccacggcacgaggcatgcactggctcagaccaaaccacccaggcttggggcctaggcctcccaagggcctctgtcacctcagagaaggtgggactttctccagaacccacagcacaactttcctggctcggactggctcaagaagggctgaggagacaggggatagtccagcgggtgggtggcacaggtcagagggagctgggggcctgagtgaagtggtcacgagagcctcaattccaaaggccacttgtgccctctgatttccctccatgactgccctcccctgagcctcagacccgaggaccccagagagaaatcgaaggaccccagacagagccgttcagcccaagggatggtctcttacttctttcctccctcttcccaaagacccacctcctaccctggccccatttttacctctctccctgtctctgggacagtttttttcttcctccttagcaggtcagtaggttccccagtaattacacacttctccttaagaagttattaagaaatacttgattgctacttttgataaggacataaatattgcgtaattggcatctcaggggatcattttcattaactcagtttacatccctaacgaggcctttaattatcaagtgggatctccagggggctgctcagcatgcacagtaccatggagtcccatgggaaccctggctttgccccaaattctggtgccagtgcaggagacaacagggcacaggctcagtgtggggccagaggagaagtgtgcccctgagcacctgctggacctcctgtgtggccaaggggccagagacacagaagtcgattgaaaattctggtacattctggcaagaggcacccccaacccccacatccttcaaagacttctcctaagatgaggcaacttgcggggtctccaacaggagcttaaggcaaggaggaggagagagatgggggcgctcggtctacggcagagatcccgaccccaccgaggcccaacgactcagactcttcggggaccgcagcagaggcgccacacgtggtgcaccacacacgtgcacacagaggattctaagtcccttccttctcttgccatcccctggtctgacgggatggactgtgccctttgctggtgaacagggcagaggcaaggaggccctcccctcagtgtcctcaagggggaagggacttaaaatcaaagcaaacctcacaacaccgaggaccaccacagccaccacaggttgcacagcagctgagcgtgaacacaagcaagacacggaggcagagtggggggcacggggcaccgggggcatgctgactcatgatcgcatacctaccccctgggagtcgacaggcagctgaatacagcttaactgtccactcgcatcttcccgtttgctgatttcctacagggagaggggaggcaggggatgggcactggtcacaggcgcccggctttcaaacagcagcaatgttgaaagaggaggaagaaacggatgggtgcaaacccagcagtgggggaatgagacatggggcaagagaggagaagaaaggggacagaagggccttccagaattcaaccacaggccctggagccagaatgagtctgaagggtgagggcagaggccacagaggtgggaacagggaaaggggaaggagactgagcccccagtaatcctaataataacagctac

SEQ ID NO: 40107 - DNA, 1215 bp, Bovine  19866881302422
acgaggaataggtgctaaggtcatatctcttttacaggtgagcaactgaggcacagagaggtttagtgacttgcctaaggtcacacagctggtgtgaatcccggcatccaggtctagggcccctgctcacactcctatagcgatgtgatgccaggagactcacgggagccagggtgaatgtgagggggtgcggggccatgaagctgtggctcagaccaatctctcccctgttcactcctcagccaagtgtccgcagttccccccacagcccctggagtgcagcaagcagctggacgagcaggcgctccagcaggaacagcctgggccgtgcccccagcctgaagcgaaggagcccaagtggggagcggaggtccttgttgtcgggtgagggccgggagagccaggatgaggaggagagctcggaagaggagcgcactagcccagcgggcagtgaccgccaccacaggggctccctggagagggaagctaagagctcctttgacctaccggacacactgcaggttcccgggctgtaccgcacagccagcggccgcagctcagcctctgagcaccaggactgcaacggcaattcggccgtgggacgcctgagtcaggctgtgcggcccgatgaccccccgttggatggagacgatggtgatgacgagggcaacttggtgaggcccctgtgggcacagtgacctctcacccctgactttgagtgagggggagctgtgcctgacctggtgcaggactggacagctgcctcccagttgtttggaattcaggcagttaccatcatgctcaagggatctcaaggggtatcagccctgaagccaaggtccaaacagtccctttgtccctccgcccacccccaccaagccccagagcctcatcatgcctggggctgcagctctgcatccttgttggataagaatgacttcaggcagatgtgtatgaatctttcatggccctcccccgtgactcagaaagacccatcactcatctctccaaactgatgccctcctctgtccccctctgttgtatcgacctcatcacaagccttgatttcactctacttttacccattcacctttccccagccgtctcaccaccatctttagccctggggacggggctcagggacctgggacctcagggttagcacatgagaaggggcgggtgtctcctcatcccaggtgtgtcttgaacagacag

SEQ ID NO: 40108 - DNA, 3179 bp, Bovine  19866881489023
gatgacctccctacccccatgattttttgtattttctagtctgaagtgtttttcgttttgtttttaaataaagctttctcctctttgaacagaagactgccaggtcaggccatccctaggaactgagtccaatactcattaaaaatggagcactgatgaaataaagctacgtgttaacaatacatacacttcagtgtagcctttctctctgttcacaaggtctaggggctagggcccttagaggaggtggagaggaaggagggagatgcagaggtagcctttatacacgtctacatggctggaattatctgaaaacttcagacccaagagcttttggctggaaatactgtattcacggccaaaactcactgggtaattgccagtagttcctgttctgctgtgtagaggctgtaaaaaggtgagaaataaagcccctgatatctgacctgaagcctcctgggaaagctgccgtgaacacctccacatttatgtcatccctcagaccacgccgcctgcttctctaggggatgagaagtgcatggcactttatttccttgcccctctagcattctgttccagacaggtccccataacccatgaggtctccaagtcatgcatcttcctcactctggctgaagctgactgtgggagcacagagcagcccagggcctaccccccattttgaacgtcctaggctggtaaatgagatgaaggggtaacttgcttttttgaacaagccaatgaaatgtttttttctgcaggttagaattaacctggcacacggccttcaagttttctggtctcctctttcatttcttcaacctttattcttggtataatgtgactggttatggatgatgtttctttccccctccatcctaaatggtttgcagtaggtgtggagatggctcctttgatctgatttttctatatgcgttgggccagcctgtgctccaggactatttgttaaaggctaatcacattctgggggctggccgtttctgcccaggatgttcctgagtgtacagaggaagacttccatccttgtgatagagcaagtataaaggcaccaaggcccaaattattctgcttctccttggagctaagaaaaggtctttgctatgcttcctgatttatcaggccaatttggcatgacgtatgctttgtgaggctctagctgccccaaaccaacagaaatgcagattcattcggcatcattctcagctaaagatttgaaaagtgtaaggctgtatctcctctcctgtcttggatgtttgcctctgagctcattgagaccttgacaggtgctgacagcccaaaggagagactcagttgtataaagtaaacaggataatcaaaaaatgtggttaatagaggatgacctccatctagcgggctcagctactctggggaaatgaagctgactgctgtgaacttagaggaaagacaccgcacaaaatatctgtctctggcgccactcagtgccagacttaagcgccaccacggcagtagaatggaggaggctcagggggggaccagtgccttctgttcttctgccagagggttctgcccctgaaactgttcaacaatttgaaccccctatgattagaagtacagaaatgtttagaaggacaaagttaaagagtagggacttagtcagttaatatttaattttaataatacttattatgcttgaacagtcagcagtgcacaaagtgaatatttacacacagtgtgaacacatgctttaaatatgcagtagaggaggcggggcaaattcacaattaacaaagctaaaaaaaaatcctttttataaattacacaaaacatataaaaatatttctctgaatgcatagattaagactttaaactcacctaccagcaactgtgcagtctaattccactgccatactcagagtcagctgaccacagaggactctataagaaagatgcagtgcagggcccatcgctcactgtgacttcctcagcctccgtttctaagcccaggaaatgccctggagctactcctctgtaggccaccgcccagccagggacctccactgcttctgagaatctctaattgatctggatggctggaagaggactaaccccagtgatttagacacatgaattaatactgaatttatttgttccaagataaaactagccttaattgtatcagtaaactgtaaattttttcaaaggtataggggaaaaaaggttagtatttctagcttctgcctggttgaaacacaaaggaagtttcttctttaaagtatttcagagaaagggagtagtaagtaaccttttactctgctagacaaacactgcacggagtgagtaactcaccatcagtaattagtggtttacgattaagtcaccgaacagagtgactccacgtcacaaagttggccttgaaaacacctcaacctcagctcagcattcaggcagcagcaggaggccattatcttagcacaacactctcctccactgacatcttctgcaccttctctcgcaatcgcagtgttccaataaaattaacccagttaggaagttcagtttctttggaaactataggcacggtggggagaaagcttcttaagacagcagggatgctcttcaacagctggctccaaagccctgctctcctgtttatctaagtgtgctctttcttatttctaaagttaagctatttagttcaacaagacagtggcttttctttttaacattaatgacagtgaagggaaggaaaagaacccttaaatgcattttttacaaaaatttttacgccatgctcaggagtttaatcaggtgtttgtttccagaacaaagcttggtagactcacattgactttgttaagtaggttagtggtggttgtgggggatccctaagattaaacaacttgtttacaaaagcaacagacttcagagttgtgtaaaaatcttaataatttcaaaataatcttcatctttgatacaaaaataaagatgctaactcctttagttcagtttcccacaataacctttaaaatagcaacagattctgtctggaaaattgcttttcatttctagtggaaaatgaaagtggagaacatggaccagcaatgtttgtgctcgtctctttccggaaattaaacagaaacgcgaagacagaatgcttcagtttaaaaaaagaaaaa

SEQ ID NO: 40109 - DNA, 999 bp, Bovine  19866881506685
tggcttatttcactaagtatcatttcctccgagtctctctgtgttgttgcgaatggcagatttccatttttcatggctgattattgttccatcatgtatatttacctcattttcttaatccatccgtgtgttgatggacattaaggatgcttccattcttgactattataaataatgctgctgtgaacattggtatgaattactgtcttcattttctttggatgtgtactctggagtggaattgctggattaaatacagtggctttatttttagtgttttgaggaacttccatgcggtttttttcaggatggttgcaccagttcacatttctgccagcagtgtgccaggggttcccttttctccacatcctcgccagcatgttacttgtggtcatactgagcctttttaataatttaaagtattagaattttcaaaagaaaatggtacaaagatactatgacatatcgctacatgtaacaggattaatattgatataaagctaaatctgttgtttagacatgattgttgaatctggttgttctttatgactttagttcctctggacacagcttatgggacctcactgcttcaaataagtgtaaaacatttgacctttgaagcaaaaaacagtatttcaaatgcaacatccagttctaaatgtctcaaaaaaactcattcaatcctaaatttagtagaccttttctaccttttcttgtacattgataatttacccaatagcaatgaagggttatatggagatattttggaattttgcttaacagattttggtttgcacgtgttacaaaattaaatttagtatagagcacgtctcagaatatatctgaaggagttacagaagtacccatgggagagaattgaaaattggtcttatgttaataattcttcctcataccttagaagtcactcagtgctggcatgtgtgaaaatatccagcacgctttagggcctgttacaagatctctttaaggaaaatacag

SEQ ID NO: 40110 - DNA, 850 bp, Bovine  19866881556474
acagtgacttccccaagtccacagcaagtcatgagggaaaagattggaactggatcccttccaggtatatgtatacaccagcggacatcagaggtccccagagtcaaggtggaggactaaagcaagagggcagcctagaggctggatgatctttctcttcctcagcttcaaatgagtgaagtgaaggagcaaaggccaatgagaacaggaaggaatgtccttcatcctttgggggtcttcatccctgcctctcctcccactcctgccccacacgccaccctttccttgtgcctgatgtttgaggctggcctggtcctgggctctgggcttccaggctcttcctctgggtccccggagccccctcccccaagcggggccccagctccagacgtggcagggtgagcaggagtgaggtttctccactccctcccaagtgctgtgctggcggctcccgaaataaaaatcaaatgtgggcttggcagagacagcggggtgggagaagcagcagccgacggcgctgggccttcattctttccattgtaacttcacatcctaacctctggcattttaattattctcctgcccgcttgctctccctgggccagagggtgagctcaccctgtcctctagcctgggagggggcggccactgcctggacccccaaacccccaggctgctcccaggaagctgggtggagccaggcttgcggctccctcctgcttctacagtccctgaggaggcggccagcctggcatctaaggttccatgtgtgaatcattaagtcttcacactcgctgctccatttaatggggccactgtcttaagctgaggcactgcggctcaccacacg

SEQ ID NO: 40111 - DNA, 814 bp, Bovine  19866881653319
tgcatggggtcaaggacaaggagtggaaatgagagcagagatttcagaggagcctggccaaagcagatggaagaccgtgttctgtgtgagcaagggagggctgagagagagtgtggtatgcgctgcgaggggcacagagaatccccagctaggggagcagggggcctctgggtcagtggggcctgattccaggcccagaggagcagggtgtgtggctcctcatcccaagctaccctaagggcattcctcaggcaagaggcagcagaggggcagtcatacctgatgacaacaatgacgccatcaaagatgttgtaggggttcttaatgtagccaaagggaccatatactagcagcttcagcagcatctccagggcaaagaggctggtgaagacgatgttgctgatttccagggcattggtgagctcctcaggctagaagacagagtggaccatgaagtagcagaggcttgtccctgagcccctcatcccagtcctcaaaaacacctggccttcctacacatctgggagcaggaacagcaagccagggggtggggtggaggttgggagagggtggtaggggtgctgaatgctcaggctaatggggaggacgctccccagaagcatccttaagaaaatgcactcaggggtggccagtgcacaaagcccccagcccctggttcttttcagctgagtctcagatcctggggccacaggctcgctggaggcctatgctgtgggttccacccacttcctactgctggtgggcaccagagggtgactgccaaggcctcatacacacagccacacataagtca

SEQ ID NO: 40112 - DNA, 1367 bp, Bovine  19866881655241
tggaacaaggtgctctacaacggaatggcctccacgtcatcctgggctgccctttacttcatcgccctcatgaccttcggcaactatgtgctcttcaacctgctcgttgccattctggtggagggcttccaaacggaggtaaccccctgcctgcagcagtccacttccaggaggaattggctgcattgctggagtggtggtgtcctgggaggttctgcccgaagtgcccttcagacaaggctgggggattaggactgggaggttctgagtttcgggcagccccttggcactcgagagacagggtggttgttgggggaagtatccctggatccaaggtgagctactgagtgggcttccccaacaaagtcggctagactctaccccagggagctggacaagatgagtgttggcacacggacagctggatccctgagcacaggtgtgcctggggacatctggaaggaacccatctgagttgaggggtgggggaagtttgcatgcaaatcacctgggctttggctgagctggtgaagatggcaccagcacccgggcagaactgagctgccctggctgagaaatgagcccaattagctgcgggcacagcagagatgagcgtcctatttccagcccaggctccatcactttcgtcataggcagcatcgtcaattaatattgatttacattgatcccaccctcgccctgccaggacgcagtccctgcctgaagggctgcgtaccattctgctccctcagctcagccgctcttcctaccggagccccaggcccagcccagcttcctagcacctagcacagggcaggtcgactcaacctagaaatgctccaggttgggtgtggagaagctcttggtccatttctctccgggtgacccggatggaagctcccgctgcggcctggtctataaatatccagcacacggtggaaaaacaaaagtctattttctgactccttcccaggcttgcgagggagggctgttccctgtgggctgggctggatggtaggtgcgggtctgcctctcccacgccggcctcctcccattgaagttccatagttaaccattgttgcatttcctccccacctttggtgatgcctgggcctcttgatgggagggagggacattggtactctcccttggatgggacctttattaaccctctgtggcctaaagggttaaggaggtcagtgtgttccatgagtcaagagactcatggagacccaccgcttggccactgtttttggcctgtgggttggaggagctgagtggggacagtggtccttcagcctcttccaaaccacagctcctgacagctaagattccccgcagaaaaattcctgtggaactctgtggaa

SEQ ID NO: 40113 - DNA, 1436 bp, Bovine  19866881833133
ggcccgcacctggcccttctctccatgctgcccccagccctcttcctgtcccttctcaccttagctcccgcttgctctggtccctgggcagtgctcctcaggccctcttccccaccctcctgtccatccccacctgccttcccccgaatcagggcctctctccactcgcctcctttttttctagggtgaccgtggtgagcctggtccccccggccctgctggcttcgctggcccccctgtgagtaccaagatcctgtttatcctccatccccgactaggacctggggccttgggtgattggatgaggacagaggcgttggccgggtttagaggcaggtggaggggagattgcctcccattgaaagcgtcttcttgcctggagttccggtgccctctaggctgacttcctgggtgagcacagacctctcctccactcaccatgctccgtcctcccccagggtgctgatggccaacctggtgctaaaggcgaacctggtgatgctggtgctaaaggtgacgctggtccccccggccctgctgggcccgctggaccccccggccccattgtgagtatctcactgtttaggcccaagctgccagcaggctggacccgggatcagcccagccttgatgcctctgtgttctcctccagggtaacgttggtgctcccggacccaaaggtgctcgtggcagcgctggtccccctgtgagtacccactctgcctctccactgaagcttcccccaggcagcattcggaggtggggcagctgggccaggtgaggggctgttctccctctgatcgcttctttgtcctcttctccagggtgctactggtttcccaggtgctgctggccgagtcggtccccccggcccctctgtaagtgtccgtgtggagactccactggtctgggaaggtgtgggacataggctgtcaagagtgtggtgggcctgactgaggcctcaggaatgccccagaatctgctggactctgacagtcgcaattctccccatccagggaaatgctggaccccctggccctcctggccctgctggcaaagaaggcagcaaaggcccccgcggtgagactggccccgctgggcgtcccggtgaagtcggtccccctggtccccctggccccgctggtgagaaaggagcccctggtgctgacggacctgctgtaagtgccccctccagaggggtccagagtcggggggcgtcgtccctggccactgggagtcatctcacccccgtctgcccccaccacagggagctcctggcactcctggacctcaaggtattgctggacagcgtggtgtggtcggcctgcctggtcagagaggagaaagaggcttccctggtcttcctggcccctctgtgagtgccccctcaccttggggcaggaccattgcaggacttggagggtgcaggatggggg

SEQ ID NO: 40114 - DNA, 607 bp, Bovine  19866881839068
agaccgctaacctctcagggactcacagcgcggcggaggagagtagagccttccagccggtggcttgcggacattggttcccagatgcgccaatgccggggctctccagccggacccacagaggtggccgcgcccggaacggcctctccagcggccgcagcaaagcagagggacaaatcccaccgccggccccgcccgtccaatccatcttgctcgggaagcgacgcttctctggaggagcaagcgaaggggaggggaaatccaagcttttggggtctcccgacaggtgtttgggggagagggcggagccggctcaggaaggatgagggagggggcggtgctgcccctttaagaggcggcggccgagccgggaccttttctctttccccggaaggaaagcttagtcctggctgggcgcgcaaggtggggaggtgcggggctgggcgtggggaggcggggcgcgtgcggggggacacccctccttcctgccttccttgcggtggactggtctgcctgctcagatccgccaccgaacccggatcggaggcgactgtgtggccaagtgggcgcggccggtgcaagctgaggggcagggtgccccgggcag

SEQ ID NO: 40115 - DNA, 1180 bp, Bovine  19866881921818
tgttgctacctctgctgacatccaaatgttacaaggggatcgtggttagacttcagaagaacttcccaatcccaaacaagtgggggattccaggtggccattagaaagggtagcccctctgtgagttgggcattttgaggagacggcttctaaagggtctgggaactgagactgaaatgcagagaagacacagcttgggacatccctgaaactgatcaccagttagggacctgggagttaggcgaagaatgagcgtgagcagaggggcggggaagcgaggtgggcagagatcacattcttccgcaagccatagctcctttaagcagccacatcatctggcccctagccgagcacagacttggctggagttgtgtgcacacacgcgtgggtgggcgcatgcagtgtgtgtctgcatgtgtgttcatacgtgagtgcacaccacccagcctctcgtatggatgcagcagccccctctcagcacccctggcttccttatcaccaggccagcctttagggggctgcctccaggatcccctcaccccagtggccctgttagcacctcctccctcccttgttagcgcctcacagcccctcttcctcctcagcccctgctgtccccagagagaggccggtggcttgcagcccagttctcctcttccgactctgcttcagctgctattttctgaagctttgttctgctttctagccctggaacccctgccctcttcatcctccttcatctacgtggaaaggtcctttcctgaataagccagcctggggtgaggggtgaaagttggtgcccctacaatctagcacacattcctcttccaggctgaggcacaaagcaagctcctcaatcagcctctcctgcctagaggataggaggtggcaagtctgggagggaacctgttttaggtgccaaagctgggtcctggtgccagctgtgccaccctcacctggacacacaaccaccctctttgcagctgtgggatagggagagagttggtaggggagagggatggggtagaagtgtcttctacccgcttctccaggatggctgtgcccagcctcagcctgggctgccgagtgggacagggtggtcctgtgcctggagccaggctgtcagcctgccaggactgcaggtttcctctcctgaagggccccttcctggccagctttg

SEQ ID NO: 40116 - DNA, 1311 bp, Bovine  19866880225533
ctacatggattatcctctacacctttctttacatgttctggcatcttgaccacatagctgttagatttctctggaaacagtgtcagactttattttttgggctccaaaatcattgcagatggtgattgcagccatgaaattaaaagacgtttattccttggcaggaaagttatgaccaagctagaaagcatattcaaaagcagagatattactttgccaacaaaggtccgtctagtcagggctatggtttttccagtggtcatgtatggatgtgagagttggactgtgaagaaagctgaacgccaaagaattgatgcttttgaactgtcgtgttggaaaagactgttgtgagtcccttggcctgcaaggagatccaaccagtccatcctaagggagatcagtcctgggtgttcattggaaggactgatgctgaagctgaaattctaatactttggccacctcatgcgaagagttgactcattggaaaagaccctgatgctgggagggattgggggcaggaggagaaggggacgacagaggatgagagggctggatggcatcaccgactcaatggacatgagtttgggtaaactccaggagttggtggtggacagggaggcctggcatgctgtgattcatgggattgcaaagaatcggacacgactgagcgactgaactgaactgaagctgaagagatgtctctggagcatcctctccgtattccctcctatctccccacagggaagcagcagcctggtggataccacccaggctggactcagaggcaaaatgagctactcagaagctgggtaggaaaactggggataaagagagaagatagctgccttggagacttggctcacccagtccttgtgccttgccctagatgttcagccgacactgcctccactccacagatctctctatggttaaggaacctgggatgtctccagcaacaactccagcccaaatcatcaaatatacctatgacttcacaatgcaggaaatgggccaggccaaatggcttctctcaaacttcgtaaggcgtgacttgcactgaaagatgagaccccattccccaggtgatgacatggtttgggcgtgtccttttctgaactgattcactctttgatgaattattcttggcgggatgattcttccatattgaaatcatcattcaaccagagtctccaaactacatgagccttccttgctggcagtagaatccatccccagacacctggcttggtttgaaagagcactggattggaatgcagaggcctggcttagactctaagccttgattgtaga

SEQ ID NO: 40117 - DNA, 3656 bp, Bovine  19866880345852
tgaggatgatgagaacaaagaaaaaacgaaccagatgatatacctgtttgggatcaagaattcctgaaagttgaccaagggacactctttgaacttctatcggcagcaaactacttagacatcaaaggttttatttgatgttacccgcaagactgttgctaatatgatcaagggcaaaactcctgaggagattcgaaagacattcaatatcaaaaatgattttactgaagaagaggaagcccaggtacgcaaagagaaccagtggtgtgaggagaagtgaaatttcgtgtctaacgctgtaacactgtaagggttattccaaatactagttgcactgctttgtttataattgttaatattagaaaaagagtcaacaaatgcagcagcaagtcaattgtatcagcagaatgttgtcctcattgcatgtgtagtttcagtacagttcccaaacttaaggcccagtttcttctagtgtgattgaaagtttcttttctttgctctgaataaaattgaactgtgggttccctatagaaagtggcattttgggctttccctttttgtaaagcaatttctgcctagtttattgtccagttaattttagttcagtgacttttaaagttggcgttgtaaataaagcaacttgcaaaaaaccttctgaaatagaatttaacaacgtattatctttattcaactggaaactggataaaggctacttgaggtaaatgctttgagtggggttatcagagtgtctttaatcttcctggaggagtaagtacccctggtattcattagcctgtatgtagcagggcttccttaattgggtctgagggcttatttttgcatttttaaccctctcagctttgaaggctcagttactactcagttagtggtttgggaggagatataataattagtttgctagcttttcagttaaaaaagatagcctatatggtgtgtcatctttttataatcagtgatcccatgtgggggaaactattcatactacttgcatgtagaaaataatttaacctttaatgttaaaatgtgtggcataacccagaaagcatccatcatgaatgcaagatactttcaataaagttacctagtaggtagtaaatggtttgctttttgtgtatttaaatgtttctctttacttaatattgaaagagttaaatttgtgtgtggttgtttagttggaaaagacttggaggcagttcttgtcctagttctctggaggctgcttacataactaaggttctgatagacttctgcctcttctaattgtcattgataccattcaggggaaccactgggctcagttttttactggtgtactccaaactgctctgctctggtttccagcctctcacctacagttgaattaagtttttcttggtagtttgagatagctcacaaatttttaattttctttcttccttgtgctccctgttcttcttactttagaattatctgtattcacatgtagttttaatgtgttcccttcgtgtagctcttgtggctcagatcattactaaacagtagtttgcctttatttcatctcttatttgtctcatatctacctctacaatagtgtgtgtgtgctcagtcatatctgactctttgtgactctatatagcctgccaggctcctccgtccatgggattctccaggcaagaatactgcagtggggtgccatttccttctccagaggaataattgacacaccaaagacaatacctgaccaaaaagcctaaaatatttactctatggcccttcacagaaaaagaatgccaaccctttgattacttctggatccctgattccctttactcaggaattaagctatttttccatttgtgctggttttagtggggaaggtagcagcattcagtctagctagagtatctcatttctatttcccagaagagaaaggtctttctgaatatgtaagattgagtggacagacaatatgattgttcccttcctgactttctgtagaccttgaccacagtctttaaatcatgattaatagagatctaacagctcatctaagaaaacaggcaatttacggacactattaagaggcccttcagttgaagaggcccttcaactggctgcagcacttccctaaccttttccctctttctgctgtatactcattatttcttgaatgtgtctaccagttttccagcctctcatttttatccaaagaaagtgaggggccctttcccacagcataacagcaaacctgtcaacctgtctgccttctcatttccgagttattctgagcaaatactgtagtatgaagtcaagctgtgaggctggagtcctgcctcttaggacctatatggttttggataagttgaaaacagtagctccctgcagtgtaatgctgttggtgagttgttggttaaggatatatgccctctaagaattcttaacctcttttgaagtgctattattagcttgccttcataagtccatctttaatatacaaaatagatattacttagttttgatatttttccaaagattcacagagggtatcccttataaaagttagagatcccagagtggcattatactgtgatttgtttattctacagttgttcctacatacctgctgctggaattaagcaaaatctatattgtaacttgttggaccgcatgatgtcatgctaattcttagtctggaactagctggagaaggatggtggcagtgagtcactgggcatgtgactcagggcatatgaagttttcttggtagtttgagatagctcacaaatttaattttctcctccccttttttttctctaattcatggggaccactaggcatagactcattcttaccccttggacagaatttgccctttccagttaactccattctatacaatcccatactattcttcaacatctctttggacctaggctgggcttttattagtgggactgtccccatctctgttgtacctctccctgctgtactcgttgaatatattcagttatggctcctctgagacccccactgcccattgtggacaagcagaccaatatagagagcctgaggtccatggtaatttgaggtctgaaataggtgattagaatagttgggattggggaggtgacacaacctaggaacctgttctgctttggtgactggctctgtttcaagaacccatgtgtgtgtgagcgtgctcagttttgtctgagtctttgtgaccccatagactgtagccctccaggctcctctgtccaaagggttctctaggcatttgccgtgccctcaggggataggcatcaaaccccagtatcctgcataggcaggcgggttctttaccacttgcaccacctgggaagcccctatggtgaactcttaaagctctctggagacttgacagttacactaaaacagcttttctaacctgacagaaaaggcagtttagcttttttaatataatgaattagtttttggtttcacatcttataggcctggcaagtctgtgttacccttgcccactcttttgtgcagttttttccccctagaattgcatgcaggaactaatagcctttcttttttagaacagtgtagagaaccattctggccttctttagccaggcttactaaacactgaataaggctgggcagcatag

SEQ ID NO: 40118 - DNA, 3237 bp, Bovine  19866880380947
attctttaccagctgagctaccagtgaagacattattttttagttgactaaactgtgtcctcatactttctccaagaataatttatgtacgtattctctgagttctattaatagcatgttcagtagagattttcatgcagtctttatatttgaactaattttttcagggtatacaatttttgggtcatatctttcctcaaggactttggaagcattaattatttaactgttttgtttttcattgcttagccatttatcactgcttattatttagcttttttccccctctttcttagtgacttaagagttttcaactagctgccccaaagattctttatcttttgaagtcctgtgatattatgagattatctccatgaaattaaaagatgcttactccttggaagaaaagctttgacaaatctagagagcatatttgaacttttgaactgtggtgttggagaagactcttgagagtttcttggactgcaaggagatcaaaccatatcaaatcctaaaagaaatcagtcctgaattttctttggaaggactgatgctgaagctgaagctccaatactttggccacctgatgtgaagaactgactcatgggaaaagaccctgatgctgggaaagattgaaggcagaaagagaagggaatgacagaggatgagatggttgtatggcatcaccgacttcatgcgcatgagtttgagcatgctctaggagttggtgacagacagcaaagcctggtgtgctgcaatccatggggtcatagagagttggacacaactgagcaactgaaataaactgaattgaaagttataggtttttaaacttataatggaaagtctaaatttttaatgcatcccactaataggtactcactaacaatgtgttcctttacatgcttgtatgaggctaagttctgttatgatctccattttatcaggtatgaagatttcaaggtgtagatagattacatttttgcccaagtacacacagctggtaagtagtagacgtaagaattgaagctaggtaatcaagctctagaattgctcccttgaccattctgtcctactgtgtattttttcacatacagtgatcatgcattttatttctcccaaacctgtgtgtgctgtgcttagttgtgtccctttgtgacccatggtctgtagcccacgaggctcccctgtccatgggggttctccaggcaagaatactgcagtaggtagcctatcccttctcgaggggatcttcccaactcaggaattgaaccagggtctcctgcattgcaggcagagtctttaccagcagagctaccagggttccaaaccctatggctcctagaaaatcttctgaactttgcagaaattacttcaaaagggaaaaagaaaggaatccacagaggaaaaagattcagcttcaacatattccttggccattttcatcataagttatacctagaatatgatgcgttctcctgaaatgtgaaactgtgattctagaggagcttcccaggtggcgctagtgataaagaacctccttgccagtgcaggagacctaagagatgtgggttcaatcccagagttgggaagatcccctggaggaggacatggcaacccactccagtattcttacttggagaatcccatggacggaggagcctggcagactaaggttcataggatcacacagagtcgtacatgactaaagtgacttagcatgcacacacatgatcctagagggctataaactgtgaaagctggtgggaactgccaacacagatgccagctccccaggaatccaggcactaaagtcaaggtttatattaagtgatgaatgtcaaccagtgttctgacctaagcatgggcttttgtgaaattcatactccagtgtcttaaaatgcttgatgcatgaaatgcatagttctcttacaattatttttttaaacacatggaccaaagacttaaatacttcctccattttctatgatatctgtaaaaagagggattgaggcagtttgatgtggtgaaattttctcaccattttttctacacctcccctcccctaattctttgtcctagacatagcagagcattatggagggatatgttgggaagcagagggtgaatttcttgacttaatattgaagttggcttgttgcaaggtggaatgcctgtttgtgaactaatctcccatatgtcaaaaagaccaattgtttgttgagagaaagagatggccagagatgtgaaatgaggtcggattccctagagtgcaatggttcacatgccaaaggaaacagatgataaaggatgtaaagatacaagtaacttccttaatgaaagaaatcttaaatcatctaagtgtacattagagagcatttctggctagggtgggtcagcaggtcacaaagtttgttgcttttgctccccaggattctccttctcctgggagctttctgagattacccctggcccacagcactgagctccagggagagaagtgaccactgttttgctgacactctgttcctgaggcaggattagggctgttcccaagaaacactgtgcagagttgaaatgaactttgtaagcagtaggattttaaagaggaagtcaattgagaactcagagcatggttctcaagatggaacttcagcttccctcagcctgcagccaactgcaggtctccttctccctcacccttctcctgaagtgggcactgccttacccttcctcctcctcacaccctgaaagcaccagcaggagtgcttgtcaggatgtccgccctgctcaagggttagactgaatagagcaaggagggttgagatcctgaagttgttctctcctgcctccctctccagaccactccttccctagaggattgactctttatgtgaaaatccattctgaggagacctgccaagacttcatataaaacagatgacaatattacaagaaatacacaaagagcaagagtctttatatatataaatacatatatgtatggggagagtgtatttgtatttttcatgtgagtcagagatgttagaattccctgtcagtttagaatttttcttcccaagactgtagatttggctcccacattaacttcatatgttactctagcaaatctcttcatctctcagaattgaagtgggctcaataagatgtgggagttctatcagtccctctagaagtttcccctgctgggcctcctttccgaaattacagagaaag

SEQ ID NO: 40119 - DNA, 2574 bp, Bovine  19866880408366
cacagcagtgaagacccagcacagccaaaagtaaataaataaatactttaaaaaagaaagaaaatgtgaaatataatatgaccgacagaactggaaacaattgccatttaaaagataatgcattactcatagttcccaagaggagagggcatggatgccacaggggatcacccggagaaacggtgggtgggcgtgggtgggaggggggtggtcatgaggtggaaggagggggaggaccctgcagcaaaagcctttgttatggtttccccggaaggaatgggtgaggcggggtcagcaggcctagaatgggctattttgggtgatttcctcaggctctggggtcaaggggttgtcccatttgtctggaacctggttctgggtaccagttgccctgagtttgagcctgatgcaggaggaggctggagtgtgggctccgtatttgaaaagcacactcgtgggcaagactctctcttgttgttcagtcgctcagtcgtggccaactctttgcgaccccacggactgcagctcgtcaggcttccctgtccttcactatccctcggagcttgctcagactcacgttcaacaagtcaatgatgccatccaactgtctcatcctctatcgcccccttcccttcctgccctcagtctttcccagcatcaaggtctttgactctctctctaggaactggctatccctgggaggggtggtccctccagggtcaacaaagccccaggtgtcaaagcatcagaacacagaaaataggagacgtgattaatacacttgcctagcaagcagctgtgccgctgcccctctgaatgcacattccttccccatcgagaaagaagtcttggctcacaggctccccttcctagtgtgagggtatctaagaattggttcacctgctcagcctccatcctctcagggactcccctgctggtctagtggctaagactccagctccgaatgcagggtgcctgggttcgatccctggtcagggaactagatccctcatgctgcagctgacgtccctgcgtcacacccaagaccggatgcagttaaaaaaataaataaataaaaaagaaattgcattttgtttcagcagagttgagttcagtttatgccagtctctcttccctatttcaatagctaatgcttaataaaatccatctttacctctttaactagcgtttgactttgttcatctttgacactacccagccagacacggttggtacaggaagtgtccacccttgtggaaagctctactgagcagtgtgtacatcgtggggtgtacgaggtggccttctgaggagaggaacaccagagacaaactgagccttcatctcagaagtcatcctccagagagccccaacagtgaggcagggtagagagaaatgggaccaatgatcaataaaaatgggaaagcatagaaagatatttgagaagaaggaaagggccattctaagttgtaaacgaacaaaccatgaataaaaagtgtaaactttcaaagtctgatcgaggtaacaagtgaacttgagctattgatagtaaattcagcctgataaccatcagctcaggctttaatcaccttggaagaaacccccagatttacgccacccaatccagagttaattgggcaataactcaaagctttgataccaagaaatatctaaaacattttacttttccatttggatctatggagatttaaagttccaacacaacagtggaaaacgaatattgaaatttaaagatgtcaaagaatacagttgtaacccaaggactacaccaaaggaaggtacggagacaaatacatggttgctgttgcatcctaagtcgtgtccaagccttttgcgaccccatgaactgtagcccgtcgggctcccctgtccatgggatttcccaggcatgaatactggagtggatcgccatttcgttttccaggcgctcgtcccgactcagggcctgaacctgcatctgctatattggcaggtctaatacctgccaaaggtattctctggacaccagagaagcccaggaaacaagtataagaaagaatcaataaagtagtttcaatgggatgtctctagaacaagcttaaataaaactgtagtaacaatttttggattcactgggtttctgtatttgctctttgggtatttgaagtgctcaaaaccatcagctgtaatgaatttgtagtttacaggtagggtataattcccatagatcagacacggagtagctctttgatgattccccaagtgaggttgtgacagagctctggtttggtacagagtccaggctctgacctgccccagctcactgttcgctcccccacgctccccgcccacctccaccgtaaatttgtgcaatagcgtcctgaccagtgtttcttctctgaacatttgccctggccaggccacccttcacaccaggccacccttcaacccacgcccaaggttatcttcctgccgcaggaggaatcacatccatgttttctttgaaaagcttcaaaggccaccgcccactctgacagctcataggcatagtcccgagcgtggcctgacctcagt

SEQ ID NO: 40120 - DNA, 1510 bp, Bovine  19866880543037
cgacaggattccaaagttgctggtcctcattgggccattatgtggaagccattctgggagaacttgctagaacatttccaggcctcagtgtccccattagtaagttagaataagaaaagaaaatctaccttaggagtaataaagactgctcaaacaaggactgtaatgagagtcctgtgagaaggagcaggaggagtgggtgccttgagggccagagtgaacagggagatggaccaaagagatacaggccaggcaaccaccttgggaactggagagaaagttgcttagctccacggcagctgcgcagcctgaattcaccaccatgcggcagcttccggggcttctttaccgttttctctctcaactccaccgctttaaaccctttcccctggtttatcactggaagagcctgaggcttgaaagacagagccctggaggcctcatcactctggtggaaagttactgcagttacagccctgctttcagggtcaacaaaacccgcctcagagagtccttccagtcattattgtggaaaattaaaatgaagccagcgctttacctggaaatcctgattctccttttgttcctttctgtccttgaagtcctaagatcaaaatacagaaaagggaagaagataataaaacttagatattaaacacttttaatcttagacaacctctaccttctgtctgattaatgcagatggaaaggtacattggttctcctcgattgtttaaagccactttagcagagcataaaagtagacagattgcagataaatgggtatgtgtattggggtgaaatagaaacgtggtggatgaaggtctggattaggtgaacagaccccacactcagtaactggccttctttgtccagtaataacctggcttgatatctattccttcttgttgcaaaagaaggaaaagattggaaaaaacattttctgttggaaaagaattgagagatattttgaaaataaagttatttttatttctaaaagactgtggagggcactcagtggccactagaagctctgggagtctctcaccctcagtagatactccgtaagtctattggtttatttcatcgtggcccccactgtagctaaacagttaggcagctaaagggtctcatgtccagaaaatggaaaaataaccactgcaattgtttgggacgatcctatttgtagttttgatgtgaaagttcctccctccctcccttccttctttcctccattcatcactttattcactaacttatgtagaaggcctactattcccagcaccatgatgggtcattacttattgtgggataataacctattggtttagcaactccatgatctctcaatttcaggaaaacaggattgtctaagacagtcatgcaaacttggggaaagtaaagctcattactgatcatgaagtaacagtttcttgagggtaacaatgggattggtacttccaccatgatcttgactgggggtcccttccaacaagccagtcggctttaa

SEQ ID NO: 40121 - DNA, 1146 bp, Bovine  19866880549090
ttgcctgcccggcatctttgttttcctggcttccacccctcagctgtccttcagagagcaccccttcacaaacactgtcagacacgtggcattctggcgttagggctgcatggatagcgacttctgtccctgtggaggaagagagccttctttctcctggggctgccagccagaaggatgtaagctggggccctgagctgtgaaacttttcagttgcttgaaccaatccctttcttttaagacaaccacaatgagtcacttgcaactgatgggtgccaataccctacccaggagagaaagctcacatcaacacctcaaaaaaaaaaaaaaaagactcctggttgaggactgattcactcaccagctcccacattgtagacaggagatccagaggagtaacccagcatgcggcagaagacagtggcatctgaaccatcccagctgtcatcacagattgtcccccatgcaccattatagaaaacttcagctcgacctcggttcctagagccgataatccggactgataatgaggagtcacctggatgacaaaacacatgtgggagaggtgagggaagcagcacagggctttgggcagatgcaggttctgccttttaatttttggaagtcctattgttgttgttcagtcactaagtcgtgtatgactctttgcgacccatggactgcagtatgccaggcttggaagtcctacagttagggaaagaagtcttctgcttggctgtcatcatagcagtaagatccctcgttatggcaccagaactaccagcagcctctgggcactgaggcttgtaggcatgaggccatacaaggaggtgcctctgcagctggccttgcaaatctagcctgccatgttttgcttgcattgtggagaaaaaaaagggaggaggaagaagggaggaagagagagggaattggggggtggggaacaagcgaggaaagaagggagagagagaaactgttacctgtggctctggacacgggcaggcttattcaagggacagccttttagctttccccccaaacgaagaatctctctgaaaaacaaggcctctcccccagaacacatacaactttcaagtacagagtagcctctatagcatacgttaaacagaacagaaatagcaatta

SEQ ID NO: 40122 - DNA, 1447 bp, Bovine  19866880562237
cgaaccaagggctgcaagtttgtttgacattcacagaaggaaaaggacagtgaacccagtgtagactttgtggttccttaaagtgagtggtgaggctgccagtgctggtagaaattgataaaaatgtatcctgaagcatctctactagtttgaatcacatgctgctgctgctgctaagtcgcttcagtcgtgtctgactctgtgcgaccccacagactgccgcctaccaggctcctccgtccatgggattttccaggcaacagtactggagtggggtgctgttgccttctcctttgaatcacatgaaattgcccctattccaccatctctgacctataaaatgatgatttctataagcaagacaaggcctttctgaactagaggatgaagtaaattagagaacatctgtttggggtttttgcaaagtattttctttgaagaagtttctgaggctcaaaaactacgtgaaaaattccagaataggagatctctatggtcttttttaagttgaaaatattgtattttccttccctactcctcctgactcacattccctggtggcccatccaccattcatatctgtctagaagaggatctccaggtcccactggccttcctggaaacgagggtccttccacctgctcagtgcccagagctcaacaaccagttccgtgactttagctttaatccttgcctcaggttacctgcaatccacattctcttggacatctggaccaaaccatgtctttttataaactatgttcaggccacaactttggcctaaagcaaaacttcacagtcaagtgaagctgtcatagactgttcaaatatgactccatggaaagccaaccccattttggctagtgttcacctgactacttgcagggagggcagataaggacagatatggacagattcatggtggtgggggctccctaaggattgctgcacagtcatgggtcagctggggctcaatgtaccatgcgagtgatagcctcagaagctggaggttggatggcattctatgcaagatgggaggacttagaaatcattgtcatcatcattgttgtttgttgttgttgttattgttatgaccacaatcaaatcttggagaagggaaatttgagactgtacatctgtatcttgaaggaggaaatagaaaaggcttgggtctgagcaagatgtaaggagggaccagaggaaaggcccctaggcggaaattatccaaggatgcatcatcaagtgagcaatgtgttggtttctcaaggagtttccatagtaatcaagtccaaaggctgtgaaagcagcacctgccaccagcctcaacatgaagaatctactgaaagagggaaataaggagggaacacagaggtcaggatgacctactgaccaggataggcctaggtagaggaacggtgaagaagacagagagtctcaaagagaatga

SEQ ID NO: 40123 - DNA, 2406 bp, Bovine  19866880619347
catccatcttttacagcagaagtctttaatcagggccagtgattacagggataatgtcaagataaaaatcgtatgcatgctagcatttaaaaaaattctctgccctaagtcactaatggtagcttagattattagcacagagatcatcctcaaggcctaatgggccctggctggttcctctcttggcaggccttgggcactgggctcacctttgtaatttcacctttggcttggagtctgtgtctccacaggcacctcgatttgaaagcaatcagctgacttcatccttagaagtgagtgttaccaaaagatcacgtgactgttattttcaaagtaactagttagttaactgaagtcagaagttgcagcaaagtgggttgagtgtgtagctgccattttgcttacaaaatgctttcccattgtggcattcatgtgttttgtgaacgtttgttgagaacttattatctagaggctctgtactcagtactgaaatgcatacaaaacacaagatacaatccaagcctaatgaagcttatggtgcaagcactcattcatcatttgttcctacacgcagcacacattacagggtgtctcagtgtgtctgtcgtgaaggcgttgatccaggtgcggggctgcaacacagcacatttccttctctcaggttgtttgcattttggaaagagatgttgggaactagactttgtcaggtattgatgacaacaaaggataataaaactggggatatgggcatttttaaacaaatgattgtatttcttaccttctttgggtgagattagtaaacccattctaagatgcaaacaaggttcaggatgcacataatggctatgtcctgcagggagccatccagagagaggtacgtttggccccagggctgcgccattctggccctcacctcaatgtgccggtaccttgcctttcaggacaccctgctgctttctctttggggttctacctgaatggctagatgttccttttatgcatgtgtgcatggtcagttgtgtccaactctttgcaacccaaccatgctcttctgtccatggaattttccagtgagaatactggagaaatgagttgctatttactcctccagaggatcttcctgaaccagggatcaaaccaacgtctcctgcatttcctgttttggcggcagattctttaccactgagccacctggaaagctcctcccttaatgcaatctcctgttaaaaactatctcccacctccagcccttcgcccagactttgactttctttcagatgattttatttgtttttgtttttttttcagaaagaattcttacaactgtcacttatgcttttaattttaataccctcccttcactcccaggagggaaaccagcaacagaataaagccccaaagaaccagcactgatgagctgggaaagacctgtgagtcctgcaataagcctcaggggtctaggactgccgcttgctgcccttgggatttgtttccatccctcccttctttccttttccagaatctcccatatctataaagtcatgaacactagcacccccagccacttgccaggattgtagtgaaggtcacctaagaaagcagctacagaagtccttcatgaactcgccccttggacaaaaacccaaaagaataaaatagatcactgagtgttgtggagagagcacccactctggagttagggggcctgggtgggaccctagcacaccaactactgaattcggctcaagcatttagtctgccaaacctgtttgctcctgtcactatagagcctgcagtgatggagggccacctggctgagggacagagcagcaatatctccatcataaggcagaaaattgaatgaaatggtgatgtaatagtctcactctgtgttcatattttctaaaccccaggcattcatgagcaccttcataacatttgtcacatcagcgctctaaatgtcttcatttacatttgtacttcagccatggctaaataaaagctataagatcacaggttttatttcatgaatgtcttacaattagaacaaatatgtaatcatttaatatattatattatatattataataaaatgtataatattatatattatataataaatataaattcctgagattcttgtaagcaaccccagtgccatgtgaatgtttatcaggtgaatgcattgtaggtcctctttctgatcttttcatgggctttaatcatcagcacattttcatggagtttcaaagtctgatactttcctttcacaaatgtcatctcatttgatccttaagatattcacagctgagaacaaggctaaaattattgtctccactttatggcagaaagggcttggcgagaggaaataatttgcacggagtcatgcagcttattagatgggag

SEQ ID NO: 40124 - DNA, 5244 bp, Bovine  19866880620047
acctagaatttccacctctactgtgctgtttctacagctccacactttcactcttgctgctctttccatctagaatgcccccgcccttctactttccctggctgcactttgttggttcctagtgccttggtacagttagctccttcccctcacccccaggagccttccagaaccccagactgggctgagcacccctcctgagatcctctagaatgccttttgcacaccatagtgatggcactgaccataatctattctagttattacttatgcacctgtctccccactggactagggtgccttggagccagagatcatgcactattcatatctacttttccctgacctggcacatggccaagcataggctaagtactcaagatacattgatgaaactcagcaaaataccacacagacctctggttcaactgtttccttctctagcattttatttgtctgggctggccgttctgggaggctcttccctctacatggcacaggtgaaaccagggcttgtttctctggtttcaagagatgacctggctctgcttgtgaccttgggtgagtcacctctcatgaccctccctttctcatatgtaaaatgaagctaatactctctgcccaattctgacagcactgacagaggagaagaaaataggtctgtaaagcttcagggcagagagtctatgcatatgtaacatgcactccctgttccacatgggccaggagagaatggagtgtgtctgaattcaagtctaggcaccgtgaggaggaagtctcttggttctggagttcagagggaacaaagtcaaataaaatctgaaaccaaagactcagcccaatggatcccaccctaacttcccccagttctcttgaccaagggggtgggggaatgcccctaattttatcttctgaatctggctggaagcaaagagggctgaggaaggaggagcaggagaaggagagctgataatccactgctgagtaactgagatgaggctgcatgtaaatttaactttctgctggcagactacaataataccatcctttggaatgtccttggagcctccaattgctatcttttggtttcgattaaaccttgagacagcttgccaagtttgaaacccacccaaccctcatgcagtatatgttttgagctcaacttgaactttatgaggtgcaagttaatttgcatttggcaaaatgcaatttcctgtttctaagaaaaagggactttaaagatttatttaagagacacaaatggcttcctggacatcaaatagctcttacaaagcaatattttaataagttaagtgtaaatgaattgaaaacacatgaatctgatttcccttgaactgcagatgggtttaacaaatagagggggaaatggcttggcacaggggctttcggggttttctccatccaaaaagtttaggaaagtagatcaagatgttaggcaaacccctccacacactaggattcccaagctcagactgtgtatctccaggacactcactccacaaacaaagggagggttccaagtcgattccactaggcaagccccgcttacccactctgctttctgcctctgccctgtcaaatcatcttccctcctgcatctttttcctcccttgctcagaagtgctgaggctatggtttcctcccaccctccccaaattctcctgcatgggttccagtgcagagacaatacagccactggtgctcaggtgggggtccctggcgctgcctatcccttctctccagcctcagctgcttgcctctagagagctcactccagtccagagaaccatggaaacctccccagtcattgtcctccaagtcaccagagctctctcctctgattccatcactctgtaagatgaaacccaccactggacttcaggtggacaccaaggatacaaccccttcttttctaatgaatgagcatatttactaggggatggataggttgtttggggacacagttatgctatgcaggctggaatggcaactgcatatcagtggatgaaggtagaatctagccttccagggagcagggaaagccagtctggagttatgggaaaaggcagtggtcctcagatagataaccagatgataggaacaggccttaagtcagggactcaggatttaggaattaagctctctctcttggcccagatgctgaggtgccacagggtcttgtgcacactcctggatggtgggcagacatctctagctgcttgttgttcagtcgctcagtcgtgtccaactctttataaccccgtggactgcagcaccctatgctcccctgtcctttactatctcccagagtttgttcaaactcatgtccattgagtcgatgatgctgtccaaccatctcatcctctgtcatccccttctcctcctgcccttaatccttcccagcatcagggtctttcccagtgagttggctctttatatcagggcccaaagtattgaagcttcagcttcagtatcagtctttccaatgaacattcaaggttgattttctttaggattgactgctttgatctccttgcagtccaagggactttaaagagtcttctccagaaccacagttcaaaggtatcaattcttcagcattcagtcttcatctctagagttgatcacaatttgcagaagagtggtatgttcaggtgaactcagagcgagcaccaaagaaagagcaagtcagtctccacatgtcatcccacagcttggatgagaaaagctggtactttcaaacaagtctgctctacatgatggggatggcaaagggggaataatcatacacataaccatgcacctaataaaagtgctccccaaagtcttcaagagcccagaaaaagggagttagctttgactaagagttagagcatctgcactgaatgtggtgaggtttgtttttattaaaggtggtacttcctcatggagggtggggacatttcttaaggataatagaagaggccattgctccatttacttcttcagcaatatttccctggttgtcagtcactgtaggattgtgccaggccctgcttgtaagatgctggaatgctatgggttcaaaaaagagtaaaacacagtcaccaccccagagagggcttcaccagtggctcagatggtaaagtatctgcctgcaatgcaggcgccacgggttcaatacctaggtagggaagatcccctggaggagtgcatggcaatccactccagtattcttgcctggagaatcctatggatataggatcctgatgggctacagaaccatagggtcacaaagagtcagacatgactgaagtgactcagtatgcacactcgtggccaccccggaggagctgataggatgctcaggcacattcaggagctgagcacctacagagcacgagcagagcctctggatccaaatgggtgggaaccacagcaaaggaataaacaagggggaggtcatggggagctgagatcagaagtgttggcatcccctaaagaaggcaggacacagcttgggccttgaaagaagctgacatttagactcctcatttttccctcctttcctaatttatcacctccctctctggccttgttggatttataagtgaaattcattacccaagttatgtaacagtgaaattaccccaaagtgctgacagctgtgtggtatagaaggggaagggagttcacatactcaggtctctgtttcaatagcatcactgacaccagctatgctaccatggcaatgcctctgtgcttcggtttcctaatctgtgaaattagtctaatcatgagtctgatcatatatttaatagaggtattagacaagcaaatataagtgtccctgtaaaggccttggacgagagataaccaacccataaagtgtctctgtaaaggccttggatgagagataaccaatccataaaaccacagtggatcatgtgaaatctaagcttcaacaaactagctgtgcattaccctgctgccccacccagcccccccacctcacacacacaaccacacaccttacaaacacaagtacatctctgtattagttttctattatccataacaagttagcacaaatttgatgacttaaaatatcccccatttattagtggacagtcccatgggtcagatctggcctaccctggctatcacaaggctgggtctatcacaaggctgaaatcaagatgccagtggaatgagttcttatctgagactctggactattttctgggcttattcaggtcattggcagaactcagttcactgtagttgtgagcctggagtctgtgtttccttgctggctgtcagctgttcttagctccagaagccactccctgccccctacattctctgtcttcaagccaacaatggagcgcttcacctgagtcaaacctcctgcgctctgaatctctaagtctccctgtgtctgacctctagactcaaatttaaagggtcatctgactaggtcaggccccaccagataacctccatattttaaggtcaactgatttgggatcttaattatatttgcagaatctccttatagcaggagctagattagtgcttagttgaatacttaggagaagttgtgtatattccaggggtcaggaatcttgcagcccatttagaattctacttgccacactccccccagaaaagtagaaaaaaaaaaaaaaaaacagaagagacaggaaaaggaaagaaggaaggaagaaggtgtaacaccctactaatctaacttaaggattttaaaaacattctcacctcctgactttagtctagccaaagtcaaactaaggaattaatctgaaatgtagtggggaaagccacacacatgaagctattcaaatacatatatatatatgtacatatatatataaatacatgtgtatctatatatatacacacacacatctatctgtataaatagctagcatatagattgatataaataggatgagaagggaatatagcacaatgctaatagagattagcattatctcagagtagttaaaaaacaggtgatttttattggtattgattttttaattatagtaaaatatgcaaagcataaaattcaccatttcaatcatttttaagtgttctttggcatgaagtccaatttgcattgttgtgtagccatatctatgattcatctccagaaattttttatcttcccaaactaaaactgctgctgatgctgatgctaagtcacttcagtcgtgtccg

SEQ ID NO: 40125 - DNA, 2935 bp, Bovine  19866880709023
aaaagattaaacaaaagaccccaatgaaaggggactgcagactgggatttcaattaaaagtctaattgcagactgaaccatcaggagataccaatgtggaatctggagtcttaaccaagggctgggattctaatcatttggggaattactgactgaaccaaggactaggggcatgggttctgggtggaactgtctcctagcttaagctaagctgccctggactggaaagccaattagatcaggagctcaacgcaaagatagcagagctcaaaactgagaggagcttactgacagctcttggagatggtgaggaagacagagaactcaaagggttcatgggaatcaggatctgtgtttctcatcatccctgaagccatcagaaatttccttcaaatcccaccgctgccaccaatattgttaaaacaaaattcaactgagtgaatttaaaatcttgttgactttagtcaatgatttatgaatggggcagcatccaatttagcagacagaaaggagctccaaggaactgtacaaaataaaagatttttataggcagaagggtgaaggacaagaaagttatattagcaaaaagtggattggttgtggcaaggtcaccttcctctatgggacacagggcctattagacagattacctcactagtgctgcccaggtaattcctgattgactggtttaagattccattcttgggagaagctgaaactgtaattaagttaagtattcagtcttggtttaatgatatggggcatagcaaaagtgactccatttggagccttttgtctatttattaacagtactgatcaatttctgctaatccaaattatatctgctagtactttagtgtgtgttatgtgtgtgtgttttgcagctgttttgaggttgttggaatcagtatacagtagacagggaaagtattacaattatgtaatttgtgtatagaaaggataacattttccgaactaccaggaagaaatatatagccatccctttgaggtttactttactttcagagaaaatttgaagctaacaaatgtaaataggctgtgctcacttctcatcacaagttactaatctgaaacataagaaatcaataagatactatttattctttccttttggtaccaggaacatcttacagagaatttgggtaaattgtgctctctcaaagaaaatcaagaagaaattgaatgattagttaatgtttattaataacctattctgagctgtgttgcaaagtattcaaagtaagtataaattatagaccatgccctcagtgggcttaaaactcattgagaatacatatagaaacagcaaagtatgataccaatgtgaagcttttgataactactaaagaaatggtatggacaagagtttggtacattttttgtaaagaacagatagtaattatattaggcttgcattttatatggctcaactcaattattcaagttcgctcttatggagagaaagcaactgtagataattataaataaatggccgtggctgtgttccaataaaattgtatctaccaaaatagatggcaggctgaatttggaaggaggatgccttgttgacttctggtatagacactaagtagtaagggtattcagagaactgagagggtttaacagtgcgtagaaagagaagtctgtgcagtaggaggagattgaagactaggaattaggtagagaggtggtattcttggtgggaacacagtgtaaacaaaagccatgtgtaataaaaaggttttgttttagggtgagtgggagtaaaaatagagcttctctatgaaagcaccccaagagagaagggcattttcactctggtgtgtaactgctgagagattaaatgcacaatttaggccctgggatgcatattactaaagccatggtgtccagtttagttcattttgctcttccacccagcagtaattctaacctatctctttctgcagaattggcatttcaggccccagggtggggggttgtcagcccacgggaagaatgaaatttgttgtatgagtagatgggatagttccttggtgatgttttctcaatgtggtagagagttgcatggcaatctgaggaactgaggtagttagttctgaatgtctgtgtctctgacgacacaagctcccagaggctcagatggtaaagaatccacctgcaaagcaggagacacaggtttgatccctgggttgggatgattccttggagaaggaaatggcaacccactccagtattctccagtattcttgcttggagaattccatggatagaggagcctggggagctacagtccacggggttggaaagagtaggacatgactgagcaattaacactttcacattttatatgtcaaagggtggtttttcttcaagtgtattaatcagaccactagtctggctggatgatttcagaaaaagagggttctgtggtaaaaactgtgcttccttttagagattgactaggtccactggtaaattaaagtgtatgagaagaactgttgcaaagcatctatttaacttgtaaaaaccatcaatttgccaaacatttgactacagaaacttttctcatggagcatctatgaacatctcatgaaactcattttggaaagtgctttagggaaacaaatgtggaaataaatattgctaacagttactagtagaggcttcaagttaacaagaaagacaaagtgggtgatgagaaagagagaaaattttaaaaactcagatgactcttgagagatgtaagtatggggtagaatttagccttcttatttatttgtaataatacccatttgaactcttcccagtgcttcccaggtggtgctttggtgaagaattcacctgccaagcaggagacttgggttcaatccctaggtcagaaagatcgcctgtagtaggaaagagcaaccca

SEQ ID NO: 40126 - DNA, 2327 bp, Bovine  19866880727680
cattagataaagttgcattcctacagggcaaaggtgtggtgggctataacaagaaaaagaattaactcaagggtccaaggttacaaatattaaagctactatttacattcctatacaccaattatatcaatcaatacactgccagggacacagtaggtaagggatatggagacttggcagcaaacattggctcaaaaagtgaaaaaccctttaccaatacaatttctaatcaatcttttaactgctcaaaggaatctgtatttagacagtttagaacatctcatgcttctcacagttgggaggctctgagcaatcacatgtggccagaaaaacctattcaggcaggctagaggacttccaaaggagtttgtaggttgaaacactatcacaaccaggaactttattaattggagctgtaagttaactcttttttcagagagaggtggtgggggggacagccccccgtaaagtcagagatgtaggtgagagcacaaagcagtaaagtaggcagactctggttttgggggtagatgcttaagaatttccagggggactcctgaggcttgatcctgcctttgcgtatgtcgagcctccttcctcatgacctttgccacggggtggaggtcctcatgccggctcccagcatcaaggtatacgtaaagagtatgaattttactgtatgttaaatattcctccaagcctgactttagaaaagttacttttcagctctacaaagtaactattatgcatctagactattaaattgcacaatttttctatattaaacatcctcgatgaaacagggaatgaatggtttaggggcagattgagaaagaaggctttcttcttgtttatttgtgtgtgtgtgtgtgttttgtttctgagtttctttcaggatgaaggaacttgttgctgttgtttagttgttaagtcatgtccaactctttgtgaccccatggactgtaacattccaggctcctctgtcctccactgtctcccagagtgtactcagattcatgtccatcgagttggtggtgttatctaaccatgtcatcctctgccacctctttctccttttgccttcaatctttcccagcataagagtcctttccagtgagtcagctctttgcatcaggtggccaaaatattggagcttcagcttcagcatcagtccttccaatgagtattcagagctgatttcatttaggattgactggtttgattttcttgcagtctaagggattctaaggagtcttctccagcaatgtaagtctttggaaaacatcaattctttgacgctcagtctcctttgtggtccaactgtcacatccatacatgtctataggaaaaaccatagctttgactatacatatctttgttggcaaaatcatgcctctgatttttaatacactgtctagatttgtcatagctttccttccaagaagcaagcgtcttctaatttcaccatctgcagtgattttggagcccaagaaaagaatatctgtcactgctttcactttttcccctcctatttgtcatgaagtgatgggcatacttgcagttttacaaagtaatgagataagtcaacaggtttcctgtttgcttgaaacctttaatttccttgaaaccacgtatagacgatagtttacttccaaagtcagccaagctcttcagagttggaatcttgcctttcttttgtcctctcaaggcaattatcacagtcttgatacttaataatatttataatttatgttgacaacataagagagccttcatttttctttttcaatgctagtctttcttctttaagtaaaatccaagctttaacctttccacttaaatgcatcttgaaatattataaacatttttagatgttattatcaaagctactcacatcctggagtaagaacctggaaataaggattaccacttctggaaaaatataccaaatgatctctgccaattctctaaatttctctgggctcaagttttcacatgtatgaaacagaaaaatcgtccttaatagagactgaagtataggagcattagcagcacaccttttaatcttctgtatgttaccatacagagcctcatctccagcgctgcccacgcagatgctcaggaaatgcttgctaactgaagatttttatggatcactggtagaaagacacataaatgcaaaacacgaattttcccttgccccgagttacccaggagcatcattctcattcagagatgaccacacttccgaaagtgggtctcataaaacatacaatttaatgaagccatctgggaagatgatcgttgtataaatgcaaggtattgat

SEQ ID NO: 40127 - DNA, 1429 bp, Bovine  19866880730036
ttttctaggggctgaagaaatcttttttaaaaagcttggaatagagaatgactagatctgaagtggtaaactgatttcttcttgtgcacaacactggttgcttagaagtggctgagatgaatgttgaggttccacctgagctcattgggagtgtcatgattgattagcaatgtctgccagtggcactgtatgggagactgcaggcctcatttattgaatgcccattgcttgctaactggtgtccacagcatatattaatgaattaaaagcttgttctatattctgtctttagtggtgttccaggaaaaattaaagactaagatattctgtaagtatagagtcatataaccatgggattcatttaaaattatgctaattggagacaaaatcttcgagataagttaatatatccagtcccctaactaccgatgatatttaaccacaccaacaggaatacgcagcctcagagacatgaagccaaccacggccccatgagttttgaccaagcctaagtatttttgccaaaagaaatttctgagacttattgaatgctcaaatcttaaggcagcccttcgagatttttgccactgaagattatgtttgcaaaccaatcagcaaaatgcagaatgagattattctgttgctggtttggataaagaaaagcacattctttactgtgtagatgaaagttgagtggggtgtttcccatctgaattctctggatcctataattaaggatacctgggagtttcagaatattagacataagcaaacagttgcaaacattttatgaagtagtggcagtggggggcggggatcccacatttttccaattatttagcaaggcatagctcttggcctctttatatgagcaagataaacaaagaagtcactctttgctcttttatatcattagagcaaatgtcgataaggacatgttctccagtgccaacatagtggctaatgtttagttccaaaaggatcaaggtggaagcaacctctcccaaaggtaaaccttctcctttgtgaatttgctttaaggaagactgtagaccaaaactcctttttgttgtcattattaaataagtctctaaacataaatattgatgctttcaaactgtggttctggagaagactcttgagagtcccttggactaccaggagatcaatccagtcaatcctaaaggaaatcaaccctggatgttcattggaaggactgatgctgaagctgaagctccaatactgtggccacctgatatgaagagctgactcattggaaaataccctgatgcagggaaatattgagggcaggaggaaaatggggcaacaagcgatcagatggctggatagcataatcaactcaatggacatgagtttgagcaaactccaggagatagtgaaggatagggaggcctggtgtgctgctgtg

SEQ ID NO: 40128 - DNA, 1933 bp, Bovine  19866880752989
gatgagtccctaatacaatgactgatgtctttataaaaagaacaccatttgaagagaaacacagggtagaaagggacatgaagacagaggcagagattggagtcatgcacctgcagctaaggaagccaaagtctgccagcaaaccaccagaagataggaagaggcaaggaggccttcttctctggggtcttcagagggagcacagctatgccagcaccttgatttttaacttgggtttccaaagtggtgtgacatttaagtgtctatttttcaagtcacctagtgtgtggtactttattacagcagccctagtgaaccaatggaaccccccaccaagcaacacagaggacttttcttaccaaggcctgcccccatgtttgttcattccattcttctgtcttttctttgcctggctcctctgtaaggctcagagccagacttgcagctgccatacaaagaccacagtaggagcaacaatgtgtgggttgtttgatcaatctgaattgaatgggaacatagtcacagagatttacatgttgctgtcccaggtatgtcctaggtataggagaagctggtgggtgagatcctttatgagagctggcctctcttcatcctccatctcactgcacaggtgctcccctccagaggctctgctgacacaactcttctactccccacttggacttgccctagtaagtcagttcttcacttgaccagtccagttagccctgaagaccatgggctccaagtcatgatgagcatgcaccttgtcatctgagcagatggtcgcagagctgagggtcctctcgaacccccccaacttgtcatcctactattggagaaaatgtgtttcttcttctactcttttgtgtgtatattttccttctgaacaaaaataacaaaccagttgccccataattagattggattacagaataattacaaccttgtttgctctcggcagattacatggtaattatacttggcattaccatgaagaaccaagaaattccaacgatgtcattacatggttatttgtacagtacaatgcagcagtgtaattatacatgcaacatttgttttccaataggagagtgattaaaacaatgctaatgcttcaaagtgttgactaggcgccaacatgatatgacatttataacgtggggggagtctgtttcttaattttttcttgaacacagcaaggtttaccttcctctaaactccccagcaacctcagtgggctgtgctgtggtcaagaaggtttaagtgactatatgaaatgctctctgctctcacagttcatgtgtgcgcacagcagccaggggactgtgaacccagtaaaacccagaggtagccagccatttatccctcagcaagagacctgcttagtcatttttcactgttctgtgaggctgcctttcttaaagccttgatatgagagagaccatgggatgtgcgtgtgaagagaacatggtgtcagacaccagcattctgtttagaaactaccatcaacactgcataactttgcctaagctgttcctcacactaagcttctttggtggctcagatggtaaagaatctgcctgcaatgcaggatacctgggttcaatccccggatcaggaagatcccctggagaagggaatggctacccactccagtattcttgcctggagaatcctatggacagaggagtttggtgggctacagttcatgggattgcaaagagtaggacacaactgagtgactaacatacttcatcttcaaaaccagggtattgaaggtgacctctaagagtccctgtgggcctaggaatgtattgacaaaaggtggcttgtagcacttcttatttaagttttcatatattttgggattgtcaatgataatgacctcggcttgggaagggacttcggctttttttttttttttttttta

SEQ ID NO: 40129 - DNA, 758 bp, Bovine  19866880786228
ttgggtggaatccttagaatagataaaattcctcccagctggattctggagaccaattggccagacttcactttttgggtcctatgaccattctcaaaatggcagaagccaggtcaaggagtgggcccagacatgaaaatcactgggagtaggactttgagtgatctagctagaaatttaaatgggctgtttccagtctctgcagagaataatgggaatggagacgctctttacataaacaattcagacccaatccttgccaaaatgagtaacaaaggcctccatgatgaaatggtatcatctgactccatcagtctcatttgatagtaacctaataactctttttttttttttaacactcttcctggtttcttttttttaaagaagaaaatggaaaaagaaacagaaaaaaaataaagtttaaatgtaagtgagcatggtggcttgaaattgggtgaaaagttttattttttatatctttaaaatcagtagcactgtttatttcctctggataaaactgatagaaatgaaatgaaactgaatcaataattagaaagaaattatacaacactggatagacgtatggcctggttctgctttcttaatgatgtcagtttcctaaagacagggatgtgattggtgaaagatccttctttgggtcttgtgagtagatgccacagtgggttgggatggggaggggagaaactggagaggacttgagttttccccaaatgtaattgataggtgcaactttcaaa

SEQ ID NO: 40130 - DNA, 1472 bp, Bovine  19866880806438
gctagaatccatggggtcataaagagtcagacatgactgagccaatgaaacaacaaccaattctatgagatttccttccgctcaaaacatgatatgtctattcttgcttaataccgtactgtcttgattaccatagctttataggaaaacttgaaatcaagtgctctaatttcattcttctttccaaaagctgtttggctagcacacatactttgctgttccacacgtaaattttagaatcagctagtcaatttctccaaaaataagtaaataaataaagcctgctgccattttgaatgggattatatggactcttgcttaaaatatctagagttcattttatttcctgttctctatccaggctaacaaagagtctcccctggcccttgcttctggacttccccctccattcagttcacctgggatccctattcaagctaatgacaaagacaagaaccctttagcctctccccaagtcctgagccactggcttcgatgggcagctgttgaaatgcacctctccagttatccttggtgatgtatgtctccttccccatccccctctcccattggctgacactccatttttcttccctcacccagcactctccctctcccagcactctccctctcccaagccccttctgccacctatcaccttagcttagagttaaaagacctttaacctatgcagatttatttttgcacaaggaagtacagctctatccatggccctcatttccctctccctccacccacccaccatactgccaacccaattccctgccccagtgcacaaagcttacaaacactccccgcagtcctagagaaagagatggccaaatccctcctcttctagcttccaaattgcaggcttctgcagatgggaaaatataaggtgtgaggccctagaaagttcataaacttttatgcagattggttttagtctggtttaaattaggcaacaaaatagaatttccagatgttctatttggaattaacttggctacagagaaaaggctactagaaggaggagttggtaatggggttatttttacattccagaaagggagtcacaaacagcatatggacttgattagaagaaaagaacctgctggttggcacattaagaagactgttctcatttattctggttgaggacatgcaaaggtgcaacgaaacattctcaagtcactgggaagataaagggcctgggcaatggtgttttgtcccagcagtcagctaaaagcagaaaggattttgggcagacgtaaaggaattctttgactataagtctgatcttctcaaactttaatgtgtgtttaatgaatccagaatggatcttattaaatgcagactgcaatgggtagatgatgccatagcttctggtccataagccatgtgttatagagcaaggcattagggtgttaaaatggagctaggaaagaatattccacttacatcgagtgttt

SEQ ID NO: 40131 - DNA, 1893 bp, Bovine  19866880833186
ccctatcccaaatccactctgttagaaagcttcccaaggcttctgtgctcccttcagtacttttctcatcataatgacccagggtcagtactggaacatcaattagtgtgtctaatagaaccacttgaacaatcttctttatcttggatcccttgaatctcaatgccctttttacttcatgcttttctgaagttggtttttccctcagccctcagacttgacaggttgggttttaaaacaaatatttggtgtagcctttgctctgcttctttgctaactcatctgctctaacttggaagccaatttcctaactgtcttggattcctctggatgtctcatgagcttaactcctgccatagagggagatggatgcaactaggttgcgtaaaaaaatttcccctgtatgatcaacaatccctatcttcaagtgcttttgtgttcttcctccagcctcttaaggcctttcacctttttcatttctaccagctttgtgtcagactgtcactgcttcataagtacctgatgttagctagctgttccctttctgctgtgagctgtaacatcaaatcaccaagcatgttagaactgtgtaaaaactaagaatgagtaagcactaaatgaaggcttgtaggtggccttcctaagagtaaagtgcatgcattttgtctctatgcttccaggcctgactccctgtatctgatcataatctgcatagctgatgtgatacaaagccttgttttctatttctaagcattagttaaggcattgtcacaatacattttatttatattcctctaatctccacataatggagaaatatagcctcatcactggaagggacacagatcatctattcaaaaccaaagcatgtgacagatgaagaagcagaagctgcaggtgaggataaatggtttgctgaagatctcactatttatgtagatcctggattctgttttacatctcccccaattcccaactgaatgtcttttatccatcaccagtggtttagtcattaattcatgcattacatatttgcagcagaagccaaatatgttcagttacaatggattcacaaggatctgttcagactgtgattatctgtggggagaatctgaaacatctcaaaagaagtctaggactttggtggtagggtatctgaaagccaacgcccatgcaatctgtattatataatcctatacaatgttaggcaaaccaagaattatattctccatgttttggagatggtaaaactgaatccaacgaggtaaagtgattggtgcaaagtttagggcctgcacagagactggaatctgagattctgactcctggcccctctgcttcccatacatcctgtgctcctctccccagagaatcaacagctcttggagaggaattttgattccttgagaaagggcaagcttgtggaagtgctggactggaaatgacaggatctctggaagagcctttagagaaaactaggaagaagctctcattttattcataatctagttatcccctggatgcttactcagcctccagagacttgctcacctctagagaatgattcacaatgtgtgactcaggacacctaagacttcacaacacttctgttgatgaatattaaaaagatgatcttctgtagtatatacatgcaatggaatattactcagacataaaaaagaatgaaattctccatttacagtaacatggatggacttggagggcattatgctaagtgaaataagtcaaacagggaaagacaagtactgtgtgatatcatttcctctgtccatgggggagtctccaggcaagaattctggagtgggttgccatgccctctctccagggggtcttcccaacccagggataaacccagagtctcccacattgcag

SEQ ID NO: 40132 - DNA, 1855 bp, Bovine  19866880874212
tgatttccttcagctggtctgtgttctcccctgggaaatttatatttcttcctggcatccatcctacatcttctctggctaccacggagacaaagaactccttccctggctttgagaatggcttgttttagaattcttctccagcctctcacagaaggccctggtctggaatataagaagccccttttctccctcctgccctaactcacaacctcaaatgacattttctgagaccaaaaactcctctttgaagcaaaacagcaaaacccctcctctggtctcatagcaaaggcctgtcacttaagcacataatttaaggggcattggggtctttgcaaaaaggaatattctctataccccttgagcttagcaggccagacatttttaccttcagaatcactcctttgaatgagaaataagtaagattactatatccgaatgctatagcatattcactaggactaggactattttaaatgccctgggccagggctgggtgctggggacagagaggtgagggggttggtttgcctccaggtatcccagttaaggcaggagaatacaccaaagttttagtgggtgaggctctagtggatcaggctcgtgcctgggggaagagctcagggtaactgacttgctgatgttcaccttggaaagtccaaagcgtatctgaccttgagaagatgagctgtggggcaggggagtttcatgctgttaacagctctgtttgtgcatcaaaggggagcagagagaagagggacagctgaaaggaaggaggtgaccagaacaccttggcttacctcccaatttctccagaagtaaagtctgggtccagcatgcctgccagagccggtcccaaacacccttctcagcgctgtgctataagccagcacagtgctgtgtgcacacagggtgccagaaactgggctaagagctctgcaggcatcattttacttaaactggcaccgcctaagagggagaagaaacaggcttggatgagtagaatgatttatccaaggtcacccagctaggaacaagagatgagattaaaacacaggtctgtgcatctgaaaccgacatgtttaaaccaactgcacttgcttcaatgggagaaaggccagagggacacagaaacctttttcctttcactgttacctgaaacagatcaaaggtcactatgggccttgaccccaaagaaatggacctgacgtgttcaagtttctctacagagcaaggaacccatctgatgggcaacagatcacatgtgttaggctacatggagtctcaaaaagtatcttgtcttgcaagggttcaaatgtgctccaagaaacccacagcatctggacaagtctggccaccaggctgcccagtgtctctattctcagtcaggtcagcatccttgaagtcctagtaagcttttcaataagacaccatttaaacaaaggctgtcagagggtcgaggtacgtcaaggacctgtgctgggctgagtgcagaccccagatctctctgagatccagctccgttcttggcctgagagcacttgtgagaaagcattaatacccagggaaacctgctcctggcagactgcacgtgcccctagggtgccaccccagggcatccaggggcccagggaatctgaaagcccccaggctctgaggaccagcaaaaaacaactgtgcttaggtcaaaaggcaacagcctgcagacaacatgaatgcagtcaggggtttacacatcacacaccaagcctgttcataatctatgctctgggtcagtgaagcaaggacttctgtgtgtgtctgagtaagcctgggttcccttggcctctctgagcttcattttcttcagctgcaa

SEQ ID NO: 40133 - DNA, 2191 bp, Bovine  19866880890819
cccttcccttttaatgagaatctgagacccagagagaggtgatcttttaaaaaagaaggaagaaaggaagggagagaggggggtactaaccctccagcatatgccatgaatccattgcttgatatatatcatgtgatcttcacaaataccctgaaaacccccatttttcaggtgagcaaactgaatcaagaagccctgaaataatgtttcagagtcatccagggaatagtaagtaacagagctaggacttagaccctcgaatgtcttctcttggatttgtttgagacattgagcacagtcttcccaaagaagacaacatatgagcaagttctccaggcccggggagacagaggcagcacagaattagaaaagtcagatgaaatgggattggggtcgaaattcaattcagccagagaagtcccagggaacaaggtcgggctaggagcctgagtgaaccaccagagctattggtctactaccacacaggggtgtctgagttcatgggggtaaccaaggccagagaggttcacaggcccacagaccattctattctaggatgaggcaggggtccagggaaaggcttataccaccactttcctgttgagagtctatcctttatcttctttaacccaagaagtctactatttccttccatagaatatttcagcagtatgacctgaagataagtggatatctagaatttcaaaactgtttgaccttggggaagttcttaacctcttagtgcttctctgcctacatctgggaaaaggagctcataacgggatctagttcatagagttcttccaagaattaatcaagttaacacacatttggaataatgcttaccacataataggcatagtatatgtgtgctgccattattatatgttgttcctaattctcctttcattcatatggatttttaaagtaattaattgctgcattagtaatggtaatcctctcaaaatatgtggtcttgacctatttttaaataattgctgctttaaattgaacagtcctcctcatagcttgacaagtagcatattttattgatgttctaaattatgtgtgtcttttttcgcagtcatatctaacattattttattccgaaggtgaaaaacactccatctgacagaccaccaagctacgtaattgctttaaagggaatcttagcaggtgcttttttgttttgtttttttttttttgccaaaccaactgtggcaacatgtgttttctgatgtacaagagggaaaaaaagaggctctaatagctgcaacatcatttcaggtttatatgaaagttgaaacatggagactgaatatgaattcttggttgaagcaaaggagacccaagattctatttttagtatagcaaagttcaggctagcagcctctgaaataattctgtctgctaccttgcaaattactgtaagccagacgatggtgtaacaaaggacaagccttactttcatattagcatatatgtcatgtttaatcaatcagagaagaactgtaattactttgctctcttttcagcaaactttaaagaaagggagtcatgaacttataaagtaaatgtcatcctgtttggatagttatagttttataggtaatttgttgcagattttattcagataacatgtaattatttccttccctgctcatcttcaatcctacaggacatttcaaacacaaacataaggactacagatgtgaaaatgatcgatgttacaatctaattattataatttgctgcatgcaatgtgtatctgtttattagcagatgacttatgctacctcttcaacaaactgtcacctagatggaagagagcagagattaagggacaaatgtccttggacatccattgtcaatcagaggacacacagtgaggtctggagggtagtgggtgggaaatacgagtcttggaatcagataacttcagatttatttaaaactgaattaagatcacgcacaagcaaagtaactgactgtactcgtttgtggtgggcactgacaaaataacctcttttgctacatggattatcctctacacctttctttacatgttctggcatcttgaccacgtagctgttagatttctctggaaacagtggaaacagtgtcagactttatttttttgggctccaaaatcattgcagatggtgattgcagccatgaaattaaaagacgt

SEQ ID NO: 40134 - DNA, 1651 bp, Bovine  19866880908465
ctgtacgcgtcataaacaccttaggcgagacaatcgatactaatgccaagaacacctctgagccatcagtctgcagagcgcccgactcctgcaatttcataagataaatgcctctgctgttttaagatgatgaaactacagctgagacgaatctccgtatttttcaccagtgatttaataaaggccagctcagaataaatatggaacggctactctgaaagcttttttagctttgtgctgaaatgcattggaactttcttccgtaaattgattgtatccaaagttccgatttgtccatgcatggaagagagacacagactaacttgtggactttaagcattccatgtaacatgctgtggcttaaggggaaatttagggaaagatgttttttggggcaaagtgaggggctgggaatcaaaaagttgacttgacttttcttgagctgaaatggctaccaaaacagacagaggagaaaaggaatctgcacctggggattttgctgtccctaatcttaagcttctcataaaaagtgcttatgtccatatgatgtcatacttgccttctgggttatttttgtggcttaagatatgttaagcacacactcaattgataagcaggaggcagttagatggatatataggtagacagtcagaaggatggagagctagataaacatacttcagtctattacaggcaattatttcccaaagtgtttaaaatcctaggggagaagcctgactataattttagagtatctatttaaatcttatattcatgagtaagaaaagttttttctttccattttggatgagcaacagaggagagcaagtgaggaagagagaaggtgaggaagaactgatttattaatatttctttgaggcccgtgttcagcagctggctcttttagtacgtccagtaaaccctcacggagttaccaataggcagaggacgtgcatgcacgttcatatgtgtgtgtgtgtctgtatgtgtgtgccggttgtcattggtctatcagcccacttttcaggttgatgagagcctgtcagggaaaagctggatcccgtcacagcttttggctgggggcccagcacagttgactcctccgagcttgaggaagcccccccttccactgctgcagccgggccacacgtctgtctgtccggcctgccccctgcacaggccctgctgactttaattacaccctctcagcggaattcacaggtggcttccctgggaggaggcggtacctctccgccagaccccgagctgctcatttcctcagtggattagcagggccacgatgaaacagaagcttgtgccttctcctttctttacacaacctggtgttagaggttgacctttcacccctggagattcggaggattaaggccgctttcaagtcccgctctggttactaatccaccactttcacttgctgttatgtaagcacttcctgacttaccctttaaatcctgtaaacataataaaacagagtttaacctttacctttggatttccccactatcttctgcacggtcgaatcaactgtggaaggatccaggaacagaaagctaataagtgatagcctgatttcttttttgccctgggacatgtaacaaaacattacaatatttaatatattcaggtcaaa

SEQ ID NO: 40135 - DNA, 819 bp, Bovine  19866880961451
aaaaatttttaattttggcttttcacacaggtttttaacagccagaatttggcttttgtgtatggtgtgaggtaaggttttcattttctccacatgaatgaccaattaccccaagatagtctgtcaaaagtcaatccttcttcaccctcctgatttggagtgcagtcaatttagggcacacagttgagggaataaaaccctggcttgaaaaatagaattttcctttgagaacataaactcataatcaaattattatgtaagtacttaaatatggatggaatttactctaaaatactctaatctgataatgtttaatcttttaatgccagaaataggttctgattaaacctatggacctctgtctaaaatgaaaaaataaatgcacaagcacattaaaaatatacttgaaatttgtgcactggcctcttcccctcagtttagagtggagaaattgggggaatgttaatatattaatgaagaggtcacaggtactatatgtcatagccagaaaaagaatccatatttcccatgtctctgctttgtaccattccacatgcatactttcagttgagccatgaaagtagaacacggaagcatcacaaattgtgatcacatgctcaaaataatcaaagaatctataccaaaacagtaacatgaatttcatttctgatctaaatttaacagttaattgtatatgacagatgaaactgtatggttataaaaagaattgaatttgagagaaggatttaactttaaattgttcattgggtctgctgccccattcaatgggaaggactttagtagcaggttatttctaga

SEQ ID NO: 40136 - DNA, 1359 bp, Bovine  19866880969232
cgccaactctaccccttcatattttaggggtcgcccttcccgccgtccgccagccttctttccgcccgggcactcttccactgtccagggagtctcggcctctcgtaggccctcttccctgacccagacgtcccctttccggatctcgccgaccctcctccaaggtaagcggagcccctcgcccttcaggccccatctgtagtcctggctcctcacacttgccaggagggttcccaggttgcaaaaatgcaagcggttcctctcctcgaaggcacccctttcctcaggctctttccctcagcatcaagtgtctcgcgcttccctaggggaccccaaactcacccccgcctccgccatcttctgggaccggcccccgccccccctctgcctcttcctcctcccctcccacaactccgcccgagctccactgcgcctgtgcggccgacgctcagacgctcagacgatcggggcagaataacttccggttcctacaggggccagatggaaggccggagagccggggcaaaagaacttccggtctccgcgagagtagcggcacctgtaggcgtggaccgtcgattggtggaggctaccagatcagctgttgtttgctgagcgggcagtcgtgggttgtgaggattgcgcagaccctatgggcggtgccagagaatcgcgcagctactcacgcaaacccttggcgcgtccctctcttcggagctgaaatcggagttctggagcgcaggtcgcctgtcctcctgctaaggatgttgagagtatcttttgtgatttggccgacctttatttaccttttttccttcccttctaaagtcataacttctttggggagagagcataattgataattctctcttctccatcccacagcactttatgcggcattcattaataatcgttccccaagtttgaccaggtaaagcggtttggggacagttttcatagaaagagcttttgaggtttacagcgaagtcgattttgctaagtaaaatacaaactactaagaggaaaatacaaagtagagaaattacaaccctttttttgtcagaagtagtatcataatatggttgtggtcaagttacaagtgttcttgtggaaagtttttacatgaaggtttgggcctggaattattgtttaagagctgcgcaaaggagtgttaattggtgaaattcctttgtattttttttttttttttttactttgaactgattaatgatgctgtttctgacctttttatgggtatgtttatttctgaaaaatttgaaggcgatgttaaagttgcaccaaaatacacctaagcaagtatttacatggcctttcttattttctctaatgtttcctaaa

SEQ ID NO: 40137 - DNA, 806 bp, Bovine  19866880993596
ttcagtactcttgtacttagatacatttactataaacgtagccctagattattccacaagggtttcatttttttttccccagttagacccagtgaaggtcaaagttttccccatctcagtgtgcagcacatagtgaggactctaggagcaccctgcaggagtcttacattatctgtagttctaccaattaactgtgtaacttgcttaactttctgaaacccagtctatccccctatatagaagcaagatggagggataagaacaaaaagttgatctctgctagattgccctgggctgaaggtatcacataaaactgcttttaaatcagatcctctcctaattcttcctttccagaattttctttaaatggttcaatctaaaaactggcccacaaaagtccatcagattctatgggccacctgtagttgaacccccatacccactgttgtcatcaccaaagaaatacatatgcacacatgcatacacacacacacacacaccacatacttgactggtacctagagcataatcaaaggtcagcttttacatacatgtaatcagcaaagtcgtagaaagatatggagcaaaagatttggacaaagagcaatggaaaacattatgccactgtgtaagtgctccagaggggcagaaatcagcttatttgagatagcctagagaggaatgtcgctaggggcaatgacctgaatcaagttgaaaagatgtggtgccgagcaggaaattccccagttggcctgttacactaggcttgacagccccaaggagccagtggaagcttatgtcattaa

SEQ ID NO: 40138 - DNA, 1201 bp, Bovine  19866881036321
ttgtggaataatagaaataaacctgtttgaaaatataacatcacatttacagatagacttaaaaccctgagaacagtcagtgcaagtggaaacctggctgggggaagcatgctgtaagagctattgatttttatatctccatgggtagtagaagtctatgagagatggaggataagtagtatatatgctcccatttcccactcttatctgtgacagacaacactaataagttatagcatctttcccaggttgcctggtctaatctcacaattctcagtacagcattccagactgtcactttcaatcagatggaactggaatgagaaatgcaacttatttgttaacgataactatctttcccatggataggatcatgctgagtttaatactgtttaggagatacaatgagtttgacttttaagccagaaaaagcaccatctatatatgtttcactttacaaatgttactacctatttttttaaccttcgtttacccatctctaaagtggagaaataatgaaaactcctgcagggctatggattgatattatataagatataaatttagagtccctaaatttggactatgaggggatatacaactggatttgatccttaaagagcttgaggatccatctggcccatgactctgtgcgtagacagagttgaacttaagcccttcccataccaaaaatgggtatgattctcaaaaggcgagaaaacttcacctgctttcttcctcagcctcttataagttttattatgtgcttatcacataagtaaatttacttatcacaaaggcttatgtgataatatgaattggtaaattctctcatcatgtttttccttctagaggtcattactattgaaattgatacagagatttgagtttaatgtagtgatcatttggataaatttgtaaaatctacttgagtaactagaatgccattgcctaccattgtcaccatgttaatggccttggaattggtcccctactcttacccttcttcagtgcatacttcacatgataccaatgtattttaagtgcaaatctggcaatgccattctctctcttagagatttttaatggctttgcaccagtcagtattttggggtaggaagaaaagatggctcaaatggtaaactgggggagttcaacaaaggagtgacttacaaaactgctgtggacaggggtaagggaa

SEQ ID NO: 40139 - DNA, 1742 bp, Bovine  19866881067754
aatggaggtatgttaactaaaaggcagggctccctttagagccaaccactggcctctgggattggtgctgtactaccaaaaatgtttactaaggacttggaataagattatgatagcatcatggcatgcagatacaggctgtaagtaacatgaagctgaaagggctcatcattatgttaaatggtggaatttgtaacccagagatctttccaggtagtaactattgacatggtttaagaaaaagaaattcaacggggaaattataaatccttttgattaggcatccacccctcaccctcagtggacaatgtggaaacatccaaacaactcaaaattctacccacaactataaaagaacaggaaagagaaaatgtggtttgtgcacatggaaagaattttcagttgtttaaatttaacaactcaacacaacttaatactgggatgtggttgccaaaaatgctactgtgataggacattttgttaaaagaaggatccaaaacaagggacatgatgatgcaactctggtgtttgttctggaagtaatcctatggagagtattaacagactggagtatgtccagaaaaagcaacagttatggtaaggggacagaggacctgtgatatgtaaaatgactaaagagacagtatattcagccaggacaagaatctgtggggagtgtggagtgggaggagaattgaacaaaaagctgtcacacaaaatggagtcaagaggcaggagcaataaaaaagatgagggcagttgaattctagggagaactctgtcatacacagagctgtttgtgcaaggatgaagaagtgagaaagttgcaatcctggagacattcaacagaaatacgaaggtcatttgtcatggagaatatcaaagttgttagtaataatacccacaagactatgatttttttatgacttaataagatgtattccatacaacaagaagtgcttttaacgatgaggaaatggaggaccagaggggtcaagcaacttgcccaagaatacccagctggggatagacagcagagatcagaacatagatctgcctccttttaaacaatgatcatgcttttccactggctcacacttcctcaaagaaaaccgagctctaggagaggaatcattctttaaaataacagaggagctatgagatcttctggagctaaggtatctaataaaccctctgagaatactgagcattgccaggactctctaggctatcactgagcaacatataatattactcagtttggaatgtcttttctactgatggttctgtcacacatcaatagtaaaatcaattttattaatctaagatctttttctgaagttttaagttcttttaattctctataatcattattaaagcattagttcctagctttaaaaagaaagcaatgtttctcaaatatcaaggaagttaaaaattttaaatttttaactgaaaaaaattattaaagtatacttgatttaccatattgttttagtttcaggtttatagcaaaagtgattcagttatatatgtatattttttcagattattttccattataggttattaaatgatagtgaatatagtcccctgtattgtaagtaaattcttgctgcttatctattttatgtatagaaaatgggtatctgtttttctcatacccctaatttatccctccccttcccttcctcttttgaatttaaagtcatttttaaatagtttatatttatggaaaatta

SEQ ID NO: 40140 - DNA, 1290 bp, Bovine  19866881096480
tttttaaaggtcatatgggtcagtcacatagaaatcagacacaaacgaataagaactctatgattcccatttatactaaattctagaacaggtgaaaataatccagattcagcctgaggctggtggtaggctgcaaaagggcacaagagaatttagagggcactagaaatgcctggaaaatcccataggcggaggagcctggtgggctgcagtccacggggtcgctaagagtaggacacgactgagcgatttccctttcacttttcactttcatgcattggagaaggaaatggcaacgcgctccagtgttcttgcctggagaatcccagggacaggggagcctggtgtgcttccgtctatggggtcgcccagagtcggacacgactgaagcaacttagcagcagcagcagcagaaatgttctattggagaaggtaatggcaccccactccagtactcttgcctggaaaatcccatggacggaggagcctggtaggctccagtccatggggtcgctaagagtcggacacgactgagcgacttcactttcacttttcactttcatgcgttggagaaggaaatggcaacccactcctgtgttcttgcctggagaatcccagggacggtggagcctgatgggctgctgtctatagggtcgcacagagtcggacacgactgaagcaacttagcagcagcaatgttctatagctgaactgtgggggtggttacatgaatgtatgattcatctaaactcattaaactgatcacttaaaacaggtccattgtactgtatttaaactacaacccagtagagctgactttttcaaatatttcccagaaaacagccatagtcatttatcctaatgtcttttgcattacagaaacagccttcacatacctgatgctgtgccacagcatggcggtacccaccatgctgaagaaaagatgcttgcaatcacatcaggtggaaagagtgtcacatttctctgaatctgaagtaaatttaacactaatgcaagaaatactccaataaaaaacagcactactcctcgaatcatcaagttcacactccggctagtgacagatgagatatatggaccacgctttttgggcccaggtgactctgtctctccttctgccatggtttcataagttcagtaagttggcaaaaaaaaaaaaaaaggaacaagaaagggtttcccagctgaaaaagctgattgtatgaaccaaagcagactggcgtttcaacagtactgcatctcgtcctaaaacaggacctaccagaaatcctg

SEQ ID NO: 40141 - DNA, 1481 bp, Bovine  19866881119101
ctgttacatgccaggcgctgggctggggttcatgtgtgtcccgtttcatagatgatgacagagaggctcagaggtgacatgactttcccagtaactctccctgaagacaaaggcatcctagggtaactccctctcacctcttccaagcatgtggaccattctgagtgggagtgggtaatggttgagcagactggtgtgacaagaatactgaccaaaagtgatctatccttgcaggctctctccctctcctacccccctccacttcagtatggcttggctgtaggtgtacaggcaagtgagaggcacgtcaaagtaaaggatgctcccaacagaccctctgatcccagggccttgaagtgagaggcccaagtggactacaacagcaaccgtgttagggcagggcagtgagcatcaggacaggactgaggaggagtcctgaacttggatttcgtgctccagccaggagctgctggagccgccccaggctaactgctacgtgcctgagtgaagttaataaagttgcatcctaatagccttcgaggtctcctgggctgacgtccctgaggggcccaggcatcaggaggtgctttgttcatttattttggcaacttgagctctgtgtgcttcacgctgctcttcccgtccgttttgcaagcttaataaagtcctcgtaatgaggctcgacttcagtgagtctgtgcagaagcctctgagaaatggggcaaaagtgacaggctttttttttctttctttttttttaaagaatttactgtgtttgcaacagagagaggtaagtactaacaaacttctactccactggtacagccctcatttctacactgtgtctcctagggataccctgttcctacttgagtatttccaggttgagattttgcacaggcactctcaggaaatggggctcaggaggtaaagacacatatccccagtggctgggcagaggctttgctatccactcagggttacacctccttgtggctccttcggtatggttgtgtgtgtgtgcatgtgcacactagccctgtgctagatgctgataaagaaaaacaggaagcagaagtggagactgttgcttggccctcccaggataggaggtagctggtgaggtctatgtacgttggggaatagcacgcacagcgtatgctcaaggggagctgtttttactgcaaggaaaagactttggagctaatgttcctcagagagaaaatttcctggaagagggtcctgactttggtcttgaaggaaagggataaagaatgagaatactacatcatattagatatgtatgttacgttattcacccacactatgaaagacatgttgagatcatctctgttttcacagatgaggaaaacaaatcccagagaatttaagcaacttgcccaagttcccacagcagagtcagtgcctaaacccgcagctatctgaccctacagcccacatcttcctactctttctcattg

SEQ ID NO: 40142 - DNA, 3120 bp, Bovine  19866881128078
atgatttttaatcaagacctcccaatggtcttgattaaatccgtgttgtgatgaaaagtttctgttttttagaaaagtttggagcagacccattttttagaaaaactctgggctgttgtattggaaatatattagaaggcacaagcatgggctcagggaggccgtgaggagggccctcctcctctccaggggagacaggaatggctgggactaggttggaggttatgtgcacagcaaaacaggatggattgagggaagctgaatttgggagaaccaacgggacctgaggattattggcttggagagaggaggcactgagagaaaagggggcccagctgactgcagggtttctgatggggtctcctcctggtgcagtgggtaggttggccaggcttgagagcagggctacagtgcccgtcaggccaggctccctggaggtgggtttttctcggtgtttatctttctccatctctgtagtctggcctctccttactgttttgaaacacagttccgtgggatctgatgggatgtgtgtttctgaattgaaggggtttggttttagttgaggtagcagcactcccactcttaacaaccctcctgcaaagtgaagtggaaccagatgtctaactagttcctggcaccaaaaagcttatttaaaactggatcaagggccagagtgatttgggtgtgggatgggaggttttgaagtgttggccacatgagctgatgtttagaaatcatcttgtcaaatggcgttgaactacttaagagaaaggcttccctcctactcttatctttgttttgactggagcggcagcagggggcggcagggacgcaacaggctacattcatggaaacatggaaccagtgctgatgtgggcggtctgagtgggtctggatagggacaggtcagggtgccctttctaagagtgggtggggaacagtccctcactggaggagtgtgtgactgcctctgagggacatggaggagggcattccagaccagggcagtgtaagctagatcagggtcttcaaacagtggcatgggacgccccagtgcatacactgatcttggcttttattttctgttttgtaatgctttgacatcttgggacctcactggctttggagagactgcccctcctggagttaaccagttcctggagataataactcgcttggttcctgggtgtgcactattaaaatgcaaaccaaccaatctagagctcataccctaaaccacctgctttatgaggctgttgctggagaagactcttgagagtcctttggacagcaaggagatcaaatcagtcaatcctaaaggacatcaaccctgaatattcattggaaggactgatgctgaagatgaagaagctccaatactttggccacctgatgtgaacagctgacccattggaaaagaccctgatgctggaaaagattgaaggcaggaggagaacagagtgacagaggatgaggtggttggatagcatcatcgacttaatggacatgagtttgagcaaactctgggagatagtgatggacagggaagactggaatgctgcagtccatggggttgcaaacagtgggacacgattgaacaactgaacggcaacactgcagaccactatccaccaacatgaatcatcccagtgtcggtacaagacaccagcctttcacattcttcttactgcaaagtggggtctatgtccccttctctcaaatctgggcttggttcgggacagttttgaccaatagtttggcccatatcccagctcactgtccactttctaataagtgacaatatagggccttcatttttaaggccagagtgggtgattgtgtggatacccaaagtgataataatagtcactatgtatcatgtttatgtgtataatgtgccaaatatgctgttcccatgataatcacatttcttgtgattacttgcaaagtagctttcaccatccctattttacagctaaagaaactgagattcagagaggttagtcacttggttagggtcacacagctaacaagtggtagaggtggcattcagagctaagttttcatgccttcattcatccaaccaatacttattgagtccttagggtgtatactccaggcatcattgtggcactggaatatcacagtgaacaggcagataaagactctgcccttcaattctagtggaggagggagacaacaaactaaggagatgtgtcaaaaaattggcagagtattttctgatctacataagcccagtgaaggagatgaatgagagtgaagtgatagagagttgggaggagcgaggtgggcaaaagatgggtccaccactaaaatccttgattcatcttctctggaagctggactatgtctggattgttgttgttcagtagctaagtcatatccaactcattatgaccccatggactatagcccaccaggctccttctgtctatgggattacccaaacaagaatattggagtgggttgccatttcctcctccagaggatcttcccacccagggatcaaacctgagtctcctgcattgcaggtgggttctttgagccaccagggaagccacgtttgggttatgcatacagacttacaagctggggatgggatttgctgtcatagacactgtaagatctactaaaaatgggcaccactgctagacaaaagagaggatcagatctgggagaatagatgttggactcagaatcagtagacctggtttctggtcataactttgctgttgatttgctgtgcaacttttggcaaggtactcagcctctctgaacctcatctctgcaattgtgcctgtcatctcctggtgagggggatcatatgagaaaagctgccctacacccctaagttgccctaaggttctgagaccctctcttgccctctactgtctttttgaattgaccagagtctagtttcataggagactgggggaaagcaggccatggagagtgaattccacttcttttttctcttgtctgtccagagcctcactcctcccattctcctgtcctggtggcatagaggacgtgggggacgcgctctctgctacgactgatagcagttgatattaagctgcccctttgtcacggcag

SEQ ID NO: 40143 - DNA, 944 bp, Bovine  19866881134681
aagtgacaagctccctcgaattctccctctcagtgagcatccaagaaccatgcagactcgatggatttgatttttattggcaaatcccaaggttggcagcgtggcagtttaaatttctttttgtgtttttgctttctctcctcagttgtctctcacttgtgagtctgacatcacatgcataaaaatatagtcaattttacttatttatatctttgcccacacatgtcagtactctctatgtgataattctctacctatggcatcagctgctgaggaaaattgacttgaaatgcctgatcttagttgatatcctcagcaacaggcaaaggaagggaagagggagcaagagcaaggaccgaccacattgagctgctagtttcatgaccccttgagaacaaaaaaagaggtaatattcattcagatatatttcagctgttaggcatgcttgttgccactttaactttgtagaaatttggaaatgctgtcaattagtctcacgggatattagagcagaaccttttaaataggaatataatttgaaactttaaaatttactagtagttgttggaactctgcattggggaaatgtgttgctaatgtcttgatggtctgtgaaccatttatcctcagcaaaagcctaatcggaagagcccattcagttttgtggattagaaaatgtatatttcattgcaacatctcaaatccagatggcatggtggccatatggcctgtttgctatgctgttccatttgtctgctagcttgtgatttttttatattagttgatttcatttttctttgaagatagaatgcattgtttgtgagctagagctaaccagtaccagcccaggcaagggcttctaaccctttggttacttaggtttgggtaccataatttcatgattcattgtaggaaatactggacattttaagcatacttttcaa

SEQ ID NO: 40144 - DNA, 1054 bp, Bovine  19866881188231
cttctgagggcaccaaggacctacactggaaggctccccctgactgcaatgggaaggacaaattgggagaggggagcctgggtgacagtgaaggtcaggggctatcacagaagtctactattactggaatctgagagtatgccaatttactgtaaagtttgaaaactattaagatacagagattgatgaaagagaatgaggaaaagaaatcaagcatgactactggatcctggctcaggtgattgaagggtcagggtggcatgcaccagggcatgaggaggaagacctggaaggcactacttaaggaagggcacaggaagcagaacctggagaaaacagctgaagagtgagcaagagaggatgaaggaaaacaagccaaaaacccaaggaaaggtgaagggtgaaggatctaggttagacaccaagaatttacttccaactgagtcctgagtacttgaacccaagcttggatgtctaaaacatagagcttttccttgcaattcaaaaagtccttcctttcagtcctattttttccaagttcttcatgttccaagatttcacatttcactaccccactcatttagtacgtttaattaatttctcaatatttttgtgtatgcattactgctttctgcacacatagacatactaggatgaaggaggaggttctgctgattggtatttgtaatgtgctgagactgatgaatgaactcatacacacaccgtcaccatcaccaataataataacaacctctgttactaagtgagagtctcacctcctgtttattgagcatctattatggacgaggtcttcaattatgaattttataaacatggccaataaacagagtagaaataacatttctcttttatagagggaacaagtaagacttcgagaagttaagtgattggctgaagatcacagagtaaataataaaaagtagtgggacatatgtgtactatccaccaagggtatgaaccctttaaaaatgtttgtgtgcctaaatgactgacttccttgatttccttgttatgatttgtggggagaggagga

SEQ ID NO: 40145 - DNA, 1613 bp, Bovine  19866881300971
tttgtttttacctatttttggccgcattgatctttgttgctgtgcaggcttctctagttgtggcagacaggggctactctctagtgtgcgtgggctttcactgctgtggcttctcctgttgtggagcacagactaggataggcgggcttcagtagttgtggctcctgagctctagcatataggctcagtagttgtggccactgggcttatttgttcccaggcatgtagtatcttcatggactggggtcgaacctgtgtcccctgcattggcagacagattcttagcccctggaccaccaaagaagtccctcactttgatatttaaatggctcccaaaaagcttataggcagggtgtgctctgcttaggggggacccccacctgcctgtggggctacttgtgggagtcctgcaagttggggctgccccgtctagcacaactcacagaattcccattagcatcagacttttactgaaaaggaacatcccgtggctaatgaaggtgtgatcttgaggttgagcagaatcaggaaagagccttggaaattagtcaaactcaagcttgaacacctgaggagttatttaccaactggaaccccaggcaaggggcttcgcaggtggctcagcagtaaagaatccacctgccagtgcaggagatgcaggtttgagccctgggtgggggagaaaccctgaaggaaatggcaacccactccagtgttcttacctggagaatcccatggacagaggagcctggtgggctatagtctatggggtcacaaaagagttggatgtgacttagtgactaaacagcaacaaccctggacaagtcccccaagctcttgaaatttcagtttttccatctctgaaatgaagatacactaccaccttccttagaggtctgttaacattaaacacagtaatatgtaaacaggtgcccagtgaaatattagttctcttttccctcctgtttgttcacttcagagtacaggttctgcaccagcatgtggacatcccctctatatcaggaaaactcccttcatgtttccattgaaatggaaggaagcaggatgcaggaatccatgacaccgataactaccgtccacagcttccctcaccaggttagtcaacagtgagctggtccctagggaagcaggagagaatgcttgctggtcattgtcattctgagaaattgtttggcaggaggcttggccaggttgggctgtggtgtcatccagggagggaacctcaggtgaggtgccacaggacggcatgaggacaccagagggaaggaaggatgtgggaagcaggagatgggttttgtcagcatcttattcttgcctggggatgacggctctgtcctcatactttatagtgtcacaaccatgagagcgcactttccggaagaaggagtacgttttaattagccgcatgacacctgatctctaacctatcagtccatttctcccggcctcatcttttcagattatttttgcctgtgtccgccacttgcctgtgcctttcatgtgtatccaggaaatcaccaaacagcctgggaatcctattaccagacctcaggacattcattgtcgagttctccccaacggttacacaagtg

SEQ ID NO: 40146 - DNA, 1950 bp, Bovine  19866881552491
cccaagacattcttccatgcgcttcaatttaaagactagcaattgtctttcttcaactatttgaaaagcactagagctgggttagagggagacggtaaaaaataataataaatctaacaacctccagtctttgcactaaggactttaagcagttaagaggcctgttacaattttttgcaatcaagagtcaaatgtttgaaaaaatgccaaaacttgttagtgcttgttcctctataaatacacagagcaaaacagtcatcaaaaagaaaatgttagggtaccaacccctctgcccctctcacatcgggctaatgccaaatgggctgggatttccaggacactcttgtggcatctgagtccccaggttccccctcctatcctgagccagttgtcacctcactcagttgacaatcctcaaagaactgagataccttcaggtccctaggttctcatctcaggctcatatttaaaagcacagtcactggggttgtgcgtatctggagaatgacctgagttctttgtgaagaattagggttggaattttttttctagtagcaaatattgaacttcaataacaatcaccttatcagcaacatctgaaaaagcagcagtaaacaatgagtatctttgtgtaaatctgtatgttcttctttcaaatttgcctaaagcaagatacacacatcttacttcaggaagcttgatgttcaaggcccgcccccaactcaaggctagatattttcaggctcatggttggcatttctccaagtagaagccacctgctaaccctgcccagcatgcactcttcccaaatccactatccagtctcctgccttggtgctctttttctgctcctgcccagctcctaagaaccttctactatttctatctctatttgtcaagactctacttgttcactgaagcaatgtttaaaggagaccatctttttcaagttccctggtatgcctggtcacaagtgatcaggccctcttcctccattcccttgtctgctggtacactcagcatgtgaggcttttgtgggaagcacctggtcacgtgtccatctgttctcccagactatgagctacacgaggccaaggctgatgttttgttcatgatatcccagcatctggcatagggcctgacccacagcagggtcagctgactgaatctgaatcctactcttggtcctccttctgcctgataggaccctagggaggaggcatctattttctatttcaccctgacatctcaaaatctttccttccaagttaagcccttttggtttcttcaacctctcctgccacatcgtttctagtggagtaggggatacaggcaggcctggattcaaattctaacttcctagtcacttagtcggtgtagatttaacaggactttagctggtctgtgtgggagcttccttaactatgaaatgactcccaacacttcagagggatgcttagaagaccatgaggatgagcacaggtaaggcacccagtagggtgccaggaggctcctagcacatgtgtctccccacttggggactcctggtcaacaaatgtccccctgaaggagcctggcgcctccaagttgaccagggaatgggtaggacagttgtgctttcatctcccttaatgtctgcatttcactggttagtgaaatgcatttcagtggttagtaagtcctattagctcagggtgaacttgagattttcatcaaatgatgcctataaatggtagagaaatagagttccttaaatagtagcactagatgatgacttttgagccaaggcactgatgattctaatgaataacaaatacgaggggtcaatgtctatgttgtagacatcccaaactgaccatgcaggatggttacaaccacttattctgaagagcagcagatgtgggctccaatacagactctgaaagtgatgagctgtgtagacccaatcaa

SEQ ID NO: 40147 - DNA, 1551 bp, Bovine  19866881997912
cctgtgcttcttccagcccagcatttctcatatgtactctgcatagaagttaaataagcagggtgacaatatagggccttgacgtactccttttcctatttggaaccagtctgttgttccatgtccagttctaactgttgcttcctgatctgcatataggtttctcaagaggcaggtcagggggtctgttattcccatctctttcaaaattttccacagtttattgtgatccacacagtctaaggctttgatatagtcaataaagaagaaatagatgtttttctggaagtctcttgttttttcgatgatccagcagatgttggcaatttgatctttattgagtgcttacaatgtgctggatgctattacaaacaactttggtgcagatctcatttaatccttgtaacaactcatgaaatagatttttaatattatttacacttagcacatgaagaaatgaaggcataaagaagtttaagtaacttgctcagtatcatagtgacaggaaatgatagaaccaggttctgtctacagctcgggttcttaccacagagctttggggaatatgacagatagtgagctgtgtacacagagctgaccagagtcccaggtgcagggtaaatgagagattgttcttgctcttactcttgagttatgaagacttggctttaagtactaaggttaagggcccagggaggggggcctacagccacaaatcgactcataaatctctaatcttcaagagcccaaggaaacagcttctgcatttgtgaaccatttctggaagtccgctggaggctgcctgttcattgcttgttagtgaggggctgttcagtgtctgggtatagatagccaccgtaagagtgtggtctggaaaaaagtgttagctactttccattttacagactgaacaactaactgggtgttttttaaaagaagttctgatgttgctgtggatgcctgtggtctgagctgtcagtggctacccacatcactggccagtcaccctcaggcccattctgggagcgtctgtgtgctatttcatggctctgttcttcttttgctacaaacactgcctctgtcacatctgagcaggctctgtggtgccctgacacactggttttcatgcatgtttttgtgattatttctccttccccaacctttccctgagaacatgtgtgcccatgttgacttttgctcatcttctgcttcttttggcctattgctttcattaataaactcttacgcatttttattttcttcttttacttcttctcttagagaaagggtggaggaggagccacctgccttaccgttctccatgtttcgctctgcccttaggaggcatggctcatccaacaccagtggagttgtggacctgggacacactcaaattgggtttcaatgaggctgaatactgtgactggagtttaaacaagatctttagtttaatcctctatctcagaaagcaccgttccaaaagcattttgtccatacaagatcccttaagatgtcactcccacctactcaccaggagagagaaggcaaacg

SEQ ID NO: 40148 - DNA, 891 bp, Bovine  19866882116018
atgattttactatctcaaatattcttgaaacttttaaggtttcttgactatgagataagtcacatttgcaagttcttttcagagtcggggatagacttcatctgggtctagacaccgaacatcacctacaaggtctagaagctctcttagtaattccatcacatacactggctcatattgcatttcctatccatgtttaatctgtattttccaagcaaccacaatgactgagacagatctaataggtgggtcatcctaatatctcctttggaacacagtgaaaactgctacctctgcctgatatgttcccctttccctggcccagccccttgtgtcctggctaattcacagtcatcattccagaggcatcacacgtgacctaccatctatcttagcaacttctttaactcctcagtctgtgctagaggcttctctctggaatcatataagcacccatttcttgcctgcagtatggtatttacaattcgtactgtactcatccttctcttgtttgtattgtcagctgaactgcatgcagtttgaggacagggaccagttcttatgcactgtgttgtatgcttagcatgtagcatatgacatatgtcacatatgtctggaaattggtttttggattaacactgaagtgttagaagttgggtggcagttgaagttgagtaagacagaaaaataatgttgagtgcagagatagatgtttacaattccagaaagaggacagaaatatctgaggttcattttcattgactgtaaactctgaaaagtctgtatcagtgtagaatcaagctgatttaaaaggtccaggaaataagcacaggtgtgcctgatgacttagtcacagatgttaacctcattattactttgaatattaaatag

SEQ ID NO: 40149 - DNA, 1276 bp, Bovine  19866880833499
tcgccagatattttaggcacgcacatccctgactgtactcttgtagatgactgtggggatattgaccccgtttgtgggaatttatggcacttagcacatcccatgcttccaggaaatgcatgttaattatggagaatgaaggaggatgtttctcctgctgactgttttgtctgcagaatgaaacaggtggcgtattcagagccgtctatacatacaatagtcttatctcgcttaacaaagataaccctcattaagtaaatgactcctttgtttaaggtttaaggcctaactacgggagacgtttcttctgttttgcctctaacttttaaaactgagaaatgggaggaggaaaagtttaaaaaatagggtgggaaatcccgtgacatcaaagtgaagctaagcgttcctaaatggaactcatcatacaattttcgtatttgagtgtcagaaggaaaagctataatctgctttatcattctttttatgtcatgcaaagcaaacactttttctaaatgatgctcaacacggactttaaaagttttttctttttttttttttcacatcattcaaactggtagaagctttctttaatgcccaggccaaatcaaaaatgacttaatggccagaccaaattggtcgttcaatttcaagatctaccaaaacaaattgactgtgtctttttatccagatcgtcagatagagacctattaggatggccgatccacttcttaaaaaaaaaaaaaaacttaatttcagctttgtgtgagctctaacttacccagaagcagattcaactgcctttatccgcaggttttctttcttttttttttttttttttgcaggttttcttaaataaacccacagtacagcctttcacgaccatgcttccatggactgtatatggatttatttgggaattaagcacttgactcttttagcccatggtttacccagaagactcttttgagtgtgaaatgggactgtaagagaccatttgctgtctcttccttcgtttccatatctcaagggaagacactcttccattggctatagtaagctaaatatttgtttatctcaataggaaaaggtcccatgaaaattcatagagcaatgtggccaaccctcgtctgatttgcaaacattaaaatgaagctgaaatggtgggaaagggatctttagggagtttgggatggacatggacacactgctgtatttaacatggagaaccaacaaggacctgctggacagcacagggaactctgctcagtgtcatgtg

SEQ ID NO: 40150 - DNA, 856 bp, Bovine  19866880270549
agtcatccgtcctcattcagtatcctctaccagaaggcatttctgccaaacaagtaaacgtggatgtgggcagtgttcttttcactactgggctgtccatgaagtagaaaaagttcttagaggaaaattagggttgtattgcggagaaggcaatggcaccccaaccccagactcttgcctggaaaatcccatggacggagaagcctggtaaactgcagtccatggggtcactaagagtcagacatgacttagcgacttcactttcatttttcactttcatgcattggagaaggaaatggcaacccactccagtgttcttgcctggaaaatcccagggacgggggagcctggtgggccgccgtctatggggtcgcacagagtcagacatgactgaagtgacttagcagcagtaccagggttgtattgaggtccataaaccttttcttaaaacaactcaccacagtctttcttgaggaatttccatgtgtgctgttgactgtaagtgtggtggtgtttcccaggtactttgccactaaatcttcaaaagagggtgcggcatcactcggatctatcagccacgcagcgattctgggatccagccctacaaagccagcaactgcagagagagaggtcagtcagtcattctatggaaaacaagtactttgccctgccatggaacaatggactgactcagaattgggaaagcagtatgacaaggctgcatgctgtcaccctgcctatttaacttacatgcagagtacatgcaggctggatgaagcacaagctggaatcaagactgctgggagaaatatcaataacctcagatatgcagatgataccacccttatggcagaca

SEQ ID NO: 40151 - DNA, 1150 bp, Bovine  19866880415485
cagggccagccttcccttggcgagatctgcaggcggccggcagggaggccagcctggctttgtcactatgtcctctctggagggctctgttactgctcctgaggatgtagaaagcccgtcgtctgtgggggtctgcggtggacgtctccctgaaggtcctgcctgggatcccgcttcccctggccctccccgcaacgggcagctggctgctctgtggttgcccctgggccttggggtctgactgtcgagctccaatcccccgctgagctgcaggtccctctgggtccctcgagccctgttgtcttgttgcccggggccttggaagcctttcccacggccacttggctgagagggacaagggacggtcccatgtccccacaggctctgccatctgggcatggtgggctgtgcgctggggcctgccctctctctctgggcgtcaaagacaattccctgaccctcacgtggggcgcgggggcagtggtcgcccctacccgctttcacagatgggaggatggggcatggtgtccagggggtgagctgacctgagctgcaggtggctctcccaccctctgccagacctgccctgtcccgctgggaaaaggggcctctctgctcctcagctcctcagaggggcacctggcaggaggcggcctgctgtctccgtggacagggaatctggacggtgggacgggtggcccacggcagagaggccaggccttgcccctcttcccaggcgggggcactcgggggtcctgggggtcccgggagaggatgcctgtctcccgggcctgggggctgcgccccgccaggcaccaggcttctcgccgcccacaggagacaggccgtcagcgctgccccctcgacttttttctcctccccaattaattaatttaaattgaccattaagtcagccgagtttttgattgatattttcattagcagccctgtccgacgccccaggaatgtatggtaatgtccgatctgcggccgcgctccccccgccgcgctgagttatggctggcaccgcgcgtctcccagggtaatttgaattcagatgagctgccgcagtgttccggagcctggcggccgccgctgacggatggcactcgggttatcacaaggtcaccggcacagccgccgcccgccg

SEQ ID NO: 40152 - DNA, 1846 bp, Bovine  19866880415812
ccgtccgcccccagtgggcgtggcctgctgcgccccgggcccgggctgcccacggccgctttgctccgtgcatgccgaggatgtggcctggctgcagcatgccgcatgcccgcagccccccgcccccgccctgcccagactggacctagactggtgagcgccccggcccgtgccccgctctctggagccctgctgtccacctcgcccctcgcttcccctagtccagctctgcttcgacgttgatcaccccctctttcctttcggtacctgcccctcctccgcccggactttgctgattggcgtcgtcatccaggtgtggttcccatagcgacgtgtggtccagccgcggtcagggccctccaggagggcaaggtggaggcggccgtgggggcccccgctcccccagggccagctcgatcgggcgtggtggctgctcccggacctccctgggaactttctgccccacagcggccgggctctgtcctgtgaatcttgaccaacccaggctgacgcccgcaccaccaagcccgtagcttctcccagcctgaagccgacctattttttaataagttatttagacagaatagcactctgcatgactttaactcttgggacaaaacggtagttgatacctacacacgcacacacacacacacctgtgtggtctagaatctgcactacttccggcccagtttggtaggggtgggtgccgggggatggagggacaccctgactgaacgtcgtttctgcccggagggcactcctgggcgggtgcaggcgggagaagcttgtcagcagcgtccaatgtaggagcggggcgccttccaagtgcccactcgctgccccaggtcacaggcaggggcttttgggagtgggtggcccagagtcggggaggaaggtggtggctggaggggcatagaggcccgcagaggcccctcgctttggggggggcgtggcaggccgcgtgggccacggacctgggcgccacgtgcagggccctggagggcgcgtcgttagaggcgctttgagtcggccacgcctggccacccgaggggccctgggtactgtgagcagctgagataacctgcggaacattgtacagaccccgcgctgccctgtacattctccctggtggcgcccggccccccgtcgggggtgggagttttgtagactgtacagaaatcggccccctattttcttgcagctctcagattttgttaatctggataatacagacagacgtaaagtgttttagcaaaacggaaaacaaagctgtgcctttttcctctttctgtttggtttggtgtcggttcggggcggccttaggtggcgaggggcgcggcggggctgtggctggcctggggcctggcgggttgtgttcttgtctggtggtggctctgggatgctgcggcttcctccggccctgtgcctgtggggcccgtccccggcgggggtgcgagggcagagggccctcggcatctgttggtgtggactggagcgcctgaagggggtcctcctggcaggggtgtggcccctcctgtcccctgatgtctgttcctgctgcgtggcccctgccccacccctgcagatgggccagggggtgctgggcacaggctggccctcatcatcccctcgtgccctttgttgctgccaggatggactccaggaggggtgtggcaggggggccacgtgtccgcaatgctcttgtccagccgccgcccggccctgaggtgggcagaggtgcctgtgtgccccaggctgggtgcgtgctgagcccgggttagacccctgcctggccagcgtgtggcctgggctcctggggccaggtctcccagcttccccccag

SEQ ID NO: 40153 - DNA, 1082 bp, Bovine  19866880628009
tgagggcccttcccccaggacagcggaaaagagaagggcaattcttggagcagtgatgggatggccggcctccgctcgagtgcagtcccgtgtcctcctgactcgtctgccccgctgctggtctggctggacctgcaggcttgtcggtgtcttcagcgggtccgtctcgcccccatcagcgcatgcctctaggtggtggggtgacgcccgacctcttccctcccctgccgctcgctcaccagcgctcggtctctcctcgtggtgctggcctgccctccgtgagccagagaaacaggactggtttgggggtctcccatccgagcagccacgggagaccacggtttccagtgcgacactgctatccgcgcagggcagagccttgggggagcgctggccgcaccgcaggggccccgtgacgcccgagttgtgccttgcaggaccgcatcatcgacgccggccccaaggggaactactcccggttcatgaaccacagctgccagcccaactgcgagaccctcaagtggacagtgaatggggacacgcgcgtgggcctgttcgccgtgtgtgacatccccgcaggtacgctgcactcggggcagcactctgacgacccgtcccaggctgcggcgggtcaggagggcggggtggtggggcaggtgtgtcttgctgggagcgtccccttcacagagggggctgggaggctccggggctgtctgcgcggccacggggctctcggcggggaggacgggaggctgcgcccccagtgccgtgtcccctcgcagggacagagctgaccttcaactacaacctcgactgtctgggcaacgagaagacggtgtgtcgctgcggagcctccaactgcagcggcttcctcggtgacaggccgaaggcgagtgagggcgggaacggggtctgcgggacgcggtgaggctgcctcggggcatcacgggggctcatggtctgggtccacgagccgaggccgagtgcagtcagggtgggtctgtgcccgggcctggtgcccgcgcctgtgtctgcagtgtcccgtgtctgcggacccacctccccgggcctcatcccagctg

SEQ ID NO: 40154 - DNA, 1305 bp, Bovine  19866880733827
caggaggaacggaacgaagaccctaccagcccctgctgcaccaacacacaaacacacttttaaaagctcctacaagacaatgaaaaaaccacaatggggaaaacaacgtttggacagacaattcacaaaaaagaacactgaacccacacgggaaaaggtgctccagcacacgcgcactaaggggacggaacgcgatccggcggtgagaactaaaccgcggaagcagacagacacacccacacccctcactcaaaacacccgactccacaccgtgacgtccagctcaaagcaggggaaacccaactggacggctggaaaaggcacagccaaccgacacgtcgcaaagcggggcggggaagcggtcccctcccaaggcagcgcgcggaggggcggggggctccggacgcagccttcctctgctccttaagcagcgtgagggggacaggcgggttgccgtgtggctcggtcaaccgaccaacgtgcgctcctgtgcacggtggatgctgaggctccgatactgtggccacctaacgcgaagacctgactcacggggaaagaccctgatgctgggagggattgggggcaggaggagaggggacgacagaggacgagacggctggatggcatcagctacgagtctgagtaaactggtggtgcacggggaggcctggggtgctgcagtccatggggtcgcgaagagtcggacacgcctgagcgactgaactgacggacgcggcagacgtcccgtacacgccggggcaggaaaccaccgcgaactgcgggagcggagaggcgccgagacgggagccggagggcgtgtgaacgaggccagtgctcaccgttttgaaaaactccgtattttgcgcaaaaagtgacataatgtaccgttaaggaggagaaaaaaagaaaaaaaaaaggacagacccactgaggagaacgaagcgaaaaacgcgagcgcgtggcaagaccccggagggccaggtgacccaaccgggcggagaccccagaagctgagggacggaggccggcggccgagcccctccagcgcggggagggccgaggagggggcgcggcccgggcggcagggggtacgaggggcgcgagcggaggggagaggcggctgcgcgcgagggggccgcgagcgccggggtctcgcgtccgcaccgccgcccgcctcacctcgtccaccgtgcggcgcgggaggtgcagcgtcccgagcagcaacttgagcttcacggccgacgagaggccgtggaagcagaggcggatgttgtcgatgaccgcggccgtgagcagggacgcgat

SEQ ID NO: 40155 - DNA, 587 bp, Bovine  19866880741736
actcttggggcctatggggccctccagggttgccccggctgcctctgagatcttgcctgagggcagacccagccaccacctcctcgggcccaaagctctgctcctgcgtgtccctgggcccccaccgcgtgcctgggccccagatggctcgggaccagcttcggtcctggcgtggggcccgtgcagcgttagggggcaccctgagctgtgggaggcccgagacagaggctccccgattcctggcccctagagggatgatgctgagtccaggagcattgcctgtgctagccgagggaggtgtggaccagccctgaccccctcgcctctgggaaaggcaggagacaggggagacaccccctccaggggcccccacccccctggccaggacaaggacaggcctggccagatcctgtgactctggagaaaccgcacggagcctggggtttgcagcgggaaacccgatcgagtaatgacagggttggcgtgggggtgactggccgagggagccgctccaccgtgggcctgtccgcagcgaggacccctgggccctcctcttcccacagatgcagacgccggctgcccggcgc

SEQ ID NO: 40156 - DNA, 821 bp, Bovine  19866880750788
gcctcaaaatcctgacttcaggtttggaaaatgtggttgctcccagatgagcaataaaagagcggtgctgtctgtggacaggagagtgacggtgggcgggcggggttgtggcgtgggttctcctgagtgccatgccagctagggggaggggccagggaggtctaccccccaacccctcactggagcctggcacagagggctgcctcaaagcgcacaagggcaggaggtgctggctgggggagagtctggccggggagggccagcacggtgcgccggtggcccccaggggggtgggctggggaaggagggcggtggagaaggaccacagctggccagggaggggttaaggcctccacagctcccggggctggcgggggccaggccggtagccgctgagcagctcagaaatctattttcctaagcgcttggcatttgcctgaaacctcaagtgtattttccctaagttttattttttctttgaccccaaactctggtaaatttaagggaaatttaattatggtgttttgggtccatttacacttaaaccttctcagcattttttccaggacccttttggagttcagcacgtcttgggagccttctaaatgagcgtttttattattattattttttgaaaaggttttactccccctgcccccaccccccaggaccagccttcctgccaagaataaacaaggctgactccacaggctccggctgaattaggaatccatccccggccgccaggccagccccacagcatgtcacgccctcctccgtccgccaggcagccttcgccctccgagcaatgccccttcccc

SEQ ID NO: 40157 - DNA, 994 bp, Bovine  19866880833512
tgccagcccatggtcaggggccagctttgggaagatcactgttgcatgccgtgaggacagtgggctggtgcatagggtggacagagtgtgccaaccggggccctgttcaaggacggtcttcctatccagcctcagctccagagagccacctcatcgctggtctcccccgtcccaggggcagccactcgcggtgtccagctgaaagggattacaggattgttcatccttccgttcaagagccatgtggtgaggtcctactgtgtgctgcccccttgcagcgtgctggggagcctgagcggccagaaaagacaccccctcccccatctggcactaccaggactcacctccggcctccaggagcccctggaaggtgtttgctaggtgctggcccgttcacatttgcactttgccgtatctctaggctgtagggagaagactagttgcctctctggctctggaatccctatggggcacaagcctgaaaactgcttgcctcctcagtagctttaaatcacggcagtacaagacagataccaccacatctcttttgatttcacagatttggaattagggctcctcttaaaaaaaaattgcatttagaatagtgcgatcaacatgtaaatttattcaaaacatggaagcgcgtgtttggattttcttgaaagttatttggggctggctgatcttttcccgcccagcgcaggcctccctgggccagccctgctgtcttgtgggggtcccgagcccttttcatcgaatctggccagctggacagccccagccctgcacactctggggcctctgccgtggagagtgtatttcccacaattgggtctccatccgtgcagaggagaaagaggccctcacaggactgacaggtaggcttctggttggggaggcccaaggcagtgggagccccaagcccagtgggcccagagggctgcggggcactcaaaggacgtcagcagctggggctgaagcttgttttcggcct

SEQ ID NO: 40158 - DNA, 1261 bp, Bovine  19866880866239
ccccgcccatgttgggaggcgtccaccaagtggggtgggagatgtcagcacggggggcggccctgggccaacgcaggcgtgtgaccacgcaggtggaggccacgcagaaggagaacgaggtgctgcggggcaagtgcgcggcgctgcaggagaggctcctggagatggggtgagtgcagccgccctgctgtgcgcgcgcgtgcacgtgggactcggctcacgcacctgctctcctcccacaggaagatcatggacagctttgaggggactgtctaccaggtgatgggtgagtgccagtccccgcccccggcatcgggggcaggggtggcgaggcagcgggcaggttgggtcccttcctgatgctgcggtgtccaccctgctctgggggctgtgcgtcccctggcggcctctgtggatgttgggcactagccgtgtccgggctggaagccccgagtgtgggacaggtctgggcttactgccagctgcctcggtttctgggcggagctggtattgaggagacagctgttttctgggcgtttggagccccaagggtctgccctgggaggtcccgagagacgcagacaccctgacgcccaccgatccgaggtgctggtctctcctccagaggagtctcagaaacagaaggagctcaccaaggccgaaatgcagaaggtcctgaaggagaaggcacagctgacggccgacctgcactccatggaaaagtcgttctccgaccttttcaagcggtttgagaaacagaaggaggtgatcgaaggctaccgcacggtgggtgctgggccagcctggggccgggggaggggcggggccctgcaggaggaggagctgagcacagccctggtacggagcctggcaagagggagaggcaggcccgcaggtggggccagcctcagccctgcctgtgcctgcaccctgggctcttggcttgtcacctgcaactggacacgggtgcccgcgaggcgtccgtgtgggcctgcgtggagactacgggtctgtgctggtcgctgcactgttccccaccgccagacggcagggcacccggctgccagagcccggggctcagggaacaggacaggctgttccgtgggcctggtgcctgacctaggttcccccacagtacctggacagaacccccgtggcagggccctgaggggcggacaggcctgggctgtctgcagggaaacaggcggactgctccacgaacccccaaagagctgggcctcagctcggggctcagcgtcca

SEQ ID NO: 40159 - DNA, 2020 bp, Bovine  19866881006232
agcctggtaggctgcagtccatggggtctcagagagtcggacacgattgagcgacttcactttcacttttcactttcatgcattggagaaggaaatggcaacccactccagtgttcttgcctggagaatcccaaggacggcagagcctggtggctgctgtctatggggtcacacagagtcggacatgactgaggtgacttagcagcagcagcagcagcagcaatgcatatatacagaatctagaaaaatggtactgaaaaatttatttgcagggcagcaatggagaaacagacatagagaacagagttctggacatgggaagaggggaggagagggtgagatgtacggagagagcaacatggaaacttaattaccatatgtaaaacagatagccaatgggaatttgctatatgtctcaggaaactcaaacaggggctctgtatcaacagagaggggtgggatgggagggagatggggggcagtttcaaaaggaaggggatatatgtaaacctatggctgattcatgttgaggtttgacagaaaacaacaaaattctgtaaagcaattattaaaaaataaataaaatttttttaaaaaaaggttaccaggaataagtgccacaaagcaaattctcaaggtataaaaagcactggtactctgaacatgtaagaaataaaccaaattgatataatactcaaaattcatgaaatgaaatggttcatcgacctcagacttaaaattttcataatgtttattatctgtattcttctcctaaatatgtaaagcacatgcagtgaagatttcatttttggcaattttcagtcttcaaaaccaatggtcttaatctttgattggttttctaagttctccacaatatttttcagataatcttcatcttttaaaaaatatacatataattctctttccacttgatgcagcttattagatgccaaaagttttctttttgtcttcacatcagcaaaaatatcagtaagaagatgattcagtttatttagctgagattcaacttgatgaaactgctccgttaactcctaaaaggaaaataataatgctttttaattcaaaatctctattcataataccaatcataaatcttaaatgtaatttacataggaagaatctaaatgatataatgattattcccacaacctcaaccataaaagacctcaattaaaaatccatagcaggattaacaaaaagtctatgtaagatccattgaaacaacttctgcaggcaagtttaagtgattcaaagcaaactcctactccctgaagagtatttgatatgcaaactgttctgcatatttatacgttcaacaagtattctgaatgcctacctcataccatgcactgttttagagtctacaactataaaaatgaacaccaaaaaaaaaaaaaaagaacaccatttccttcatggaacttaacactctgccaaagtaatcaaaccttgttttagcctaacctgtttactccagacatcagaggtactgataaaaccttgaaatgaagcaattaccaatataaagtaattgtcttaatctggatttttcttttttcacactgttacagaagatggaattacacgtaacattcaactatcctgatttaccatgtaattcttctcaaaaacctaaacattctggaccccccacacttgataactgaaattcctcacttcttaacattaaaagcagcttaggttttctaaccatcagccagtagtatcaaagaggttctcagacaatctgtagctataactacacctcaaccttcgaccacttctcagaatgatccacagtatggtaatcacctgatgcttgctgtgaatagattcctatacctcactccacactaaatcactctgcaacaaagccagaagccacatttcaacaggctccctggcgattttaatgtacaagttcaagagtactagcttggtcatacacatgtcataaatgccagctccaaagagcagtacttcttaaactacagtaaaa

SEQ ID NO: 40160 - DNA, 1126 bp, Bovine  19866881050795
gtctccccttggggtggggtcttttgcactgctgctggctgggcgggccaagagtccttcaggctcccaggcactcagctgtggatgggcggtcaaccgggccgaatgagtgaaagcgcctggctgggtcccagtgaaatcgtacgcactgacactgaccttcacagcgttttctcgtctcaggaaatgttgtttttctgtttgtcttcatgaaagtagttaaaacctctcccctgtgggctatccagcaacaggcaggggccaggtttggcacatgggcagtgctcgtctgccctgggggaagggcaaatggctctggaaatgcctgcgtccctgccactgcggctgtgtctccaggtcttcagaagagcagcttggccacgcctaccacctgctgatggcacagctgagccaggagcacgcggagatccgcctgtccgccttccaggtcctggaccagctctttgccaggtctcaccagttcaggacgctggtcgtttccaacttccaggagttcctggagctcacgctgggcaccgaccacgagcggccgctgccgccccccagggaggtggcacagaggctgaggcaggcggccacccaggccatccgtggttggaatgagaagtacggcgcggcctataagaagctggcccttggcttccacttcctaaagcacagcaaacaggtgggcaggccctgcactgcactgcctgcccgtgcagtctgggcagggggtggtttggagctggaggagcagctgtgaaggaagagcctcagctcatccccgcgtgtaggtggggctgagcttttagccctggtttccacaagatgaaaaggagcgtgagagtcacctgctcaacactgcccttttctctgccgggctctgcgcccgggcccagccagtctgggtgggcgacacctgctaggaccggtactgcccccgccgactccaggcctgtggctgctgccttcccactgccccctgggtcccctcgagcgttgttctcaggcccctgggtctgcccagcagcctccctcgccactggagtacgtgtgtgacgggaagtctttttacctgacttactaggagacgccgatggctgtgttcatctgggggtttagt

SEQ ID NO: 40161 - DNA, 1333 bp, Bovine  19866881085770
ccaaggcaagggtgggcacagccccggcaggggatcggccgagagcatgcatgccgatcggatgcgtccaggcggccaggtggggccaggccccatgtccagcctggagccagaggggtcagccagggccgctggggccctggaagtaaacagccccaggccccggcggacacagtttctccagagggttggcaggcatccctctgctgtgggtgggacaggcaggaaggaccaccggggcatgccagggaggctgcagagtcttgacttcagacgtggaggggtcctcagctggccctggggccccagtggccgtctcggatgaagagcggatatttggcctgctcagaccagggccgggtagagggctctctggccacctggtctgagggggagtgggggggtccccgaggcccccagggagcaagctcccaggacacaggctccccaggcaggctctggctagatttttccactgcctgtgagctatcaatctccactccctccaagacaaatgcctcgtcaggctggccgcccagaccccctatttatcaccatttaatatatattaaagctctctcacctctgatcatgaaaacaaacaaaaaatctgcatcaatcccacggcagcaacaggcagaaagcgggtggggtgcggggtctccccgctttctgccctggcggagccccaggactccgggcccagggtgtgaggagggcctccccacaggcaggcagatctcccggactctgtcctcccaggatggaggaggaagcagagggatccctggccagcaactgccccgctcctctggggcccctctgggcagatctcagcccccagctcactctggccagcctggtgctacctgcgagaccttggcaggagtggtccagggtaacagcccgggcgggcgggcgctgctccagccttccctggctggagaccctgtggcccccgggttgggagacagggaccaaggtacccgtgcgggagctgtgccgggtaggccctcaccacatgtttggatggagggctcttcctgggggagaagctgagccctggcaccaagcatcagttggagacgatgtggaaagaacaggcccttcgttcagccccagggtcactgttgaattagtaacgcagctggtaaagacagaagctgtgactggtccaaccccggagccaggcactccgggcacggtgcacccccactccacggatggagagactgaggccccgggctgggcgggctcgtgcgtccacaggccctcctccctggggacccaggtccttggccccaggctgccctcaccccctgcacctctgcca

SEQ ID NO: 40162 - DNA, 916 bp, Bovine  19866881121781
tcctgggacttacgtgctggatttttagtgtttgttctgttttgttggcagcagcactggggaacccagtcatttctaccccacgctctccagcccaagggcccctctgcaggagctcccaagccaacaatctcaataacctctgagagggaaaaatcgagtgggactgaggcccatctgggactgccccccacccccaggctgccagtcctgcttctgtgggccagcttagggtcaggggtcactagggacacccgccagccagctgggagctcgatgagagctcccctcccaggcaaagcaattttcttccctagaaagcgcttccgtggccagaggggacaagtgctagcctcttggaatgtccccaccctttgggccagacgtgatcacgcagtcctctactcatgggagcccgtctggactgtggcggcagagcgttgccccccttcttttctcagattcttccttctgccctagggtcctctgggcggctattgagggacccctcctgctgtgggcctcagtttctccactgagatcctcaggaagccctgaccgttaggctcagaccgtctacgcccctcctccaagcccgagcctttcccggggtcacgttgtgtctggcggggagggttgtcgtttttttgcagcctcacgggagacccccgaggacaccgcgaggacccgaacttccgcgaagccagtgcggcagcaggctcagggcgacaggttcttgcgcagaggacgcggatcagcggaccggcggaccggctgggtgtccggatcgctctccgagccccatcgggcactcgtgcgggggccgggcggagggcggccccgccgcgctccgcttcctctcggcaacgcgtccggccgcggcgccctcattggccgcgcgccccgcggccgacca

SEQ ID NO: 40163 - DNA, 1256 bp, Bovine  19866881200228
gagccggggccgagacagaggaggggacagagagacggacagacagaaagaaagggcgcaagtgttagagcagctgcagacgggtgctcaggcccggccctggggcaagagcatcgggggcacaaacggggagcaggtgggtcagcgcaggccgtgggggatcagagcaggcagtcacaatggaggccaggggggtcaaggtgcagaggcggccacgccgggagcacagtgtgagccagggtcgtggggcgggatggtggggcgtgcgggtgggcacagggccagggcatcggagctggagctcggcgtgccaggcaggcgtgggacagagctgttacctgctgggggcccgtgaacacgcagccaaaaggccttctcagccacgcctatgaaattggaggctcgacagaggtactcgcccccatcacgctcggacacattggccaggcggaggcgggcgtcggcctccgcactctcactgatccacgactgcggggacaagagacccggctcaggcgcgggggccccgccggacacacgggcgtgactgccgaggagctggccctcgcccggccccgaggaacgggtgggcagaccaggcggcgccagccaggagggctgcctggaggaggcatggagacacctcacggcgggcactgtgctcacactggacacaactgcccatcatgcacccccgccgcccgctgaccctcagagaggccctcctcggggcgctcaggccgcccacccctggggtcccagccacaacgctgccaggcctgagagctccgggcaccgcccccgcccccagtctgtactcctgatcccgcccctcagccccatcgtgtgtcttaacagatgtttctctttgggcggcaaatgtcgcaatcgccccaactcgggtggcccccaacccccagggccgtgggaaccgagcggacacagccctgccctgagggcccagggaggcgcctgggcaggcggtggagagctccgctctgggtctgcaggccaatgcggacagaccctgccccccaggccgaccccgctgcatcgcccccaggcccagcccgacaggcctccggcctggcacaccctccccgcccagccggccagcggcggtgcccaccttgagcacggtgacgtagggcgtgccgtcgggccccaccttgctgccgttcacctccacgtgcttgagccactggatgtggggctgggcgtcgctgtagaccttgcagtgaactccacatcgctgc

SEQ ID NO: 40164 - DNA, 619 bp, Bovine  19866881210648
ctgtttgacagtggaatacacacgcacaaaaaacagcgcgtgtgggagaagaaaagtatataatggagggtatattatgtattgagattatttttattttctaaatgctgtaattcaaaaccatttccataaatctatttaaggattgcagacactcttgtttctcgtgtgagcatggatggactcctttttctctgtctgggacgtgatggggttcttgctcaagtgcactgtcctccaggaaacgaggagggcttctggtctcctgagacagtgggaaggcaggacgtggcttcccaccagcccccaggagaagggtgaccagcccttcccctaccccatcccactccctgcgatgggctccagcctcccccgccctgcgcgcccaccctgcccagcaccccaggcaggccagcagacaggtggacacccacacggggcgggggcacaggagaggagaaagactgttcgtgtcctggaggcttggtggtggcgggaggaccactggcagcatatggtagggtggaggcttggggtacactccccttcccccatgggtctgggctcctccaaggcccctgctgctgcctctagcggccaccagggggcaccccgccca

SEQ ID NO: 40165 - DNA, 1707 bp, Bovine  19866881257402
gagtagcagtttactattaatatttatgtagcttgtattttaattttcctcttttaagtctaccacagtcctttaaaattaggtagatgttagacgtgaagattaaatctcaaaggctgacttgacttaggtcttacatgacagccagcgtcagacctcagtcttccgtttcaagttctttgccgtttctgctgcctcatagttgtgttctgtgaaagaagtgttctctagggcggtatctctgaagggtactttaattgaagtaggttagtggcagttaaagtcaaaaagaattttatgtctaaaacttggaagatgggaaaactgggaattcagatacgataattagaatatgtatttctgtaatgagatagtattgtcgttggaaagtttttaattgtttgattaatatttacaattgttagctttcccaaagatgccccaatatagtgggttataattttgaaaactgtactgacttaagaatttcttctaatttttatttccacattttaggctttatcaacttttagaaggagagaataagaaaaaagaattgtttataacccatggaaacctggaagaagtagctgagaaattaaaacaggaggtttctttggtacaagagcagttggcagtatctgctcaagaacattctttctttctgtccaaactaaacagtgatgtgaacatgctttgtgaagctttgtatcaaggaggaaatcagcttttgcttagtgatcaggtaggtgcttaccctggtaattaaaaatgcttaaaaaaaatgttcattgtaaaagatactaaagaaaatgttaacatgaagaaaatattaccccatttccctgatagtaacatttttatatctcatttttattcacatatatttttcaagtagttttggtcaaagtttttaaaatttattaaatatttcagatatgaaaggatatgtaatgtttatggtaagaattaaaaaaaaaaaacaccatccctgtattttttttcacttattttaacacacaggatagcttttatatctttaaaattctgtgtacccttagtaatagcagctccttctaataggcttccctggtggctcagacgggtaaagcgtctgcctgcaatgcgggggacccggggttcgattcctgggtcgtccgggaagatcccctggagaaggaaatggcagtccactcccagcactcttgcctggaaaatcccatggacggaggaagcctgataggctacagtccatggggtcgcaaagagtcggacatgaccaagagacttcactttcactttctaatagcattctcctctcttttttcagggaggaactatgctaagatttgtcatttgctttcttttatttataatacagactgtgtgttagttttgtatgtttctgaactttatatagattgtattatatatattcttcagtaacttgcttgtttcttaatatgattttgggttttatccatgtgggtatttgtaaaacgtagctcatttatagctcgtttatagttttctcttttgtatagttagtattcccttatgtgaaattccacagtctaattacctgttctgttgacagacatttagattatttccagttcttgctgttgtagatcatactgatgtggatagccttgctgcatgtcccacagatgcatgtctctctctctctgtcacctcacataggag

SEQ ID NO: 40166 - DNA, 1645 bp, Bovine  19866881264466
acaaagtaataagaattgcatattaaagagtgacaacttgcagttttctcagtgtgaaagtccatccctagctgaactgtttgaggaacacaagaaaaacaatccaagcgagtgctttactctacctgatttttgtcaccaaccatcttccagtttcacagatctcagtttgggatcttttcccttgtcacaactagcaaatcggtatcagtcttcaactggaatatcagagttaacaggatctctatcatctttggcattttgtaaagcttctccgacaagagaccttgagaatttgtcactttctgatttgattgcagaaacgattgatatagacaaccctcagattaggaaagattcctgtatgctcagtttatctgaaatgaggtcacctggaatagactcaaatattgatcttagtgtcctcataaaagccccagattttgttcccaaacctgtagtagaccaatcagttgctccaataccagaaactaaagttctaagttcaaaattagggaaaaattccaattctgctaaggataataagaaaaacagtaaaagctctctgcctaggaaaccacctttttctctctcttggaccaaagcccttgctgccagaccttcagctttcgcttcaaccctgtgtcttcgttacccattgaaaagctgcaagcgacgtacctttgatctctataaggcttttctttatagtagacaagtccaagacgtaaaagacaaagaaataagtcctcttatagcaataacaccgtttgacttcaaatcagcatctcctgatgacattgtgaaagctaatcaaaagaaagcttttactagagaatagtaacaaaaggaaaacttgctaactgttgtagagctttttcttttaaattaatttaattttaagcttttatagggttactttatattacgggatttaagttgtgaaatttatattaaaattgtcttaagtcagttgataaatttagttgatatatgcttttgcactgaaatttctttttactatatcttcttttagtgataactggctttaagttgatagcctgtaataggtgtatgtttacaaagtgcttatggtaacttgatattgtgaaatcaaacctcagctatttttgtttaaagcattcagctttgaaaatttttatgatgagacattttcttttataaaatatttttgtgctttgttcttaaatgaaaatgctaccacttgggattagtatagtttagtgataaagatttttcttgtgatatatggcatggcatagccaagacagtattatattttgaaatattaatgaaatcattccaagtttcattatttttctgccagtgaatactaaaacttttctattagaaaatcttaaaattcctaacttttaagaatactgttaggttgttgaaataacatttttcatgatataaaatataaatccttttaagggaccatgtacatattgaagatggattaatacataatttatttttatacattttcaaaaccatttgtcctaaatgaacactttaaaataaatatgtagaaggtcttttcaagtatggttgcatgttccttgagtaatctaccagatctctttcatgttttgttttgtttttctttttactataagta

SEQ ID NO: 40167 - DNA, 1417 bp, Bovine  19866881292662
gtgttgtggtatgtgttattgtttccacaaataaatcttagtggaggggagaaataataattataacccaaccacattatctagctcattttcaaaagtacttttgtattcttggttcatacacagataaggctgacgtcttttttttgatgaatgagtaaagagccttattgctgttatagggagtctgccttatttgctctgaccagaggatgatgctaatgaaatccaattcagtggattgaaactcttgattgtttttaaagaatgtacaaatgtattaaagatatctacttgcactcttaggtagcttgctttcctggtcatgtaatcagtagatagttgagtaaaaagaagagcttttctgaagctatatacctataattgtctcaaacttcagaatgatgtgtgaagtactgtcattctgtagaagttctaaagtcaacaagcagggtgggagaatagctactgagattattttaagaaaagcataaatagcatacgttagtgtttggtaagtagtgtggtaatgggtgattttttttgtaagatgaacttgaccaaaaaaatctgttttggtagccatttatgtgtatagtattttacatagtagtaatagcattaaaatttagcagttcataatggctttacccttggtttcatcttctctgtgccattttaaactgggtttttggcttttgttaatacaaaacaagtttctattagtgaatatgttatctgataacctaaaatggaaagtgaaaataatttaaaaactattcctactttgtatttacagtttgaaatgtaattgttttctttgtgtaggctcttggcaaagataatttggatgctaaaatttctagcttgaacagtgaaattctgaaacttgaagaacaaatcactcatataaaagacaaaattttgcctgctatggtaaaagagaatgcccagttattgaatatgccagttgtaaagggagattttgatcgacagattgctaaacaagactattacacagaaagacaagagttggttttaaatcagttgataaagcaaaaggcatcatttgaacttcttcatttatcatatgaaattgaattgagaaagcattgggacatatatcgtcagctggaaaacttggttcacctacttaagcaaagtaatttgatgttccaccagcgattagaaatgctaacagatccatcagtatctcagcagataaatccaaggaataccattgataccaaggattattctactcataggtaagtttctttgtttctttagtgagtaattatttttctgtttgtttttgttaagtactagagtttgaactaaaatttgtgaaagtttaaaaagttctttgtacttcatttttggcgtttgtattcttccacctttctgttatatgggt

SEQ ID NO: 40168 - DNA, 600 bp, Bovine  19866881346383
ccccctgggcacctcccgtgccccagtttgcagttagaaacacagtgacatctcagtcagctgtggagcgaggtgtgagtgactaacggtcttgctcttcggtcttggccgcaccagcagctcagaagttcaccgtgtgatttcaggaagtgtgagaactcttgctgctaaatctggaagaagttacaagtgcctactctgagttctgcccctcggaacactaagtccccttgggagcctaagagcacagcagaggccttgatgtcggcttcagagagcgaatgccgccgccgccggccaggctgccttccgggaggactgcgccgacagccgtgatcccaaggctgtgcagaaaactccggccccctgcccggggtctgccggcccccagcccactccctgtgggccccacgtgccctgtgggtgcatctgctcccgcacagccctaggaagctgggctgcaggtgcctggtcccagcggctccgtcccccaggtgggctgtccccacgggcaggagtccagcagcagcactggcttcggttcagaggctcagggcggcaggctgaggcccctctggctccctggcccttcccctcttg

SEQ ID NO: 40169 - DNA, 2147 bp, Bovine  19866881354345
tcttgcccttgctttaggcctcacagctctttttccttttccttagcagacggcactccgattttcacgagggtcctcctccccactttccctcagccagcagaacctgtcctctggctacggcgactagctcaatagaccagtggctattccagacagagatgcaaagagatgcttgctgagggcatctgcagaaggtgtttcctcctcctttcatggaaggggcacggagagacactgctcgtttccactggagagaaactaagctggtgtccccaagacctgctaagatgctgagaaagagaggctgggagatgggggacggaagctggactgcccatctgactttgactgctagactgagccttgccttaagccagccctgccttgaactccttaggccgggtacgctgagactgctgaggccagtttagtctgacttgctgccactcgcagctgaaaggtgtccgaatgagcacacggcctaagaggtgcttccatcaccagtttagacgtggggagaagcacccactcagcaaaggcccagcagtcctccaagcccagcctcctccttgactttttctgtcatgcccctcccgctccgggcggcatctgccgggagaagcctacaaacccactgtatcaggaaggcgcgggacctgcgtcagcagcctggcgctacctgccctcactgctttggctggtgaagccagttatcacaccagggccgacatccaatggcccctcctctgccgacctggttctggcgttggctctgcctgacaaggctgatctgctgaaactcaggtcctggacttggccttgggctgtccacttcacagcccccgctgtgacctgttcagaccagacaaatatggtagccctgcatttccataccaggggacccggggcccagggaccatggacttcccagtcctcactcaggcccttagggcctatggagtcttggtaggagagccacttagggttcctgcccaaggctcacgcccggtctcggcctggagctcctggaaacacccttctcccaggcttctgggccggaagcaagcctcagtcccaaggcttgcagcttgtgtcagcctacctgctctgggtttctcccccaaagggcccggccaggccctttcggaggaggtgcttgcctccctctcagcacttcctccaaggccgggaggagttcccacgcctccctgtgaaatggacctgtccgtatagcatacttgcataccttacattataaactctgaaaaatacagtcctgagtcttgatatttaaagggaagcttttgaaaggaaaaaaaaaaaaaaaaaaaacccaaacactttctgatggtcgttcctgacactttcttgtttccgctgagcactttcacaagttccatgctgaaagccagagccaaacacagacttccttattctcagctgtatccccctctccccctgaagaaacagaggcctcggccccaagaggtgctgggagtgaaatccacagaagacagtgctttgaaagcttccttgtgcaagcaaggcttttgttccgttaaagatgccaattaggagactacgcttccaggaaggtgtgcgggtgctctcccacccccagccagtacaaccagagcccggatgaaccaaggcgggcaagcaggtggacagtgaggcagaccggctcgggaccacagggccaagggttactagtccaatcccccaccgagtccccccaaactgagcacgtgctaaataagtgacagctggattagcacgcaggaaaccgcacagtctaacaggtgaggcctcctttcagaatctcccctggtggctcagacggtaaagcatcagcccacagtgcgggagacctgggttcaatccctgggtcgggaagatcccctggagaaggaatggcaacccactccagtactcttgtctggaaaatcccatggacggagaagcctggtaggctacagtccacggggtcgcaaagagttggacatgactgagcgacttcactttttctttctcctttcagaaacaaaaagtgcacaggcagccacacatccaggcaaaacttcaccctcacacagagacgggcgctccaccagcgctgactcacggggtgcttcgctgacagc

SEQ ID NO: 40170 - DNA, 755 bp, Bovine  19866881364610
cccccctcccccgcagaccacacgcccgccctacccttctctctgagctcccctaagatgtcttggacgttggggttctgctcttccaggtccaggttaagggccccggagtcaggaaaggacttcaggatgtcagccaccatgagcacccaggggtccgagtccaggctggcgagctggatgatctccgtgagtgcgcccttcatctgcgagacagcacaggcgcgtctgggcccaccccgtgctgcccgcgcgggtctgagggcaggcgccgagctgggcctctgagcgcctcgccttctcacaccttctcacacgtgggcccgcgtcagacctgcagggctcctgggggcgctgaggggccagcctcaagggggcctcccagcgcgcggcagacggaacaggagccggcagactgggcagcagttgagggagctggccagggtaggtggtggagcgcggtcctggcgggcagggagcaggcaagggctgccaggaggcccgggccgaggccacaactgggctcctgggatggagcagcacctggggaggctgccctcccgaggccccggtgacaggggcctgggcctgggctgtggccgcgtctgctgaggccccagccacctccccaggccgccagcggcttgagtgtccccactccctgcagcttggggcccagacagagccggactcacccggccccctggccccaccccgcagaccgaaccccccagcacggccctcgggaacagggg

SEQ ID NO: 40171 - DNA, 1951 bp, Bovine  19866880376982
ccaatgcatgaaagggaaaagtgaaagtgaagtcgctcagtcgtgtccgactcttcgcgaccccatggactgcagcctaccaggatcctccgtccatgggattttccaggcaagagtactggagtggggtgccatcgccttctccaaagcattttgcatagtacttgacaaatggtaagagcttgatgtacttgcgtgtgtgctgtggcttcagttgtgtccaactgtttgcgactccatggactgtgacctgccaggctcctctgtccttgggattgtccatgcaagaattctaaagtgggtggtcatgccctcctccaggagatcttccctaagaatcaaacctgtgtttcttacgtctcctgcgttgccaggtgggttctttaccactagtgccacctgggaagcccaagaactggatacatattcactattgttatttttaatattgctatgattattgttattttattatgcaacgtgtctaacacaaggcaggttttcaacaaaggtaactcgagtaactcctctgccaccaagtcactatgtggcccagaaacaggcaccctctcctctggacctcagtttcctattttgaatgaaatgaagacggcccctcccagctctgcacactgtctatacttagtctctagagtctgtgattctgcacggctcaagaatccaaagggacagtcgtagggaaaagggatgtgaacgtattgaggatgcaaagaacagttctcacgatgctgatttgcttgtgaaggctcactccgtaatcaaatcaaaataatcaggagaagaaagaaatgaagcattgtggcagcttcaatgttgccatactgctcatggctttcaaaacacggtttcatttctggttaacttggttctggtacctgggtgagtcacccacacatacaaccagtgtagacagggagaatagggtccttgctctgtgtagcccttactcccagaaccccattgatgtcaaattaacgtggcaaaatatttcaagggcaagtcacttctctgaagcatagagtctgtagtcagatctccagggatcacaggacacatctgtgacttagtgagggggccagcccatctcttttcttaactcagtgtcctcatctgtaaaatgggaaatattcatggttgcggggtgtgacaggactttcataagatgacacatagccttgtgtctgacacattggaatctcaaaaaatgccgttttctttgtttaaaaaaatatatagtaggttagcaaggctgtactggaggcctctttaaaaaatgtatgatttcaagtttgaagggttggttgatcacagggcaattagcaaaatcttttaatggattttgaaaaaggaaaaacgtgggcaatgatacagaaagaattgtctattgacgcagtttgtagaattcaataaatattgtatcaggtccaggatggaaaaaaggatgttgccgaaatcactgtgatgtgatagtctaaaaaaataaacccaacaataggccagtgtgctggccagcaggaagccccaacaatacccccacctttttcctgtaccttacccggagttccttccaggccacacagataaccgatgggtgatgaaaagtcacggactgggtctggtgccagcagagaatggaagagtgagtgtcaaattgttatctgatcagagaacggactcagcaaacacccttcctaggctgtgcttaagaaagtccctggtggggggaagtcctttcttcacctgagcggtccctctgagtcacactgacccactgagactcagctcccccagaagaggaccaccgccatccccggggcccttttagcatcctgcccactgccctcgttgccctcggtgatgtgaacggtaatttctcgcatttatagagagcaccgagctctcagcctgttgccttcccgcattccactta

SEQ ID NO: 40172 - DNA, 2140 bp, Bovine  19866880428500
tctgtcacctgcctgataggttcaagacttgaggttttcaccacaatgcagataaacaattgcagagactctgggtacctaaaaggaaggcctccaaggatgcagagaccgaccaccacagttcctgccttcaaggaattcacagtcttattaagggcttattgtaagtgatgatttcaatttagcaggaatttattgaattcctactgcagatctggcatggaggacacaaaacgtaataagataacggcccctgcccaagaggaacctgccctgctgacatcttccatccgatgcccagattgcagtttctgttttctgttttcatcctgggttgagactcataacatcattaacttttcatattctgcttacgagccctagtttttgttttgtcttttttgctccatgtactgataacataacatcattggaagaactttgctgtagataaatttagtcttcctaaaatttaggaaaacagaagacacaaacagaagccattttcccttttttttttttccctatagagagacatttttctaagaaaaacatctggcttcccaactcctaactagtgcctggcaaagtgtaggaattaagtagtttgtttgttgaaataatgcatgaatgcctatgacaagaaatggatggaggaaattccgatgtctaacccaattcactcttcccctgacatcccttttatttacttaatcagcgatgtatatacagagctgaggaaagagggcttcagacgaagggacagtgggtccgaaggccttgaaatggggacaagttgggataccttccaagaagcagaaggaaggccagtgtggttggaggatgcagggagaaaggcagttagaagtgacattggccatttatgcagggcctgtagtctttgtcgtgggtcttgtgtgttttctgagtgtggtgggaatgagaaaactgatttccatttttaaaagatctcattgatcacgatgtggagaatgggttacaaggaggcaagagagaagccaaaaggccagtgaggtggtgtccagctcagggcaagtaagaggtgatgggggacagtgccaccaagtctgagctcaccctgcttgctgtgtgcacgcctgcatgctcagtggcttcagttgtgtccaactctttgggaccatatggactgaagcccaccaggctcctctgtccatgggattctctaggcaagaatactggagtgggtttccatgccatcctccaggggatcttccccacccagggatgtaacccaagtctcctgcactgcaggggaattcttggcagtttctttaccttttggccagttaactgagagacaaggggttgaggcaaggaatacgaccttattcggagagccggcagaccgagaagaggtcagactaatgtctcaaaataaccatcttgtcatcactctctggatgccactttcttttatagaacagagagggagagaaggggagggagtaaagtaaaaaggccattagtcttacaaatatctcctgaaatggccaacatcagggaaggggtgtgtttatctcttccttcctgtagccactcacaggtggacagggtcttgaacaaaggcagtttggttttaacattcaggcagttggttaaggctccccaaggcaggccatatgtgtggacattatccttctggtgaacaaaagattccagaagcaaaagtaaaagaaacagacccaacatgggagtcagttcttccctgtaacaacacctgtaggatgacaatggctatggaagcagattcaggacagactttgaagactgagtgtgtgctgggcccgtgacaccatctaactgatatagcacaccgattatatgtgtaatttaaaattttctaggaaccatcttttctagtagcaacgtttttggttcacgttttgcggcaggggctcttttcaaatctactgatatttgctgaaaatgtctttttatattgtccattttattacatttaacttttatacaacaatcagctttgttcttttctgctgcagtaaatcgcagtcaacatacctcttgaaacttgtggtattccttcttttagtctaaagggtgggatttttttttttttttttagtccattttgtcttaa

SEQ ID NO: 40173 - DNA, 1574 bp, Bovine  19866880444198
cttatacactttaaaatctgtctctacttattggttttaactggaaattaatgtaatgatttacaactagcacccattatttttaattctcaattatgatttatgtagaaacccctgtttatttatgctgtctgcataaaatatttaaataaacatattataatgctgtctgttgcaaaggaaagccattcaagctgaatcgatgtgttgacaggaacgaacacacagtgtgtggtagtatcatagaaatgacacatgttccccactctctcaactacgaaatgactatattatcttgtgtgatacaatcgctacatggatggaaatggatcattccagcatcatagccatgcttgacggaaaggtattttgcactgcttaaaattttaaatttgactctgcatcagttaaatttaaacaaaaaatttcagttccctggtctctccagccacatttcaagtcctcaacagccacctgtgacaactcactggtgcctgccatgttggacatgcaaccccagtgaaattctaagctcagaggccctgcccttacctctcctggcctgttcccctctgactagagaaggcattggctgataggggctctaaatgccacactcaaatgccacggggctcaaaactgaactcttggggctccattaacaaataagccaaggccatgtgatgccaagcacataagcaccaggttacatttaagagatgttttacacacagaccgatgagtgtcttctttacgagaaggaaagggtccatttgacatagaaaaattgtctcgtgcacacaaatgtggctttcttttacctgttccattttaaacgtacatgttcataagcctggcagccttgagtgggccgggactggctaccagccctgatggctgatgtccacatcacagctttgaggagtggctgccgaaagttggcagaatatgtgcatttttgttaaatgccaactagggggctgttggaaggctgtcatgctccatcgaacaaatcatgccagtaaacaccatcagtattcagtagaccgtcacatttctgaagtctgttgagcaaattatactcattttaaaatttgtgtaactgggaattgacacttattcttgtgtttgcttgataggcagagtcattggctgtcactcacacacacacacacacacacacacacacacacacccatgcaaactctcactcatctacatccgtcacatttttgttctgcagaagcactatcctgcttaaactttgatcccaccgtagccctcctaatggttctctggacctgccaacactatgccttgtccttggggagcactttaaagcaagaacaaaccccttaatgtctgcgagacttgggtttcaagaaggatccactttgacttcctgctgctgaggcaagaccctctttgcaaccccgtcccccatggctagtgtcacaaatattaatgccacatttccacatgctgggctcagaacggccccttttaattaaaatatggatctatttttttcaaatgcgttttctgatatctgcacatggggagaagcgcttctc

SEQ ID NO: 40174 - DNA, 1651 bp, Bovine  19866880462742
tagaagtcctgaatctgcagagagaaagctggagacccgggagaacaatggcatagttccggtccaaatctaaaggccagaaaaaccaatagagtaaattacaggttcaggtttgagtctgaaggcaagaaaagactgaccatgtccccccagccagccagccccaacctttttggcaccagggacatgttttgtggaagacagtttttccatggacggtgcccgggatgggagggtgggtggtttccagactatcccatttattgtgccctttctttctattattattacaactccacctcagatcatcaggcatttgatccaggaggttggggactcctgccaccagctcaaagaatgtcacagagagagagagtgaattttttcttctcagcctttaggttctattcaggctgtccttctaagggttggataggcctgcccacatggaggagagcagtctgctcttcttagtctatgggctcaaatgctaatctcatccagacgcacccttacagacacacccaacataattaattgaggcaagtggtgacccaggcatcagagtgtcctaattttatttcttggaaatatggtaactgatgctgagaaatgtgtcttaatgtgttttaaaagcagagcctttattaaactatgacatactacatatgcttccatggtggctcagctggtaaagactccacctgcaatgagggacacctgggtttttgatccccagttgggaagataccctggagaagggaaaggctacccactccagtattctggcctggagaattccatggactctatagtccacggggttgcaaagagtccgaccggacagagcaacttttgctttcatactacataagcatttgagtgttagtatttatttcagcagaaaggcagtgggcatggtagacaacaaataacctttgaggccatgcacaaatcatggtcagtttccatccttctggctgttgctttagaggcttagttttcttatctataaaacaaggataagtacaagtgatatgcgaaatatttagcagctggtttgtacaggcacccagcagttaaaagagaagtcagccataggggaggaggggtgtatcactgtgtaccatcagcatatccatcctagagctgatgacgcccacttcactggagagagtgggggtgaattggtggagaaattgacacagagacacctaacaatggccagagagtcaagagctcatcttccatcttctcgagtctttgaaaggtactgtctttgtttcctaatcaagcagacatggtttctctcaaccttgcctctctgcagcaggcagagatgagctcatttcacataacctctgcgggctctgcttctggtctccacggtcattcaggaaaaagcaattggcttcaggttttattgacagaggcaacgaaggctaaggctcatccaaacagcttaccctgatgtttggttgacctcaggcagctaagctgtctctgtcagaggtctaggggctactgaaggaggagacatgttcttacaaagagctccccttttttttgcagctgaagaaccttggcattcatattccaggcttccacagaggagccagtggagaatcaggcacggttttttcctttctca

SEQ ID NO: 40175 - DNA, 1897 bp, Bovine  19866880516672
aaaatattagacaggaagagaaaagaaaaacccagctcctgctgtcctggcacttctggtctcatgggaaaggcaggaatatagataattatagaacccagcaagtgcaaaataagtctttcaactgcagttgaccctgaacaacacaggggatcggtgcactgactcccagtgcagttgaaaacccacagagaactttatggtcagccttctgtatatgcagttctgccctggtgggattcagctagccggggtcatgtagtactgctatgcatatttgctgaaaagcccacgtgtaagtggacccatacagtccaaccccatgttgttcacggtcaactgttgctgcaaaaataatcaagattaataaaattatatatcttggtagttattattaaaatgttggccctgagcccaaagtcacttaaacccttaacactatatacatcttaatatattaatagtgcccatgcaacatatgttgaacatttaaaaatatgagctctaatgatctatcaagatgatatctgtgtatcttttcccattgcaacaatttaattcaatatgttaaaacataaaaataaatcaaagccagacttgacttatttatacagagatttccccatttctttagtacaagattatttagaatcccatcaaatacacgtatctgtctgtgcttaattaaacaaagatgtttgtcagattaggaaggactatttggcatattggcagatgctcattaagcttttattaatgataggaagatgaacggtatatttcatacccgcaggaacacctctgttgggagaagtcagtgttgataactgagtatcatcacatcctgggacttcccaggtagtgctagtggtaatgaacccgcctgccaacgcaggagacttaagagatgtggttccatccctgagttgggaagattccctggaggagggcatgcaacccaccccagtgttcttgcctggagaatcccatggacagaggagcctggcgagctgtagtccatgggattgcaaagtcagactggagagtatttcgtctctttctgtatcacatccctctatccctggagagtggagaggaagttgaaatggttttacctgggaaggactgaagtacaagaaggcaaacccccaggtgtggatcacatgcccactggtgacacaggctagacaccatggcaagtgctgtcgggaccacacagaagaggaaacttctattaactagtgagcctcattcacctcctatgacatagatgggtttctcaggtggcgcagtggtaaagaatccacctgccaatgcaggagacacaagagacacagtttgatcctgggttgggaagataccctggagaaggaaatggcaacccactccagtaagatgatgctgttaaactgctgcactcaatatgccagcaaatttggaaaactcaccagtggccacaagacaggaaaaggacagtttccactccaatcccaaagaagggcaaagccaaagaatgctcaaactactgcactcatctcacacgctagcaacttaatgctcaaaatccttcaagctaggcttcaacagtacgtgaactgagaggttccagatgtacaagctggatttagaaaagacagaggaaccagagatcaaattgccaacattcatcagatcatagaaaaagcaagagaattttaaaaaaaaccaaaaaaaaccatttacttctgtttcattgactacgctaaagcctttgactgtgtgaatcacaagaaactgtagaaaattattcaagagatgggaataccagaccatcttacctgcttcctgagaaacctgtatgcaggtcaagaagcaacggttagaactggacatggaacaacatattgggttcaaattg

SEQ ID NO: 40176 - DNA, 1377 bp, Bovine  19866880643945
cagttcagtcttcaggagtctacttgcttcctccagtaacctcaacaattctcaaaggtaaaacacactgtcaattctgtgtgactgattcaaaaactatttcagacctgtattacttagtaagaaaaatcaaaataacagcaagcattgtattttaactaagtattccataagcaactgccctatgcccagcactgtgctaaaaagtgagtgctctctcattcaggacacgaacaaacctaggtaagcagggttatttccttttgacagatgaggaagttgcaatgcagttgggtcaagaaacaataagacttaaccgtagagtcataatcctgactttcttacttcagcccagttcttcttccatttttgccctctttttcatgaccctggggttgaaacattattagttatacgtgagggcttcggaaccatagcaatctggtagatttacacacctagccaagtgtgtactgctttgatttaatttaaaaataagaaggaactttgccctgaggtcaaaccctctttcataattttaactctgaactgtttttcttaaatgatacaaatttacacttgctccaactcttcccccaaatcctcctttcctggaaagtcagctttcttctagattatcaagagccatcatattcttctatctgattcccgagaaattgatgatttcaattatctgagtcaatgacttaatgtagacttgggaaccttcaaaccaaaaaggggattggagatgggtcatgagtgaaagggttcagtgattcttgaatcaagactaagtgatattcctcagcacacagtagttcctgttattctggtgtgatccaacaggcaggatccccagactgagatacaactgcttcaaagctgatgttttggggctgtgctgctgcgtgactagcaggatcttagttccctgaccagggatcaaatcccagtagtgaaattgcagagtcctgaccactgagctgccagggaaatccctgagatagaactgcttcaaaccatctctctaggataccagtcttacacagcctttcctttaagccatgggacacaaaatgtattttttttcaaggccattggtgaaggggacctttaggccaagtgactgcctcctgactgtttcatgactcagttccagtttcaggaaagcatgcaaagatcttcttatttaaggttcctgaagctcagaggttttccccttaaaaccttggcctgagctgaatgctcctggacatcaggagttcacaccagccctggaccctcttccttggagtcctcgtccactcttcccatccgtgcccattgcagttccaccagcagcgaccatgggcaaacctttattcaaagccactc

SEQ ID NO: 40177 - DNA, 787 bp, Bovine  19866880645731
caatatgcatgaggctaaaatgccaaggcatgtattcaaacctggcagtggtggggttaaaagcagcttcatttttttctccccctgagggaaagtaggaaggcagaagacttagcatccgttggattcatctgatttcttcctgttggaatgtatctcctgctccctggtcagctgcaatagagagtgggcttgagagtaagggtggaggttatcttaatggttgttttaatgtaaatagaactttaaacaattcttccaggaagcagcactcagacaaactctctgacaggtctgaggttttattgtattaagtggttcttcccaggaaaaaaaaagtgagtgagtctggtcacctcttaccctgacacaagcttttttcaggaagggacacacaaaacttcattagggaaagcagaaggccccattatgaaccactttaatacagcttttattcagttggccatttgctaatttaataaagattgcatatcccctgactgatactcagaaatttgatatgtcaattcctgaaggattcagtggaaaagcttgagagaaaactagagatgaacatttcagtttttagagagggagacatgcctggctcatgttcagaaggaaaagccatgaagatcaaaagagcagtggacccaaaggcagtacctgggcttggagtccctactttggcattctcaggcttcatgccctctctgagtgcctggacttctctgagtcttagcttccttatctgtaaaatggacatgctaatagcttccttctagaa

SEQ ID NO: 40178 - DNA, 2320 bp, Bovine  19866880665944
tgcacaagagttggacatgactgagcaacaccagcacacagcacaccagtgagaagaaatgtgaataaaataggaactagggaattttctgacagtccagtggttaggacgtggccatttcacggccatgagtccaggttcaatccctgatcagggaactaagatcctgtaagctgccaaaaaaaaaaagaaaaatgaactgcatgccaaaaatcatctgactttcaaaagcagataaaaatgctaccttgtctctgatcactctataagactcactatatttcattaataatatacatttatcttaggttaatttggctccccaaagcctggccctttatacaagcagaattcgtcatgtctaatagaatgtgattcaaggaatttactctaaaatgtctttctttccaaacatccgtaattgataacccacagccttgggttaagcaccaccctctgacatttctctttggaaatgaaaacttcttctgcttcagttcagctcagttcagtcactcagtcctgtccgactccttgtgaccccatggcctgcagcatgccaggcttccctgtccatcaccaactcccagagcttactcaaactcatgtccatcaagttggtgatgccatccaaccatctcatcctctgtcgtccccttctcctcctgcctgggtgagcttgaagtaactcatatttacacggaatacttgtattaggtactttctcccagagtaggataaccgagattagaacagagctcaaactcttagtctagaaggatgatgaaagtggaggagaaaggagatgaaagcatgctaatgttatgggggacacatgtaccaggagtgtttgacacagcatcgctataagatgggttttgttcgcatatttacaaatgaagaaataggggctcgtggactttctgccaaaactagttgagttaccagtagctcatggctggtgagctgctgtgctgacctttgaccccattaatttcagagctgagaccttgctccatggatgcgtcacctgtgccacgtttttgccaagatcgagcacctgccaagaggagtcagggagaccgcgttgagtggctgacatgtgaattacaaaaacgttcgcgatcaccaagtgcataaccattgatcctcctgtttgtcccttccaggtgtgtacagaaggcagactgatttttggagttcacctttgacgacctcatgagaataaaaacatggcactttaccattagacaatacagagagttagtcccaagaagcattctagccatgcacgtaagtacttaatttctatttcactttcttccctttcatcccctcatcttacccagaaaagagaagccctgttttctcactgtgaaagggctcccagaaacttcacactttaggcaattaactctaaattttgagttttctcatcaaccattttcatccataggccccttttgccctcctttgtttctgagtttggtaaattgtgagactatttcctttcctactttattattttaaactccaaatggaggttacctcaataaacagtctgtacttttcttaaattccacgcatttgttatcaagtaccactcagcctgggctaataaacctgttatgtataaatgagagaaataaaacaaggagtaggaaaacagtttccagtttttattggaaccatctgacaagatgtggggttcacacaccgccgatgtgtgtgcacacacttcctaaccacggcattggaaacccgaggaagacctgggttcctcttgattgcatttggctgtaaatcatatcaaattgcttggacatcaagaaggtccgagggtggattcgatgccaatctagagagatgttttaatggtaagccctgacagaaactcatcaggtcagtcccgtgagaaggaatcaccaggcactgacttaatgaatgcttcttccagagtgcacgatgcagcagcttctgagaaaatgctctggagcaaaatcagatttgagcctgatttttaagacccgatgtggtgaaaagagaatacaatcacagttgtaattgcaacccactccagtactgattgacaacccgctccagtattcttgcctagagaatcccatgggcagaggagccctggtgggctacagtccgtagagcctcagagtcagacacaactgaagtgacttaggatgcacgcacgcatgtgtacagaggaccctcttttcagaaattgagatgaaaaatggcaagctattttcacctacattagttttttttttttaatttatctacacaaagccaattggttgcatta

SEQ ID NO: 40179 - DNA, 721 bp, Bovine  19866880688106
tgaagtatctatcatttctgcattttttcttttctaatgtattcatttctgcttttatcttcaggattcctctctttgttctttgctaatttaattttcacaggcttttaaaagagaaaaaagtggtatctgtctgtgcctttcatagctaacaccagtctagctgcatctgtaatcatgatattaatcatcgcaggcaggggtcatgacaaacatggagacttgggtctgctgccaattgcctgggtcatgtcccagctctacctttgccaaatgtatgacttggacaagcagattccacatctgtaaaatgaggattattattatgataaaacttacctcatagggttagtgtgaagattacttgagctaatatttgtaaagattttgaaacagggcttggctcacagtaatggctatgtaatacatgaataaattacattcatgcagcactttatcctttgcaaagcattttcacattaattttctcccttagttatcgggacagccccatgaagcaaacagttcttgtccctacttcatacataatagaactggaactttgacaagttagtgaatggaagacccaggtcttacgaccctgtgatcagtgtgtgacttaaagtccagattacctcttttatttgtgggggcttcgctggatggagagaagttcatgttagtccagcttaaagacggcaactctttccaattttcaggc

SEQ ID NO: 40180 - DNA, 1202 bp, Bovine  19866880710439
ttgcaatgtttcttttcggaggcccttagcagtttgatggcaagaagagttctcagctggtttgctgcatggcaataaacaaagaacacagttgaacatggccttagagattctccagctgagtaattcatcagaagaactgcacccaggcctccccttatgaaattctattcctgtggaagtaaaccagaacctgtctctgccttaggtttttgtctcataaacacaagacaaatagattagataataaaaaaaaaagcatgacatttaactgggctaatatttgcttaaacatccaataaccccctctctttaaaagaaaaggattatggcatccaaatatccctgtcctgtattgtcaagacatttctctgcccatgtctggccatagtcacctctcttctgggaaagcctcccctgcctgtggcttctgtcctgttaacactcagggaagaattgcgtggcttaatctccatgcaactctttggaaaaccttggtaaattaagtctgatgctggggggcaaggctctggaggagtggtgtggggacgctgaagtcttccctcatttcactgtgctctactctcatggcgaagatccagaaacgaggctctgaagaccactcagtcgaggagtttgagggcaagcagcccaaacgcctggaattacccacagcttgtgctaattggatctgagtcagaggccttcacccagattatcaataattatctgacagtgcttctgagacctttgatgaaatgaaaatggcaggtgttattagcatctttcttttttttttttttcaaagcatctttcttaagtcatgctctatcaacaggttactactaattctcctgcacttggtgttctgcttgtttaaagaaaatagttctttaaattagagagactaggaagcacctaacccagtgcctaggacatagttgcaattcagtaattgatggtttttggtataaaattcccaaagaaggaagtgattattcagttcagttcagttgctcagtcctgtccgactctttgagaccccatggactgcagcacgccaggcctccctgtccattgccaactcccagagtttactcaaactcatgtccattgactcgttgatgccatccaaccatctcatcctctgttgtccccttctcctcccaccttcaatctttcccagcatcagggtcttttca

SEQ ID NO: 40181 - DNA, 2443 bp, Bovine  19866880796566
gcaagtctgagtgtgtctctcttctccttggatccttctagaagaacctctttgcccacaaaataacctcattgtgctttagcatgcagcaaggtcctctaatatctggcctctgccttctccagccttccagccctcactggtccaaagggccatgggttatctgctgccaggggtcctcctgggtgctgggaccactggcaccacgtttttagaccatgctgagctctgtggctgcaaagccaaataagaccagtccttgccctttaagggaccactaacccaccaaatataacatacgatatgacacccatgataataagggaatataaagcaggaaagttgagaaatgtcattcagatgagggtcgtggctcatagaaggcttctgtctaaacaaagtgactgtcacctagtagacgctccatagatggctgtgcaaagaatgtttgttgttgttcagtccctaagttcagtccctgacactttgcaaccggatgaactacagcacgccaggcctccttgtccccagaaaaaataagtgcctcgtgttagtaataataacctattcaggccttgagaacacattacattaccagcttgtggtaagtggcgtttacatgattttaatcatttatcctgcataaccacccgtgagttgtatttgttgttgttcttcagccgctacgtcttttacaactctttctgacctcatggactgcagcgtgccaggctcctctgtccttctctactcctggagtttgctcacattcacgtccattgagtcggtgatgctgtctaaacatcctctgttgtccccttctccttttgccttcagtctttctcagcatcagggtttttttcaatgagtcagctcttcccatcaggtggccagagtattggagcttcagcttcagcatcagtccttccaatgaatattcagggttgagttatgtattctgctactgctttacagatgaagaaatgggcttaagtcctatgcccaccatcaccctagctagttaactgctggagcatcgcatgaattcagaatggtctgactctaaagcttggtcttctcatcaccaggccaaactcttgcccattgtgaatacagcagggttttgtagaatgaataggagtgtctcacccagaccacaaaggagatgggcatcgaaggtggagggcaaagcaaagatattctaaaggtgagacccagagaggttaactcagttgctcgagttcacacagtgagcattgggagtttcaacatgtttcagagaacgcattaaatgtcaaggctggagatgatgaaatgagaaatggaaggagtttttttttaaacccttttactctcccacttgctatgtaaaaataaaaggactattgactggtagggccgaacatgccgttagtaataagattccctctgaaaatcctttaaagtctccataattaatttatttgggaggtgaaacaaaccatgcacatgaaatgagttgaaattattaacaggtctgcacagggtccattgcctgaagccacccagcctgacgctgggcactgggactcaggtctgcactcagcatttccattgcaattggaaacagtctctgaatcaattattgatcacacccgggattcaagcagcggtctctgtcttggctacaggagctcagttctgctgaggcttctgcccctgttcttgccctgctggacagaaccaagagtgggaagtgtggaggagagctggggccctttcaccctgagaactccctactccattcttccacgttgcttctctgagtatatagagtggaggcacacctgattgtaaggatctggccattgagaagccccttgttgcatgacaggataacctggcttagaaattcaagaagaggcaaaactcatctatgctgataaagtcagaatcatgtaatctgggtgggtggagtcttggctgagaaaaggacatgggaacttaatgggaagattgaaatatctgccttggtcctgatggtctccaagcacagctaaggtttgtgcattttattgtacgtaagttcagttcagttcagtcgctctatggcgtctgactctttgggaccccatggactgcagcacaccaggcttccctgtctatcaccagtgcctggagcctactcaaactcatgtccatcgagtcggtgataccatcaaccatctcatcctctgtcatctcagaaaagaaagaaattatttttattacttgtcttgttccttctaatataaaacagtaaataataataataaacaaaggctgaaagtgaaagtaaaagtcactcagctgtgtctgactctttgcaaccccatggactataaacagtccatagaattctccaggccagaatactggagtgggtagcctttcccttctaccaggggatcttccaaactcaggg

SEQ ID NO: 40182 - DNA, 1662 bp, Bovine  19866880811268
ccataaaactgattttagacatgtatatgtatgaagctcacatatatattcattatatattatgattattatttatatataaattactgacatctgtaatgttagtttagctctaatgttctagctaatctatttatggattatcaattaataaaggaatatgtagaaagaagatagatagagcaagctagctataacattaagagaaaaacaatactcagatcagaaatgagcaaattgactttaaatcacatttatgatgaaataaaagtcatcagagcacatctattaccaacagttcagtatctataggcttccagccttaatttcagcgtaaacaaaagaaaaaggataaaaattaaactcagttcaggtgatcctggccatttaaaacacacaagtccctattacaatacagatgacactgatttacaattactacttccacaaatctgagaattttgaaacttacaccccacccctagaatatgaatattcagcagcaaatggatggattacattcttatgcaaaggccatcacctttctggtgagcagcaattccttctgcctccatctggtgagcagggctcctcccacagagggttcttcaagaagcctttcctacaactgccaaaactgaactctaatgcacaccttcaaacaggaaaattctctctctaagcctgtttctgattcatgagcttattcatttgactgcaaaggcttgagaaaaatctgcttttttcaacaagcataaacattctgggaagagtcaggacaataggaggaaaaagagaagggataaacacacacacacacacacacacacacacacacacacacacggaaaaagtactacgttaaatgccaatggcaaaagttagggaggcttgaagcctgacatttgaactgcaaggacttgactggtgtttcaagattgattaaatacagaactaggcttgatgggtggaatggttcaatcataatcctgacctggagaagggacctacaggaaggttctcgggggtgggggtcacccaagaaagcacaaacccatccacagaaaaggcatttagagaattctcatttactattcatttttacatcgtgccatatttaaaggagggctcataaaataaaaacagcaacccccaccaccaggagccagaatccagatctggagatgtggttagagaatctccttagaggaacggcccatgcccctggcccacacagaaggcagctccactccggatgaaagtgtctgcccctcagtcttgtctgatgctttgtgaccccgtgaactgcaacccaccaagctcctctgctcgtgaatactggagtgggcagccattcccttttcccggggatcttcccaacccagggatcccacctgggttcaagctagggaaccttcaaatagatggagggcagcatagaaatggccaatgtggagaggctgggtaggggcctgatgttttctaagggaatttggagttataaaaagtgcaagaaataattacacagatgaatcaaaaattctttgctcttcaacatattcagaatttttctaccctacttgggaaggaacccaaaaccgaaaaaagaaaatagaatgaacaccaggataatagattaaaaaaagtctacagttgtcacat

SEQ ID NO: 40183 - DNA, 1241 bp, Bovine  19866880815809
gtgaatagcgtcccccatcgtcttccgcccagatttccccgtcaccttttgtgtccttgcttgcagctgctgtaggtctttcaatattggcacttgcaagaccctgaaagggagcacctccttacatttttatgtcctgggcacctcagcagcctcccccaagtcccagcaccgttgtcaaggcttcttgccattgcaccccttatcctttctacaggcagaaaggtctttgcaggatttagttctgtgccctgcttaaatacatcacttctccccttggttccttcactcagtgtatgagttcattgaggagcccctggagaggacaggaggtctccacggcagtggcccatcttcacccccttgcagctccagggacacccctggttccctgaaagcttgatcacaactcatccctcattctctgttcctcacgcttctgtgagcctctccagatggcctttcctctgacatgcctggcaaaagctaacagcatcactcctccctccaggtttcaattttcttctgagtgtctggtagataggggttccctaacaagaacaacaagaaaagacctgatcctaagagataaatggggaaagtgggggtgggtgccatcctttatctcaccaagtaccaaatacctgtctcccacaatctgctcttgacctctgtctgcaatttcattcagcttttcagtcattatcttaataggcatctacccatcatttaccaaaatgcagttaagtggggtgatcatttttctgaagataaaaatgacatttctctcttctctttttctctctcttaaaggtgatgcttgtccattattttaactcaagctctttggggctctccaggatggttccatgttctggctttgtctgtaaaacttggggaggcagagagttaagccatcagctagagaatttgatcactacagacctagactcctggtagttcagtgaaaatgaaaacaacaagtttcttttagccttaattatctgtgtaattgccttagctcagagagacagaggctcagactctcaagaaaggtgaatttcttttcttcaatcaacaacatttattatatgccaactgtatgaagcaactctacattaagtcttgaagggtaccctggaaggagtattatagatgctgctaatgaacctctaaacaacctaactacagagtcaagttcattggaatgccttgataaggaccaggcagtacaccagctg

SEQ ID NO: 40184 - DNA, 2530 bp, Bovine  19866880833578
aagagcttgaaggcaaaggagaaggtggtgacagaagataagatggttagatggcatcaccaagacaatggacatgaatttgagcaaactccaggagatagtggaggacaggggagcctggcatgctgcagtccctgaggctgcaaacagtcgggcataacttagggactaaatagcaacagcagtctctactcttcctctgcgatggtggggggaccttagaagggatggtaggctgaccacattcaacacacacacactaaacagacatgcataccatctcatctcccacccacttcattctgcttcatccctacacagatgcctggggtcaaccacaccgagacctggacagcttgcctctgaatgcgtgcttctcaattgcaggagagaggaatttgtaaaaggggggctgccatgagtgaaacagatcaacactgtttacaaaaatgcctgactttttaaataattcctggctcgatttgcaaagattgttgagatgcttgttggagttttcaattccccattagcatttttaagccaacaagtccctgagattcaaatcctgtgaccagcacatgaagctataaaacactgttctgctgatgcagtaattgtctgacatggctacctggttccaactcctgcttagtatgcaaatctgctccaagaatgcatttgacaatcacttttctgtccgcagaaactgccccttgacagaaaatgtattcctaaaatgactttttttttttttgcctttaaaactaaagcttgcaagtccagtggtagctgagagcaacaacatatgcttataattatgattaccatcagggaattcaaccgtacagagggaaggggaagaggcccggcaagggggagcacaaaagctctgaaatacggcagaggaagcacacccagccaggttggctattctgggtaacgggagaaacttgattgtagaaaccaacactggtttccctccagactcgaaagaaatgttgcgtgggcagaatgagaaatgctgacagacaaaatcaagccttagggatttgcctttcatggtgggctaaaggagcctgcataaaaaggcagccttgtcctgtacctgcccgcagcatggacctttatacccggtggccactcactccagccctgtacaactgctgtgctaccctgctcccagagaggacttggggtccacttgcttctactctggttccctagcatatttttggatcccaagcacgagtttgcactcaaataagcaagactttgcatcccagctctcaagctgcatgatttgggcaggtaatgcaacttctctgaccttcagcctttcaaacggggatggtaacaccccacctcccagaaccatgatgagaattaaatcacacagacgaagtaaaggaatgtctggtggccagtggccacttaatcagtgatgactgccgttcattgcattgttgggttggcttctgagcttcttggtgtcagctactacttatggctccgttgttttttttgttttgtttttttgtttttttacatttcaattatatatttttaattgaaggataattgtgctacaatactgtgttggtttctgccacacattagcatgaatcagccatttgttgctgttgttattcagtcgccaagtcctgtctgactctttgagaccccagggactgcaggaagcctggcctccctgtcccttaccatctctcggagttctctcaagctcatgtccattgaatctgtgatgcatccagctatttcattaccctcttctcctcctgctcttctccacccttcccagcattagaagcttttccaatgagtcagctcttcacatgaggtggccaaagtattggagcttcagcttcaacatcaggtcttccagtgaatattcagggttgatttcctttagggttgactgatttgttcccctttcagtccaagggactctcaagagtcttctccagcaccgtagttcaaaagcatcaattcttcagtgctctgccttctttacggtccaactctcacatccatacatgactactggaaaaaccatagacttgactatacagaactttgttgacaaaatgatgtctttgctttttaatacactgtttaggtttgttctccaggagatcttcctgatccaggaatcagacccaggtctcctgcattgcaggcagattctttaccatctgagccaccagggaagccctctggtctctgggaggggaatgcagatacagccaatgtatagcctgggtggggagctaaccccccatctcactctgctttctccctcagctctttcaccacttttccccattggctgaaactaccatgatgcttaggacaagagatcttgcagatgtagttcatacacagtcctggacagaggtcagggtggaaaagcatggggaatagatctggagggataagctgtaaatattctgcacccttctggtctccacaaacccttaggaggataacaggacagaaaaccgtgtaaatg

SEQ ID NO: 40185 - DNA, 2573 bp, Bovine  19866880888190
tcagtgttactggttggggcatagacttggattactgtgatattgaatggtttgccttggaaacaaacagagatcattctgtcatttttgagattgcatccaagtactgcattttggactcttttgtcgaccataatggccactccatttcttctgagggattcctgcctgcagtagtagatataatggtcatctgaattaaattcacccattccagtccatttcagttcgcataacacactcactacacagaaatccacaatttcaagtgcctcccatcctccactgggagtatcagctgacacaactgtattcattacactgccccaaagctttggcttattagccactgaggccaaagtcctctgagtctagaaacaccattccgactctcttccagaactggaacacacattttgggtgtctctgtgtatatccaggcttctctggaggttcagtgacaaaaaacctgcctgccaatgcagaagatgtgggttcgatccctgggtcaggaagatctccaggtgaaggggaatggctactcactccaatattcttgcctgggaaatcccatggacagaggtgcctggcaggccaaagtccatggggtggtaaaagaatcagacacgccttagcgactaaacaacaaacaataaaaactgtgtatatccttttaggaaatctctttatgtgcaccagagttcgagatgagttctgttcctccatgacctccttatcgatgaatgtaaatagttagcttggattgaagggctgacagcagaggcattgcttgggtaaattgaataggatctgtttactttaaaaattccaaagaaaagttcataaagtcaggattcaaaatagacagattagcaacattctccaggagcaactgaaatgcaagcttgtataccaaaaattcctccttctggaaccccaaatccaaaagagagcgaggatcttatcagaatgtgtgaaagtccaaatatatctctgtgaggagttcgctttacacacataagcagtcctgtgtgtaggctggtctggaagcatgctgaagaccctgtcgtcaaaggcagattcaacaagttattcttaatgttttacgataggcaccacccttacagcccgcagagcagttctggaagctcagagaaatgaccagcagcctctgaaggggccctgctcagctagagtcctagggccatttcttttgccattgctgtgtattcagtcacgtctgactcttggcgaccctgtgaattgtagcctactaggctcctccatccatgaaatttcccaagcaaaaatactgaagtgggttgccgttaccttcttcaggggatcttcccgagctagggatccagtctgagtctcctacactgcaggtggatctaagtcagtcagggttttcaccttcacgaaatgcagacatttgaattctaaggggggaagaggtggcacggtagtaaagaatccacatgccaaggcaggagatggcaggagacgcaggttcaatccctgctaagcacaatgaggtcaggagctatgatcgtccagatgcacacagttcttccttgtctttctttttttttttttttcttttttcccctgtaataacactcagtggctgagaataaaagagaaaaggtcattatcttcagtgtctttagtggcaattacacacatgccataagagtacacttaactccatctgttctttccgtgtgtctccttaagaggagtgaggctaccgtcatcacggttccatctcaccagtggagcaccatcttattggaatgggatggaaattaaagacaatcatctccaaccgaagcttaacaatttcttctgcttaaggacccaagcaaagcagtacagaaagagagggataggcaaaaatggcagagggtaaaatttaaagaactcgactctctcaaagacctgtaatatctgagcttccatccatagagcattgtgtacatttactgagggaaagaaaatatatccaacaagttctttgatgctttttcttttcaaggtcaatgcttgatgctgttggaataacatttactcattgtagaaaattcagaaaatacagataaggaaaagcaggcaaatttaaattattcatagtcttgccacgctgagagattccctgtggactccatagatgcacatttgcatttgtctctatctatctatatatctgtctatctatccatatctatctgtatagacatacacgtctatctacacattcacatacaaatacccaatttttacaaactgtattgtcattttagactctcaacaatacatctttatggtaagcaattctagtactcatcaatatccagttatcctctactttctgactctctagatgacttccttctctgtcctttgacataggatgcagccattgactttggcaaacgaaatgaaagctgaagctttcacgtgccacctggaggcagaaatatcctgaaatgctaagtcaacacatgggagaagagcttcccttgagagcgaccagctcaatatggtcttttgttgtaagacattaaaaa

SEQ ID NO: 40186 - DNA, 2217 bp, Bovine  19866880904525
tgaggaatttgaggttctgggtataacttgtttgggcatataactgaccaaagttaagtttcagaactggagttcgagcttacaccttactgactttagaacttgatctcttaatcaccacagaatgtagatttttagattctaaattaaattttacattagaatgtcagtttactggcttacagttcacattcaggatatcagaaataccctctgagttacaaagactcttggctgttcaggacagggtgattcatttagctgggattccagaggtaagagtgaaagtgtgagctgacaggtccagtgagcctgtgatgactgaatgagtgtaccagttgggaaaggagagatggggcagaaagaaactggaaataagagttcagacaagtgaaggacataggaattagaagggctcatgatttgggagtatccttttcagtcctgagcctgggacttggggtctattcttaatttgaaggtttaaggagaagctctttaaagaaacagcagaataatgctgcttcatggagtacctggaaagtcaggtagtcttaaagcacagatgttaatgaaccaaaacagggcaaacctgtgaaaacatcaggccttcactgtctgatttaacactaagttggttgtttaaaaactggctttcctctgcatgtgtttattgtcaagattgcatgtgggttattcctgttgccataatagtaatgttgatgatttttcaggtgaagcacatgaggaagaattggaatccatggcaaaacatgaatctaaggaagatagaattttccagaagtttaaaactaaaatatcccttgaaccagaacaggtaaaatggaactcatatagctccttctgctgttcaagtggtgtaggggtatgaatcttgagttgggaattccctggtggtccggtggttaggactttgcactcccactattgggggcccaggttcgatccctggtagggggactaagatcccaaaaacccccaccccaccccgcccccacgccaggaaaaaaaaaacacacctgtgtagaagtaatttttctaatacagttagtctcttgtctgtgggattccttcacacaagtggtccatatggaaagctgtttgtagtgctgatccttttaatagttagggaaagactaaaggttacattgtgtatcatatagtcattttctaaaaccatcagcagagataaacatcttttgttgcctgtaacacatggagtttagacactaatggcaagacagagaggaaattttggcccatttttccaacagggacctttgacttaaaaaattaacctgacacattcgtagagaaatcactgactttgtgaaaagaataatgggttttcgtggtgtgaggatttctggctccttgagttatattttggccttctgatgtagttgtatctacagtatagggagaagaaaaaagtggttttgaggatcaaggtagattatagacttacagtaagtgttcagcaactgtttcactttgcctgttttcttccattaactttattcccttaatttccttcaccataaatataaaccagtaaagactttgcaaaattcccataagtcagtcactagagcaaataaatacttaggggcttataggaagaataggtctaggtcctaaatactgagaaggtggtttttagcaatgtgtaaaacatctaggaaaatcactcggttgttacgtaacattttattatagtgaaatttacttctgttgtatttaaaacagtgtgtctcacttggtatttgtttgtttcaaaattggcaactaaggctccttatctgtgtgaaggtccgcagagacactgggctgcattttatattcaaaacctggtaatggggaaatagaattattgttagtctcttcacaaaacagccatagaattcagaatttaaccgtattgtcatctaagaaaaatagttgtgatgacctgcatcagatgagcggaaagtgtcactttgacgatactgaggcaggcattaagggtgccatgtgtatgtgccagggagttggggagaggcaggcaggaaaccggttttcagatgagcgtttcatcaattgtcagagtatgtacaaagtttcttgagatgatcctcaggtaacatgagatgttggtgatttaaaccgatcctaactattttagattctcagatacggcagagggattgccccgct

SEQ ID NO: 40187 - DNA, 1017 bp, Bovine  19866880926859
tgaactgaaaatatggcaaagcacaaaacctttggcatttgattccatttgctgacagagcctagttgtctctgataactaggacttgttataattaataatttggacctgaatttctttacctttaggagtggaaattatagaaaaggaaggtagaattctgagaacttggttcaaatctgtgtaagaagcatagctgaaatgtcccaggtacatattagttattgttggacagagaaaaaggaagggtgacctttcagagatcaataacaaatagatttttcaaggttagcctatgaaacctagtaggaaaaggcaggaaaaacactgattatactgagaaggattcaacttccatctgagcaaaggttacaaagttatgaggaagggtgaaagagagagaggggcaaaaaaaaaaaaaaaaaaaagagggagaaaaaataacacagacaaatcaggattcaattttcagaaacaccaaccaacagaattgcagattcaaataatgaaagcgtaaacaatttgggcactactttatttcttttgcttatcttcttttccctcttttctttgatatgaatgtggtaatgagaaacccaaaacaacaggaggagaggtatgaatgaaggaagaatgggagaaagtggaatactgcagcacttattctctcatttctatctcctatatttaaatttcagataaacaataaatacttttatagtgtaaatatgtcccaaatattgcatgggacactcatacactaaaaaatcatttgctgtttatttgaactgagtatcctgtacttttatttgctaaatctggtagccctaggaaagacccactagtcttagtagaggtggatcgcccttcgtttatccccttcttaaaaaattatattaattgaagcaaaacacatgtacaaaagaacactcatcatgagtgtacaggtcactgaacattcacaaatgaagacatccatgtagccaggacctaggtcaaaatccagactgttagccc

SEQ ID NO: 40188 - DNA, 934 bp, Bovine  19866881020984
acactcacctgctctgtggactaggacaagtgatctaacctctctaagtcttggattctcacctgctgaattcctacaattccaaactagtagggtgatggtgaagacgacattccagggtacctatgaaaatgccaggcaaaagctaatgctcaatgaatacatgtatgttctaacaaacacaaaataacaggaagttatgaaaaaaactgcagcatcaaaatgaggttccttgagtttgttcaaagctaaattagtatgtggagtccaccattggtcaactacacagcagccaggaaatgttcatttaaatgaagtaaagtgctgacaatgaaaagctatttaaaccacatcagatgaatcacatgatattatgtacaaggaaggctttgagcagaaggaggaccagcctgagggtcatttacaaccaaactgtcattactggtaacatgtgttcaatgcctatttaaggtgtttttgaatgtcgcttagaattaaagcaagtaaagaaaaaatattcatcagatgacaaaacagtcctaaatccatccttggacattttccagaaaagactggatctctttcaaaagccttagatagccgctaacagtaagaaatctggaacacagaaattgcgtacatatattataggtgtacacgtgtaattattttttaacaatgttcgtgataatgtgggtcagcttgctttagaaaaatagcataattatggtagtttctctgtgctctgttgctctgtcttgtccaactctttgcgaccccatggattatagctcactaggctcctctctccatggaattctccaggcaagaatactggagtggacagccattcccttctctaggggatcttcccggcccagggatcaaacccacatctcttgtgtcgcggcatcagcaggcaggttctctccca

SEQ ID NO: 40189 - DNA, 890 bp, Bovine  19866881037382
actgaaaacaaccctcaggtatccctaacaatcatttccttcagtgacagaaaggattcagtgaagcaaagtcgacaccctctatgtctattgagtatagagcttgtgcattatctagagtcagagagaatatactagatgcagaaaaatactctataattccacttatacacgtcacctagagtagtcaaattcatagagtcagaaagtatattagatgccagggaacaaggggtcaggaggcggggaggggagccagtatttaaaggggacagagtttcagtttaggaaggtgaaaacttgaggaggtaggtgatggtgagagctgcccagcaaagtgaacatacttttagaataatatgctgtgttttatgtgacttttatcacaaaaaaaaagattgaaaaatttcaattgaaagttaaggaattttgaacttttttcccatttgaatttccttaaactatgaatgaaaataatgcttacatatagcaaacactactacagagaaattaaattgtgcatgattcatgaataaatgataatgtggctaatccagtgatgtttatttgcataacctttttaatgtgacaattccttggatattgtagtgaaatattttcaccctacatctatatttttatggtgtgtgtttactttccacagtacatatcccaaaatgtcaaaattgctagagctgatttatggtaattagttttaacttggaatatttgaaatgcatttaattaattttagctgtttagcaaagtacaataaggtttttcatattagcaaagttttctttatgacatatcagctatgcatatgtttaaggatatgacggactcaaatgactcttatttgaattttatatttagcaaataagcatgca

SEQ ID NO: 40190 - DNA, 1076 bp, Bovine  19866881043465
tgtgaaggctcgtaaactgtgcggaagcaactgacaagttgacaaaacattgacaaaaaacaattactcaagaagcagcacttggaaaggttgcttgttgttgaggagatatcagagaaagaacaggggaagatgccgtttatgccaaggcgctaaaacgtaatttctcggacggcatcacagagctatctgtaaggaaagagtcaacagatgaaatgatatactctaatacagtaaatgggctctgcgggtggcgactgtggtaaagaatcctcctgccaatgcaggagatgtaagagacgccaattcgatccctgggtctggaaaatcccctggaggaggaaatggcacgccactccagaattcttgcctggaaaattccatggacagaggaacccagtgggctacagtccatggggccgcaaagagctggacacgactgagtgactgagcacacaatacagtaaataaattccttacattttatttgtgagatgcgctgaatcactgggcagctttaaaaaaaaaaaaatcactaatcactttccacccaagaccaaaatgcagaagttattttaagatgcctgtattcaaatacttgaaatagacaacacactttgaagtgcttaaaatacaaaatatatcttatcagtttgaaataattgctgtatttttaggcatgatctgcatactctacttattttgagactgatttaacttcttgggttgaaaaatacaaaggaagcaggttttaaaacaatttaactacagtaataataatttggtgaggatgatgtaaaataccatttaggtcttattttgtgccagttagtcatgcttaattttttacttgtattgtttaataactcctcgatccctctctatgaaataggaacttctattaagcctttttacagataggaagtttgaaccttgaagcagttatattacttttccacgatcatacagctagcaatcagaggagtgaggtttgaacataggtatgtgagttcctgccctgggcactgcaggtatacacaggagtctccagggaatcaggaagcaggtctctccct

SEQ ID NO: 40191 - DNA, 948 bp, Bovine  19866881073470
caaggggtgatgctgtctttctcttccaaggtcttttgttacccaaattttctcagaaaaagagctcagaacagatgattgttactacctctgtttgcaagctgtgcagaaatgcaaaatctctgtggaaaactgtttaccaaaacccgctgttgcatcagaattcaagagatgaaccagttctatggctatgagtgaaccatacaaaagagacaagttagacgtagctctggtctctagaaacaatgactgcggacatggttttcaggggcctggagtagaagaacccggacctcaaacaagctgtggccttgaattatggaggacggcagccagtggacacatgcccgttccatccttatttatgagccctttccttcctctactgaagtctatatttagtgaaacaggggtcaaaacccacagaatcccctgaggaatggactccaggtcccgtgtggttggtgacatttttatttattgctttaattatgcctattgtaaccagcccacaagaccaagcaaagggcacatgtttgaaaaatgggtttattatggaaattgctagtgatttttttgagtgtgtgtgactgtaacagtatcaagccagcttagtcctgctaacagttgtgaaattataacagaatgttctgctagacttttcaggtccatttagtcagttatttgtctctgacttgaggagaacttgggttttattcacttatttattcaactgatactaagaagtatcaagcactgtgagaggttctgaaggtaaagtgatgaaaaacactaaactcctgtgcacctacatggagctcccatcctagtggggaaggtggaagaccaactggtaactagacagatgaacaacatcaggtggaggtggaggtaagggcagtggagaaaaggaagcaggacaaggggaggaaagccggggaggagggt

SEQ ID NO: 40192 - DNA, 1466 bp, Bovine  19866881086348
attcaataaggactttgaaagatggtccacaataacagcaaaatatcttaaaaataaaaaatccccatcttagtaacaagacacggagcttgaactctggagaccacggcttggagtctttttgttttgttttgttttttatttttggctgtgctgggtctttgttgctgtaagtgtgctttctctgggtggggacagtgggggctactctagaatttcagtgtgcagtatcctcactgcagtggcttctcctgcagtagagtgtgggctccaggggttgagggcttcagcagctgcagcatgtaagttcagtagttctatacaccaggctctagagctcaggctcagtaattgtggtgcacgggcttagtcatgctgtggcatgtgagatcttcccagaccagggattgccctgtgcctcctgcactggcaggggaattccttaccaccgagccaccaaggaaggccctggattcatatttttaaaaccataccaatttctctctgcgaaggacaactgggcatggagttagactcccaggctggaatctaagctctcagctctcagcacccagttttccttacctgctgtacagctgtggtgaggagtatgtgaacagacgtatatcaagttcatgaaacctagcggagtaagtttactataaaaggaaacagttatcattacacttcaacaaaaaggaaacattgcaaagaaaaaaagaaagtctaccataattacatcacaccaccatcgttttttttttcgtttgctgtacttttccctttcctcattgttagcatatttgcaaccattcagtatatacaaatctgtactctatttctcaatagagcataaacacttttctcacaaacgccatgctcaatatctacatccagtaaacttataagtgatcatttccttagtttttaaacaccgagattgtttccaattttagctttaaaaataatggtgtaataaatgtcttcctgaatttagcatttccacacactgggctatttcctaagaagggatgtttcatatgtgtgcttcttcagagttcgaatcatgtctttcctctttattgttaagtccccagagactagcagagagtctggctcaagaacgagttgacgaatgaatgaatgacttcaacacgttatacattaaacatggggtgtaaatgtagaatatcgcccatgaaaatgtaaatgccaagtattaacaactgtagaatgttttcattccatacattactgaaggcattatcaaatggcatacttttttatcaaaatcttagaaaaaacttttttataatcttatcattttttttttattctgggctttgctgggtcctcgttgccgtgtggtcctttctctagtggcagctagtgggcagctgctcttggttgactggcttctcttgctatctatggagcacggccactagggtgtttaggcgtcagta

SEQ ID NO: 40193 - DNA, 3026 bp, Bovine  19866881125401
taggcttgtgtgacgttcttgctgggggtagatttacaggagtttggccaactgcagagaactgctttgggattaaacacagcaaggagagcatctagcccaatacttggcgcaaggcagcagttttataatcacgagctccctcgggttttatttttattcccatctccatggagatgtatgaggtcttcttctgaggtctaactatttgggtaagtgtgaccactgttatgttcctatttatttattttgctgagttttctgtgcaagaacacatttttgtattgtccttttgagccctttctgttgttctttgaaacaacggcaatagcaactgaatatgggtggccttccattacaatcccacaactgtaaatgaaactggattcaaaaaatatgtccagattaaagcgattaacgtcttccttgtcttcttgttaatgcacacatgcccaacctgcataattttctctcccagtcatgcaagaggcaagggtaatttagaaacacgcatgctgtctttgtaccgctgttgacaaaaggctcagagaaaaaacacataatacacctttgttgaaaataaacaagaataaaccccttaagacatacaaagcaaggtctataatttggtgcacattttttagcctgaataaatcatgcctgttattttcttagcgccaaagcaaggaaaggctgcccctgggatgggatgacactttctacctgtttccaaaaggcacttgatgatgttaggaggtagtgcactctgtgagaatgtcaggcagaaatcatccagtgaatattcatgatttgatgttgttgttgagtcactaagtcatgtccaattctttgtgacccccacctgccaggctcccctgttcctcactatctatctcccagagtttgctcaaactcatgtccaatgagttggtgatgccatccaaccatctcatcttctgtttctcccttctcttcctgccttcaatctttcccagcatcaggatcttttccaatgagtcggctctttgcatcaagtcgccaaagtattggagcttcagcttcagcagcagtccttcccatgaatatttagggttgatttcctttaggattcactggtttgatcaccttgcacctctcaagagtcttctccagcaccacagtttgaaaacatcaattcttcagtgctcagccttttttatagtccaactctcatatctgtatgtgactactggaaaaaccatagctctgactatatatagacctttgtgggcaaaatgatgtctctgctttttaatatgctatctagctatgtcgcagatgttcttccaaggagcaagctgcagtctatgatgggaaagagtaatttgttacggatctgaatcgtcaggtccagtcatttggcttgaaggattcagttgactccactgaaagcacatggcaagtatagctcctaaatgacagtaagaactccctcatttatattctctcatgtctctatctcatctaaccctgtcgggtgaacccctgctgccctttaaatgcaaattccatccattcccccatctgcatggagctgacaacccatcttccatgatgcttcggcactctgtatgtacttctgttagggcccctgcatgcatatcagagatttgtgtttccattcttgtgtccctcactggagaattacgtccttgaaaggagaacctcatttcactgtcgtttgattccccaaagtgaactgtgttcctacctgtggagtaatgtgttttgcacatttgctgaattgaatcagaatttcaggtttggaaggaaactttcccatcattctaggaagcctagaacagtagaaccaataacatctgtggcccgtccacccctcatttagtcgatggggttacagggctggttcaagatctcacagcaagttggtggtaagcagagaccagaatccagaaggccccatagcagtccaaggacatagtactcagtggacacccgcatgttatcagtttctttgagaaaaaggaatgtgctgtatctttcagttagttggcctggtttcctcatcataaaactctcttgtgaagttccaaaactaagtgatggtatgcagcatttcccaaacatgtttccccatggaaccttttcctcacactatctgactcaactggtgttccccaaaacacactttggaaaacacaattgcagtagacagaataatgaccacccccccacccaaatgttcaagttacaatccccagaacctgtacatatgctatgttatggacaaaggaggaattaaggtgttggatggaattaaattagataatcagctcaccttaaaatgcaaagattttcctggattatctgggtgggcccgtatgtgtacatgtgctaagttgctgagtcatgtccaactcttcgggcccccatgaactgtagccaaccaggctcttctgtccatgggattctccaggcaagaatattgggagtgggttgccatgccctcctccagggaatcttcccaacccaggggtcaaacctgtatctctgtattggcaggcagattctttactactgagccactggggaagcccctcttaaaggagaaagaaagcagcagaggaggtcagagggatgcagtgtggggagtgctcagaccatcactgtgggctttgaaagtggaggaatgggccgcaagacaagggaagcaggtggcctttgagctggaaagggcatggtaatggattgtcccctagaacaggggcccccagcctcaaggatctaatgcctggtgaagtgaggtggagccaatgcagtaataacaggagaaagtgcacgataaggacaagggacttgaatgatcctgaaatgactccccctcctccagcctgtggaaaaattgtttcctatgaaaccagtccccggtgccaaaaaggttggggaccagtgtctaggggcctccagaaaggaaacgcagcccttcccatgtcctattttagcccagagaggcccgtgtcagactt

SEQ ID NO: 40194 - DNA, 2245 bp, Bovine  19866881361394
cagagacttcaagctcctgttcatttgaaatgaagaaatttggctcaagacgtacgggcggcaggcttaccgcatcaagtcatgggtctggctctgggaggcctggccccttcccccggaggagctcacagtgcagtgggagagaaagatgcggacaaaactagctgctaaacaagctagcctggggaagtgcttcagtggaggcataaacacgaaaacccgggtccagaggagagagatccactggtgtgggggcaaagggagggtgggaagactgtgtttgagctagtgtttgaaggacgagaaagaccttgacagctttctgtgggaaatgaaaactggccagtgctgtatctctagcttttcggagttttattcctaggctgcggaaacatgagttcaggagatgtgtgatttgggcctttttaaagccgatgtaaccagatttctggctaatgggaacatagtcataacattgtcactgaatgcaagaacttgttgatatattttgctaaattgcccttattaatgattcatcaactcttttttccttcctgcactaaaaaaaaaaaaaaaatcttgctataaaatttaacccgcatatctacacacccagctgctgctggtgcctggcagtcttcctaagcagcgtgtgttttccagatgtgattgttgacatgcaaattttggaattcagcaacaatgaatatgtataaggaggacagaagcctcagaatacatctatgatatacaaagatcagtgtttcttaacctgtagtgcccggagcattatttctttttggaaagattcacagaggtaaaaaaaggaaaaaaaggtctgtgtggtgtgtagggtcccttggactgcaaggaaatccaagcagtcaatcttaaaggaaatcagtcctgaatattcattgaaaggactgatgctgaagctgaaactccaggactttggccacctgattcgaaggactgactcattggaaaagagcctgatgctgggcaagtttgaaggcgggagaagaaggggacgacagaggatgagatggctggatggcatcaccaacgtgatggacatgagtttgaggaggctctgcgagttgatgaaggacagggaagcctggcgtgctgcagtccatggggtcataaagagtcgggcaccactgagcgactgaactgaactgaattgagtgttttaagtcagtgtgtcagctatcgatttatcacctcttcgttccaaatgcacctcgaatattaccagctccatgatgaagcgttaagtattctttgtagagagagagtattaggatttgtcagtagagggcgctggagagacaccgcaggaaggagaggatgctcttcctggtgccaggtggctgttttcttcttgcttcagaggcacccttgccagcagctctgttcctccattgcaagtccagagcttgcggttgctctgcaagctcacagccccacgcagcctggagacctcctcacacagtcctgctgaagaacacaccgggcactcaggctttgtgctgcccggacaaccttgcagcctgccctcctgtgctctggaggtgtgtttcctgctcacctgggccctgtggagctcacctgcaggcccatctagtgggctgcagccacagctctggcaccccagcaatgggggaggggctctctcttgcaaggttttgtccttccttagtttccctcgtacagctctaggatattatttgtttaaagattttttttttaaatgttgaccgttttttaaaaggctttattgaatttgttacaatgttgcttctgttttatgccttttgggttttctttttttgttttggccatggggcatgtgcgatcttaactctccaaggagggatggaactcacacccacccctgccctggaagacagtccgtcaaccactggatggccagggaagctccatagggcgttatttagagtcctaggttcatgtttatagttactcctttatgatgttgggaaattcttcagagtcagtaatctttatattaagctttccctgttcaagttcccatggggctcctgtctcctcactggtcctcctgggactgtgtcagtccagccatagttctcaaacactggttttcaggacccccttctatactcttagaattattgaggactccaaagagcttttgttcaagtatgttatacctcttgatatttccatataaaaggaaacaaaatttaaacac

SEQ ID NO: 40195 - DNA, 899 bp, Bovine  19866881364449
gaagagatgcagaggtgagcttacctgggaatttattgcttagcagggaagctaattcttgtaatctagcaaaaatataaagacaaacccagtgcttaaagagagaaaaaaatgaggtttttttggacaaggtagcatgtgagctggttttaaaagattggtaagatttagacatgcaaggatgaaggcatccgtagtaaaggaactcatgaatagacatgccaaaatgataaagcataaaatagttcggaaaaatgaagcctagaacttcagcttcagagcctgaaaaactcagtttcaaatccgagctgattaagccagctcagacatcttggaggcacaaagggttattttcctctatgaaagtgatagtcgctcagtcatgtccaactccttgcgacctcatctttttctctctttaagcattggtttgtttttgtattgaacctgcatctcctgctctgcaggcagattctttaccatctgagtcacctgatgttgagatgtagacacggctttggtcctctgaggcaacacatttcctccaatagtgccccattctttccttccctccagcactcatttcatgccatggttaagatcagttactcggatttataaagccacctgcccaaggacacatacttttcagagcctgaattcaacctgaaatctcttgaatttcaaaactcccactcagccaagatctgctgcctacatcccttcacctcctgcactagaatctgtctcctctagttttaaccatcctgggagctcagagtacacgcatcccacccacaccttgctaggcaaccagcagcctcaggaaaacagaagacgtagaagcttaatgtcaccaactgacctttgttcttctctgcaccattttaagaacaaac

SEQ ID NO: 40196 - DNA, 743 bp, Bovine  19866881675145
cctgggaaatccatcgacagaggagcctggtgggctcagtcctggtgccgaaaagagtagacgtgactgagcatgcacgcaagacgtaaagaatcccacagtggccaaattcattgaacagaacaagaccacacaaagctggaaagagatgctcacggtcccccagcaaccgtctcctgcctccaggaccctgatctaccggatccagctcctgcgctgcctttgctccagagccacctctgagtcttgctgaccctctgccctctcccccaacatccatcagagtatctgggaccccctagggcaactcatgtctctttgaggaataagtgaatattcagctggaaatgaacaccctgaattttgagcattagctaaaggctaggtaggcaaacacacccttatctataaacttgaggaatctcctatgaagtgggtagaggctcccctctgcggttcatgtgcttccagaagaagagcagctccataatcacgctgtcttcctggagttttcctggcaaacccacaggctgccattggtggtgacatggcctgtggctttcagccttgctctgcggtttccttaacatgaaaccttaaaccaagctcttgaaagaagctacgtgggaagtaatgagcctcaaaaatgaatgcattgtaccagcaaagaagacatttaattagccaccataatagcatcggttagggttctctttttcttttctttcttttaaaaataagtt

SEQ ID NO: 40197 - DNA, 788 bp, Bovine  19866881762360
ggattgcaaggccgcaataagtagcaacttcagtgggagtgaaaaggaaagccaaccaagacccatgattattgtttctctcttttctttctcctttgctttggagtgggcaccaaatgccccggtccagctcgggacgctgcttctggcacgggctcgtggtccactcaacattaatgctgtgatcacaccttcggatgaatcttggagctaaaggaagagacaaaaagaaaatttcataaaccaccccgagtcttggaagctaaagtgccacacggtttcagggcttcaccagccggtctcttagatcgctagcgaccccaagtggccaactgcaaatgatggtattttttttttcttcagataagaaacctaaggcttttttttttttttttttttttaactcccaaagcttcttcaaatttaaaaactggggagctggaagatccatggatgtcacctcattttacaggaaggagaggttcagagaggtaaataggggtcccaaaagtcacacagcatattaaggtcgagttgggaagcagtacaaggaaaggttgcaagagattctgtggggctggattttaattccttaatggaaggaggaaaaggtctttccccacagaccacaaaagaaatgttgctagtacaaacgaattgcatgctgaggggggtgtgttctaacagatctgaagtttcattaggtgctcacccaacacacacatttctttttttcctcttctatctataaaatgaccagggcacttcagcttaatcaaggcagcctg

SEQ ID NO: 40198 - DNA, 1084 bp, Bovine  19866881977024
cttaagaggcccctgctacaagcatttaataagaccagggttatgaagtcaaatggcttggcacataggtgctacgtaagcgcttgttccaaacataaaagttgcaactatctcccaattccatctaaataaaaggcaacctcagaccagaagtacatcgcaagcctacaaacatcccatatgaacacagccatccaggcagctcaccactcactctgctggacaaggtggtccctgctccctcatcatcgtccccaggcgcagcacagcccccagccccagtgggtgctcagcgaacatgtgctcaacacccccttaaatagaggggtctgggggaactgagatccaggtgaacacaagcaagcagaaagcgcatcctctcctgaccttccaaagccactcatattcacaaagggccttgggggccgaatatgatctgggggacaaaggacgcttttctgaggtttggcactaattcagacacgtgggcccagaggtctcacccaggtcagcggctcactccatgcagctgtgcttgttaacagagagagccagtgttccaggcgatgggctcacacagcatttctgtgggtcagacatgggctgggagcctgtcccactctacgacggcttaccctcccaaaggtcatcacggacccccattgtacagactgagaggctgaggcctagaggaattgaaccactcctggtggaggcggaggcaccattaacccctccagcctgcgaggttcacacagagttgcgagatgcccttggaggtcaggacctcatggagtagcgagttgattgataagccaggagaacatgggcctgtcctttcacccgcaagagggaggcacgagggctgtgagctgctgagtcagtgacgtgactgcgatactcactcgaccaggaactccaagggcgtccaggagctgaagtcggcttcgggcattgacttcctgttcaccggggtgtccagggtgaccctgcagagcagagacaagcctgtcacgtgtgtgtccccactcccaggagacgatggcaccaagggtgaccacgccgacgtggacagaccactcga

SEQ ID NO: 40199 - DNA, 1638 bp, Bovine  19866882002036
ccccgtactgttttagattccacgtgtaagcagtctcatgtgattcaaatggtgtcctataatgggagccggaccccagggcccagcacttgtgttaatatgatgggcaacatgtatggaggtgctcccctgtcctgggcctagaattgagtactttatccccatttttgcagatgggaaaactgagggttagcaaggccttgagaagctgcccaggatttctgcagtggtgaatgggaagggctgggctttggacctgcgcagcctgaccctaaagcctgtacttcaaactgctgtgccaacccacaggggcacccagcggtgaatgctggctgctcacaagctgttatggattcaagggttcagaacccttgcctggcttttcacctctccgctggcctcggtacgagtctgtgtgtgagcctgggcctgtccaagcctccgtttccttagcaatagaactaggattagcctcatggcttctctgataaccattaaatgccaggtgaatagtaggttatgtccttcccaatttccaaagatgtccctagttctctcttcccagcctccttggggaccctggcatgctgccctttggatgtgccagtggtggccagtggtccctgaaatgttttctccccgtttcccagggatgatcggctacggcatggccaaggccgcggttcaccagctctgccagagcctggccgggaagagcagtggcctgccgcccggggctgcagccgtcgccctgctcccgtaagtggctgggggtccctccacatctgaccccacccagggttaacgtgggtcctggagtcactccacaccagggatgagcgcgtgctgtcacctcagcccctgagagccgtcaaaggccctgacgacacttgtttggcttttggattatctgggctttcccggatggttgcttagctgatgggatgggtcttcctggcctgcgtcttcctcattttctgtccttgtgtccctcttgattaagaaatagtggacacatttaattttaatatctgtagctctgtctttcaagtcatgttaaggtcagcatggaagaaagactcctgtttggtctgtgggtgtgggaagagaatttggggagaatttggggaactctgggagatgtttctggaaggatttccagaccaaagaccttgtctcttggctttagtcctgaaagatgatgtcggtgggctggggcgctggacggtcctctcacctttcattctgagattctgtgacctggtcccagggctatgattctgagtgatttcccaggcctgaaagttctgggaaagtcattcatttcagaattctgtattctgttattgaaagtcataagattccctggaaaacagtacacaatgaaggatgaggctgtcttccccccatatttaaagaaatattattattacacttaaaaaaatcctgagaaatgagtctgctgcattttagggagggaatggagacacaggcagaaaaagagtttactgcagtaaagactgttttagaaaaaggcaaaacgtggctcttacccaaagtgccttgctggctcagggctgggctgggctgtggtctctgaccgggggcagcttcccagcctccctggtgagcttcgag

SEQ ID NO: 40200 - DNA, 1848 bp, Bovine  19866880340147
ggacaggcaggatccgctgttgtcatttcggtcaagccggacggcctcaggctgtcaccctgatccccttgccacggccgctgaggccagcccccgccaacccgcatccccggccgggctcccggctcccctctcccggacccctgccctcaccttcccccggtgctcagcgctgctcgcccatagtccgtagcccggagccggggctactcggcgctccgtcccgggggaccggggccgggcaaggggcgtgggagccgctcaccgccgtctcccggcgcagcctcccgagccgccgccgccgccgctgccgccgcctccctccatggctgcagcgccgccacctgacaacggaagtgacgcaccgccccctcctcccggataggccgcggccccgccccttgcccgtatctacagcccacggctccgggattggacgccatcttgacgaagggcggaagccttcaggtaacagaccagaatctgattgaggattggtttagggtggagctcgggctgaaatctgggaaacgattggagacaaagactctaaggggcggtacttaccgcttatctgaatctgcggtgaggttgggccggaggcaccgccccctccgctactccactgagcctcgcgtgccctacactcgccctcccggatctggagacttctccagcagctgaaagatcggccggttgtagtatctttgtcagagaactggctctttcttgacccccatttctcgcttcctggagctttgtgcggcgagcgctggcgtggggctcatcaatgacaggaattcctgccgtagcccttacaattcatttccctctgggcccctcgcttttgtagaaatcccgcttcaatctgaagatccttagagtctcgaccagtcaggttaacagtgaagagttcctgttagctattccagccacctaacctcagcccctcctgctgcagtttcggtccctttctcctccttctccagcaaccacgccctccatgaatcagcttcttgcaccagcagatgagccctttaaagggattgcatcaggctgatgactcactggggccctctgagagcctggcttccctccgctggcatgcagaagcagctagaagggcgccgtggtggcagtacccgcgatcatggacccactcctttgtctccgaggtgtgagccagtatgccagctgcatatgactgtcttaactcctgagtctctttccagctgtgttattctgtatccatgtgggcacacgtgtccaagcctgtgtgcacagctctggattttcctagggtgtgtggccaagcacttacgtgtatgcacgcatttgtcatctccacacaggcagtgactgccaggacatgagagctgatgtgagtgagtctggctgcctcctcctgtgtccttgtctttgtctctatatgcctagtgctcactgagctgaaagggctgagtaacagtagtaatcgaaacagcagtagtatgtcagacactgtgttaagcgctttagagacatcagcgttaaggagtctgtttgcagatgaagcagctagaactctgagagggaaagtaaccaaagacacatagctaataatggcagagctgtgatttgaaccaagtctggcaggttccaaaaaggttggatttgagtccttgctgtgtctcttacaagttcagtgactgtgcaatttccctaatcattcccatctgtcaacatagggataatactttgtgggctcactgtgaggatccagtgagtgtggaaacagcttctcatgggacctggtgaactaagagtgcccatactcctctcagtacagtggaggactgaaagcaggca

SEQ ID NO: 40201 - DNA, 1385 bp, Bovine  19866880395993
taggagttacttggcgcactcacacagacacatctctgcacacccacacacacccatctggggcacgcacacatacatgtaatgacaacacacggctacaggcgcctatcctggcacgtacggaaccaaacacgcctgcacagatgctgagatgtgggatccacgggacccgaatgcacgtgtgaacacagggctgtgtgttcacactgagcccacatgcagatgtgtgcacatagagccacgcgtgcccggccagaacccagcacaaacgcaccttgttcttctccagcttctgccgctgccgctcctccagagctgcccggcgctgctcggctttgagccgctgttcctccagccgccgccggcgctcctggagctgcttctcccgcagtgccttggccttctcctccttctccagccacactgccttcttggcagctgcagggggttggggaaggagccccgagggtgtgaacatctggtagcacctgggcccccaagtgtctgctctgagtggccttgcctgttcttccggcccggggtgggtcttccccactgcctgcctactggggagatgcctgtgttctgagactacccccactcaagttgaagggcatgctgaaggtgggctggggcctcagaatgagggcttcccgggcaggaggcctatttcccctccaccagcgtcgtggtctctgggcacccgagaagaagtgagctctttagggccaggtccctgtctaacttcggggcctgctgacatattgtgattaagagcatggggtgagatgaggcttctgggtctgagtctcagctactccacctagctgcgtggcttaggcaaaggactgcctctttccgagcctctgtctccccatcctcaaaatgggtacagggttaagtgagataagcgaactgctcttagcacagtgtacacaacagagattcccaaagggttagtgctactaacaggatgtccatgggggtgaggctgaaggggagctgtcacacacttacccaggtacttggcccgctcttcccgccgttcctttgccagcttgtgtctctctcctgccttctttacatcttaacaaaaggaataagaagagacttaggtcaagaggttcctctcaaaggggagtcagcctcagggccctgcccccaggctgcatgcccacgccttttccatctcctccggagcccaggagactccctctggggtcatcacccagggctgggactgggcccgggatgagggacatcactcataccttgcttggtgggagggctgtcagaggcgggtgctgctggcggggatggctggctgctccttcgaggaggcctggcatcccgtgggcccgtggctggtggggtgggtcccctgg

SEQ ID NO: 40202 - DNA, 671 bp, Bovine  19866880398489
ggagtaattacaggcctgcaccaccgccttacccaggtctctaatctgctccgggtctctcccggctccgaactgggtggtcctggccctaaacctcccctagactcatcggatgacccccctcatgtacccgggaaggattttctcccctgtgttctgtccaaggagggagtgagttccttctgacccgcctcccccaagtagttctgcttcccagcccagggaagtagatcccccaatccccttgttagtgccagctgaggtgggcctcaatccaagtcaggcccagcctgggcagagaggggggagcttgctgggaaggtggatcgatgctgctgctgcagggactgacggggcggaaggagcaggcgcagctgggccctgcgcaccccatccctgccctttgtcctgacctccagaaggtcagttgtctagttcttcatcgcccagagatgatgcccagtgacctgttgtcctcctgctcccctttcctaccagtgtcttcttcctttgagcaactccagaaagcagtcatttattttttattttgattttatttttggctgcactgggtcttggttgctgtgggtgggggactactcttcattgcagtgcgtgggcttctcactgcagtgccgtctcttgatttggagcttggactttagagtggg

SEQ ID NO: 40203 - DNA, 985 bp, Bovine  19866880495606
gagtctgcaagactcctgtgacttgttagccttcagatggccctccagagcagcccttccgtctggtgctgtccacactgactcagcaagtgatgggtcccaaagagcagtgtgccctcagggcaaagatggtgttcccggggcctgggaggtctcatctagaaagagaccttgaggtgggatttactctggaggctgggttggccgacccagtccttcttctcaggaaggagagatgtctgccacaggccacctgggacccactcagccatcagggaagtgagagggagctgccttcatgtccttgtccccctgagctctgcagagagggatgtgctggtagatgggacttcacacaggccctttgaactggggagattttcacaggatttgaccttgcacttgcggtgtacagaaagtcaaagggaaagtggcctaagacaagggcatttcttcctcctgcacctgctcaggtgagactgtggccttgaaggtggcccggggcccacagcagccctgcatctcctctcgggatctgtcaccaagatccaagaagggaaagcgtggtgtcgcttgcactgatttccttactatcttagagatggttccactttgtctcatgcacgtctgggttattttgggtgatactgtgtcatcatggtttgtgtaatttattcagcaaactctctgctgatgaacttaggtttttctcggccttttgctcttcaaacaaagctgaagtgactgtatctgcatgtgtgtggttctgcccaccttaggcatccacaggataaattccaaaaggagttgctgcctcaaagagtaccttttataattattattattattattttaaagtagtttctcagcctccttctagtgaactggagcagcctggttttcccccagccagcaaagatgctccttcctgaagggaactgagaaccccagtggtgataaccctcttctggctcttcgcggtcag

SEQ ID NO: 40204 - DNA, 2746 bp, Bovine  19866880562243
tgcccctacttttttgagaggtgggcactgcatttgggaagtacagacagacaaatatctctttgggacactgagctgggctcaagaaagggctggattcagggaaagttatactcattatttgcctccaagtctctctgacaacctgtgtcttaactgcttccagtctccatgtaaatttcacaccatgtaaatttctctctttcctcctcagcccttctctggcttgcttggctctgagctcctgtctgtctgtctcagagtctctctatgcctctctttttgtctctcaagggcccttttgtctcttaagtcttaaactctcttgagtatctgtttcctctcagcctccgggtgccgtgtctctgagtaccaccatcccttgcctcaggctcctttctctccccacctcagtctgtctctctgtgatctctctccagcatttcggtttgtgcaccccactttcctactttttccacctgtctttctctgtctgaaccacatctaggaagtcctctcccttgttttgtcccagccccctcctctccccaaccctcttcccaaggaaagaatcttcacgtgaaggggagacagaggcgtgaactggagaagggggaggcgagaaggctgagtgcgatgggatggaaaggagaggaaagaagaaaggtggtggggagcaggggttggtgatgcagtgaccccaggggacaacatagcgtgctgggactccagagtccagagagtgagcagggatggctggaagcaaagggggagactggggggccaaggagcagggaacccagaaacggggctttgaaacatgaaatgtgacacagacaaaagcaaggtggcagtcctaggaggcggagaccacacagttggtaagcaggggagagaggtactaaaccgtgctgattccatgaggtggtatcctgctttatggcacatgaaaataacatggtcatggagtgcttcctctatgcaagctccgtgctaagtgcctttatcacggaccatctcacttcattcctcaccccaaaccggagatgcgggagctgttgttatccttccttcacagatggggtaaccgaggctcagaaaggtggaataatctgcccaaggtcgccaagctggtaagtggtggacctggagttcagaccaggtggtctgactcaaagctgggcccccagaaagtgacaccatgctccacctggtcccagatcccgctcggcgggggtggggagcatccaaggctgccatgggtggaccagggactgatgccaaatgtgccaacccctggcaacccagggagaagatgcctgggcccttgggatttggggttgggttgcccactgggagccagtggagagggatgaagcggtacctcaccgggcaggagggctaggatatgatcaaaaatacacaggaacgggcacgagtgtcccgaaatctgagccaaggagacgaaatcttccccaacaagtgtgcgttggtggatagtcagatgccagaggaacaagggtgccaaccgctaactggtagactggggtcctctgaacaattgtgcgcgtttctcactgcacaaagctgcccagaaagtagaggctgaaatccagcctgttctctagttgccaggtccttgtgtggagctgcatttgtccagaggaagggatgctttgttcctgatgtgcaaaaagatgactcaggggctagcatgcacctggtatcccgatcctgcaacatataataaggagggaccagggatttaagtaagacccctgcaggcagaaacagctttgggtatctgcagttgttattcactcctctgtcttggagcgaaagaagcttaatcttttctgagcaccggggatcggctgggacaccacctacatgtatgtgttcatgtatgtacatacaaaagctggtcaacgattcccactgatctgccacccagatgtcagttagtgctggaggaccaggtgtctggccccaagaccccaatgggagcagaatggaaaggctggaagccaccccagcaatagaaacctttgcttacttcctgagattaatgtactaatgctccctccatctgggcactgtcgccatgaccacaggatatctggtcccagaaggcctccagaggtctgtgcccagaattggggtatcctctcaacccacccttccctttagccattgctggggaagccagcttttcaaggtgcagcctgtcctcagctgttctgtgggagttgtccctttctgccaggcagtgagcgtctctgactcttggagcatggctcaccttgggggacctgcccggtactcagacatgtgcaatgtgacacgtgccagggagttaacaccccaaggaacagtccttgaccaacaaggggcaggaactggtggacaatgttcccatcctgtctgccagccaagttctgaggcatgttcagcgtggctccttgcaagattccagcaggattgagccccagctgtcctcagtttgatgatgcacccttgtgttggctttccttcttacccgtttcattctctccactcccttactctgttcctggagtcttcccccaaataaactacctgtaggcaagccttcatctcagactttgctttcagcgggctgggagactggctaaaacagaagggaacgggaagaatggtgttccccgtggctcccttccctgctctctccttaaaggcacatataataataacagtcatttaagag

SEQ ID NO: 40205 - DNA, 1992 bp, Bovine  19866880563297
tctcaagcaaggcactggtatctccgggttcagtttctcctctgcaaatcttgtgggcatctgccttgatatttcatgctaggagtagacagcctttcccaagatcctgtactgtgcctgtgcctctcacacacctgtctggctctacagttatcatgtcccgctaggatgggtcctcctgcggacggactgagtttgactccctttgaatcccccccagtctggtcctgtggctcagcacagaacaggcactctacaaatactcgctggctgactgcatgaatgaaataaggggcttacttaaggagatgtctgaaaggtaaacaccagatagagataacaagaaagcctcagccttggtgtgtgcttgcaggtaagggagagacaaggcagagatccacttgtcctctccactctgaccctgctctgccattacactaataatattaagcaaataatattaagatctagtaagagaaatctgaacagctatgcagactgcctggggatgggaaaccaggctctccacctgggaagggcggacacaaggcgctgtattttaggtaagcctcggtagtgtaaggcccctgcctctcaatggttcatttccactcacgcccactctaaaagctcctgctcccatcctccccttctcctgcccttcatggcaggatccaggcccacgactttgttgcaagggtgaatgtgggcttcttcgcaggacctctgcaccatcacccctccacgcctgcctctgggtggctttaagtaaccacctcaagcctcccaggcaattgaatctttcttccgcctcaagtcgcatccagttcctacctggtttctgggtggcatatccgcgggcagcctggaggatgagacctacgcaaaaaaaaaaaaaaaaaaaaaggtcgggggggcttaggtccgtctccttcaacagtccagccgtgattctggtctatggccgtcgcattacccttcctctgtgccgaaccgccgccgcattttttcggcaccaggataccccatgtctctcccacctcacttcacttctttcccactcaccactttttctcctgccgctacaccgtcccccagtagcctcttcccccctcataccctctatatcctccaaatcctatttctctactcttgctgtccggcttctcagctcacctccaggacttgagggaaggtcccgctggacggagagaagcttggcgcaccctccgcccggcagcccgaggaccgggggctgtgtcactgcctgggttcgaatcgaactcagcgccctccacgccgccctcagcatggtgacttccgacccccaatggacccgcgcacggccgcgtcgccttcgcggtacggactgggttacacgggcgccgccatgttggctccggctcgaccaatcgagtgcagttgcgagaccggagcagatgaggaccgagatgatggattgacaggtaggcctccgtgatgacgcggagttgggtcaagtggagaggtctggttagctctagcgctccagtactcttgcctggaaaatcccgtggacggaggagcctggtaggctgcagtccatggggtcgctaagagtcgggcaggactgagcgacttcactttcacttttcactttcatgcattggagaaggaaatggcaacccactccagtgttcttgcctagagaatccagggacgggggagcctggtgggctgccgtctatggggtcgcacagagtccgacacgactaaagcgacttagcagcagcagtagcagcagcagcagcagctgcagcagcgcgagactggaggggcttggttgcctggccctgttagtggcgtgaggtgctgtatcagctctaatgccaccttttcttgatcatgcatcctgcccttaatcccactccagtttcctgacgagttatcctaagggcttcccgtgggcctgtcagggtcttcttcccccgacctagaatttccatcccctct

SEQ ID NO: 40206 - DNA, 4998 bp, Bovine  19866880671717
acttcttgttcattacctgatttagtgctcaactaacccattgaataggttctgttactatcctcagacgaccaaagagaaaggtagcataacttaccaaaaaactcagagccaaggagaggcccagctgagctgtgcgcctggacagtgtaacgtcggcaggccatgctgccagcgtacaaatcctcagcactttgcactttcgctgccttgcgtgcaacagatgcttattcttggcaatgttactgatataatcttgtggaattttagagtttgaaggaacgcttcaagtttatctcactttacagatgaggaagaaactgatttttttttttttttggccatgctgtacaacttgtgggatctcagttccccaaccagagactgaacccaggccccctgcagtgaaagcacccagtcttaaccactggactgccaggaaactccccaataaaactgatgggatttaattcaaccaacacctcaatacaagagtgcatgaagcaaggaggagaaataagcatagtgtggggttttgactcatgtagtagactttcagactctatgcccgctggacccacccggccggcccctcctcaccagtccagcacgtggctgagagcttgcagtcagaaacacaagggtgtgaatcctcagctctgccccttatgagctggtaggcctggagggagtggtcaacctctgaggagataatgagggtcttaacagctccagcctcagagctatatagagagtttataaggaaccaaggaatggacatagaatctggagtcatccttgattttgaatccttctgggcaagtcgcttcactctctgaaccccaacctcctcatcgtgaaggcaggggtcgcgctatccatgggcttccctggtagctcagctggtaaagaacctgcctgcaatgcaggagaccccggttcgatccctgggttgggaagatcccctggaggagggcatggcaacccactccagaattctaccctggagaatccccataaacagaggagcctggcaggctgcagtccacagggacacatgagttggacacgactgagcgactaagcacagcacagcagcactaccctccctgggaggtttgttatgtggctcaaagaggttctgtttgtaaaaacactatactccgccagttgtttgtcatggtgtgtttttctctcgtcttaagccattacacacttcccattctcagaatgcatatgtctgtggaaatatgccaagaaaatgacaccaaagtattttttccccccaggtgtccatatttctaaaggacaaagttcagaattccagtggtcgcttcgtgttgccagtgtccgggcccgtcccctggggaactgaagtccctggactcatcaggtgaatgaatgctcaacagtaattgtcagaccagtgttcagggggccgggaaagcaatatgtgggccgccacatagactgcagccatgctcggcccctccctttctccagttaagcacagcagagaggaggtaaggtttaatcccagcttgtcacctagcagatactgcaagatttatttcttcatctattgaatgtttactgtgaggatgaatatgataatactgtaatgctctaaagtgctacacaccacccagtacatagcatatactcaataaatattattatcattattattgtattactatcacccagctggcgttagcggtaaagaatccacctgccaatgcgggagatgcaagagacgtggatttgatcctgggtctgggtcgggaagatcccctggagtaggaaatggcaccctgcttcagtattcttgcctggaaaattcgacagacaaaggagcctggcgtgctaccgtccttggggctgcaaagtcagatgcgactgagcgcacaaacccgcacacacacacacacagttacatcagctagcatctttattttgaagcagcatgtaaattccctctggtcccatagtacaaagaatactgaagcctccggggctctccaggcttggagagcgtggcgtcacgtcctgctttgtcttttttttttagtatttatttatttggctgcatcaggtcttagctgtggcgcgtgggatcgcttgttgagacacgggctctctacttggcgcacagagcgtgcaggcttagcagctgtagcgtgcgggcttagctgctctgtggcatatgggatcttagttccccaaccaagattcagacccatgcgttgcgcggtgagttcctaaccactagaccaccagggaaatcccatcatgtcctactttgtctcgtagaacattcaacaacaaaggcaaagaagtgaagaggacagaatttaagcacggcgggagctacgtcgcggcccccaaagaagggtctcttgagctctatggagaccgagtcctgaaactgggaactaatatgtaagcaaattcttccttccccaaatgaattccagtgcagcagaggtcccttcatttaaaacactggcttgacttctgcagtgaaaaacccctgctgacaattgaagaaatttccccttagagacacggcaggcagggcccccgcatttccaaagggcacctcggatcttccaccagaaggtagattaacaggtcaaaaagataaataacttaaaaatagccatacaagagaactagccaaaaccttttaatgcagtagagacccaaaaggccttggccttcatgtaccgatcatgtttttttccagaaatacacattactttgcaagaggaaatatcgccatacagcttcctaggtattttgatttgggaagaagcaaaacttgagtggttgacacccacttagttatagtctgtatccccagcacctttctggatgctttttgatacctcagagtaaaagctatgcactatatttacgagttagaaggaagtcagggtaagaggcctggacaatgttttcgtggttttccgttgccaccaggtatagcgtgaaccggcccgtggaaacccacatgtctgcagcatcaaagaacttagcttcacagacgcaggtgagcttctgcctcccgtgtttaccttcagagctaatttctagataccagagtctggacagggagaaggggaggggtctctagagttcagagctggccaaggctccctccttgtttgcagtcttctccattccgccttacccagtacgcaggtttttaattatagtttctcatggagacttccagtgatctgactaattaggtaattttaagcttgtctccaccaccataattaagcaggaaccacacataaggacatgtgaaatagcattgtaccagtgctgtgaggtccgtggctgctgagttcagcacttgtgtgtattctgatcgttaaaacatcccctttccctgcttccctgggtgatgatgtgaaagttgggttcaaaatggggtttgggttctctgaattcttttgtacaaattttcactgaactagctgtcatctagctataggccccatggactattcagttatgctataaacatttattgaactgtgtctatgggtggggggggggcgttcccaggacacagagctggcttagatttggtcccatcctgaagggccttgtaatacgctaggcttataaagacagcaatagaaacaaataactataacctggcggaagacagaaggtgaactcactgagcattctgagcaaagaactatgtcagaacacatatcctgtccaggggggtgggaaggagccccctggacagggaacaagaaggcttttcggaggaggggacattcaagtggggctctggagcgaggcagatgctaaacagctcagaaggagaaaaagacacacaaaccaagatgacaggacgagcaaaggcaccagaggcacgctcctggggggaagcaggcagtcagcgtccctctcgtgtagctggatcataaggcgatagcagcagtggccagagacccgcccagacaggcacacgggcctgattccagaggcaaagcaggggaaaagccgggttagagagagccaggtaggaggagggtgcaggctgcagtggggccaggccatgagagaaggagccacgggagagaagggattcgagggtgtgctcaccggtcaccaccggagggcagtgtggtcgctcctgtggaaggagtgcccttggacctggaggcttcacccaggccgcgcgggtaaaggctgggggaactagactgcctgaagaggaagcagtgttctccttcgaggaggaaggtggtttgaggagaacgaggatccctggggccttccactcatcttgaaagtgtgagaatctctggcttgtcgccttgctagagtccctctgcttctgacacgggctatttctcttctggttctatttcctatgcttcgtgtggacccagtgcttcccagaaatcatttagacagttactgttttgccttgttttgaaataccaccctgggtctctggggtatcagcaaggaattgaatcaccttcacgtggctaaaaattatgaaattgattttgcaggaaagcatcgttccaaaccctcttgctaaagaagagctgaatctcttggccaggctgataggaggcatggagattcagaaacccagtggccctgagccaggattccggttgaatctcttcaccactgatgaagaggaggagtatgttttcaacctgtttctttaaagacctatgtaaaaatcctaaatgtggtaagaaccaaaaaatgaccatcagaaaccaaataagtggttcttatcacttataaacacagatgtaaataaagttcaaaaatgaaagatcagcaaactcaacaaccttagttaaagaagaacccactagtattaaatggcctgaatcttttggatttgttcaaaaagtagctctaacattttatttagctcagttcaagagaatggaagtcaagataatcatagtttaaaaagactgttaagaaaccaga

SEQ ID NO: 40207 - DNA, 943 bp, Bovine  19866880709453
cggcaaatggggcccaactcacccaagaccctagaacttgctgggcctgacttgccttaaaaagtaagagtgagagtctgaacaccaaagagggggacaggttacgatcgggacgggagggtgaggaaggagcaccttggcagcatcctgagtgggctgaagacagaagaccaggacaaaaccaggacatctcggggaacaccaagtgggactgcccttcccgtgctttggcatcttgaaaggaaatgccctggaattcaactgattccaaagaaagtgatggggaaccctgaattgactgcaattaagtttctgccactctggctgagtaaagcaaaatatgaattcagttgagttagagaaaattcaagttatgtttcttacacacttgagattggaacgagctatactcctgacccacaaggccctgtatcatttgcctcacctctttcccatttctcctgtctcacctgtctgcttctcctccaccaacagtcatagtggtatttggttattgcccccaaccctcaagctttccacctcaggacctttgcattggcgatttcctctgtcttcccttggctctttaaatggtaggtgccttctcagtttaaatttaacttcttcagactacacttttgaaaataaaacctattttctctccatgtgccctgtttatttccttcctgtttacttccttcctgtatatttttctctgttcatctccccctccagaacgtcagctccatgagagcaggacccctgtctctcttgttgctccctcagtagctggcactgtggctcatattacttgtggaatgaatgacccatggcttgccatagcttggtggcactgagctccccccaatccctacctgggccctggtcaatttcccagcagtccaggaccagatgccaagacccataacctggtagagctgtg

SEQ ID NO: 40208 - DNA, 736 bp, Bovine  19866880806455
accctctgcccttagataccaaggaggcaccgtgcctcacaggtctttgtagaaatcttgcatctctcaatcctgtgagggaagacatggtgtccccattttgtagagtatcagactccccaatgtcatacagcttctaaggggaatcagggctgaaagacatcaaaaccaggcccctgtgtgcagcctctgtcctgtgcagtgggagctgggcagtccgtccagtccctcccacagtgcagtgtgacaggagaaagaaacaatgactgtagaattggcgtgtctcaagacagactgagccatatcccagctaaaatggaaatcctcttttgccctccctgcagtgaacctggaacactcgagctgacagccccagtttcctgttaccacatcattgcatgttctcagcctagcagatcagatccatgcagacttttaattcctgagaaatggcaccccacttccagagaggctcctgttgtaaaagaaatttttaaccattcttgcttttcaaactaaaatgaagacagcattgcttccccttccccctttccctccacacccgtctctcattgctgtggttttttcccacagggttgatgatgttgtgaaaagactcatatctttggaaatggccaacaaggtgagtggcctctgccaagctttgacctctctctgtcctctggagactccctcctaccctgctagcacccccagcccatgcttctcaagtcag

SEQ ID NO: 40209 - DNA, 1362 bp, Bovine  19866880859698
tttgaaagagggacttcccaagaccatccctgacgggaggaatttgcggagcatcagagtgagggttaggcagggtgggaaagaattgtgtggatgatacaggattactgcaagttgcggacgccacccagtggccataaaccaggcgatagggagccatgttacaagagttctctgtgcgcggagcattctgggagttgtagttgggctgcactaaggggtggtgttaccagtgggactgttgggtgctgtggttcggcgtttattgcgcgggaattaccctcgtctgccggactacgagtcccgtggtgccccgcggccagctgcgcaggcgcggtgagtcggtgccggtcaattcttaacgctgagggggcagctagctgggtcgagctgtgttgggaggggttgccgagtgggtctgtggtgaggcagggtaaggcggccggcacgatgtcgaggcaggcgaaccgtggcaccgagagcaagaaaatggtaaccggagcgtgtgacctcggcgggtggggcggaatggaggtgttctggggaaggggcccagcgcggggtgcaagtctcaactggaaaggcgccttctacctgccctgggagggagtggttcaactggagggaaggaaggggctcattggtgggtcgagagcggagattagctctgggagcgtcccgagtgccgggcaggttggagggccgctggaggagctcgaagacctcttcccccgcctcctgagtgctattgcgtacgagaccaacaacgacggtgacgataatagtagctcccactgttgctctcttactgcgttaggcactgggccatgcactttacgtctgttatctcatttaatccgcaaaataactcgtcaggtggatgataacatcgccgctttaaaactcagatgttgcataacttgcccctatttacagctaagacgagttaggatttgaacctaagtctctctgacatcaaagctaatgcttcagactactggactataatgtctcccacactgtgccgtggtcattgtgagatgctcaggtactgatttaaccagaaagcaagaaagtaaggggtgggccagagtaggccgtaagtggtctccctctggtgaaggtggacaggctcccttcttgtcctggaaatagtgggacacctgtctatcctagaaagtttggctgctggtgagggctgggcctggaaagtaaggttgatgatgtttttctccaaactaaggggatttcttgacaggtgtttgttttctttggcatcttcgtacttcctctagaattgcccatttgtctttattttccgatttacaaactgagttattgaaggtcgcatgcagggcagat

SEQ ID NO: 40210 - DNA, 2186 bp, Bovine  19866880888682
gctggcagagagtctctaggccgggccagcttctgctctgatctggatttccttcagtgagggagctggatccaggcagctggttcatatccccatgcactggggtgggcaggtggaagggagagagaagataggggcatttttcctaaaaatcctgcccggaagagtagccaggagaagtcaaataacctggttaagacaagagaggggtgaaggcaggcccataacttcctagatgagaacctggaatctgcattttttctgctgctccctggggtgcctggcctggatcctgagaggaagaggggtcatcaggctttgccagtctgttcccttggtcctatgtcctctgtccgtctagtctggagccggggccacagatgggggcttttgcccataggtgagcctttgggctgggggcccccaggaagaagcagagggatggcggctttcgccacctcctgtggttacagctgttctgatgagtggtgtagactgctggggcaaggcctggcctattagctctgtcacctctctgaccgcccaggcttctcctgtgtttgctggaatgtccggttcattcagttcactctctcatttattcacctcgctccccttcccctgcctgcatatccctccatctcacttttcccattcaccctctcactcactggtccatccacacatccatctacccatctgctcactcatctgtccacgcatccacagccccaccgtcaatccatcacattgccacccatgcactcacctgtcggcccagccctcatcagttcagcaaatgttttctgtgggtgtaaaccttccacacacacaagctcttcatgcaacctctggccgcctcccatccctcccatcctacctccctgaggcccttatgaaaggaagcagctcctcccaagttccaggtatgacaggaacgaggactatggtgggatttcctgttgatcgcaaggttgtatccagatgtggctcctgggtcctcatctgaaggccttgccatggagctgtgtcgccctcaacctttccctggtacgcgtcttctggcctcactcgctcttgatttgtgttcctgcctcatggtcttcctctccactgccatcctgccaccatctgggggcatcttactggccacgtggatggtgcccccccatccgggttcttcatttccttgaccagtcacctcatggcttttccactttagccgccagagctgtggtcacactatggacctcagcatcacctggaactactcaacctctcaaacctcacactccaacgcccatctctttgcccacatccctcccttcatctagctctcacgcctcctgcacagctcctacactctcagctcagagagttcaggcctaggcttcctcatctgtcagcctcctcctcgcctttcttcctttccttctgcctgggggggccagtgacgactcactgatgacttctgactggagacctgcggtacctttgcagccctatcctctctcctctctggctagaagagcctcatggatcatgctgtcactgcctgtctccccctccccagcccaccctgtcctggcgtggggcctgtgaagacccctcatggaagacgagacaagggcctggtcctggctccagtttctcctgggctctcaactgtccatgaagctgtattcttgtcctgtgtccccaaactctcctttcaatgctttttgaggcacttgaaggcccttttcaagagttccctcccaccaattctcgattggccagtaagagagcctcaccttgattttctgacccccaaacatgcctgtcctggcctttttccaaaacgaggcatctctcccatggtccaaaaccaacttctccttccacccttcttccaagttcctcccacttctgtagtgatcttcaccaccatttctgcctctgcttttgtgctaataataacaccataacttcctctgccagtgcttcctgggtgctgtgctctgctttaaacgctctgcattcttttatgtatctaatctttatggctgttctgggaggcagggtctttgatcaccattgccccataccaaaggtgggaaaactgagagagcaggccagaggcagagctaaggtcttgttctgagcctggaaacttgactccagattctgtgcgcatgcccactgtg

SEQ ID NO: 40211 - DNA, 866 bp, Bovine  19866880953943
cattggactcccagggccctggcttcttctcttcctcctccagcaccgtgatcttggtgatgggtggcatgccggggtcccgaaggctgggcagctgtaagatatcctgacataaagatgtgtggtgagggcctggtttgtttcagatgtctgttccagccactgtcccttcctgcactggggtggtggggggacattcctgctgttccttgctggaacgcaaagggttattcaggggatgcaaagcacctcatatgtgccggacgcgtgctatgtgctgttcagacttagcccggtgaatctccccagtgcttttgtgtgtgatttgtcccatttcacaatgaggtgactgaggctttgaaatgggtggagctgggattcacactcaggtctgctttgctctataaagaggtgaagtgatgggaaggcctgagtactcattcttgggggagtttcccttcactttgagcctggggtaggagcctaacccgcagacccatttccctctccctccagtgttctcacctccgccgtgatggttggcacccaggaacccaggctgctgcgggctgggtccgggacactcggccagagggaatacttcctgctggagaagagggcaggtgaaggctgggtcagcatgccctcctgtcctcccagcatttctcccaccttctcccagcagcagaagggatgaccccttcgtgcagagaggagaaggaggggggcctgactcccagacctgaaccctgtggcctggcaagtctgagaggagccagccttgctcacttgggccttcagttccttcggcagggttacctgggtgtcaggtctactcagaaggactcacctgggtctgcaacaga

SEQ ID NO: 40212 - DNA, 742 bp, Bovine  19866880965765
ctacccgccggcgcagtacgtgcagcccatgcacaaaggccccgtggggccgcccttccgcgagggcaagggccagtacctgggtgagcatcgcccgccccgcctcggcccgtcctcaccccccagctccctgtctcctgacctccaccggctcttcccaggcccctcacagccacagcccgtccatcccaccaaagaccttcccatctccacttgcttcttgatgcgggtccagggcctcccaccccaagagcgcccggaagtggggtggagctggctggcggaggtggtctttgggtaggggaggggcgggaaggtttgtggggaaataggaagggttggcgccgattggctctaaggagggctgctggtgccacctggtggccattccaccacagttccgcaggaatgagaggctgctggggaagggaggcccagcctgggtaggttgggaaccaggagtcctggctgtggctaccctgcagctcccaagaccgccaccagaccacccctaaattgcgtctttcatgagagaagggagggaggaccagggtggtcttcatgagcaggtacagaaccctaacttctcaagttggaccccatgctggctagggagtgggaagatgggtcccctggccccactggccaggcccctgactgccttttttctttttctctctcagaaatgcctctaccactgttgccgatggacctgaaaggagagcctggaccccctggaaag

SEQ ID NO: 40213 - DNA, 768 bp, Bovine  19866881046925
tgcgccctgcaggccggccgtaccggggcaagcccagcgacatgtgggccctgggcgtggtactgttcaccatgctctatggccagttccccttctacgacagcatcccgcaggagctcttccgcaagatcaaggccgccgagtacaccatccccgagtgagtccccgctccctgggcgccagcccgtcaggctcgaggggcagaaacagcacggggaggcttggcgtcctgggccgagacctggcaccagcccaccccgcctgagtgcccgctgcccctctctcctgcatcagggacggacgggtttctgagaacacggtgtgtctcatccggaaactgcttgtcctcgacccccagcagcgcctggccgccgccgacgtcctggaggccctcagttccatcatcgcgtcgtggtacgtgggccgggccagagctgggtcctgcccacccgtgggcactgccctgcctccccagagaggtcgcctgaggttgggcctgtctctccaccaggcagagtcaggtctccagatggtcctgatgggcagggttggaggacacaggcaaaactcagggttgagcatctcctgcgtgccagtcgatgccagctctaggatgggccttatctccctgagttctcaccacagcctgcaagatagaagttgcccccacttactgggcgagaaagctgaggctcggagaagcagaggcagtggcatcaggaaggggcttgtgggtgctcagcccaggtctgctgactccagccaagt

SEQ ID NO: 40214 - DNA, 899 bp, Bovine  19866881053704
ccccctgcattgggagtcttagccattggactgccagggaagtcctagggactatgttttagctggaaaacactagaactttgtctcccatttccttggcagaatagactctatgtgtgtgtgtgtgtgtgtgtgtgggtaggcactgccaccagcttaacttggttctggctagtgataataatagtcactaacacatacggaacagttactttgtgtaggcacatgtctaaactcatgtaatcttcacagcaatgctttgagttagacactgtaccattcccatttgcgagatgagtaaactgaggccagggagggtaagtaacttgcccagatctcattgctaacaagtaacaggattagatttgaacccaggcagtctagcctctgaatttacttgcttaaccaccatactgtactagctgtgggccctctttacctctgctttccaagaaaaccacgggggtgggatgcgaggtcccagctgtgttataggccttaaggaccacctcccgggcttctgaaggcagttggaaggtacagttcagctccgtggtgtcacagagggttggctctgccccagcctggtctgagggtctccaggaaaccaggtaaccttggatctgtccgctgtcttcttccagggctattggctgttagtgggcataggaggaaaaagataaggagatgcgcagctcatcctgagtaggggagagcttctagatggagtgtccgtgtccccggaactgagccacccagactgggagtcagtcctcttccctccctccctgccttctcccccgtgctaggtcctagaagagaggaaaggataaagtaactcagtgtgagcagcaggcacctaacaaggtgagtcctgcattgagtctctgcagaagggc

SEQ ID NO: 40215 - DNA, 1457 bp, Bovine  19866881148497
cttgggcccagggcacaggtcagggcctggaccatactaaggccacttcagggctgcttttgtttttaaatctttacttatcatttatttggctgctctgggtcttagctgtggcacataggaccttcagctgtggcgtgcacgatctagttccctgaggatggaacctgggctccctgcattgggagtgcagagtattggtcactggactgcccaggacagtcccagtcaggttgctttgtgatatcacagaaagctctggacgttaggatgtggagtcttgtatttgctttggttaaacaatgagcaagggaatgttaggtcagagctgtgttttcttgatttagttggttggttttgctaaacaatctaaaaactaccaagactgtttcgaacacagagaaaatctgtataggcaatcataaagagcagctgagcagaaataccattaaaggccagatttggaaaagcagccagatgttacagaccagtggctgagtaatgtcaggatatgtgattcctatttctcttgatgaacattctgatgttttattgcctgcccatttagcaattaaagcttaatgtagtttgtggtttaatatgttttaatgattttgttatagacttattattaggagtcttctcatcataatgaatttcatcttgccagaactgagaaatcaatatggctgcttatattacaacgatccataaaatattgtccaaatatgcacaggcttgacagcagggttttcaatattttaaagtaatgtaaaacttaatcttatttgtactttcacatttttaatttcaattgatgactattagagatcttgatttacattgatgttattattgctccatccatagcaaatgaaattattcatgagggttaaaaataaaattggcctcagcattgtcatcaatttatctttccctgttcataggagggaaataacaaggttctaaatatattttatttatttcctttttttttggatttaatattattattattttctggccatactgcacagcatgggggatcttagttccccgatctggagttgaacctgcaccctctgcagtggtccctatttctctttttttttaaaaaatatttctgtttgtgaatatgttacacatgaacatgtacaaaattcaaaaagtccaaagagcgggacttccctgctggcccactggttaggacactgtgcttccactgcagggggcacgggtttgatccccggttggggaaactaagatcctgtaagcttcacaatgtggccaaaaaaaaaaaaaaaaaaaaaagttcaaagagtatacaagggaaagtaggtctcttttgcatccctgtcctccacgcacttccccgcccccaggaggcaaccaccacgaccagggtcctgtccctcctgccagaagcactcggtagtgtgtatatatatacatacaca

SEQ ID NO: 40216 - DNA, 1861 bp, Bovine  19866881151962
tcaaccctcaaactcctcctctttaaaagggggataatgatagtccctgatgacaacagctaacccttgcggggctcttactccataccaagcactgttctaagaacttctcacggattaactcgttgaatcctcacaccagtcctttgagatagataagagtattgtccccactgtgcaggtgggaaaacagaggcacagaggggttaactgactcaccccatggtcacctggctaggaagtgggtgagctgggaagcgactccatgcaggctggctccccagtctccccgctttcccaccatgctatcgggcctcttagaaacagtgactataaagggcttaacccaagcctggcacatagtaacgacttaactaatgttagcaattgttattactgtcaccgtgattctcccactccttctagatttctgtcttgacaagtcagtaagaaaactctctgggctccaaccactctaggttggagcctggggagggcctgaacggaatcttcctcttgccatcccttccatctgccaggcaaactgaggggagagagggacgttagcatggatgtgtggcctggggtgtgcaagtcatctggggagggggtgggtgctggtaactgtccctactctcccagggtcttggtgattctgcacaccttcatgcccaccccactccctaggggactggactcttggttctacaattcctgggaagcccgtccctctcttgagcccttctttctttccagctaccagaggcctctcttacagaactagggtaatgaagacccctccttcagcccccaccgttctcctcacttccacccctggggacctctcagccccatcctcaaaaatcccagtaattccatggaaattgaagttaccttaaatattctaatcttataacaattttgcttcaatcaacatctaaatgtgaccacatgtgcccagaccacccagaggcctggttggtggtttggggtgggggggtaagttcctagacagatggagggcaagagggctgctctcaggaatggcctggctcaggaggggctccctgggggagacgtctgcaggtcactgagtcccttcctggcctgcttacactgagcaatcctcaggcagcctgggaagcacaggcctgggcggagtctcctatactccctcccagctgggctgggggagggctgggggctggtgatgctcaaaggcaaggggaggctggggctggcttcatgggcctgcagctcagaagggcttggtttagggctcttttgggtcatcttttctgaaccaggggctctgcattttcgttttgccctgagttcacactgcccatccaccctctctctatgggccctccttactccattcttacacttagtcaacagtgaataaaaatttattgagtacctgctttgtgctgaaaatgatgctagacacttggggatacagcaatgaacaatagaggcatggacttgattttgcaaaattaccatctgcagacactcatatatccacacacagcaattctgcaagataattcccccaaatatcatgttcatcataactgccaattagggaacactcagcctaggccaggaaatacacatacttcattttgttttaccctcaaaacagtcagcaaggtaggcattattatccccattttccagacaaaaaaactaaggacccagagttccaattcttcgtccagagtcacataaccaataagtggcagagcttggggttcacccttggctccacgttttcaacctgtcctccccatcaccatacatgccttcagctgcttccccatggataaaagctcccagcatcgtgtctccagcc

SEQ ID NO: 40217 - DNA, 2646 bp, Bovine  19866881300680
tcttcacctgggtaccctgcggcctccctgcctggctgatcccccgtcacttctggctgcctgcgtcttgtctgccctgagcatcgctccaggctgggttgggtgcacaccaccccttggtgatcttataatgcggcagtggctgctggcagcctgcctcctccgttaagactgtgcactccttgagggcagaaaccacttctcctctctgcctccagcctcagccccgggtgcacaggagacctcagcgcaggtctactgggctgcggactcctggcgaagctgtttacctctccaagcctcggtttccttgtctgccacagggataacaactcttcccacggggtgttgtgaggattaagggagctatgggaggtacagagcctcgcacaatcatgtagcaggataacgatcacgtagtaggtgttcaagaaaagtgcttcctgtggcattcagcatgtcagagcagggtgtggccgatctcacctgtgctccgttctccactgagaacctgtaccaggcaatggagctgcagccaccgaagtgaaaattaggcttaaagaagaactctccttaggtaagaagcactggcatatagaaaggttaagagcaggggctgaggagtagactgcttagatttccctctgaaggctgtgtgaccctgggcaggttgtttgacctctctgagcctcggtttcatcatctttaaaatggggatgaggttagtatttaccacaggggatccttgagcgaaatcagggaactaatgtgtgtgaggctcacagtaaatgctcaacagatgtttactctgaggagctggcaagcacggggcagatgtgggctcacccgtccctcacacctagtgtctgctttgaggacacttcctcctccatctatcctgccccgccccctcttccatcagacggggtggcctctgtgggctggaaaccccagtcagggaaccttttaagtggggaggggaaccccattctccgcagccctactgagggttgggtggtttctgtttgttattgcctgtgaggtgtgggctgtggggttggtccaggagctgcctgttgctgagggtcccgggcggaggccaggtgggctagccctggtgagggtctggaaggagaggctttgcttgtctgccaggggctggtttgtctggaagacagcagccggctaagattgtgcaaacaggtcattgtgcaaacacacccccgtgtgtgacctcgattgtgcaaacaggtgtttactggagggtgcccagcttgggctgcccgcttacaaaaagcgccggagctgttgactcagaaggaaccggaatctggacactcattctttcttgaacacaccctgaactttctgcctcccagccttggctcgggccattctctctgcctggagtgccctcctccctcctcggcctccatctctacttgttgaaattgtacccattttgcagagctcagagaaaatgccagtaaatctttctccataaactttcccctcatttgcatactcaggacatttgatatttctctgaaatcacaggtcacttttttacctgatggccctttctggactgtgagccccctgagaacaagaacttttccttattgtcctctgaaaggttagcaactgaggcacagagagggaaggtgaccagccccatgtcacacagctagttctctacagagctgtgctctaaatcaggtctctgcacttcctgccacactcactgcctctctttcagcctcacccctcttctgaccctggattttgcctcctgaccccgggttgtgatgtaactccagctggaatttgagggatggtgggatttgcacagaggagggaagggtattcagggctggggaatagcaggagcagaggtgtggaggctggaatggcaagagtgtgtgtggaggccataagaggtaggaagaggttgcaagggcctgggaacgggggagatggggtaggcgtagggctgcatcctagactcagagacgacattaactctgcgaccttgggtagcacctcacagtcctgcttcacaggcccctgcctccccctagtactctgcaggtaccccagctagacacgccctcacctggtctctgctaccttttctcctgaccaccttcttttcagtcctggtgagcggcatctggatacctggacgcggccctgactcctccctgcccctcacacccacatccagcctgtggccccttcctgtgggtccttccccttctccccctcctcaccgccatggcaggagtcaggctaccatcattgctcttcaggatgatggcagtgacctcctcctggtctcgctgccttcatgcctggaataatgccctgctcagctggagggcttcttccaaaacacaagtcccagcatgccactcaccaacccaaatcctccattggttcttcgctgcccatgtgataacgttccgagtcaccctcatggcctttgaggccatcacccccagcccctaatcctccccagtgctagagtctcatctccccacactccccttcccaacctcctctcccctttcccaggcccgagactccagccgttctatttaccatcactgtgcaatcatgtgctgcttttcctgggctccagga

SEQ ID NO: 40218 - DNA, 788 bp, Bovine  19866881310090
ttggggctaggggagctgtcggcccatgccacgcccgccttcaccgctgtgctcacctcgcccttccccgcctcgggcatgcccgtcaagtttgaccggactctctacaacggccacagtggctacaacccggccacgggcatcttcacttgccccgtgggcggggtctactacttcgcctaccacgtgcatgtcaagggcaccaacgtgtgggtggccctctacaagaacaacgtgccggccacgtacacctacgacgagtacaagaagggctacctggaccaggcgtctggcggggccgtgctgcagctgcggcccaacgaccaggtctgggtgcagatgccctcagaccaggccaatggcctctactccaccgagtacatccactcctccttttcgggattcttgctgtgtcccacataacccgtgctgccctggcctcctcctctttagcggtagagagaccttctcacttaccaagaacctccatttaaagaaaaaaaaccaaagactgaaacagaggcgggcacaaaggcggccgcggcctcagcctggggagactgacttggattctctccacgcaggctgaggtttcttcctggaagaagctggcctgagttcctctcccccacgtgtctgtgcagtggtggggggttgtgcccccattcctgccctgcctggccccctggcagggccccggacgttcggcctggctggtggagacccctgcccccttgagtcctgggctctgccgggcggtgaaggaggctgcttctcagtgagtcagt

SEQ ID NO: 40219 - DNA, 1025 bp, Bovine  19866881891366
caaagggaaaagcctagagattccggaagctctgacaggaatgagtgttgggttttccagagctctaattatcagctagatgaatcacttagagctgacaccaccatccccagcctcaggaggctctcagctgattcaaaatataggattttaacgaagaggaggaggaagagaaagaggggagcaggagaggtaatgaatagaaaggaaaggtgccagccagaggaaatgaaaaactgtcatcaggacagcaacacgaggagaccactgcatcagacacacacatactgtgacacacgctcctgctggctctccaactctgggcatcttggcagacgacgctgccataacaaagtgacacctgtcacaacagcatgagatggttgcttgacgatgtacaggcagatctgcctattacagagggagaggaggagaccttcaaccctagggagcttcctcaggcttctgaaacccagcaaacctttcctactggctgacttctgggttctctgtggccaagcccctagaacaaaggtgtgcaagtttgagtgctggcccatacctggtggctgggtaccatcactgttagcagcgtgcttggttactccattgtgtccaactttgcgactgtttgaactgtaccctgtcaggttcctccatccatggacttttccaggcacaagggatcttcctgacccagggatcaaacctgaacctcctgtgtatcctgcattgcaggccgattcttttacccactgaatcatcaaggcattgcttatctttcctggttaccagtatcaggaatgctggaaggcagaacagtgcagtaaagatcatggagtttcaggcatacagacctgagttcaaatccccaccctgttattcactggctctgtgaccttgagcaagtcaggtaacctctctgggtttgtttgcttatctctaaaatggggctactaatacatacctctagggctgttgtaatgatgaaatgagatgattctttcatttcacaaagatttatg

SEQ ID NO: 40220 - DNA, 2543 bp, Bovine  19866880353041
ctttgagtagactgtagccaaccgagctcctctgtccgtgggattgtctaggcaagaatactggagtgggttgccatgcccttctccagggcatcttcccaacccaggtatccaaccccagtctgctgcattgcaggcagattctttaccatctgagccaccaggaaagccccaaatcttaagctactcacatcttttaaatccacatctgcgtcctcggggaaatctgggtgactgtcaccagatccatcctttgggaatattccccaatcatccccttctttcagttctccacattctgcaataacgcacaactgtaaaaataaccctcaattgtagaagcgcactcctacattagtgatgatttttcaaaggtctgggtttaaaagctctacagccgcaagccatgtgcacgactgtccacgtcgcttcctggcaggcgcagcacactggtaggggcacagccacgccccgtgctacggaagcactcaccgcagccagtaactcagtgcacaaagagtgagtggacggtgtcaccattcccttaggtgttgcacatgctttcaactgactctttccttcgcacactgagtgacagcacacctcccgcaggtctgactctccagtttccactcccaaccctgtggatgcaggtgcctgtgatggctgtgttgatccacagacatgtggaacacaaggatctttgcagtgacaggatctagtccaaacccttaagtgatttctatgggatgagcaatcaggccgaggaaagtgaaatcacaggagcaagcctagaccacaagttacatggcagaggagaccagaggactcctgggttcccgctcgctctgtactctgcacccgtacacacaccgacgcaaagttctacaggcgtaggagacttcagttatcaagatcagcaagactgaagttaaaataataaagtctctttttaaactgccctcatctttcccacaatagaaaacagcttcaaagaaaaagtggcaggtacaggcttctagaacaagagccttctggacattttttaacaatcacccttttattcacgcttctctaatccagcagctaagataatattaccatcttgctactcactttggcaggtttttcacctttcacctccacattttccagaatctttgccacacccattcctttaatcacttggccaaacactacgtgcttcccatccaaatgcggagtcggaacggtggtgatgaagaactgggagccgttggtgttgctgccggcgttggccatgctcagcaatccctccttgtcatgctgcgggaataaaccataaagaaaaccaagatgcgagttcccgctctactctaccaaccattcacagaaaggggggcgggcaccactggaataccacttagagcacataatgtagagtgattttacttcattatcaagtgtgactttaattcacaaaacagagtacttaaccactttttaaactttaaggagagcttatgaaactaaattaagatgaaacaagagtgggggcaggggtggtactcctaaattgatcatactgggaacatgcttggacttcatcattaagatgaagatgccataggagggaagtctagtaattctgcttcaccctttcttatgactgaagcattttttttctgaaaggcactcaacagtgttcccacttgtgggcctacattatgattctctcttcccacgtcagcaaagttaggtcctttcctactctccacccgtgtaacactcatgttagctctcctacctgaaatgccttttacccctaaacccaaatctaatccagctctcaagaccaccaagtgtgcggaagaatcacgtgtccatgaaatagcccctctttttctaaaattttatttttgttttggttgcactgggtctttgtcacttttgtgcaggttttctcttgtggcgagtgggctcttctgttgaggtgctcaggcacctcacgggtggtgcttctcactgcagagcacagcgctgggtgcacaggcctcaccaggtgcagcacacgggctcaatggttgggcgtatgcgtttattcactctgcggcatgtgggatcttccacgtcggggatcaaacctgtgtctcctgcactggcaggcggattcttattcactgcaccaccagggaagtctacctgctttcttttgatcaacttttccatcacataatctgagttttcatccttgtggtactttctttctcccttccaaaagtctggtgctttccccacaatattaaatattattaactttatttcctcagcctcctcatgccttcttccttcttcactcatatccctccctcaaaagtatctgaattttagttccttctaaccaaatctcagccacctggcgaggtccagtctgcctagttcatgcaccattcccccttgatgtcttccctagtaatccagaccacaggagtcagacctttctcctgtagtatacacaggtattggtcaatttagcacttctacattattctccagttgcccta

SEQ ID NO: 40221 - DNA, 1203 bp, Bovine  19866880360220
ccctcgttcatacggtgactgtaactagacatccccaaagaggcagccacaggagtgtgtgttgtcacaggtgagagtgtccttaactgagcaggctgaggagacgggagtgaggccatgggaaagcggaaaccgagtggcaaagaatccataagaaatgagaagagcatgccagtagctatttcagagccacaggaaaccagcacaaccctgattcgtataggattttctagtttgcaaaatactgggttggcctaaaagttcatttgggtttttccataagcgcatacagaaaaattcgaatgaactttttggccaactcaatactttaactgccatttgatcctcatttatgagccatgttttaggactttctgaatattacagataatgaaagtgagcttgacaacagctgaacagtttcttggggtctcagagctttctagctgtgaagctggggctccggaccccagagctggcattttctatcctctgaagtcatcatggctgtcaatgtaaatgaaggatctgaggaaaaaatcatgctgattgatgagatgtggatgtaaaacaacgtaaacacatcaggatctttaaaaatggtttttgatgttgggaagaagaattaaatgattataaatggccgtgtaccttactacagacagcccagctccaatataattgagcactggttttgccacttcttctgcatccattccaaaccagccaaacctggaaatggagaaagtcacatcaaagtcgatgttgcactgtttgcagaggcatggatggacctagagactgtcatacagagtgaagtgagtcagaaggtaatataccataaaatatcgcatattaatgcatatgtggaatctagagaaacaatacagatgaacttatttgcaaagcagaaatagagacacaggtgtagagaacaaacctatggacaccaaggggtggaagcggggtgggatgaattgggagactgggactgatgtatatataactactaggtataacacaggtaactaacgagaacctactgtatacagcacagggaactctactcagtgctttataataacctctatgggaaaaccatctaaaaaaagtggatatatgtgtatgtataactgattcacttttctgtacagcagaaaccaacacaacattataaacaactatattccaataaaataaata

SEQ ID NO: 40222 - DNA, 1349 bp, Bovine  19866880576162
ctggcttgctgcgcttcgagcgcagggtgatgtacaccacgttgggctgcagcgtggtgccattgccctgggactcgggaggggccagcgtgccatccaggggtatctcagggaagggggcctcggtggcagcccggctccggtgcggcccctttcctgccggccttgcgtgctggacagaggcgcgccccacctgactgaccaggaagcccaggtagatggcgcaggcggtgcccagcaggaggttcctccgcgtcctggggcgccgactgctccagagtttccgcaccctcgggacgcacagggagcagaggaaccagtttatgagctgccctggcttgttcgagcagctcatttctccgcggtgtccacatgctgaacagagtttaaactcggccgttggtgcctgctgacatgaagcatggttttctgaacgcagctgtcgcctccgctcaggtgtttaagtggtctccagtgggtcgaggtggaagttaggcgttggtgatggagccgggaaggcttctgacactggccacaacaaaccttttacacccccattagtctccccaaggagaagtctgactagttcctgggaatgaatggaaagagtgcactgagtcacagtctcaaactcccgttcagttcctccacaagaggaaatttttaaaaaacgggaccctttcctttcattactgtcaccactaaatgaatttttaaatggagttaaaaaacaaacaagatagatctatacatttgatattcagttgcaattagtgaaaacaaactaccaaaatccaagactgttttataacttgtagctagagtcttttaatttgatcctgaaggaaaagcattaaaattggacaaatccagttttttctctttgaaattaaaaagtgatttaagaaaagcaacaaagggttttaaaaatctatagctatcttctatttatttttagaagtcttgcattaattaactgggcagaagctccaaatattaacattcaaaatcagaaatatattctcttaatctgatggtacaatcttttcttcataatacatttcattatcttacattaagagtcattatactataaagccatacgtgttcacgtatcttggaagtaattacatttattcagtcatacacacacaaacataaacacaaaacacgcatctaactgctttttattccttttctttccaccaaattcagctgaaagaaaacccaaagctctctagctgtctttttttcacgttattaaaaagaagaactggtaaggcaatgttacttacacagctggccccgtgcttggctccaggaagaatgtaatctctgactctaatgca

SEQ ID NO: 40223 - DNA, 1454 bp, Bovine  19866880635720
ggggaaatgagaaaaaaagaagtcctggaaattcctctgtgcctcttccttctcgcacagtgaaaagatgatgcttatggcaatcttcttcctccggactatggccgggttggaactgcaggtttcttcggccaagctgaacgtctcatccattgacctggaaggagaaggggtttgaggggtcgccctgctgtcagtggaccacagtgaaaatgagccatgaagccaggatgacaccctgacagcctaccagggcatgtggtcctcactcagagcacatcccctgctaagccgtcctcctccatcagattctattgtgaaaatgaaaacctctacttgatactcagtgttatcctaacatgaaaagaaacttcagtgagaactgaaagtaattttaagtgccctcttattagacacttagtccttttcccttgaactgtgttacatcagactggtggtattttggaaggggtgtgaaacatctgttggctcaaaacacaggctctcagttttagctaatagatgccggtagataagactctctgaaagggaaggtctgctgcagtccactgtgtgaccaggacatcgcgtttggacatttactagcagccaaggcttgccttcccaaggttactaaaactattagatgaagttactcctctaaatgctgagactaagccacgtgaccttgaacattctccgggaaaccctccaagaagaaagagccccctcttttctactatagttagcacctggaccaacttaacgttctgtgcaaagactctgcttctaggatgagagaagcacgaagccaacaaactgaatacatattcaatttgttgtaagtgatgaacctcacaaatacagccaatccaggtctctcctttattctgaaaaaccagcatatgaccatgtagctgctaacagcaagagtgaaagatttttaaaattattttgtttttttttttttctattaaaaaaaaaacaccaaagcaaaggatgtgcattcatgctgagttgcttcagttatgtacaactctttgcgaagctatggactgtagcccaccaggctcctctgtccatgggattctccaggtgagaatactgcagtgggtagccatgcgctgctccaggggatcttcctgctccaggggatcttcctgacccagggatagaacccacatctatgtctcctgcactggcaggcgggttctttaccactagcgccaccctttaggaagtcccgaagcaagtgacatcacactgcaaatgaaagagcctagcatggcacaaggtaggttttgcagtaaatctttctcattgaccctagtgttcagcttcgtctgttgctaagcacaggaggacgctgcctccttcacgtcccttactacaaactaacaccccgatggccacatctgctggcagaactcaaggcaggcagcctcattcccggg

SEQ ID NO: 40224 - DNA, 1620 bp, Bovine  19866880680848
ggaataaattgaggagaaaggagtaattcatttttcatttttctagtattttccagcttatgctttttttcatttaacctacagtgatgtggttggggctctcttgctcacctttggaaaacattcaaccagccctgggagcttttgtgccctggagacagcctgtgtgacatttatggataaacccctggttaggcccatgaccccacagatcagcttgcctgaagctagctctgccaaggtcccctgatctgtagactgtttcttgaccagcaccgtaccctctgatctgtccaagaggctggtggctcatggagcacctcatcccatgtgactacttttatataaatttcatagaaaattggcttatgctaacttctcttataatcactgctttctgaagtatgctttttgatgtgaagtctacttacctgcagaaaacagagaggagggtcatttgtctggtagtgggtttgctgtgttagcgaggcaaaactgattcatctccctctggaagtagtgctggtttgggcggggtgctggccctgggtgacatttgcctcagtgcctggcccactgctgggtggtagaagatattacataaacatttgttggatgaataaatacaggatttttgcaacgtaggctcaattttggtactactctttctgcatttctgtcttagcaactgactacctatggtgaccagccctataagatatggaaaaaaacaggaggaagagaaaagatgggagtttagtaaataaaagacttaaaatgacaaaagaatggaaatgacagcctggggacttccctactggtccagtagttaagactgtgcttcaatgcaggagacacaggtttaacccctggtcggggaattaagatcccatgtgctgggtggtactgccaaaaattaaaaaaacaaaagacaatctgtgtcgagccatcttttgaatcttgagcatacgtacaatatttgactagacaaactattcaatgtggtgttttagggggaaatgtacacttcaaagacaaacacaactgtgtctgaatcttaactttgctacttactaaaattctatgcagagtacaatatttaatctctccaaggctcagttttccttcactgcaatggagaaactaccttttgtttcagaagcttgttttgtggtcaatcatttcatacactgtgtacatgtgtgtctcaacaatagtaatgacagttttccattcttaagtatcttctagatgcctgggtcaggctggggtgtatccagacacttttgtgtccttaacccatcaaaagtacaaggctaatagtatgatttccgatatacagaaaattaaattgagactcagtaacgtaaagggagctatacaagtttgcggaactgcaaagaggagacttgagtttaaatgtatctaactccttagcctaggctttaacttaccatgattaatataattttttccctttccaaaaagacatgtaaataacccatttctccctagttagtgtctgccctctataggggtggtcgccctactcccacaataaaccccaataagcctaagtgttctgcttgttcatttagaatctaactgtgggctccatat

SEQ ID NO: 40225 - DNA, 3553 bp, Bovine  19866880730011
attgtaaaaaaaaaaaaaagcagatatttttgaatatgtgtgcatcacactatttaaggccatggactcaagatcagattcctgattcaaaccctaggtccatgatttattaactgtgacttggataagttaactacctttattgtgtctcaacttttcatgtttaaaatggggataattatatctataattatacctaatatacaagtttcttatgaagattaaatgagtcagtatatataaaagtacttgtctaaaagaaaactccctttcactttaagactaagagataaagaagaaaaaataggttaagtggctaactgaatgctgataaattgactgcaattttgtatagaatttgaaataaacttcagtgactatttggttaaagatctctactctttggcatcgctttaaattctgtttttaatcccttgatcttgcagtgactattaccaataatcactgtgaaccatccaaggatgagaaaaatggaggcaagaagaagaaaacagcacttgtacaaggcagactgggggcggagaaaggacaggaaagaatgtcttggaggttagtttgcttcattataactgaggttgctgtagtgctttgagtaggaagaggagctggaaaagtaaggttagaataaaatcctccttctatttatcatcccaaactcaactggaatattcatcttaatgctgacagaggatggtacagtccaacaggacttctctaatgctccatggctattccatggttgcacagggcagcttctaaccagatacagtgatggagcacttgagatgtggccaggaccactgaggaactgaatgcttaattttatcacattttaatgaatttaaatatacacagccacatgttttgtggcaaccccatctgacagctcaactctagagctgaggggttggctaactttcccataaagagcaagagagtagatattttaggctttgtggactggatggcctctggtaactgctcacccctgcctttatggattaaaagcagccatgctgcaaatgttcctaaagtggatgtgtttggctgtgtgtcaataatattttatttacaaagtggaagctgggcaatgatttgctgaccctggctcagaccctacagggaagaatataggctctagaactattagacctgggtttgaactcggctcattagctccgcgaccttcaacaagccactcatctttttgtgtgtcagttatcttctaagacagcacctacctcatttgtttgtggaaataagattagaatgatgatgtgtacaacatgtgaaacaaaacagtcacactcagaaaaggaaaataaatatcaatgccctttctctctccctatttcattctctaaagaaaattatttatcttggttggtgtgttagatcacttctttagaattaaggcaaataattcaacgtagcacaagttacgtgtgtatcttacaagaagtgacctttctgagggcaggaatcagcgtttaccttacacagaatgtgagtgaagagaatctgagttgaaaacaccctgttttgtgttaccttgagcttgcccatccagttaaggcattaaatgatccccagattaagattccaaggcccaaaccaatggttttgataattgggacaacagctatgttacctgtaggtgaaatataaagaagaaaggtgttatttttcaatacagaaaaatctatttgtaaattaaattagttttaatttcagatgaagcttatgggatttggacaaacttagtaaagcttaattcctcattttaaaaataaaacaaccaatgtttggcattaacctcatgattatgattactaaaagagccaggcttagggcaaaatcctacaaagaaaatgttaagttagctctttgcctaactgcaccaatgttcttcatctttagtgcaggtctccattacgacttttttgcagaagttggtcaatgataaaattaatggtgaccatcctcttagactggaactagaccacctatcagcagatgtccttggctcatatggctccagactttgctctctcatgctcatttacttgtcttttggattgccccacccagcgctttgtgctcttgagggtcactcaggaccaaattcacagtcatttttttttttccagttcctgacctgctatctgactcagtcaatatcctcttgacaggttttctctcttggttttcaagatgccttcatcatcagcttccctcctgttcctcttattctttggctgttctttctcatcataccatctgcatagaggaaccctctaaaaattatccctaaagtacactcctcctcttgctatattctttgggcatttgactagtttcatgatttcagctatcagctagagacacatgcttccagcactagcctggaccttctccagagctttagtgccagtaagagattaccgaccagatgtcccccattgtgggaatattaggaactttaaactaaaaaggttccaagctgaagtcattttccctctcatccatgttcttttcccttttctcctcatccatttcaatgatactgtcactctcctaatcacctacaataatatctctacatcactgttaactcttccccttcctctactaaccatatccagtcagctactgtgccctacactgtgagatggttagatagcatcactacatcaatggacatgagtctgagcaaactccaggagatagtggaagacccaggagcctggtgggctgcagttcatggagtcccaaagagtcagacacaacttagcaaccaaagaaaaatactgtgacccacatcatcccagtctgcagcagttctcaaattaaacttttcccaccaactccttggaccataaagaagcctgagggccaaaggactgatgcttttgaactgtggtattggagaagacccttgacagttccctggactgcaaggagatcaaatcaatccatcctaaaggaaatcaattctgaatagtcattggaaggactgatgctgaagctccaatactttggccacctgatgctaagagcttgactcattagaaaagaccctgatgctgggaaagattgaaggtgggagaagaaggggacaacagaggatgagatggttggatggcatcaccgactcaacggacatgagtttgtgtaaactccaggagatagtgaaggacagggaagcctggcatgctgcagtccatggggtcacaaacagtcagacacaactgaatgactgaacaacaacaaccaactcctggtgtgaacagccgtgtgaatataaatactgaagtggttgtccagatctgcaggatgaatgactggtctctctgttcccctctcctattcaaaatgatgatcacaatcatactaaagtatacatgaggtataataattacaactctagtgcaaatttaactcttttatcctccaactcatcatcttcactaaatcacttaattctgtagagattcaaattaagtaggtgcccaataaatttttaacattt

SEQ ID NO: 40226 - DNA, 1459 bp, Bovine  19866880760219
acacacactgtcctaactgctgtgcctaaggagggagtggggccacttcccagctctccatcagcactgctgacatcccccgtgaaggcaggcagccttcctgtgtgttccaacagcactcatccccccagaagagtcctgacaactctaaactgaaactgactcccctctcccaccaagtaaattccttgacgggagggtctttcaaccaaaacacctaagcgcctatcagctgcttaatctgtgcccaacattgcgcttaaaatgctttacacacataacacagtctttataacaatcccaggaggaaagcagtatttccacttaacacaaagaaattaagactctaaaattaagaacctcctcaaaataaaaaagtgacagtggtctaagagaaaagccatgtctgctgactaactccacagccacattcttagccattcctgggtttatcttccaatgtccggcacataataggtgctcaatagtcaataaatgagctgagaaagtatcttcatggaagttaagtgatctcgtgttataagctaaatgaatggtttgagaggaagaactgagatccaaatattcagatgtaagaacatcaacagactcacctccaaacagctatcgactgcgccctgccaatcagacatcttcagtttgcaggcgccaatattcagcacgcagctcaaagcgacaggctgcagctttgctccatctgcgtcctcagcagcagccctggaaccttccacatacctagagaacacccccgtacaagcagcaagcaacaccccattaagacactctgcctgtgactcactcataactcgtcagttttgatataaaagttcaccgatgctaatattaatattcttaatgaccaccatctttttattaaatgctttcctttagaagatttttttgttccaacttttttccccaaaatgttcaaaaacaccaacttaaaaacaatccccaaacctaaagattatatatactattaacacttttctatttgtaaaattaaggtttttatcagccactttccaatataattaggtttggaactaaggttgtcacagcaggagaggactgggaaagatgaggaaacctgcagcggtaacgctgactcatcttttactgtagttcccgtgaaaggggccctgaaacaatacatgtacctggtccgacagtctagtccctagtctccctcaatgaaaagaatctgggctcctgagagaaattcagatctggacatgaggttaaatataagatgagcctggaccatcttgtggcagaaagcgggcaagtgctcacagactaagaggaacacgtcagatgggtgcagccaaggggcttccactgggcaaatccgaaaccttacagcatcagaaagaatgatgggaacagtataataggctgaactgaaagaaaaataacccacagatctatagtgata

SEQ ID NO: 40227 - DNA, 1190 bp, Bovine  19866880828579
acctgaggctgctgaagagccctgagggaactcagtatggagacaaacgggctgcccacttccaaggccacctaccagtcagttgctgcagccaccctgaacagtataccctgaggacactaaggatgagaaaacacaggatactggctccagacagctgagatgcacatcaaatgaatgatttcagggagcccagattcttacatcttcccatacagagaaaagccctaaattccttaactagagatacctggcttcctttaataaacagtaatcctttttcgatattccgaccacctggtctttgttgcaaaaactcccgtataccttgactccttcctcatctctttgaacagagctgagatactctgtcccaggcttaaggcctcagtgttttcctttaaagcagttgtaacgtgttccagaacagcagcaattaagctgcaaagcaacgtgagaattcacaagacctgaggcgcctccaagctgctactgtagcctaggcaaccacaccgccacacagatctcattctccccatgccaaaacggagaaaatgtccaccaatctgaatggatcagtagtaaagaagaatcagtagtaaaaatgaaaaagaaaaccacgcaaaagtcgctttaatttacagataacatggcaactgctgacatacatcacgtggcaaaagacacaaggtgaaaggagcccaccagacgcttaacctggggttttcaaaataggttttcgccctacaaacataaaatcatctcgttttgtgctaacttcacggtgctaggtggcgggcaggtgcggccaagtcgggacggataaacccaaaggcttccagcattcctcgaacagaaatttccagaaacttctccacgccccacggccccggtacaaggtcgcgggcgcaacccagcccggaggcttggaccagtccaggtcccagtgtgggcagccggcccccacctcagagcatcaccctgccagagcagcgctccagcctcagggacccccgacccagggcgccccgcctcctcacctcgctcccctccgatgtccacgtcgaagaaaactcgagggttactggggttggaaggcttagcctggggggatggatgcgacattgtggccctaggacgcgtgtatgaccgcctcgtaacacgggcgtggtcaccgtgcagctcgaacc

SEQ ID NO: 40228 - DNA, 1474 bp, Bovine  19866880834037
atataattttaaatattgtgttaataagtccaaaacctagtatctataagagcataattttactctattttaacacatttacattttaatcaataacactctccatgtaagtttgaggcacttataggtatacattcatgactttatttcttggtcattcctttagaaagtgcacagtaaggatagggtaaaatggtgctgaatatttaaggtgcatcattggaaatgcatcaagatactttcaaccctcagcacatttttaatctccctaaaaattgcagaaccatggtcataactagagaaatagcttgcccagaacacctttgaagtcagaatacattatatcattcttgaaggtattaataattattaactcaagtactgaactaaaagagatacatgaatgaaaataggctcttttttgcaaatacattatataaaaaccatgctaatggcttctaacatgataagaaatgctttaaccacaggtcacagaaaactgaaaaaaatagctttcaatacatttatgaaaagacaagtgattcaccttcagttggaccaagtaatgtcttttcattgaataaattactttctggtctaaattaaatgtgcatctggaaactctattaactctttaaaaataacatagaaaattatattcattctggagttacaatattggtttactaaatggggtttacagtggtagactgaaagaacttcatgcatacataatgtgtaaaggtttatttcttgtttcaccccaaaagtaaatcccatgtcaatttaatctcttgtcatttagagaaacctagctaacctaggaaaataagtttttattcattcagttaatacacatgtatactctagattctaaatccaaactctctttaggattttctctatcatttgataacaaattacagctatggtaaaaacagtattatgctactaccagctttactgaaaagctagtcctaatctaaaaatatttctctctttatccctttcttctttaattttctatttcctccctttccctccttgccctaacaacaacaacaacaaaacagctaagactccttagtatgatggttccacagacaacatgtagacctcagagttgctaggtgtctgtaaagggctcaagtcctttgagaaacaaagaccaatatagtcagactttctgctgactgtactaggatcagacccaggaggctttggggatttttcataactggaggtttgtacactttttcactgccttcatccaattcccccttcctatacccacccgcccccaactctccacctctgataaccacaattctgatctttttttttttttatgcatttgttcatttgattgtgtttgaagcataactgacctaaaacacggtgttagtttctggtacaaaacatagtgttttgatattcctgtatattacaaaattatcaccacaataagtctagt

SEQ ID NO: 40229 - DNA, 935 bp, Bovine  19866880867897
caagtgcatctgttaatcttttttaccttgaagacagcaggcgtaaatggtctagaagagaatcacgtcagatggacccttgccagagccatcaggtgacttactgaggtgcctgatgactgcctgccaaacgcagaagcatttgcctctggtgcaaagcacagatggttgctgttctctaaaacacgaagttggacacagttccaagggtagagatgtcctgaaaataattgcctgtctctattgttattagagacctagttaaagtacactcttgagagacaagaaaagttcagaataaccttgttccagtcattcttctgggaatgaattgtaacaaaataatctgaggtatagaaaacaacaacagagatgctttttataaaaaggcattggtaaagaatttttaataacatggggaagggattattagaaagttttttgaaagcagagaataattgtacttatagaatgatttcaactatgtaaaacaaaagcttttttaaaaagactagaagatatatatgaagctcctaacagtcattggaaaaagtaaactgacttgttttacaaaaacctgttctttaatattttttaatttatattagaatatagttgatttataatgtagtgttagtttgaggtgtgcagcaaagtcattcagttatacatatacatgtgctaagtcatgcccaactctttgaggccccatggactatactctgccaggctcctctgtccatgcaattttccaggcaagtggaaaactggaatactgaagtggagtgccatttcccactccaggagatcttcctgacccagggaccaaagccgagtctcttgtgtctcctgcgatagcaggcagactctttgcccatataggttattacagagtactgggtagagttctctgtagtatacggtaagtccctgtt

SEQ ID NO: 40230 - DNA, 920 bp, Bovine  19866880907690
tgacctgcttcccagaggactccttatgtggccgtccctggatctgtttctctcacctctgtccctggggctttgttcccactgcagtgcaaaaagggagcatgtgtgcattgtgcgtgctgatggctggtcttgttttaggtctcagagcatcagcaaccccaatgtgagaaacttcggccgctccctcctggcaggatactgccccacgtacatgccagacttggtgcttcacgggaccagcagcgacgagaagctgaagcagtgcctagcagccgacctggttcacacggtccaggtgagtgatcccagctgggagtttcaggctgctgaccagggggtgaaggaggggcagccaggcgacgtgggcagtcacaggtatagtcatgggattgttgctacagatgctgccagggttacgggaaccagtgaggctgctgaggcatctggggacgtgcggagctggaggctgtgagcaccacaggacacagcagtggggaaaagaagagggtctgcctggttgtcggagcacgatggggtgggggaacccccgacctctcactcctccagccgctgagctcctacagggcctcctttgggctaagcccagctagaagcctcagagtgaggaggtcatagctgatgcagatccaggcctgcggtctgcagagctcacctctgcacaggacagggaagggcacagggtgaatctggaggcaggtggggcaggccgggcagacagaacagtcagcacagatggtgacaattatatgcatcccaggaagaaccaaagagatgtcacatgcgttttgctttttggctgatccttacaagttcctaaaagtaatctattttaactgatttgtcattaagttcactttgatggctgtttgaggatgactgtataaagattaacacat

SEQ ID NO: 40231 - DNA, 1792 bp, Bovine  19866880953968
ttgatggacatttaggttgctttcatgtcttggctattgtaaatagaactgctgtgaccattattatgttgcatgtactttttgagttttgcttttctccagatatatgcctgggagtgggatttctgtgatcatatggtagctctgtttttagttttttacagtgcttgcatagtggctgccccaaattatattcccaccaacattgtaggagtgttcccttctttccacaccatctccagcatttttttccagcatttattatttgtagaaatttgatgatggccattctgactggtgggtagctatcattattaaattaggagatctatgttgttataaccttctataactcacagattatcattttcaaaatataaatgaaaattgataccaaacgagcctacataatgaccagttctccaagtgtctcattctactcattatttgcctctttctttatgtcctgctcttctccggtgattcaaatggtatccagtatttatttaagaaacttccaaagagctgaaatataagacaaacaagaggtttgtattcattagacaaagctgatttagctgtcattgtcccaggcagtagaaacaaagctatgcatttcttaagagaaacaagatgagagggggaaaaaaatgggtagtttttaagggaagcaggagaacaggacagaatatcaagagctatatctctgtatctcagagaaagaggataaatctgagttagtggaaaagggaaagaaccactggagattttacatagatgaaatggctgcatatggcagaaaaagattccaatagtcagacattgcattgaagaggctttttacctaaaacaaaatagaaggtaatgattctgcaatgcactaaaaacaaaatggaaagagaggaatacaactgataatggaggaatagatctaagacactgaaagctgttgaaggggatgatgttgcaacaaagggaagcagatttacaggaactggcttcttgaactttgctgtctggttcccattactctttctcttcaaaaaaatgtcacccattcctttcagggcagaacattttgccaaatatgctatttaaatattgattttagaacatttccttgatctgaaagcatgctacccagattgccataaatccaagttctttctttccagagtccttgtcatgatttattcgaggagtttttttgtttttttgtttttttaaccaaagataaaaatcaaagaagaacagaccatcaagggcacaaaatacacaattcctgacaataaagtgcattggctggagctatcatgaaggatatttgagatattacataagagattttgattcataaatatatctgaaaaataacatgccttttttagtaggaacagttgaagaacaaaaagaaaaggctaaaggaactctatataaaattagtttttcttatgtgtgaaaaaattagctaatgattctgatttctattctaccacatatagacagatattaacctttacagtttcatgatcaaagatttgaagaaggaagctgctgaaaaaaagtgatcccttattttcctctactaaatcccaagatctaaggcagtgcttggcacatagttggcactcaagaaatagttatcacatgaacaactcaataaagccttaaggaaataaagttaaaaaattatgtagtcatcaccagttaagagctaattataccagaaaatcctgagatctggtttaatctcatggtttggggcaccctcacttaaattaaaagcctcaat

SEQ ID NO: 40232 - DNA, 1141 bp, Bovine  19866881018785
aactgagtcactgagcacacacattcctattaatagcaaattacaatgtatcccaaaagaaattaggcaaaatgaccaaacaaaaactgcaaaggcatcaaagatgaacagacttgttaaaatgaagttagcaacattcccttagcaatcaaggacaagagactacaggggtcagtttatccacatgcatctgttatgttgactgtactcctgaaaaatcaaactccatgacagacttcagtgattcactaagaaagcttcagaaaagtgtgatttacatttggaaaacaaaaatttggaaatgcaatacagctacttacggcagtgatgattggaaaactgaccacagcactgagagagcggttcgctatgaaccaacagcaggtggcgatcgcccagaggactccggacaggaaccctgaaacacagacgcgttcgccaaccacatacctctccagaaaagtccacactcccggcggaacgactactaaagtgaacacatcacacactcctattaacaccgacagccaacatgggtttttgagtcatgtttatgaccatttggaaaacaaatcatttctctttttgtgactgcactaggtgtaaggatcaccttttaccttattgacattaaatcaagtacccaaagtaataggtgcagtaaagattggataatggagtgggacccagggaaggtactgggtctgaatattttctgaaaacaccatttactctaagccatgtacgtcaaactatgtgaaattcagaatgatgcttaaataaggggggggatgtaacttggaatctgaataaaaataccagcttaaaatgttcagggtactttagctagacattcagtaaatattctaccattcttccaaaactgtatagtggggtagtggcactctttggcttaaatgaatcaagcactcaaaagtgaatctcctgatacatgctttgttttgttctttaaaaaatttttacttgtggacctacattccatattgaattatagtaaattcttaagtgagaaattatatttatatacaatgtatttttataattaacttaaagtatattaattttaatctttaatgcataatacatatttaaattgaattatatataatttttataattt

SEQ ID NO: 40233 - DNA, 1675 bp, Bovine  19866881025137
cagcatcttcgatacaatgaggtcaagtcctactttcataaacagttcattagaagaacttctcatttttacgcttgactgaaagctggttttccttcagtgtcacatttgtgggaaagaaaatcatttaccctaatccaggacggatgaagatccacttgctgtgtgagcatgaactctattttcagcacaatctcttgtgtccaggagagaagtgttctcaagtaccgctgccatctgctggccttgtggttgtcaaattttagaaaaagctgtgcataaggctccagtcaagatgatgcaaaatgcaagcatcatcagcaggtagttttttcgaccctgagtaataaaaagaataactgttattaagaagacctgaatcaaatatataaaaagcacaaactctcaagatttctgtggaccttactaaccatctggtctacctcctgtatgcttttccattatccctctgtatgaatcttccaggttctcaggtcctctgtcattacccattcaataaatacatgtgcactcctactatccatccacatgttctgggattaaaatggtaagcaaaatgtgcccctattcagtgactcgtgtaatgtgggagatgggaatgagtaacaagcaaacagcagtggctattgtaagtgcatcacaagaaaatcttaaggaggcagatctagagttgagttgagctcctaagtatcagtgaattgggggaagaggagggcagcaaaatctcaaatacagattttgagtagaaggaatgtgtgtgcaaagctctgttgtaagagaaacatggtactttccagggactgaaagaaggtctgagagggtgcagcagtgaattaagtgtggcttgatgaggctggaggctatgcatatgcctgagcaggaggtatcttagaggccgtgttatactttggatttacttttcaagcaatgggaagacatgagaggaacaggcagagccaagtatattgaaaagacaggcttgcattttgtaaagcccacacttttgcagatgatgaacagattggagggggccagagtggatgcaaggggactagtgaggaggtgaccgcagtcctcctgggaagagaggatgaagtgcagatggagagacagagaccaagctaaagggcaagggagaaatagaaacaaagatgactcccccagctacatgtgggtgcactggtcttaaagatggaaccacggaggatgccagccaatctttatatgaataaacatataccactctgtgttcagtagaatactgtatttctcacaagttccatctctaagagttcagatagatcgattctaatttctctcccacaagataaaccctcagacacaggaaaataaatgtgctatatccctgaagcatttttttccttggtcaatattttagctcctctgaccatccttcatagggaacaatttgaagctcccacatagtcctggctgttctcctctgaatgattgccaggctaaacagtctatatgattgggtttaaatgtagacccaatactctgaggcaagtggaacaagatctcaattacactgagatctcctggtagtcaaatcatatgatactattatcagcttttagtaaaactaatgacaattaatatataaccaaaatgtcaaaaatgtatatcccca

SEQ ID NO: 40234 - DNA, 1634 bp, Bovine  19866881082730
attcagtaagggtggcagagtgaggccctcataaacccactcctctgtaaaagcagtgaaacactagcaaaaatggtcaaacgcaactgtgctggagctctggaaataaactaaaagttgacataatctcaggaagatttattcaagtaaaactgctgaacctccacttgacttctcgtcctcctctgccgtgacctgggtagctgacagccgtgtcttacagcccttgcagcggccttgcagctcttgggaggcccagatcggatctggggtccctcaggagtcctctgctcagagcggtgttactgactggcctcggctctctggaggagcccatttgcagagctgatgaggaggagcccacccttgtgtctttgttacgatcaaagctgggggctgaaatagtgggagtatctgtggcccggggacctgagcagctctgacagactgctgtggatcttgaagggtgcttggcagggctgtgtgtgtgcccagggggacctgagaggggcctggcctcatgctgtctagacctgagtcctgcacagacgagaagtgaaggcagaggataactgcctgagggctgaaagtgggcctcagcgtgtccacagatctggcggcatcccggacactcactagtcaacacatgtaaggactccctgactagtcagtcactgatgactcagctaactgagcagagactcagggtagctgcaaactatggggacttacaggcttcgcaggaaagtccctgagcagcaacagcagcagcgacagcccctggggaaggggacagtctgaattccagggctgcctcagtgtattgtctgaaatgccagctttcagtaagaactgataagatgcacgaagaaagaggaaaatatcgtctttacacaggaaaaatgtagtcagtagaaactgtccttgaaagggcccagatgttaggcttaataatactcgacgaggactgtaaattgctaaagaactaaaataaactatgcccaaataattaatgtatgagagtgatatctcaccaaataggagctatcagtaaaaaggtagatgctattttaaaaaacatgaaataggaattctggagttgaaaatacaataactgaaaaatgaaaattcactagaggggtcaagagtagatttgaactggcagaagaaagaaatcagtgaatttgggaataggatttttactttaattaaattaagatctaaattaaggtaagcacagatccagttgaggaacagaaagcaaaaagaatgaagaaagatgaacagagcctcagagactgtgggacaccatcaggtgcactgttgttcagtcgctaagacctgtctctttgtgaccccacgactgcagcacaccaggctcctctgtgcttgctgtctcctggagcttgctcacattcatgtatgttgagtcagcggtgctgtccagccatttcatcctctgccctcccctctccttttgctttcaatctttcccagcatcagtcttttccagtgagatggttctttgcatcaggtggccagagtattggagcctcagcttcagcatcagtccttccagtcaatattcaggggttgatttcctttaggatggactggtctgatctccttgcaat

SEQ ID NO: 40235 - DNA, 697 bp, Bovine  19866881093060
ttttggatatggtagctatcatcatggaacagacttttaatgttatgaagttatatttaacaatgcaaattaagcaactgtgattgtaatttccataatgagccttcctaactggcagtggattgaagatttcatgactctcagagcctaacataccaatcttccagtgtattctacgaaagaatatccttatttggcaaagggaagagtcaaacttgaaacataattctcttttttatttctggtctcagaaacagaaactcctggggctttaatgagtaagctcctttaatgttggtggagttattttagagaagatcccatagaaagccccagtatgtgctctgctcactaactagtgtctgtaaatatctcacatgatggtaggttactggatctcagaacaataaagaccaaactacagagtaagttttagactattgtgtttcacatcatgggttctggttctatgttcagtgggtgatcaaacatccccgaggcaccactttagcttgtgttctgtatgtcataccttccttgactcttcttgttctgtctcctctgatgactttcaaccaatccactgtcatgtctttactgctgcacttcacgtttgcatcttctctggtacttgactaatcactgaatggcagtaggagggacaaaaaccacaaaaaacaaccagaaaagaactggg

SEQ ID NO: 40236 - DNA, 1052 bp, Bovine  19866881210793
taaacaggaaagtccctatccatattcctggactgtaaacacagggaaccgaagtatcagagggagcacaggagggatcacagaacagacaaaccattaaactgctcctcgctcatacaataaacacacacttaagcaaaactgaattcctcatcaggcaaacatttttgcataagctgccttctctttatctttctgtgcctttatcttttgcttgactttcagcaattctgcctggatcgctgcaaaataaatatggaatgtaagttatttctcaaaacatccaaaaaattacgttgaccaaactgatgctttagtatggtttaaaaaaaaaaagataaaactcttctcctgaagagtaactgagccctattaacagagcataatttagaagactgtccaccaagagaactaacaattacacacagatgtgccttctcccttccgttagaggcggctccaaagtgcctcccctgtttccttttagcaaaagactcaagatatatttcaatatctagactgatgatcactatttgtaattggtttattgggaaagaagcttatttttgtcacagctttccaaaactttcctacaacatatccagtagctatttgggatatgtccacattcagcttaaggaatggtcccaaacattaattaaatctgccataaatacgactttctaatgctgctccttcatctagcattaccggacagtaaagcaaatagtccagatacgtgcaaatgggtgttgtggacagagactagactaagctgaaggcagggccctgactcgttcattgcagtgtgattggagcctggccccataacaggcgttctgtactatctgcttaacaaataaaactctttaatggcaaagggtacaatggctcacaaacataaattcttaaaagacaaagtgaactttcactccaaaaactgccaacttacctttatcttctggtgctatttcctgagctttcttaagatcagccttttaattgggagagaaaaaaaaagaaataatagattatgattcatgaaagtggtt

SEQ ID NO: 40237 - DNA, 1593 bp, Bovine  19866881317201
tcctttctgagatggatttcttcaattttaacttctgaaattttaaatagctactttctctttccatattcaaagcaccaacagaaacattaattgtatatttcattcaagtgaattttaaggagaattttaaactgcagatgaaattttctttgatcttgattttgtggttaaatgtaacatgtctaaattaagtaaaaaagaactgtggtaatttactgctgggataacttaagatgtcaactgtagtgagagatatggattacagaataaaatataaaagtaaatataaaatataaaatagtaaaaaaactgtataatcaaatacatctctctcttcttacagaaaagcaagtttcggcctctacatcaacatgatgcacgttgctactagaaggaaaagctgcctgcaagtgcagaacaagggtcatgctgtaagaagccacaggtgcctcctgggtcaccactgggacaggggtcctgccatttaaagcccaaataaaggtttcagtgaataggtggtgtccttcttcacagccgtgagcactgtttcacataagtagttattcttaacaattataccaacagaagctgtcttatgagtgtgtataacatccagtgttactccaagtgctttaggtgaactgtgctcggctgcttcagtcatgtccaactctttgcaaccccaagcactgtaacccgccaggctcctctgtacatgggattctccaggcaagaatactggagtaggttgccatgccctcctccatgggatcttcctgacacaggtattgaacctgggtctcctgcattgcaggcagttcctttgccgctgacccagcggggaagtcccagagaattagccccagtaattcacttagccccagctaagtcaattagcttacttaattcccataacagacaggacagtttctgctgttccccagctttgacaaggtacatggttaggaagcagaggagcctggtctgaatccaggccactgaaagcccactgactgtccactactgtccactggctgcaaggagcctcatctcaccctgggcttggccaggtacaaagcacacctcagcgaggctctcacgtgcttgctgcaaaggtaccagttcacaaaggaaaaagctgaggtgcccaaggaaccaaataggcaaagccagatgtgatccccgtgatgtccctgtgatgccacactgccacctcaatgtttcaaagcccccctccaaggacacaggattcctggctttccaaggggtatggtgcatctgtaggtctggtcacaagaactcaggggaataacccttcctgagcaatcaggcagctgaccgtaatccagccacctacttgcttgttactagctctgcatcttttgtggaggccggaggctggcaaggagatggaggctggcagggagatgctagctgtttggtgcggggctgagtgcagacaggggagggagggggagctgagaatgcaggtgagctcatctcaggtgcgaccctcccagctcctggagttcttcccctcctggtacacgtcttcctgctctggaaacctggctccctccctccttaagt

SEQ ID NO: 40238 - DNA, 1241 bp, Bovine  19866881345876
aatttgaggaaagtacttttccgattatcagaattcttgctaattctgtccctctctttgcctacatataatgatcttaagtaagacattggtatgtcaagttctcagtggtatagaaaactcagtccctttgaaatctgttcttctagtatataattattgagaagtgtaagctagacgctgacagaaatgtttcgattctcaagatattatctgatagtatgatttataccagattaatgactggctgaaccactgggcagggcataatatttccaaacaattacgaagaatgaaatatcattttctcttttcaggtttcccgaatctgcagtttctgttttgaagagccaacacttacggcagaaactccttcagtctctgtttcttgataaagtttactgggagagtcagggaggtagacagggcatcgaaaagctaatcgatgtgatagaacagagagccaaaatcctgctcacctacatcaacgcacacggggccaaagtgttacctatgaatgaataagaaaaggtcttctggctagcggtccagtccttttagagatgaggcagtggagatgaatacacaaagtaaatgaatttaatctagtaaatacgatgaacctgagcacaatagcagtctttaaaagcttttgcaaatatactgctaagatgtatctgtttacattttcctttaacatcatgactcggagtctcaacatctgagcacagaatagttgcaattttgatcccaagttagttgtattaaagcatctgtcacatcgggttaacaggatagtatgaaccagaagtggtgattcctttaataaatcaggtttgatgccatttgctggtctaaccaaatactaatgggaacagttctggatatctttctgttgttgattgttagaacagacagcagtttcaacactacccagaggcaactctacgctggaaaatggaggtgtataaccttcagaaacttcaggactctatagtaattttaaggagaaaagttggtttatttgtaaaacctccaagtgtatattctattgtatctaaaaatgatcagccagctttgtgatcctcaacacaagaatcgcattttccattcccttttggaaatgtattaacattttgtcatcagtatagaaacctacatctgagagtttatacattaggtagttttactctctgttttggtccaacttatgtctggggcttaaaaattcaatctttagg

SEQ ID NO: 40239 - DNA, 1416 bp, Bovine  19866881354290
agtgtaaggcttttccattaaaagtattttactttcagggactttccttgatggttcagcagttaagattgctcactccccaatgcaagggacctgggttcaatccctggtcagggaactagatcctacatgctgcaactaagtctcagcacagccaaataaataaatatattaaaaatattttactttcaaaatataataggaataatagtgatccatgactattaacataaacttataaattgcaaaaaaaagtttggatgcagtcattttatataatcagtagtaatacttcatatgatatcttgactcataagatttttctggctcacttttctgcagattcatttgtttaggtcatcagaatttgtatgtcagttggcataattgaaagcggtgttagctgctcctttcaaatgccaagatggcagataatttttgataatttttttattttgggaaagctcattttgtttacttgtaacagttactggaattgtatagatcataacaacattgagataaacttttaataaactttaaaaatataaattttagtatgtctagataagattattcttatggagaagttttgctaaagatgttattcttcacacatatccattttgtatgtctgaattcagttttaaatgtaaatttatacaagattattttaatgtttcctctgccaattcctgcaacttatggagatcttacaagaaattagaagtgtctttgtgcattgcatgtaattcagaatgcctgtttatgcattctatactatgttgtcaattatatggaaaattaattttaaaataggcttccttattaataatttcatcatctaaagcttcatctagaaagtaatgggtattttctatccagtgaaacaagctctacacttgatttctatttctgtgcttgtatttgcttggcagtgttgctgcagttttcaaaatgagagattaaaaactctttgaagaactctagtaactccctgatgtattaatactttactgcattgtccactgtaggctcttctttgtgataatttactgccctggggctcaagacaaagagctgagtatttttgtagaccccacaagggcgggctctgatgatagatagacaagctgcctccactatgtctcgcccaagtcctttccctctcccacagccgtgacctctgctgccaccacctgggatctgctggcccaggtcccagccttgccacctggggcctcgtggcacctgggttctggcgtgtgggtatgtgcctgcccccaggctgactgcccagcgtccaagttccccgtgtgctcagctgcctggcatctgtgtgcgtgcccgtgtgcatgcgtcatcaccccatcagacttcacttagagagcacaagttaaagggacccagttaggg

SEQ ID NO: 40240 - DNA, 847 bp, Bovine  19866881379905
tttctgagccttgtgaaataattacatctgagaagtatgctcagcaacttgatgagatgcactgaaagctgcagtgcctgcagccagcattggtcaacagaaagggcccatttcttctccacagcaacaccaaactgtatgttgcacaaccaatgttttaagagttcaatgaattgggctacaaagttttgcctcatctgccatgttcacctgacctctcgccaactgactaccaattcttcaagtatctcaacaacttttgcaaggaaaatgcttccacaagtagcaggaaacagaaaatgctttccaagaccgtggaatctggaagcatgaatttttacaccacaggaataagcaaactcatttctagttggcaaaaatgtattgagtgtaatggttcctatttgataaataaagatgtgtttgagcctagttatcatgatttaaaattcacagtccaaaactgcaattacttttgtaccaacctcataacatgtttcaaagctagtctctcaactcatcccaccctctccttcccctgctgtatccacaagtccattccctacatctgcatctctattcctgccttgcaaataggttcacccgcactatttttctagattccacatatatgcattaatatatatatttatttttttctttctgacttacttcactctgtgtgacagactctaggtccatctttttactgccttcccaatgtgagattgtttccaacagtgtatttttaaagcattttgcctgatccaatttgaatcactcaacagtctatgataatttcaccacttccctgtcagactgttgtgcccttcaagtctcacagacc

SEQ ID NO: 40241 - DNA, 1505 bp, Bovine  19866881431911
ccaccctccagggtttacagacaataactagatgcaaaatcagtgcaggtagcggcctgtggagcattagacccagcccagggaagctgagctttaaatggtcaattctaagcttcatgcagaaaagatgtggcccagcccctggcagccgagaaaactagcttggcctctgcatgcccccctcccctagaaggaggtgacgagggagacccctcaggacatcaggcagcccgcccctcacggctgccgcctgcaccacagaccaggaatgttgctgctcttctgtaaaccctcctcctctcaagaacatccacctgttctctcataaactcaacctcttcccaaaagtggaaaaagaatctcatggaactgggtggagacacgccagacaccaccccggggccgggttctgtctcagccacagaggtaaggaagggacccgccctcgcccaggcccacctcaagaagaaagcaaaattttaaaaaaaaatgtacaaatagagaaaactacctcagttgacaggattccacctttagggtttcttcaactttgacgtcttacctgttgagtgtacctcttgtagcatcttgcttgtccaggcgaatgggaggcagacggagcgggtgtgtgccagcgttgccgtgcgggccttcctccagcatgtcaaggcttaatttttcgtagattgatgagtgatacgaaatgtaaagatacttgtgtacgtttaaacatgacaatgaaaacttaaaatgtagcttccatacttgtgcataattccaaagtattttatttttatcagtgttaaatagctttttgtacaggctccaatccatttttctgaagtgtgctgttttttaatgaaagtaacgataaacttttcacatcccatgaaactgccgtttacacattgcaactttttaaacttatcatatttttcaaagttaacttttttcgagggaggaaaatccccacctgctaaatgatactaaactcttgttttggctcttctaattaggtcctgagattttataaaattcagtctgtagctttttaggttcctcactggagttggttgtacataaaaataaagaatataaagtgaccctacagttcttttaaatatctgaatttttccacttacatgtgcttttgaaagtattttgttcatgcatactttcaccaataaattgaaaaagtcttgagcttcttggtaaatgtgaaccatttgtttcctattgtgctttgggggcaggaacctttaataatataatatttgcctaaatcaagcagccccctctgaatgttaatttttaaaagtccatatttggtgaaccataaatcttggaagcaagactgcaatatgcttaaatttaagtgatgttttaaaaggagaaaattccaggggttgatttgttatcattgaagttccaatacaacaaattgataggactttgtttttgatcagttaaatagatatcagtatcaatgtttggaagtctttttt

SEQ ID NO: 40242 - DNA, 1675 bp, Bovine  19866881627307
caaagtgtagctgcaggaatacatctttaatttcagttctcgccgtccagttttgtatctaactcccagggtcccagcggcttgaggcactggtgcagggttgacctgagcacctccctctcaggaatccaacaagccccgttctcatgctctcatgggtcactgggagacaagcagcttttgctcataagaacttttgagaagtttgaatgaactgcctctaattgcaggatagagctattaaacacttccttaaaagatattctccagctttcatttttggaaacacccccattctgaagggtaccattctaggccccagcctaggattattcccaaattcccactctccccttggaatcagagcctcctccagtgattcctcgggtgctgtttgacacactttcagccagagaagaggaaaacagagagagtcaagtttcatttgtagctgtgcatctcaccacaatagtagataacattcctgagtgattatgaagaaagaacccttcattcaacgctgcaggttcatgcaggtgcttttttttttttttttttaacctagcttcatccctttgtagaaatgtctaggtacagttcccaggcacatgtaagtgtggggtcaagcaatggttaattaaggtggatctgacaaccaaacattcagtgtgtttggcattaaggaatgtgaacgttttatttagactttctctcttctgtgatgagcttgattcttttttcctgcttgggctagagctgcctccttctcttctggaacattttcttcttcaatgatatgaagccttgtctcacgttctgtgtatgtgatcccgggcttccctggggagtacagccaacagcactgagagagagacctgtggcatctgatttggctgcttccggccagttctctctctcttggcattgctggttcagagattcagattccaacagcttagtcttcaccctgacaagtatgcaaattggactaatttgaatatggctaactctcccttttgtgccagagaacacaccctccccctttgcaaggcggttgagaatcctggaacgctgcacaccccctcaccttcctccttatcccctccactctctttatccctcacatggcaacagccgcctccaagagtccctcctggaaacctggatggtgctatcattccaagccctttcaggcaaagttaattgctccattttcttgttttgttttcataacattttgtccacatctctgtaatggttctctttaatcccatgctgtaatttactttctcattctcccatttcctctagccacttgagggaaaggcccatttatttttcttttctagagtcattttcttttattgaagtatagttgacatgatattaaattagtttcaggttcacaacatagttattcaatatttatatagcttagatttcctttaaagttattagaaaataatgggagtattcccctatgctgtgctacatccttgttgcttctttattttatacatagtaatttgtgtctcttaatcacctacacctatccttccctcttctcttccctctccccattggtaaacactagattgttttctatgtctagattttgtttctgttttattatatgcattcacttaaaaagttttttagatttcacttataagta

SEQ ID NO: 40243 - DNA, 1915 bp, Bovine  19866880421905
ccctctgcgtgatggtgaatgcgcgcgtgtcccctcgctctcactgtggtgtggctgggaccttctcgggttgtgtgtgagggcacaggcgtcagccggctcacagcctccaggtcagtccaggaggagccggtccgcgaatctcatgactccggctgttgctagatccgattggtgggcgccaggtcctggctcaccctttcctgcccccacccctagctctggcccatccagctgcccagcaactagtggtgggcagggggagggcctcccagtccagacaaccccgctggctccctggcttggaggagggaaagttgcggagggaaaaagcttagctccaccatcctgtgagactcttccttggttttagggcaaattaggcctggagaggcagcctgtggtggtcaccgcggcaggacaaagctccgctttcacccggcctggctccctctctgacttaggaaagacagcaaatcccaacaggagatgagctcatgtcctcgctttctgccatgttgaccttggccaaggtgtaactgtctcccaacacccccacccccacagccagccgtgaggagcagcagaaggaataccattccctcagttttcctgccctgagtctcacggatatatgcggtcttcgggtcatactgaccttgttcctctcttcctctttcccctcctcagggtacagcagctggagggagctggccaaggctctggccagcagaaacattccggctgtggacccgaatctgcagttctaccgtccccagaggctgggccccaaggtacgtggcagggtcagctgtccccttcctgctgccttaactcgggtcccccacccgcccacccacatagccctgagggcatcctccactttcccgtgttaggagaagcagagcagagggacgccctggatggcagactggcgtcctgggctctcctaccttgtgggtagagatatccatcctgccctccctcctcaaagcctttattatgtcttcaagatgcccaagtctgagctgtccagggatgtggcctccatctctgcaagaacaggggctggaggaaggaccagcacgtctcgcctcctgctaggatgactgggctggtcctccagtcacaatcccggatgctggcagccaagagtcacagatgatgtggtagacagacacccctccctgaaaatagctgcaaataatggagcattttcctgatagtgtttcttgggctgctggtccccagaagcagctctgggtgggggtttgggaactcaaggtcagttcagcttggagccgtaaggttgagcttctgagcctagaacagatactgcccccaaggctggaccagagcctaactgaccccatggacctacagggtagggaagagttggggtgtccccagggggacaaatgttaggataaatgagttgcaccctaagggggtgtagagaaagagggaggcagggtccctgtcctcaggagagcctggtctaattagaaaagaatgcttttggtatgggaagactgagaaaagtcaggaaagcggaaacatcccagaagtctatgttggaggtgtgttggtgagggacagtgtgtgggccagaaacaggaatgtccttaagttgacaagcttccgacagcaggactatgtctcttgaccctctgcatccccctcaggcacattcaaggggccccggtcctatcgcccccttcatattcccaccaagttcattcttctctgttctgccaggacccaggctcagcacgtggtgggagtggaaacagcagctacctgaagtggaataagccggtgccctggctctcagaggtgaggctgctccttgaaaggcagggttaaaaaaacagtgttgatattagtaggtcactccagaggccacagagcattt

SEQ ID NO: 40244 - DNA, 830 bp, Bovine  19866880656034
cagtcaagcctaaaggaaatcagtcctgaatattcattggaaggactgatgctgaagctaaaactccagtgctttggccacgtgatgtgaagagctgactcatctgaaaagaccctgatgttgggaaggttgagggcaggaggagaaggggacaacagaggatgagatggttagatggcatcacagactcaatggacatgagtttgagtaaactccgggagttgatgatggacagaggccttgtgtgctgcagtccatgaagtcgccaagagtcagacatgactgagtgactgaactgaactgagaaattctcagaattagaaacaagccacctggtataagcttcagttgtattggtgggattttcacagctatggtgtttttgctaattgattggtgagtggctttttattttctctggtgatagtatatgactctctttctttttacagatttgattgagctacgagtaatgctggaggatgctgaggataggaagtacccagagaatgatctctttcgaaaacttagggatgctgtaaaagaagctgagacgtgtgcttctgtggctcagctgcttctgagcaaaaagcagaaacacaggtaaggctgagaagaattctctagtggttttctgttttattttgaccagagtaatgacagtcttaattgtctgtgaggccatgttatccctccccaagtaatgccccagctttgtctcttgctgcttgcgcttctcttgctctgcctgcactacctcccctgctcgtcaccctcactgtgctccccctgcccttcatcctcactgtgctccccctgcccttcaccct

SEQ ID NO: 40245 - DNA, 1451 bp, Bovine  19866880716474
acatcagttgtatttcagggtgtcctgatgtcggaggaagaggtgtttgagcttgtgcctgatgatgagcgacagtgttcagcctgcaggaccacctgtttcctctctgctctcacgtgctcctgtaaccctgaacggctcgtgtgtctctaccatccgactgatctgtgcccctgccccatgcagaaaaaatgtcttaggtatccagacgtttcttgtaaagcttccattacagtctttttaaaaattgttaatactcttgttcgtaatgcccttccttgtgtttgttctagttacctcttacctgtccgcctcctttcttgaagatcagcccattaaagttggccctaaacttactgaataaaatgagttgctttatcaagttgatgtcacacattccttgactttctctgaattaaaactctgtgagctgcttaggtttttctctttatgtgtacctggccattgtacttcccttaaggtgattctgtttcaatgttaatttattttcaaattattgttgggttttgaaagtttttatttttgtatgtgatcttctttttagatatcgctacccattggaggacctcccttctctgctctatggtgtgaaggtcagggcacagtcctatgacacgtgggtcagtcgtgttacagaagcattatccgccaacttcaatcacaagaaaggttaagtttcttccttttttaagcagacactgaaatggttttcactttgaaagagatcttgttttgtttcatgtgtttttcctccattaaggaaaagtcctaggcttcataagagatttgagaccaatgggttggttgactacagacttaatttcctgtttgagaatcttttgttaagtgataaagttgatataaaatgagattgctaacagcagatgtatcatatattttggggaaccgttgttacaagtagactcacattaacagctcactgagcaattctctgttcaagaaaattagagttaccaagggaacatttcatgcaaagatgggcacaataaaggacagaaatggtatgggcctaacagaagcagaagatattaagaggtggcaagaatacatagaagaactatacaaaaaagattttcacgacccaggtaatcacaatggtgtgatcacttacctagagccagacatcctggaacatgaaatgaagtgggccttaggaagcatcactatgaacaaagctagtgggagttttgaaatggaattctagttgagctatttcaaatcgtaaaagatgatgctgggggaagtgctgcactcaatatgccagcaaatttggaaaactcagcagtggccactggacgtgaaaagggtcaggtttcattccaatcccaaagaaaggtagtgccaaagaatgctcaaactaccacacaattgcactcatctcatacgctagtaaagtaatgctcaatatt

SEQ ID NO: 40246 - DNA, 734 bp, Bovine  19866880754334
acatttaacttttaaaactctgtgtttccttatatataaaatcaaataagacagtggttgtgaagagaaagctctgctaattggaaaacaatatctaaattaggcaccttcgatctgacttccaaaccaaactacagcgtgccagcatacaacactgtaccttccacttcacagaaacagtcaaggaaaagaaagatgattcagaacacagcaaccaaatgccacagttagagcctgggtacctccacttttactgcaagtgtgacttcaggaaagtttctgcatctctgacccttaccttctttagaggtagaaagagctaaacgcttgccttgtctgtcctttcccctcctgctcaggattatagtatcacagataaaaaaacatgggtaaattatataaaaatatataaactatgtaaaacctcaataaagaaaaccataaagcagaaatactttggcttggtgagagagaaggcaactggagcactatccaccagtcctccccttgtgacctgaggaacctccaaggagctgggacattctaagtggtttaaaccattgtgtaataagcttccaatctgtacctccatgatgtgcaggaatctatcttcagagggtggggtgtgtggcctgcaaaatccgccatatgtgctgagtctcgtccagggacacctccaggagatctcccaccatcatcagctcctccagctgagctttaactcctggcgacaa

SEQ ID NO: 40247 - DNA, 2118 bp, Bovine  19866880759682
agagaaagagtttgtgtagtgtagctagtatcagttttatttgaagcgtgttagattttcagaagttatcttagtgtatctgttggcttatgaaaagtgatcatttagtaatttatttcacgtaggaaaattaaagtacatgattaaaattaaagtacatgcaatctcatgattgcactttgaattttttctaggccagactggtagttttaaaaataatttttagataacatctaaatagtccttataaaaaatagtccatgtgaactgtttagtgctttttccttcccttcccttccattttccctcctttgtagtagcatctggtttttttttgttttgttttgtggaaacatcaatgttgactacgtccaattatacctttatagcttgataatttttttccttttcttgtaagagcagtcccatgtgactggtgtaaaagagttctgcctcatttatgtgtcaagaaactcatgcttgaggtgcataactgtgtaatgagtggaaatcagctgcttaggctagaagctcagcatcgtgaattagggggattttctttgggaaggccttcgtgaaattcttgctgggtgataaagttttaatatttacagttacctcttatattcaaatgggacgttcttgttctgttgtttataagaaaaaaagaggatttggggtaagcagtggttctgttctggaatgtgttataagcaagtactttaatttgagaatcttgtctttttttcagctgcccattggacgtcagtgtgtgagtcactaccgccgtctgaggcgccattgtgtcttctcacatgaggagctcatcttcaagatggcagcagatccggaatgcttagatgtggggttagctgccatggtgtgcaaggagttgacgctcctgactgaggaggagacacggttaagagagtctgtgatgcagatggtgagtttgctgattatagtgctcacggaatacactaaaaattgaacctatggtggaaagaatccattttcatcttcaatccctctagaagttgaacacagaaattgctagtttggagatttcatacctttgtttctgccattttggtttaagttgaagttttaggaatcttgatgtcagcatctccagatttttaaaaatgcagtcctgtcaggtagaatttattaggtatatatttatttttaaaattgtcctatgtatagtgtttctttaggtgagaaagatcaagttcttctctcagctttctaattaaacaaaagttgtgtttctggtgattgcagattgtccgagttaatcgatttgtctttttcctccaatctaagttttaagtgaatataagaggcactgaataacccagtgctgggattttgaatgcttcaaataaactaaatatcatattgaaatggaaactaaatgagaaaatacatgtcttcagcctgtcttagcccattttccctaaccctccctacgtagctagcctcactgggtgtgtaccatgctccctccgtctctgcatagcccactttatttcccatgatacacgattccttgtgggatcttggttcctggaccagggatcgaatccgtgttccctgtattggtaggcggattcttaaccaccagatcactatggaggtcctttagtggaattctttactgtaaaacttacctgatcctttaatatgctggtgtttgttaatttccagttggaagaggtatgatgcatagcatttatctcccccttaaatttccttgtttttttgtggaataccttctagggttagtggtccttagagtatgctttggaaagaggtgtagaatttcttaaagcagccaggacttagttgatgtattagcattccctgtttgccagctgttaacgtaagaaacacttgcaatgcattttggaaccatttttgtattaaagtaacttttaaagaaaatacgaagtgctctatgagaaaatgaaaagatagagttcagccaggagatatctagataagaagaaaatattgaaggaattaggttgtgtctgccagtgaataaactattagatcactaccttgtttaagtggaggaagaaaagaagattgctctcatagtggaattgg

SEQ ID NO: 40248 - DNA, 2342 bp, Bovine  19866880827410
gttggccagagcagaggttctgggagtagctattcccttcacctgcagggaccacaactgagggctttggaggagagcctacaggatccaataaggtgtcctggtcctagtaaaacctgctgaggttcagagtggagctccaccttggtgagaacatgaagtttgagacagaagagcatcatctgaacagaggacaccaacagcaagcttggaagggaggccagaggttccagccaggttgtggtcactgcagaggacttcctgtttctgcccacccatgggggctgaggtcctgcatgtacaggacaggatggggccaggctggacagagtcagagggtacaggtctcactaccaagtgcagccggggctgaggcgcccaggccatggggacactgagacctgattgttgtttgaccttgtctctccttcgggattgtcctctccttcgtgaataaatccacttcctcttagtttactctctccttgactgcatgtttcagaacacattctggtgctcctagagggatgaagcacctccctctcaagatgcagtctccttgtcagtgtcttaatttagtactgagcactgtcaagtctggagaaggaaatggcaacccactccagtactcttgcctggaaaatcccacgggtggagaagcctggtacatggggtcgcaaagagtcagacacgactgttatggggactccttgctaggcaccgcctccccgagtctctcagccgtctgtcctctaaccacagtccccaccttgcagggtgactggcccacccaagtcagcactgggtcatttcaacccctgtttcacacctttggtgggttttaggtcagccgaagcagacctgggaacaggctcccatcctagcctttgtgaggccaggtttcacaccaaccctgccttgtcagtggattcctcagggagaaacaccaaactgtaccccaccccccagcgcccacaccccagctgcccaagctgctccttcggactcgagcgccaccacgtggacacggggcaacggtgccttgcgggaccagaacctttcaacatgtctccccggctctgggccctctttaggctgtgcatccatatccagcgccatcctaaatgaatcgcctcaaaacgcgcccagttctttcgagagactgcaggttgcctgcagcattccgtttgccccctgcccccacagccctgcttgtgaccctctcttttagagtaagtggcttcttgagagtaaaacttcatcttaatgtttcaaaagcaaatcaaatgtaaattatgcatcaataaattctagctaaaaagtaataacaaacaaatgaattcttttgaccggcctgtactcctgtgtacatacatgcatgttcacagacgtgtgtataatgggctgggtgtgacagctggggtgtgtgtgcctgagcaaggctgtggctgcaggggtccccacgaggtcaagttggagcagaacccaagagtgcgcagctcctgttccatctgtggcgctctgcaccccgccttggggcccacatcgttctgggaggagagaggccttttccttgtccactcagcctcagaactcctcatcctgtcttctgcaatgctctcctctcaggggaaaacagaggtggtaaagaacccacctgccaatgcagaagactcaggttcgatccctgggttgagaagatcccctagagaagggattagcaacccattccagtattcttgcctggacaatcccatggacagaggatcctggggggcttaggtccatggggtcacaaagagtcagacacaactgaagcgacttagcacaccccttcccagcctctcaaccgcttcccttctggagcctcccgggtaagcctgtattttgtccccaacagcctgggagccccagcccagggagcagcccgctcgtcaacctgaaccgttatgccaccaagaagagcctggcggagagcttgctggacatggcgctcttcatgtccaacgctgtgcagctgaaagcggtgctagatcggggtccgtcctcctataactacttcgccctcgtcaccctccttagcatctctctgatcctgcaggtggtcatcggaatcctcctcgtggtcatgggtgaggagcccgggcctggagctggcctcggggggtcggtgggaagaaaagtcccgaatgcctccctgtcacaccgtgcgtttgcacagtcttacactaacctgctgttagccctgtgcaccttcaagtgcccaagtaacaaccacacagtgcaggcaggcaccctgacctacctcctagcatcccatctagtagccagtacaatacctg

SEQ ID NO: 40249 - DNA, 1130 bp, Bovine  19866880834496
tgaagactagtaagttggtgtgttgtcatcatgatttgtggcaactcatcccataaattaagagaatgaattccttgctgattaaccaatgtagtgaagaattttttttcccctatttaggattggcagcctccatttgcatgtgaagtcaaaagcttccgttttactcccagagtccagcgcctgaatgagcttgaggtgagtgatttcttcatgtcaggacttcaggtggagacctttgagaaactcatgaactgaggctcagagttaatgtgaatcgtgactgaatggaaggaagcttctgatttttaaaaaagttgtttataacagttaaagttttttctacttaactgggattatggggaactatctgctttcttcggtgcttattattctgctaaacttttttgttgttgttagtgttggaaaattctctatcctgtagtcttttgggaaatatttttaaaaattattctattaaaacctagtttcagaggggtttttttcccccctctgacagaacttttctaggactcgattgatttattgagatctttctttaaatactcctgatctgtcttaactttccagtttgaaatttgtttaaatagttgttcccttcgcttgctagattttcaaaggatgcttcaatgtggataaaaactgttctagaatacaaaagagagatcttaaagatcgttaaggcttaatgtgttatgctgtttgtttttttctatgatgctcataaaacattgatttttttttattttaatacctatttttctttagtttcttatattaagatacttgatgaagagtcttaatgtcagtgaggtagagagttggtgtccctgaagtgtgcatattatctacagatgaaatgtcaggcatagaatgcttagaaacagaataatttgatttattaaattttctgattagcttaaagttaacttttacaaaaaattgctttgtttagataagaacttttcacataaattaacttttttgacttagtaaagtttgcttcttttttttttaacttataaggtttacttaagcagtgatgaaaagtctgaatttcttttgagagatgagtacctttgttaagtaaaactcattttttcaatcat

SEQ ID NO: 40250 - DNA, 1297 bp, Bovine  19866880911878
aagggggtggaggatgtccatcgcctacccagtcaggtgcccagtgactaggtggtgaggaggtgtccggtctctcagggagaagagtgtcttcctcgtcagggtcccctccccctgggcccctgatcttgccccgtctacctcctctggacgctgcttcagcaattacatcctttctctcttggattctcctcctctctctccttcaccctcactcctaaagctcaaatctcaaggtgtcatccattttccccctcctccccttggtggcaaatttcctgaggaattttgaggtggaatctcagactaagcctcctggttcctcaccacccacacacacgccctgaaacgccctctccctgcatcccgccagcctgtcctcctctgcaaaactgccttctcccggggctccagggacccagagcctcctggatactcaatgctttcaacggtccacgctggctcttatgctgaccctgtgttgactctctcataaaccccccaaaactccagccttctccccagccatgttctcccaggtgagcaagggggtgcccagcggacaacattaccattcacacccttgcagctcagagtctgtgcccttccctaactgtctgccaagcaccctccacgcctgccctgccacacaggcagaggcaggatcccctccaatagttcagtctcagcgaggaaaggaatccaggccagtggggccaagggggctggacctggggggctctagccccgcccctgccccaggctcctcccgtaggcccctccccagtcacctgtccagcagctcccagtcctctccgccccagcggtctcggaactccttggtgttcatgccgccgatcctgtccaggtctgacttgtagatgcctagcagcccgaatccgttcacctcccagtagcctgcagacagacaagccccgggggaactgaacctgggccaggaggtggaccgagggggctccagggttgcacccctagaccctttactgggaggcgcaagactctcatctgaatgagcccttttcctgtttgtggggaaagccctctgagctaagtttcccggtccagagaaggcagcagtcctccagggagggaccaagggctggtgacaggctcccaggaggctatgacaacagcagcccccgagggtgcagccatgcccggctccctttccaggcaggaaacctctcttctctgcatcctgagtgggcacacagtctggcacatagtaagtgcttggtaaatgtctgacgaacaaatgaaggggaaaacccaggaa

SEQ ID NO: 40251 - DNA, 842 bp, Bovine  19866880944570
gtgcggacagagttaacactccttcctccaacaacatctgctgaagacatgaactccagccacttcagaatgttgcaaactacagacagccagtggctgctgtctcctctccgtacagagcaggcagaccacaggccagcagtgactccgtggtaagggtacagacagtctcctctctgctgcgcggctgctccctgcacccctccacctattccccgctaccctccacccatgttaatattcactgaatccatagtaggcatcaggcactgtgcggggcttttcctgtgttcactctgccagtagagacctcagccctgatcagcctctctgcagggaccaggagctaaagaatgtgccaattcaactactgacacttgtcacctgccctcagctaagtgaactccaactcccggccagagtgccagctgccagggcctgtctctcctgcaccaggtgtcacatttgtgccaggagacagacaccccgatctcaggtgacagacaaacaccagcaatgggcctcacattcgggcctcacattctgccctcacagagctgggctatcaagttcagcatcagcccctacgccaccaacgcccctcccctgcatagcatggactcttcaaaggcctagagatcatctcttcagctcttaggtgaaaatatggcatacgcacagcccatggtcctttattatctttttttttccccccaaaaaactctcatgtgcattatttcactgcatcctcaccacctccggcctgggcagggctgcactgttaagggcttggcgtctgccctgagctaagacacactttgcaagacgggaaggcctgagcc

SEQ ID NO: 40252 - DNA, 1227 bp, Bovine  19866880986136
catggacaaagaagcctggtgggctacagtccacagagtcacaaagaagttggacattactgagcacatagttggggttgggggtgctgactttctgcaccatcctggtcttcacccgttggccacagattcaggatcctattcctttttgtcctcacagtatcttggcaccacaaatacattgataaacattttggtaagttatgctaccagggataaagtagatatacaataccaacctattaaaatgaatctcacagtattttactggtaagctgtgggggtgggtggggagtaataataagccttatatgcgtagagtaatccagagatagcttaaataactaaagggaaatgtaaatatcacttaggagataggattaaatatttaggaatatgagttacacgtagagagcaaggagcacatattctggattagatgattgtgacttaacacaatttttacttttgtttttaaagactctcttgagatacctgttgggctcttgtcatttctgctctcatttacactgttttccttctgtaggaatatgcgctttctggttggaacttgaataacatgcctgtgctagagcagtctgttcttgcacatatcaacgtggacatctctggcatgaaggtgccgtggctctatgtggggatgtgcttctcctccttttgctggcacattgaagatcactggagttattccatcaactacctgcactggtacgcacagtttttgttaacaacatgcacacttggtgacctttctaaaggtgtgataaaattaggtgatgtgttggggagaactgactttaaagtgtgtcctacccaaagtaggataaggtactgggtaggggtctcagggtacagcgtctctgacacttccactcttaacgtgtgcagccgagccccaggttttagaccaggtgattcttagtattcagtgtacaggaaacatttctttgatttaacttttgatatgtaaggcaggatatttaaagtttatatagtcaagatctgactaaccttcagtatttgaaattaaatgcctgtgttacatgtgtattagttaaggttttttgttggtttttgtttttatttgacccacagcttttatttacttacccagttccatgttcagtattccgatcttaaccaaatagtatttttctttccattgaaagatactgctcaggtcagcggagaaggcagggcacccca

SEQ ID NO: 40253 - DNA, 1333 bp, Bovine  19866881008032
tcaaaagaaaagaacctcagcaagccaacacatcaaggtccagcagggaccaaagaggaactcaagggttcatgctccaaacgggacagaatgaggatccttctggaaaaaggagaaagtgagagagcgagctttggagatgagccaggacccaagaggctccaaagactaggagaagggggcttgcgaccaccgagccaagacctgctgtgatcttagactcggtccgagcaactctcgtttcacctgcatgaaatggtttctggaacattctcccacttggggtacttgtgaagacaagtgaggcacagagaactgagattatttttttggcctcctgagcttaaactttgatatttaatgacccatgatagcggtcagtatcctagtaacacagaagacccttggggatctattaactgtttagcattcccaggtcttaggggaatatgtgttccgtctttcaaagagcctgttgtaggcaatttggagagtaagatacaaatatgcccatgagcaggctgagcacagtgctaggtttcctcggagctcaccagcgcacaaaaacacacgcaggcttcgcacaaagaaggcagtctcatactgattctgaagtggcttcttggatcagcttgttagagttgcaagggctacactaaatggcttacagtgggaaggaaggttaaaaagagacctgtggaaggaaagtggacgctgcaccgtggtcacttaatggatttattgagcacctagtatgtacacggtagccgctcttcccagctctgtgcgaagtaccagtgccggagccgggaaggtctggaatcaaatcgagccccagccccatcacttctagctgtgtgaccttgggcaaattccttaacctatcagggcctcaggcaactcgcctcgccaccaccaccccattgttcacttaggaagattattaataattaggtctgtgaatgaattaaagcaacatctcctccctgtaggcaggataagagatggctccctcagcaccagggtccccagctgctgtttactgattgtttactccacccttgcatatttcattcattaatatccaacacacactaaccccgtaaggtaaatgttcctctccccattctcccaataataaaactgaggttaaagagtttacaagatttgctcaagatcccgtaaatggcccaactgggattccaactagactagtcctgtttggcttcaaagttcacagtcgtcctggtagccccgtgagccctgcttcctcagccccggtctgcctcacacattgagggtacagtaggccccggagttcacagagacggat

SEQ ID NO: 40254 - DNA, 1408 bp, Bovine  19866881080544
tggacagccttctctcttgtatgagcttatcctttagggactgtgggtcagaaggagagaaaaattcatttgttctttaatttgggtaattcaaatagcactgagggaaagaaagaaaggacttccagaagtgctaaatcagtgaaggaacaagacatcacggagaacatctgaaaacctacttctggaggattctctagcttttttcttaatgtgtacagagtaggaaattctggggttttttccctttattttttagaaaaatttttaaacgaaacaaatattttcggctcttggaagagtcagataaaagagttaggaattgtaccaaataagacattacaaactatttggggatacacttcttaagtttttctttaaaaagaaacatcaacagcacttaaaacacatgctccactgagcagccaggatgatcctgaagaagcccaacttggatgccccttccttacacagaatccttcaaagacacgacgacgctcggagctgtgcatcctcagcaggagcgtgacgtgacggccgccctccctccaccctgcgtgcccacccctcacggccacatgctccctcacacctgccctgatgctcttcccccgaggtctgcctggcaagcttcactctccaggtctcagcaaaaatgccagactccagatagtgtcccagtgcttctcaacaaaagtagacctccaacagcaacatacaatcttcacagaatccttctaattctataacaccactttttttccctccgtaaatttaatgtattttggctgcaccacctggcttgtgggatctcagctccctgaccagggaatgaacctgggccatgcactgagagcccaaaatcttaactactaggccaccagggaactcccaggaccacttttctgtaacccatacttggttatttgttaatgtttctagtctttctcacctgttagaatgtaaatgccatgaagacagacctggtctagccttctgctgctgtacactcagagccccgcccaccacaggacttcaacaaacatctgttgaatgaatctgtcgatcagtcaacacttagtgttctaaatccccaaacacagtaacaaagagctactctttgagacctatttcttgagatcgttgctacaagagcttcctggactggatcttatatgacaatgattaggttctttgaaattctccgagttctttcaacaattccagaataaaaaaaaaattctgtaagatagaggaaactaccttaatatattcattttggttgtgatgactctcgtgaactagccacattttccccattttctcttctttcttcttacactgcatcctgtattccttaatctttgacatcaagtgatccttttcaagcatccaggacttctcctta

SEQ ID NO: 40255 - DNA, 2160 bp, Bovine  19866881122909
actggattaggtcctcggcaccttagtgaggaataacaggaagattaattgcaggcacctgccagtctgctcatcccacataaaccaaccaaccctggatggttgctctgattccagaaactgcttggtcttcagcctctctgaagtgtgcccatctgtctggaagaaggcagtccaggccgtgtttttccccaagcagtagaaaaagccaggctgaacaaagcaagaagtttgtcctaagaaactggaagtttacttaagagatatttcaacaacctatgtctttggtaagtctcccctgaaacagactcctaggaggagacatgcatgcagggtgttgggattgtctttatttttgaagttttattttgatgtggactatttttaaagtcttcattgaatatcttacaatattgcttctgttttattttattttttagccatggggcatgtgggatcttagttccccaaccagggattgaacccatacaccctgagttggcaggtgaagtcccagccactggatcaccagggaagtcccagttatttttgttgttcttgttgttgtttgggaggtggagtgtcctctcaggaacgacatgtgaacggccgtaaggggaggaggtgagtttgcatgctgcagcaccagggcctctgctgagcccacggtggctggacaacagtgcagagttgtctccagtaaaacacggtgtggccttgcatccccagtgaccagccattgcatgctggccgccccagagaggggtagaaccttgtgcgaggcagctccctcaccctccctgacccttcggagggggctcagctgtgaaccaccagcagctaacacctcggcggctggaagcttcgctaacccaccacgaggtggtgagccacgttcaaagttcaaaatctagggaaagtgtcagactgtcatgattttagagagtagtcatgaaggaaaaatgaagagaagcccacttaggagcggagatttgggaagggccatcgtgtaattggcagctttccagagtgctgatgggctagagcctggcccaggtggcctgagtacaggccagcgaggtctggggtgtgatggggaaatttgcatgttccttgtcaattaaggaagtagaatcaatggactgcaatacctgggaacttaccccgtagcccggaatcagagtagtcactcaacagatgtctttttgaattgaatagtgattcactggtttggagtttctgtctgagggatccattggtgctctttttggaaagtgtgggggttttccccagagtgtgcatgcaccagtatgctcactttgatttaactatactgtataggggtctaaaagtcctattcataacacatgtcaagccctaggaagaaaaggtaagaagattagagtttgttagatcttgacaaaggaaaacaaaaaaccacaactgaacaaacaaccttatccatccaatggctccctctgaggttgaccctttacattccccaaaacaggcaccaaccaaatccagcggacacgcgtctcggcagttgtacagctatactggtgcatatggctgagtatctcttctgcacgtggaaggcttccagtaaatgattgttggattgaatttcattgctttggtagtcctggccttggcatctgatggctttctttcagaagtcaggttactttttcttgccaaaatatgaccatgaccatttttcctccttaaaatcatccagtgggagtcgttgagtaattttgaagaaattcagggcagtccattcttacctgcattgtccaatgtcactagccacacatttaaggttgctggataaaaaacaggacaccagttaatttgaatttctgataattaaagactaaatttgtagtgtaattgtgccccatgcaatatttgggttatccttacactacaaaattattggttgcctacctgaaattaataattaactctgcatcctatatttttatttgctttttcattccaatcccaaagaaaggtaatgccaaagaatgctcaaactactgcacagttgcactcatctcacatgctaggaaagtaatgctcaaaattctccaagccaggcttcaatagtatgtgaaccgtgaacttccagatggtcaagctggttttagaaaa

SEQ ID NO: 40256 - DNA, 1032 bp, Bovine  19866881165128
attttccaaagttgcatttttcaagttctactgcatttcatggtcaggagccatacttgaggagagactgccagtgtggtgtcagacttctcttccccacactgctccccggggtggcaataccttgagagcagctcttagaagcggacgagtatgcgtgctctgcgcagaaggagggtgccgtccacatgtgcgtgaccacttcctcagacttgatggggatctcttcatcacagaagaggttgggctccaggctgctggaggacttcacactagctgtgtcctgaagaagcagccaagggggtgctgagaattaggaacatttaacttgtcccatgacaataatctaagcacagagttttaatacaacacagttagcggtggggtgggatccttaaatatctggtattaaatgggaaagaaaatttccactggggaaaaaacaatgatcaccacagtttcaagccaaaagtaaagctcaagagcaatccacagagataatagatctacaagaaagctatgatttgaagaataacctttctacagtctacaacacataaagactcctgtagccctgagttaagaaactctgaccatttaagaaaaaataaaatggacttaggaggggaataaaggttcagatgtggtaccttaaagacatggctcattcaatcctctctaaaggttttcaaatccagatgcttaccagttgctgcttttatttaccagctagctgcccttacttaaaaagcctgactgacagtgttttaggttataaatcctgacaacttcaagcaggtctcagatgactctcccctgaagttaggctccacaacccacatgtacagctttaacggtcatagtgcaatcaggaatacagaaacctcaggtattttaactaggagaatttaataaagtgaactggctaaatcgtacactgaaggctgaaaaagcaaacagaaacatcaaagtaacaccaaggtaactacaagaaagagctgccatctctagggcttaggtacagagaaaaga

SEQ ID NO: 40257 - DNA, 1258 bp, Bovine  19866881340999
tgttcttgcctggagaatcccagggacagcggagcctggtgggctgccatctttggggtcgcacggggtcacacagagtcggacacgactgaagtgacagcagcagcagtagtttgacttatcctcatgcatcctccctgtttttatgtttatcaaggcctcggcacagtgtggcgagtttagaaagcatcgtgaatgaagctaagagcattccagcctttctgcccaatgtattgtccctgaaagaagccttacagaaggcccgagaatggacaactaaagtggaagctattcaggtaaagaacctcttgagttgtctaccattcagggaatgctatctcacacctgaatccttgaagcctttaattctgtactgaagtgattgtgtacttgaaattcacttgttcttttatctgatttttatttttaaacatgtattacctatttaaacattacttgtttctgttgacttcttgctgtgagagatgacagaattagccatttaattaatgcctagcagtagggagtttatttcctgctgtatttgactctcttgccatgtacatgagttacttttttaaaatggaagtatagttaatttacagtgttgtgcttattttaaggttacagcaaagtggttcagttttttatgtatatatatataatctttttcagattcttttctattataggttgctacaagatagagtatagttccctgtgctatacagtaggcccttgttaacctattttatatatatagtgtatactttaaaaaaaattatttattgtttgctgtcatgggtctttgttgctttgcggggggctttctctagttgcagcaagcgggggctactctttgttgctgtgcttgggcttctctttgcagtggcttcacttgttgcagagcaaggactctagggtgtgtgcactcagtagttgtagttgtggtgcacgggcatgtggaatcctcccagacaagggattgaacccatgtcccctgcattggcaggcagattcttaacccactacgctaccaggaaagtacaggagtgggtatatgttaatcccaaactcctaatttagcccccgccccactgtcctctaattacttttgaaacaagtagcaggaaaagaaaatgaaactgacatttactgaaccccacaatactcttgggactcatctggatgtttgggagtaggaatgcgagagaagggtgtaaagatacaaccccggacctcaaagggcgtattctag

SEQ ID NO: 40258 - DNA, 1441 bp, Bovine  19866881388100
ggtcaggcttcggtctttgttctgcgtgcttgcctgggcaccaagtccagggacccgaagactgcccggacgcaggttctcagtcctcctctgcacacaactagctagtctcattcacacaactgggaactttctcccttcagctgcagtttcctagaaatgtggccgccccgtgttatgattcagacagggctcagtccctaggggtgccagggcagggcggggctggcagcgctggaccttcgggtcacgccctgtctctgcctctctggttttcacagaaatccacacaattgaatgctcatccacaccccttgctgtgaacggttttcaacagggtgagggctgggagtggggaacagagatcttgctaaacccatgatcgctctgttgccacaacagtctctgtgaaccggattctggcagcagctccaggcaatcactggccagacagccagtgccctcccagtcccatgggcctccaggggctatggggctcaaggaacagaagctttggactctgtgaaagctgagctttctcctccccagaatctgacagttaggggacgcagcttgaagaggaggcgggggtggggtggggaaggagagcagagggtggacaagcttcagtttaatacagtgtccactggtgtccccagaccccaggagtccaggattgcctgtgctgtccccacaggcatttcacagtaatagcagcctacaggagaccatccttgtgagggacagaggaaaagagaggccgagggatggagagacagggcagaggggagccctgttgccgccttttccatcctccacaggagggacctgcagtatttttcctcctcctgtaaggagtcagcaccctcccccgccaccccaatgtgacctacttatctactccctttatagggagggaccctggacagcatcccagtccagggcagggctgtctgagtctcaaaaagacgagttctctaataagggaaatccagacgctgtaagtgggcttccctggtggctcagatggtaacgaatctgcctgcaatgtgggagacgtgggttcgatccctgggtcgggaagatcccctggagaagggaatggcagtccactccagtattcttacctgggaaacaccgtggatagaggagcctggagggctacagtgcatggggtcacaaaagagttggacacgactgagcaatgaatactagacctgtaaggtggtagggaggttggacaaggctggtaagaaggaggatggaggctggtggctcccaaggacagtgctcatctgtggctgctggccatcaggcccgagtcacagcctgactaaggggaagagatatggggcccgaaggagtggccggggcaatcgagggagtgcacagactcaagggaaatcgcacagaacagccagctcctgcaggttctccaaca

SEQ ID NO: 40259 - DNA, 817 bp, Bovine  19866881741937
tttccttagctatgaatgaaattgaataatgaacaatcctacttgacctagtcatggtaaacttcttactaattagaaagtagcaagagcaaaacagagcttaggactttgtcttggacttgaactctatttcagaaaactcagcttacatttattaagtgtttatgatttacttgttccttggccaggtagatatagtgtggaaatgcaggtgattcagagatgagttggaaatgattctacctttaacatgctcattattactgctgtctaatcttgggtaacttttaatttctctggtcctaaattcttttttacctcctatgtaaaaaatgctaagattcacttagtgacctcagacaagtgaggtaatatatgtgaaagcccttgatactccttaggaaaagagtgtgatataattgaaaagtaaaagcagctttatatctggaataaagtgatggtacaaatttttataagctacagtggacaatcagttctattttatgtagcttccttgtgataattaaaaactgcaaatcctctggttttattttttttcttactcttgctttaaggctgagaaatgtttacatatctgagaattaagaaagaattgtatattgttggtggacaagataaatgctgaacataagctcaactttttttttttcttaatatataagctcaaaaaaaagcataagctcaacatgtattttcttgggaaagattgtttctttgaaagagtggggaaatagtgcttgattcagagatagtactgtgctctggcgctctgattcctgtgattcccctctgcttc

SEQ ID NO: 40260 - DNA, 702 bp, Bovine  19866881820048
ggctggcggagggtcaagggaagaaagggctgcccagtgtgaaaggaggtgccaagcggggatgggaggtggagcagggcagagcctggagaagggcttttaggaccttcagcccccgagggacaccctccgggctccctggcagctgtgaaactagcagggagcacacacagctgccagcagatgtgtggaaatatcccccaccgcagacgccggagatggagcagagatgcccatacagagcacaggggcagccctcgtcgtcgggggtttcttacctgggggtcccacagacgcgtgaggtttgggtacaggtagaactgaattccttgcgctgccccgggcagcgtcaccccctcgaatcaataggaccaccagcatgaggtaagggaaggtggccgtgaagtacaccacctgggccaaggcgatggaaagacacggaagccgtgaggggctggaggagctgcgaccccacgagagaggtcacggagcccgcctgctccccctcccgctcacccctcatcccgcagctgttcagtcctgtctgccctctgcctccagccacaacctcctgcctccctccctgcagctccccctacacaatccccggcaaatatttgttgagtgactgaatgaacttaggcatgcccctgacagggggcttagaactgggccagggtcgtcgggaacgacagttctgtc

SEQ ID NO: 40261 - DNA, 2508 bp, Bovine  19866880368290
atgaggtaccatctcacacaggtcagaataaagaaagtgaaagtgaagtcgctcagtcatgtccaactctttgcgaccccatggactgtagcctaccaggcgcctctgtccacgggattttccaggtaatagtactggagtggattgccatttccttctccaggggatcttcccaaaccagggattgaacctggatctcctgcattgtaggcagacactttactatctgaaccaccaggtcagaatggctgccattaaaaagtatacaaacaataaatgctagagtgtgtgtatcgaaaagggaatcctcttacactcttcagtacagttcagttcagttcagtcactcagtcgtctctgactctttgtgaccccatgaatagcagcacaccaggcctccctgtccatcaccaactcccggagttcactcagactcacttccatcgagtcagtgatgccatccagccatctcatcctctgtcgtccccttctcctcctgcccccaatccctcccagcatcagagtcttttctaatgagtcaactcttcgcatgaggtggccaaagtgctggagtttcagctttactgttagtgggaatttaaactagtacagccactatggagaacattgtggagattccttaaaaaactagaaatacagatgccatatgacccagcaatcccactgctgggcatacacattgaggaatcagaattgaaagaaacacgtgtgtcccaatgaacagttcatctcagcactgtttacaatagctaggacatggaagcaaccaaaatgcccgttggcagacacatggataaggaagttgtagtacctatacacaatggaatattactcagctctaaagaactcctttgagtcagttctaatgaggtggatgaaactggagcctattaatacagagtgaaataagccagaaagagaaaccaatactgtatatcaatgcatatgtatgaaatttagaaagacggtaatgatgactccatatacaaaacagcaaaagagacatagatgtaaagaacagacttttggactatatgggagaaggcaagagcggcacaatatgaaaaatagcattgaaacatgtatattaccatatgtaaaattgatggtcagtgtaaatttgatgcatgaatcagggcactcaaagcgggtgctctgggaaaaccatagggatggggtggggagggaggtaggagaagggttcaggatggtgggacacatgtacacccatggctgattcatgttgatgtgtggcgaaaactaccccaattttgtaaagtaattagcctcaattactttacaaattatttaatttaaaaattaaataaattaatttttttaaaaacctccatgaaaaatacacaatatactgagtaaccagcagtttttccaatttcacattgctacgaaatattttgttttgtattattgcaaatataactttgtggtagtgaatattgtattctaaatctgaaagacatggtataaagcaatttttaatttattttattcagtgtataaatttttgttgtacagcaaggtaaatcagttgcacacacacacacacacacacacacacacatatatatatatatgtaaacattcttttccattattgtttattaacatgatgttgactatagtggaactttgttgattattaagtctatatataatagtttgcatccactaatcccaaattcccaatccatccttcccccattcctctcccaccttggcaaccataaatctgttttctctgtctgtgattatgtttctgttttgtaattaaattcatttgcataatattttaagttccacatataaatgatatcatatggtatttgtctttctttttctgacttaattcagttaatacaataatttctagatcaacccatattgttgcaaatggcatcattaattctataaagtaattttgggaatgatgttgcacaatgtaaggacaatagcaaaagtacaataattaagaacatgtacacacatcattaaaattccatatattagtttaacatgtaatcagaaaacttttactttcagaaatctgtagatgtcaggaaactaaatataaacttaacaaaatcaaacttttgttgcatatacacacagtcattgagcaggttcacgtttctgctttgtgttagctggtgataattctacagggtctttcttttcccaggctggtttcctccagagagaactggcagctgctgcagctgttcctgctgaatgggaatgttattatattcagggtaacagatgttacacctggaggttcatcttttactttcaggaaaatttaactccagaacagaatgtcttatgaaacatcaataatatcctgaaatgaatgttcaacctcaaatttaaactatttcattaaaaaatactttaatttcacaaagttattgtgattaattgaagttggctgtcatttctaaagctttacaatatcactatcagaaa

SEQ ID NO: 40262 - DNA, 1816 bp, Bovine  19866880478059
attaatagactttattttttagaacaatttaacttcactggaaaattgagcagaagtgacttcttgcttctgattctacatgtaaggagcttggaattttccactttatcctaacaactggtaaaaatctaaacagactgaaaaactgacagctctcctaggatccataagggaggtaaagacacagggtaaaccactgccccaaagactggagagacaatttaggcaaaaacatggcgtcatgacggcttagagcagagcctcacaagaggaaactgctgtgagaactagtgctgggtaggaaaatctgaactataattgactcaatgatggaagctcagtggaaaactctgagttaaaacctcagggagaacccagtcatcgggggccccctatttttgtgagttttatctcaaggagctcgaccaggttctcacagcaaacactggagaaaaacctttttgtacttccaggaaagggatgaaaaaggaaccattttgatatatccagggcactctattctccttaacaaggcctgctctcaagagaaactagttaacaaagcctaaactgctggggtgttatcaaagcctcactcactttgggaaagggaaatatccaacttccagccaactttccccatcctctcccacttaaggacagagattactaagaaatacttgtgaatttcacagtccagaggtgtaggctcactaaaagactgagacctaggcatagaactgtagaatgtttcttcccgccaaacctcaccaccatattactaaagacctatgtacatctttaggtcataaaagttccttttacttagtacatcatgtctagttatcaagaaaaaaaaaattacaaggcctaccaaaaggcaaaacacagaatctgaagaggcaaagcaaacatcagaactagacagggcaaaaaatgctggaattatttgtttcattaaaaaaactatgaaaaaatatgctaagagtcctaatggataaagtagaaaacctgcaagaacacatgggcagtgtcagcagaacaatggaaatcctaagggagaactgaaaaaagaatgctagagataaaactgcaacagaaacgaaaaacgcctttgatgagcttgttattattagactggacatggctgaagaaagaattgctgagctggaggatttctcaatagaagcctccaaaattaaaaccaaatagacataaaagagaataccaaggactatggaacaattacaaaaggagttcagttaagttgctcagtcgtgtctgactctttgtgccctgtggactgcagcatgccaggcttccctgtccatcaccaacttctggagcttactcaaactcctgtccatccagttgatgatgccatccaacaatcccatcctctgtcattcccttctcctccctccatgaatctttcccagcatcagggtcttttccaatgagtcagttcttcgcatcaggtggccaaagtattggagtttcagcttcagtatcagtccttccaatgtatatgcaagactgatttcctttaggatggactggttggatctcctcacagtccaaaggactctcaaaagtcttctccaacaccacaattcaaaagcatcagttctttggtgctcaactttctttatagtccaactcttacatgcatacatgactactagaaaaaccatagctttgaccagatggacctttgatggcaaagtaatgtctctggtttttaatatgctgtctaggtggtcataacttttcctgaaggagcaagtgccttttaatttcaggctgcagtcaccat

SEQ ID NO: 40263 - DNA, 3502 bp, Bovine  19866880689087
aggtagacacaatggctggtattccgtctctttaagaatttttcacagtttgttgtgatatacacagtcaaaggctttggcatagtcattaaagcagaaatagatgtttactggatctcttgctttgtcaatgatccaactgatgttggcaatttgatctttggttcctctgccttttctaaacccagcttgaatatctggaagttcacaattcacatactgttgaagcctggcttggagaattttgagcattactttgctagtgtgtgagatgagtgcagctgttcagcagtttgaacattctatggtattgaatttccttgggattggatgaaaactgactttttccaatcctgtggccactgctgagttttccaaatatgctggtatattgagtgcaacactttaacagcatcatcttttaggatttgaaatagctcatttggaattccatcaccattagccattaaggattcattggttaattgagaatgaatgggaaagaaaataagagagaaaagtggatggaaggaaggaaggaggaacagggagcaaaggaaagggaacaaaaagagaaaatgaagaaaagaaagtctccattgatatttgaaaacaacttggattgtctccacattgaaagaacaagcatctcattaatgcctgcaaaacacatgctccagataacctctttctcttccttggagtaaatcctgcacattgactacttctagttccttgatccacatgaggtgttttatctgttttaattttgtttatttgctgctataaaaataattataaatttcatggttaaaattacacaaattcattattttatagttctatatatgagaattctgaaatgtgccttattggggttaaaatcatggtgtctgcaagactgcattctttgtcttctccagcttctaaatgccactgcatttttttagtccatgaccccactcctcctccttcaaaacaaggattagcaagtcaaagccttttcacactgtagtattgcgatcccctcttttgcctcctttttccatttttaaggatgcctgtgatggctttaggcatactgcacaattcaggataatcttcctgtcaaaaagccagctgattaacaactttaattccacctgcaattgtaatgtcctgttttcaggtaatatagcacattggcatctttggggaaggggcttatcgcacttactttctgtgacatattgtattttagtaacactacccatcaagcttcaacctagaagttctattagttcaaaagacattttgtttctcaaattgtggcttaatttgttaaattttgatatatccctgttttctcaactgtaagaattcacagaaagaagcccccaaatagctaatactgtaacagtaatcataaagatcaatctctcattaaaaattatcatttaatctttcatttttataatgcataaataatcatgttcataatattaattcctactacaaaaggatttaaattgttttcaaggctagctgcatattcctttcttcatgagttcacatatttccaaatatgttcctcacatttagactcagtagtaaatgtatcttgtatccaaagaagtaagaggaaaaaattccacaaacagccctactatttggtgcaggataagcttagtatatactgacagtaaaagatggaatcaggaatgctttcattatgtgtttcctgaatagcttttcattaccatatggcaggttctgaatgtagcagtgggataacatcataaatggtcattgtaaaaagaacttaatgttctcttgacccaaattaaacctttgttggtttgaaatgaggaacactttttaaagtttcaaaaacaagtatggccataatgtacctaacacatattttataggggtgctgagcttgaaaagctggattattccaaatgaattctcatttgaaaagatgaagtaaatgattcaaactaaaaagatttcacactgtgaaggaaactatcaaggaaacaaaaaggcaacatactgtatgagtgaaaatatttgcaaatgatatattctataatgaacttccccctgtgactcagccataaagactctacctgaaatccaggagatgcaggagatatgaattttgtccctgggtcagaaagatcccctggaggatagcatggaaacccaacccagtattcttgactgaagaatctcatggaaagaggagcccagtgggctacagttcatagggtcacaaagagccggacatggataaagtgaatgaccatgagtgcatgcatattctataaggggttgatattcaaaatatatttttaaaaatgtatataactcgacaattcaaaaatgcaatccaaaatacaacctaatttaaaaatgggcaagaggacatgaataaccattttcccaaagaagacaatcagatagtaagttcatttcagtggtcgttcagtcgtgtctgactcgttgccactccatggactgcagcacgacaggcctccctgtccattgccaaatcccgcagtttactcaaactcacatccattgaggtagttatgccgtccaatcatctcattttctgttgtctccttctcctctggccttcaatctttctcagcttcagggtcttttcaagtgagtcagttctttgcatcaagtggccaaagtattggaggttcagcttcagcatgtctttccaatgaatattcagaactaatttcctttaggatggactggttttatctccttgctgtccaagggaatctcaagagtcttctccaacaccacagttcaaaagcatcaattcttcggcactcagctttctttatagtccaactctaacaccaatacatgactactggaaaaactgtagccttgactagatggacttttgtcggcaaagtaatgtctctgctttttaatgtgctgtctagtttggtcataacttttcttccaaggagtaagggtcttttaatttcatggctgcagtcatcatctgcagccccccccaaaaatcatctgcagttattttggagctgcaaaaaataaagtctgtcattgtttcctcatctatttcccatgaagcaatgggaccagattccatgatcttatttttctgaatgttgagctttaagccaactttttcagtctcccctttcactttcatcaagaggcttttcagttcctctttgatttcagccataagggtggtgtcgtctacatatctgaagttgttgatatttctcctggaaatcttgattccagcttgtgcttcctccagctcagtgtttctcatgttgtactctgaatatatgttaaataatgcagggtgacaacatacagccttgaactactcctttcccaatttggaatctgtctgttgtttcatgtccagttctaactgatttgtccatttcttatcagatggtaaacaggaatgcaaaatgatgttcaacatcacaatcattagagaaagcat

SEQ ID NO: 40264 - DNA, 1426 bp, Bovine  19866880790438
tttagtatttaaagtgtatgggtggcaatttaaccagcaacagagtaattttacattagaattcatctttaaaaatttcagtactaattgactaaaatctaaaaactgccaagggatggctcaagacttgtgaaatttcagagagatagagttcaacagatgtattaactatctgttcttctcatgtctgtaagttccatcccagtactaagatatgtcaccagaaatcaagtaactagacatattttctgaattaatacttttattatttaacagcattcccttaatattcataatgataattgtgtactagttatagaagattcaatatgtacttggcacaggtgaaaattttttacatgaattaatttaatcctcacaaaacactttgctattgtagcagtattttttgcatattttacatgtaaagtgaaaaaaaataatgctgaagacattgtctatagtgttgaccattacaataaaaaatataaatcttcagtatcattaaattctatgggatatatttttccccttagtttagtttgtatgtgcatagtgcatttattttggaatataaatgtgtaacagatacctttaaattttaagtatatattttcacaagtttagaattaaattctgagttcaataagcacagcttaggtacctaatagtacctattttctctgctcacatgattgttacatatcccaaatgcccatatttttcatcaagttcaatcttattttgttttcttacattctgtttgaaatatatggcatgtacattcttaataaataaggtaaaattaatattagcttgataatagtctcaacagcaggaactatgcctttgataattaatgatattgtgacatagttttgcttccacccacagaaatgtatctttaagagcaatttcaggcatatagaaaagaaacaaaattgtttcacatacctagacattggtttattacataaatgtatatccttatgaatactaatgaatatttcaaatcacttgtacaaatccattaatcctcattgttttattttctaagcataaaaatagctaacctgcacacatcagagcaactctcttcaatataaatgtatatgatcacatgaatatacatctttgccctttagggaataggtttgctgaaatagtggataaatccatagtagaaaactaccatagctatttataaagaagggtggggactcacatactttttagaatatattttgattgtgagaagaaaaaaaaaggacaagttcttccttagttttaccacctaggaaaacaccattatcgtattgattaaccctggcccattatgtcaatattatgtagcctagattcctggggactccatgactactgacagatgtttcccggctctttaatttggctggtgggtggtaaa

SEQ ID NO: 40265 - DNA, 1882 bp, Bovine  19866880841243
cttttgagttgtggtgttggagacgactcttgagagtcctttggactgcaaggagatcaaaccaatctattctaaaggaaatcagccctgaatatgcattggaaaaactgatcctgaagctgaagctccaacactttggccacctgatgagagcaatgtcactcattggaaaagagcttggtgctggaaaagactgaaggaaggaagagaaggggatgacagaaattagatgattggatatcatcaccaaatcaatggacatgagtttgagcaagctccgtgtgttggtagtagaagggaaacctgacatgctgcagtccatcaggtctcaaagagtcggacatgagtgagtgattgaactgatgctaattaattcttttatttatttattagttttctggttttttgttttattttattttatttttaaactttacaatattgtaaaatgtcagtgtttaagtcagtaaatttttaaaattgattttaaattattctcgaattaactatacaaatcactcaaaacagatgaattgtccccattcagaggatagtgttgattttgaaagccatctcagaaaatgacaaaaaagattcaaaatagcactctacatacataagcaactgacccctacaaagcagttagatatgaaggtagtcatctcctatgacagatgcatctggacaggagctctcctgggaaggtcagcagcctcctcttggtgtagcagctgatttcagggcccatgagagtggaactctacagcacaggaggaatggaatacatagatgatgatgtgttagaacccaaatcctggtggagggagagaggataggtctctccaatgagtgagcaggtctgtttcagattacagagggtaacattaggatatttctaaaattgaacgtagaatatacaataaaagaaggagttagcaatgttgatgtgagttttagtaacatttaggattggcaaaatagcagaaaggctatagcctggaaagggaaaacaataaacattggttaaaaggaaggaaatcactttctggcttaatgaaatgtcaataaatttacaaatatgtaattttaaaacatagcatatccaactatgggttataaggaaataaggatgtggcaaattctaaagtaactttagaaagtctctgctttgagttagttagggattattttgttagtaatggaataaaaaagagtgttgacagtataaataactgtgacatttatttaaaaaaaaaaatgtttcttgaacaggcagaagtatcagagattcctctataaattttgtatatttgaaaaatatcacattcaataaaaagtttctgtaagtacactttcacaaacaaattctgtgaaatactggtcttgttctacagtaatgtgtataaactccaagtaaaacctgattaccagttgagtatctttgtttatgataatataactatgtgcaactttgattagcaaagaagaaaagtcaagttcttaacttctggaatgagttttcttcaccaggtaaaatgctttaaatgaaaacaataaaatatgtattaatatgctatgaaaattagaatataaaatgtatattatagtagtaaaaacttctagctttctattttttatgtcacatggaacgattacgtatttttatgtgcaaacgactagtcattcttcctgcccctaccccaaaccatatgccttttttgttttttcttttacttataattatacttctggccttgataagaacattcaaacattaatgaactcaaagtaacactgaatgctatgggatgcccaaataaaaaatatcttaattttcttgtttaggtctcagcaacttccgagtcagaaattggcacactat

SEQ ID NO: 40266 - DNA, 828 bp, Bovine  19866881327445
tatatgaagttctgagaaacaaagactaatgagtactgatgaggaggaaatgatcaacaaaatgcaattctgctgatagatcacatgaaatgaagacataatattgacctttggatttagcaacattaagggcattggtgacattttcttaatgttatggagagatgaatgtgaactaagcagagaatgagagaagaattgaagacaatataaatagcaattcttgagggattttactctaaaggagaatagtgaaatgaggctgtatctcctagggggacatttatctttctatctgttaaaatatttagcttgtgtgtgtgtgtatgaaaatacagctattaatataataaataaagggcaatcagccagagaagagactttataagagtcaaaaatgggaatgccaaagacttctcttctaatgtgagacattttaatatggttttggaataactaggttacagtctaaacaagcctgtgtaatggagagtattagataaggctgcactctgtaaagttgtgtgtttggggaacctgcatgctaatgactccgagaaaattcacttgaaaaacaccagctggccaatcaaacacatccctacagggtggcactattttggtgaattcattacagcctaactgtcaaaactggattcatgctagtgaagcttaccaggaatccaagtttatttatttaaattaggcacatcctcttttgactaattctagagaaaggaacatcttttgtctttcagtttcttcctttttattagttatctcccttctctttggatatttggcaagctcctggaaaagacttcaatg

SEQ ID NO: 40267 - DNA, 1864 bp, Bovine  19866880402229
atatgagcagcagtatgacttatctggggcaaacccagattctgttaaccattgagccttggtgatcttttatttatacataaaaaccttttaacaatgaaataattcaccttgattttttttttcttttttttaatactagttcggtagaaaaacaaaagaactggcatggtgcacagtggtgaagagtgtttgcatggatgcagaactgaagtatgtatgaaaaagtctgttcctcggtgagaattagcaggaagcatgtgttgaaagtttctcacctaaacaggtcataattacagactttaggatttatttcttttaattagaacatgaagctcacttagtggtccttctgaaaactttccttctaactgcacattttatatcgaatagtaagttaaatttctcaggtagaaagaagagttttttgttgtaactgtaattgtagctcgtgctgaatacatcaatgctgctgttcctaagtagttgactagtcagcttttaagttttcttcctttgttttctaagaatagtcttaagacagtgttatgtttttagaaaaatgtacttgtttggaatgtctcggatctaccatgaccatcagtgggaatagaggtgagaaattacagctttaactgaacgtcatctagagttctgtaatattccattgcacgacacaccccatgtgtttcacagtttctaagaaattcaacgttgtgtgcagttttatcaacctccctgcatccctggagcacaaggaattatttttgttattgaggggacaaaacaggggtgaagtgactcacagttaattgccggattaaatcgggcatctaagcctctctgctttgggtagattctcagactcagctgctatcgtcaaaaggaagaaatacattgccgcatccgaaaagaacatggtgtgcagtatgtgatgggtcttgttaactatcccttgttttctaatcaaaatagcctccgggctggaggaaaattttgaactcctgtagtaaattagcacatctcttattatgtttcgtcattatttatagcattgtgaatgaattaacagtggcaagttgtggtaagttgacgaattctaatttttttttcttttaattttaagatggttgagttttacataggctaagttttgatctctgtgggcttgtaaagatgcatcggagaatgcgttcattactgacgttacaggagcacccaagcaaccatcacactgttcagcgtcctttttcattgttcttgctttcacggagccctgtgcggcggccgagcatctcagggctttgaataatgccctttgccaaccgttagtcctaattgctgtaactaatttgctgtgtgacctaaagacagtaacatccttaactttggttttctcatctgtaaaatagaattaatgacactctacaggccggggatttcagggaggcatcatcatcacaatactgattagagtattaaaaaccaaatatttggtgaaagccggatatactcatagatgccagtcaaaaccatgaaaaacacatttgccacagacagatacaaaatatttcatagacttaagtgatatgtttagacctgaaggaaatgaaaggaattgaagttgttgagctacaggaaataaagatctggggccgatttaaacagttgaaaatgatttgaagaagtgttttgtctccatagtaatgaattcttttttagcttcttttgaggctatccaaagaagaagtgagattcaattacagcagaattacataagttagacagcaacggtagtgataccaattctttgtaagacccaaacttgagtacctcagtttcaacgaaaaggtcaatgaatttg

SEQ ID NO: 40268 - DNA, 1977 bp, Bovine  19866880452615
ctcaccctgcacttgtcctccagctgtctgtctccacactcttcttctctcatcaacccttgccatcttctctccaccctgaggcactctagggtgtgaacaaagggcctttctcttttccagaaagtacaactactgcttcaagtgtacgataaaatttacacatggtttgagaatagtataagatgatttcaatgccaagatggaaaattcagacgataagccaaataccctacccctgtaaaccatgaactaagcctcttcatagggaccagctgctggctgctccctcatgagaccccaggctacagcactggccaggggccagacccaactccctcgactcgggagtcacttaccttaggccaagtttttctcaacttgtcttaatgtcccaaactagccttctacattattatgcatagaagccttgctcttcattctctgggatgtcttggttataaaatggaatttggccttttcttttggataactaaattcccccttgaaatgctgttctcaggcaaagaggccaacttcctctaaaagtacgttcttgagcaataggtataaattgcaggtggctttcagatggaattttatatgtccttttcctttttagacattgctactcatggattatctcactgtagaaaacaaataagcccatatcttcgacttactgatttgcttattgtctgtcttcccttaacaatagcttccataagggtgtgattttggggggtgtgtgtcactggcgtacctacatcagtgcctaatgagcactcagtatatatttgttgagggaataaatcttatgtagccctcagcttaagcctacaagataggtattattaatttcattttccagaagaggaaaagagcctgacagaacataggaagtcaatccaggatcccatagataggaagttgtagaatgcttttgatgagcatcagagccaatattatttctgctacgtttacttattatcattttgttccccagtagcatttggcagctttaacctgtttcatttttaaggattttgtctgaatttatccagacatttaaaggagaatagttcctaggacaatgacaatggtagtgattgagacccaagggaaaggggaaatgcaacagaatggagtcaggaccccgtaatccaaggatctcattcatcttgaaattcctccttactaggctcaattctcacctttgctaaaagcaaaacaaacacgctagcacctggtaaactttggttgatttttcagcatggattcgttccacatttgaacatccattgttctctgtccttgatgcaaagtctagtcttcaagagcttattgccttttggtgccacagaacagagcaaatttgggtgatggacagtggaacaaatctacaaatttgaaaccttggggtacattgtgccaagcctatacacccacaggccaccatgaattaaacagagaagtagaataaagagtaaagaagaaaagaaaggcttggagaaagttctctgcagtctccaaaccattttttttgtgtctttttagctgcactactagcatgatacctcctcacagtaggtatgtagtcagtatctgatggttgactaactggatgaactctcctcatatggaccagtgtccttgcttttcaacctgattcaccctgtgtaagatcactcttaaggatttctgcgaccttctgcaggactgtagagttggcagcattatggtttcacatctaaagatgtcaagtctcctgacttcctgtctgaggttcactggagtagttgtagagaagagctaaaatacacaaaaattggagaggctgcctaacataaaagtcctttctgtacacatgtctatgtcagcctactttctttgggaaacatttcatatgcttggtctctagacaagtgactgagtagtcatctttgttagatgcctccatcttcatggccctttagg

SEQ ID NO: 40269 - DNA, 1308 bp, Bovine  19866880454763
ggaataggctccggtatggcacagcagcatcagagacccagtctgctgctgctgctaagttgcttcagtcgtgtccgactctgtgggaccccatagacggcagcccaccaggctcccccgtccctaggattctccaggcaagaacactggagtgggttgccatttccttcttcaaagcttgaaagtgagaagtgaaagggaagtcgctcagtcgtgcctgactcttcacgaccccatggactgcagcctaccaggctcctccatccatgggattttccaggcaagagtgctggagtggggtgccattgccttctccagagtcccagcctaggagggcctttctaagcaggtgctgggagccaggctgcagaccacccaaagctccaggcctagcagatgacttctgggagacttagacagcctatttgagaccaccaccagctgggaacctctgctgctggatatgcatgctgtttctatttactggatgtcttcttggtttaaaaaaaaaagttattttcttgtttcaggtcaggacagttgagattactgcatttgccctcagcagtcccataaggaggagaagtgaatgtcctttgcctggaggataggggatgagatgttgctagatccttggcaatttagggtgtcaggggaacaggcctatagtctgaaatcttcaggggagataaatttttgtgtggaggtcagaaaagaggcatgagatagtttttttgtttttttttttttgtttttttttttaccaaaaaagatcaatatgactgtgacacagagaatgtaatttgggggatttgccaaaactcagttctcagttatcaccaacgtactgagtgaccaatttgccgattttcagttcgtcaaaagttcaattaactttctccaaatattacagctaaccatttcccataaatggttgtgacagccttaaaggatgtgtctcaccatttagtttgttttggttgaggcaacttgaaattcaccagcaatgctcatcccccaaatcataaatccaaagaagctaaagtacagaagctttggctggtccctggaaatgaagtaaaattacttcagtgagattagactaactggaaactaatagaaaatggtgtttatataggattctaaattgttttaacttttttcctcatctcctcctatgtgttaccaatggaatttatcattcttttcagtaaccccctcatctgaatccccttataatgggcttgttcccttaagaggctgaaatgctaaaaacaccagttactaaattcccttgctgccctgcca

SEQ ID NO: 40270 - DNA, 1575 bp, Bovine  19866880479571
tgacaaggacaccagggctgcatttccttgttgtctcctaacacttgtagaatgagtcattgggtgccgtgcggttatcctcacacactgctcatctctgtgatggtgctcatgttgaggtcagtgttactgctggaagctcatcatcagtcatctcccccatctgctcaccgactctaacaccactgactttgatgttctgtcctcagccctgggcctttgcaattgtactttcccacccttgtccttgaggggctaattcccttaggttcagtgtctgcttgaacatcacaaccctaaaaagactttccctgaccatcttatcaacctcttcctccaatccattcccctccatctccacacattctattaccctaaccctgtctaatttcccttaggcacttttaattatcttaaaaccatatgaatgcttatttagtcattttgatacatctgtctctgtctgcaactaaaatgtaggatcagtagaaacatgatttttttctctcttctttactgatttctggtgccaagacagtgcttgatacatggtggagggggcagacaacaaatattggttaactgaacgaatgagtgggtgatgagaagaaaatgtatagttaactggcttgttctccaccattccatcaggcagagagagagatgtgactgaaaccaggtctttggatttcaaattccatgctatttcctgtacacaaggttgcctctattacaacacttacatttggcttcaatgttgattaaagggggaaataaactaatctacacaggaatcctaaggccattgtcaccactcttatgatttggaaacactctgatgaattattatcaggtgttttatttttaaccctcctaaagctaaacgcagtactttccctaagagaatgagttcgtagaagagtgggagcaaagaagcctcaatgagtttgagatgtttccaattaactccccaaaatgactgatacaaaaggacgcccagaggttgcatattgatttcaagtaaacaaattacaatgctaattacactatgctgttcaaatggtcaccttacaaagagtgatagaaactttcctgaatccctatgtcctctgacggaaaaatctctccctttgagatctgtggtacttgctttataccatttgtaagatccccaccataagatctacacatataaaagattacacatattctaaaaactttattatgtacttaaatacatattaagcatttatataaatgcttaccaagtatttttcagatatagaagtgatatattgtcatcaaataaaatttgcaaaataaaactcctaaatgagaaaattgtccatattttacagatgaactgtggaatcattgagccaagttcaatgcagaaaaattctgctcaaattgtatttgatatttcttttcatgtttataattcatgaagcttacaaattgtgaataactgtcatttttataacattcagttttcaattatataagcatgatacatatttctatttgattatttttaaaattatttatgtattgtttatgtctctgctgggtctt

SEQ ID NO: 40271 - DNA, 1360 bp, Bovine  19866880483961
ccccggggctcccagcaacgccgcccagcccactcagcgactagaaagcgcccattgagggcttgcagctgccagggccgcttgcccaaatactacataaagcctcaacttcagctccagtgaagaagtcactactgtgttcttcctgagccccagtcacggctatcaaacattcaaagcaaactggcgatggttaaacactgcatgtgtttacaccccgaatcttgaatcacaatggggaggcttgagctgccaaggcccggctttatcctggacactgaagtctgttctctgacccaccggacaggagtagcattgagtaaataccagatcgctttgcttttcatcgatgtttgctctcagggacttcagtggggttcgtctccaggcggggttgaagggcacatacttgcagagtcaagatgctgtctcacgtgagtgggcgttcagaagctttaaggctttggaagccatctctaaagagaaaacacaaacagtataaaataaaatatatccaagcagatgaaaggataactgggatcctttaaaaaaataaaaataaaaaactgctatgaaaaaaaggaggaaaaagaaggatggcagtgtggttagtggggtgagctgagggctggatgtttagcgcctcataacactgttctctacccttgagaatttaacactattcattttaaaaaatactataattagaaagaccctttgcctcgcccctttatctaggataaaatacaaaacctagattttcttttaaatgtcccagtctgttctgtgtttttaactctttcaggttttttatcctttacattgcatgtcaggattttgtttttttctgacaatagaaaagtacatcattattgtgataaattgagaaatccaggaaagaaacataaagaagaaagtgtaagtactgtatctttgaattagagtttgtatttttgtacacttccttgccacctgtttacacagagagagaaagaaagaaagaggaaaaagtaattttaaacatacttaaatagaatccaattttgtttagctttatactatgtgttgttttccttttttttaacttctcatgaccattccccataccactagatattcctaaaagaatgactcataatggctttggaatattttcaccctatgtttttcaatgccagaaaaagttcaaaacagagttttacttgtataccataccatatttttaaaaaatggaacaagctttttatagctggagagtataaggaaatttattttgcactagatatataccactttctccagaataatttaagaatcgcagctggattcagcatagtatttgggcaagtacaaatatagt

SEQ ID NO: 40272 - DNA, 703 bp, Bovine  19866880710236
tcttatttaccagtgtaaaaaatcagagactgtaggggccaagactcagctggtctttgtgaaggagtttatagttttcagctgaaatctctaagtgcgaactctcattctcagctgctggctccctaagagctccctgtggcctctgaccccatttccatggagacagaggtgggaagggtaaaaataagttaaagagaaaactttttttttcttgaaggcagtattttcaaatccccactcctccaatcctaatgagtgttcaagttaaaactggccacacatcagtaactgaaattttatttattcttcagggttaaatggctgaaaataaggtatttgcttgcaaaggtatgtttgcatgaaaaaaaaaaaaagaaaacacccattctgttgggtactgtttaagctgaaaattggagctcaaatgaaggtaaaatggttgctgccatttaaagacagaaagagaatcctactggtttccagagtctggtttggggctgagagctgtgactatgcacagatttctgcagtgggggtgggagtgtaggttggtgtttccccacatgtcagaaagctgggatattcatcaggagaattaaatataggatggtttgcctcatgtgtatcagttaatccattgttttgctataagcttttgttccgaccatctaactgaggctaataaaagtagataggatgc

SEQ ID NO: 40273 - DNA, 2512 bp, Bovine  19866880718724
acttgagagatgaagtactttatgtgatgatcccaaacattgactttactagtgaagatttattagtctaggtttataatcaaagatagcgaagatgatctcagaagttttcatattcccatcccaatgtctgtcttttaattccatagccagataatatttaattgcatcaggtcctttcaagtagctgtgccagagaccagtgcttacctatttcagtatctatttgattcttccttttagtagagataccctaatttctacctatgtttgccagatttagcaaataaaaatatagactatcaagataaacttgactttcagaaaagaagtaaatgcaattttactgtaatatgtctcaaatatcatactcttatactaaaaaaagaaaaaaggtttatttggaaactggaaatctgatttaattggccactttgttttcatgtgtccttacaaactgcttgtgtttctccccagctaagattgcatttctgaggctcacattatgatgtgatcacgtgaccaagttctagccaatgaggtggaagctgcttgtgttgcgtgttcctagaaagtctccttaaaagaaacgtgcattatcttcccctctaccccaatctctgtactgatgtctgagaaggatatgatggaataagagcagtcttgggccatgaaaaacaagaccataccatagctctggtagagcaagcaggagcctccattccccagcaatatcatgctcctgaataccagcccggagctgcctttctgaagattttccttgagagagggagtgaggaactggcggagaaggggaaagaaagggaaagagaatgggagaaacttcttatataaatcactgttatttggggctttgtcttgtattcagttgaatccaatactaatataaaccttatacccctaaaaatttgtgggcacagcaaaacaaaactttgtgaaacagaacactgtgtagagcagagtattccaaagactctgtgaatgctcagtcacagagattttcattgtctatctcacaaacacagattcacttacttttctaaagcttctgattcctgtcttatctcctggatagtgctcagaagttaactcttgcaaatcaaggggaataaaaggccatgcctagtgaagcagagcataaaggtgaattgtggtcaacaacatcatctgaagaggttgcttgagcatttcaacggatttcattgataatttttgaacatgctgtcaggtggcaagaagaataattgattaagtggatttcatattatgttttgaaaatctttggctttgagaaatataaaaatgaattcctaataacaattataccttgtataaagaggaagaaaccaatatatcatttcttgaagttatcccagatcagaacacttatatataaaattctagttcaaatgagcaatgttgattttttattcagtgcttgagatttgccaatttcaacattcctctttgtgccatgaaaaatgttgccactggcagacactccacactacagagaaaggaaaaaatagtgttaaatggtagaactatgagagcaggagtctacattttaattaatgtatcactcagaatccttggttggggagcttagattccacaagccatgtggtgtggccaaagggaaaaaaagtatagtttaagtccagtgtttccaaattaattttttatctgtataatctatcagttgatatatgagtaataaacaatgattaaatagttttttaaaaatctatcaattattgacagcgggagtattgaagaccacttttattatacaattctctatttctcccttcagatctggtagtacttgcttgttatatttagattcttccatgttgaatacataaatatttacagattgttatattctattggtaaattaattcttaatcattacataatgatttttgtcttgtgttactgtgttgacttaatatctattttgttggatataggtataactacccctgctctctctttttttttttttttaactttacaataatgtattggttttgccatatatcaacatgaatccaccacaggtatacacatgctccccatcctgaaccctcctcccacttccctccccgtaccatccctctgggtcttcccagtgcaccagccccaagcatccagtatcgttcattgaacctggactggcgactcgtttcatacatgatattatacatgtttcaatgccattctcccaaatcatcccaccctctccctctcccacagagtccaaaagactgatctatacatcagtgtctcttttgctgtctcgtatacagggttattgttaccatctttggtttttcatatgcatataataactttttcaatcccttctccttgagcctatatgcatccttaaaacagaagtaactctcgcaggcagtatatagctggatcttgattattcacttaaccattaaatacctttgattgcagaatttaattcatttaa

SEQ ID NO: 40274 - DNA, 2167 bp, Bovine  19866880732670
ttttactggtccctgctcttgaggataggatccctctgctctaaaccactccaggattcaggtacccgataggtagactcccccccaatatcttagcgtctgctgaaatcactcaaattacccagtcctaagctcagctgcttagcctgcttgcccattccttcttgcaaccacccacaataaagttttgtgtccaatcttttcctcactcttctgcctcctaaccagacttggtgttccccaagtagctctgtgtatcgacatttgccctttcctcttgagaactgtgagtaacaaactcttatctttttggtggcagttgtctcctgagctgttggtctcaccatccttgcataacaacaaagtcccaggtacatttttaaacaacccaaagcaagggaaatctgtattcagaagtctccagattctggctccatcagcttggtcacttgtatctcatgcatagcctcagtttcctcccttataaaagtaaaatagcagttttatctcacagagccacggggaagatttatacacatgaaaagtccatcactgttaatgcttaactaatgtttgtccctgcatttgttcactcaccagagcattctttaccatccacctgtaacctataaatgctattcaattatcacttagtttgtgctagtcaattatgagtaaattctaatgtctttccacatgtctatagctgctgctgctgctgctaagtagcttcagtcgtgtccgactctgtgcgaccccatagacggcagcccaccaggctcccccgtccctgggattctccaggcaagaacactggagtgggttgccatttccatctccaatgcatgaaagtgaaaagtgaaagggaagtctctcagtcgtgtcccactcttagcgaccccatggaccacagcccaccaggctcctctgtccatgggattttccaggctatagctgctaagcaccatcataaaaatctcactcttttcactgtgtgtgatctcactgggtctccttcccttgggtgctttgcttgatttctgctgcagttgcttgaaagcaacgcaggtttggaaaaggccggtctccccatttctgctggactctatcaatcttatcaagcaattctgtctgcaaaaggagagtcaaaaacccttctgccaggcagctaaagaaatcacatttttggcagataattagtaaaataaacatctgaaagctgcagatcatttgtattgcactctaagcattgtggatgttttatcacctacactcttctcattagagaacaggggctgataaatgctaaagtagaaagagagttcctgaaatcagagagccaatgtcctcactggactgatatctccatgaggatcaatagaaagaaggaaaatgatcagagaaactgagtgtggcagagcttccccttggggccaagtttgagacagatggcaaacgaggcaaccttaagggagagagacagtcctgcatttttacttgtatcctgaggaacaagatcaaggagaacatggagaacttgccaagaattgtgcaaaaggagctggtcccaaccacagggaccagctgggagtccctgggagtcacactgggagatggtggccatgcggtgccaagacccgctcatggcctcagaagtcctgcccatgagtgaggatcctctgtctacatcatggccaattccactgcattcatgtagtggtcatttgaaatactgttttcaaagaattctaaactccgaacagctatatgaaaggggttgttattgatgacagaattattgtgcttccatttcctgcttgaagagtatgcacaaatattttaaagtgcagaggtatggaaacagaggaggttccattcctggttttgctacttgccttctgtgtgaacttgagcaagccgcctgatttcttgatccccagcttcttcctgcaaaataaataaaatatagggcctaccccactgggttgttgtaagagttagagaagatttgcatataagtctctcagcacggggcctgatgcatagtaagtgaaagtgaagtgaaagtcgctcagttgtgtatgactctttgctagttacagtccaatggaattctccaggccagaatactggtgtgggtagcctttcccttctccagggaatcttc

SEQ ID NO: 40275 - DNA, 867 bp, Bovine  19866880737014
ttcgaaacaagcctctaatgtcagaccgcattttaaacccaataaaaaataaatcagagaaaagtaaaactctttgaaagtcatttccctctggcttagtgcttgctttagtcctggttgcaaaccaagcccggagcatttaaaacaagatttatgaatcaggctcttcaggataaatgttttgcaatgcaccagtggttaaaaattaactctgacaggtgtagaagggcaagggggagaaagaaaggcatttattttccctctgagtttgagggtgcaatattagacttcaattttctgaatatatccatgaaatctgaaatatgtcaatacacttataatgggtttcattcaaaggcaccctgtgttaaatagcccctgttttaccttagttgctctatagaaatctgctttagcaacctaaggatcaagtagggtaaacataacacaaagtgattcaagaaaacctgctgctccactttaaccatttttgactttcagtaacaaagagaacagcaaactgtcaaccaagttctaagaacataccgggtgcatactctttgaaaccttagtttctctccctataggagagaagttacttcacaggtgtgctggttgcattaaatgggttggtgtgtaagagttctctgacagtagggaactttatcaaagaatttttaaaaattttatttggaggattattatgctatgcccagttctacgctaggaagagccgaaaagaaggctttgtccttgagaaatgtagccgagcagatgaaacgaacagaacactactgaacagctaaatataagaggacgagggacttcaggacataaatgtactgaatgggtcaaaaccctgcacat
